United States Patent 7,468,248 (METHODS AND SYSTEMS FOR INFERRING BOVINE TRAITS) - sequence listing, part 6

SEQ ID NO: 30288 - DNA, 3069 bp, Bovine  19866881013532
ccatggggttgcaaagagttggacacgactgagcggataacactttcactttcactttaaagtgtcagcatctggaaagagctgagaacacccatttccctgctggcttcctgggtgctgtgcattcccagaagggatcagagcacttctccccacgtaagcagaacacccaaggtcaaagacagacaaaaaacaagattatactcctggccactcagtgtcttccaaggtggacctccccaccttcctgagtctgtgagcgcaggaggaagccgctgtccccacccagcctctgttgttgtcgtttagtcactcagtcatgtccccctctttgcgaccctgtggactgtagcccccaaggctcctctgtccatgggatttcccaggcaagaatactggagtgggttgccatttccctctccaggggatcttcccgacccagggatcaaatttgcatctcttgcttggcaggtggattctttcaccaccaagccgccagggaagccccccagtacctgtatttgatgtcaaatactgtggagtcctcgtcctcatcatcctcttcgttcagcggggccatttccactcgctcggcgggagtggtgatgatgtcatacttgcgggtcttcttcagtctcttcccagacctggacgaggggaagcacatgcctgagactagggcgatgcccactgaagtcagccacgctgccacccccagcccagctcccaggagacctggcaaaaccccatccagctccttcacttctggccatgggacctcgggcgggatcctgacctcagcatccctcgttggtcctcacccacaaagcaaagatgtgcccagagggctataaagcccagggatcaggatccataacacccaaacgcaagattttcaaaaggcaaagtaaggcaaagaaaacccacgacgagccaaagatcagaatgttcactgtggatggagctcagccacgccctgggccaggcctgaggcacctcgtcccctcaacccccagcccctcaccctcgccccagccctgctgtgtcggcaggtcactgctccaagcacaggcatcacagcctggcaccaccgtgtgcactgccccatgggccgcccagtgaatcagaacccaggctgggccactttctacctgcgtgatcacaggcaagtcggtcaatctcctgaggcctcagtgtactcataaagaaaatgggctgagaacaagatctgtgcctcacaggccagggaggatgaagtgagacgaggcattcaatcagcccaggcagcaggctctcggcaaaaagggctgctggtgaaaagaatcaacagagagggacttccctcgtggtccagtggccaaaactccatgctcccagtgcagggggacggggtcaatccctggcagggaaactagagcccacatgccccagctagaacatcctgtgtgccacaactaagacccagcacagccaaataaataaattttaagaaaaagaatcaacaaaaaggagttaaatgggctatgcctctctcacatgacaaggacttggacaaatgagtattgtttccatcacaaggatttacgaccacagggagctgtaaccctaggcttttactctgggatggtagacggtcactgggggcccccaggaaactgctgagcaaggcttttggtctccagtgtcagaccttctctatgaagcatgcagcactgatcaggccacgctgagagtttatgatgccacaaggaacaatattgttttacaactactgatgctctatgcatttatttctccactattttgaactttttcccaaatgccttgtatcctctgatgtccttcttttgaaaataaatatttgaaactgtctgtgagaaaccagtcaaaccaccaccacccccaaatcataaatacggcgctgaagaatcatagtctctaaacatgcttcccacaggccgtaagccgtacctacatagagaccatgtcaaagacacatgtggggtctctttgcccccagcacacaaaacgcctcaagaagtttgcaaaatagtgaaaacagaagttcaccttcaagtaagaatttcttaggaacagcaacttgctcttttcttgaagaaagaaagcattagtctctcaattgtgtccagctctttgcgaccccatggactgtagcccgccaggctcctctgtccatgaaattttccaggcaagaagactggagtgggttgccatgccctcctccaggggatcttcccaacccagagatcaaaccaaggtctccagcattgcaggcagattcttcactgtctgagccaccagggaagcccagggaagctcttttcttgcctagtattcatcaaaaacatgatttgtgaaaggattatttacatagaaaatatatatatttatctacacctttgacataaagcaacctacatagcctatagtatttgctgcctgcagttctctgtgtagagattttggggcatcaggtatacagcctgacaaccccctagcctcattacaaagcaatctgccattgtgcttccatcacaagcactgtgtgtgtgtgtgtgtgtgtgtgtgtgtgtgtgagacaccacatgcatttcaagcacgatgcagcaaggtgcaaatgccaagccaggtgttaagaggggcacagccagtggcctccccggggccacaggacagcagtattttgcaagcaggtttgtgcgggagcttaaatgctaacgtgataaaccccgccagtccagattctcaccatcaagattcttgttttccctccacctcctgccaatggaataaaatagatcttttgttctgcctcagaggacttacaaaccctgaccaacttaatctccaacactggatggagatatttaagcccagaaatggctccatgtgccacaggcaacccacgacaaagccacaagaaaaccatccacccccgagccctctagactagggtcaagccccaaaagtatgctgacccacacaccacacctttctcaggaagtctcctatctccgccctgatgggtcacagctgttcagaggaaca

SEQ ID NO: 30289 - DNA, 1832 bp, Bovine  19866881023085
ggccaactaagcccgtgtgccacaacttttgaagtctgtgctctgcaacaagagaagccactgcaatgagaagcccacgcgccgcaactagagagtggcccccactcggcacaactagaggaaagcctgcatagcaccccagactcggcacagccagtaaataaatacaaagaatgggggtgggcaggaacatgaatgccactgggggcggggggctggtcaggtggcagtctcccgtgaggagatgggcacagatccatgtctccaggagaagccccagggtgagacactggggtgccatgtgcaagcagggaaaccatcccctgtgtctgagtgactgctggtctggggcttgtccttaagtgctgagattagtcactttcctgggcggcagctgggctggttttaaattctccccagtctcctgcaattcgtcacttggctaggaaactgcccagtgtcctgacgggacctgtttgtcctagtatttcttagcttcagctgtcgcagactttgcagtggcaaaggaaactgctccagaggtgtctgtattccatggtggcagggagtgggctcctcccagacacttctacacttggaatcctggttggctgctccgggaaacccggagtccctgtgtgggtgtgtgtttgagttcggaaattgctctttgagaaagaagctctctgctctgtcacagagttctccagcatttggctatcattattgcaggagcagggaggcacacagctctggttcctggtcccctttaaaggctcagggctgcagtttctcctccgcctcttagttgatggtaggaggttgaaatgaccctgaggtcagcggttcccaatgctgatctgcagatgggcagtgacccagaaggaaaaaggaaagagaaaataagagatacaatgtagccatgacgattctgttagtttcaagttttcaacctgtcattttctgagaactcagctatcttctgagatgatgttcttcttttgggtgttaatgtcctttctttcctgaaagagggtgatggtagatagtagtgttacatttttcctaaacttagccccaaactgtgtttttggaccagtgcagtgggggatcttagttccccacccagggatcaaacacaagacacctgtgctggaaacatggtatcttaaccacgggaccatcctggaagtccctcagccccaatgtttttggaaatgttattgatgggtgaaatctatagtttgggatctgagtttaccttgaagagtaaacagaggcattgcttctagaaacaggggctcactcctcacacttcttttctcagtggaggctgacggcagcaaagaataacaatggtcttatttatttatttatttatttattggtgtatctgtcacatgcatatgacagcctaagcaccttagctctgttcgcacctgtaatattcccagcagtcctatgaggtccatgttgttattacctctgttatgatgatgatcaacctgaggcagaacagttaagcaacttgaccagagtcacacagccagtcagtggcagagctggggtgtgaacccaggttccagtaaatcaggagaacaatctataactgatgtatgaaatgacatccagtgagggaaatatacatgctcattcccccaaaggataaagctgggaaagagagaggtccgcaggaaagagagaaacccagggaacagtcacgctccaggagagctctggagacaggatgctagaggcggggctgtaatggaatatggcagcccaggagatggaggcgattcagggtggccggctccatggcatcttgtttt

SEQ ID NO: 30290 - DNA, 1027 bp, Bovine  19866881054103
tgcttgcagtcacttaataattaactgtctaccttcacgaggatgtaagttccatgcaggcagggatttttggtgttttgttcacatctgtattcctgggacttggcatagatgaatgctaagtgaatttttctccactgggactcatacaggctcagctccttaatactgacaacatgtctacggtagttcccggctattatgaaactggcatgttttatcttggactatttctctttgttcctatagcgtcttccctacagccctttccttacaatgctgatctcctgggacacacactgtggaatgtgataaaacatcagtgaattaggtgtctgagcagcttgggttattattatcattatttttatcagaaataaccttaagaaaatctgataccttttaaatttgttcatatcacataaaatataccaggttctagtgtttttagtgttaataggatagagataaggaaaaggagataatggtttaatcattgacataatacattttatgcctacatagattatgcattgttgacctttaagttaatttaggcttaatgagatggtgtcattatgtttgaagacttaatataattattttattatgtttttaaaaaattattctctgagcttgtgcatgttttatacctcataaaggcccatgtgtattgttttctcattgaatatattttttagatgtttcctgacttgaggtttgcagaagtctgatctcttgaaggatggttttactcaaatgtttaattttcccaggcatcctacaacttttgtttttcaatgtttttcaatggagacctgtatttccaaaagaaattaaactttatgttctgaaaatggattctttagatactgggatttctctcgggatccagtggttgagattcccaccttgcagtacaggggacctgggttctatccctggtcagggaactaagatcctgtctgttgtgcagagcagctccccccgccacccaataaataataaaaagaggggtttgcaacag

SEQ ID NO: 30291 - DNA, 1302 bp, Bovine  19866881078726
gagggaagtgacttagcatgcatgcactcactgctccctgccttcctcatctccctgcacctgaatacttgggatggtgacatggagatcattcatccaactttcctttccctagcagcatccctttgtcaggatgcctccctctctgggcttgtctcattctctctcccctccctttaccatatgtacattatagcagactcctggacattcccaaacatagggaactctttccagtctggactcctggggaccaccacaccctcaggacagatgtctacctcaccagcatcttatccccacaccctgggttctttctctaactgatgtcagcaccatgcccctgtctccaagcctgggtttagggcaatctcagccccttttcaacagaatctatgcatcgctctcctctgacaaaaataggagaagaaatccaaaagatttatttccttcatactccaggttaaaaaattggaacagcacagtatgtgtatgcaccaccgggctcagtttagacaaacttactgatttaggagacttattttctcttaaggagctttacagtgggttaaaaagtgtatgatcataacttttgcattcattagcatcgtttctatgctgccaaatgcataattctgactcccggttcccactgaacctataagcaagaggatttattttattgtttcattttattcattgctttttcttccctctcagtacttccctagggctgtatcatgggcaaaatttcacctgtgatcaggttacagagctgggagctgggaatcaaggtaccagtctcttgttggctggtacctacacttgggtaggatgatgtttttcaggagggttgtggccccagccaaaatgatactggccaggacaaaggaagcctactttctagaaaaagtcacacctctgatgccagtgtctaaaccttagccccaaggtattgggacctcctccttaatattttgatagaaattgaaataaaattttaaaactcttgttccttggaaggaaagatatgacaaatctagacaatgtattccaaagtagagacatcaccttgctgacaaaggtatgtatagcaaagctatgatttttccagtagtcatgtacagatgtgagagctggtccataaagaaggctgaacaccaaaaaattatgctttcaaattatgatgctggaaaagactcttgatagccccttagattgcaaggagatcaaaccagtcaatcctaaaaaaaaatcaaccctgaatatgcattggaaaggctgatgctgatgctacaatag

SEQ ID NO: 30292 - DNA, 722 bp, Bovine  19866881151697
cttcccctccccagagaaaaggaggggaaacagcaaaccggattccttgacggaggaggaaaagggacctatccatacagtattcgtgttctcacagttcacacacctgccatcgggtcctagtaaaaccttccccttatgtgcccagctgtgtgcccagcgctctgcttttcaagaaatggaaagcagaacttttccctcagagtctttgcagaaggttcctgattcaattagggggtgatgcttgtcacatgttgcacagatatagctgcgcccaacccctcattaacttaatggattcttacagtcagtcctccagggatgtggagtgaagctgctgaggttcacgacaagtgtgggtgtatttataaatgtatctgccatcactcccaggttctgaaagtgagagagctccgcgcctgtagcaggtaaggaggaagggagcgcagaaaagcagtcaccgtttgttcattcacttatgttttcacatgacacctacttttgcttcccaagaagagaatgcttattaattttcgagccctttgtccatcttggagttcctgccagcccatttcatctgacatttttggagtaaagactgtagggccagctgtatgaggcagttggctttgcttagggaatgcttcttttcatgttcagaggcaataattatttttcaacaagtatctttcaagtataaaccaggatcataactcacagcc

SEQ ID NO: 30293 - DNA, 1074 bp, Bovine  19866881327381
ctggtttaatctagtacaattggatcagcatatacacatgttcagagttacagagagagagtccatcattttttggtttgtttgtttgttttttaaaataaggttgcaggagatcttaagaaatgctatagcgggactccaagtaccaggaggtttggatggcagccaaatctggcccgccacctgatttgtaaataaagttttattggcacacaaccatgctcctttgtttacacattgtctgtggctgctttcccctatggccgcagcattgagacattccaacagaggctgtgaggccagcgaagcctgaaatatttattactggctttttacaggaaaagtttgctgatcctgttcttgatgattgagtttgcaatcagtgctggtggtgatggttgaggaacagatggaattagctagaagtccttgggtacgtggtcctctagaccttgttatccacacaagctagaacattgagtgttcttgtggggaggcgatggaaaaccaccctggacttttttaagcagaggtgaaatttataggaaggatattgggggtattcagaatcagtgggtggcttaattaatgcatgtgtggactgcataagatggaatgccttggattcttttcattcaccttccaggctcgtttggtaacctgagtgcatgtaagagaaaaatgaacaagatagaagctctttgagcattaacagttgcaggatgagcaaagatagcgtctatgtgagtttttattgtatccaaacaggtttattttattcctaatattcttttacatggcagttacttttatttttctttcatttttaaaaaaatatcacattgctcaggagacatgtttggcaaaacagttgaaaggaaagacgtctgatggaaactcaagtggttttgcatgagcaataataattattatgatgataggtttcctgcctaagccttctcggtgggtagtatttgcaaattaaacacaccatgaaatattcagctccttgccacacatcttgggtgatttgcataatccccctgcacgggctctggggtgagctactcccta

SEQ ID NO: 30294 - DNA, 718 bp, Bovine  19866881467003
atggttggatggcatcctgactcatggacatgagtttgagcaagcttcgggagttggtgatggacagggaagcctggcgtgctgcagtccatggggtcgcaaagttggacatgactgagtgactgaactgactgacttgcccaaagtcacattactagaaagtagtggtcaagacctgaacccatatcccttggattccacagccagtgttctttatatcacatgaattccacagctctttgtttccattttcacagagctgctccagctttttttttcccacaattgaccagctatttcatccactggatcctaaaacagcttggatgtatagactgatgctagcttttgagaaaacgatgccatggtgcatcagaccccaggagcgatgctgtcatggtactgctgcctgtgggaagcaggcagtttctgcaagttcattagacacccctaattgctgtgaacacattcaggaggtatagtaaatgcgacttaattgagaactaattaacttgttatagttatctcgttacatgccaattaaatgtctaaatattcttttcttctcagataaaggaatacaaaaaaggaaaatcaggggtgaaactggatctccatccaggtaccagggcagcaacaggggccttggtcctgcagaaggagtcaaactcattaacactatattaaaggcagatgttcaaaggcggtggggcagatc

SEQ ID NO: 30295 - DNA, 1502 bp, Bovine  19866881520156
aaaagcaaaaattaagctaaattaaaagaaataaaaatattacctctatcatctatttgaatcaccagaataagctaacaccaatgataaattatccacaaaaattataagaacaaatgcaaacctgcccttatatgaattaattggttatttgactatccttaaaatttcccaagatatctcattatattccatatttcctctggtaaatcccttgttaatatcacttgacattaatttccacattcagtgttaaggagtaagaaattattcctgacaattctgtacctatttttttaaattcatgtatctaattttaggatatcaaaaaaccatatacatgttgaaattattccttcctttcaagctctaaagacttactaagctataggtaacaagtctctcttgtcacatcattttagtttcctgtaaaataacttatttttctacctgtttgggaagaaagactcacaaaaataggtaaaatgactattttaaatccactaaataataactagactatgaaagggtctacttaatttttgaaatacagttcttttaagaattgtaagatctgcagatacaaaaattctacgccatttctaaaacataatctatatcaccaaaaaaatggctgaagaatgtacatttcagattgtaaagatgactcaacttctgatttaaccataaatctaaatcaccatttaactgaaaattactgaatgtctcacagctgatataaatcacatgtatcaactgttttaacattaacacaaaactgctttgatacaaggaaatgcacttgacgggcttttcctcatcccttttttgagattaagtctacaatttatgtcacattgacaacctttactgatattttcctattcaaatgttggtagctattagacttcatatgttgggtaaaaacatttacttacttgctatacaaaatacagactatcacaaagatttatcctcaaggacaaaattccatggtctcagtcttcaaaatggcataccttttggggggggggggggggaagaaaacaatattctaaacaattcattgatggaaccaccaaaagccaagtaggaatacatgtttttaaagttcttatttcataaaaggaacaaaaactaaaatctatgctcacaaaacgctagtttttaaaacattctcccctaaaatgttaatatgaatagtaactagattgaattttccaatgaacttatttaatattaaagattaaaactgtttacacagcatattaggcagcaaaaaagaaaaaccatatctttggtttatggttttcctgaaagtataatcagtctttttcttggtcccaaaattaaacaaaggcttaaaggaccttcaatattttaaactattcaaaaggcacattaagttacaatagctatgtacgtaatacttctcaagaaaaggtttaaagattttgtaaaattatttcagatacttactcaaatcagtatcaaaaatataa

SEQ ID NO: 30296 - DNA, 834 bp, Bovine  19866880346100
gaaggaatgctggtggtgacccttccttctctttatcctgcatcggagttaagtgctggccttgcgcgaatctcacacagagacctggacctcagtaactccaaaacacacacccttttcagaaatttgtcatttcatcatttcttaaccaaatgactccaaccgcagaaagccacaaattttccattgggacttattccactgctcccttttggtgggtatattctttcctgcttcctttaaaaaccccattcattatatgaagtataggttttttgaaactgcttttaaagtgaactggttattaaatatccatatcttgtcttccagtctttctcactccactttatagatttgagaactgaaacacagaacggtctatggcttagaaaagctaagttccctttttatttggcccatggaccataatctgaactttgaagtctaaagatataggattacccaccctctcccccaccctcagtatagccagaccctgatgtaaaaagccaggaacctcgctccacaagggtgggcaatccaagacttccagtttctggttgcaattgaaggccaggaaatttggagaacaggatggaattgtttcttgtacaggcaaacaatttgtaatcattaagaagtacgaagctaatgaaaagcaattcatccaatggcaagcgttgccataaatttcattcctaaagggaacacatgatacaggcatgattcttgatttcagataaagagaaaaatgtggagctattattaaatacaaagtaaaacaacataaaaaaaaagccagatgatagaaggaatgcaagcaggaccccccgg

SEQ ID NO: 30297 - DNA, 3138 bp, Bovine  19866880488488
actgattgaaaccttccctcctccaggggtgcccattttctcagcgtgcacgctggtcattatatgttgggtgccaccattttcacaccaatctcgttcagggattccaagggcacctcccctcgagaaagtgtgtagagttgcaaaacaacgcagttagtttgaactttggcaaaaaccatgacctgacatgctgctggctggccaggacgcagcccggccagcaagatcctactgggcagggtcataaagaccaaaccacacaacagactgcctgagcattcataagcatgaaggcaggtcagtccatcgaagaacttctttcatgagggcattctttgatgatgatgatagtaaaatacatgtaacctaaaatttgccatcgtcaccatttttaaatggatggtccaacagcattaagcacactcacaccattctccaaccgatccccagaactctttccatcttgcaaaactgaaactctgacaccgttaaacaacactccgttcctctctctcccccagcccctggcaaccaccctcctcctttctgtctctatgatttgtctagtctgggtacctcatataattggaatcatgcagtatatgtgtttttgtggctggcttatttaacttagcagaaggtcctcaaggtttatccatgttgtggcaggtgtcagaatttccttcctttttaggctgaatcatattctgttgtgtgtacaaaccttcatccaccaatgaacgcttgggtcacctccactttttggctattgtgaataatgctgctgtgaacacgcaaagacatctgtgcaagaccctgctttcagttctttcgggtatatacccagcagtggaatcactggatcagatggtgtttctaattttaatttttttttttttctcactacagttacatgcaaaaaactgtagatccctttacctggcttgcaatgcagctcttgaacaagtagaaacgtcaaactcctttcaagatgagacatctaattttaatttttttgaggaaccaccatactgttttccgtagcagctacaccattttacatttctaatttctccacatccttgccagcacattttctattttttttttttttcatggtagccatcctaatgggtgcgaggtggacttgggggaaaactgttaaagacatctcaaaatactcatgtactgaaattctaagttagggctttagaattcctagattccaaggagaggcactcacatatcccattttctttgctgcgtatgattcatgaagcaggtggggaggattaactccatctaacaagagggcaaactgaagctcagaacagctaagcagcctgtcccagatggcagccgggccaggaccactctcacattctcttccattattctctgatgggccgcattttgaggactagagcagcgcaaacaaagagggaaataatctcttggattgaacaatgctgtcaggcagaacaccaccccagcccctgagaagccaaacttccagaaaggctgagttctgaaccatgggactgacctatatctaactagtaccagcctgcaaggtactgcccagcacatccttaaaggacagtcctctgcgatccattatggtcaccttgacaaacagagggacacatccagaggggctgtttcacacaatttgtttgtggggacagtaaccccagaggaaggacagggattaaagagtaagaaccagctttagaggacttccctggtggtccagtgtctaagactctgtgctccactgcagggggcccaggcttgatcactggtcggcaaaccagatcccacgtgtgacaaccaagagtttgcatgccacaactaaaaatcctgtgtgccacaactaagatctggaacagccaaatatgcaaataaatttgtttcttaaaaaaaaaaaaaagaaactagcattagcctggttgatgagtcctcaaataacaaccgatagatttgttttcctttcaacgcaaaataagttttggcacaaaagggacaggaccgtacctgtggttggagccaaactcttggcagttacctcagaaaatccaaggtattctctaatgagctgactcagcttttggtaggcaacatccagatcatctacagcagaggagagaatttactttagcaacagacgtatgtaaaaacagccaatctgtggcaataattttttagctagatctaactgcatgaatatcgtggtaggcagaattctaagacccagtgacacttcacccttgcttaattacacacacacaccttgagtgtgggcagaacctgtgaatctgatgagctatgactcccgtggttatgttaggttatatggcataagggacttttgcaaatgtaattagggttattttattaagatcctaataaataatttactgtcctaataataaatatcctaataaataatttattatcctaataaataattagggttatttatgagtttgggctaatcaaaaaggagattatccaggtgggcctaatctaatcgtatgattccccataaaaggaggttttctgtctggagaagtatgaggacactcgaagcaggaggaggaacttaatgggctgttgctgccctgaaagtggaggggccacatgcacacaacctgagcacagtctctaaaaactgagggtcacccttgtcagacagccagccagcaatcaggaaccgcagtcctacaaccgtaagaaactgccttcagtcaacaacaagaatgtactttggagtaggtttttccccagtgatcttatacttcaaaaataaaactttgctgaaagttacttacctgcattgattactgcatcaaagtatcctggatatttctggttaattttaatataaaggtccactctggagacagcaaattcaatctctacacgactgaataatccttttctcctcaagtagccctcatatttttgcttgtccatgggtaccactaggatatatcgaggctcaaaatagcaatgttttaaacttcttacaccctatgtatttaaataaaagataataaattagaaacacagatacaatttagaaatcatttaggaaatatgtgacaacataggcttaataagtagtgctgt

SEQ ID NO: 30298 - DNA, 2678 bp, Bovine  19866880527161
gtcttagatgaaataagacatagtacacagacagaaagaaagacgagctccttggtaatatcatttgagttgctggataaagccacagctgagcccagaggagctctatactttatagttaattgagccaatagcccacactttttcatttttggctcaagctggttagagaggcacctttctttcatttctaactgatcttcttgaggttagatggggccacttaactagttacagccaaggaatgttttgttttttattaaaaacacttaattgctagttcaagactctccagaactcttctcatctcatggtgtgcgtgcatgatcagtcgctcagttgtgtctgactctttgtgaccccatggactgtagcctgccaggctcctttatgcatggaatttttcaggcaagaatactggagtgggttgccatttcctcctccaggggatcttcccaacccagagatagaatgctcatctgcatcttctgcattgtcaggcggattctttaccactgagccacgtgggaagcccatcctgtggtactgaggagcttttaattggtggagcctctgtcggctttgttccctgaaagaccacgggggaaaagagatcctgtcaatccacagtgaatttgcagcatgagtgagatataaatcagtaggtttcagaaataattgccaccaaggaaaagtttgttctttcccatataccaatacaataccttatgttctaccctctgggctgtggaacatactttatacacaagaattactctaaacatataaggtaaaatacattaatgtctctgtaacaagtatttccacaaactgttgacatgtgaacacaaaaaggtaagttggattagaattaaatattttaaaaaaatccatttataaggcacacttacttggatattcagataaaccctgctgacacaagcaccatcctctataccccaaacacaaacttcccctgactgtgtgagtgtctgtaaaagaaagaagaaactcaaatggaaaacaagactgctatgggagcatgttctaaatttctttctagtatatcaatcactgatgatttaaaataaaatttcattttatttatgtggattaaaattactttgcaatctcaatgttaatacttctgatttaaacaaatattaactattacctttcagttcagttcagttcagttgctcagttgtgtctgactcagcgaccccatggattgcagcacgccaggtctccctgtccatcaccaactcccagagtttactcagactcatgtccattgagtcggtgatgccatccaaacatctcatcctctgtcgtccccttctcctcccaccttcaaactttcctagcatcaggatcttttcaaatgagtcagttcttcacatcaggtggccaaagtattggagtttcagcttcagcgtcagtccttccaatgaatattcaggactgatttccttcaggagtgactgattggatctccttgcagtccaggggactctcaagagtcttctccaacaccacagttcaaaagcatcaattctttggcattcagctttctttatagtccaactctcacatccatacatgactactggaaaaaccatagctttaactacacagacctttattgtaatgtctctgtttttttaatatgtaaagtaatatgtaaatatgtatttaatatgtattaaatgcatattaaacatgtatttaatatgtaaagtagtatctctgctttttaatatgctgcctaggttggtcataacttttcttccaaagagtaagtgtcttttaatttcatggctgcagtcaccatctgcagtgattttggagcccaagaaaataaagtctgtcactgtttccattgtttccccatctacttgccatgaagtgatgggacctgctgccatgatcttcattttctgaatgttgagttttaagccaactttttcactctcctcttccactttcaagagactctttagtttttcttcgcttaatatgtgttggtataaatttttttggcatttatccttctagtgttctctgagcttcccagatctgtagtttggtgtctgacattaattttggaaaattctcagccctcattacttcaaacatttcctctgttcgttccttcctttcttctccttctggcattcctattacatgtatgctacaccttttgcaattgtcccatgttcttggatattctgttctttttgattcttttttctttttgaatttcagtgttgaaggttctactgacatttcttcaagcttattgattctttcctctgcaatattcagtctattgatgagcccaccaaaggcactcttcatttctgttacagtgttttatattttgaatatttcttattttctttcttagtgttgccataaatctacttatattttctaatcattctttcatgttgcccactgttttcataagaccccttagtatattaatcatagttgttttaaatttctggcctgataaattacaacatctttgtaattatttgcagatacaatatctgagtctggttctgatgctttctctgtatcttctaactgttactgtcttttagtatgccttataatttttgttaaaagctggacatgatgtactgtgtaaaagtatataattaagtagg

SEQ ID NO: 30299 - DNA, 1621 bp, Bovine  19866880533137
gtatctcggatgaagaaattatcaacattactcttcctactggggtccccattctcctggaactggacgagaacctgcatactgttgggcctcaccagttcctgggcgaccaagaggctatccaagcagccattaagaaagttgacgatcaaggaaaagtgaaacgagctgacaaataaagtttttcccacgtgctggctaggaatagctgcagaaggaatggcatgcggtgtgttatgagtgctcatctcccacacccccccttttttttttctgtcttcccacctgatttttccagatctaggctgtggggtagagtttgtagaggtaattaggtcttaacgttggcccagttaaacgctttaggatgcacatagccttatgtgctaacccctgccagcctccttttaattagtcactaagttaatcaccagtggggcttaatcaatgtcctaagtttctgagatggaaaagcaacaagtgaagcttaagttcaaggtcgtcctcattcagtaaatcagtattgagtcactattgacagaccttcacttcaataagacgtttgtatttatagaaaatttctgggatgataataaaggatattagattaaaaaaaaaaaaaagagatcagatctaatcagtgtcttttctttcccctttccttttcctttctttttttctcccttccttctttcctttttcctttccttcatttcaacatggaactgttttctcaaataaagaagataatttcagtggccttacacttttccttggttcttgttcctagcttttttggtgaaattatcattcacatagtgatggatggataatccatggtatagtccaggggtcagttaccttttcctataaaggtttatatactttaggctttgtgggccagttggccaagtgaaaaagcggcaatagatggtaggtaaaccaataggtactgtgctccaataaagctttatgtacaaggacagggggcaggccagacgtggcccacgtgctactgcttgctcacccttgggatagctctgtcagcagtctcctccattctagagccctgatgagaactccaaatcgagtgaggaagacactgagagaaaggaactggatcacttcaattctctacccctaactctcaaggcattcgcctcacatcctagattaataacagatgttcacaaatatatatgctccagagtgaatgttttttatttagaaacaaattgctctacattcatgaagggaagaaaggggaaagaccaaaaaccaaattgttgttgactcacctgatgagcaaattggcaaaccactcacctctgtcctacagggcccatgatgagtccagagctgagtcctggaatctacagatcctgccatcttctcccaccacaacagaactccacacagtgcccctctgcatttacatagggcttacggaataatatgtcaggttgttaattacataatgagtctgcctatgtgagaggagagattctaatgaaatcctcatgtgtacagtattttatagaaataaaaaaatacctactggaccatttgttcaatcctcattttctgagcattaatcctccccacttctaggaatcacatc

SEQ ID NO: 30300 - DNA, 1093 bp, Bovine  19866880576741
agtccctcctctgctttgtgtgcgcttagtcgctcggtcgtgtcccactcttcgtgaccccatggaccatagcccaccaggctcctctgtccatggggattctccaggtaagaacactggagtgggttgccatgctctcctccaggggatcttcccaacctagggattgaacccaggcctcccacattgcaggaggattctttaccagctgagctaccagggaagccctcctttgttttaacaccccttttcctctgtcaaagtggttacatgtgtgctattgcttcagttgtgtctgactctttgcgactcccatggactgtagcctgccagggtcctctgtccacgggatcctccaggcaaaaatactggagtgggctgccgtcctccaggggctcttcctagctcagggatcaaacctatatctcatgtctcctgccctggcaggtgggttctttaccactagcgtcatctgggaagcctgtggctccatttgctgcttaccttttccttatgaatgaatgtcttcagtatgctctgtttcttggtggtatttgctttaaaatttttttatctctaatgatttcatagagattgtaagtcccttatgaaaggaatttcaggcatctgtggtggcaaaaaggaaagacactttttcttagtggttgggaagatcttgtcattatactaggtattcattcattcaaggtacccttaagtggactttgaagggcaaaggatgtatcgatatttcaaaggcagaaatctctacctggtcctctggatctgagtagaacctgcagtatccctggctgatattttttcaactgcaggctacctcaaaagccctcacaggtatatttgccagatgtctccctggggagagagacttaggtagcttgggtgccttcttcccccacctccgctcctatgctaccaaaaatctgaaactttgcctgcttctgccaactcccctgtggtctcaagtgttccaggaaatgaggagtcattctttatttcttgcttcatacggggagggccccacgtgactccctgggcagggggcggcggggtggggagggtgagggctcag

SEQ ID NO: 30301 - DNA, 898 bp, Bovine  19866880612267
tgaataaaatgtgactaatttcattaaatgtgagaaggtatcacaacagataccttataaggaaccataagtggcagggttagacctgtaagaacccactaactacataaagagagcaaagagaggggagaaaaaatatttctgaatccctggtgctcaaataagaacagaagaagctagccaggattaagatgtagactcaaatgcaaattaaagaaaagcatccattaaaggggaaagaaaaggactaatccctctccactgaataaactcatagagggaaagaaatgggaaccatcaaatattcaggaagtattaaagaagtaacaatccatctctggaaaggaaagagcaaacgttccatctgatgctcttcaatatcactgagtgtgtctcaaccattgcataaaacagcatgtttgctgacctctgcatttttcttttctcgtgagtcgggtgcttttttttttttttttctcatggaaaaagtagaggattaatgcataaagtgatccataatagcatttatatcaagtttggtagtattaaagtatattgccctctgcaaagcttaaattttgtaataattcagtggtccatcaatttactagaatgacaacgacataccttcaattttatttactgaaagatccagcttctgtaggtgaacatatccacagaggatgctaacgtcagttaaatcaagatcctgagaaaataaaaggtaaacgactttaatgtggctttagcagatgagtactcaggcttttcaagatatctggaaataaaagctgacagagaaatccagaatttcctttgaaagtattgtaggagtgagaggataaaacctgaagcctattactagtaggatctcaaaacagactacaaaccccatcaa

SEQ ID NO: 30302 - DNA, 1453 bp, Bovine  19866880618642
catgtatctattgggagaaatatatacacactattggttctgtactagaacactgactcatacagagatggttgccaaagcttctagttccctgtagatgcactctggagctgccacccataattgttcataaggtgtgtgtggtttttttttaagataatggtgttattcatcacttttagatttagattttcaaagtctaagcattagaatcccccagtctgtctttaggcagccagctttgttctgtctgtgaggtcatgactcaaacagaaaggctccctgtgggtgaaaaggaatgtgtctctgatctcagtggcattgtcctgggaagaaattgagatggtgtgtcagaagacctgcatttgaattccaactctggtatttactgtcagtaagaagtaactttttctgagctctggctttttcacctgcaaagtgagcataacaaagcctggctcagaggggtctgggaaagactttcaagaggacaatatatgtgaattgctcattgtaactcaatagcattttaagaatattagttgttggaatgtattcttttacgttgaaaggagtttgggttttggacttgagtacttagtttagttaatctcttgagcctaaggatcttcatgtactaaacaataaaaagattgcaacgtacttttgctgcttcttgtaaggattaaagaggataaagtatgaactgcctctagcaaaaaccatggcaatgcatgtgcttcctgcaaaagcataactctttcttaaattaataaaccatcattatttaaatgttactcgaagtgtgtatttttaaataaagaaaaatcaaagaactgcccccactcaagttctgacaaatgatgtctacctgcatctttcactgtcacccgtcattatcacctcttccagctccacaaaacttcttgtcctaaacccttcttggcccattgtgaacttgtaactgtgaaacacaaggcccccagcctttaaccacaagaaaaagttgtcgagatgcacagctgacagatacgcattctcccagttacctggtattcaagactattacatagttacgagctttctttctgaagatttcataagaaagagaaagcaatttctgctctgaacacttaaatcagctagaaaaaggaagaagttctattaataaacttattacatattcatagatccctcaccatgagccttctctatttatagatcttataaacactcttcctgaaaagtcttaaggtacagatcattcatgttctactcctcaacctggttcaagctcttcgtagatcattttctccttggcagtgagataagagagaaagtaaagggactttctaaagtattccatctgggttccaccctccatttagctttatatggtcaggagcaggtcccttaacccctctgagccttaaagacctcacctgtaaggtag

SEQ ID NO: 30303 - DNA, 2910 bp, Bovine  19866880638078
cattggcaggcagagtctttacctctgatggccctttaattaaagacacagaatagctttcctgactcatggtcggctacagagccatggacaagccatgcaaacaggctcccagctctacccaaaactttagagcttcttcagactgcaaccactccctacagcgagccctgaggaaactcaggatactggccccagattgctgagatgcatatcaaaggaatgacttcagtgagcctagatgcttgcatcttcccatacagagaaaagtactgaattccttaacttaggagatctggttttcctttaattaacaattatcttttgattttccgactacctgccctttgtcgcaaaacatctgtataacctgggtccccctcctcacctcctctgagcagttctctcacggttacttgagatgctgtctcctgggcttgaagtcctaaaagttcccactggataaaacaactctcaactaaaacaaaacaaaaccctttagatcttctttgcaaatcaacaacatcccttgagtagtccgtgcaggctccccccagccccgatcctaccccgtctgggcacggtgctcaagccagtcctggtccctctttgtccgaaatgactctctcacaggccagccagcccacaggacccctgacaggctggatggccaaactcattaggggaggctggggtgcaggcagagtgcattttgtagacatggagaaagcactgtcaactagatctggggagtccgtgaattgtggcagatttggggcaaagtggaatcaacagggacaaaaataatttaggagacgccctgctgggagctccaaagcttctaagaagatgctgcctgacggcacccagctcagcttgactgtcccacaaatcaagggcacacttggctatggtgatgatagtacctgggcagagggagaaaggcatagaaccacacgactcagatgctttgggccacttctagaatatttattgaagcaggcagtttggaggtatctagccaaattacttaatcattcaactattaatcatttcaactagatgtaaatatatccctgggaatggatggggttcactcaaaagttttagaggggtgaaaagtctttttagggacttctgtcttggttcagtggttaagactgtgctcgccatgcaggggactgtgggttcaatccctggttggggaatgatgatcctgcatgctgctcattggtgccaaaagaaataaataacaatttataaataaaaaaaattaaagaatatcagcttttttaaaaaaaaacaactttttagggggtggtaaaattgcacagctctcagaacaggtgtggcttgtccacatggagatccctgatgtctgggggccagaaaattccattgggaccccaaacacgggggagaccccacagggccttcagagacctacaggcagagcacgctcctttccaccagcaccggcagggcgtggagtcgatgagcaccatccatggcagaacttggccgggaaaggcgattccagaagagagcagacctgattaatgtgctgcagcctctgagaagattaatgtgcggacaaggggaaaccaatgaaggcaatttatttagactttcagaaagactccatgctaagggctatttttaaaagtcactgaggaatctaggttttaaaggactagctttttgagattaacgccaacgagacacccacattttcctgttgcctccactacgaaatatgaatgacttctgactttcaccccatggggcatttctaagcaggttccctcctctgctggcccctccagaagtagtttttgattcttctctctcttacctaacgtcttccactttatatgtaattatgtataaatgcatccctggtagactggaactcacctgaggacagggcagagtcttccccatttttgtatcctatccagcactcggactaggattccctctccctgattcaccctgacgcgtgacggcagaccagcaaacttgaccactacagtttatgtctggggctatgttcccacgcaggctgccctggtggctcagcagtaaagaatctgcctgcaatgcaggagatgcaggttcgatccctgggtccggaagatcccctggaggagggcatggcaacccactccagtgttcttgcctggagaatcccatggatccaactgaagcggctgagtacacacacatgtcccatgcacctcaagttcagcctgaccagccctgcagtccccagccccagcccgtcacattcagctgctcttcctgtgcccccttttggctagtggcatctgcattctcactgcacccacctcggttggggccgtcactcctgcacctgtgttacacctttccattggtctagtctttcgaaggccagtgagcagggttctctgtgtcccctccccatggcctctccagtctcaccttctgttccatatgtacaaaacccctgcaggtcctcacataccctgagaactcctgctgtcctcctgtgacctcccgctcctcctcacccggattcttccagcttcttcctgtagtgaaatcctacttgttctttatataccaacccaggtgctgtttcctctgagaaaatttctcccagtccccagtccgggtttattgtgtttcctatgtgctcattcattcataacaaacatttcttgagcaacttctatgtaacaggcattctcttaggcaagggtgatagaatggcaaacaagactgttggtctctgctttcatagagctcagcattgcatgaggggtggaggcaattttacaaggaattataaaaaatatagtaagtgttcaaataaatgcccccttctgccacacggcctttgcttatgccccgctctcccccggg

SEQ ID NO: 30304 - DNA, 1801 bp, Bovine  19866880727125
tctgtgaaaaatggtactatgtgggtgacacaattctaggacatatccaaacagcctccaaaaaggagaactaaatttacaacaattactccataagaggggtagggttaatcaccactaccagaactataatctactgattaattcacagctcaatgggccacagacacagccatctgtgtagccatttgtacctgctcccaggaggaagaggaaaagaggtatacctcttggaacaggtgagggggctgccatgggaagagtccaccctctggacacagctgagtgaatttcattcagaaaacatctgctggtgtcgactggctccgacgtgtaccgcttccttgctggaacagttgggaagtacacgtgtgcctggtccccggacacagctggggtgctgagtctttcattaggtaaacaagcaggggcaggtggggctaattggattcaactgtttggtgacagcctgggcatgatgtttgctttcccagactgaatctttcagacaatttaaaaaaaaactaggagccaagctagagaaatgaaccccatcaaggctggtccaaatgaagccactatagttgatttttgaccatgaatgactggacctgtagcaggtcagactgcagagcgacattcagcaactcggcgatcatgacaatgaacgcagaatgcagagctggtactatgtcgctgagtgaaatcaagcaaacacaaaagcagatgcaaaactaaagattctcttaagaaaagacggagcagaataaataggaaaagagcagagaaacatcaggttgtctttcacatcacactcaatgctgctcagagagctttatgatgggtatgtatctccaccttggaattgtaactcaagaaacatctgataactctagagatgggtgatggaaagaaataatcttaagaggacccagggggaaagacttgaaatttcagagcttaccgaaattatttaggggataatttaataacaaccttcaactagataagctctcacatgaagggtcataagtgtttgatattttaaaaaccaagaaaaataattataacacagtggaccaagaatacaaaatctgcctcaactgtcagggctcagattttttttaatgataagccaatttaaatataaatataaagatctttataaaaagatctcagaccaggtaactcccagtttccaccctaaatgaacatgtctctctgatctgaaacattatttgagtttcccactttctcttctttgggctgtagagccagtcttagcttctcatgcctgtacaaccacttgcttacattgggaccttagccatggtatgaacctttctgaacctctgtttcttcatttgtaaggttgggagaatctaatcttgagaactgctgtgactgacaaaatgagtagataactatggagtccttgcacaatgaccacgcaccttcccaagtgtgtatttccattctagttcgggtccttattactttgcttcaaagtgactgcaactgactcctccttcatcgtgagttaggtgggggaaattaagactggctgcttgctagggaactcctgggagatgtgattggaagggcagtatctgtacttgacaagaaggcagttgatgggcactagaatatggggcttcccatgtggcactagtggtaaagaacccacctgccaacccaggagacataagagacgcatgttttatccctgggtggggaaaatcccccggagaagggaatggcaacccactccagattctgcccggagaatccctcagacaga

SEQ ID NO: 30305 - DNA, 1942 bp, Bovine  19866880754810
aatatatgttgccaatctctgttatgggataataatattcactttttccagaagtcatttgtaaatgacactaaaaatacaggatttacataggaaacttctgtggaatatatttcccacttggatcatcctagataaggaacagcttgcctagcataggctgtatctacctgatcaaaccataacaactctaaaaagacatttggaaacacctggatgattcactgtattctttcatttccaactgagtatttgcaagcctgcagtggtgagcagttttatttagctagtgtgtcaatttgggaaaagtaaaagcaagccatacttttctcattcaaaatgaaaatcaattcattgagttccatgaaaaatatacattctttcaacttaaaatatctactttatacaattgaacagatatttcaaacattttaaaaggcagtaaaacaacctgtctcccccacacacataccttcttttactcaaatgaagtatgtccagaaactcaagtttataaacaataaaatcagattggtagaatgttaatatcaaagttgggcaataaaaatggtaaaaaaaaaaaaaaaagaaatgaaaattagactaaatgtacttatgaacctagatgaaaaaattagaatattgaatctaacagtgcaaaaaaaaagggccattcaaatatgggacttacaagcacctctcacaggagagattatgggaggaaggtgggaagggcaggggtgggaagggatggggacacagcttctggcaccaaggacttaaccatgttggacccaaaaagtgggcctgaaaacctgaagcttaggcttcacagctgggttgtaaatcagacctgaccccagcaaacatgcaaggtcacggacagggtgcctgaggtggtgacagtgaacaacgtgtataggacgtgcccagtggtagcaatggataaaagtataccaaatggactttgaaggaccacaggttttaaaagtcgattggtatcaccccatactgctagggtagtgggggtgcatttgattttcaaattgggtacttttaacactttagtccttgactgctgttcttcactgacttgactcagtcactcgtagctttattggtctgaaccagctccttgttcccaggttgcagacctgcctatcgttccagtaatcctgtttcatttgaatgaagggagtatgtcttaaatgtaaagcttctggttctcaacactgtactctgaggtccaaatgactgtcaatgtataacctgatgtctcaaccccagtaagaagagtcagttctttggtattcaccaatgcgggaggcttcaccagaacaggctttttctttgggctctgctgtttgtttgcagaacacccaagagcgagcaaacatgctctcttcatagcagtaccttagggttttgccattgtaaatgggtctgatgtgatatatgacaagatcagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcagtgatatatattgcattatatattgatgtgtgtatcaatatatactgatatgtattacacttacacaatacaaacacataagagggggtgaaaaccgtagcatttgcattctctatagcctctacagagagatcctaaacagcaaactcttggtgttgtgatgtacagaaatggagaagagtattaaaccatatttaagaatatacttcgtgtgcttgagattttttaggactgttctaagaaaggtctgagccgtggagacagtgtgaatgagctctccaaagcatgtgcaatttcctcagttacttttcagccataga

SEQ ID NO: 30306 - DNA, 2243 bp, Bovine  19866880811682
cagggacacagtgaccattcgacagcatttcaagtgctacacatagtgtcatacaaacattttattacttttattactaatgcaggttaatcatatttcaaaaagtaaagcgaagtttgagtgttgtgctttttcaggcacggtggaatgtggattattttgttataaaattataatagcaaagcaccatgtttattaggcagtgacacttcagttgtgttaaaagaatacaatttattttcacattaccagaccaagcactcatcacaatattcccaactcacaggaaagcaacagtaagaacaattaaaactttaaagcagaatatcttatcacaatagaatttattcaaacacacaaaaaataagaatgaaggtgcaaccaaagttactttccaagtggctcatttgttaggcaagcaaagaaagttcttcactgacagtgagttaattaaactgtgtttgactgcagcagctacaaagtgtgtccagagaagataaacacgttgaagaccactagtttttgtgcaaggacaactgcttgaagacaccgactgtcaactaaaaaacaaggcaaatgatttggcttttcatgagtcaatacatgttaccaatactgcctagttgttgattacaagagaagtcagtatggagcttaaagtaactcaggaattggcctctgtgaatagactccgtgcaacaactcccaataagataattttttttaagagaaaagacttttaaagaacttgagaaaacatcagtgctaactgaagtggtgtctgcaaagatgtgttgtaacttaatggtggtaagggcatatggagtagaaaatggtttactgggcaaatttacaaagcttgtagaagtataaaatgtttaaaatcaatctttatgcattacatgattcatcagcaggtattctgggggaactatttgaatctgtcatgttactgaactagttaagtcagtggtgaatttcatttactcttgcagttttaactatcattacttccagtaagtttttgctaggaatggaaactgaatatcctgacttgcccagctacacagcagtttgatatttgtaggaaagttttattgcaatttttttttagctcagaaccaacactgaattttctctgaataggtatcatttttacctattattaatgaaaactgaatagatttgaaaattaggtttgcagcagatttgacatttcttagtaaatcaacttaaaaattgtaaggcaaaacagcacttatatgtgaaatttacacttgcaacaaaatcattatgacaaaactaatcttgtttaaatcacaagtaatgtcaagccactttatccacttcctatgctgtcaagttaaaacaagaagcaagatatccattcctacacaatttgcagtgggtatgtttttcaaactcaactgctgtttcagctacatttttggatccacttaactgtacaaatgaggagcatccatctaatcttcaatacaaagtaattaatctgcaatgtaatgttatgtccatggcaaatatcaagggcagaatctaagaaaattgtataaaacaccctcctaatggtgaatacactctaataaaatgatacgtatggactgatacagtatttggtaatatctatctgaagacattttcaaagatgaaatatataaaatcacattacagatcagcataacagacgatcaatttcaaactcctaagtgaaatattatcctctcaaaatatctcaattcttatcagtagacctgtattacaaaaaaattgtactcaagtattcatatgtattttgaacttcctcaatacaaaactactggaaatttgttttctcattatgcaagtatataaaaacttcaattttgcctttggtcccataaaaccaaagtttgtcaaccccactctagagcagtgcaggactgtttttcatattaagtcaagtcacagtatggtaaacattcctgtgaacaactgttccttctaaaaccattttcacatcccagcagtattacctgataatacttgtatatgtagtcctttctttggttatgatccatgtattcctatgaagtaaatttcctaagaaaataatgtgggtccatattagagatgggcagagaagaaactcatcatcccaaacatcagcaaaactttataattccatttactttttctctagaaagatcagcttttcactctactaatccaatggtaatcacaaaaac

SEQ ID NO: 30307 - DNA, 1496 bp, Bovine  19866880812357
tatacattttagtcctgccactgatcgaggaaaaaaaaattcttaaaagagtttttgattggttttacggaatcaaattcaagctcctagaaagaaagcattgattactataaaatagactgcttaagatgaaagagacagactgtgaaggaaacgaaaacaaaggaattggggggaaggcagctgattactggactggccagagctctttgatgtcaaacgtaaataactcattgccattctctgtcaaatgcaagactcagagatttgggaccaccaaaataactgtgagttagcagagaacatggatatggtccaaccagggtcaagatggagccacgcaagggtgaccctgtcatactcactgataaagtcaggctgaggtagacctgctccgtcccagagcctgagcgccccagttggtagagcttctcagccacgacctcctctctcaggaccccatcaaattctccctgcaaaaacaaaacagacaggtggacaaagaaaggacttccattagaaaagaaacaatccgcttcgtcatatccagcacttatttagtatattacacatctgggagctgagacttccaaaatttactggcccccaagaaaattgtgttgaagacccatgcatattacacactattaaaaaatgtatctatccaatcaatgtctcactgctgatagcattgagtgccgtttgttgctaagagctctcagtgggtccactcactgatccgcctaatgattctgagggaggtactcttcactccattttacaaataaagaaactaaggctcacagaccaagactagcctgaaaccacaaagcccagaatacaaaccagaatctgcctgacctcaaggcagttctaaccaccaactgcacttgactgcttgtccacaccccaaaggagggctgcaccacatcaaggcagtgacttctctacatctggcattcttgttggagaaaatgggtcctcgggttcactttgcattggctaatcttgctggattcataccatttacaaaattaaaagggtaataatttcaagaaggaggctggtccttagtctacagacaccatgaaccagtggtggcccaacaccccctctccccattctccccaagagcagaggtaatagtgctgtgtttgtgctgccggcaactctataatgaccaacacattaacactaacatcagcattaggacacaaaatagagcaattttttaagtcacagcaatacaactaaccagtgtaactggtacgtggactatgaaggcaaaatactgtttcaggtgttttgggccactttacattaacttgggaatcaggagtgctgttcagactgcttgtactgaggacataagtatgtagggtggtgctattgtaaaaagttttatttcctcccgaatttcccctatcttgttgctatttttcagtagctcagtcatgtctgactctttgcagccccacggactgcaccgtgctagg

SEQ ID NO: 30308 - DNA, 1323 bp, Bovine  19866880838295
tgaaagtgaagtcgctcagtcgtgtccgactcttagcgaccccacggaactgcagcctaccaggctcctccgtccatgggatcttctaggcaaaagtactggagtggggtgccattgccttctccggttaaaaccgcatgtagttccaaatcttggagcaggattttggctgtggctgagtgcatcaaaacatttggagggttaaagtaaaaaataaacaaataaatacagtgtatatcgcagtgtaataaccggcaaagcagttcataagccttctatgcatgtttttttaacttgcttaaaattaatagccattgtgagcaacagccgacattttacagccttagcagccaataaactcacccgtatctgaagtaagtgctgaactgtctgcagaggcggtgagcgagttctcgtttaccacatgcttgaggaccggccaataccagcatggggtacggggcatccagactaggcagggtgctgcaacatagggcagagcgggcacgcgcattaatgcatccggcgtggaaagctgtccacgtcgcagtcacggtgaatccggctatccggcacttgctatccgcagacacggtatggaaggacggtcctactttccagaagcaagttgattacaaaatagcaaagaatttactttaacaccattttttgaaggaaaaagacagtaggagagatactcatttctggttgatggagttttcccccaagaaattcaaaatgaaagaaataagccttgccctctcagaggtaaactttttcatatctttttaaataattactttaattggaggatacttactacacaatattgtgatggtttttgccacacaccaacatgcatcagccatggggtatgcatgtgtccccccattctgaacctttcctcccacctcccttcacaccctgtccatctgggttgtcccagaatactggcttagggtgccctgcttcatgcatcgaacttgcactggtatcttttttgcatatggtaatgtacacgtttcaatgctattatctcaaatcatcccacccttgccttctcccactaagtccaaaagtctgttctgtgtctcctttgctgccctcaatgtaggatcattgttaccatctttctaaattccatacgtatgcatcaatttacagtattcgttcttcctcttcctgacttacttcactctgtataataggctccagctcttatctgttgatttagaacactgatgtggggactttcctggtggtccaatggttcagaatcctccttccaacacagaggatgtgggctcagtccctgtcagggaa

SEQ ID NO: 30309 - DNA, 852 bp, Bovine  19866880840221
actgaattgtatctttagaaatgatttttttttcaagtcagacatcaaaggctgcatattgcagaaagtttattttgagaggcttcagtcaaaacagtttggaaactatgaaatgagtcattttttcttaaagaaatgtaactttgtctattcccactgcatttttggtttggtaggagacatctttattccgcaggattttaaaagcatgtttaagattccataggtttagtattacatcactaatggtttctaatgagatccaggcaatagcaagaggggagaaaagaacagcacgaaaactgaattctacaacatcaagtaccatgtgaaacatggaaaagtccatgctttatctatggctgaagccatctggcaaaaaaaaaaaaaaaaaagggcgggggggtgtgggggaggattcacattctatcaaccagatgtagatgacaagatacctaatgtttgacaatttggaatcagtcatctaaagggctggattttttacttttcaagcagatgtgtgctgccctgtaaaatctgtgaaacatgcaaatatctattctgtattcattctactgagtgcttgctgttgctgtttagtctctaagtcgtgttcaactccttgtgacctcgtggactgcagcctgccaggctcctccattcatgggatttcccaggtaagaatactggaatggattgccatttccttttccaggggatcttcctgaccagggatcgaacccatgtctcctttactgctgagccatctgggaagcatattgagtgcttaagtctttagttacttgtttgattttgtcctcataaacaccttttatgtaagtattataccaa

SEQ ID NO: 30310 - DNA, 874 bp, Bovine  19866880890992
tgatttatatataatgaatcctactaagtcgcttcagtcatgtacagctctttgagaccctctggattgtagcgcactaggctcctctgaccatggaattctccatgcaagaatactggagcgggtcgccacgcccacctccagtggatcttcagcacccagggtttgaacccatgtttcttatgtctgctgcattggccggcaggttctttaccactagcaccacatgggaaggcccttatgtataataatgggggtgcaaataatattcttgctaccaatcatgctgctagcctttgactgacattgctaattaaacgtagcattctttctcatgccttcagaattcttttcaatgcagtattctaggcagctgaagctgatagatgagaattgacagacaagtgagaacctggtgtaggacaaaagtcacagggtctgtacagtatataagacctataagtaaaattttgaaaaccccttcaaattttaatttcctcatctgtaaaaaaaaaaaaaaggcatggcttggaagttataagaactaaatgaaataatataaataacttagcacagagcctgtagaagttcaatacatattagttccctcctcttgtaaccttaatttttttttttttttatgaagatgatatatgttacttttagctcatgtcttttctatgagaacaacacttcatctggaacaaaatgtacattcgatgcagtacagttgtctatattttgactgtcagttttagtcatgtctgtcattgtttgttttccaacatgaaaagaaaggtttaggatagtagtcacattggaaaacaaagacaataagattaaaattccctcaaatcagctttggagccacaaa

SEQ ID NO: 30311 - DNA, 769 bp, Bovine  19866881001304
cttatatcgttgtacactcatgattgaggtcatttaatccattctgacactttttctatagaacattcactggagttctccaggcagctactagccgttggtatagtaaaatactagtcagtatttttatttctgaagcaccccaggattctgaattggattgtaggaaacattatttgtagctggaattctaggtactctcccaagagtcttggtattttataatctttatttaatctttatttctgcacctagacactgggggtcagtatttattcataaatgcctctccatttgactgtaagcctagctctggctacttacaaaaggtgatgtctagagagtcctggagttgattgtgggatttctttctctgattatgtaactacagagcccagcctaggtaaacataaaatgtaaatataaacattgtggatccctgtaggactgtaaccagagaaggaggcagacagttttcaatctgaaatacaaactaacaccagatccttttcatttctggagacttgtctggcaacattggtcctatgggtgcactcaaatgctcaggcagaatttggccatcacccttaactttccttctgattacttattttttgttgattctctctcctcctagctgtcaaattcatctctgtccccaccactcacacccttgagtcacatctctactttttctgtcattatgagactcacatgctgccttctgcactaagaagggcatttttctctctctagacatttaagcagt

SEQ ID NO: 30312 - DNA, 3366 bp, Bovine  19866881007942
ttggagtcggaacggaatggagactgagcggaatgttaagcgggtggtggtttggtcaggatgctgcgaaagggctggctatgtgaaccggaggtggtgacaagagccctgatctggtgacgtcctagcctgccaggctcctttttctttctttctctctctctcccctcccctgcactctttttgttggcccccagctgggcatccagacatggccccagaggcagcgagttacagcagaagactggaattaggaccctggtagctatggatttcaatcctagctcctcagactggctcttggcaaattgggccagttccttaaccttcctgagcctcagcctctttttctgtaaagtgggcttaacatccactgcacagagtgaagtgaagactaaatgaggagccatcaaccaggctggtacctggaactaagcacacagtaaacactggtttttctcccagtttacccagaggaaaaccgtcaccctagccttgattgtgctttggatgttaggcaactgcttcctctgtctgctaagagggagtggccttatgttctttataatgtaaactttctgcttccaaccctggttgggactggagcgggcatcccagggtaagagtgtaatcttcccccctaagtctctatacacttgtacaggtgtgtgcgtgccaagtcacttcagttgtgtctgactctgtgcgatcctgtggactgtagcccgccaggctcctctgtccatggggcttctccaggcaagagtactggagtgggttgccctgaccttctgcaggagatctttccaactcagggatcaaaccagcatctcttacatctcctgcattggcaggcaagttctttaccactagtgccacctgggagcacacacctgatcatgtatggcagttacttatttgtgtgcttatctgcctggagtttctttccctcacatatctgcacactttctgaggacaggcactgtgttacccggtcacagtcagatgctcagggtctagtgccgtgcttggccctggaagggatggatgactctcacccatctgattggcccagagcagaatggtcaagataacccctgccagagctctgttctgtctcctcccacagctgtttctgaactcagatcacgggctgtacttccgtttggcctttggcacagattaccttggattcacatttcctggatctgttgtctctctgaagttgtgggcttctggaggagtggggcatttagaacttcaagagcaggacatgcaccatcgaaagatgatggacaaagatgtggaaatatatatatatatatatatgtatatatgcacacatacaatggaatattattcagtcataaaatggtgaaattatattattttcagtaacatggatggacctaaagattatcatactaagtctgaaataaatcaaagacaaatatcacatatcacaaatatcacttgtatgcggaatctaaaaaaaaaaaaatgacacaatggaaacttatttacaaaacagaaactcactcacagaggtaaggacaaacttatagttaccaaaagggaaagggtggggagggatacatttggagctggggttaacagatacatactattgtatactagtgtataaaccagataaacaaggacttactgtgtagcacagggaactatattcagtaccttgtaataacctataaacgaaaagaatctgaagtatattcagattggtgccagcggtaaagaatcttcccaggtgggtgcagtggtaaagaacctgcctgccaaggcccaagagacttgagtttgatccctgggtcaaggaaagtcccctgccagtaggaaatggcaacccactccagtattcttgcctgggaaaccccatggacagaggagcctggtgggctacaatccacgggtcgcaaagagtcagacacaattgaagctacttagcacacttgcgtgcacagcttgtcactgcaggcctccctgaaagcagagatggtttcagggagaaaccaaaaccaaagaagagagtggttgctctatcctttcttacaaacacccaccaaatcagcataatttccagcaggggctgtccaaacatctccctcacccctgtgaccacggagagttagaaaggctgtgtcacctatccttccttttaaaggaatggtcttctttaaggtcagaactgaaaagaaattgtgggcccaggcagtgaagggtaaggagttggtagtgaaaagagaagcagagtgtttggtgcctcagtcccagaagttcctgggaactctcctgcccacttcacccttttagtacagacgcaaaggctagcccctctgcagcagccttttaaagtgctgtcaataagggatctttcaaggatagttggaatgctcatcaggggaaagatttctgtttctctactgggaggcctcagagacgtctacatttcccagaacttcccagaagagaatcaaggggaaggaaaattactgcttagactgcagttggcagtggctttggggatcagctccccgccccccaggccctggcttggtgcctctatggggaagcatctttaacttccattgccaggggtgttttgcttctagtgagtggaggaggagataggagaggaaataaaagtacaaaaatgaaaaacaaagaattcctgaaggtctgataagttgttcagctatgcaccaaaacataaatatttggccaaattagttactccaaatgctttatatttctaaaattgagccatagttttgttatactttgaagtttttcagctcttgacaatcctgtgcaaatctaaggggagtggggcttggagttcatttccctccccgagatcccagcaaatacttagcttcttttctttgaggcctggtaaaatgattttgttttgttggtcatctctttccaaagggacatgttctgtgtttgtgcagtcactcaagtcagcattttattagtgaacaagcaacaagcaacatgtgctggaaaataatagcttggaactgatgagaaagctctaatgattattaaaatatctgcatcctaatataatctgcagtaatgccgcagcttaatttctgctcaccttttgttgaattcaccttttgagatttgcatgacttcaatcatggagtatctcattactgaaatcgaatttacttatgctatggcatggtagaaatcactgttccctcgggctgaagaatgaacatccataaattgagtgtttatatgatcctcaggctgttggttaatttccttagtgcagtcctattacctgaaaacttgggttcacctcttggggatgtcaaaccaaaagacaca

SEQ ID NO: 30313 - DNA, 762 bp, Bovine  19866881014151
ctatctctctgttttggagagggaccaaaatgtttcattccttttggcactgttttcttcatttaaaaaggatttatacttcaggggttttgactccagaaggaaaaaaaaaagggaaaagagcacatactttggatgtcagattctgaatgttttgaccctttcaaacaagaacccactactctgtagccagtggggtgagagaaccagatcggggatagaacatgtccacatgggcttctaaagtgacaagcaaagagggaaattggcccacctacaataacttgtttaggaaacattaaaaatagcccatccaagaagtagatcttttgtaaatagttttgtttaaatgtaacttaagataatctagctaagcatttccaccacgcccaagctatcagtcaattaaacgtcaaatgtgatggaaacacagctatgggtagttttatgaaattttcattaaaatgaataggagtaaatagaaggttctgaatggtgaatcttagagagccttctctgaaggttctcaaccaggatgagggttggtgggggaacgggtgaggataatttcagaatgtcctgagtagcacaattcacactatcagcctggatagtttgaaaaaactctccagccaattctgattgtacttggcaacccttctccccagttatgagtccccagggaggcagaataatacccagaagtatcaatcgtgtcagtgaacattcctgtcttcaattaactgaattcaattcagcatt

SEQ ID NO: 30314 - DNA, 1126 bp, Bovine  19866881026005
gtttctctaggaaggtttctcatcagagaaggcaatggcaccccactccagtactcttgcctggaaaatcccatggatggaggagcctggtgggccgcagtccatggggtcgctacgagttggacaagactcagcgacttcactttcacttttcactttcctgaattggagaaggaaatggcaacccactccagtgttcttgcctggagaatcccagggatgggggagcctcatgggctaccgtccatggggtcgcacagagttggacacgactgaagcgatttagcagcagcaggaaggtttctcagagtgtgtgtgtgtgggtggattgtgtgtgtctgtgtgtctgtgttaagtctgctcatatatgatggaaagggaatatgtgcagggcattgtgcagagggtatgagcaaggtagaagagtagcatgggaattgctcgctgtggccaccttcgggtcgttgggcaagtctatacaacccaaggtttgtgtaaccacacacatgatatattctcaacctcattcctatttttcttatttggatgtcattaattttttatagtttgttatgaatgcattctaaaaattattctgttttttatgtcatgcaatgcttattttctttgtttaatgcaccaaggggttaaccatacatactgtattttttccttaatgttttacagcactatataaacaagcatttccacatggaaaagggtctctccaacacagaagacacatggtctcagccatcagtcgcccaggttccaacatcaaacccaccctccctccgatacctcagggccgcaagtagaccagtactcgatgtttgatcttaatgtggaaaatcctctctgatcatgtctggtccctctgtcttacctggccgtgcatcctggctattcctcactcaaccaactgcctacaaaagaaggttctatgtgcccttatcctctcaatcagcttcttttgtgattctctgaatagtgtctatcttttttgaaatgtaagttattcttagcttttattaacgtaatttcagtttttcccatagctatgaatgactcttccagctgcttcctgctctgaaatatcagaggcaaaaatctcctaagatatttg

SEQ ID NO: 30315 - DNA, 1308 bp, Bovine  19866881135746
tggttcctttaatttggttttctccaatagggcacatttgcatttactgacttgtggctttttagaatagcaaatgcatctctctcttctctgtgtttcattaaatgactaggcggtctctaagctacactaacattagccagtactcctgagattcagaggcttgtccatctagctgggtggtttcttttcctccacccttcctcccccattatttttcattttatatccttctggtcattgggcctcagaaatgagggcgtgtgtgtttttctgtgggcttcccaaatggcgctagtggtaaagaacctgcctgccaatgcagcagacataagagacacgggcttaatccctggatcgggaagatcccctggaggagggcatggcaacctacttcagtattcttgcctggagaatccccatagggagaggagcctggcaggctacagtctataggggtgcacagagttggacatgactgaagtgacttagcacacacgtacacacgtgtgtaggtgtgtacaacatacaaatgtaatgggatagggagataagaggacaaagagtgtatgcaatcttgcttaggataaaaaaagactgctttggtccacagctgaagttagtaaaggcatagattttttttttattgttttacaatttagtgttttattaggctgtcactgcatggcacttaatatttggtgttagtgatgtgtgttaccaagtggatcccccctcttatccaacagtggggaggggcaattctgagcagaaggtctgtgactcctgtggtcacatggcccctggactccagcctgagcctgggggagcagcagggacggagaccagcccagctggcaactcacattccagagtgacacagctgaatgatcaaagggagaattctccatactctagcagagaagccaagacatcggggctgatctaacacaccctctgtggttggatgttttctttgctccagtgttttgcaactacgattaaggcagatcaggaatcactcgctggaatgaattacaagtagagagcaaaaggtttcccacaagaaactctgaaaattagacaggattccccaaaagacaagaaggctacaaaacaattccatgatgcactggaattaccaacatgcaagataataattttcaatcaaatcagtttgcatccacattgtcctttggattcatttaagtaagtttcttagggttggaggatctaaatccgtgcctgtggacagcatcttttgcctttttagtaatgtcttttaaaaagaattgttctcctctacat

SEQ ID NO: 30316 - DNA, 1332 bp, Bovine  19866881166108
aaaaatgccttgaactatacaattaggatgagcttccatgctaaacactgacacactgaaatgaacatgtaatccaagtgggataaataatttatcagtgcttattgaggccccgggaaaatgaaagcttgatctttatcatcacaaattaaaatagcagccatggcttccagggccccgcgttttatacaaggtggcactctacttgactgccgagacaggaccaggggaaaacatatttgatttagactttttctggctcatgacttgtagagcaagtttcttcacagctggtgatacattcagagtccgattgctagacatggaccaaatatcccattccagtaaccagagatccacgtcccccttaggggtggaacgttctgtgtggaggtggttctttcctgctctttttctcttgccttgctgagtgcctttgggcagtttccaagtttaatgagtggagggggagagaatgcaaagatagaaaagtgacgtcatatagacgggtctcacagtctataacatgacaacgtttgtattttgcttgggtccaagcagattattttttcatatcttcctcatatctcctttatccacagacctttcttccttactttttcccttattttattttaatattgcactgcaactttttctccccagtgattctgtcttaaaacattcataacagtaagcatacgaaggacattttggtaagctgggcaaatcttcttttccacgtgtagaaataaagtttgtttttctgtgattggatattaatacatgtgtcatagctgtccctgtggctcagctagtaaaaaatccaccctgcaatgcgggagacctgggttcgatccctgagctgggaagatcccatggagaaaggaaaggctacccactctagtattctggcctggagaatttcgtggactgtatagtccatggggtcgcaaatagttggacgcaactgagtgaattccactttcaatcatataaaagaaccagtttttgattttattaattttctcaatttttttctattccattgatttccaaattgatctttattattttgttctgcttactttaagcttaatttactcttggttttctaacttcttaaggtagaaagttcaaatcatttatgtaaagccactcatcttttcgtgctattaattgaatatcccagcattttttgctatggtttcttttcttttttttttcattccaaaatgttttctaatatctcttttggatgttttcgaatccgaagtatttcaagtttatctccaaatatttatgtcatttttaaaattagttcacattaga

SEQ ID NO: 30317 - DNA, 1715 bp, Bovine  19866881177211
atgcttaatttatgaagaaatctggaggattaaagagcatcaaatgtttttaaaatgtttttgacacctgcccctctcggttctttgtacaacttggtttctatgtaccactctactctccctcagtaaaatgattgagcatgagggcttaaggttggggatttcagagcttgcctgaaacttgccccgattccatcatttgaccccactatgccttagttcatccataaaaggggatcgctagtaggatccatttcatagagctgccatgaggttaaataagggaatatatgtaaaacgtttagagaaacgccttgcataaggaaaaactcagtcaatattacctgtaaccattgttgatgctgtaattattaggaccccttcattcatggagcctgcctagtggatgagacagactgtagtgcaaagctggagaaatgagcgtaatagcagtatgctatggatgcaaggcagcagacatctttattcaccaccttcgtcacctcctccatggagtcttcagttcgtcactgttccgacatacacagaactttacaggcataattcaaagacttccctggtgacacagtggatgagaatcacctgccagtgcaggggacatgggtttgatccctggtgcgggaagatgccacatgtcacggagcaacaaaggctgcgtggccccactgccgagcctgcgtgccacctgcagccctcacgccgagagccctgccagcctgtgtgccaccactcctgcagctctcacgcgagagccctgctcctcaacaagggaagccactgcggtggcaagcctgtgtatcacagccgagagtagccctgctcactgcaaccagtgaaagccctcacaaagcaatgaagacccagagcagccaaaaataaatacattaaaaaattataaataaaaataatacccaaggtttcatctgaggagcacacagcctaatgtgtctcatgatggtcccatgatgctttgattaaagcacatgtttgagaagccatatcacactgttggctcaaattgagcttttggttaaataagacccccagagccattttacaccaactgctgccaagttacatgttccccatcttgtatttttataattcatttttggaactaaaaacaagaccttgcatttatccttattacatgccatgttgctggttttggcccagcactgcagcacatcaagataatgaatcttgattctgtcagtgatcttatatctcatttctagcccctccagacttgtgtcacaagcacatttgatcagcatacttattacatcctcatgcaagacaccaataaaaatgctgaccaagacaaggctaagagaatagcccaatatttctggaattgcagaacatacttaaatgtgtccactaatcatctggggtataattgattagacagctttgagctcattgagtagtacccctatttcactattttgttcaaaaatgtcctgatgaggacctcccaggtggcactagtggtaagaacctgcctgccaacgcaggagatgtaagagatgtgcgttcgatccctgagttgggaagatctcctggaggaggaaatggctatccactccagtattcttgcctggaaaatcccatggacagaagagcctggtgggctacagtccacagtgtagcaaagagttgggcatactgtggcacttagcatgcacgcc

SEQ ID NO: 30318 - DNA, 1181 bp, Bovine  19866881183689
tgcagctgcacatgtgccggtgacttcgagacagattgtgatgtccagcaaacattatcctcactagatgggctccacagcaagattttggctgtggtcctggctgctgccaggtctcatttgttcctgatcgatttctaagcctggttctaaagtctgtgaaatacacaatatccttttattaaatttttttttttcacttaaatcaaccacatctgtttcagttgtttgaaactataaaaccctgactaatacaactggtgagacaagtttttactatgatggctgggactgctagccatctgccaattttctccatttcatcttttggttgtagaactcaggatttcagctgcatccgcagcagcatcacgtcttgatcttaggtcccgaactgaaaaagtgaaagtcactcagtcgtgtctgactatatagtccatggaattctccaggccagaaaactggagtgggtagtccttcccttcgccaggggatcttccagggatcgaacccaggtctcccacattgcaggcggattccttaccagctgagagccataagggaagcccaataatattggagtgagtagcctatcctgtctccagtggatcttcctgacccaggaatccagccagggtcacctgcattgcagatagattctttaccgactgagctaccagggaagccaaaaaaagaaaaaaaggatgtatgctagtgctaccatctatgttttctgggtcagttcaatcgattgacttttcccttcgttatgtatttcccagcttttttgcatacctggtaatttttgcttggatggtaaacactgtgaattttatcttgttaggtgctgaataattttgtattcctataaatatgagttctgttacaggatgtgattaagttacttggtgtgttagtctcttgatgctgctgtaataaattacctcaaacgtagtggctcagaacactaaaaatttattctttaagccagaagtctgaaaccaaagtgtcagtggggacagctccaggggctccggggaagatttcatctctcgcctcttccggcttctgtcttgcctcttccggcttcggtggagcccagcatcccttgaccatgtcactccaatctcagccagttgttttcacatcgcccttgcctctgtgggctctactcccgcctc

SEQ ID NO: 30319 - DNA, 683 bp, Bovine  19866881218075
ctatattgtagatgagtaaattgcagctctgtaagtgtcaaaagcctagtaccttatgctttattagtctcttaaaactggctgagttaacagcttctcagggttatgtttcttcatttttaaattgcaacttcattatctccttcaaagcattaatatttacttccattgggacatcagagaaatataaggaagtctgagctactggagaagagtgtagaaaaacagaaagtagatttttttttttcctctcagtcttcttcttgctttggtgaatggacctgaattgtcagaggattaaaaactcaattcctctgagaggattggcattgaatggccctgtgttagaaagcttttaaaagaaaaaggggctggtccagtgagatgattcctgctgctgctaagtcgcttcagtcgtgtccgactctgtgcgaccccatagacggcagcccaccagtgagatgattagacctcagtgaaaatgagaggttttaagctttaataacttcaattatcataggcattaattttttatgtattgaatatacaggctttcctatgaatagttagaaacactgagaccttactattattacattattgattacacaattattacataattacataatcattacataattattatcactattattacacaagtttaaggatggaggcag

SEQ ID NO: 30320 - DNA, 1001 bp, Bovine  19866881300869
cagctccagaaggagccaagcttcagggcatgtaatccagccagttttgctttctttttttttttaaagtaaaattcttgatatgaattgaagtattctctataattgatcaagataaagagatatgccgtaacttcataccaaaacttcaacagtggtgagtaataatttaagactccaagctttactgaggattgacagttttaaaagctaaattttaccagattcactagattttactatgtctgtaaggaatagtcttggttttaagttgcagagaagaaattattgaaaggattccgggtaagtcatagatgattcagaaagacggaaacatcagacttggaaagtgagcaggaatgaacaatgttagggatcaaggcccaagtcactccaggatcactcttcaaggacagttttctgaagagaccactactgttgctgctacacacagaaccccacgtctcgctctgctgccggcagaaatggatgttgaccgtgtcatggccactgccactgactcaggtgactgacagctaccactactgctgatgccacgtcacaagactccccatcacccctgcactcgtcccgggctccctgattagttttgagtaggtgcatccgtgacccagctgaggctgggtcaccacagagtgagcaggcctggcctttgtgtttttataatgggaaatgggccctgcctccctccccaaggagggggattcccacaaggccacattgtggggaattcccttaacacagcaagagacgtagaagctaggtggacaaaaaaatgacacgtgtcactcatgtatcactattgtattttcctttaaaagtgactgggttttctactgatacaacaaaaagacatagcctcttgcttcccttcctttctgaatatattaaattcattggaaaaaatcaaagtagcttcttaaaagctattttagacaacttcatcagtcactgtattaccaccacacgttaggtgtttt

SEQ ID NO: 30321 - DNA, 1193 bp, Bovine  19866881330710
actgagtgactgagcaacaagcacaaaatgaatcaatgaataaggcctgtcatccatttcaactataatctactttcttaaagagattggaccctctttgcttttgaacagcttaaaacattttctagctgccaagttaatatggctgtttcatatattataatcaccttcaaaccatgtatatacttaacaccctaagctattattcagctttcatagcagaagaggcaagaggaaaacctacaaaagggcaggtgttgaagccatcctcaaggactgtcactgtataatcaggcccaccctggttggagtacaagcatcagggtcttcgttcttccaataactctttctcttacaacaggagaaagtatatgcatatgataatgccagtatatgtatattatgatgttctgacaaaacaaaatgtaggaaaaacagcatgctataagatagtgatgataacaaccatctttgctagacaagcattagaaagtcttgccccctctgtcttttccagactgtaagtaaaatgtgcttctgatttgttgtgcagggcagcatttggcaaggagtcggaagttcttattgggaacctgggtgataaattaatccctccacaagacatcctctgtgacgtcagcgacctcaaagccttggccaacatgcacgagagcttggaatggttagcaggccgaacaaagtcagctttctccagtctttctacgtcccagagtaagtattggtggggtggatcttgtggggacagctgagaaactaggctgagtacattcatttgaaatgagagagtgtctacacgtctccgtatgggcacatgtccaaactgtcagaagatccgtgcaaggattcttcttgtgctgagcctctggtacttttggggttctgtgaaatgaagaaatcttgacttctgtgtgttggggcatgggaagtcaaaaaaggtccatgttagcatagcttgacattaaaccctagaaacccagaatcatgtaagatagaaacaccatgtctcaagaacagaaagcagtatattttgtcctccttatgatttctcaaggggagaagctatgtcttggagctccaagttgtgtatttggttgatgttttcattttaattgatagaaaagaaatgaaaagtatctaaaaagacaattatattgatagaaatggttaaggtg

SEQ ID NO: 30322 - DNA, 1109 bp, Bovine  19866881400192
tcattggctttatgacttcccctcaaaaggcttgttattgtcctttctatcagggttacctctctaatgttgtacttttattggcaaatcatcttaaagggagaataacagctaatttgggcatccctggtggcttagcagtaaagaatctgcctgcaatgcgggagacttctaggagatacaggttcagtcctggggttgagaggatcccttggagaaggaaacggcaacccactccagtattcttgcctgggaaatcccatggacagagaaccgtggcaggctacaatccttggggtcgaaaagatcagacatagccgagcgagtaaacaacaacaacaaaaagctaaattaggtcacacagtcattagaaatcagttgcattcaaggtatccaggctttcttttttgtttttttatgacggtttgtttttaaagtagattttgtgtggagatgtaacacatgcaatgaaaacaataaaaatgaaaatatgtattaatgaggaagatatcctcttgttatattcatatcaaaaaaattaattgaaggaatctacaaatcagtgagtgaaagtgatagtcttgactcaaagattgtccttaaaacctcctgataagaacattatcatcactgagtttgttatctatgtataaataaagctggtaagagacaccttccataaaggaaacgattgaactgactctcagataggaagacattaaagtcaaggaagagagtaaaagctaaagccatggagtggaaatggttactgggtttagccatctgctttggtctttcctgttccacatgtagctatacagtttacataaaaatatctctccagaggatcagaaagaacagatttatggaaccagatgtgagttagcatttctacaggtgtggctctgcagctgaaagaacatgttgtaccagggatggagtttcttattatgtaatcaatataaattacctctagacttttacagaggttgataaagcaaacatgtgtcatttggactggccttctgatatataaagagaacctgctctacttggggcacaacgtgaaaaaatgcaccatttagtatttatgaaagacttggtagcaa

SEQ ID NO: 30323 - DNA, 1350 bp, Bovine  19866881497829
tgaagatttagaggaacacagaatccacatcccccacatatgataattttccaaacttatagtcagccttacagctgccagcctaggtacatgaaggctgcttctgtctcccatggccagtctccttactgtaccaaaagcagggctttcactgtgtttgtgttgacgctcagctctgcagagggttaaacaactagactctaggacaaggaaatgctccttaaataaataatgaatgagcatactgttatacactcatttctggattgcaatggtcctgcagcagacggcatgagcttttgaacctatcaactcataaacacgtgaaatatgactacataccttttcgtccactttaatcttcttctgatccaattctgttaatcgaagtagcataaaaatgacgaaggaccaatagtcaggtttttcctgtttaaaatgtcaagagggttattttgttaccttccttttcccaaattaaaaagcagtagcagtctgctttcataagccaaggccttttacccacgaatgctgtcattcacacacacacacactaggtcttcacattttcacaattgcagtcccctgatattaacaactcaaatgcagactctgccttgtaacttataaagcttttcaaatgtgtgatcttgttaatctccctgtgagataggcaggacaaacctgattatcttcatctctaaagagaaaaacacctaaggctcagggaggtggagtatttcatctgatgttccatggccagtgactgaaaccctatcttctaacttaaaggagtttcattattataatagtagcagtccttatgattaattcctcattatttctttgtgttgttttatattacttttgtatcattaattatgattgttttacaataataaaatgatattcatttataggacagttcccttaatactctatcatctgctgtgttaggactatctgctttttagaaatataattagttacattgtatcaagaagctacgtctctttgaagggaaagatattaagtgggtgatgcattttgtagataagaatacacatgaaatgaatatacaatggcatcttttgtgtacttcaaagtgcatatgtgggaggggcttataaataaatgaggtaacattgtgaaagggtttgggctatttatttatgcaaacacctggatgctctttatgggtctggaattgggagggatggccactttaaatcccttcctttccaggggacgcttttacagtgtctgccactattcccataccaagcgttgtttttactttcagactgtattttcatttttcatttgattttttgcctgcctagttagttt

SEQ ID NO: 30324 - DNA, 781 bp, Bovine  19866881579198
ggtgcagaggtggaactctggtcaattcacaacgctttagaggtataattttgaaaaagttaaagtcacaactctaatagatacttttttgtaaggacgctgcgtaacgacttttaaggaatcacatgtgctaatgaaaaatgaagggtgaggcaagaggctaacggaaatggggaagagaggaggggagtcccggagcagtaaggaagaggcactcttagaggcaaggagccctaggaatggggctcagccgcaggctggtgaaggggttctgaccgctggagaaggaactgaggggattaggggtagggggaaggcacacctcaaaattcagcatttcggattctgaggactcctcggattccacttcgccctcgccctcaccctcttccaggtcgtagtaatctctgtccacgtctgactcctgatagcggtgaatgaggtgctggagcaggtaggaggaggctttgcataaagtatttttcggtctctgacccatgggaaaaggagaccagcaagagtgacgatccttttctgagtgcagcacttttgactgcgctccagttcgtgaaatgctcttgcctccctggagagaggaaggcttcggaaacttgggctctctcccggaggtcgccatcttgtttacctgagttgcctaggagacggacgctagggcggaggtgccgcaagggattttgggggctgtagtctctgcccctcgtgcgttctccctttcagcttgctttgccactgtagcgcaacttagttttctgttcgcttg

SEQ ID NO: 30325 - DNA, 1005 bp, Bovine  19866881921189
tcgcagatacaagggaattcaaagtgatttctacaaaatgattgactcaaagaagccacactcagaatctcaggcttgcccaggtactctctctcgggtcagggtttcttatcttctcccttttcctactgtgtttatggcctgcatgctctgatctttccgtgtttatccagcttgttaggactgggagctttccccataaaaaccattacatactatatgatctcaatcaggatgtagaaatcctgtaccacctacctctatacacacatatacacgcacaccagagtataagacatttcgttcagtgggaggagagcattttaaagtctttaaacacagattataactgttgttggactgcacaaagatacagagtaattaaaaagctcttcaaagaatggaataagtccattaaatccagttaaataatttttcagaaacactgcaagaaacacttcttgctgtttcattttctcacaatgaactgaaggaagaatatctcattttccaaatggaactttatggagttttcaataagacccctcagcacttatctacatctttaattagttctataatatactgatgatatcaagcctaattaaatttatatagataaggagcaatgaaattctaaccaagtgagctggaaagcatatattaagtagtaaatttaatggttcaagctgataactataattttatatcaaaaaattaaattcaatttacttgttgtattcaaattgattttgagtgtgcaaattattggaaaaatctcgtgatgatatcagtaaaattgctaatccagcctgtttaaatatcagttattaatgtctgcatttgcaaataagccacacacatttgcatttttactgcatatagtaaaaaattatctaaaccttatgtcattttattaagaatactaagtgattcttcttttggcttcatgcataaattaaggaggcaaagaaagactacgggtctaaagaagagagagtcagc

SEQ ID NO: 30326 - DNA, 1078 bp, Bovine  19866881998540
aagctggttggtcgtgagatgctgtggattactcttttataattggaatactggaaacaaaaatatgtgccttttcaagaattcctgggctacagatgcggactaacaacttgtagaaagtctttattttgtcacggcattttgttcaaccagagcaactgctttaagggcatccagagatgagacaagaaagatagtatctccattcagcgccaacaaagccctcgaggaggaatggggataacctacttctttgttgtgcctaaaatattcacggcaaagtgtctaaagccaggatgctaaaactatagatatgaccattgttctgcctcggtgccctggtctaggatgtgaagagcaaaaagtctaactccaggccctctttgccatcaactgatcacagacacatgttgtaattcattgagatgatgtttcaacttctttgagcttttccgccaggggaaaaacactccagaaattcaattattattgaatttataatcctataacatattttatccatcatctcctgctttttgattatctgaacccgatttctttttataattcaaagtgtttcagtgaagaaatcaagttgccctggtctccttctgtgaggaaccattctactgaaacccttttcagtggctctccctaggatccagctcagggcaatgtgggagcagcttgtggtctttgattgagaaaacttggtcagaaccactgatatctccttcctttggtctttatccttgctgcctttcatctctccccttgttactatattcatgtttcaaatgagaattaaattccactgccgtgccccctaatttgactcacttttcaataatgtcaaccaactatcaaacaaaaaaacggggaaaccaggcactgggtgtccttttgcgtgttacactaagaagaaatagaattaacaattgcccacatcctctttatgtttatactaggtacttctattggcagttcaatcatcctaaaatgtaagcagatcatttctatttagagataggacaactaaggtctccaaagatcaagaaagactggcggtatacagcta

SEQ ID NO: 30327 - DNA, 1590 bp, Bovine  19866880342272
ccatggactgcagcccaccaagctcctctgtccatgggattttccaggcaagagtactggagtgggctgccatcgccttctccgtgtttgttaggattgtagtatttctcatcctgaaatgcaagctgctctgctggccagcgtacggtgagcatgtgctgcttgtccagctcatcccccatcccaccagcatcgaacatctttccaggggctcagacacggggaccagtccagacagtgtccaattccagagttgtttttcctgttgcaatcatgcgcttgctccctcgttcagagaagaaaaacaatacaagggagtaggttctcgtaattgccgtggaggctgcaaatgtggagcgtttctgtgccagctggagaggagaagggtttggggaagggggtgaatgccaagtctccgcccgtctgggcttctcagttgcagatcaacctcagatggagggtaggaggagctgtgtgaaggcctccgggacaatctggggactggtctgtgatcagggaaggggtgggcaacgtgaaagccttgttgggctttcgggctttgcatacatccatccaacaacggtactggtttttcatagcccttttcagtcgcttaacaaacatgaagcacttagtgccaggcattgcgttagtatcccatttcatcatcagaattacccctggaggctggtattaccctcattttataggtgagaaaataggttcagagatgtttggttcaaaggtcacatagctgttaaatgccagaatggggactgaaacagaggctgtgcagggtccaaaccttactcgcgctcactcaagggtacatctcctcctcaagacgcggccgtgggggctggcgctctttcccatggaagatcagattgttattctgtgtgttttttcctcctggtgttgagaagccccgtctgcccaagtcctctgataatcccttcatctttggagagggaagcacgaattccagtgtgaactatggctctgtatttgtccgcaaactgccaagattttaaaaacatcccccttactttcacctctccgcggaagaaacatttgttaaagacgttgggaaatttacagatgggcagtaaaaggagagatgagtcctttttgagggacagaagcataagagagcaagccctggccttggggcagtggagaatatgttggtggttttatgggccagaaaaggggaggggggggatttttaggcaaaggggcctaagacaaagacatcagatgtatctctgtgttcttttatccaccctcccccggcccaatcatcttgaagtaaaagccaactgggattttcaagaacaaactttattttgaattttaaattaactcagagatttaatatgaatggtatgtagtaattcctaacactatgtgccagccaccaccctaaacacttgatgtgccttatctcattcactcctcacgagaacccatttcagaggtgaagaaactgaggcacagactaaataacttggcaataaccattaagtgactgagccaggattcacagccaagccacctggctcccaacgctctgctcttgcccacctg

SEQ ID NO: 30328 - DNA, 1205 bp, Bovine  19866880428177
ccagaatggaaacaacctacccaagaaactagctggaacattagttgtagctgctgctgctgctgctaagtcacttcagtcgtgtccgactctgtgcgaccccatagacggcagcccaccaggctcccctgtccctgggattctccaggcaagaacactggagtgggttgccatttccttctccaatgcatgaaagtgaaaagtgaaaagtgaaagtgaagtcgctcagtagtgtctgactcttagcgaccccacggactgcagcctaccaggctcctccatccgtgggatttccaggcaagagtactggagtggggtgtaattgccttctccgttagttgtagcagaccctatatatttgagacgactgcaattctttgatagtttacatgtgttgctttgacaaaaacaccactagcaaggcacatctcaatcacatcatgcctcctaaaaagcattagtttaaatgagctatttactcaaatcagttgtccagatagaatagaaactattcgtcagagaacactgcaagcagttgctgagctgtcacctgggaacagaaacagcaggtgagggctcagaaaatacacaaaagaaacaccgtcctaaggaccctgggagcatcctatcaacagccctcatcccaatttatttctgggatcgacagagtaacaaagaaacctcaggaaatacaatttagaaatgacctctaatccagcttactttctctaaccttgtggtgtgaaatctcatgccactgaataccttcctactagacttgcttgtttcccatggacaataaataccagaagggcagggtttcttaggaggataaactctgtaggtaatgatatccttatatgtatttttgtgaaacgaggcagcatggaaaaatcaagcaaaagctgaaaaaccaagaagacaggttactaatcttggctggctagtaagacatggtctcagggaagttacataaacctttgtacctcagtttcctcggaggtaaatttgatacactacatggatccaaaggcacatggatcagcagcagtgctggaaataaagtactccgtcattacgcttagtaacactgtaaaacgggctccccaggtggctcggtggtaacctgcctgctaatggaggggagagacacgagtttgattcttgggttgggaagatcctctggagaaggaagtggcactgca

SEQ ID NO: 30329 - DNA, 447 bp, Bovine  19866880542842
atgacaatggtggtggtttactcactaagttgtatctcttgcaacccaatggactatggccttccaggttcctctattcatggggtttcccaggcaggatattggagtgggttgccatttccttcttcaggggatcttcccaacccacagatcggatctgcatctcctgcatcgcaggtagattctttaccactgaaccaccaaaacatgtttttgtccagtcccaaatgcagacttgtggcaaatccaagcttgcagcagcctggctccctgctgttgacagttgggatcgatccatcatggctgcagctgcttaccctgcttttcaggccctgagccttgcggtcttcctccctttcactaccctgtttatatagagtttaataaagactctgccaggataagaaggtgcttttcaggccttcgtcactgcctctccatcatcag

SEQ ID NO: 30330 - DNA, 1555 bp, Bovine  19866880590703
atgatctgtggatctgtgggaatacgggactcctagggttcttttcattagtaacaaattagaaccattctgctcaatttactctcaggtatttctctaacttctctaagtgtttgttaagcactctcacagaagaggaacccagggaagtattaatagcttcagcaaatgttggagaaatgagataccctggccagtcggtgccacggtccagatgaaaggggagatgcctgacgtcatacctgttttcaccatctgtgggccagctttggagaaaaggaaaaagtgagcacacacctctggcacttatgtcttcccagacatccaagttgctacttacttcattttaattagtgcacttgagccactactgggagcaacagttggaggaaataaaagcatttccttctgctttttcatccagcctcaatggtgcccctggtacccactcaacctgcagccatactgtcctccatgtggaagaccctcaacctcctccaatgcgtccatcctatcctagtcttaataccgtctttccaacctgttcattctttgctgtccctctccaggtcataaaaagatcattgctatggtcctcattccaccattaaaaaaggggaaaggggtctggaggctgcatccagggcatattcagaaactgttcaagaaccatcacataggctgctgacggagagagtgagaaggtgcagaatgcggtagtagcagggcctccgtggtccaggagtaaggtggtgattacatacgagaaagaaatgtgtggctggtgctgtttatcatctcctcagctgaaaaggaaatgaaggggctaataatttcatttgatggcctcttaaagcaattacttagtactgtcccccatttctgcagaaggattctttaactttttaagtcaataacaaccacaacaaaatcaatggttggaagaagtgtccagaagcatctaatccctttgaaaacacatgagttcttaaaccctaaactttaaaaacactttctatgttaatagctaacacatacctatgtatgtgtatatgtatatagtaactctgttatggttcttactaggttccaagtgctattttaagtttgttctattaaaagtcattcatttaggataaagaaggtgtagtacatatatacagtggactattactcagccatataaataaggaaataatgccattttcagccacatggatggacctagagattgttatactgagtgaagtaagtcagacggaaagaaaatatcatatgatattactgatatgtggaatctaagaaaggtctacgaatgaactcaactaccaaacagaagtagagttacacatatagaaaataaacttgtggttaccaggggggaagaggtggagggataaattggaaggttgggattgatatagacactacacaatataaaaaagataactaataagggcctactaaatggggggactctactcaatactctgtagtggcctatatggggaaaagaatctaataaacagtggatatatgtatatgcataactgat

SEQ ID NO: 30331 - DNA, 1205 bp, Bovine  19866880598513
ttttggaattggtacggtgatgagaggcttgttcataagggccgacagagcgtagaaagagattggggccatgcacatgaagtcagtgaagatcaacacagccatccttttggcaattctggtatctttgtcccctgggttgtagtggggatttcggactgtgatgtagatcttcacgtaacaggcacagacgatgataaaggcaatgatgttgagtaacagaacaaggataatgtacgccagggcaagaggagtctcggtgtccatgggcaggcagatgctgaccttggcatagctgcttattcccaccaaagggagcagggcgagcaggaagcagcaaacccagccccccagcatgatgacgtaggcgtgccagaggcggatcttgcggtccaggcgcatggcgaaggtgatggcgtgccagcgctccaaggtgatgaccgtcagcgtgtacacagacaactcgctggcaaagacggtgaagaagccagctgtgttgcagccagggcctgtctgccagtcaatggcatggttgtagtactcagactgagtgtagaggtctacggaggcgatgaggagcagatacaaccccatgcaaaagtctgcaaaggccaggttgcacatgaggaagcgtgggacggtcagcttgtagtggctcgtgaggaggatgaccaggacgaagacgttgcccaggagagccagcagactcacaaaccacaccacaattctcaggaacttgtagcccatgatgtcctcacaggggttgaactcatccgacttgggggtacacaccatgtcctcactgcccccacacacggtatagtcgtaatggctgtcaaaggcctgcagggtctcctcctgggggtttttgagctgttggccaaaaccgatgatctcatcttcttgctcctcaaagaagacatagtaatgagagttgctgtgggtatcttggaacttggagttctccttgtacccagcactgccatcacccagatcctcatattcctggtagaagggaccattcaaagcacttgcggattttctctgacgcaggccccgaatactgctctcgttacacattaaagactgaaggattctgcaaggcagtggatagaaagtcaccacttgttggaaacccactaatggtccccaccacacttagcaaaatgtgcagactacatagtgtgatacacaggattctacag

SEQ ID NO: 30332 - DNA, 1046 bp, Bovine  19866880604587
tcatcctctgtcgtccccttgtcctcctgccttcaatctttcccagcatcagggtcttttccaatgagtctgttcttcgcatcaggtggccaaagtattggagtttcagcttcagcatcagtccttccaatgactattcaggattgatttcctttaggatggaccggttggatctccttgcagtgataagttcatctcaccggaaggagttcacctgcattcctatatgctgagtcgcttcagttgtgtgggactcttggcaaccctatggactgtagcccgccaggctcctatgtccatgggatcctcccagcaagactactggagtgggttgccatgccctcctccaggggatcttcctggcccagggattgaacttgtgtctcttatagttcctgcgttggcaggtgggttctttcccactcacaccacctgggaagccctagtcttgtggaaaaccccaaatctagaaggaatctcttgttttttttttaaacaggctagttttccttcttttcttttttatttatgtagtctgcgctgcatgtttgctgcagcacagggactctctctagctgtgggcgcagtcttcccgtgtcggcggcttctcttattgcagaccatgggttctagggtgtgcaggtttcagcagttgtggtgggtggtaggcttagttactctgggcacgtgggatcttagttcttggaccgggatcaaacccatgtcccctgcaatggcaggtggattcttaaccactggaccaccagggaagtccctagaatgaatccaaagtggctgttcgcttttctcttgctgcatctctctgccctccttctccctgcagagtaagcacgggccaagcttgctgctcaggtgtgaggcgaagggtaggagggtgaaaggaaacatggggggaagtaccggttaatatttcaagtccattatcctgccacgccaataataaagcacccacatttgtgaatgatttatcttttttataaattggagtggtttcaaggttatcctataataacttccatcctatt

SEQ ID NO: 30333 - DNA, 1698 bp, Bovine  19866880638155
caataacactgatcacaattccatgcctatggaagatcacagagttgaatgagtatgttaatacatgctctgtgcttgattccctttcagcctcagaaaacttacatttcagacagaaacagaagtaaccagttacttacacagcatcttcctctttggctggaagtaggagcaatgacacaaaggctatttgcctccataaacaggattgccaagaagcactgggagagaggttcatgtcagagtgatgtaatcattctttcaatgtctttcattaacagtgtttcattattttctccacaaatgaaatgagcagaacccagtgctatttaggaaaattacataatttttaaaatgttataacattactacagttttagctttgggaaaaatccaatctattttagacatataattcaagaagggaaagcaaagcttacagacttcccagtgtgtttcattcttcttctccataccccatcattcacttttctcctcttaggccctttctgctacagacagacgcacggctccattaactcaaacctcccaggcttaatttgttttggtgtatccaaatcttttactgcctctcaattcagaccatattctcttttgctattcttgaccatttaaaagtatttttcagctccacggatattatgaagttaataactgggatatctgagcgcctactatggtacaaaatgcaccactttaggatctttatgtatattatctcacttaattctcaaaaccatactgctgtaattttatgtatggagaaactgaggccaaaaaggttaaggtcatcaatgtaggagcctgaattaaactgcaaaagtacaagatttgctgcaacaaagaaagcatctttattatgattgttttaatggttaaactttgcaagtttcctagataaaatagtaacaggataaaaaaaattacaaaaaagcaagcttcttaatgattcatttgaaataactataaataaaaatacttgctaattatttaatactttctaaaataacacaaaatatactcaatatgtagtacaggccttaatgatctgattcttttatgcaactatttacaaactctaaagtaaaataaaaatatatagctaaacagtgaaattaaaaaacaaggttgttctcaaataattttatcctaagtaatctattctttggagtagaaatactcacttaatacaatatgttatttatatcaatttttagttacactttgttggtgtggctttagcccaatttaaattcctgtgtgcctagaaattacaactattccttttaaaaagtactaagaatttataacagtttaatattcagactgacatcccaccccaattaaaggtatagaatttaatgatacctctttttgataatggaacttattaacaatgtgaagcattttcctttctcaactctatagttttattcagttatctatataacaattttataaactagtaagcaaagcaagcagcattactttttttaaataacatctttaattaaagtttttgcaaaggtaaaatattaaacttaaaataggtcttagtacatcaaaatactaagttctctaattgtattccaagatggtctttaaaacataatatcccgtatatcacagaagagcaaccttgatctgcaattgtacagaatgaattttacaaacata

SEQ ID NO: 30334 - DNA, 2262 bp, Bovine  19866880671024
ttaaaataatctgttagaaaaacaaccaaacaactaattcctaccatgccaatagatttattctagcaggtagagatctatttgtactctcggacctgtcaagctttttggaagacctcaaaggcaaatggagtgtaaagctcctccagatgatttgcacccacactcagcgtttttcctggctggccccagtaccctcttcatccagcatatgaacagcagggtcccccgggtggacacaaggtctataatagaaaacatagcttcagggtggtttatactaatgctggcttgagttcctggccccatgctcatcctcaccacttaatctgtgaccctgcagagaaggtaaaggcctttgatgtcagactgacatggccttgctttggaaaactgcaatcttgggcatgttactgaaccttctctaagcctcatgtttatcaactcttcaagggaattaacagtacccattttgtagtgttgtgagggtaaatgagatcaattaaggacagtgaatttaactagtccacagcacaataaatgttagcgatcatgataaaaatatgtaaatattatcattatttcagagtccttaagcaaaaaaaggagtgagttgggggggaagcagggagaaacaactgcctttggaagttttatcactatcaaaggaaaggggggagtggagaaaaaaagaagaatgtttgtctcgggctacaattccatgaatctgaatcttcccacaattattgcaaaggcttaggaattacaagagatgtgagagtctgcattcacaaagccaccttgattatcacaaaacagcactagaatcagctacataagggaagtgcgaagtcatgagtacactttgctcaagacaggacacaaaacttcctattaaccctctggtactaagaattgcctttgcaattgcaggctgagtctaagatgttttagtgttccagggcagcaggccccagagagggaggagtgcacccaagtatgtacacagaatgagccacttggacatgagaagaaaaataccagaacttctgtttttgttgactttttaacccatcctttaaacatttctatttttttgtttatattagaaaacatatactaaaaatatctagtatgtttgtaatttagaaatacatttataatatagtatatttataaatatacaaatattagaggttcatgatcaaacctttggagagacatgaccaaacatttagagaaggctggatcagtgcactaggcatattttaaatacttatcatgggtgcacacacacacacacagataccacctcttccctgtctctgtcagagtaggctactgtaatcagaaatatggtcttggttgtcagtcaaaagggaaaggtactttggcaaataagaaggatgtattactctctgaagctctccttttgtttgggcaataattgaatcgtagatgctccagctctctggtgggtgctagcaacctatatcttagccttttcacgttgcatagaacccagttaagcttgacttgatcatcaccccaccttgctctctaggaagttttaaaaccagtcttccacctcttcaaaatgataaaactcatctaaacaaataactgttggacttgctgccagggccaaagattgttcaacctcactaccacaatactggtcttttgatgtctctctcttggctatacacttagtgcccaataaacatatagcaatgctagaaagaggggctgtctcaaaagaccctgaatagccaaagcaatcttgagaaagaagaatggagctggaggaatcaatcctccagacttaagactgtactgcaaagccaccatcatcaagacagttcagtactagaacaaaaacagaaataaaatgtagggtaagggagttagagaaggcgaggttcagagaaagaacaagacgggcactttacaggaacagatcacctttaatgaggcgagaatgcgcagtagtcagattagtgagctgctgcactaacccaagaaaagagtaagtatatataggcacgtatgtggaaagctactgtcttaagggggcctgttcttctccaaggttgttcagagtagttatctcttaaacggctggggcaaggaatttttggagatcggccagaggctggactgtgggagctgggcgtaatcagccttaatgtccaattttttttttcgggttgagagagttctttgttttgcatagaatggtgaggaggacctggaggggag

SEQ ID NO: 30335 - DNA, 970 bp, Bovine  19866880689610
aacaagaactgcagagaagatcttgagcagcatgatcttgtaagaagacaactaactcagcacaagtgccacactgactcgcacccccttttgtgttctttggaccatgcaatttgcagatcacattctgttcccagactgctggaaatcaagtaaggattggtgcgttcatctcagtttttcctcctcatctctgactgccgcaagtgaaaatcggcttgctctaatcagtagaaattattgtaaaactaaataattgcttgtccaattctgcagtgttttcatcggatattcaatacgcccccaaggatcaggaggctggttgataagtgctacagtttaccagaaatgctgcaggggattttaaactgggaaagccagccagagtccaggaggggagcagccggatgaagagagggtgcagccaacttgaacggagatgaactgagtcttggggggaggctgccttctctaaaaccaaggattgtttgtagacttcatcccttagaaataacgaggggcttaaaaatgaaacccccactctgccattggcagtttggaggctgtcttcttatcacagatgatgataatgccacgaagtgttaaccttgggttcagattgcggattctaccttccttctgaagcaaagtggatggggtggggaaatacgtttgcagaagccttaatattcaagaagtgtggacttccgtcagccccatgtatcatataatgttcatggggaacatcagtttaaattgagtctttgaccctgacttatcctgattcctctagaatccacaatctgtaagccagcttgggtaagtcaatcacagatcttggcagggctacatgggtaacctactgcagacgattatttcatatggagggtatatcagtgtgatcagctaaactctctcttccacagaaggatgaatgtaaaagacgaaaaagagtagaaagtcttggagt

SEQ ID NO: 30336 - DNA, 1701 bp, Bovine  19866880750703
tagccctgaagcataccggatgatttaaggaaacttaacttgaaatagtagttaataactcagtgtagttctcctcctaaaagaaaaaacaatttttcttgttcctcaaaataaaaatatcaagtactgtgtgttcttccttaaaccataaaaaatgacaaaaaatagactaaggcagacttaaaaagggaatacaaacttcagaataatttccatagcataatagattaaaatgcaaaactatttaacataaacccatgaggaaatatataaagcaactattttttaaccaatgaattaaaaacctgaaacagctgattcagatggataggtgggagatagatagatgtatgaaataaaacgaaaatgtacaaaggtggatcaataaaatattacattgcacaaaagctcaaaaaagttcaagatgaaataatctgaaaatacaggaattttcttaagaggaagaaaaagctaagatataaagggagctcccaagaaaattatgtctgatttcttatacaaggtttatttatttctgaaaagaatggtgacattattgctataagataatcaaaaattactcttagaaggagataacacttttcattcctccataaaagccagaaaaaaagcaaaccaaatccttgattttcatatagcaaaagaaaatctttatacaaaagctattatacttttatttttatgttcttgcagtctaaaccagagtctattagactatggtcttcaagaacacattttaatcgctatacacactgctcaaatcttgatgcatgccaaaaagaacatcatcaaggtggctttgattttaagagaggcaacaatataaatgtggtgctatgatggcatttaatagaaagaaatgtgaacatttaaaaaaatataaaagcccaatataaagatccccctcatataacagacattttagtccagaaactaattgcacattagagttgttttagccaaatgtggcactccacagaatttaaatgtgctctcagccattcaaatggtctgattatccaaatgaccaccaaaaaaaaaaaaaagagtacatacactgaaaggcacacattttcacacttaaacctagtacttttgtgtaaattttccttagcactgttgattgttttttaataaaaggtgccatcatcatctgtgcaaatctaaacaaatccttttctgaaaccttcacttatttcataataccaagtctgaactattttccttctttgaataaacgttatctttacttcaaaattttgaaagtgggaatccttgcattttcaaaggaatgacatttttaatggaacctaatgaaatgatgttaaataaaatgttaaaagcatgattaacaattcaagtacaataaaagataagcaagtggcattcttacagcaagccactataataaaactaaaacatgctatttgactgtaaaggaacacaatgcagtgatatataagagcacaatttggtatgcagtgttgtttggaccagttttcagaattttcacaggtaaaagaaaagcgcttaccaagtatgttataattgatatgcaatatacacaggtgcaaatataaatggttatttcctgcttcaaaacaaccctactaagtcacactgaaagcagtggttgttcatatttcaatgttataaaaacaggctagtatacaattctat

SEQ ID NO: 30337 - DNA, 1396 bp, Bovine  19866880770493
gaaaaattatcgttatgcctggccagtcttttagaaatttttttttaattttatttatttatttttggctgtcctgggtctctgtagctgtgtatggaccttctctagctgcagcgagctggggtcaccctccagttgcagtactcaggcttctccttgcgttggcttctctgtgttgcagagcgcaggctctagggcaggggctcagtggttgtggcacacaggctcaggggtaccagagcaggtgggatcctccaggaccagggatcgaactcatgtcctctgcagtggcaggtggattcttaaacactgggccaccaaggtagttcttaggttttcaaacgagtcacagaatgggcgagagaccaggaatgacaaagcctgactctgttgctaatactttctaggctttgattttcttgcctgtaaagtgggagaaattctactaaataatctctgacattttttctaactttaatggctaaagaatccaaaccaacccctatgattccaaaccaaacatgaagacatccatttccagaggctcagggctaataacacaccctggagagggcccgtgtgccagccaccatggtttgagcattttatgcccactgttattttgttgagttccagttaaaatcttattatcagggaaaaaagcagagctttccctcttggaagcctcactttgctaggtgttgaatggtttgcacaaaagctttagtgagcaatttctatcttaaatcaaattagtggtgttaaatcactcacctgggaagctacttaacagggatgacgccatccttcacaggtggatccaataagcttatatttaaaatagtgagtaaattaattcaaacctgtggccagaggaactcacttctagtgagtaagccaaaaatctcattcaggtttttctggaacatctagcagaaaacccaaacagactttttggccaacccaacatttttcttaatttctttttctagacttgagtatctgggaccaaagtattttgaggcaagtttccccacctccctacccctgaggctgtaggcaagggcataatgctgatgcaatgtggcaaaaaaggagagaaataatgaaaaacatgcatcggatgcctccttcattcctgccattgtgctggagaccagactgtaggaatgattcaaacatggaaacatccttgttgccctggaggacctgagcctgtagggaaatgacttccatgcaaaagatccctctaccaaaggtagaagagacggtagacacacgggggcctaaagtaaagctcggagagaacccgcttggggtggctttgttggaatgccatacttagcacaaagtaaggacttcgtgtgaaaaaacatcacttgagttttattttaaa

SEQ ID NO: 30338 - DNA, 1051 bp, Bovine  19866880801814
acctgtggcggattcattttgatatttggcaaaactaatacaattatgtaaagtttaaaaataaaataaaattagaaaaaaaaaacactttacaaataacaaatgataaatttataattttgccttcaatttgaccattttattattattttgtttttttttttaattgggagaaacctgacaggaaattactcatagtatcctagttagtgtttatttaaagtgtctggtttaaagtttgccctcaaattaatatgtggaagttatagctttagtctattcacacgatataaaaaagataaagaaagagtatagattgcctaaaaatggcctaaagtgtaatcattaaaataaatgctacaagtcaacagctcattaacttctacttctttctctacttgtgggggagaaacaaacaaaaaaacagagaattctgcctgctactattaaggagttcttggtaaaaaatgtaaaactgtgattttagcagagtgactattttatagaacaggtatctgacaatcatatacattttttcacctcatgaaaaagaacaatcctaaacagatggtcaaattagaaacaaaacaaaattaaacaatgctgattcattttttccagtcacagatatcttttatgtggaaatatcaggttttaatttttctaaaaaaattactgatgacttctaatccaaaatttatacagactaaaaacaaataagaaaggatatggtaatcttttgactataataacaacaaatttaaattcaacactaaagaaatcaatgaaaagacagaaacgtgagtcattttactggcagtaaataaaggggaaaatacaagaaatctgtgctcatatcctgtttccaacacaagttgtgcaatgttgggcaagtcacaatactatgctctcaaactcagtttccagcttatgtaaaaatggcatcatcattacacttgcaatctgaattataatgatctttttaaagatccacgttttatatacgaaaattatttcttaagtgtttttaaccaatacagccatagcttta

SEQ ID NO: 30339 - DNA, 800 bp, Bovine  19866880804857
gcatcactgactcgatggacgtgagtctgagtgaactcctggagttggtgatggacagggaggcctggtgtgctgcgattcatgggctcacaaagagtcggacacgactgagcgactgaactgaactgaactgaactgtgcataatataacaggcttattatgttagagattaagaaagttcttttctgaaatggataatattttaaaatattttaaagtaaaagcattcttaacttatgcatccatgaattaatttatatattaaaatatttagttaaattttagtgattttctgaattatataacttaaaaaaaatcatataacaacttgtggagaggaggagaaaagagggacatgtactagagtaagagagtaggtctatgatactgaatgcaggcatggcaatcttgaaaatatcaaccatccaccctgctctaaccccttttgtttgttagtaaagcagtcatttttgtaagttgttacacgcttctgaagtacagagcttaatgtttaaatcagatttattgtttcatactgctttatgtttatgactgacagaaaacacagtttgaaagacatacattctcgttatgttagtaaggaagagaatttgatgataagtagcttcagtctttcagtcttctggaaattaaatttcgcacattggttagcccaggcgtagataaaatcattgcaaacacactgcctaagatattgtaagacaagtgtaaaaaaaaaaaacaaaaaacctacatcatgatacataccctaagtgataagaaaatatatttgttttca

SEQ ID NO: 30340 - DNA, 918 bp, Bovine  19866880807248
ttactctccgtcccttccaccccttcccacatgctgtctcttcaagatcctactccgcacccccaactctaatatctcctccacgtactttggagagcaagtctgtgttctcaacccctgctctcaacccctcaacctcaggctatctcttcatattcagatttcatatccaagcccaccaaggatccagcagaacaaagacgattctcctacaaagagaaacatccttacagaaggcaacggtgttgttttttttccacagggatttgtctctctgttatatacttatacatgaaagagaagtagtgttaagttcttactaaagctaggaagggtctcaaaggattccagacatgaagtcagcttatattctcctcacctgtttctccttcctctttcctccccttctcttctcctctctccatactttctgacctcagttttctgcagataacttcatctacagatgtgggggcttcctaggtggcgctagtggtaaagaacccaccagctaatgcaggaaacctaagagacataggttcgatccctgagttgggaagatcctctggaggagggcatggcaacccactccagtattcttacctgtagaatccctatgaacagaggagcctgacgggctacagaccatggggtcgcaaagagtcagattcaactcagtgacttagcacaaaacacatagctgtgaggaagacgttgtgtactaccaattagcaaaggaaagttccctcttgttccccttaaaagttcaacttccataaagtaatgagaatttagccatcaataattaagactatccctaggaaacactcccacagaagcaagctgcagtactttctgaataataaagcagattttcccagccacagtattttcttgtacattttcacaatccccaag

SEQ ID NO: 30341 - DNA, 965 bp, Bovine  19866880819321
aatccgcctgccaatgcaggggctagagtttcaatcctgggtccaggaagattccacataccttggggcaactaagcccatgccacaactactgaagccctagtgcagagcttgtgctcccaaacaagagaagccatcagtgagaagccctcaaaccacaatgaagagaaagcccataagcagcaacaaagacccagcagagccaaagaataaattaataaacaatacagagaagtatttttagtaaataaacgaaatgaaaggcaacttcaaaaattttttttaaaaaggcgcaaaaggctttttcacaatgggtttgtccccaggaacatgtgtcataaaaaccatcactaaatctaagccaaaatgggaaaggaaaagactcatatccacattgctgtcactggacaggttgactcaggcaagtctaccaatactggccatctgatctacaaatgtggtggaactgacaaagaaccatcaaaaactttaggagagaggctgctgagatgggagaggtctccttcaagtatgtctgggtcttggataaactgaaagctgaacgtgagatatcaccattaatatcttcccaagaaaattcgaggccagcaagtactatgtgaccaacattgatgccccagaacacaaagacttatcaacaacatgattgcagacatatctcagtctgactgtgctgtcccgattgttattgctggtgctgatgaatttgaagcagtcatctccaagaatgggcagacctgtgagcatgcccttctggcctatattctgagtatgaaacaactactcattagtgttaacaaaatggattctactgagccacgctagagccagaagagatactacaaggaaatcattaaggaagccagcacctacattaagaaaattggctacaaccctgacacagtacatttgtgccaatttctggttggaatggtgacaacatg

SEQ ID NO: 30342 - DNA, 751 bp, Bovine  19866880823440
gagtcccttggattgcagggagatccaccagtccattctgaaagagatcagtcctaggtgttcattggaaggaatgatgctaaagctgaaagtccagtactttggctacctcatgcaaagagttgactcattggaaaagactgatgctgggaggggttgggagcaggaggagaaggggttgacagaggatgagatggctggatggcatcacagactcaatgaacatgagtttgagtaaactctgggagttggtgctggatagggaggcctggcatgctgcgattcatgggattgcagagtcagacacgactgagtgactgagctgaactgaactgaagaataatttccttaaatggggttcagaaattaagtttgaatttccatttttggacttctgttttatgcataactttcccaagcctgcctaagaccaggttatagactggaaagtctttctcactcaagttttaacgtgcatcaaatcatctatcaagttttctaattatgccattacttttttcagttatcccaggtggcgctagaggcaaagaacctgcttgccattgcaggagacttaaaagacatgggttcgatcactgggtcaggaagatccccctggaggagggaaatggcatcccactccagtattcttgccagaagaatctcatagacagaggagccctggtgggctacagtccacgaggtcacagagttggagagtactgtaactcttactcttacatactattag

SEQ ID NO: 30343 - DNA, 1740 bp, Bovine  19866880825658
atggactgtagcctgcctgctcctctatctgtggggttatcccagcaaaaatgctggagtgggttgccatttccttctctaggtggtcttcctgagccagggatcaaatccacatcttctgaattagaggtagattctttaccactgcaccccctggcaagcccactatgtgctagaaagggaagtcgctcagtcgtgtccaactcctagcgaccccatggactgcagcccaccaggctcctccatccatgggactttccaggcaagagtaccggagtggcgtgccattgccttctccgaacataggcacagtgctaaattctttataggcatcttctcattttatacttccccaaaccctctggggatgtaggtatattattatccccacttataaataagggactggggctcaggaaccagcccaggatgataccaggaggtggctgagctgggtgtcaattctaggctgtctgaaatgagttctccctttcaacaaaaatcctatagtgtctctttattctgtgtgtgtgtgtgtgtgtgtgtgtgtgtgtgtgttgggggccaggggatggggtcatttaattttcctctaaaaagctaaaaagatttcctatctgtcaaatgagacaaataaaaataactaatatttccacacatcatgtacattatgaaggactcgcgggtgtataatctcatttgaatgtcagcaaccttattaagatagaattacacatcttccaaccaggtctcagaagttccaaggtatgatgctctgtgacagcaaaagcagctaggttctttctttctgctctttcatccttgactttttggctttattttaggcttgctgccttgtgagcacaaaatggctgccacagctccaggtatctcatcttcagaaaagtatattcaaagaaggaagaaagtagactgggcagggaaagaggctttcatttaaatcagggaggaaaatctttctcaaacacccactcctccccatctggtaaactgcctcttacatctcatttactagaactaagccacatggccttccctaggggcaaaggaggctggacaaattagtccagtatatgagtttttcagcctcaacagtgaaaagtagctatatgactgacagtactgtctttacagcaggcagagggggtactgccccagactccaggcctcggggtcctgtttcagaatgccttcctcacaattttccactttgtgcctgagactggcggggctgaaagtgctgtctgggtaggcaccctgagcctgggtcaggccctgtctgtccccttttctccccttgtaagtgctcctgggggctcccccggtggtgctagtggtaaagaacccacccaccaatgcaggagacacaagaaactcgggtttgatccctggttcaggaaggtcccttggggaagagaatggcaaccacttcagtattcttgcctggagaatcccatggacagaagagcctagtgggctacggttcatacggttgcaaagagtcagacacgactgaagtgacttggcacacatgcacacaagcgccctggggctctccaggtgcacatggaactgaccggagccccaaggagctcttagcttcttcgtcctgctggggtctttttggtaccctgtagccgtcttctctacccaggaggctggccgggagcatggattgcttccctggcctgtgcactctttcttttgcaggattgcatg

SEQ ID NO: 30344 - DNA, 1849 bp, Bovine  19866880842157
tgctggtctgaagagagcatttggacactgtgatgcctagttcgtactaatagtctaacatctgaccacgtggttttctgggatttgaagtctttgaatgagtgaaagagatgttctggtgcagagttgggcagtgcacattttttcataacggcagtcactcttgacaactgttcattttcctgtttgttacagatctggggcttctgagggagtgtttagaacggaagaaaactttctctttttcagatgttggcctttttatgtttctaagcatgggtggaacatccatctgattttgtaaaccctcagttagtagacatgtcttttgtattctggtaatacaaagatggaataggtagggacagatggtatttaaaaccacattagagttggctcttaaaatatttatgtttactgtttttatatttctattgacataatttagttcagaattttctgtgatataaattctctttaggaacaccagtagttcagaaatagctttaaaaatctgtagggtatttgtatttagaagtttaagaagaataaatctcctttcgttatattctttaatttagttaaaagaaagcttggaacaatcaataggccaactgcggagtcaacggttgtcgagaaactcaggagggagaagtatttctgttacaagtctgagtacaagtgaccttgatggtgtcactgtgacaggtaaatttttcagatgttctgaaaactttttctttcttttctttgtcttaaaaatcttcctgaagtacatattgaggacatgtagtatttagacaaatgtaacccatatttaaaatcctacaaataaggtgctagaagatacaaagttttacagtgaatattttgaaacatgttcaatgggactttgatattctgagtctgttactttggttcttctcaggctctgtagaccatgtaaagctttacctgacaaaactttgatttaattgtctgcctccagtcaaaagaaacacaaataggattttctgtgtggtgtactttctggattgtaagtcttctcttggcttcatagttcttcagatgtctcattatgaaatgccccgtgacagtggtaagaacaggggagttgtagcttttctgtgcagctagatttcagtggctgcacaaaaggtggtaacgctgagtttgcctgtaattaaccttacttatactttgctataagtggcaacccactccagtattcttgcctggaaaatcccatggacagaggagcctggtgggttacagtccatggggtctcaagttgtcggagacagctgagcgactgagcatacacatcctttcctacagctctgaggttcatgtttgaatagcgaaaacttgtaaaagtttgcagtgaagagaggcaattagagtgaactttagtagcttgcactgttaatattgttactggtcatgataatgactaaaaatcacagttggctatttttctttatgtagtttagttcatttatactgatttgtaaacaccattcagattttagataatttgttgtttgaaaatttctgtttttttagtattattttggggaatcatagaagttatttttatagcaacttactgtttttatgtaagagaaaatattctattgcttccttgaaaattatagccagttagaatttttgatatgttctattttcaggtcacttcagttttcattttatcggctttaagagcaacataagtgccaattttgtggaatgttacggccacagcaagatttgtttgtgattgtctgtgggaaatagtgtgggttaagggcacatgtgcatatccaggtctgttacgtatttcctgagt

SEQ ID NO: 30345 - DNA, 1923 bp, Bovine  19866880887209
ctgatgaaatcaagatgttaagtttttaaaaatgaatgataatttgaatgtagatagcatggaaggaagttttccaacccttggtttaaaaaaaaaaaaaatccaggtaaagcacaaaggcaatgagaattaaccaataggaaaaaaggctccaaccaccaatacgtacgcgatgccagcaggtgaagcggagctcttgagagggtgcagggctctcaacttgggtaaagaaggtgttagaatacgcttgaccttgacaactcttccacccatctcagtgcttctatgaggaatcctcaggagcttttagcacaacgggggaaggactatgccttggagtccccccacttgacaaagacctctagaggaacccaccgtatttcaaagagcatgaaaagccacttacaaactaaaaccaggtagagttcgagtcctattactgctgaaactaaacatctatgtagaaggtatcttggtaagaaccttgcctacatccaatcttagagtccctttcatggcatttaggagagatgggttattttagcttttgcttgggtatctatagcaactggaaattctactagttgagtccattcctctttagaataactcctattacaaggttctttcttgtgttgaagcaaacatctgtcatctattaagctcctctttttgccctttgaagcaacacaggaaaaatccagttcctctccccttttatagttcaatggagatttcaaggcagctattatatcatcctctctttttccctttgcagctatatcttctgttcttcaggggaactatttcctggttccacatataatcagactcttcatggtcctggccacctgactctggatataataatttattaatgtctctcttaaaatgcggttcccagaagggaacccagtcctccatgcagatgtggactgagctgtgccccgtgcagggctccctggatttctgtcaccacaggccgagtgtgtccgtttagccgtgagatacccctaactcaaagctggactcacatttccctacgaaaacattcctacaaaaactgctgtgaaaccaggactttctaacacctttcccattaacacacacatcgtacacacataggtgccctcatctatactcagaaggttgcatttaagaaactcagaatatggaagtctctcgttaatgcctgttcaattttatccttttagtttcagtcttatgttcacatatttcaaaaattataatgatttctgtatcccaatgtcagtacatagttagaattcagtgaatattcatgggatgaattaatcctgaatctactagtcaacagactagatatatgtgtctacttctgggtcatctataaatctgataggcgtactttctgccccccttactctcttcttcatcagagaactaagaaggcaagtaaaagctgcctttaaattgttgagctagtattccctttgggatgcggaggtacaggatgtgagcaggagcagacgaagagaaagaatactgagtgtcctagatccttggaatcaggatttaaggttcccgacattagaaaaatatggcttccccctatctctaccctcgagtcttctgcctttcagatctattagaatactgtgattatcaaactgtggatttttaggaaaaactcatacaagcttaattttgaaacagcttttaaaatgatcttttcaaattacatttcctgtaaagtctgagttagagacacacagctgtctattggctatgaggtataaaatggagttcccaaaatgcccttgacaaatgcctgagataatatgtatccatttatttcaggagtcagaaatggcatatattttttcagtggggaatttagaaaatcactgagcttgaagctggctcctgaattgaatattatct

SEQ ID NO: 30346 - DNA, 1001 bp, Bovine  19866880921123
ccacatgatgccagataacaactatcttcctgttgggtgtcagggtccagaatggcggggagttgtacctaggggatgttgttgtttagttgctaagtcgtgtctgatgctttgtgacccatggactgaagcctgcctggctcctctgtctatgggatttcccagacaagagtactggagtgggttgttattttcttctccaggggatcttcccaacccaggaattgaacctgcacctcctgcattgccgacagattgtttaccgctgagccagcccagggaagccccatgcaagggacacaaagagtgataaatgagatcctacatacaaaaaaaccatccagagtgccacttcctccttctcctcttcctcttatgctgagcaccctcctggacttgtttgtgtaagccccgaaggtttgcttgcactttggcaccaaaccgctaatgctcctagacgctaacacactccgattgctacagttgcatcaactaggatctgggttggcagccaaactaagctagtgcactgtgtcatcgcagacttcccacaccacggagaaggcacagaatgacttggagacctggtcgcagttcctgctgctattagtcatggtgtgttagtggaatgcaagctcaaaaaactatttcctaagtgctttccaaggacctggttcctcacacaggtagttttcgccaactgtaatgacagggagaaactagagtgtcagggagaacagaatttatgctttaagtttattttggatcagatgttccttaaaaataaatctccacctgatcctaattttgacttcaattccatagactggtgatctgagtgttgaggacagagagcttagaatctgtttatatggtataaatacagaaaggactggttctgagtcgaaggattagatcaacgtttgattataaacttaaaacctctctaagtcacatgttatttttgaagcatgaaatggtcttgcaaacgccctaaatcc

SEQ ID NO: 30347 - DNA, 1727 bp, Bovine  19866881072166
tattgaagaggataaaaaacacagtcaccactggccggtaaatagggaattgggcaacttatataaaatctttaaaatatgtaaactagatcataagcacgttcactttcaaagacttcagccgtgatgaatgcatctaaagcttgcacaatcggaacctagaatattttgagtgcttaaggcagaagaagggaagatgttttctaaatccctgtgtgtgtgtgtgtgtgtgtgtgtgtgcgcgcgcgcgcacgctcagtcgctctttgtgaccccatggtctaaattcctaggaaacagttaatagccaaggagaccacactcacattttatcttggtatttatattaatttgcttaacctcacctaatccattctctgtgtgtgtgtctctctttccagttacctgaacaagaataaatacctgacagtcatcggccaagatgcatttgcaggggtctatagcggaccaaccttgctgtgagtaagacatatggaagagcatttgccttttggtgcagcggggggagggggccattaagacgattagctgatgatgtttatggggagagaatgttgtcttggataaaggtttctgctagtgcttttctgcccagccatatagggcagaaaaaagttcagaagaaagtccttgttctttgagactcagagggtcccacactccactgtgccatcctgatgcctgataccaccttggtgtggacattcatgaaggccctcttatgaaaaaaaaagacatttttgagcagctgacgtttgcaggcataaggtctacaaacaagcagaagatacttagtctttgccgagcaatgactgtgcgttgcacagtgcatggcagaaagaaggaagaatacaaatagcttggttcacatctgggaaatctgactagaaaagatgagatgtgaacatttttgtgaagcagcatagaaaaagttgtatgtgtgcatttgctctgatttatactgatacctctgtatctaatcatgatcaagtcctgttgattctgcctcccacaagcctctttctcagggccaccttcttcatcaccttggttttgtcttagtttagaatttcattcttgagcagtctttccatccttgccaaagtggaacacagccactcaggagaagcagaagacgatccatcagagacgagaagtttccgtttataaataagaggttccatcaagtaggtgcagcccaaggcaacagtgggtggcccacagtcttgaagacttataccctcactctttcatttttaacaatttcacttcactttaagattgaatgcaccccagttaaaagggtctatggccttactttcttaacacacagcctccatataacagggcagagtgaccctgaaaatctcttttacgtatactggggttcattgataattcatggcaaagtacttaaaagtattatgcatttttcttcttacaaaaagacaagtgaaaaaattgtattgccctcttctgtgattgttttttaaccttgaagatattttttaaagatacctttaactgttcctttcagataaaaggtgatatttcaccaatgaatgaggaaacttgttgcttttctaaagaaatgtgtgctttggaaagagtctttagaagcaggtatttggaaacatttacatgttatgtaattttcctgagaaaataggactatcgcttataaaaatatttttaaaaatcagaaa

SEQ ID NO: 30348 - DNA, 2989 bp, Bovine  19866881154887
tggcagggcaacccagttggacagagtgggcttggaatggcttacctctacgggagaggagttcaagttgtaagttcctcagtcctaatgttctgacttcaacaagcagtcagctggtgacgtaggaagtgttccttaactagctcccagtcagcccaggtgaggccgttccatttgtaaccagagctcaacctgggccattctctcttaggtttggttccctgccaccgctcaccccgtcccaccgtagcagctgcctcttggcatggctgtgtctctggtgccttctcagggcgtgaaactgtttctcatgtttccatctctgctcttcgcctcacttcctctcccatctctctcaggcttcagtatctccgggccgcatcttcactcaggcctaagaaaattctcaagtcctgtcgtgtagagtgaggaaagctctctgtgctaccccttgcccttctagctgccacctctctcctttccagccctttccttcagtccaggtttctccagagaaggagctccgtgagctgctgccgttcactcctcagctctcagcagtcaggcttctacctcctgtcactgcgctgcacggctcagcagtgacctccgtgtcagcccacacggcgctggttctgcctccttggactctgtcctcctcggggccatctgggttttccggggccactgcgcctcactcctctgtgcttcttactcacactggaggccctggatcctcatcaccgtccccacctctgtccgatctcccaagccatgtattcttttaatttgggcccagactaagagctcggtagagtattctagtccgtagatattccctagcattaaagacagggatgtggtctcattctgatttccttctaatcattttagggtagtagaatccaggagtgtcatttgtttcatttttctctgaggatatgtatatttgaaatatgataataatgtttgataagctgttcagggaaggaactaataaggacagaataatttttcttatttaatgtttaaaaattcaggtttaaaagggtttgttgattaatagaaaagctgtgactgtttcttaatttttgatctgctgttttagtagtgttgttttatgttttctgagagcagacatacaagttgtttcacaaaataatgtatttgtttttctgcacggtcttaaatgttaatccaccatgactgaaaaaatattaccatctgtgtattattaaaaagaaggtcttttaatgacttcaggaatattgtgtgctttgtgaattctttttatgatgaatctcctgacttcagaatatgtcagcctttcgagccttctcatcgtgtgatcatgtgacctctttttctccagaattatgatttggcactgaagtatttccagaaagctgctgaacaaggctgggtggacgggcagctgcagcttggctccatgtactatagtaagtaatgatggatactccacatctaaattccctgttttcctctagatgtcactgtgatgtggaagtgagagctattgagtttctatctgatgaatgtccttccaattcagtaatttgtgtacatcttgtattgccctgtagaatgtattaatctgtattaatgtgcaaatctatgttaataagattcatatcattctggagtaagaattctgagtttcatttagttttattcctaggtagggcttctctgatgctttagctaaacctcacttaacactgttcctgacctctcatgtgattttccttacagacggcattggagtcaagagggattacaaacaagccttgaagtattttaacctagcttcacagggaggccatatcttggctttctacaacctggctcagatgcatgccagtggcactggagtcatgcgatcgtgtcacactgcggtggagggtgagggctcttctgcgctcgcccgggaggagagtctgcggttctggttctggttctcttcttatggtttcttctagagtagagacagactcggtcgactggcactgagacaatgagggaaggctctgactgtcgcacttactgattcagtttgtctgtccccctggaattagccttcataagagcggatattattgtctgcggtctctctggcacctcagacagtatctgagacatagcatcaaaaagtatatgttaaatgaatgttgcagggggaatgctgatatctcccagctggagcctttcctctttagctttctcatgattggcacgtcagaggaacgttgttcaacgcttagcacagtttctcagggcttcccaggtgacacaatggtaaagaatccacctgccaatgcaagacgtgagtccgatccctgggttgggaagggcccctggagaaggtgatggcaacccactccagcattcttgcctggagaatcccatggacagaggagcctggcgggctactgtccccagggttgcaaagaggtggacaggactgagcatgcacacacaaagtttctaaacctctctatgcctcagtttccttcctcgtaaagtggagctgttactggaacttatcgcataagagggtggcccctcacaggaggagtgagtgagttactgttcaaattagtatcccagatttatatatatatatatttttttttttaataaaactgccagagattcagacagcaagcttaacaattgcttgtagccaacgtgcaaaaaatgatttctgacacacctctcttttttcctgttctcacagttgtttaagaatgtatgtgagcggggccggtggtccgagcggctcatgactgcttacagcagctacaaggacggggactacaacgccgccgtgatccagtacctcctgctggccgagcagggctacgaggtggcacagagcaacgcagccttcatcctcgaccagagtgaggcccactcccgtcctgccttgggtgtgggaacacagggtgcacgtcaggttcagtgcagt

SEQ ID NO: 30349 - DNA, 1989 bp, Bovine  19866881157203
ctgccctcggggagctcgtctggggaaataagactggcacacttgagataattagccaccaattaaggactgacttcatgtgctgcgaagcagtggtaggcagtgtggtgtgggggtgggtggaccggaagggcaggccctggcttcctagttcctagtgctgtgccttgtggggagattgagcagtgtgcgcgcatgtgtgcctgtgcacgtgtgtgtgtgtgtgtgtgtgtagggggagatatgtatgtatgatatataaactacattcatatatacacatacatgtagcttttcccacatctctttttaaacttagatcagagttttaagtatttcattataaaacattattataaaattaaaagagagtgtaagaggaagaaaaggagccatacctaatcccatacactttagccgtgtcgactctttgcaaccccaaggactgtagcccgccaggctcctctgtccatgggatttttcaggcaagaatactggagtgggttgccattttcttcctccagagaatcttcctgcccccgggatccaacccgtgtctcctgtgtctcctgcgttggaggcagattcttgacccactgagaatccctcatccctaagataattgatttatcagaagtggtagctcgttcttagactccagcatcgagcccagcagctggcacagaaagggggctgcaaaggcatttgtgaatggccaggccaccggtcctaccccaggatccagacaagcgaaagtgaaagtcgctcagtcgtgtcctactctttgcgactccatggactatacagtccatggaattctccaggccagaatactggagtgggtagccattcccttctccaggggatcttcccaacccagggattgaacccaggtctcctgcattgcaggtggattctttaccagctgagccaccagaagaagcccaagaatactggagtgggcagcctgtgccttctccagcggatcttccctacccaggaatcaaacccaggtctccctcattgcaggtggattctttaccagctgagccaccagggaagcccagtatccagataaggactttataaagagcaccagactagcacctctcccaggctgagttctttactgcactgagtgtgagggggtggatggcagaggctccgcatggcactcagagctcagggctcaggtggcaggggctgggtaactagggagcgcttggcagcttctctgttaggccatcgagccttctcgaaacccgtcagggtagagaggtgggtgcctgggacacaggcttctcccgcggtgtctgaagtgtttgtgtttccccctttatcctgtggaagaggccatcagtatctcccttgccagacttcacaaagagcagtctcattcccaaggtatccatgtcagcaagttctgtggcttctgtctccctgcttttcaggtaaagcaggcttacctgttggtacttgcacagctccgatgagtcagtcctgggccccgctgatgtaagatggactaaaactggttccggttctcctgtccaggacccccccccttctcctcgcctctctttatcccactaaacggttggagccacaagtaggctgactggtccagatcgttggttgggtttcctgggtgtgttaggttgctcgagctgcccaaaaaagttaccacaagctgggtgtcctaaaacaagagaaatccattctctcctcgttctggaggctagaaacctggggtcagtgtatcaggagagacgtgctcgctcaaaagactgcaaggaagagtccttccctgcctcttctagcctctgatagttactggcagttctgggcctttcttgttttatggcagcataacttaaatctctgaatctatctctccatggttttccctgtgtatccgagtctccctgtcccttgtgaggacaccagggcggattaaaaacccactcagtccagtgtaaagtaaaagcg

SEQ ID NO: 30350 - DNA, 1447 bp, Bovine  19866881188397
tggaatgatgggactggactccatgatcttagttttctgaatgttgagttttaagccaactcaaacatgtaccaaattgattgctatgtcaggcatcatgccaagctctgggtgtccactggggaatgagacacagatggtgtctgttctctagggatttaccaacagggagaccaagattaaacagtgtgaataatcaataagaagtgctataaaggaaagacacagggggtgcctaacaggtgcacctgatttaatgtggagacgagaggaaagtgggctgggacaaagggcagagggaggcaggcaggcagtgtgagacctgaacagccctgccgggatgaacacagcacatgcacacgcgcctccactagctgtcatgactctttgctgctgctgctgctgctaagtcacttcagtcgtgtcggactctatgcgaccccatggactgcagcctaccaggctcctcggcccatgggattttccaggcaagagtactggagtggggtgccattgccttctcctcgactctttgactagctcagctatttcaggtaaatggacgtgggaggtcttgttctaaatttatacacaggttggggtggtgacagttggggttaacttagaatcacagaactcatggaagccgctttggtcttcaaaagctcctggaggccatttttaattttgtcttttctagttagaggataactactttacaatattgaaagtcccttggacagcaaggagatccaaccagtccatcctaaaggaaatcagtcctgaatgttcattggaaggactgatgctgaagctgaaactccaatattttggccacctgaggcgaagaaccaactcatttgaaaagaccctgatgctgggaaagattgagggcaggagaaggggacggcagaggatgagatggttgatggcataactgaggcaatacacatgagttaaactccgggagttggggatggacagggaggcctggcgtgctgcagcccatggggtcctagagtcggacacgacttagtgactgaactggactggacaatgctgtgatgatctctgccacacctcagtaggaatcggccataggtgtacatatgtcccttccctcttgaaccccctcccgcctccctcctcatcctaccctgctaggtggtcacagagcaccagcttctgacaggttcccgacgtcatacatcaaactcccccggctatctatttttatctattttacacacagtaatgtatatgttgggcttccctggtggctcctgcaatgcaggagatgcacgtttgattcctggatgggggggaagatcccctggaggaagggtgtggcaacccaccccagtattcttgtctggagaatcccatggacagaggagcctggcgggctatagtccacgggtcacagaaagtcagacatgactgaagt

SEQ ID NO: 30351 - DNA, 1452 bp, Bovine  19866881195137
tagaatgtcttttgttttaggtttgttgattttttttttcctcatcactagattcagatcttggacttctggcaggaaacccagagaactgttgttgtgtttttcctaggttatcagatcaggagccatgtaatgttgatttgttccatcactgattaaaactaaacattgattaaggtgttacttgccaggtttctctactgtaaagttactatattatgctttttaattatttgtgttatggggaaactctttgaaacttgaaaatagcctatatttcatcatattttcacctgcaaattttagcatctattgattctttcatgaaatagttactgctgtaagtgatactaaacagtgatttaaaaaatattctgtcatatctattacagttatcagttggaatcctactgtcaggaggtgctttgtcattttctccactcattcattcattcgttaatattagtgtagatttatgaattatcattttatcatcttggttatgttttatgattgttattataggaaacttgtgagattacctttaaatgtttcttagatatataaagcataaaaaaaaattagaaacaaggaaaccaaaaggtttaaaaacaaaaggaatgctttattttttcttttacaaaatgtttttctttaaaagtgatgttcttcagatatacttgtgtgttcttaaagatcattagcccttttagattgacagattaaatttttttttaagttttaggaaacgtgcccattgaaaattaggaatgaaaattgcaaacctgaaattataatgtaagctgatagaaaaatctgcttttgttttctaaaaatccatttttcctccatttcacaaaaggacgcatacccttgttagttggtaattactttaaagaggatactttgttgaataattagatacagatatgggtagcctttttaaaaaaaaaaaaaaaaacaaccttgatttttatatatttgttctcaaagcaaattgcatctggtgagcatagaacagcactgaagagacaattgttcttttttgtgagagaagattagagaaatttcccgtgcttattttctactctctttacagaatgcagaaaattacaaagaaagagggagagaaagattgcttcccacccctattcttaagaaaccagagcctgagtatttgcactgtaattgtcattttgactaaaagcttgaacagtcctttggaattccatctctgacagtacaatagaggatcactattgataagaaatgtttaatttcatattttgtcactttaatatagtgtggtaacctatgtgcttttaataggtgattttggattaaacagtgcagtggaaactggagaggattaatttagcctgatgcgttttcctactcccaagttaagtggcttagagtgttcggaaagatcatgtttaaggagagacaaca

SEQ ID NO: 30352 - DNA, 1491 bp, Bovine  19866881209774
attctggaagcatctgtacaccgatcaataaggaattgctcaaataaattatgaaaaatatctacaatacactgcagccattgtaaagattggagtagatctatatgcaccactataaagagatattcaaggcagatagttaattacacaaaggctagctgcagaaatctgggtgtagtatgaactcacttacgaaaataaaaatgtgcttgagacgcaggttactgacatttctggaaagagccataggaaacatataatagtgattttcctctgcatagtgggaatttcattcgtattttccttcttttttactctctccattttcaccatggccttgctttattttcacagtgaaaatctagttttcaaaaataaaaaataaataggggctcatctactacttaaaattaatcaaaagttttactcaatatattctgaaggtagactagtaaccagaccctgaagacagaaagatgtccacaatgccagccccgtcctccatgagctcattttatgtctacagagatagaaagagagccaggcacccaaataagtaatcgctcacctagatgggcacgataggaaagatctcatcctttgcgatactcagtgctgcctgaagcaggactccagaatagcccacactggactcacaagcacaaaccacagcctttcttgtgatctcagacacaagactaaaaaccccaggagacaggggtcttcacagctcccccaggaactggaatacagccatcctttgaaaggtctttgtcagtcactcagaacgttaacctttggaactcatctctcaaacggcctgggtcaagggatctagctctcaaatatgagcccacgctccacgggaaccacaggtctattaagccttagctttggagcaattatgaggcaaagggagctcgaaagcctgaggctttcgtgatggcagaggggtctcagcgatggctgtgtaacgagtattatccacaaagcatcactgccccttccttcaaccccacttgcgtgctaacacccggcttgtcaggagaactcgtttgataaggactcactcagccattgagtgagtccccagctccccacccttctgaatggcaggactctaaagtctgtgttcctccccatgtgggccccgctctcagaggggaagactggggtcaaggaaccatccagcatctaaagaccaacctgaaaatcagcaaatgggactaatgagatggcatgggcccatccctgctgggaacatggccttgtgcaaagatccagatcaaaagatttcatgggctggggcagagattaaagatgaggaaacttccactaggttgggcagaggaaaatgttcatggcccacgcgtgagtactttcaggaacccgccctgggctcttttccgtcacactgtgttatctccacaggcctccagggggggccctctccatgtgaatagcatggaacaacccccaccttcacgacca

SEQ ID NO: 30353 - DNA, 1647 bp, Bovine  19866881236701
taaaaaattgaatattcggtttttaaaaaagtctgtgtggagtggtgcctggccatggtacatgattagcatacaggataaccagaggtggaatctttatttcacaagtttcaagatacagtacaaaacgaatctgtacatctctctattaacaggatttgtttacacaattatattacacttcaccagcctttatactgaatttaattaaatacaaaataaatttacaaaaagtctaccatggtgttctttccaatgtcagtttatggtcttttaaaatgtctcctaagtatcaatagtggttacaccttgatcgtatcaaatgttatgatttttttttaaatcaaagagaacagtgtcatcttataattccaaacaggaaaactggtgctgtgagatgactctacatataaccaagacatccttctcgtgcacacacaggcttttcacttgtgcaaatcatttttacgtggaatattttcaatcttcttgaaataccaagtggaaggagaaatttagcttctttttactacacatttaaaagtcaggtagtgcctcagacagtacagtattcagaaagtttgtattttcacttatatctgagaccaatgactgatgaaaaatactttcatgaaaatagaagttcttttgctttatttcttgcacagtggtagtcataatattgtataacatataattaaattcacttttaaaacaaacagtagctgttattggggtaaatgtagcccatgctgctcttcttggtaaggggggtgtttaacggctgaaaaacttttgttttgaaatgtgcatgtgaaaagttaatccaaacctctgaataaggtgtttgcagatgtagctagacactataatacacatgccacatacatgaagacctgtggtctccatttataggcttgcatgcatacttccaaaacactggtttgaagaacatgaggagcaaagaaaggaggtgaaagaaaaaaaaaagctcatacaaaattcttgagtttcctggaggcaacagcagctccttaaataaagcaacagatcatgggcagaagtttctacaacttcccagtgatagagagatacaatggcttagcagtaaaactcacaaattaaccgcatatgcagaaggggaacacatcctcaagagtattaggattaatgatccgcaagttaatctcctttaagtgctaaatcattttggaagaaaagaaacctgatttttctgtgccattgaatagaaactaagaacaaggtaagccttacccagaaaacagaaacaaaagctccaagaacaaaaaggaaaaaacaaacaaaacaaaacagaaaaccaatagcaaaccccaaacaccagtgccaccttcttagcagaaaataaaaagctaaagagtctccagactctggaacggttggataagcaacagaccaaacgcacaagagaacggaagctgagcaaaggccctgctgccgctgccccagaggcaggaagacagcctctcacagggacggggagcggggctaccgcggagaggtgaagcctgagcaaaggccctgctgccgctgccccgaaggcaggaagacagcctctcacagggacggggagagctgggctaccgcggagaggtaagccacactcta

SEQ ID NO: 30354 - DNA, 1082 bp, Bovine  19866881242267
atgccgctcttgcgtcatgctgaagataccaccacagcttctgaaaacacttccagaagatgcaagccaccacacctaatgttataattgcgtcagtgcaatacatgtatggctcaccatctttggggcttcccaggtggcactagtggtaaagaacccgcctgccaatgcaggagacggaagagacatgggttcgattcctgggttgggaagatccgctggagaagagcatgccagcccactccagtactcttgtctggataatcccatgggtagaggagcctaacagactgcggtccatagggtcacaaagagtcagacacagctgaagtgacttagcatgcacgatgcctggaccatcttagatttatttggagttgtaacttctatttctttttctttttatctctcttgttaatgttggcctgtgttcatattttgtgaaacgtgaagggtcaaagagagcaatctttgagacgattccccagacacccttccggtaataacagtgttcctacagattggcttttcaggataaatttgatttttagaagtgctccttatttaaacaatattccacccacagtattgtttgctcttccatttaaattatcagtgctcgttattatagctaccagtagaaaagatagcaattatcatgcttagacacagctgcagggctgcctttgctcgataatttaaggggtccatgccctattgtacctttttattgtcagctttattggagaacatccaggttttagctagatttccccttcttcatttccctaagagccaatgtgttgaaaatgccattgtttttcctaccgtggtgagtgtcaagtcagagccagctctgggatgtcaggaagctcatagtcttcaaaaattatactgaaactgggatttccctagtggtccagtggctaagactctcccaatgcatagggcccgggtttgatccctggtagaggaactagtagagaaggcaatggcagcccactccagtactattgcctggaaaaccccaggacagaggagccggtaggctgcagtcttggggtcgctaagagtggacacaa

SEQ ID NO: 30355 - DNA, 1905 bp, Bovine  19866881248347
taccaggaagatgggtacggattttgctgttggacacatacccttttgtgtttacagttttttgagcatcagcttcaaagaagcaaggacttttgcaggaacatagaaatagtcatctgaaaaggtagtgggccagccgtggcatccccacttctagatttcaggaaagttgaggttccctcattcagaggtttatcaaatgcctatcaggccccacactggatgcgagagaaagaccaggctccaatggagagggctgcttgtggtatgagtccttagagaaaaacgccaaaaggtggaggtaacgttctgtaaagaaactgagactggtgtttatgtatgatgcgtggccaatggcacaggggaagcttttacaggagatgcaaatggccctgaggtttgggaccgagccgactacaccccagtctctgctgtgtggtcaaatgaaatggctaaggagcctcttgtttctttaagaaagctctcctcctgtttggagaaggacgaactgaaatgctccactctgagtagagttccagaggttgagattgcctcacagggtcaagattgctggcccaagactacttcgaaacagtccttcaaagagttgtgtggagtcttggatcaattttgctggaggataattcgatcaggtttggatacattggtgaagaagatgcaatgtgacccaagaaaggaagctggataacaatccacaccaaacacccaccgagcctgaacgtgaacagtggtactgagaccagtcaggtggggatcatttgatgaggccccaactttactttgtggttaatttgaccaaagaagggaattctttatggcttgggaaattaacttatcttttatacccctatgagatctccttcctgagaacattttgcaaattttcccagtaaagcatttccttttgaacaactcaagagcagaacccattcaaactctggaaaaaatgatgatatagagaaggactatgttttctatccaatatcccatagtaggagcttagtaatagttagtgatgacacagctaaagtatgaatgcaaagcattaaaagcccttattaggagcactgttttctacttcagggaccttgggacagtcacttaaatttgctttaatccaattcttcctctgttcaattgagataatggatacaggatattgttttataacgtctgcaggccaaatgtggcccactgcctgcttttgtcaataaaatgtcgttggaacatagctgctgtgctcattaatctgtgtattgtggatggctgcttttgccttacaatggcagagttgaacagctgccaccaaggccatgtggtctggaaaacctgaatggccattcacagatagagtgtgcggaccacttctgtaagagactaccctttgtcttgctgcctaaaccactgtgtcagctgcagagctccgcaccataaggtgccactcttatttaactgtatgtaacccttggcagaccaaagagcaacatactgtgcggcagtgtggttcttggatggcctgcgggaatatgacagtgacccagataaaaattccagagttggcaggagtggaactggccatactcacagtgtcaaggtttcgttgcacaggccctgaaaagcattcgcagggattgaagtcatgtaagggttgtctgtaatttcactgaaagagaggaacaaaaacacttggtggaaaaaaaaaaaaacacctctggagctgggcttttgctgtacatatgcacccaaatatataacctgacatgattccattttatctcatttctttttaggtgttgttgactcttagctgttggtggctcagagctccggtgaggccgtgatagctcacctaggtggacatgcactcagagccccacctgtgca

SEQ ID NO: 30356 - DNA, 2300 bp, Bovine  19866881263273
agtcccacttttcagaatcacagtcccccatattactaaacccaacgggcatttctcagtccttgcctgacttcattcatcagggcgattgtcacagatgatcactgcttcctccttgaaacaactgcttcacttggttccaaccatcatctacggctgcaccctaattctcgttagcaacaagtcaatactgccgaatattgcctgtgtgcacacttacagtatgaagaacacatcggtggaatagattttggtcaggtcggggaatactctaagtccagtgttgaaaatgccactacagtacatgaaaaagaagaaaaaaagagtagaaacaaggtaagaaaattaacacataggaagtagaataatgtaacagctgaatgtgttctgacgtcagactaggatcaaatcctaactccttcgtcaattatctgagagaccatggcaagctccagcccttggatgggacgatgcttctcaaagtacaggaatttacccagtccaccagcgtcaatacatctattctatttaggaaaatctggggattgtttgagccatgtgggattcctagaaataggaattcaggtttctttgtgtgtgtgtgtgtgtgtgtgtgtgtgtgtgtgattaccttgttttaactggagggtatgatgcatgtgtcggaggaagggagggtggaataagggaaggatggaacaggaagacaatctaattaccaactccatgccaggctcccttttgcaaactctaccttatattgtgttggttattttaccaagaatgatacgcctatggcagcctcttgagaataccacggcagcagtaccataaaaatatgttcagacaaagaaggaaatcagtcaaagacaatgtcttcactttccaaagcttgtatcatcagggcaaaatgtcaagataaaaatgtgcataaaacagcatgactataaaagctcaggctccagatgcctcccagacttagttggtctaactctgttgtagctactagaacacgggcagtggagttacgctttgtttgagagccttggcgtgccatgctaagagctcgtcactgccagtaaacctttatagaatgtctccagcagagaaagctctggtgtcccttctaaggcaaattctgacctgattcctagaggggaaggcacatgatttgaagagaaagcaggagcctgaggtctcaaaaaagcaaatgggaagctccaaataaccaaggagagaagtaacattccataaggaatatctgaagaacggtaaataaacccattcaattgcaacagcgcttcatatggaagagcagggggcaagagcctgagagttaagtggggactgtattggaaagggctggaaatgccattttagggacttggaccaagatctctttattcttcaaaaccccaaatgagtccatctcctttttgatgtctcctgtaattacctggacccccagataaaggtaagtacctcccatttgtcacttcccactattcttctaggggaggaaattttcaatttcatagataaatcttcctttaaaaaatggtaagcttctttgaaggcaaggacaacgttttattatccaacatgttccccaccaagccttgcacagactagggaacctgatgtctactaatcaaagagttactaaaggactgaagctcagagtccacgcaggagcaattgccttgtgctgttaagtttttattgggcttcccttgtggctcagcaaatttttattacttcctagatacccccgtcagtatcccatccgtgtcctcttctgttcccctggcgtctcccacccttacctcttcaacactgaactgttttccattccccaaataagccacgtggttgcacacttgtgtgtctttatcatgctattccacccacccgtatctctcttctccccttcctgggtaacctctactcatccttgaagagacttatttcatggaatatatttggatatatacttttatttaaagtccctagatggcaatgaactaatatgtgaatagtgattgtttctgggtattgggatgaaggttaactttttttttcctgtgtaatgttttcacatcctaatcttttacagcccatgtgagcaggaaaggaggcaagaaaggagggcgcccagaggacctgagcgtatgcacacacatccgctgaacacgctttgttgagcagacaggcagtgaagtacaacagaggacgaaaacgtgtggtccctgctcccactgagactgcagttagctcacaaggtgtcacccaagcagaaa

SEQ ID NO: 30357 - DNA, 1933 bp, Bovine  19866881348590
cagtggtcatgtccgctgtgtccagctgtctttcttgggtcccttcagtcactctttcccgttctgtcagccgtcttgaaggtcttatgcattgacactagaactgatcaatgaaaaaaggaaaacccagttagttgcaaatttaaccttaacatgtttgaaagtctgaaaatagaacttgccttttaagttaagaaaaaaaaaaagtcctcaaagtgttccagaactgtgataaccaaggacctttgatcagtccatgtgcaagtatacatatgcagcgtatttgttcctttaaaagggaaggttgggcggtttcttattattggtgattgattgtcatactttataccatacttctctccttcaaagactgaaaggccttgttaaagagttttatgtgaacttcatttccttggagtggagtatatagaaaactttgtgaactgactccttgagctaacacatgaacttgccccacctactcactgtaatttgcttgtttgttacaagtatgcagagccttcatctggagccagaggctggactgaacgggagaattagaaagcaatattgaaggactctgggtggggtaccaggatcacagacacactttcccaaaagttaacagcttctgttcccaggattcattttattaatactttgcatttcttactgcaaaagaacagaccaccctcctgaattctttaaatgtgaaatatccttgccaggctatggcagacagaaactaccattacaatactaaaactctagcgagtcagagatgcattaaaatcagtggttgaagaaagctactaaagtctccttgttcagatagatttttatttctgcagcttgatgtaatgggagaaaatcaaccacctgcgtagctaccatgtttcatcaccatcccactgttaacaggaggaaaagcgaggctgttacacttcagaactgtctgcttaaggagtacggagaaaagccaccacggcgccagcaaagaccactgagaacatcacatacacaaatgaaacacgtcagccaaactcatactcctttttacagttggatggcagcgttcgccagcctgtatccagtctgaggcccgtttagcgtctgagcaggctttctgcgcttgctgacctccgtctgtttctattaatctttatactcttttcataacccctcatgtgccagaaaactggaagagttccttacctgtagacttataaaactttggtttttgaagtggggattgtatttagaactaggtctaatcagtccgtaaggaagctgagggctctaaatgtgaagttgtgtgcttttgtgtgtgtgtgtgtgtgtgtgtgtgtgtgtgtgtagagtattatgagaaacctggtgagcaaactttcctcctggatagttgcttctaaacctgaagaggtggtcacagcgagaaccatgtgtaaatgcacatctgaaaggtaggccattttaccctcagaaatgtaatgttgctttgggcagctcatgtaaatactgagacttctgttcgctctcttatgtgagagattcgcttgcatttggtacaggatgttcatgtcttcacccctgcctcttctccccacccttcaaaataagtatgatccacggtcagagccactctctgtttcaaagaaactgtttcattttatttaaatgtttaacaaataacttctatgtttttctgtcatccacctaatttctcctttagcagtattcttatctctttatctttccttccctcttagtacttggaaaaagacaattcttcaacagtggcctctaccccgaggcagacgggaaaggccggtcttgttctccaggtgatgacagacttcctgttggcgtacctcttgcccatgtccttttcattcatcttccaaatcgatcttttttctgtggccttgtccac

SEQ ID NO: 30358 - DNA, 1683 bp, Bovine  19866881490864
taatgtgaaaatattagaagtgaattcattttaccagtacacagactgttactattagaacataaattagatgtcccttgatatcaagagctgtgcttttttttttttttttttttttgaggctggtgacttgctttatgacttcatagtaaaggaagataagaaatgctctcattatgatacatcagacaagagaatatgaggtactttggggggagaccattaaccccccctttgccactcttactcttgtgaacatagtactagttatgtcttatcaaaattttgtatttcacttaaatataatctggacagtttttttttttttttctattttgtcccccgccccccacctgccctgaccatcctgcattattttcagggttaataactcttgagaacgttattttggaggtggggggcactgcgtggcttgcagaatcttaattccctgactagggattaaacctgggtcaccacattgaaagctctcagttataaccactggactgccagggaattcctgagaatgttgtttaatgtaaaatatttcttatttgaaatgagagtaatttcttttcagatcttatagatgagggcaggagcttcaaagtgttagccgctcatttgtatctgactctttgcaacccctggactgtagcccgccatactcctctgtccatgggattctccaggcaagagtatactggaattcagttcagttcagttcagtcgctcagttgtgtccaactctttgtgaccccgtgaatcgcagcacgccaggcctccttgtccatcaccaactcccagagttcactcaaactcatgtccattgaatcggtgatgccatcttatcctctgtcatccccttctcctcctgcccccaatccctcccagcatcagggtcttttccaatgagccagctcttcacatgaggtggccaaattattggagttttggctttagcatcagtaggtccccagaaattcacattcccaagaaatgtgactcgtggaggcaagaaatgtatcttattctttctttctactatctagcaccaaacttggaatataataaatttcagctaccttaaatccatgccaataggacaaacatattcatgtaataaagaaaaattattaggtattcagtaaatgtttgctgaatgaatactgaccctgagactccaagactacctaacccttccttatcatcaaacatcattaaccttaaagcatacaagcacgctttcatttcctggagcacttaagtaatttcttttcttgcctccactgtcaactaataactgtcagcacttaagcacttaatgtgcagctgaatttaaactacagtgaaccttattcatattgaaaaaacatttttgtgcccaaagataacagcagcacagatgctgtcaatagtctggattactgattcagttttgttccggcaaatcagagagctctgtgagcccgagccttgtctcttcgaatggtccgtgggagaaggaagcatttgctagaatcgtgggcagtcttgtgtgcaaggtctttcgttttccctaacagtaaccactcaccagtgtcgctgtttattttgttatcatagtaagaaggagacctgatagtaaggaggcctgagacagtaagctgaaacttgtcaagtaacatcaggatttcagaa

SEQ ID NO: 30359 - DNA, 782 bp, Bovine  19866881597783
tgtcaagaactctgtttcagaagaataatcatttggataagttgactttctttcaaaagaaagcaaaatgtagggcatttacacctataaaatcaattgtcagcacttaagaatgatggatgcttgtttcatgacagatgagctgtcatggacacgatgcttgtatttttacatacgaatttcttggagatataaaatatggagaaaatgatcacttttcactgactgtggaatgcttttcactttaacccacctgacacttaataggtgactcgttgccccaaggtaaagcccttctgaagctttcagacttgaatctgaattgatttgatcccaggagattggtctaccttgattattctgttgtcagcctggtttggcaattggttcaatgagtctgcctataacggaggtagggagagagaagagtggttggggaaattgactgattgagagccatctggggattttacttaatgagaggaaatttagaagggtccatgtcatcagacagtaccttaatccaggagagttttctcgattgagctgtttaaatattaaaaattgttaaacaatcacttcccagaatactcctgctaaaattatttttatcacttagcattgctaatgataagcaaagaagtagttttaaagtgattgccacagttagggtagtattacaattatcacagcaggcattgtaatttccactttaaaagccttaaaaattaatgcagcatgtcgcagttagagcaatggttatcaaagaagaaagggtaaca

SEQ ID NO: 30360 - DNA, 893 bp, Bovine  19866881647572
cccagaaaagagttatgactgaagataaattgacttaatggccccatctatgtggcagggcaaactactaattaccaaacatctacttttctccttattgtcctgtgaatggccctcctgttcttggaagtcccaggcccctgtcccattctttagctcaggatgacatctatacctcattttatatttctctcaccctttcatgcatatggtatctctgaccctctcatgtatgtaggattcccatatggatggaattcagtttgtttttgtcctattaacccatctcaggtcaatttaactcttagaccagccggaagaaactagaaacgttccttccctagaagggaaagttttcttcctccccaacacctactttagagcccaagaagtgtctgatgataccggcttctgccatttcagacactgagaagggcaaaatctccttgtccccaaagcaaaatgtcttatagaaattcaatctctaagaaaagtccttattttgacacaaattatatagaaggaagagcggaaggccttgaaaaacaaatgagcaactttttcaaaagctttcagaatcaaatgtaaaattcattaagaaaagtaatggaaattttatggctggtgcacagataaattcattgctgcctcttaattcatcaagcacacatacaagagtatatgccaaattgattggaactaacagcctcttagacgctctaaccagctgcagactcagggtaaactagttggaacaaaacaaagaatgcctcctcctttcccttcttctcccaggtgctgactgaattaagggttaaactttctcaactctaaaaatgctgaacaactctgttcttccatgacggccaagccctagcgctcttcaggcccaa

SEQ ID NO: 30361 - DNA, 1070 bp, Bovine  19866880421828
gtttgcatcagattctgcctgccccattgtaagctcagcagcttcagttgatggtaaaggtaaaataggcttttgtcagagtccagatgagggctcagcttggggctgtcactgttttgagtggaacacctgtggttttgaatttttccagggctcccctgctgctcagtgccatcctgctttgggtatttttagagcattgctttgttttaggtaacgccatattgcaaaggtacttggagtcaaactggacattgtgacagtcagttatttggtatagggataaggcatttgggaagtactaagagcaattttgatacaatattcagtgaacctaatatattaaagaggagggagcaatgggttacctcataggggagatatttcaacaagggctgcattactatagggcaaacaaagcatctgcttttaaccggggcaccaaaaacaagagaacatattttttaaaacatttagcatttgaccatttataaaatgatagtattaaaaattacggagaaaacgaactctgtcaaatgtcattacatttataactggtagaactgggagcagagacaattccagaatatctacagagaagcagctgattagtagcaatctggtaggtcagtggtgctagagacatgtctgaaaaccacactgaaatgtttggagagtcctgaaaggaatactagatggggatttgatggaaggtatagggaaagagctaattgcctacacttctcatctgacccaccccaccctctctataagtcatatgatggtgctaccatggggaaggggcatcatggtctttctggtgctcagagtctctgatggtcttaattcaattgctaattctttggaataatgatagtactcaaagaaatctcagcaatattaggaacaggggaggtaaatctatgcttcatatttctctacacaggtgaagggcaacatggttatggcccagcagatgtttcaaccttgaagggtacagaaaggacaatgtgtcttacttgcctctctgtgcccaagttgtgaataactgacttagtgtctctagatca

SEQ ID NO: 30362 - DNA, 1534 bp, Bovine  19866880434697
cttttgaagtattaagtaaagttatgctatctgaagtcactttatcattccataatattatggttattttttcactgctattaacttagagaaacactatacaatatttaattatggaagccacatcaaaattatcactcatgagattcattcaagatttgaatgagtttgctaacctatataaagagatgatttcattcttattgcttatctataatgagttaccaatgtatatatatgtgcatagatatatatctgtgtaactatctgcaatctgtattatcttcaattttaataattccagtttaatttggagaaatgatactaataaaatatcaaatttaattataatttcacttatgaataaagcttatcttttctttgaagagtatgtaattactgagtgacaatgataaaaacttccagctttggagacacagtcttgggctcacatctcaaccatgacactagctttgtcacttcagacaagtctaagtacaataaagccataataacacttactaaatgagagaaaaattcaccttacctagtgccatgctgacaattaagggctcaatgatgattagttatatcttaggaccagtaattgccctattataccatagaaaaattaaacttatgctgaacttttaacataaaaggtttataaaataaagttttttatgttaagattggtatctgtaattataagaagtatagctaacacatatggaatttaaaatatcgtcaatctatcaccattacaatttaacattatagtcatacttccccaaatgtggtcaaaacatctaggactcctttaaattttatccctcctagagttctagcctcttttgggaaagaaaatctgtatgtttaataagcgcctctgggactccaagggcttccctggtggctcagaggttaaaaggatctgcctgcaatgagggagacccaggtttgatccctgggtcgggaagatcccctggagaaggaaatagcaacctactccaatattcttgcctggagaatcccatgggcagaggagcctggtgggctacagtccatggggttgtaaagagtgggacatgactgagcgactgcactttctttcagggactccatggcagacatttttctgatacatctgtgcatttaacatctggctgctactagatattcttatactctttaacatcctatataattgctttatagtgttcctttgtaagaacgcttaatactctgttgtgaaacacaggtatttttaaactcacatatagtaatttaaatataacagctagcaagtacttacacacagaaggttctgctgtaattatcagataagttctgagaattatctgcattcatttacatgcaaacagtaaatgagcttaagttcttaaaagagtttgttctattaagtaagttaagtgaattcactgagcaatcccatgtgtgcagttagtttgccaaaaaaaatatgggataataagtactgaataaggaagttgaggtcagtgagaattgttta

SEQ ID NO: 30363 - DNA, 1500 bp, Bovine  19866880638692
tgtagctttatctcctgaaagctctttgttcaccttgagtttagggattcaaaatacgaattttgcgggggatatggttcagttcatagtagatggattctgtaatcttctaggaaagcaactttggaaagatgcaaataggtagcttctcctaattgaagacagaaaattctttctgagaaggtccccttccaaaacttaggtgaaggaatggatggtatacaggggcttctcccatggctcagcaggtgaagaagctgtctgtgaggcaggagacacaggttcgatccctgggttggaaagatcccctggaggaggaagtggccaactgtactggaaacatccatgctattttcaaaacgaaaagcaattgagtgataagatcaaaatgccttcttagtagatagaaaggcaaagtcaagatttgatgctaatggaaaaatgataccaaaatattcaaagtggtttacctcaatctgtgtggtgccagtatgggtagttttattttcttctttttgataatctgtctttcaatattttctataataaacatgtattacttttgaaataaggaaaagaaatgaggcaagaaagcaagcaaacaagaagagacaaatgatacatggagtagaaaggatttctgggtgttctgtaaagttctgtaaatggcagtcaatacatcacaattgcagaggcagattcaagttttggaaaaaaaaaaaacagctatgtgtgcagtccccagaaaatggaccattgtggaggctagaagcccagttaaggaggctacgtggcattgtgggcgatgaatgatgaattcttgaaaggaataggacatggagatggtgcaaagttagcagagtagcaaggagctatagcaggagaaaaacgtaacccagtataaataagaattacatttaagacttataaaataaaaaaaaacaaagaagtaatgtccaaatggaatgagtttcagcctgaggccctcaactggctctcgatgttaagaaataaacaaacaaaacacacacacacacaagaagaaataaatggttatgtgttaagaatcttatagtgaaaattattcatgtctctggaaatgttcattcaagtatgggtatatctctagagaaaacttattcaatccaacctagaatgaattggctggaagtggaacctgagggtgccactccatgcctggatgccagcctttcggggaatgagcagaagaaaaggctggggatgtcccaaggtacagtatttttactttatgttgcctgcaatgtcgtttggtaggttcccctataaaaaggcagacctttctggtgtctctccccaactctcactcattccattatctgattagggaacatatcagagggaaccaactgtgcccagcaccaccccttcttctctattctttgggagccagcctgaccacaagcaacctcaggttttctgtgccttaaatttcacagtgggaggagtctacaggggaag

SEQ ID NO: 30364 - DNA, 1608 bp, Bovine  19866880651600
tttccttaaaaattaaaaaaaattataaattttaggtgccactgtagaggaatttcatgactcaaaagattttccaaatacaaaagcaaaaccatttagtctttagaatatgtctctctgaaagcgaaaccattcttaaccactgacagccctttagatgtgccttgggtggtaagaagatgctatattagtttatgattttacaacagacaaaatggttaaaaattctctggagctagagagtctctgtcaactctttccccctgagttgcgtctcagacgttcacaaggcatcatccacagtgtcaacgtgcagatcagctaaaggtttatgtacaaagctccttctccctttgtgtacataaactgaaggacaaaactaatcattcgagccgtcatttcaattattcggaagaaagaatagttgagaaggctaaacaacgattaaggagaacactgttaaccaagaaagtaaagtttcaattttaatatgatagcagtggaaacttacaaaataaaagtgtatctgttttaaaaggacattctgtcagggcatatgaagatgctataaaatcttaaaagtggacccccaaatatgtttacctatagctatgtatataggacatagataatatttcatgaaatattactaaaatcaaatttcaaatatggcacattaaacactgtttttcttctatttatatagttcaaaacaaccaaggtgattatccttcaactttctaagccagtgtttgggcatcctgtagaattaattataggttccatttgcaatgatggagccaaggacaaagtattgaaccttattgaagttcttaaggctcttgctatagaaatatttttcaattcatactctttcatcattttaaaatgcaaaatacctttgggaactgttaatgattaatccaaaattttttaatactccacaaaaacctggatctgtagcaatgcagtacagtagctcccatgggacttagggtccgcaaataagaactgcaattgcagctctgttgcaaacagctgtgtgatcctactcaggataattaaagtaagttgtcagttgtttaaacaaaaagtggggatgataaaggaaactcatttgacgttggtagtatggatttgagagattatgtacttgtgaggtctttgaggtatataccagctttacagagagtcctataaatggtagtttaagaaaaaaaagatcactgatgtacagcatgcacgcagaatgtgcaaaaattatacattcacagtttgataaattaaaaaaaatcttttaacaatttttaaaggttactttccatttatagttactacaaaatgttggctatattctcacgttagacactacatcttacatctgatagtttgtgcctctgagtctgccacccctgtgttgtccccaacactggtaaccactagtttgttcactgtatctgtgagtgtgctgcttttttgttatattcagtagtttggtgtattgtttggattaccatgtaagtgatatcatacagcatttgtcttggtctgacttatttcacttaccatacatttgataaattctaacaaagaggatacactcaaaaa

SEQ ID NO: 30365 - DNA, 1383 bp, Bovine  19866880675418
tttaaaaattcacatgggtgttactcgtcactcccagttggaaatactgaggaggtttcaaagcactgatttgggatgaagactgtaacagtctcttagtaactgtcacgcataaaatccaccaatggtatttattattttaactgatactagacgaaggtacagaaatcccggtgcttaaatttctcagtttatggaatccttatgttaattcttatgttaaatactttcattccaaacatatcaatacatctgaaaaattcttaagtgctatcagtgagttgggtaaaccagaagtgaccaattagatgggaacgtacaaataaattgttctgttcgccccaaacataaatgcagctgactctccttagtgacagagtataaatagatcatgttatataaggcacattgagttttttttaaccttccaaagaattagcattgcacatagcattactatttaagaatttcctccacacagaacatggtgtttgaaaatctacccccactaactctcaccagaaccaggagagcaaacaaaagattgagaatgtgcatcttgaggagtcctggtttatgaacatagactggtgtaggctttgtcacgaatatttgaacaatgctgaaagtaggtatctggttatttaaatttctatttaacagagttagcagcaacagcagcagcataaatcttagttacctgtcaccaaagtaaggtggagaagggagaaggcaatggcacaccacttcagtattcttgccttgagaacgtcatgaacagtatgaaaaggcaaaaagatatgacacggaaagataaaccccccaagttggtagatgcccaatatactactggagaagagtggacaaataaatccagaaagaatgaaaaacagagccaaagtgaaaacaacacccagttgtggatgtgactggtgatggaagtaaagtccgatgctgtaaagaacaatattatataggaacctggaatgtcagatccataaatcaaggtaaattagaagtggtcaaataggagatggcaagagtgaacattgacattttaggaatcagtgaactaaaatggacttgaatgggcaaatttaattcagatgactactgtgggcaagaatcctttagaagaaatggagtagccgttatagtcaacaaaagaatccaaaaggcagtacttgggtgaatctcaaaaatgacagaatgatctctgttcgttccaagataaatcattcaatatcacaataatccaagactatgcccaaaccagtaaagctgaagaagctgaagttgaatgggttctataaagacctacaagaccttctagaactaaaaccccaaaaagatgtccttttcatcataggggactggaattta

SEQ ID NO: 30366 - DNA, 1248 bp, Bovine  19866880740094
aaatgatagtaggaagtaggatggtattgtatcaccgaatactctgttatttcatgagtccctgtttataaaaggcacagtaagctattgcctataggatttaaaattgcttaaaatcttgtgcaggaaatctgacttttctgttgaagaggaagcttattagagaataagaataaaagaacagaattcttttttgaatggaaactctattcttaatatattgcattattttatttaaaaaatttttggtttttcaatgaacaaatgtttactgatttctgattttgtgtaaaacattgccttaaaccccaggggtggggttgctgagatgaatactaatttctgccactgaagagttgccagtgtgttgattacatgtatggcatgtgacagtcatgtgagggacagaaatgccagagaagcatgtggatgactctgaaaagttggggaaactgcatagaggaaatgacctttgacccaactcttaaactgtgaatagtaatttgcacttttcccaggaagaaagatgcttttttaaacttgcttctgactctcattgactgtgctagctcatgactgctagccttagcaatggatgctaaattatatagcgataaggaggaagaagagatcagaggtattttgctaaaaatgtctcattttatagaagaatctgatagaatggaaaaaaagaaggaaaaatatttgcttaatattatttcttcatatagaaagaacaatatcttcctacagaaaagctaccttgggagtcaattgaaaataaacaataatcttggggcatgaattagaagacatattcctactctagatctgctagcaatcttgaaagaatgtgataactgccttattattaaacaatgtcattccagggtgaaattactgcaataaaaaataagtttgattttagagaaacttattttattatggaataacacaaaatatgtagcacaaacttcacagatatatttatgaacctattaaaatgaaacactcatttttgccctaattatttcccatgaattctatagtcatttaggtgagtaaacacagttaaattatgaaaaaatgtgaaaattgatttgtataatggatgttgaaagcattgtgcttttgacacagacttatggatgaaattacttgtcctggaagtaaattataatcagtgttgataatttatgttagctctattccctccaaataattacatttaatcacagtagaaatcat

SEQ ID NO: 30367 - DNA, 3131 bp, Bovine  19866880791412
ttgatgtgggtggcatgggatatgggtgtttggagtgtgtttgatgagaggaggttgaaggtggaaaagggttaggagacagcttagcgtttcttttaaactattatgtttgtatttgcaagaaactttcttactcaacaactcaagtgccatgataggtttgttttcctctttttaaaatgtcagaagaggacagaaagcaatggtatcttgctttggggtttttgttttgtttcatttattccttcgggaattactttttttaataaagatcaacaaatattaatagggtaggggaagttgtttttccttcataacatgttgaagattaataaaagattaatataattatgcaattttgatgcaatattttaacatgaggatatttatccaatattccttgtcctattcagctcttctatgttaaaagcagtcactagtttagggaaaaactatgaatctcacagttcttatctctagatctagactgtccactttaacgcaccttacttatgtttcattgcttacattgccatttggaattatttttactaatataaatgatcccagagagtgcggaaagcatttgtgtagatgtatttaaaggcataccccattaaactatagagtgtctcataaaaaatatgctttaaaagacttgcaatccattaatcacggaccctcctgagggattcagggaagtgctaacaaattttaccttgaacattttcataactggaatcaattatagcacattcaagtaaagtcttaccatatcttctccttctccaggtagtgcacttatttttaaaaactaactgcacaaatagattataattttaaaaattctctaagctttccagactcctccattcttccagcatcccactaccaagtctaaattcagcaatcagacggtgattgattgcactttacctaagagggaaaaaaagattcccttattcatgcaaagcaaagcactccagtttccatctgtttgagatgaaacattttctagcagcaacccggcagaatccaagagggcttaaaagatatgtgtaggcatgtttgtgtgcatttatgtgagtgtggtttgtgtgtgagagaccagcacatggactgactataaagtgtgtcctttagccccacagaagcattagtgagcatatttaacaaggcaatcacaggcagagaattacaagcacgacttcaggattcaacagtgtatctcatgatttttttttttttaagataaatagcagttgcttctgaaatcaaggtgtatccagaacctcaagatgaattcagtcatcaaagcatactaacctaccccatcacagcccccagacatgctctctctgttgcagacaccagctgaagatttttaatgcacagtgcagttgtgggaactcaaatcagaaaggtcaaatttatcagatgataaacaagaggaaagtaattcaaactatactggaaatataaagcctatagaaaaaaacaacccaattttatgttgagcaatattatcacctgagagcatttcaacttgtattcttttacaggagaaattaagacacttatatttctgaatggagaaatggaagggaaagtggagaatggatggtccaggtttccattgcttccaatgaggtgtcatatcccagtgaggtcatttcctgacttcaaagcatttatctgaactgcctcagtcagccctagtggttataacctgatgtttcttgcaagagacattgatctctacttgttctacttttcagctgcacaagccggcaatgaagaaaagtccgggtctctctgactacctttgggcctggaccctctttctgagcacattgactggaagaaggtggggaccctttattttaaatctgcatgagaatttctgtaacttttcatttattctttcagagtgaagaaaattaaccttggataaattcatgactaagggaattaaaaaaacttaactgcaataaaattccagctaataaagtggaacagtatgaaaaaataatcatcttatttgcatgttagtcagaatacacttaacacgcttttgttaaggaatgtgttaattcaccatttaattcttaaattgaacttttcattgctcagttgtaactgaacaaaacatgcagtttcctaattgataaaaaaagttaccccaattaatatctgcatactatgtaagttggttttccaacaagaaaatttctaactagttgccaagatcatagagtaacttctgactatgtgcaaggagaaactttagaataatatttttaatttgaatgttataattctttataaatgcatgtgcattttgttttgaatctattacttgtataactaatagaagtagagtatactagacacatttaagaacagaagataaaactgaacttctctatttaagtttactgtggatacaagttatgagaaaaatgtaataatatgattaactatattcaaaatattagctaatgatcccatcgagcatatagatacattataatagcaaagatataaatgaccaagtatttcagattctcctttatctgcttttatatttctagtgtaatctattcctgtggccaaagtcttagccatactataaaaatccaaagattctccataatgtaatgaaaagtgaatccttacaagttaaggcagagagatggaatagtctggaaatataaggacttaggaggatttttttcaattgagttgtccatttttaatgtttgttattgtgcatggtgaataatgactgccagatgaacaggaaatgtattattgtcagatactcttaatctgaggagtaaaaggttcctcactgcttttgaaaaattatatgaagtgttactattgtgatgacctgtagatggagttagtgcacagttttttattatatagtggctcatacggaatcaaaatcaagtactgtatctgacatttctctacaaattataaattatatattcagtttaggagacattacattggcatgagtgtttaatagcaaataaataatcttgatctttatcttaggcttattctctgacaattacatagtaaagagaattaaagataagtataacctattaagaaaa

SEQ ID NO: 30368 - DNA, 1481 bp, Bovine  19866880809084
ttgcaaagaattggacatgactgagtcatgcacacatccccacacatgtattttcaaaggtcacaaaaatataactttataacaaaaatatgttcgtctgaagacctagttcaaatgagttgaaaattgtatttttcacaaaagataaattctaagtatttttgagaattattttgtttgtcaaaacatgtgattatgttacaacctgtctgtacttaacatagacacataactattatattgcccaaaggtcatatactaacatatatctagaaaggaagaagaactaatatttatcaaaataccatttaacagtgtcttatttgacaagtacagtaaaaataagaggagaaattcatgagaaaaagggcaagaaaagtgattttgaatatagtcattgatctgatatcgagacaaaaggaaagaccaacttccttacctcaacatttttaaaatatggattactgagaaggatatgatctcaaatccttggagaaagcacagagttatcattccctaagtctattattttaaaggtataatttattaataagatggaatttaagatctcaggtcttcatacagactatcttctaatagttcgaatatagtaacatcattaggctgtcctttggaactcgtataaacaaattggattcaaatcatctcaaagtacttttttccttgcaagtggactcttttttcctatgaaaaattatatttctaaacctggctccacttataatatttcaaggcaatgaaaaggagacttttgtttctgaaaggctaagtcaaagtataaaaataaaaaccaaaagtaaccaaacctaacaatataaaccttgtaagcatcaagaaataaatacagatgattgcatagaacacgcacattttatttatttatgtcaaaacttggcaattgccttttataatatagaggaacaaacataaattacgtatttggaatttatacagcacaatggtatattttgattacaaggccattttttctttcaaataccatgacatttaaaaatgcctattcagttgtaatcaaaataacattatttgggtaagctggacattgaaatagcaatccaatatggcaaagctgaaatgagattaagtgcttggatatttcatgtgattctaaattgtatgttttaaagtacacattgtttttcacaggaaactggttagaatgaatgtgaaaactttattgctttgaatttgaccttgaaatttataataatgataaagaaattcagacatttaaaatctagtactcatacctgaagagactaaatctaaatcttcagaaagtgttctacagattaataacctttctgtttttaaggcatttggaagtggactttatatttttagattttgagaagaaattctccagtgcttctttcccgcttatatgggatctttccatattggttttatatgatatgctatttaggcattagaaagta

SEQ ID NO: 30369 - DNA, 2107 bp, Bovine  19866880876350
attatacttttcctatgaaactctttaatgcttttatcaggtaataccttgtaagtcatattctaaaattcaatagccatattagcatgtagaaatctcagcaagggttggagaaactcagggacttcacagagattgaagtgtgtattttatccaaaagagtaatcaggtatgtgcagaaatccaatagacttagtttattgaacattgattcattgattcattcattcattcattatttgtgccctaggactctgctggctttgaggttgcagagatgattaatacttgattctagttttgtgtttttttaagccctcaagtagggcattgtgaactgattttaaaatagaatggtaattatccttttcaaatgaatacttagtccttcatttagtcattcaaatgagggtgagagagcaattacattgaagccatgagccgctaagggagaaaacacgtcacgagatgtatgtaagtcctttattcataatatatagctttctgtagttcatagattacatttgagttacacatttaattgtcataataatcttttgatagatcaaagatatattaaaagccccatttatagttaatggaactgaagtaaagaagttatgtaaatttatgtcctagaaatagttaggaaattctggagcctgggactccagtgctcaatttataacaaccactgtttctccaaagtaaggagactcgtctgatgatccagaatttctaaaattaggggacgacagaggatgagatggctggatggcatcaccgactcaatggacgtgagtttgagtgaactccgggtagttgctgatggacagggaggcctggtgtgctgtgattcatggggtcgcaaaaaagtcggacacgactgagccactgaactgaactgaactgagtgaaatactaactgaacttatattgtttgataggtagaaaggtatatgcaatgtctcaatataaatgatacctccagtaggaagcgcaccttgattagacagatacagattttcatataaactcttataattactactgtaattaattgaccattttttgcaattgtatttatttcccaccaaaagcaatcctgagtaccctcttttagaaagacaaattacttactaaataattattccttaccatctttcttcctgagtgagtgaaagtcactcagagtcatgtctgactctttgcaaccccatggactgtatagaattctccagacaagaatactggagtggggagccttttctttctctaggggatcttcccaacccagggatcaaacccaggtctccctcattgcagacagatcctttaccagttaagccacaagggaagctcttttcctgagtaatatatagcaaatttcaaaagaatgtgctctcttcacttttgtacttattgtggtgcccagtgcatagtatgggctgagttagaatggatttagtaaattaatatttgccaatatgtgaatttgacacaagtttgagcaagctccgtgagttgatgatgggcagggaagcatggagtgctgcagtccatgaggtcacagattcagacatgactgagtgactgaactgaactgaatttgtaaatagtatatgtttatagtatttggttggatatattttcttgtgaatactcaagtgtttgcttatctcccaattccatttaggtacaaaataaccaatttttttttttttttttttatcttctcaatttcacaggattataccttgacaatgtactttcagcaagcttggagagataagaggctgtcctataacgtaatacctttaaacttgactctggacaacagagtggcagaccaactatgggtgcctgatacttacttcttgaacgataagaagtcatttgtgcatggagtgaccgtcaagaaccgtatgatccgcctgcatccagatgggacagtcctttatggcctcaggtctgtagtgaccgtttcaaaattgaacttttcctgagcacaatactttctgctctttattgaaggggaatattgtgctattttcctgagtcctcctttaattctgctgataagcagttaaacctcctattcaataga

SEQ ID NO: 30370 - DNA, 1589 bp, Bovine  19866880903026
ttatataatgtcaaattaaatgtttgtagagacagtctattataaatgaaataataatgaagtcactttcctacaggtaaagatcacaaatactagtattttacatcctccaagcaactgctgaaaaatgcaattacttttccaacttatttaaatattgagagctgtgaaatatacattgtaataaacttgcctttgatttttgcagataggtaatgtcataagtgaggttgtgagcaatattagaggataataaatcagattttaatactttttatacatttatttctctgaaagtacattttattcatgttaattaaagagaatcaataatagagtgctgagaaaatggctttataaagcacatttggttagtgttgaacaaacattctgtcagggtactgaacaagaaggaatggagtcaaatatgtcactctagatgctgctttccccaaatattgttcttccatcttgttcccacttactctactcggcctatggggtgaaataaacatagaggtaaatgtggagttactgcaggagaggaatactctataacttgaataaatggactctttttcttattcactacttttcttttactatggatgtcacatttcgttggtccagcctacggctaatgtgtcatcatgatgaatgccacccagtgctatgagacaatagtctagtgaaatgagggcttcatgatgagctgtagttcatttctgatttttgcatagattggttgagtgaccttgagtaaattgggtcatgtcagcatattggagtttttggcagcatccttgcttgcctcatatataatgaatgtattgcatgtggtaacctttcaatatgaataatcaaagttattaataagacagtaacgatattgtactatcttataactaatgttgctaggttactaaatttatctcaatagctagtttctttattgagattataggaatgcttttctacttgtgtgttgtataatttctttaaaatatttgaaaatatcatttttctttatgaaggtataattgaaagataaattataaagtattttaagtatataatatgatgctttgatatatgtatacactgtgaaaagattcctccctactgagttaattaacatatccatcatctcacatatttattaataaagtagaaagaggatatctttgatagggaatgccccattcttcttcagaagctctaactaaaataaataaactgtaaagggaaaaactggtaatttccaaagaggaaaacaggataacatgagagatattagaaacttatagaaagcctaaaaattagagttggatttagttgcaagtcatgtccaactcaggactgcagcctgccaggctcctccgtccatggaattcgccaagcaagaatactctagtaggttgctatttccttttccaggagatctttctgattcagggactgaatgtaggtcttttagtctcctgcattggcattcgagtcctttaccactagtgcttcctgggaaggccctgattagttgccaggcagtgatgcacaatcctatatgataggctttctttgggatggaa

SEQ ID NO: 30371 - DNA, 707 bp, Bovine  19866880904298
atgactgtgacatcaccctccggaacttttggagtcaagacccatgttttgttagaagcataatcttcatagtcatcatcagatttttgtctagtgaggctaagaaaaaaaaaaattgatcaagaatcacatagactccatccaagttgacttttagtcacagacctttggtggaaaatgagaaacgaagtagggtgatgggagtgtgttacaatggattgcagggaaattctcagccgagggttagtctagctaattaaacttcacagaggtagattaaaatctattcaggtgtactctttggttttacagaatgctctgtcctcccatctataaatatactacgctctaccagttatctttgccttttcttttgttgatgttcttcctgtccacctgcccaacttcacaaagcacttattaagaaaaaaatcacaagcattttgttgaaagcaatgcttaaatgatcataatctagtctaggcgttcaggcataatgtctacttctttctcctttgagaagttaacttgttccaacctattaatgaaataagaggctgataattagattcattcccacacaccaccagacaaatctcttcctcctcaactgaactactaaggagagcgtcagtcttgctgcattttcttcccccggggtgtgtgtatgtgtacttttctcccctcccttgcactggaagcaaggg

SEQ ID NO: 30372 - DNA, 1334 bp, Bovine  19866880967303
tctcctctgtcactttcatcaagaacctctttagttcttcctcactttctgccataagggtggtgtcatctgcatatctgaggttattgatatttctcccggcaatcttgattccagcttgggcttcctccagcccagtgtttctcatgacgtactctgcatataagttaaataagcagggtgatgatatacagccttgatgtactccttttcctatttggaaccagtctgttgttctatgcccagttctaactgttgcttcctgacctgcatacagatttctcaagaggcaggtcaggtggtctggtattcccatttatttcagaattttacacagtttattgtgatccacacagtcaaaggctatggtatagtcaataaaacagaaatagatgttttatcagttcccccaaacgttttatgctctagagaaaaatattactcttatcatagaaagggagatgtggaactgattacagatgcatgttgatagaaataaccttcatatcaagttggaagtgctggtagacagagatcagccacattctaccatgtgacaatgtttctgttattgccttgcactgtgatttaagtgttgcatttttttccctagctgttcaggtatttgtctcccaaaatagatgagatgtgttttgatatcagcattgtgctttgcacatctttccatctgcaatggtactttgcacaaaagattctcaaatacaggctgattaactgaaggatagagaaatctaaactcacaagacattatttcccaaattcccccaccttcttgccacatttcagtgacactaggttatgtttttgcttactatttttcataaatcaatgtcttttaaatctagcttgtccttgtgcttagtcactaattcatgtcctcctcttgcaaccccatggactgtagtccaccaggctcctctgtccatggaattctccaggcaagaacactggagtggtttgccatgcccccatccaggggatcttcccaacccagggatcgaatccacatctcttacatttcccacattggcaggcaggttctttaccagtagcgccacgtggcaggcccaaaaacccactagtgaagtctctcagtcatgtctgcctctttgcgagcccatggactatagcctaccaggctcctccatccatgggattttctaggcaagagtactggagtgggttgccatttccttctccaggagatcttcctgacccagggattgaacccgggtctctcgcattgtaggcagacgcgttactgtctagccaccagggaagtccccccaccaaaaaaaaaaaaaacccactag

SEQ ID NO: 30373 - DNA, 2007 bp, Bovine  19866881117319
gcagggagctgaaacattgtccaatgctgctgctgctgctgttaagtcgcttcagtcgtgtccgaacctgcgcgaccccatagacagcaggaatataaattgatggttatgtagtgagctcaaaatattttcaatttctaaacaggaccatttcaaagtggggttttaagaaatactttattataatgactaatgctagccaattcagaccccatatagtgactgcctctgtggattaatagcagcaaagtagcttgaaggaggcaataaacctccttcataagttacaagcacacagaactgggtccagtgaatattattctgagttcctattattctgagttccttagtagacagcatttctttttttttcccatggagtgcagcctaccaggctcctctgtccatgggattttccaggcaagagtactggagtgggtgccatagtattgtctacaaggcgataaatgctacagtacacctccttgcaatgtgtatattttttctgaaggtctagttcctttagagttctgcatagctaatggttttgtgcaccatctggtcttaaaatctttcatttggttttatttatttttttttttttttaactttacaatattgtattggttttgtagacagcatttccattgaaaatatgggcagtgccatattaaacaaattgttgtaataggaatccctaacaaaataccacctacaattcttcactattgattccctcttccatttaaaaaaaaaaaaaattagtcactcttacaatccactctttacaaagtatcagttgtcttcttaaaccacaaagtaacattatttcacttcattatcccaaagcttcttattacattagaacaaagggtcacctgcttctataaagagctctttaagtgtggaccctcttacctctagagtgccatcttataccatgatcatcagcatcaccaagttccagatgcatggactttcttaaacaaagagcatttattctcatctttgctttattctttcttttatgctttagatctttgctttattctttcttttatgctttagatctttgctttattcttccctctccttgaaatgtctttgcctggatctgttcatccttgaatttttctcaccttctaggtcacaagtcaaatgccatctcttctttcagagcatttataatgatctgacattaactagtgtaattcgtgcatatatgcttatacacaactatgtataattctatctacctacctacctgtttatctgtctatgtttctaacctatttacctaaaatatgtgctacctaagactatgagatatgctgcagaagaacaggaacaactgcacttttgttaaccagtgtattaactgttatctagaaaagtgccttcctagcacatagaaaactctcaataaacatttgttgactaaattaacgtacccagaaaatacatctatttgactttcactccaacagaatggagttgactgtgcacgtattatttcttcactgaagaagtaataaaatagtctaagagaccttaagggattgcctaaaatcacatagcttgttctctaggaaaatctgagttaaaatccaagtgttttgactcttaatccaatgtgcttactacttactatactacactgcttttctgatttttgcctcaagcgctaatcatctttttgaattatcacttcaaaacatctgttacttcaatacttatcagcgggatatcaacattgtaggaaatccctagtaaaaacagatctactgctgtctagctgttacagaggttataaccgtgtatgtgcatatgtgtatgcatatatgtgtgtttgtgaatatatgtgtgcacatatatgtaatataaataatatgtatatgttgtatgtgaaacatatctttgaaaggggtgcttgtttaaagaatgattttaatcatcataaacaatttacactgatgtactgtcttagatatccttatcactgtaaca

SEQ ID NO: 30374 - DNA, 871 bp, Bovine  19866881192507
tttaataatttttttaaagaaaatactatatcttgttgctcttcacactctatgatgaggaaaattgatttcatggttcaaatagcaggcctaccagctataagaattaaaaaggtcattcaaaaataaaccaagttgtacaaagttcccagggtacaagatctgtggatcttatggatgcagatttttgtaatttaaatatgcaaattctctcagagttcctttcctaaagtgagttttatcactctaaggatgacattgcttgagtgatacagaggatagcggtaggaaggtttaagactaaacatccaggctactacatactagctgtgtattgtttttaaataaactaagtacctttatctttctgtgacctaatttctgatctttggttgtttggttatttttttctttttcctccctcacgcaccctcctgcccatatataaaacaaggggctgagctgaatgaccttaaagtcaatatggagtaatgaaaagacatgggcttagggatctggcaaatggggttccaattgtacaatggatataatacaattactatggggattaattagtaaatgtacataaagtgactattattatggataatccttaatgggaagtgggtgaatgatctttccagtttgcttgctttttattgctatttttgttgcttttaatctgttttctttcccatctctcttactttataattcttttttcaaatgatatcgaacctctagcatggtctccttgaagctttcaataagtagagatccatatgtacaatactctttatattgtaaagtaaaaattcatataatttaagggagatcactgatggtgattgcagccagaaattaaaagaca

SEQ ID NO: 30375 - DNA, 821 bp, Bovine  19866881235333
ccatgggtcacaaagagtcggacacgactgagtgacttcagtttcttttcttttttctttgtgtgattggggcagcaggggagagagtacatgttacaggcttttcctatttcttagttgtctcaaatgtaaaatgagggtgtctttaaatttcctctcagacctaaaaattctaagacctaaatcaggggttggcaaactgaccaagtccagccctgccttctgtttttatgaataaagttttattggaacacatccatgatcattagtttaaatattgtctatgcttactttcaggctacaactacagaattgagtagcctctgaagtaggtctcttttcatcctcaacattttttttaagtctgatgaggaaattgagacaaaggtcaactcacttgcccaggtttatagggcaagtaatgggagagccaagactcacattcagtcattctgcttgcagagttagcaattctaactagagcactgagctaccctgatttgggaaggccacaataaaaatgaatgttgaatccttctgatcatagtgactatgctgtgtttattttgtctttagtagcagggttaacattaacaggaacgcatgtggaagcatgaatggaggagagggaaggtgtcagcaggttcaacaaagttgttaggaaataacaccaagaataaaatatggcctgcttattttttcaccatcacatgcagtcctaaaaggtagttacatgttcttttccttttttttctcttatggtgcaaatcacagacacgttcacaaacaaatttacaactaagatgctgacttagtcttca

SEQ ID NO: 30376 - DNA, 1017 bp, Bovine  19866881539096
gaaaattctttgatgctggacatatgttcgaaggatagaatgccaacgtgagtaagtggaggtcactaacattattgacttaacacctacataaaattttaggagggcttttcttcacagccatcattccattttcacacctcagatcccaacgccgtcttgtcagtgattattgtttgaaagcaaaatggcaaattgaagtttcagaaaagagtatttcttttctgcaagttttctggaagagaagacaatggaggattttatagctatgcaatttcttaggctgtaggtttcaccacagagttccagacaggtggtgtttgtattattaattactatataatctcttgtaatacaccactttacattcattccattatattgactttgatttttggtgcctttgaagatatgaattgaaatattcaacaacgactgtatgtttcctatgtgtatttgacaatgatgacctttaatctcagttgattattactgaaataaagaagaaaaatgaatttcataaatgattttcataaaaatcttttaatttcatggctgcagtccccatctgcagtgattttggagcccaaggtaaaattgctcatgaaggtaagctagaaaccaaaatgaaatgttggtatgttaaaatattgattcctatatgggaatcaagacaacaatactcagcagtatactgcttatggtatactttagagaagttattgaactaatataaaaacccacataaaacttatgaatttaattaaatgtgtaagttgcttattctgtaaactggaaatatttgactaatggtttgaatttagtagttgtattcatagaaaaagatgaacgtttattttttcaataatatgtatgcagactttagttcaagcattgaattgtaagttggcattgcttaatttacttatagaaatgattaaaaactttatgagtaaaaatcaaagtgaaaaaatataaattgaaggctttattgccagaaaaatggaaaaatttagg

SEQ ID NO: 30377 - DNA, 1238 bp, Bovine  19866881579171
aggtttttgagaatacatgtggagtcctgaaaaattacacttcattttaaaaatatttcaataaatggtagtgattcttattagtgttattaatcataataaaatatatcctggtaataggtcaaagatataatgcaattatatcttggtttccattgactttttaattaaactatttgtttacaaactatcaaatgcttaaaagaacaaagagaatccatatacactttgatactattgattccacatcacattaattcaaaaggactgtccctgattatatacattcttatatggcaaatcctagtagcgtattttaaatgatattcatttatactaaacaaaaacaagaacaaaatattttatttttttttaaaaaaggccttctgccatttctcaactactgaaaataattacaaactcctcaaggacaggaatcacgtatgtctctctctccctccagctccctttctgagtctttctcattctccctctaacagcagaagcagcatttaatttaatcaggttttgttcttgccatgattgcattatgcactaaaacaacaacaaaacaggaaaaccagagctccagaactgtggctattttttaaaatgagagcataaacacttaagaggtattatacccaaatctgggaattttacaaccaggacacatttctaacatttgccactttgactaaagcatcctatttaagaaagtttcatttctacctacgtggtctacctggtgatgatgatcatattctgttagtaaaataacaagataaaaccattttaaaacatggttctcaaaactggctcattaaatagaaaattggtttccaaaacctaaaatctcaaacaaagcatctaaaaaatccaaaggaaataaagaaactctatttttcatatggtctataattccacagatctttcacctgtaagcttggcaagtgcttaaaatattatgacttttagaacaaaggtatcattctctaatgaattcccttagaaaaatggtttgccatacaggcatactaatgggattcaagtaatgagcattcttccaacacacaagccagatgcaaatttacacagcctagcagatcagccctaccaatgtccagagagagtactggcttagtagtgctggaaagaggaatggtgtacacaactgatagatgagagaacatttcaagagattttcagcttattaacttacactctcatttggcaaa

SEQ ID NO: 30378 - DNA, 940 bp, Bovine  19866881712335
ctggagtgggttgccatgccttcctccagaggatcttcctgacccagggattgaacccagggtctctcacattgcaggtggattctttactgtttgagccatcagggaagcccaataataatatgactattctctatcactggcacctagcatgatgtctcaggaagagtagatgctcagtagaaattattaagggacagtgcccaaataaagccatatacagtcaagcacttttctcttggaaaatattttgcatgaacagtgatgtcttttctcttagacaaaagattctcactaggattttggatacactattaaccctaagattaccataaattactttttacaaatggcctttggtcaataatcaggtcagaagaagggaccagagtctaaaccagtgacactgttttgcctaaaactcttaaataagccaacatttgaattgttctgtcacagaagcaaattagccataagtatgcaactgatttcctaagtgactagtggaaactgtacctaaccactttgagaagattaatatttaaactacattatgggagaattatccataagaaagagtggaatgatttacagggtagcaaaattaaaaggcagaatgacaaagctatttttcaagacaggaaatatagtttttaaactgagtactactaaagaactaaataataataaccataacaacattaaacactatcgaatgcttatgttaggcactgtgctaaggattttctagatcatatatcttttaatccccatgccaaaatttttgctacatgttattattatccacattttccagagtagaaaagtaacccagctaggtagcaacttaaactcaggctgtctgtccttagagattccacagatcccaaagtatctgacttcatctggaatagaaaacaaaattaggacaactccttaa

SEQ ID NO: 30379 - DNA, 856 bp, Bovine  19866881730445
ttctcttattcctggaaatcctgacctcagtactagaacagtccttattttggtccccattaacagattcaggattgtcttagaacaggtcttccatctgtgaaagaacatatgtaaaaatattctctaagtctgcatgcttccagaacaagaaaaagggtgttaaattctgctgtgtattcatatctctatagttattatagcaccctaaaacagaacccacaaacttatgactagcagattttttgtttagtcatttgagcccagaatggccttaaaaccaactaatggtcagggaagtgttgatttgatatcatagggtttaatatcacccctccccaaagtctcatactgagaataatgagtatttactgtctaataagagatacttccaaaagaaaacaatctgtttacttaaagcaggacaagaaaatttatcaaggcatcactgaactatttttcttcctagaaaaatcaaagcaaacctgtattgatatcagagttgatattgaatagcaccatttaattgattgcatcaattccttatgaaatttaatatgggagttagcctccatcttggtctttttgtccactcccagttcttgctggtttgtttttttgtgtgcggtaccatttcaattgcctctgttaagaaaaaggaaacaccaatgctgaggggcatcttgattcttgtaatagttgactgtgtaatgatcaaaagtctgtgtgttactttgttttatttctgatgccattcttatcttcaaagcattgctccataactagttgatacctacaaagaagttacattaacaactttcttgggaagttatcagaagatcacagttatagattt

SEQ ID NO: 30380 - DNA, 996 bp, Bovine  19866880433851
tttcagcattactttactagcgtgtaagatgagtgcaattgtgtggtagtttgagcattctttggcattgcctttctttggtattggaatgaaaactgaccttttgcagtcctgtggccactgctgagttttccaaatttgctggcgtattgagtgcagcactttcacagcatcatctttcaggatttggaatagctcaactggaattccatcacctacactagctttgtttgtagtggtgctttctaaggcccacttgacttcccattccaggatgtctggctctaggtcagtgatcacaccatcgtgattatctgggtcgtgaagatcttttttgtacagttcttctgtgtattcttgccacctcttcttgatattttctgcttctgttcggtccataccatttgtgtcctttatcgagcccatctttgcatgaaatgttcccttggtatctctaattttcttgaagagatctctagtctttctgactgaacaatagcaacatgtattaatacatttgattgcctcttcacttatgctgtagaagtataataattttatacttatgcatatcattaaaaaacaaaacaattatttaatatttagtgtttcatttggattaaaatattgatgtttctttactggtccaataagtatatttttcctattgagtgagcttaaagaaaatgattctgcagaataatagtgttcagaattgtaggcgattaagggagaagttaactgttcaagatataactccataaagatttactgcttagttgaaattcacacttttaactagcaacagcagggtggctagggtaatgtcctgtgaagtattgatcatttatcaaaggaaaaacctcccgctttgttgtggtactgatgaatgtgtggagaataaatgcatttgggcattctagcttctttctgtaagactggctttttgatcacaaatatacaggcacaattctgacatcttcattaataaatttt

SEQ ID NO: 30381 - DNA, 1368 bp, Bovine  19866880446466
ctgtgtaattataatttgaacattttccatgtgtatgctgtacttcaataaaaatgctaatttgaaaaaaaaaggttcctgacactcccaccaacaactgctccatgccttacacataatatttactgtagtcaattaacacttttgcatggcactgcttaccagccttcaggcttttttaattatcttttatttaaaaacagattgttttatgattcattttgtcaggctctgcctcttgaaattttcttcttcaaatctttctaaatactaacttgacagtatctttcattttcaaatatgaacaaagttgttataaaacatttttatgtccactaaggtactggtttttaaaatcagggactttgatgaacagaatcataacataatttaagatatagttgtcagtgggaggataaactaatctaagggaagtagttatatagccttatgcttttttaatgaagccatatttcttgatgctttaagtccaaaatattttaaaataaaaatatgtaaaccattttatgttatattcagttgaattcatggtgaaataaaccttaaatttctattctttaaagttttaattaaaaaaattaagttgtatgccaaatcatgcaaaaaatgtacatctcgcccactcaatccacttaaaactgtactgatgctgtgctacttaaacttgcacacgagtaaacattatttgcccatctgtaacgtttctcttcagaaaggaaactgttaacgcacccaagtatctgatgcttcacgactgtagtcagcaagcagatgactgtagtgaatgaggcctcccgccttcttactccctttcccatccacaagcagcactcagtgcacacagacacactcaaaagaacaagtacaaagaaacaattatcacattgcaattccgtatccctcctcctttttgagtatagatctgcacgtataaaagggtctgcaagcccacatgccatatgttaagtaatcttggcttgcagaagcttgggtggagtgctcggtgtaatctgtagatgtgcatttatttaagcttcgcagcgttttatggttctacaaagctccgtgggattgccatcacactacaatcacagcaagaatgtgactgactacctcttttagacaaaactcgcacctcaaattcattttcgatcttttctaatattttgagatccactgcaggtatctgtgtttccaaccccaatctgtgggcctcgtgtatgtctgtgagcagttccatcctcaggcgcgagcaggagtttattctggtgtagcaatactgtcctcccatcatccagccggatcacatcctctgcaccatctgtttgggatatatcttcgctgcag

SEQ ID NO: 30382 - DNA, 3103 bp, Bovine  19866880639154
ctcaaatttctactcttagtaagcctaatactctacaagacttacagcattaaagttactcacaaaagaagaaaaaataagtacataaattttcttcaacccactgacatttcttaaagggttaaaaaaaccccaaatcattgaatgagatgaatttttcaggatcaaggttggacagatttctgttattctgctgatgaaacttcttgtctttaacaagtgtattgagcaaactacaattctactgtatatggagtgtgttaatagtgtataatttggcctgcagaccaaatgataaatatggaaatacaaacttctgaatttttatatgacacccagtggttttcatagtaattagctttgactaaaaattaaagataaggacactttcagctgttggtttccgatatacaaatgtaagaagattgttcacctgttttgaatgtctgtttaattctagatcaatgctattattcaactatgatcatcaaaggtactgttatttggcaggccctcaacatttctttatccaggtttctgagtaattacattggctttcattaacatgatcaaataccagctccctgcagaaaaatttgagtctacacacaccagttttcacttggcaacttgttctgataacaaaactgcccttcaaatctaaaagcaacagccaaatttcatggcattgaacaaaatgatttctagagtgaagtgacctgaagtgacgatcaatcctagctgaaattttttgaagagatgtcagaggtttttttgttgttgttattattttaggagtgagatctatcacaacctgtaatgttgaaccaaggagtatctgtgaaaagacagaaatctctaagagacctagtcttagaaagatcattaagattcaggctctaaagctagaccaagatttaaatcctttttccagcagtattgggcatatcattttatctcagagcttcagtatctttgcctgaaaaatataggtagttaattttacctgacagagtgtttgtgaggattaaaagatgtcatttactaagctttttcacaaggattcttccatagtaagtgctcattgatagaagaaactctcattaacaattattaactcagaaagtaggcatactattcaaaattagatagctcccaaaatatagtttttaagtgattataacattaacacctttctttttagtttgttgaattttatctcaaagcaagaattaaagtgaaatcacaaagaaacttgacatgaagaaactatgaaagaaaaacctgggcttgtttccgggaaaaacaacaacagttaagagaagagtcctaagaaaaacacatgtatttgtagtttgcaagtctgttatctgcatccatcgtattttggaacacaaatcatatgtgttgctaagttatctgagccttctacataccaccacctcctcctccataaaatataggttagctggcagtattaaagacagaattatagatttatttacacttcattaaccctttactctaaaaggattgataatggcttttgaagttctgtaaagtatagccagatgataaaaatttcacctagtctataataaagttaaataacaaggacaaaaggagagacaaaatgggcatgatctagagctgaaaatgagattactgcacaaaatacaataaatatctatttaattattaaaattcctagcagaccaaggatatcatctccagtttcatgatttatgatttcttatgacttcttttccaaatgacaaaacaaacttgtttcttaagaggagtacaactattcccagtcttaaaatgattagaaatttcccttgaactattttgcagagaagcctccttttaatgtattatgcagtgtcctcaatagctgcattagggctaacagagcttctgtttataaggctgtttcagtatcttttaatacaggttggtatgctcacactaatgtgtaattctgcaccagcagttctataagctagcagcagagtagatgcgtatagcatgggcttttaagactctgtgtaaatagtatttcttcctctctgttgagccatcagtaggcatttgagggcccagtttctggaccacaacagccagatccatgtcaacagacagctgagctgggaaaagggttttcttcctagaaaaattgagtggccttaacatacatcttttaagtagcctatttaattaaatttctatacatctactcttttacaaataagtgattcctgtgtgtgtgtttccccccaaccaggctttacatatttctacaaaggaaaggagtactggaaattcaacaaccagatactcaaggtagaacctggatatcccagatccatcctcaaggattttatgggctgtgatggaccaacagacagagagaaagaaggacacagcccaccagatgacgtagacattgtcatcaaactggacaacacagccagcactgtgaaagccatagctattgtcattccctgcatcttggccttatgcctacttgtcctggtttacactgtgttccagttcaagaggaaaggaacaccccgccacatactgtactgtaaacgctctatgcaagagtgggtgtgatggagggtttcttcctttctttcttttctaggagtttgtggtaacttgagattcaagacaagagctgttatgcggtttcctagctaggagcaggcttgtggcagcctgattcgggctgacctttcaaacccagagggttgttggccctgcacatgagtggaaatgcactcatggggaagcttccatgatgcacagtatctgctgttcttcagtcctctgtctttctttgtcattcagttctaggcctttcctctgcacgctcaatgcccagttaattttcaggattacctaaagaggaaaaagaagaaaagattattcttagaggtttctaatattatgttttgttttgttttctgacgtctgagcccatttctggggggagaaaagcaaaatggaaaacccacgaatttttgcttcatagcaaggaaaaagaaaaggctaaacaaaaaacccaccattaacttcaggaaagtgtaagacc

SEQ ID NO: 30383 - DNA, 1744 bp, Bovine  19866880647968
actgatttagaaaaaaaaaaaaaaaagcaagttcttaaaaacaaagtaaagggaaaagtccagatcatttgtagccatgtgtaaaattagtttcacattttgcccctttattttaaagaaacagatctttcttctgtgttccaaaggccctgcatttggctgtttggttttagagagaaaatattttcatatgtgtggataattctccaagtgaaataatattttaaccgaaatattgagccaactactattgagaaaatttattacttgatgtaaaaacaaaaaagtaaaatcttgtaaatatggtcaatatagtatttggattgcacttaacagaaaatattacacttgcctaatagttagcacttttagggttttcaaataaagagaagggaaaacttagtggatattccaatcaaaatgaaagaagattctgaaacagaaagatcatttgcttagctctaaatccaggaagatgccaatttctgatttctaatgtcaataaggtttgtctatgtttcatgtagcttatacatgttatataggatggaagtaatcgattttgttgtttaaaggaacatttattattctttatttacagctacattttcagatataagtactgcaaattacaggatcaatattaagcattcaagataaaaatcaggtcctttgacctaaagctgcttcaggatgaagatttagtgtaagctaagtatctgtcctatacatatatgcaacttcatttatcttcatttagaatttagaatatgctgctgctaagttgcttcagtcatgtctgactttttgtgaccttatagactgtaacctgcaaatctcttctttccatgggtttctccaggcaagaatactggaatgggttgccacttcctcctccaggggatcttcccgacccaggaattgaaccatcatctcctacatcttctgcattgcaggcagattctttactgctgagccactggggaagcctgcaatttagaatctatgatggaattattccttgagttaatgtgggttatatgcatatgtttatgctagtaaccagttctatagagctttttccctttctattttcccggaagtgatcaagttctcccaggtctgggataatgtgttattttgtggccaacaccagcaactacattgtcccagatccttccctattacatttctacctcctcaagggaattaagctactacttaatgtctttattttcacctgattttctcacgcaggacacagttgattccttctgtagcaataaatctctgcatgcccctaccatttctcaaccaaatcactttgcaagtctcaactaacttaactattgacagctttctgttttaaattttctcctttcatcataaacttatgtaaatcactgtaatttccacctctgagataccagtttttcctttgatatcacacagaataaatggatttcctctttcagaatagcatactaagaatagaagttttagaaccagactgtgtctattaaattcccaatctgtgtctcttatgtctcctgcattggtaggcaggttctttaccgctagcaccagctgggaaggccttaatagctataagaccttaatcatccttatacttacttgctaatatcttgtttgaatcctggatcgtttcatcatgcttgtattagtttcttattgcctctgtaacaaattgccataaaatctagtggctagaaatgacacaatt

SEQ ID NO: 30384 - DNA, 931 bp, Bovine  19866880785107
actttcttcagttgaaaaaaaaaagtgaaattcaagttgaagttcaacaactttttatatagtcacagtattgtaagcagttttacagattagctagtataccctgtatcattttttagatcagacaacacagtgaaactgtcagataattacataagaaacaggtttcctgccaccttaccagggatcattttgtggcatcatatttctacccatctgacacccaattttcccaagttccctcctacaatggaataatggtcattttaagactttgaggaaatttgtcatagcagtatagttccatttaatgctgagatgatccacttagcagttcgtaaaaatataaaatgtgcctacctgaggtgaacaactgttttgctctttaacaggaggccctagagcatgaataagggaacacatcacagtctttttccaaccagttttttcatttggatttcaatcatgctgaatcagtggcaattaccctcaaatagctatttcatgactcttggaaaacttttctttctatgtttcctcacagaaactgtccatgttagttgagaatctagtaactattctacaataggccccaaagaaggaataacacaggaaatgaatgtgtgtatacacagaggatgcgtatataagtgctcctttatatgaaacttgtgggaaactatgatattattcttattccacactttcccatctgacccctgcctataaatatcatgaactttcatttgcttttacatagcaggaccagagggagagagccctaaaatttctacagaatgttatgaattgcaaaatgctttagaaagcatggccatctcattctcacaaaattttggcggtgatcctttgccattttacagctggaaaacgaaaagcagttcaaaagcttaagcaactgtctaagacacta

SEQ ID NO: 30385 - DNA, 1969 bp, Bovine  19866880978904
caagtgaaaatctgagactgtgccaattcagaagccagaactgtggcatcttggagataaacatgtaagaaatgtggcagctgtcttaaaatacctagagtgtgtcaggttacaggacattaaacctagttcatgtagtctcaagagacagtactcagactaggcgaggttttggttcaatatttagtcaatatctttctaataactcgagctttttggaagtagaatcgactacatcagtaggaagtgaatgatccaccacacaattgtaccttcacaaaccaaagcttccctgaaagctcagttggtaaagaatctgcctgcaatgcagaagacttggttttattcctgagtcaggaagatcccctggagaagggataggctacccactccagtattcttgggcttcccttgtggctcagctggtaaagaatctgcctgcaatgtgggagacctgggttcaatccctgagttgggaagattcccctggcgaagggaaagattacccactctagtatgctggcctggagaattccatggactgtatagtccatggggtcacaaatagttggacatgactgagcgactttcactttcacttcaaaccaagggtatattttctagaaacatttctggagaagacgttcttagatgttctctaagcctctttgaccgatcactcctatattacttttaagtagagcatgaatgacacatccatacatggcatccttattcattgattcatgctattctacttctcaggctttggggatgctgcattcttttagccgtgtacattagaagaattctgcaaattgcagaattttaagaaaaaaaggtatgttttgactgttactggtggtaattctataatgaaaaatatatcttattggtaccctgatgttaaagataacactgaactcaggacctcaaagtgaaatcgtgttaacacgatagcagcagcaatcattctcacagatccttgcaggatttccttctttccttgaaatatgagtgactaggattgccaatttgtgattgccaaaactacaccataaaattccttaaaaaaaaaagaaaaagaaaagtaagagggacaacgtctagtggctgagatggtaaagaatctgcctgcagtggaggagacccaggtttgatccctgggttgggaaaatcccctggagaagggaatggcaacccactccactattcttgcctgggaaatcccatggacagaagagtctgaccagctacagtccatagggtggcaaagagtcagatgcagctgaatggctaacactatcttttttgtccactaaaatctctaaagtattataagagggaggacctctgaaaatgcattttgtaataggtaggatctgttttgtttgaaatagctccagctcaaaatgttagcttctagaacatcagtgttcccatcaagagaaaaaaagaagctagataacacacacagatacacacaagcaacagaaaacaaggaaaaagctgtttgaaggccttggaagaacaagaaagctagacttaaaggattaagatgtcaggaagaaaggaaatatcttacggtgaatctcaaagtgtctgcccatccagaaaatgctggccaaggagaaaactgcatcgcagtgtcttccagtctcataagcctgagtagataaaaactaaagttccggactataaagacaggcaccacactaaaagacaagatttagaaaaaaaacaaattggtctatttttttccctcaagaaattctaccagttactacactgtgtacaagatgcttaaaacttgagcggaggtggacatatgagaggctaaaattgaccagggactgcagaagtcccacgttgaaagggggaataagaacaagaattcatgaccttccaaaaaaaacaggctctggtaatcaaacctaaattttcagttgagacttttaaggaccacacc

SEQ ID NO: 30386 - DNA, 1093 bp, Bovine  19866881105940
tctgcctaaagctgatgcactgatattccatttaaagaataactgcctggagatttcagcggccagtctactggatctgaaaagttgaaatccctgcaggggacttgaggatatatatattgaatcttggaatctggggaccactctgcctcagtgaccctcattgccgtacagatgtgtgacaaaagagatgcgggttgtatggatgtatccgcctttttacattgcactgttggccaaagttgcatgcatcactgctgaatgaaaacgtcagataggatcacaatgctagcctcaggtttgtaccaattctcattaccctagtcttgtaaacttggtgtatatcccacaatatacagagtactaaattctgtaacaaagacaagtgcactatttatcagagacactataattttgagataaatgtattatactatgtcttataaaaattgactatatattttactgaggccattacagttcagagagtctattagtctttttccttgcagataatgatatttactggcaaaacaactcaccaaatgccttttgggtgacattttaagtttaaagaaactgaagatattttccccctattagttattattgggatctcttcatattaaggctgttttattctctcctccttctctctctccagccctctcttcctttattctttctctctctctttatttctgttacattcatccctcaatataactttttccctggttgaaatgcttcccttatgtcattgatttaatcttggtgagctaattatattcactaaatagataaaaatcaaatatgaaactagacaaaattttggcctagagttcagagctcattcaaaggaatcacacagattttcatttctgtttcaaaccatctgagattccatctagtagtcaccatagggggaaaaaatgcttattctaatgtaccaagtacattaatcccaaacattgtgcataaaaatataattagcctttgaatgatgccagttttccgaagagagaatctatgtttcttttggaaaacagttaaattagtgggagatgaggttcctgttaaaggtttctttatt

SEQ ID NO: 30387 - DNA, 1238 bp, Bovine  19866881302193
gtgctgtattattactctatttacaaaacacgaacacacatacacacacatacacacacacacatttatcaagacgattaggttatagttttgcttccaactcatgtatcctagaaagaaaacatttttcagagcatttgaaatgcataagcacattgccaacagagcattctgccaattcctaagctaaaaccccaggctttcaaatatttgtttgttaaataagaatgaaacaagccattctgctacacctctgctgaaataattaaaataatatgagggtttttaacagagtatgttgactaaatcacagccagattaaaagcatttctattattaaaaagatatgtctttttctttttcttacattttcatcttctatttaggtttcatcactttaaaaacaaaccctgaataaaatagacaaggaagacacttaggtgacatcacatccttccacaggatttagaaatatgtttcaaaattttctatgaacactgggccaagtatgaatcttctgattttgttcacatgtgccatataaatgtatatattttaagttcactactttactgaaatatttttgaagagtcaattcacctaattctattgttgactgcacaaataagtatcaattttgtgattctgcattttaattttttcacatatgaatgataattactcaaatgaaattatgcatttcttatcactcttagaacacaaatatgaactcagatcactgttgtaaaataagcattgacgaaagtcaaacacatttacctttcacctttcatcaatagctataaataaatatatatgtgtatctatatgtatacacacatatatttataaaataggaagcttgttgtgtaaatacatgattatgtgaagagttaaacttatcactgcttttgcattttgcacatttggttgggttttactaaaagaaagtaggctagagaaggtaaaaacaggattgctttagagaaaaacaaaaaagaaatgcctccttttaaagatgaatgttaaagaaaacaccatattattgacccaaaataggttcttctgggaaaatgcttatgttaggtaaaaaaggaaaaaacataaattctaaatgaataattaaatttttatcatttctttactataatcactgctgcttgattatattttaatgatttataaaaataaactgacataatttgttagtaaatctctatacattgtgtatagagaat

SEQ ID NO: 30388 - DNA, 799 bp, Bovine  19866881410115
gagacatgagacaggagtttgattcttgggtcaggaagatcccctggaggagggcatggcaacccactccagtattcttgcctggagaatcccatggacagaggagcctggagggctacagtccatggggtcgcagagtaccatgacgggagtgacttcacacacgcattcattgttagataaaaagatgaatgtaaatgatgcaaagtccttatcaccagtcccagcaccctggaagtatcatgatgaataataatattaacttagttaatagtaatatgatccctaaaacagttatatttatagaaatatggttatgcttttatataatagtgttgcaatttctgctctaaaatattcactttttgagacaaacaaaatgagtttcttttttgcaataattaatttaagaaacaaagaaattcactggcatgtcataatggcttggtaagagttttgcctattaagctttatgtgtttttgatgtaactctttacccactgacttctcacattagccaaatagctgactccagatgaaaatgtcatctctcttgagaacatattacattgcaagtgagaacttggaagtaacccaacactaatttttgtcaagataacctctttagtaaaatcttgtatctcatttcctaaaggtatgttataaaacagcatgctttctttggtggagtgcaagataaaaaggttctactttttaaaactgttataaaaatatgactatctctaccactcacccacatgacaaaatgggcattagtgtcttagaagaaatcatagag

SEQ ID NO: 30389 - DNA, 886 bp, Bovine  19866880566093
tgtccatggcttatcacttccctaccagctgctacatgtacttaagtgaacagctgtcttctccatccctaggtgttgttgcgggcccgtgccattgaaacccagtgctacgtagtggcggcagcacagtgtggacgccaccatgagaagagagcaagttatggccatagcatggtggtagatccctggggaacagtggtggcccgctgctctgaaggaccaggcctttgccttgcccgaattgacctcaactatctgcaacagttgcgcaaacaactgcctgtgttccagcaccgcaggcctgacctctacggcaatctgggtcacccactgtcttaagacttttgacttctgtccactgagacctccattgtgagctggtggtgttgtgacttgtaggcgggacccaggcgcagcttccctcatttggagaaccttgtctcttgatggaacacaggctcagcttcttggaaaagaagaaactttcacctgagctcagatttcagtttcagaaaggtggaatttaatatagtcactgtttatttcatgaaaactgaagttatgctgagggctgagcagcactggcattgaaaaaaaatatataatcatcataaagtctgtgtctgaatatctcttttgggagctgaaaggggaggtggtattgtaccagctggactaggctccagttctaggcctcctggcttattcaacatgcctccctacctaaagaaaagtgcaacactcagtgcatgtcccagccccacgctcccaaacttgggagtgggagtgagggtagaggatggggaaagacaaggaagagaggcattgctaccgcatcacttcactctcacctgtgatgccctttgcccaagccagaagaaagcaa

SEQ ID NO: 30390 - DNA, 2137 bp, Bovine  19866880640000
ccgcctggttcctccccaagccttccgtcaggagatgctgcagcgccggcccccagccaggcctggccctctgcctactgccaaccacacagctcctcatggttcacactgactccttcttaatcatgaaactgactctttcccactttaatcatgaaactgaatcagaggggttatattttccccaccctcagctcctcactgctcttagagggatgtgaggaaatgaactttactgctgtgctaggggcaggggcctctcctcactgctggactggagctgggctcctctggccctggaggtctctctttctagggtcacctgccagggcttatgactgtgaatccttgatgtcatgacttatgtgatgactcctaggagtcccctgcccatggggtaggagcagggctggaccccaaatcccttcttcttccatggagagaagagtgatctggcttctcccgggacctctgtgaatatttattctatttatggttcccaggaagtgtgtttgaaggaagcccctccctgggtactttctgccagtaatggagtagctccctcttttggacctggctcagggggctgggattttgatatattttctaataaaggactttgtctcgcctccgctcctgctttctgcgtcccaggcactctttgcctatctttgctcacccacccccaccttctgcccttggatgacagaacagccaggccaagccaagctttagcaacttttattttcatgggtgagagaatccctgccaccaggggcaagaagaagtgggagctgaggatcaactgttgggttctgtgcccaagacacgggctgctgcctgacgcccgctctctatacagtcattgacagcaaccccctcataggaggccccagccagagtcaaaggcagcttctgagcagccaggaattgggcagctgactctgaaagggaagaaaaggaatattacagctggggtctattttcacggctcttctcagcccagctgctttctcaacttacccagtttttgccagtggcctaatgtatactgggggatagagttctggggagagaaaaagggatacagggaaaacattattattgatatcccaggcctgggtgctacattccgtggggtcacaaagagtcaaacatgacttagtaactgaacaacaacaggcctggatagacagtgcttccaagcctgcctctactaggtagctgaagagtgtttaccttgtgttaccaactcaccttgtgtagatggaccaagcagtgacttggtggctcattcagtcctaattgagtggcagcagctttctctgcctcctgttggagcagctcctgagataagacacagcccctggcttctagtgtctgtaaccaggaacctcccagcatcacctaaggagggaagatggcactgaccagcctggccttactgcactggggcagagaggagccctttggaaacccccactaagcatggctgccttctctcacagtcagtctgaggccaggcaggctcccatcctgctcagggaaagcaacggagtcatacacaattcccaggataactggatcttctgaggatggcaccaaatgtccaaatccctgaagaaaacaaagagaatgggtcaggacggaagggttccagttgagcccgtgtctgtctcgcctccttttctgagtcacacctggacaggcagacgagctcctcggtactgcagattcaccacagccacagacacagcagtgatggtgctcagggcacgggccagaggtgtggcctcagcagggagcagcttgctgagcactggaggagagagcagcctgcctcaggaggcgttcccagtgcagttttggccaccctccttaggataagatccccacagggatgagcagttcaagggcatggtatagtcccgttggcccaggaagaagctagggtgcctcaccctggctggggaaggggagggtggctatcccattacctgaagctggaatggcactaataatgtggtcagcctccaggctgctgtcctctagagacacctgaaaggatgaaaacattaaaagacagaaatcatgggaattgtgcctcagttttccagcacccaagggcaggagagag

SEQ ID NO: 30391 - DNA, 1112 bp, Bovine  19866880698901
atgcggccttgttcctttctccgacgtctatggagtcctgatcctcactttaagctgtacactgagggctaccaagttcccccaggagccacatacacagccatcgaggcgcccaaggtgaggcgggcagggggaaagactgtgtgcagtgggcgactggagacagatgtgcaattaaactctcgttcatcagtgaaagagaggacatgagagtgaatagaaaggattttgctggcagagaaaagtgttcttcccgttaatgaaggcaggcaaccttcttcggacagggagagtttggcgtgtacctggtgtctgatggtagcagccgcccttaccgatgcaagatcaaggctcctggttttgctcacctggtaagagccagcctcagtgattctaactcttcatacgtgaatccagtaatggttgagatctttatgaactttcattccttctcctccaccttgcttctcttgcctaatacttgctgtcttaatctctccaggctggtctggacaagatgtctaagggacacatgttggcggacgtcgttgccatcataggtacaaggcctgttgtgtagtggaggggttctagtcaaggggctttggaactctgatgggaacagaaaccaaacacctctgtttaatagactgcaggcatagacccagatcctcagtctcctgggcactgcagggactgctagatccttggtaacatcacttttttttctccttgccctgacctcctaggtacccaagatattgtgtttggagaagtagaccggtgagcgggggatcagtgtcggatctccctgccctctgtgcagcctctccatcgttgcaaatgggcctgtgcgtgcgtgcgtgtgtgtgtacacgtccatgaatgcttagctgtcaggctttctgtgcatgtactagaaaagggagaaatcacaataaattagccacgtctggccccacacccaaatttctggtttgtctttcccagtgtcttaccgtctttcactttaaagagaaacttagggcgtttgtcaaccatctacttctctgttagactcagtccttggcagtttttcctgttcatctccacccccgtttctgactcttgtt

SEQ ID NO: 30392 - DNA, 2762 bp, Bovine  19866880740508
gagaaacatcataacctcagatatgcagatgacatcacctttatggcagaaagtgaagaagaactaaagagcctcttgattctgaaagtgaaagaggagagtgaaaaaactagattaaaactcaacattcagaaaactaagatcatggcatccggtcccatcacttcatggcaaatagatgggcaaacgatggaaacagtgacagactttatttttttgggctccaaaatcactgcagatggtgagtgcagccatgaaattaaaagacatttgctccttggaagaaaagttatgaccaacctagatagcatattaaaaagcagagatattactttgccaacaaaggtccatctagtcaaagctatggtttttccagtagtcatgtatggatgtgacagttggatcttaaaactgaacgctgaagaattgatgctcttgaactgcggtgttggagaagactcttgagagtcccttggactgcaagatcaaaccagtccatcctaaaggaaataagtcctgggtgttcattggaaggactgatgctgaagcttaaaatccaatactttggccaacttatgcaaagaactgactcatttgaaaagaccctgatgctgggaaagattgaggcaggagaaggggaggacagaggatgagacggttggatggcatcaccgactcgatcgatgcacatgagtttgagcaaattccgggagttggtgaaggacagggaagcctggcatcctgcagtccatggggtcgctaagagtcggacacgactgagaggctgaactgaggggtggggaatggaatcctgctaggagtcggtccaatgggggaagagaccctgcgccggttcccaaaacgtcgagcccctcgttgcctgcggcctgaagcgagccccaccatccccgcggtgctcagaccctgcgctccacgcctggacgacccccaacccttccgaggccccgccccgtgacgcgaggccccgcccccgcgacgcccgcttccaagatggcggcagcgattcctgcccggctgtccgggtggcggtgacgacgggcggcagaaggccaggtgtgtaggctggagatggtggggtgagaggccctggagaaaggtttgagagattgggaaggtgagaagttttgggtaaaggctgtaaacagccttgagcaaggagggagacctaagtgcaagtccggacagaggccggcggtctcactttgcaaggtagagcaatcgccagaggaggttggcgtgggatgagatgaggctgcttcggaagaactgggctgtaaccccttccagaccgctgaccacgcccctctaggtgagctagcccaggttcctgacaggttctgcccagccctccctctccctatctcatttcatcaataaccctgatccccatcctcgctaggatggagaaaggtagaagaaggtagaggacgccacccccatcctatttcctgccgcgctccggggttgtttgcttgcagctcccaggtggtcacctccctgcacctgcggagctagctcccataaatgtgaagaacggaaaggagccggtttcttccgcctccctgggttctcttgaggccacttcacagtcctgttaggactgcctcacccagatctccagtagttgccctgtccccactccccaaacaggttggtcctgttggggtgggggatggttacataccgagtgaatctgacacgctataggatggctggggcagagccggggacctagcatctcctgctccaccccttttctctccaaccactttccctcgctcgcttcccgagctgagaaaccggcttcaccctgttcctgccctctgcccctctgggggtggctggctatccttgaccacttctgttccagctggtcccaagattgctgttggcgtgctggatggagcctgtctctgtcctctgttacgtttccaattttatataatgcttcacatctctgctcctccgggacctcctggagtccccatgatcctgaagaagacagtttgaatctaggtgagtctatctctccccctctaaaattggaaggaatgttctccagagaatgctctggaatggccttgggacctgaatgatgtaagcattcttgggggtggggactgagtaggtggtgggaggggtgggggagagtgaaacttaggctgggagtgacaggtggtgcggcctgccgatggttacattctatttctttctgtatcggtgtgtgctcccttctgtgactctgttcttttcctttttcctctttacccctgcccaccaccttcatcaatacccaatgatctctcttctggcatgctgccttcctgcccactcccagaactttcctctctctctcatccagaccccagcacagaatgttgcggaggttgctggagcggccctgcaccctggccctacttgtgggctcccagctggcagtcatgatgtacctgtcattggggggctttcgaagcctcagtgccctctttggccgagagcaggagccggcatttgactattctcatccccatgatgtctacagtaacctcagtcacatgcctggggcccctgttgccccagggggcctcccagctcctcaaggcctgccatactgtcccaaacgatctcctctcttaggtgagtgcagaaggaaagcagaaggcaaggccaaggtgtggggacagggaggctggacaagtataggaggcagcagtgggtcttcaaacggagggtcaggaacg

SEQ ID NO: 30393 - DNA, 1225 bp, Bovine  19866880746611
gagctcagggaaatgcattttatgccacaaagacctggaagccatggacagactttcacagaaggcttaacctaccaagagagggaaagagaatgctttcagaaagtgaccaggagccaaggcaagggtcgagaagagttggtgtctgggatgaggcacgtggtgtaggaagggtccatcccaacaggcactttggaacattcttttcatggtttgaagataagaggatgagagacctgggttcccagagagaagaaggtatgctatgtgggaggaatggcatgaaccaagactcagagacaggaatgagcaagtcattgaaggtagaaaggcccagggtcagaggcccagagggaagaggtcaggacagatacataacagggttagaaccatgaaccagaagcagaggactggaggtggggaccagggttgaaaggtgagtgttatgtgcattgataaggaacagtatgaagccctcagggagatctatcatgtagccttatcagcaaagaaggatgcatgtcctgcacttaaagaatctgagttcttctggggaaaagatatgtatggaaacatctatggaaatatgtgtgatggtttcttatttagtggttagtggtgtgttgcaggttagttacgggataggctagtcacagtggtcctgattcaggtaggagggcctcatgcatgaggtgggtagaatcaggaggggtgagaactggaaagggatcccaggtaagggcccaaggtgggcaaaccccagggaggtggagagtctggctggttcaggaagccaagaggagaggacacactaaggcaaggcgtgtgtgttgagtgggagtgggacatctggtcacagcaaaatcagccaggaccttccacaccaggcaaaggaattcagatttggccaggggaaatacggagtcactagagcattaagccagtggtcgtgtgccccccgactggaaagagagactgagggcaggagacacattaggaccctgctggcatccctgcacggtgctgccaagaggaggggacagttccaggagaagctcagcagggcttgctcactgaccagaaagaggaaaggctcaaagacaactcctaggtttctagaatgagtaacttatgagggaggtagggccagagaagctcgaggctgggaagaaggagatttgaagttgtggaataaagtgcatgaaacagggctgggggcagaggg

SEQ ID NO: 30394 - DNA, 1329 bp, Bovine  19866880758688
ttgtgtactaaactactttgagctatggccagtttgtcaaattaggtaggaattccagtggcaaaaaacaaaactctgttatagagcccttctcatttagattattaatgactgaatatcagttttaaatgaaatgggtgactacctccatgacagagaggacaggaacataaatgttctatgatggtagggtattattgcaaatcatggccatatatgtatttctttctttctttcttttttttttttgagcaaacaatgctttaaataaaatccattctatagtattatactgtatgactatcctgtaatttacttaattgttcactttttgctgagcatttttttttctttgctgtataacattaaattgtccttgaatatacatctttaagcttacctttgattattttcttaggttatattcctagaagctggagagagattaattttgactggggaaaggtataatggattgagggacactggcccagaatcttgaagagtgaatggtgtttcccggcttctctgctggagacgctgtgtacagtagttttgaagactcagaatcaggcagacttgggttaagattcccacctcctttgcagctgagtgatttggggcaactaggaaaaagcctcggtattctcatctataaagtgggatggtaacaataatacttgccttccagggttgttttctttctcctcgaaacatttttcatgagacaatccaatgcatatgttcacatttcttcctgccttttttctctccttgaaatttatcagactcatatacaggatcttgattgtaatctcctgtttcttactcatctgttacttcatttcaccttcaaagttttatttcattgtcctgtgcttcctggtgtgttcttgttactcttgatcattcttcctttgtttttgcctttgcttttgtttcccctttctggctatgttttatttttctttgcttcttgtgatctgattttttttttctttcctttttaactcccatttcccactcttttttctttaacttaaaatatttaatacatacttggccattacacaaatgtagaaaacatagaaacatagaaaagttgcctgtattctcacctctcagataatatgcactgtcaagggtttggaatctattcttagagatacctttacgtatatcctaggattatttttctgaataaattgatctaccttattgcatggcaatatggttagttttgtttgtttttatttttacttagttgtataatttattgtaccctggagccaggttaccggttagaatcctagctctacctcctactag

SEQ ID NO: 30395 - DNA, 1805 bp, Bovine  19866880779985
ttatagagcacccggggttgagctccttgcgtcatacagcaaattcccacaatctattttacatacagtaacatacatgttttaatgttactctttccattcatctcccgctccttccctcactgtgtccataagtctgttctctatatctgcatctccattaatgctctgcaaataggttcatcagtttcatctttctagatttcacatacatgtgttaatatgtgtttttctctttctgacctacttaactctgtataaataggctctacgttcattagcattgactcagatgtgttcttttttatggctgtgtaatattccattgtatatatgcaccacaacttctttgcccatttatctgttgatggacatctaggttgctcccatgtcctagctattgtaaacagtgctgcagtgaatatgtgtacatgtgtcttttcaattatggtttcaaatgaccagacccagtaaggttaactgctcaagctgaactcatagctccatcatctgtcctcccatagaactagaactagattcataatcctttcttttagcacttaaagtgttcgttttaggactgtgatcattattcattaaggtttgtcaaatttttagttaccagaaattatccacaggattgttccatagaaaacaaatcaagagagaaaaataaaactatactaccaaagtatatcccagtacatccctcccaaaggacaaagaaggggactaatgaccatgggagtgcgacatagagctgcttgtcattgcctatgctagagcaccccactgcaatcaacgtaaacaagtggaaattcctgtggccatttttgtcagggaagctatgcagcatggcccagtggatgcagggacaggtggatgcctgtctgagtgggttgaaaagggtcagggagaatctgcaggagagaacagaagatggaggtagttatacaaacatattttttcaaatggagaacattgagaatagagcattggagagagatttctagatgtccacatgcattataaacattcactcctaaccatacattcacactggcattttctcaagagactaagtaaacaattaaaagacttataattactatttggtgaatataatatgattctctgatttgacactcctaaaagtaaaacacatggagatcctattcatattcctatgacttgaactggctctgctcattaccagaccaaaagcagagactatgctatacacctccgtgactgtctcttgagatcctgccactatctaaagatcttgagaacaagggtgaacaataaaataattactaaacctacaaaaaggacatgcactgtactcaccaattatgtagcctttactgaatccctactgtacccaggcccctaaaaaggcagagcctcttcatgaataagatacgattcttgatgccagagaatttatgatctggaaatagaacatgttttcattctgcaccatacacgtcaacattgagataaataatcatctaagcaattctaattccactaatggaagactagattaagacatgcagccaatgcttccactgaaaataactagaaaaatgggcaaagtataaacatatgttgttaacagcatcagagagctaataaagtcatataaagttataggtccaagatctgtaggaaggaaattcagagaagtgagaccagcatttttgactcctgctccttagaggcatcttctgagtccataaaaagcagctgaaaagctgagaagcttgagcagagtttacagtaaacttcgaggatctaaa

SEQ ID NO: 30396 - DNA, 736 bp, Bovine  19866880942253
ctccctccccccgcctctgagctcaaagtgatgtcggggcttaggggcagtggcgagcagggaggacgaacaactaattccctgaccctcaagctctgcacctcgcccaccacagcagctttcaaccgggtccgcccccctcgagggcagaaaggccgaggctgctgattggctacggggtccagaggcatattctccacgatccaaggatgctggtccctccagcccagttctctcaggcctgccaggaccccagcggctttgcctttgtggagggcgatctctcgagtctggagcagtcttccctcggaaccccccacgccatacgccccggaccgtacctgtccccgagtgaggcggcgggggaggccaaccggagtcaggcctcagctcagggccaccccctactaccctcgcgcagcgcccccgcgggcccggctgcagctttagccgcagctatcgcccagctctctcccgccgcaggggccgccgccatctttgttggtcccgcccggccaccggccaccggcttcactgtctctcagggcgcctgcgcacccacactcagaatccacccacttgcatcctcggcgcttgcgtgaacccgcccccttggctccgccgctgacaccatggaaacacagccaactttaggaccgccagttcccagctctgccaaaaattttctttagaccatcattccaaagcaagtccctaaagtagagtcccatcgccc

SEQ ID NO: 30397 - DNA, 1506 bp, Bovine  19866880966912
cccgccctcgacgggctgcccggcggcttcccaagtccccgctaacctgccggccgcgctttgaggcgtccttcgcagtcttgtgcaatttgcccttctccatggcactgcagggaaagggtgtgctgtggattcgggggcttcgtcttcccttccaccctcccacccatcgaagtagtctccgcccagagaccgggagtagtgggtcggggaaggggtgtcagactccgccctttacctgagcctcctctgcagggccgcctgcctgcgtagccagcagtaccgaatcaggtagaaaagcagcagcgccaacagcaccacccccaggacgcccccgatcacggctcccagcaccaccccgtacctcgtaggcactaaacggggcaaggaaaacacgtggggaatgagcagagacaagtgtctttggttcctagccacacacctattccctgcggctggggatctaagatatccgaacaaggctgccttctgcccactgtcccagagcgtgaggggcattagccgggacattttgccccttgccccagcctctcagccaggcctgatcccctctgtgaactgcctcccatactcccgtcccacctcctctcacacctttttcaaagacatagagcgtgacctgagaggtcttgcccactatgtctggggggtttttgacgtcacaggtgaaagtgccgttgtcaccatagtccaggttgtgtatgacaatggagccatccttccggtgagggtcccctacccactggatgcgctctttgaaggtccccacctcatcgatgtagggctgtcccttggcgtagtggaagatctgtgaggaatgaggggaagcatgcaactctcgcctcagggtgaaggattctgggctggagagggtagggctggggagggcgtgtcggtgttggtaggtcccagcagggagacaagacttgccacttaccttgccaaagttggggttacggctcaaaaaggatttctccttccttagcccaagttctctttcctgtggttgtttgaaaccccctttctgttatgcaatcccagtattcccccaggcactcaccgagatggcatcacggcccccttcgggctggtagcgccaggtgaaggagaggtcatctgaaacccactcactggaccagaaggagcagtacagggtcacctgggagcccacagcaccgtggacctccttgtctgtgtagaccacaatggcctggacaggggagagcactgcaaacatagaggggaaatcagatgcacgggtgggcccggcaaggagtatagaaggagtgagaccaatgggaagtcaagcctgagtcacagaccatagcgaagattggggcaaaaatgatgaattctgaggcccaggtctctctggactaattgaatagaagagtagaaatactgtgttggctcaagttcttcagcatgtttgacaacagtaccagagttctccggaggactttcagatgttggattcagtctcca

SEQ ID NO: 30398 - DNA, 2507 bp, Bovine  19866881075752
aatgggtctcaaaataattaaaagagggtcagactgtggaatgtaagaaaagcagcagcttgcactgctctgccaacatgttagccccatgcttcttcttaaggatattcccgttgtcctgtaatcttccatgatttttctgttgttgaatttggaagtggatagatttgggctaaagttctggttctgctatttgttccatatgtgaccttgagcaacacacccaacctgctaaaatgaggcaaagagtggtaaccaatataccacctatttcacatggttgttgggattaaatgctaaatagtagcatgtgtgtgtcaggcacatgtgtgttagttgctcagccatgtccagttctttgcgaccccatagactgtgccagacaggctcttctgtccacgggattcttcaggcaagaatactggagtgggttgccattcccttctccaggggatcttcctgacccagagatcgaacccaggtctcctgcattgcaagcaggctctttaccatctgagccaccagggaagcccatccggcacatactgatgctcaaaaaattttgttgaatgagaaaccaaagaaagttgtctttctcttcatcctctttatcccataacctgctttgacttccctccattcacttttatgcttcttctccacgccacctatagacctagttggtcctcctccattatcttccaggctggaaatggaacatttaacagggcaaagctgctgaatgttcggggtgccggaggccctgcgagatgaagaatgggactgcttgtttctgcatgatgtggatctcctgccagagaacgaccacaacctgtatgtgtgcgatccccgaggacctcggcacgttgctgttgccatgaacaaatttggatacaggtagagggcacaggagggtactggaagcagggtattccaccatccagtggaagaaggagggatggctcccaaaagacgtgtggaatccaaggatctttctttccccagcctcccgtatccccagtactttggcggggtctcagcgctcactcctgaccagtacctgaagatgaatggcttccccaatgaatactggggctggggtggtgaggatgacgacattgctaccaggtcagacttcttgccaccaccttcttccctgaccccagcctggatccctatcctctaagaccacctctagccctagtcttttaacactaatttagctccctggtcctgaacggtgcctattcctctcccttatctttgcggtctacccaggtcaggctttgcatgctgctcccccttctgttacctttcagtcccttagagctggttaataacattcccgggagagaagacaagatcaatacaatcaatcccaatagtatcatgggattccagaactggaaaggggcctagagattgtttagtcctgcctctgctaggattgcatccaaaccacttcctgcagagctggaagaggaaaggctctgctccacatagtccagaatcacttttttttttttaaataaagggcctgtgccattggcatgatgccagcttatttttagcatataaaacattttgaccttcagcctcagctgacccaatttcatatgtcatttgactatttgggcttgatatgctgggccccttgcttctcctcccgctttgtcctctgggaagagatctctatgaattcttgtcttctgtatgtgtgtaaagcacccagcaatttctaaatgtatgtattctttcagtaccttccccagccatcctcacttcttgcttctgtgtatcagaattggagttcatttctttccaggtcttgatttcctggttccacacttttcttaaatgtgggtgggggacaggagtgcatcagagctgaggctgctcagccactaatctcagtaagaactgctgagcttgggtctgtggttcccagttttgtcctaccttttttgacaaaatggttcctctccctgtcctttccagatagcaaaggcagctcctaggagccatttgggaaacaggtgggaggtgcaaagctacctctgccaatggtttatagcccccagcgtgcctgcactaggccctgagggtttggagacagccagcttttacattctcttcagcctttccttctttctgtttgacttttctgtttgcccttccagtactcggccctttgtcaagttagttattctttgtgtaaagaaacatgcagttcctccctcgctggccttagctcttcttgctcacctgtcagcagctttcttccactctggatcctccaaggtgccctcacttttcccatagggttcgcttggctgggatgaagatatctcgtccccccacatccgtgggacactataagatggtgaagcaccgaggagataagggcaacgaggaaaatccccacaggtaggacgggagggttgcctgggaattactagtgaacccttagggctctacagtttctagattccggctgttcctttccg

SEQ ID NO: 30399 - DNA, 1173 bp, Bovine  19866881125449
attcccagactggggaagggaggctgatgtcctcttcctagatcagtattgattagggaggagttcaggctagaggagagattctctggctgagggctgcccttcacctgggcaaaggaattgccctgaactgtttttttcccccaactgaggaatgaaccctcacccttggaagtgaaagcatggagccctaaccactggactctccaggaattccctggccctgagccttcttattcttggaggagttcaccttgccgttctttgagatggagtagctttaggaacacacatctctgactgtgctcttctgtgtgcagaaatgcagaaatgctcccccagttccagggtctctccttttgagcaaactgagactgggaggtgctgcagaatgcccgtggcagccacggtggacaggttttcagggttaactcatgtccttgtcctcttccatcatgcttgtcccagcccagttctgaaaaacatctgtgttggttgtagcctggtaggttaaactctctgaacttcattattcttatttggaaaaaggggttagtgatacccactagctgagtttgttgtgaaaattaaataaattaacatatgtaaacttccttacacagtggaaggaagaccctgctgctgggaaagattgagcgcaggaggagaagggaacaacagaggatgagatggttggatggcatcacctactcaatggacatgggtttgggtggactccgggagttggtgaaggacagggaggcccggcatgtgcggttcatggggttgccaagagtcggacacgactgagcgactgaactgaactgaactgaaggatccaaaaataaaagacgtacctctggccttcaacattacatgttcattcttctgccctctttgtttccttcctctccattgctaccctctccatgatattgagccagaagccaaggactcacctagccccttttctctccctccttaaaaatgatcagatgcctgctctgtcattcctgtctcctggcctctacatgccctctacctcttagctgaattcaggccctcatcattttccacttatcagtgcaagtagtggaattaaattattaaattaaatgattctatctatgaccagcttcatctctttccaacccatcctccatgctgttgcta

SEQ ID NO: 30400 - DNA, 1089 bp, Bovine  19866881157036
tagggggctgcctctcgagagcttggtacccagggacccctgtggataaacacggtacgctgccgggctgccctagctcccacaggcccaggctgttgctaacatcaaggagctgttgatgaagccacctccccacggaccagcctccagtgtccctatctactctccctacaaccaaagctcatgggaccctccctgcagggttctcaccctaggtggggcctgggaagctcgacctggggaatgctgaccaggattcagctctcgccgctccagccctgaagggagagtcgtgcgagatatggccgctctctccagcccggcaccgaaccagttaatctccagcttcagagatccgccttctacaggctggagcatccgcgagactagaatggacggagagtcggagaggccaaaaagcttgggggcggaggctacgggctgaaagcactaggcctagataggggtgggagggaaagcgctccagaacacccggcgtccagttgggtccccgagccctgcgcgagcagatagcgtgggcgtggcccttatccgcctcccctgtccccccggatcgccggcggggtgatgcgctgagacctctacctcctcctttcgcctcatttttctcgttcccctcgtgggtgagtcctaggccctgggaggggacctcagagttccaccaccccatccgccggctctgggtttccccgaaagcagcgaatggccgggggtggaacgcggagctcgcaggttttctggagagcaggctgcttgcagtcacgctgttcgtagtgcctcttcacccgcaggtttcttcatgggccggaccgtggtcgtgctgggcggagggatcagcggcttggccgccagttactatctgagccgggccccctgtccccccaaggtgagtgcgccacgctgccagagggagcgcctttaacacttctctcccatttccagcaggagcgaatgcgccgccccctttttctcctgaccacttatgccgccgaagctgtggctgtaggctgcagtgtctccctcttgccctcaggtggtcttggtggagggcagcgagcgcctgggagg

SEQ ID NO: 30401 - DNA, 1366 bp, Bovine  19866881227309
ccctgcagccggaggagagtgtagggctgagagccgagggccaccccgatagtctcaaggacaacagtagctgctctgtgatggtgaggcccccgggccccaccggtgtccccagcactctgctcaggcccctctcccggcccccgatgtggtgcgtcagcagcccctccaccagcccccttgctgagactcacgctgcccgcctgcctccccccacacccccagctatgcccttacgccttcgttctctagttgccccttccccacacctaacattcactcctgtccatcgctgagccgctgagcaaccgtaacccctgcttgtgcctgacctctggccccaccgtgccccagccagcccccttacgcgtggccgccccacccaggctcctgactcgccccctgcccttggtctccagagtgaagagccggagggccgcagttactccacgctgaccacagtgagggagattgaaacgcagaccgagctgccgtctccaggccctgggcgggcagaggaggaggaggatcgggatgaaggcatcaagcaggccatgaaccattttgttcaggagaacgggaccctgcgggccaagcccacgggcaatggcatctacatcaacgggcgggggcatctggtctgacccaggcttgcctccgtcccctaagcctggctccctctgctgacagggaagccttcagctcatccccaggggggcctccctacacactcttttcttgaggaagatgctccccatcccactgactgcttgatctccagtccttccagtccttccgttggaaaatggaagggctctgctggttgagtccctcccacagtgtgtgcaggtcgctgtgtgtgcatgtgtccttgtttgagtgtgtgctgcgtgtgtgtgcaggggtgactgtgcccgtggtgtgcgtcatgctgtcacaagtgagctgtggtacgtgtatcacccagttcggtggcaatatggggggtacgtcacggggatgggcttgtgtgtcgtgcggccgtgggacctttgcctgtaaaatgcaggtgttttcctcagaccccagagcagtattaatgatgcagaggttcgaggcgggaggtggagactttggccagatccaggtgtgcgggcatagctggagctggaatctggcctcctgagttggggagcagggctcccaccacttgggacccgctggggcaagtgtgaagcggtggccggggttcgccggaagctcaaactgccctctggtggtctctagccctgttgcatgtacatattttctgtaaataagcctgcacaggggagcttctttaaggaatattgccccaaactcattaagagaaaagactttttaaaaa

SEQ ID NO: 30402 - DNA, 1667 bp, Bovine  19866881258845
cttttcctctttaagatactctgcagagagcttgattttgctaaccataatagaatggtagtaaaattaagaatgatttttccctgctcctcagtctcccataggggttccctagaaagagaagcaaatatgtctggggtacctgagactagaagttccaaactctggaattctaaagtggaaatcaccagcttacaaggcattattgtaaaacatcactccaggtttcaatttgtaaaagggattaaaagacagtgagagtcacaaagtgcacaaagtgatgtaatttattcccttcccttccttgttagcattccatttttccatctctgagggtctgggcttatgagctgggttccgtgcctcacaccacacagctctcagcggtagaacaggagcacagctgcctcagtgatctcccggctggagctgtaaccctggtgagctccgtatccattccagtcaaaggaggagaaatccccacactgcactggattgccctctgggaagaatcctcctccaccgatgcagtgctggggggcaggagaagacacagtgaggagttggctgtaaacacaccagtgagctcttaatggccgaatcccctgtaagtttggtcttcttcctactcgccttgacccctcccctgaaaaaacctttccctccagtggactctgaaaccatgctttcctgaattcctttctaccttccttcatgcttattctcaggcccctcaaccaccctttttcctcaatggatcccccaaaggctatttattgctcacagttctgtccacacctcactctcacaatgatggtctgtcttcacccatgacttttgctagaaccagcataatcatatattgccaagatatactcctaaatctgaatgaccagccaggtattttctgggcttgaaaccccctatccagctgccctgtgaatgtctccacctacatatcactagatctaaaactccacttaagcaaaacaaaactaattcactctcttgctgcccttgaatctatttatcttcttggtcacccatcttaactgatagccaatcacccaaaacaaaaccctgaagtctgttgcctctttcacttcccatcccccacgtccatttaatcttcaagaactgctgatttcactgtctatgcatccatgcttgctctttcaaatttatcaaagccaccctggctcaggtcctcactatttcacatctgtacctttacacctgcctcatggtctcattgactcttatttccctgctcttgaatccatgtccccctccttgctaaaccaaagtgatcaagtcactaatctggtcaaactcctctgatgtgtcccataacatcagattataggtgtcccatcacctataacataaactctgtgtcctggacataatgcaaaagcccctctttgccctacttcttgcaagtatttccagcatcagctcttaattctacaccatgtgcataccatgatacaatttacacaacagctcactgccccctcaacataccatggtctattaaatcccagtgattttgaacatgtcagttactcatgctcaaggacactactctgccccttgctgcctattgaactctacacgcatctttcgatattcagcaaaagatgtcacccttcctgcagaatcaa

SEQ ID NO: 30403 - DNA, 1614 bp, Bovine  19866881296413
tccctcccccaaacctgcctaccgagagctccacgcgcccgtgaagttctcagtcctgacctctaacgttaatgagcagaggttaaggagagggacggcggaggcgaggggggatgctgagtgtctccatcttctggcttgtctttaggacctccaataagaaggtaatttacagccagcccaatgctcgaagtgacgtgagtatgcctgccctgggatggggagggccccctggctggggttgggggtttccagcccatgttcacatgtattctggggattatctagcagctagagaagactgacgagagctgacttggatgttttatttttccagggggagttcagacagacctcgtcattcttggtgtgaccctggtccagcttctctcctgtcctcagtgcttgccttactcaggtgctaccagactctggcccctgatgcctgtagtttcacaggatgccttatgtgtcttcgagccccctcaggggcccccacttttatcttaggttgtgttttataataatttcagcaatgtgcaccttcctgcctcccttcctttcccaccactgctgagtggcctgggacttgtttcaaaccttcttgtcccagccctacaagggatcagagagaagtcctgactgatgcctgctgaccacaagtagaccacaagagcagtggggtactcactgccccctgcatgtagtggttttcagataggaatctggagtctggcttcttgactccttcctgccgtgctgaggcctggtgcagctgttctagagtgggggctggagactggagcagctggaatggttgtttggaaacggtgtcgagtttctgccacctctgcaggccactttcttctgtcttccatgggaagtgccactgggatcctcctgcatcatcctcttcccgaacacaagcagactgacaactgtgtctgtagggaaaacaagacgctgatctgcagataagaaagctggagtgggtagctcaagctatcacccttctcttggttggaaaaactcgacctgcccttttaagatatgtctgcagggttatggaaatttgtgtagcagtcagttctgctgagcgtgtgagtgtgtgtgtgcgtgtgtgtgtgtggtcttggccctatgttgaaatctagtgttccagagtcctcttgcggtaggaggcgagcacctggctgaagtgatgctgtgctccaggttctacttgatctgactcacccagtgaaagaagaccacccctcccacctctgccaacccagatgcgctagtacacttcccagaggctacaggaaaagctgctccagggcctgaggcaggatttctcaaatcctttggagaaccacttctttactagtagtttaaagtagtactactactttatttagaggataggcgtaagtgagagcaggagtgagtgggctaggcacgccgggccctgcttccctcatcccatctggacccttctttgcccttgaatctatttctccctttacccagtagtctatttattaactagcaagagggcaaataagggatcttctaggattgattctgctaattttgggaggatactgagcaccatttcaccatattctg

SEQ ID NO: 30404 - DNA, 909 bp, Bovine  19866881320142
tattgcctcccccccccaaccccaccccaatctgtcatttcctctttgtcctcttctctgctctgggctgtggtgcctgcagtggaggcagggtgacggtgggtcccagctcatttcctgctcttaggcccgcccctgtgtctccagatgcctccttccccttttctcctcccccagaggcccccatccccacaggcctcgcttaagggaaaacccgggccccaaggaagggtgtacaacagctgaagtggtttctctgcacctttctcttctcttggggcagagcccagcagccagcgcagggctgacaagaggaatcacaatcttgagaaagatggctcttggccgagggccacatgctttagctggggctgatgttcttctagttctctgcaaaccctcagttcagcctcctcatcctggcactgtccttccctgtacccccatgttgaagccaacctcatgttgaaacgctgaccccacagccaacccagatcccactcctgtaaccttcctggcctcagatggtgcagggcatgttctctggaagggacagacaggttgctgggtccagatcctaatgaatcccaaagagagagagagagaagcacctcctgcccttcaccaaagtccaagggtagaggagaatcttaggcagcagggcagcagcagcagccttctccccttcccccagctcctcctagcacagacaggtggaaagttgaaggatagagagaagccataaccgcttctctctttaagctaagacccagcaaaagtgaaagtccaggccaatggaaagctgtgtttctggttaatttatcctgattatcttgggttcccaaatccttgctgctgtgctccatttcagcaacctctcccagctctttgcctcaggtaggtctcttc

SEQ ID NO: 30405 - DNA, 635 bp, Bovine  19866881328713
tggtgtttgcaggagtaaatgcagaagtaaagtacaccaagattcttctcgaagcccaagccctaaatgaaaaagttagagctgttttcttgagctcggctctggccgtggcccagagagcaagctggcggagaactattagaagtggggaaagcaaaagaagcgagagccccgcgacccttccgtaaaacggagtaaggaaaagataatccgccagtgactacgaagctctccacgatatacaggagcggctgggggagggggaaggggtctctaggactcgagaccgcgtcgcctccacccacgggtcctttccgtgcccaagcacggggtaaacagctatcagcaagacgtgagggggcaatacaggtcccctgagggccgccggcacggactcccagccccaaattaaagtcacctcaacaagagcgcagccatcttgggatccggcctgacggaagtgacgccagacggccccaccacctctgggcggggcttccgtcacgtgacaacaccgactatgttagaggcttgggcatctgtcgggttcagtttgttggctggttttatctgctctcatggtgtctgcctcttctctctcaactgacttctatttgaaagtgagaagatttcgg

SEQ ID NO: 30406 - DNA, 1199 bp, Bovine  19866881436909
aaagtgagtagggagggcccctgaatatatcggggggaaggaagacagagaaatgggggctatacactgagaagcccttggagcaccagaaggacactgggggcagaaggagatgtggaatggatctgatcctccaaagctgcaaccaggctttgatgggtctgcagcccactgagggcccagggatgggattcgtggccactaacagggcctctgctccacaggccatgtcttcagcatgctccatgacaactcgaagcaatgcactggtctgaatgggcctgagagcacctcccgccacgtcatggctcctgtgatggctcacgtggatcccgaggagccctggtccccctgcagcgcccgcttcatcactgacttcctagacaatggcttcggtaagcagatggcactcccctcgccctgtgcaggacacagttcctgccccctgcatagtacttcctcttctgccgtatcccacatgggccaaattgactctctccaacatgccttctctacgtgtgggatggggtgagaaacgttgctgcctttatgtggttcccacttcctctcaggatgaatagcacaactacaggaggcaagttttggcctcaaaagaattagaactgaccttctgagggccagaactgtttgacaccagaaggggccagttgtgaaggaggccttgtcacttgaggtgtgcagacttagcagtatgactatgatcgaacagtgctgttgatgagaagcagatcaagaagtctgtatttggttagactaggtaggaagatctagtgctgtgagctcctctcctgatcctactttttgatgtgtgtggatgtgtgactgtaagttacttcacttctgcatagccgatctgtaaaaatctgtaaaatctgtaaaaaaatctgtaaaatagcacctgcctcacaggtgctggccatgattaaacacatattgctggtcaagcatttagtcagtgctcatcaaataaacatcgaataaattacagctgctatttaaagcttcttccagtactagaatttgtaggatccctcagccacccgggaacccaagatttcagctgatgaccagcaggcccctctgcaacctcttgctgacttcataacgcccctgcctcttttcccagggcactgtctcctagacaagccggaggctcctctgcatctgcccgtgacctt

SEQ ID NO: 30407 - DNA, 1171 bp, Bovine  19866881974217
tactattacgtgctggacccacgggtgaggaccagaatgctccagggccttgtctgtgctcactcacccccccagaggccctctgctttctgatggccaagatccaaaacagcgctattgctggagttcccacggccatgcctggccagcccagggctccattcagacttctctgtctaagggtatttggaaaatcagccctggactctggagaagttgtccatcaggatgtgctagcctgtcccatttccatcggtttctcggtcttcctctccccatcttccactgctccatttggtgagaatggaagcctgtggccttttgggcatggctctgacccccatcggatgggctgctctgttgaattacagtggtggcctcactgagctcatggggggccagtcccccactaaacaggcctggagagggtgatggccccgccccgcccctctctgtgatagggccctgggctgaagctgaagaaggaagaactagactagcagtcttgcctccttcaccctcttctggggagaatgcctacttgttgactgccctctagtgtctagctgggacactacaccaaagtttagggcttggtgttgggactcagacctgcaattcccgtgttgccatctcctcttgccagctgtgtaacctttgagcaagctcctaatctttctaaacctcagtgttccatctctacaaacctcaaatagtggttgtgagatttatatggcacttacgcacagtgtctaactcagcgtgagcttctgaaaatggtggcttttatcactgtcattatgattatcatcccttacagagcctggggttccttccgcattccatccacatcccctccctgatgggatatggtttttgtttggcttaccaacaccttttgatttaggaagaccctttcatcactccctctcttctcctcaggtggcagatgggaccccctgttccccggacagctcctcagtctgtgtccagggccgctgcatccatgccggctgtgaccgcgtcattggctccaaaaagaagttcgacaagtgcatggtgtgtggtggggatggttccagctgcagcaagcagtctggctccttcaaaaaattcaggtttgttcacttccaccttacctggggatatagaggtatcctcaacactgttt

SEQ ID NO: 30408 - DNA, 969 bp, Bovine  19866880343267
catgcgttcgcaccggcagcagtgcgtggcggcgacacacacgttcagccctggatgaataaaaccccaaacactccttgcgtttactactcagatcctttgttttgtcccaaacacactcctctcctctctgcgtgaggatttagtttttcctgcgtccctaacttgtaactatcagaagaggatagacgttcttcaaaacaatttttcaggaaaattaaattggattccgccaaccctccaaaaatgtccaggtaggaagacttctcaaaatactacagaaaccttctcttcacatttccccgtggtaatgtggtcacaccgccgagagaaagaaaacagcattatgccaactattttttaaatggaggcgtgaaaactgtttagagggagcctcgagctagcagttgggaaaacacttgtatttttgtttcgaaggatgtctttgtgggttccaaactgtcttgcttcactaggcacctattactacagtatcataaagactctaacagaaacagtctaaacactctgcgtataccttttctgccactctgcagattaagaaaaataaagttttggtgacaagaaacacacacacatctgactattccatttatttctttgcctgtgctggtggattcttctggggtggttttcctccttatctggacttgccattagctttgtttatcacttttagtgtctgaaaaatctgtaactcccacttaactgttatttacactgagataaccaaaacaaaattgaatcagaagtcatttgcaaatagttgcgccaagccgtgcaaggactttaccgtgctgtgtaaatccacaggctgcatatcacactgttaatcttagacgcctggcttgaaggggcatttaaccaaggcctgggtgagttcttccaaagtgcatatccccagactggcccaaagactacctctcattcctttcatttttttttttt

SEQ ID NO: 30409 - DNA, 1833 bp, Bovine  19866880344238
agaggggttggttccaggatgattcaagtgcattacctttattgtacactattgctattattatgacatcagctccacctcagatcatcaggcattagatccctgaggttggggaccccctgtcatagagaaacttgcctactaaagactagtggcatttacagaaacaatgcagtagttaacagaaaccagtaaactgatgagaaaacagctaactagtgaagtcgagattcttggtagaatgactgacttcacctaggaccttttacatcattatccttaattgtggaataataatagataatcccatcccacattccattcctttgacaggaagggatgtggggaacaaaaaacaggtttgtaaaaggttggaagagaaagctgtagcagccacacccctaaggagagatgggtgtttcctgttctatagtcccaacccaaggttacatccaaatcacctagggcgagtgttaaaaaattcagatccctgggcaccatcttcctgcagatcagatttcttgcatctgggaatctgcttttttaacacacgttttaggtgattctacgtaaatgttcattagaccagaattgaggagctctgttctgagacactgtttgcacatatcttagttatatgcacttccatcgaaggatctgggcaggtatttatttcttcacatttcctctccaggcagttttcagataggaagcaggtgattcaagtttctggggaaagtccccaagaacatattccttaaaaatgccagagtggtggtatttccagctttgccttatgacatttatttagtagcagtagcaaagagccttttgaaaacaccaaacctcacctcatgggtgcaagggatttccaaaaacatgtttaaagtgccagctggtggggtttatggagctggatccagccctttcaccacccacccactgaaccattggttgtcactagaggtttgtttcaggtgtagttttccatctgtgttcattgtattgtgcttattaaatgctcgtggaagcatgactctgcaggaggtgtgcaagcaagtaagacattggggtcctgtctcctgggaacacaggatctaagagttccagaagtttcaagcttccacagtagatgccacctgtcacacagtgcttccccttgtctgagccctgacatcgacaggctctcaccccagaaggcagagatgggagacataattgagtcttaatctgtagttcaccacactgccctggttaatgtttagctgcatctgtctcagaggcaaagcttcagttaaaatgtaataggtcttcattttttattctctcttttgtttgaagctgaagtctgggtttctggtcaataagtttttttgttttttttttactattcactctttaagcaatcaacattcttctttattcaatacatttaaacactagcatggagttactatttgatattattttggtgtgtttccagaatcctcacagatttccataaagcattgagatctcctttactttactgtatgtgtctctcatctctttctcagatgcagacactagatcaggtagaagggagacttatgaatgaaaaaaagaagaaaaaaaaaatcaagtgaaatgtgcaaaattcatccaaacatctccagaatctttggcaaagaaaactaaagaagtcgtattgctttcgctgctctttgtggtttaagcatgggtctactcgccctctgatacactcctttttatacatttgaggcatcactctcaaaaaggactccatcgatccttcactttaaagcagcattctccaggcacttccttggcagt

SEQ ID NO: 30410 - DNA, 1593 bp, Bovine  19866880348488
gctgcaatagtaaaattggagacctaaccttgaagacgaaggattctcaatgcaatgtcaaaacagtcaaaaaaaaaaaaaaaaaaaaaaaagatctatggtgcagtagaaatagtggattcctgctagagctttagcaccaaaatcaactagtaatcattgtgttcactgtcatacactaacagaaaaaaaaaaaaaaaagccagattcacttatgaatatttctgattaagaagtaaaaaaatattgatttaaaaaaatctcaatccttgggtacacatttaaaaagtaaggtgagatggaatgagaagtatacataaaacacttttgctatataatgaatggcttccctggtggctcagctggtaaagaatctgcctgcaatgtgggaaacctgggttcagtacttgggttgggaagattccctggagaagggaaaggctacctacgccagtattctggcctggagaattccatgaactgtttagtccatggggtcatgaacagtcagacacaactgagtgacattcactttcatataatgaagtacgatggtgtctagagaactgtttgagttgcaagccgaactatccacttttttcacagaacactgtttttacttgtaagaacaactcaacaaacaaattataaatagttagatatttggcagacactttctcaaatgagtgtgattagcttttcactttgaggaaaatagctgacaccttttgttgtccaagtgataaattcaagctttcaagtggaaactagaattttgtaaaaggttatctgccaaagtaaacagacatttttccagtagttaatgaccttttgatgagattattgacaaatgtaatttgttgaatactatataataaaattaaatgtgtcaactttttgaccgtctacattgcccaatgaaccagtgttttccaaatgaccaatgatagtatgaaattatgtatcagtaaaagatctattcaaagttcaagatagactaatggattttttagaaccatagagtaagaaaaatttattgatgtggttgtacattccacattgcaactaatcttaaagaaactaccactcatttagttttggtttaatatcaaagaagaatatccaccattgtgtgaaaaggctattgaaatactcaactccttccttttcaaccacatatctatggttatttttcatctttttgaaacaaagcaatatattgcaacagattgagtatagaagtagatagaagaatgtagaagcacatgcaaaccagacattaaagagatttctgtagtgtaaactaacacaattattcccacctttttataaatatagtgtttttttcataaaatatgtaacatgttatataacaggttattattattaaatgaatagtcatttctaaatttctttagttttatctttctaatattagaaatactaataaatttaacctacataaccaagagatctttgggaaccttaataacttgtaagagggtaaatggttctcatacctgaaaacaaatgtattaatcactgttagttcagtttagttcagtcgctcaggcttgtctgactccttggact

SEQ ID NO: 30411 - DNA, 880 bp, Bovine  19866880385773
taggaagtattgcactttgagaatttatttccttttgttttttaatatacttaatttctgggtaactttatatagttccattggtaataatgcttgtgtttcaacagcctggcttacaaaattccagaaaattccacaatcagctctctcaagccagtacatagtagacgttgctccagcacatcacaagttagctttcaatgctcctggacctaggcccccaaaagagtctgagaggaaagaggttaattctagaaattagtagatcatatgttgccggcctagagaaggaaagggggagaacatccccttgtgcagagtctcccagagtgactctgctgcccctcacccccaggcctggccgtgtcccctcctccccagggtggcagtcaaacagatgcagggagagcaccacaggccgcctcctgactcggcctgcacttgttttcccggagggtcacggcgtctgctctggagaaaaacattttcatatttcaagtgtttatctcttcagcatttgagtgctcagagagattaatatctgaagatcaccaccgccctgggcaacgggggagaacacttaccctcgtcccagccttaatcatcctccccccgccctcgttcactgcaataatgtttaattaatataatgagcctcctgcacgttggaaaaaaatacttatttttataacccagcctggatttttcatttcatttcctctcctttgagacttggcccaattaattggttgtttttcccaacccccactttctatacaaacgtaaaggagatttgcagggtgtgtgtctgtgtttgtgcacatttataggtgtgtacttgtgcattgtgtgtatgtttgtgcatgtgtttctttctcaa

SEQ ID NO: 30412 - DNA, 1833 bp, Bovine  19866880433079
ggtgctaggccagagggtcaggggagagacgccgcaggctttgtcgtgcgcccttgattctctgaaagttcatctgcagtgagacttatcagacactgtctggagcggcctccttcctcacgttgcaaggcgttcttggcagcctgctctgccagaaacaatgagaccggcaggccctttccctcatccctgggtttctgcggaaaaacaaccagtaattataaatagatgttatttgtagtttccattttcttgccttcaaggttttttgcaataattcctccagtttcttttgggttgttctctttgcatacttcctttgctgggtggtcggatttcctcccttctgaagagccctggtgacctgggctctgagcggattgtgaagaagctcaaaatatcagagttttggggtgggaagaaataaaggaagaaaatgaaagtgccaactaccggttttaaaacggcactcggcaccaaggcaaatacccaaaccgatgcagtgtgtgagtccgtggggttagatagcaaataataaaggagttagataagacataacagggatatgaagttagacaacagataataataataatgacagcagcagtaacaactaatatttgtttattgagcatttactatgtgcctggccctgtgctgagctgttgacatgtattaactcaccaaatctgggggttcagtgcctagttgttcaagacccagcacatgtgaggggcagcggggctggtttttgaacccagcctggctggctggttccagagcctgggctgggaaacaagactgaaaagaattctcaccagctcaagtgatgaagcactgtggatgggtttgtacaggaggagggtgtttagaaactaccctctatagcacggaggttgggtggcatagacagtccctaaagttatgacttttcatttcattgtcacctgttcagtttccagagcatcatgtgtgtgtaactcttctctcccccaagtctcccacactgttgcgtagaacagtaataatgaaaatagccagtgcctctcaggcagtttctaaggcatccggtgctatattgggcctgtgtagacctttatgaacctttcaacaatcccacaaggtggggaaattattatttccattttatagatgaaaaaactgagacttaaagaaatgcctgaagtcataacactagcatgtgccagaaactagctgaatctgtccacaaaacaagagtatacatacagactatgcatttcccagactatacacacccttgtagacagatatgtttctatgcagttgaaactttttttctctggtcacagaccccatccctaggaaaatgtgcacatacccaaaccaacaacatttctgcatatgattataggggttccccaatctactaaaattcatctgtggaccctactggaaattcacgggcttaaaaatgtatgctctagatggtacttaaaagcatgtaagtacacaggatactgttttctcactcgggccatatgttgacatatgggtatatatgtgcttataaaaatacttcacttacagaaattaatatgttatcccatctgaacacttagaagctggatttctactgatgagactcaaaaccacgaattccaaatctactccctgcttctgtgggtgatttgtctattaaatttggcattgttaaacaaaacagctaaattaaaagactgagattctgtgaagtctctaactgagatgcaaagggtgctttgcatctgcaccttctaatattgtagtgctctggcaatctggcatgcccactgctctctgatctttcctcag

SEQ ID NO: 30413 - DNA, 1076 bp, Bovine  19866880489813
tagttgccgtgctgggcttctcattgcagtggcttcttttgtggagcaaaaggcacagggcacactctagggcacaggggcttcagtagtttgggcacatgggctcagtagttgcagtgcctgggctctagagcacagattcaatatttgtggcacatggacttattttcttccacggcacatgggatcttcctggatcagggatcaaactcttgtctcctgcattggcaggtggattctttaccactgagccaccagggaagcccctagatttgccttttgtaagtaatctcagggtcagaagtagtcctgtcacctgtctaatcactctttgcttttttttccattgcattccaacctacttttgatacatcagtgtcaaggaactgagctcctgagatatacccattcatatttttaaatactgtctgtccccaacttatgatgtttcaacttacagtttttttactttatgatgatatgcattcagtagaaactgaattcagattttgaattttgcttttttcctgggctcattatagtctctcatgtgatgccaggcagcagcagccaagtgatcatgagaataaaccacaaatacatttacaactatttttcacttttagtattcaataaattacatgagatatttaatatattgttataaagcaggctttgtgttaagtggttttgcccaattgcaggctaatggaagtgttccaagcatgtttaaggcaggctagactaagctgtgatgtttggtggattagctacatttttgccttaggatattttcaactgaggatgaaaggaagatctctagtgtaattcttagaatatttcaggaacaacaaaaaaaatggttgatgatatttatccctggagaaggggatcttacctttccttgaaaatttattaatatgtaatttttgtaaattaaggggggggagtatttccttacatatatcacctattttttggcaacccagaggaagtcctctgacatgatgccatggcagacatttgtagacagtatcattgtcatgcagcacaattaacatctcaaagagggcatt

SEQ ID NO: 30414 - DNA, 1993 bp, Bovine  19866880490132
cgacttagcacgcatgcaatgttaaataaataatatccactcccttatgcaatgtaactctttcagtgtttcaaaatatgaaaatcaatatgccttttccatgtcttacattcctctccgctccatatactttctacagtctgcatttcctctctctttccgagttgcattccccttcttatcacacttctgtccacttttctttcctcatgtccatcatctctctcctttctgctgtctgactctcctcaatttctcacttttcctatttgccttggaaactagagtgcatctcctatgcaatgtcatttcataggtgagtacatatggtcattaatattcattagttttcttaatctctagtaaaaatagaaaaaagaatgctacctttctgtgtgtcagactggttgattagcagactgtacttttaaagtataaaactctccttctagagacagcctagaggtcgaaaactctgggaggtggatgctttccttgggtcaaccaaggaaaagggaaatgggcaaagttgagagataattttgggggcgaaatgtaagcctttcagcagtgaattaacctaaatgtttttcccaaagatggtgatcatattttcacctcctagactcactagcagttcaaagggattgctgcaaaaagttaagaatctgagactctaggacctaataaagccctgaatttttggttttgtgttgcctataaaagtcagtgtggattaggaaaaaaactggctgttatgactcacaccccacatgtactatcttaaaacccagaaagaagccaaaaatgtctatgtaaaaggtgaaggctgtgtaaagagtgaaaaataaaataaaaagatggaaaagtaaacaccacctcagatgtaaggaaattcggatatttaggacctcccataagaaataacttctttttttcttaagtcaatggatccataaataaatgaacttaatctgacttctaactagctcattcagtgaaaagctagtggactagaagtttatttgaagaactggggtctttcagcagctcaatggcaggcttcctgtttgactttggccaagttattcaactacttaatatctaaagttactcatctgtaacatgagtaaaacaatatgatagccatgttatttttggctcttgggctgctcccaaccttgactgtgtaactgaatctcacagaggaatttcatggaattaacgaatatctacaaacgctgaagggcctcaggtcaatgttgacttcatagagttatcattatggagtagctgttaatagccctggtaccacctcctgctctcctacacattactctttctgtctggtatgtcccctctgtttaagaatccatctgtccccccctctagaaggctttctttccattccaccatccattagagcctctatcacatcttttctctagaatgcataagaaatctcgttgaccttgacttgcctcgtcttccttcctcttttaacacctcataagctggtttctgtccatactgtatgtggttttctttgtgttaaactcagtggatcccccatgtacaaatttttctacaaaggtgtgttctcaccactcttcctggtgctgtgagaattgatgtctagacttcagaagttcttccatgtaataaatcaccgccaacctttctgatgactcttggcaaattcttatttctcttgctgtccaatgattatcccttctaattctttccagtaagtggctcatctaatcatgtagattttctatcaaccatctatctactctccagctcctgttctttatctctttcagatctgtatgaattctgttgaagatacatgtgttgcttacctatggtcacaataataatgcctaacaaaccatcataaaacttagtggtctaggacttccctggtggcacagtgggtgaggatccacctgccaatgcagcggacacaggttagatccctggtcctgga

SEQ ID NO: 30415 - DNA, 4006 bp, Bovine  19866880559590
tgggcagaggactggatgagatgaccctccccccccgccccccccccaaaaaaggtccatttttaaggttctatgaaattgattacccagatgtggctgagatttctgcacctggaggatcaaaggctacttcaggtgaagaacactttagaggcttgacttggctttttgcataatcactgctcccaggagtttgggtgagtgggaaggggtcaaaaaaaggataagttaatcaacattttcaaaagcgcatctgttcatgaagccttaaagaaagaatgacccactggggaaaaccccaataaagggaacatttgtacaaaaagccatttactttgatagcaattttctctagtccctttgctaatattcttgatgtctgtgtttggttaagagctttctttctcagaagcctctttgctcttcatgggccactttccttttctgttgaggccaagagagaaacttcagcctgtttcctcagaatgctggcagggtgtgtggatgtccactgggtccctgtagttctagtaaagaaaaggcaagggtgggttggaaggaggaggagtgagccaggaactcaaggcagagactggaagcagcaccttcccaggcaggggacaataacagccagcgaatgaagacctggctggagaagagaggcagagcaaggacctggaacttaactttttaaatgaggaaaaacttggagaggacattccaggactcttttaggaggtgtgtgtgtttgtgagtgggttgacggagagtgcagtgagccccacctttaaaagaacgcagatcaggaatgcatcttaccacccacacgacttccactttcaacctttgtgcttacatgaccctgcttccttctgggcccccgtgtggattcaagctcaggtcagtctgactccaaaacctgaattctgactctcagtactgtactggggccagagaagaccctcttccttcaacccctccacctgcgcacacaaattctctggctatgggcagaacagtgcatttcacctaaatcatccctgtgtgcgtgtgtgctcggtcacattcgactctttgtagccctccaggctcctctgtccatgggattctccaggcaagaatactggagtgggttgccatttcctcctccaggggaatcttctctacccagggattgaacccaaatctcctgcattggcagttgggttctttaccactgagccacctaggaagcccctttcttttctctgccactcattaaatagcttttcccaaaggacatcatcttagggggttgggggtcagcaatcctactagaatacttccaacagtatgatttattttttcttttttttttttttaagatttttttggccacactgtggcatgtgagatcgtaggtccctgaccagggattgaactcacactcccaggcagtgtaagttgcagagtcttaaccactggaccagcaggggagtccctccaacagtgtgacttaaagaagtttttattcatcgccatgggacctaacctccacatataaaatggcttaaatagaaaaatatgttttgaaaagcaaaacaaagatgtaaaaaacgattttgaaatatccattcataggttgtgaactacctgtaagggttaaatcttgtgtttcctaccctgaacgtgccgaagtctgttttccaggacacttggttgacgccgcaggagcattgtcttatttggtgtactgcgtgtcccagagctcagccagccaggcagtagcaccaggaacagcaacactgaattttccctcctggtccctgttcatggaaccatcaaatgtgcccccagagcctctccatcacggaggcagcacaaatcactgtttttatcaggtccactgactcgcatagcctggtttttctgcacataaagaggtgcaacaagtggaggatttaatggcccagaattcagctatagatattcccttacgttttcattttactataatcagatggttttctgttgctgctgctactaagtcacctcagtcgtgtccgactctgtgtgaccacatagacggcagcccaccaggctgccccgtccctgggatcctccaggcaagaacactggagtgggttgccatttccttctccagtgcatgaaagtagaaagtaaaaagtgaaagtgaagtcgctcagtcgtgtcggactcttagcggccccatggactgcagcctaccaggctcctccgtccatgcgattttccaggcaagagtactggagtggggtgccattgccttctccagctatgggttttcccttatgttttcattttattataatcatatggttttctgagggctgagattaccttcatgctgttgaaagaacaaacactcaggaggtgaaagttcaaccaatccctgccttctttgcagtgcctgcacctccatgtctgcttgtttatggacgattctgaagaacagggagtttggcccaggctttggttgtgcttgcgaacatgcgtgtgtatgtgctaagtcacttcagtcatgtctgactctctgtgaccctatggcctagcccgccaggctcttctgtccatgggatcctcccaggccaagaatactggagtgggttgccatgcccttctccagggaatcttcccaacccagggaacaaaatcgcctctctcatgtctcctccaaaacccgtggagttctttaccaccacacaaatatagaaaacagctcttttggagttgttagccatcccttcaagggaaggaaaaatccattcttcacgggatatagactgtcaagacaggatacctttgtaatccagtgtcagtgggcggtgtattcctggtgctttaggacttttggaaagggagggactgagctcaccgtgggaacagtgggcccaatatgttagcaatgtctaattcagtaataattacgaaatttacctagtaaggataaaccacaactttgcctagcactggcttgactcttagaagctctttgagggatgtgggtatatgttaaaactggttaaataaaaatgttaattatatactcctgtagtattgacatgacatgatgtaaacctttatacaaaaacattgattttgacatccctttggaaagccatgaacaacaaatagttctctgcttatctcttgatccctttccagccccacatcagttctcgtatctgtagtttgggggttgaaagaaactgtttaagatctttccttcctacctctgagacctgttgattaactgcacagagtccctttgcatctgtggggtgttttctagagagaaggatggctggcctccaaaaggtcaccttccccaccctcatactacagccattcagaagttagaggaccagcattgtcagtccctgtcacctgctggtccatgcaactcttcgccttcggcctcagggcctttacacttgctctctccttgccctgcaaagctgtttccctagacactcccacagcgttgcatattccccttgcctgccgtattgcttctccttagcacttgtacagattgtacatgttgcatgttttcttgtttggatgtctctcccaactggaatgttagttccaagatggtaaggattttttgtgttaagtggtgtgtcattagcatctacagcaatacccagaacaggtattccttgataaataatcagacacaataataaataaatgatcacctttctaacccaaagcacccattagccagtttggatccatgttgaatgcaaagtctatcaggagacaaggaaatgactacttcacacacctacatgagaccccaagcctgacacccatgtgtgtttggggtcccttaggtatctcaagcctgaccaggccagaataatgcatgaccaattaattaattaacactaaattggttgaactggccatgggaggcccctatgtggatgctgccccaagactggattcggtaaggcttaattccttaaaatcttatgca

SEQ ID NO: 30416 - DNA, 1399 bp, Bovine  19866880568530
ccttcccagcactgactagtaagcatcccaccaaaataaagataatatcatatttaccccaacttatatgccctagttccttatcatttaaggtttttatctctgtccactaaggagaagagagaccaaaactttctgattgcatactctatgccaagcactatgtacatattagcttatgttggttttcatagcaatcctatgaagaggatataattaatttaactttattcttggaaaaaaaatttaaggctttgtaacttgctaacttcatggaatggggtggggagaggtgtgaggttgaagccaggttggagtccatcgaagcaaaactgtaaatgtgtcctgttgcccattccgtgtgaaagcagtctgtctctgagcctcttctgtaatggtgatgggaaagaaaacattcgtcagatcaagtgccacatatcatgaaccaggacagcataacaccaacccaggatgacaactctaggaaagaaatcacacctgatggggtggcttcactcggggtttctgcctgctgagtttatggctgttggtggttattctctaggaccgtggtccccagaccccaggccacagagcagttctggttggtggcctgttaggaactgggcctcagagcaggaggtgagtggtggacgagtgagcgaagcttcatctgtgtttatggccaccctctgtctctggccttactgcccgagctctgccttctgtcacatcagcaatggcataataaatataatcacttgaatcttcctgaaaccatcgccccccaccctggtctgtggaaaaactgtcttccacaagaccgatccctggtgccgaaaaggttgtagggatcactgctctagtatctgtctggcttttgcaggggccagactgctgaattaaatggagatagggttggaaccacagcttctgcatcctttagaccagtactttccactgtgtatataatgtgagccacatatggaatttaaaaatgtttaatagccacattaaaaaagcaaaaaatcagtgaattggttttagcaatatattttatttaactcagtctattagcaatattttcatatgtaataaacataaaacactattaatgagatattttacaatctttttttggagtacccagtgtattttatatttatattacattccaacttggatattaaaatttcatcagaaatatttaatctatatttaagtttcataaactttacaactgaaaaagtagacttgcatacttgagttgttccaaacatactgaaaagatttccaataactaactcgggtatgtttaaaattttttattaattaaaataaaaaaaattcaactgctcagtttcactgatacatttcaaatcctcaataaccacatatg

SEQ ID NO: 30417 - DNA, 1111 bp, Bovine  19866880630510
atgacaccggggaacttattggttcctctttgtccagttaaatgcacagcctgcatatatttgcacagcatctcagggctgccaattctctgccagtgaatgttaccaaaaatttctgttagaagagcttctttctaaggtataaagcttcctgtgcctctggctgggatacagaaggttggcacaaactgaagcatgctgtactcagagcttgggtctgagctcagagaaatttgactaagcacctctctcagatgagggccaaaatctgttatgcttatgccagcaaatctcccagggaaattgcagagaggtcatctcatgtatatgcatagtggcacagagagagaaaccaggtttttgaagggaaaactcaggagctggtgagcatggcttaaaacacgttggaagcaggaaaagccagggaaatatgcttctgccctgtttggggctgtggggtaccatttcccctcaggactcagccccagggatggggcgagcacaggtctctgaagccactggtggcagaggatccaagatggtatctctgactggagctggagtaggggaagcaggcaagttacaggttattctgaagtttctggtgcttatcatccataccaagtagcttcctgttcttctccccactcctccactccttgcttccagcttgaaccaaaaagttcatggaggtcagaaaaagatctttctggagtctctttgccctagtgccaaagtgtcagcaagactctgttggggtcatgctgcttcatccggtgcttacctctcttactcccccgccctttctaactggatttggttctcagggtccttttgttgtcgttgttcagttgctcagtcatgtccgactctttgcgaccgcatgggctgcagcatgccaggcttccctgcccttcactacctccctgagtgtgctcaaattcatgtccatcgagtcagtgatgccatccaaccatctcatcctctgtcatcccctcctcctcctcccttcaatctttcatagcatcaggatcttttccaatgagttggctcttcatatcaggtggccaaaatattggagcttcagcttcagcatcagtccttcctatga

SEQ ID NO: 30418 - DNA, 1349 bp, Bovine  19866880640193
aatattatagaaaagtgttgaattaacaacaggaaaagaatacacatatacatggttatggaaaaaaaggttacagaacagtgtactaaaatccataaatcatacactttatgggtgaattttatggtatgtgaattatattttaataaagccatacaaatcctccctcccagggtaaatgaataatctcatttatatttaaataaaaacatgtgtatatccctggttgattggccaaaatgttaaacatagttatttctgggatggtagtgtttttaccttgttatggtggccttaggtaagtattctacaatgaacataacttttacaatacaactaaaaatcctattaaaaacaatcttggatacaaactgtaccaaaaagttaaaaatatctatctgcttttagacagaaaattatttttaaatgtctgtcaactacctcataacctagatgttctatcatgtattataaaatctgtaggttagtctgcattccttaagaatattcttaacaatttatatcagaagcactatttaacatgtttcacattttagtgttttgattcttctactgtaattctcagaaaaaaccttcagttttttgtcactcaaaaaattatccccatattgctgtatagtaattctacatataatagtaaaagtttatatttaacatctgctaattcttactggattttccaactctacttacattagaaaagaaattagaaagaaaataaattagagtaaaatcagaatatatagttatattagttcaatatttgaaaaatcttgtgagattagacatatcaaatactaccactagcaggtgagaatcataacactaaattaggtgatgatattccttcccaccttccatttatggcagccatgctaacaactgcatacctgtcatgtagaagtcttttattgttagctgaggtggaacaagtggatcagcaagaagctgttggttcactagctgcaaaaaaaggaataagagatcagtaatagtattgaaaactagtactgctacaccagaggatacattattatgaaaactgcaaatagacaaggttttaccttggaaagctcacttgcttgctggaaataattagctccttcaacatcatcatatcgaacaagattaggagagacttcttccaatctgtttctcacttgatccagagtatcatatggaagagtcatacctgcaatctataacataacaggttccaaagcattaatactgataaatttcaaataatacatcattgcaactatggtaaaataaggcagtactagtatgaaaaatatactggggtccatttgcatgtatattaagca

SEQ ID NO: 30419 - DNA, 1439 bp, Bovine  19866880641473
tctataaactgctcttcttaaaggcatcagtcttggtctaaagctgctctttgaggcgaaccttagtgatctctcttggagatcaactccggttctcagagacgcctagagagacctgtgctcctctgagtgaaggaaagatattacatctgggtgtttgctcagcgcccctccagtcaggactcctgcttcagcctcatggaatatgtgtatttgaagtaggaaaacagagcttggaataagtatgaaaaatgagataggtagtgtggatgagacctaaatcctgcaacgagccccaccttggttcctgaaagccatggaatcagaaatctcagcaggcctgaaggaatgttcacactgacagttatccactaagccctttttggaagtaggtcaatgggttcaagcagtgacatgtatagaggagcctggctttcacttctaaagggtttattcagatttgaagttcatcggtgtcaaaagttgccccaagtaggggacctatttcagattaggcagaggaagctcaataaactttctaactctgtaaatttgactttgatagagaaattgatggcttcttcattcctctctggattcttgtcacatatttctggctgatagttctgaattctggccctcctataccctgggcattatttttgttgatagctttatagccaaacttgactttcatgattatcttctaaatcataacaacacttaccatcaatttcatcctcgtagccctctctcccatgtatttctgggatgtccactataacaagaaagaaaatttaaaaaaatcagtcataacaggtttgagtggctaaaaggcagagatgccaccttgctgaaaatgactccccagcattgtgggaagctaaaaaatcgcatctgcttctagatcatttagtattgcagattactggatccgtcccccttcaaatgacttgactttacttccaacaacaaccagaagaacagaaacaataagaaaggccttaagtgcccagtagatgctctcttgtatctttataataactgttatttacaaccaatgtaggtctgagttttatctaaggcaacttcagtggtctctcatgtccatcatcagtcacatgactgtaatgttcatctggtatagcacacgacccctcctcatgaatgcatctaagtggacacaaagcataagagtataaaagtttctcctctggattgcaataaatgtaatttaagtcacatttcatcattatatgttttaatgtatttatagaactagaactggaaagaatgttataacgcctgtccacccccacatatccatgctaatacttttctctttccttcccaatctatttttcccattggctttcttcacagtttagaatagatcaaaaaaaaaaaaaaaaaaagaatagatcaaacataggcaccca

SEQ ID NO: 30420 - DNA, 1093 bp, Bovine  19866880669277
gtctttgaaacagatgtcacccgctccttcgccattctctttgcgaaagggaggtgccgagctccagaatgggagacaataggcattaatatccattggaatgacagctgtttatgactcgctttgctcaggacacgtgtcccccaagcaaaatgattagcgctccggcagaatacaatatttgtggataatcaaaagcgaatggcgaatcgtttgggctaatgggaagcagggtcctcatcagcctttctggaagttctcaccaagaataaataataaagtgagctcctagcagtagcctccttcctactcataacatagtggatttgtttaatgtgtcctgggaaaacttacctacctcaccagggtgttatgaggattaattaatgtttataaagtgcttggaattccactgaagaaatgtaccttgtcgatgcaaattatcattctatagtacctttcattccagaatctcaaagtgcttccccaacaattaattaagtctcactacaaccctgtgagggaggagagcatccttctgcccttactaatacagcagagtttctgtacctgagttgcagagtctaatgttccagtcgccctccaggagggagagagaccccattagcaagcatccctaagtgcttcataatacatgagctgctaacaatgcgaggcaaagcactatacccaattctgatggccataaggacttgtttaattttgtttggtccctaattgtctgggctgcttgttttatttacatttttttctccctctcttgtaaagcaataaggtgcttgtcagatgagagcccaattagcagctgtaacaagttacagtgttctgactgtaccatctaatcctattccttagcatctgcagttctagtaacaggttgtacctctctcccaccgtacataccccagaagttgacttatcctttgcaaaaattttaatgggattattaacaggatggacagttagatgccacgttagccatctagaagctgcaggctcgtctaacacatgaacatctcaagcatgtactgtaattcctttttcattacaagtgcagtgattcatacgcaca

SEQ ID NO: 30421 - DNA, 1977 bp, Bovine  19866880769905
accaggtgtgtgctctccagctcagctcagtctccttggctcttttgtctcctagacggctgttctgttcatatggataatgggcacccttgcttcataccatttcacctatgtattgataggaaaagcagtttaaatgtactgtgtaccgtccattcactatctctatgggagtgaccctggctcagcggcactgtcttgctgcagggcagaggccacgctgatgtcatttacaagttacggtcttccttctttcagcctgagacctgggtctgaagaagcagggagctctgctgtcagctcatttacctcctgaggctggaagctatttaaagctccaaatagatctgaagaactcttgataccctcctgatcattcaggatgaagatttttctgttttactttgtttttgagggaccattcaatttcctgggtcaatctggctttcggcgatcatcacagtcagataaatgttctcatgggtgaacactgtggggtcacaagtgcagcctttcagccacacaccaggacaagggtgtgtcctcagatgatggactggcaaaggggacctcagaagattccagcaggacaactattttcaggtgatgagggatcgtgtgtttcctttctcaccagaaaccaaatatgtgaccagtaacttgttctagtcaaggagccagagaagctaataggtttttgaaaagactgcagaagtataacattctaagacacacacaaaagagataaatagtaactttggtagactggaagtgaaattacacttggaagatgattttgatccctcatgaattcaaagacttactaaataaggctttaaaagcatttacggttcttatccatcccctcactccagatagagattagctggggacttttacactaagaaaatagggtttacaggtcagatcaagaagccctctttgtcattactgacagccccaaacactgaagattgatctataatatgctcattggtgggaaaatagctaaaaatattaggttttcatggagaaccttataataataatcatcatcactccagcaaaaaaatccagatatctggagcagaaaattaagcctgactattacagactattctactcccaaggcatttgtagacagacttctttccatcaacaaaagcgagccctggttaaacgtaacaacacatgatcacggctttaggtccaacggcacaggctctttgctcaagtgccacttcctcttacctctttgaactcaaaggcagagagagagtctccctcctctcttctgaggcacggaatttcttgtctcttagggcacttatcacattgaatttaaatgttgcgtcttgctagaagattgagagctcagagtcatagtgtccttgagacttggcacagtactgcagaatttttatagatcaagtttgggaaaggtaggaaggaaagaagtaaggaggtgggggagtgggagaggaggatggcaggctagcagaacataaggaaacgtaggccagatggaaggaaagagacacttagtgctacttacccagagtgtctgggctcctcttctttagtcttgaagcgtactaattcctaagccttgagtgtttcacagtttataagaccagtgaacttgacatctttcaagacaggtcaacactcattttcagcaagccttcctgcatccctttccctacaccagtcctcttatcttaacttcctgcatgatttagtttacttaccaccttgggctcagaggggtttttttgttttgttttgttttgttttagacacgttgtctttccatgctaaactgtgagcaccttagggcctagaattttattctgttccttcaagtcccaggtagagttcctggcacagaagcttaataaacatttgtcaaatgaataaactaatgagtagaaatccctaactttcataattaacctaaagggggcctacattaaa

SEQ ID NO: 30422 - DNA, 2175 bp, Bovine  19866880787974
tcccgggtggtacagaagataagaatctgcctgccaaggcagggaatgtgggttcaatccctggtccgtgaagactgcacacactccaggcaactaaagcgcacgtgctacagctactgaagcctgcacacttagagcccatgttccacaaggagagaaaccacaacagtgagaagcctctccgcaactagacaaagctggcatgccgcacccaaaacccagtgcagcactcccccacccccgccaaaaaaagaaagaaactgcagccatttccactcactaaactttcagccctgctgcgtgcagacagtgatgggctacctacctgactggtctcctctagggagaaccctcacctctgggtaagaacagagacattagggatcttcctgtagctaaacacatctaaagatggaggggctgagctgggcatacctgggtccttctcccaaagttaccaagtcaggggaaggagagatgcacgaaatgttacttgaaactttctccacatagaaacacaaaagtggggagatgcggtgtccaccttaacctccttacctgcagtcacagattcaaatactttcccatagtgtggctatgtgaacgtaagagtgtaaggagatcaagagcagcagtgggcacatgtagggtctgggagaagagggggcggggctagaagttgtgtttagaaagcaggagcacccaccaccccacccaaggtagtgcccctactcatctctggccagttgtagaaccagcaacaggctgggcttctgaatgaggattcttttttaaacaatgaaacttcttgattgttcaatgatgacacagaattcagcttcacatggtccatctgcgagctgccagcttgtggcctactttatagtaataaggtaatggcctgggaaaggatgaatttcaggaaaaatggaaaaccaaacctgaaggcatttgctctctctagtaagagcagaagagaaaggagggctatttcctccataataaacaggaagagccagggcactgggacccaaagacagggtctcactggtactcccaagtctggggcatctgagagactgctttgtggccccaatgggaggattatagcccttgatccacaaatatgggaggatgaaaggctcccatccaggaaaaagggagatcctgccagaatccgccttgttctccaagaccacgccctctactgttctcagtcccttcaaatgcctaaggagaggcaaacccagccgccaagtgagtcacccagtctgggaggacgactttcttccgtcctcgcttccctttggctcccttcccctcagtaattgtttccagggccggcgctgggggcagacaccatccgaaaggcctgctctgttcccccctccccctcttgaatgggcctcacaggctgccctgtgttgctagtgcccattcatctggaactagctgttcacagccccagctaaaaaggcctttcatccactcattattcctctaccaaagcctcaaacgggaggagacttcaaagtatgagggccaagcttgatttccagtctgcggcagctctcccgcaagcaaaggtgggggaaaggcagcccaccgtccacgggttctacctggtccggcagagttgtcatctgtccctagtaacaatcagctgggtcccctccccttttggaccctcccattgttgtgtctcttagagaaacaaaggcttcagaggaaggctcgcccacagttctgagccacccccttgcttgttgagtatcacctctgccagcacaagctgaaatgctcggccttggggcgccctgtgagttgtgtcttgaaacaagaggcccctgacacagctcctggatttctccctcttgtcctcctcttcttcctctgatttcattcctgatcagaatcatatttctaaaatgaggccctgagtagcaagtggaatggcaaagtggccatttccccatcgtgattttaaaggtcatgccaaagccaactagtcttttttttttctagttattaaattgaggttggaatgtacttttgtagtttatgggtctttgagcatttgttgtatgatcctcaagtcccaatagaccccaaacgtaaacctaggcttcttccttcctgaccattgccacctcattttctttgagtgagacacac

SEQ ID NO: 30423 - DNA, 1185 bp, Bovine  19866880794373
ataatattagtgtttaattctctaatagttctgagatctctggtctctgtgggtgtgtctcatttctctctttctctttcttccctctcttttatatgaaagtggagaagacagctaacaacaagagtcctgtcatccctatggtgcaatataccctcatcttttcttttattagtattattttaattggagtataattgctttacaatggtgttttagtttctgctgtaggacatgaatcagctacatgtatacacaaatctcttccctcttgagccgcccactgctcccccatcccacccctctaggtcatctgagtcctgagtggaactccctgtgctacacaggcttccaactaaccctaacacatcattttttttttccaaatctattttacacatcttttttttttttaattgtggaattcttgattccccaaagtagatgttattatctccatttaaaatacacataacggagaaaaacactactgttattactcagactgtcatcgggagggggaataaatgagtgcctgtattatgggagctgggagctgaaatctgccacaggccctaaccggaaaccatcggatttagtggctgctaatccattcaattcaggcatttgttttttcctccgtattttttacagcggtgagagagaaatctctttttctctacagaagtcatttcagatctcaaaatctaaaatgcgtcctctccgatgcatgcccacccacagggttgacaaatgctagatttcccaagatagctgccacacgctcagtttctaatctccgtatttattccccgccagaatttctaaatccttccccggtacgtccagccatcctttctgaacgtttgagctccatctgctttccataaagcccctgggcactagtcgggcgacagaggccagggtggagggcccagctgggggacccctgcacccgaggtctgactctgcaaggcctctgggcgttctcgggccagccagcacgccacgcgccagcgtgcttcccagtcttagttcccccgcgctgccggagagctgaatgaggagcagcgctatttttaccttcccggctgcaatcctttagatatatttgcaggaaggaaataaataaaggattgagaaggaaaggcttggcctaagttttacactagaaggagggggttg

SEQ ID NO: 30424 - DNA, 1307 bp, Bovine  19866880820016
ttgggaagcttctctggacagttcatggaatgccctgtgtggtgtatggtgcatggaacaaatttgacactgaggagtattcctgagattaaaatgcaagagaactgtttagagcaaagcagataccacagatagagtttggcaggcaagacgtttcttactaatagggctaacaatttagaggagaatgtcataaattgtaatatgtttacttttcatctgatgaattttaacggcagctttcaccattacctccaggaatccataagaaacagaaaaaccagcctggaaacgtatttgatagtcactaaaacaaagtctgtggcattatctcagctctacttctaaaccacattattttctcagaaaacattttaaatatagcacaagaaagagtcctcatattgcttgcactcactgtaacttgaatacagtagttctttgagaagtctcattttcttgcctatcttattttgttattcaaatgatgaagcatattttgcgtgaagttacaccttctcagaggcagtttgttctggaaaattggtgcagcatttccatttctcacatctttacataactggtttcttgtcagcaaatgtaaccgtgtttgacacagtagccctggaatctggacccctgcaggccgtgagcaccggtgcgtctctgcagctctgactcggatgacacgccttgctcaggaagagggttaaaatggacagatgcgtctcaagagctcaaatatttctgtcgccaggtttttattcaaaatatagacccttgtcatgagaatgccaactctgtcctcaacttaagcttcaggtgtaaacctcactggcttcctatcgaggcgtgctcctcattagctgaaacagtgacatggccacacaaggcccacgtcgaccagctcatctgactgcagaggctcagctgaatgaagaaaaccccaaagtgttcctttttgttctcttttaaaatggagcttttgacattataaggtggcattttattaatacactcgttatctcataccagaatcactggatggctagagtggctcctgtaaaatatcttgtacagacattaccctggttatccctggcccacccagctctggtcttattcccttgtgatcctacaaggcccctctcactagcagagccgttgcaccacacaactgtaggaagcgctgtttacactgttttctgtacgaatgccaccctagggctatgcgagtgatgccccttaagttgtgtgtcaggggagccttgcctggtgcatgcaaccagggtctcccacaaccaggt

SEQ ID NO: 30425 - DNA, 1229 bp, Bovine  19866880841545
ccttttgtattcctgctgctgctgctgctgctaagtcgcttcagtcgtgtccgactctgtgcgaccccagagatggcagcccaccaggcttcctccgtccctgggattctccaggcaagaacactagagtgggttgccattgccttctccaatgcatgaaagtgaaaagtgaaagtgaagtcgctcagtcgtgtccaactcttagagaccccatggactgcagcctaccaggctcctccatccatgggattttccaggcaagagtaccggagtggggagccattgccttctccatttgtattcctatcaatcatcatttatagataaatccatggtcatggctcaacaacttggcagcttttgagaagacaacttaggctcttggtcctatggaatctccccacactgagaaggcaccagagtaatgtcctgaggctcctaacttattttgaagcaaccagtacttctgtctccattatagacttgctgcatccccaagctccctctgggagttagagatgcctgctcactcgttcaggaaacagccctgcagagtagcaacatctccatagcctttctgagcagctgtcccattggaaagaacagagcttcatatgaagcccacattccccaagggctatgctgggggcctggtacacaagcacaggtcctgtctgtcaccctcctctgcccatggcttgggtttaaggtcatagatgcacatcgttgccttagctgttctgatgtgagaggtaagtgatggtggcccccctaccgagcccagagagatgcggcaaacggaagcacatggctaccattgagcctccaccctttcagcagccgctggtgcacccactggtgtgtactcgtgcgatgcagacacacagaagtgaacggtggggcagatgggtgggagactgtgcacagccttgttatgttcccgcctcagttcctcaccagcgaaccgcaagcattcaacggcatactgctccttgcttcaatcaagccatgccctcgccacctgaaaggaggatgaactacctgctaacaatgcacttttggaatccagttccactgccggggaagctgccaggtgccccgagattccaccgggagaaaacaaggctgtttaattccaattaaacaccatattgagtactccagtctcagtacactctatttgtttagtttatttgaatgtttgataagagaagtgctggggggcaaga

SEQ ID NO: 30426 - DNA, 2927 bp, Bovine  19866880843657
ctagatcatatctgtcacagctctaacaaccaagtgactgtaaatccattcacagccacctctgcaacaaccagccattcctcttgggtagggggaccagatccttcagctcatgacacctataacacatgagctgtctgggcatggacaggctttggacaaggggaatggggaaactagtatgttggaatgccactgagccagatgctgtttaaatacaatcaggcctaaaaaaaatcccaggaagtaagtgctattatttccactttgttgatgaaaaaactaaggctcagagatgtctgtctggatctcaagccttgccatgtctttaggctgtaggcttgtggttttctcccttgcttcttgtctctcttacatgtgcagtgttcatgttggtgttaggagtcttggagccttgagatccccaagcgtgggtggaatggagggagagctgctgttgagtggtgtgctcccattgtttctaatcccaacgtagaaggctctgggaaagagtgaagagcagcaccaaggcttagagctaattaacagcgtggtctttgcttccttaggaactgtaactaggaactctgccatttgacaaccttgaaccttctatatttcccacttgctaaaggtcaaacgtcagagccattaatagctcacaccgatgtggcggtgaaggctaagagccatcataccttttgcaaccaaataaggggatgtggtctgttgaagagaaacgaagggaaggagaggacaaaacagtattcagaggaccactgtattcagctgaaaccccttgttcctggtactgagcccacctattccaggggagcactcccctccagccttgctgtttgctctgcttccctggggagcctccgctctggtccccaggccgccaggttcctcctctgctgcttcgctgactgccgggagcaccaaagcaggactgccactgccgggagcaccaaagcaggactgcctgccgcacacatccctcccagcatcagtttggctgcttcccgaatggtgattgaggacaaagaagagggagaagacaaagaaaacgcgccacaaaagcagaaggaaagaagttggagccagacacttgggagaaggccgacaggaagaaggaggtgcctgaacctctgtgatctaatcttggggaggaactaccaggaggaagggcaggaggtcggacagtccaggccttgctatgcccgtttcttggcttccttgccgctttggggaaagagatggagcaaccgaatccaagggaaagagatgaatcagttctcctagaattcagcatgaggcagaggctctttgtttgtttttttgttttgttttggcagggcagaagcaaagacaagccctctgcttatttcagacgggtgctgtgagcagtggggggggcccactactgacctgctccctgaggatggtggtggtggctgtgtggcctccatcaggagatgctaaggagttccaaggtggggggcttggtggggggtttgatttgccacgtgaatatataattggagtgttgagtggatttgaacctcaacacagctgctaattcacagtgtacacaccatgctggtaccgtttagaaacacagcacgtcttatgtgtttttaatatccaattttatcttatctgaccccttcatttctcagcctgggcagacaacaccaggaaaccatttctttccttcctcggtaagaaaatgactgtgtctttggactgtcttggggaggctggctgtgtgtgggcatggggaacacacacgcgtgggtacgtgtctgaggagggggctgctcttcccatggatgtgtgtggccacaggcttgggtaagcctcctggatctctgcccacagtggcatcagtcagtgagggaggcaggcacatgggttatctacctgagaagacctacttggttctctaattgaccttccatctgctattgctcactcttctcccacccctgaaccaaatgaaggctcttacaatgtgacctcaagtaatcattcctgtttctgagcccagttccttctcagtgtcttgtttgcccctgagcttgtgcttttaactaccttctgttcttgggacccttggctgacagaataccatcttttttttggaatgtggaccatttttaaagtctttattgaatttgttacaatactgcttctgttttatgttttggtattttggccatgaggcatgtgggatcctagctccccaaccagggatcgaacacgcagccctgcgttggaaggagaagtcttaaccactggagctccaatgtgtgattgtgctcagtcgctcagtggggtctgactctgtgaccccacagactgtagctccccagtctcctctgtccctggggtgatccaggcaaggatactgaagtgggttgccatctcctcctcctcggacctccagggaagttcccaataccattttattttaataaactttttatatacctcttactctgaggtgggtgtagtagaaaaaagttcaaacactaaggcttgaaccgggagccagactctgttgttaattagttcctgctgtgcttactcactcagtcgtgtccagctctttgctaccctaaggacagtagccagccaggctcctctgtccatggggattctccaggcaagaacactggagtgggttgccatgccctcctccaggggatctttccaaccccagattgaacctaggtctcccgcattgcaggcagattctttaccgtctgagccaccagggaagccctcactgtaggcaaatatctctacctcccccaggcctcaatttccttccctattaaatgaggagatcgtatgggttgatctgtacagtcccttctggcccccagattctaaggcttgcttcacaagagtttctcatt

SEQ ID NO: 30427 - DNA, 1379 bp, Bovine  19866880844552
actgacttctctgcgtttaacgtgggatagcactgtggttaagagcatggtcgggcaccagactgcctggattcacatttgctttgtcacttactagctgtgtgactttgggaaaatgattgaagtgttctgtgcttcagtttccctaggcctaaaggaggattaacagtagtacttacttcttgggggttgttgcaaggattccattagttactatataaaattcagttactgattctgttagttactgtacaaaaagcacagtgcctggcatgtctgagtatcttacgctgttagccaaggactcttacgtccttgttggtgacagtccccactaaccctcctgggggcggtgagcatagaggagctgtgctgagcatcgaattgtaagctgggtgattgtttgcccttctagatggaacccttcatggggttaggtctttacttccatatgtatcatcacagctcttttctgccttgcatccttctcacttgctgttccttctacccaaaatgctgttcccctcacttaccatcagactaccctttactcagcccagaccttaagtgtcacatccttagaaaggctgtccccaaactgttgatcaacgctccaagaggttccttcagtcactcgcagagcacctcgtgctcttccttcacatagttatccccacacttacatttgtttattatctgtcttgccccccagcctgaatgctctgccatgccagggaccctatctgctcattcccttctttttcatctccagctcccagtgtggggtccagcacacagggggccttctataagtattcatgcagccactgagagagtggaggttgcctgaagacatggtacccagcaaggcagggtccagacttcgtgtgcattcaaaacccacacaggtaaaatcgagccttctgtgaaggccacgtgctgcaatcgtgctgttagcacagggctggaactggaagcagagcccaggactcagttcgctctccaacctcacagcaaccccactgtacctgtgacgcggcagccgaagagttccaggcggagggcgatgcccgtgtgccaggtctgcgggcggaccctgacgaagcgtgtcagcagcggcgagtgcagcttgttcagaaccacctctgtggcatcgttgttggcttggaagacctataacatcacacgccagtccatgttattgaaatctctgtgtgtagttgagccaggcagtctttgacagagtaggggaagctctgttcaatgttagttcccttaagcttaaaaataatcagtgggtttgtagtctggggctgtttttgaaatgccatggaaaaaaaaaagataatttctcacacagctctaacttgaaaacaata

SEQ ID NO: 30428 - DNA, 1354 bp, Bovine  19866880858578
ggggggttccattgtcttaaggtaggaggtttcgtcccacccgactccttccacccattatcatcattattatcattaaaataattaccgtaacaattacagttgatgagacctcgggtttatagagcacctttcatctaaaagttcaaagtgatttatctgtgcgtcatccctttgagagcggtaggagggtaggaaagtattgttattattttttttggtcttatctgctgggaaagcgaggtccaagcagatagaggatttagtcctagcctcagggtagactgctgttagggtactgactcttcttctgggcatctccattgccctactgcccataaaggcccttatgcttgtgtggcccccacagctcatccctgacactgatgctccctcccaagatgtgagggtcccaccggccactgcagtgtgatggccatctccccggccagccaactcctccatgcacacagcaaacagcctgctctgactgtgggataaaggtccttcaaggtctgactcacactgttcccatcctgtgaggagacttcctgcaatctggttccccttcttgtagaagctggtgacctttctagccatatttcttcccggtcttactgagccttcagccaagagcacccgttattctgaacttcacagcttctactcccccacaaatggcagctgattctttcaggatagagggatgtgcttctgtgatgcagagaggcgagcgctgtaatgtgccctgagtggacaggcctgcttttgctccagcagctacggggccttcagaatacagttgtcgaagaaagctgttacccagtggtggtttgagaggcggaagcggtcccagctgactggccaccgaatgctcttttcagaatctccaacccggcgtggcagctgtcccttcctgcctggacattagtgcaggcccctcatgtccacaccccagtgctttttgcacagtagtgacgagtttgcccctggagccaggaagaagctctgagctctgtaacctgaagctccaagtaaatgaaatgcaaagacagcactctcacgcctgcccggtcacacctactcctcagactgtcccctgcttggatttccgcatggcacatttttcaggcaagttttgtattttctgacttttgttatggaggctggaagccagcaaaggaagacagaaaaacctttgagagctcccttggttcctggaaaaaacataaaggattttttttgatgctgacagattccctggagctcagcactcctcgttcccagcaggctcccatttttcggacagatgggaaagggtatgattcactctcacaattagacccgctgggag

SEQ ID NO: 30429 - DNA, 2408 bp, Bovine  19866880876248
atgaatgattacagaaggagaaattattacaggctgctctcagctcctatcacataagaaggtgttacattaacaagatggaaggtccctgcggtcccctccccaacacagcccccactgccaccacctgccaccccactatttcaatttgtgtggcatggcaggaggggagcccaaaggcagggagcagggagttaattcagctatactcatcaaaaagggggtcacggtggcagccaaggccaactgaagcggattcaacctgagtgtcatgtgaaattcttcccttgcaatctgtactggctatgacctctgcggcccgacaaccatcgatgacattaaagcaaagtgaggccttttttcttagctgttcacatcatctgctttccagcctgggtgtgtgcatttccccatagatatgcctggccttgtctctgttggcccccaggttttctggtgtttctaacctttcctgacataagcatggacagatggagaaccaggcgggtgccagcctggaacccatgctggagactgggggagactaagttgaggaaggacactggccctggagccgctccggaccagcacaatctggggtgatggcaacaggaagtctcccttttgtggtggccaagtggacgcgatagattgagcggccttccaagtccttgctcgtcagtgtcacaggctgtcatcatctcattcctcgtcctcatctcttctccagtctccatgttaaagaatcacaggtcacaaatggaaggttagcagagagtcagaagcatgcagacagatggatcaatagttcttctttaatgagatttgtattccttcagattccattcacatgcagaggggccaatgccctagtctgcttttaaagtcaaatgcaaagccagatccagggacagatgggctgtgcctgagagggggatcgccactggtgccttccccaggaggccagaaaactcagttccttggcctcgcccctgcaccaagctccttaccactcagagccctggtccagttcctgttgcaaatgtgaacctaaagtggtgaggagccccagcacgctcactaaccaatacgatgttaaatatcacacctccctgcttgggcctgggctggaagccgcctcttcgttacacggctttctctgcacttaaggaaagagagtacgcctctcccagatatgccccacagagacctgccctcagcctccccagcgctggggaaaccttcaaaactattcagtttgtctaaaccccatccatctttaatgtcagagtctacattttctcctctcctccttttttcaaagctgccaaaaaagaaaatgtcactgcattgggggccaattcaaaagccaggcttagacggatgttcggtttcattccccctggcccctatgtctttatctcccgtggagtcttcagaggctgtgtctccacccacctccattcctgggttcttttgacgtcttgatgtctcccctgtctcttgcgctcctctcttgccttcttctaaagcacaggccttagaattcacaaagctgtccttgtgaccgcagcccctgctaagaggacagcttgttgatttcttaggggatgggaagggagcttgccagctgaggctgtcgccacccctatcaacaccctgccagggattcagaggttgaacagctgatgcaggtaagtatccccgatggtgccttttagtagccagattctccaaatttgtgcagaacacatggaatcatcccaggctgtgatgatttggttgggaatggtgtatgtacctccgttcccactgcatgccttagaaagactcttcaagccatgaagggcaggtggcagtcctgatgaagatgccagcggaatgcatccccgacagcccctggctcacccaggagcagggagctgaggccctgattgatacctgggggtgaggctgtcagctgggagcacacaggagggagataagggactcaatcagtgtcagacccatcttgacacacatcgctgtaaatcactttggggaaagatgctcagctgccaagagcagagaagggcgagtaggtgatagaaaaacagggcgagaagcagctgtgtgggctgccagctctgggatggaccctggccttggctctagagggaaatgtacaaaatacacagaacactgtccagccggccttagcccaagccgaggtacagcactgagttcactgcagtggattaaagcataatccagggtgaacgtttgaggatgtgaattgtctcaataacacttctatggaggcttcccaggtagcactagtggtaaagaatctgcctgccaatacaggagacacaggtttgatccctgggtgggggaagatccttcggaagagggcaggcaacccacgc

SEQ ID NO: 30430 - DNA, 1115 bp, Bovine  19866880890130
tttcgaaagtatataaagttccatagtcctcagttcctgaagagattcaggctgatttgcatgcatgtgtaatgttcagtaggagtgggtgttaaaacacttccatgcatttgcttattatgccacgatgttaacattctataagaatcacaagcacacccctcacaatctatttctgttctccttctagttataaaaaggaaccattataaaaaaggaacgaattccacttttacatttagtcttttattgctttaaaattagtatgaaaaattctcggatccaccttcagaacttcaatttagagaatatttagcttctgacaaggagagattcattctttccaaattttctctccatgtctgtgattctcttaaagatctaaatgctgttttctcaagtgatgtgtaagtatgcctgaacagatgagcacagctgaagtggcttagactttgttctttttcataaggaattattaatttgttctctctcttctccattccttcactcacccatgcctaaaaaacttatttgaaggcataaagtaaacaagtacattctagagaagagaagatccctagctgccttttgttttgttctgcttttttcccatttaatgtggtgctggtcttcgttatcttttaaagataacctttttgatcattcaagtaatacatgtttattatagaaaattttgaaaatacagaagaggttaaaaagaaggtaaaaatccctcttaatctagtaactcagaggtaatcaatattagcattctggtttatttctttcctgttgcatattttctttgttacttaattcttaatgaagacagtggaatcatttgaataaacctacccatgggttctaaaattgttaaaatcttcatgagtctttaataatcttgattcatttgaaaaaaaaggtattaattgatataaataaagagcagttactattgtaaattatcagatttccagaaaaagtcaagcagttttagaacacctaataatggctctatctgtactgtccatttatatcttttcagcctctacagaaaattccattaatacactaggaaaatggaaaacaactgaaatgaaaatttaaacacttta

SEQ ID NO: 30431 - DNA, 1443 bp, Bovine  19866880943070
tacatgagctgtgtttatctattggggtggtgggaccagcagatcagttgaatcttttttatgttaataatagatttcttcgtattctgagttataaaatattattgatcaccttttcttggtgaaataaagttgaggccttttgtaaagaatgccatttttaaaggggctcctttgtttaaagagttggtgggatcatttcaccatgcacatttcaaagctgggttgatttcagttatttccaaattttttttttttaaattactcagttgtgttgttatttatgaagttagcatgcccccaaaccaccatattttggctataggaaaattatgatacccttgactttttacctggtttatatgcaatttttaaaaaatgcattcctgtattttgagttttgtcattttgctatacattcattactgaagtgtctggtggtctaaaatagtcaaagctagagttttattaaatgctccagtcacatttatttttaatattaaaaaatcgtactttgaaacatgttaaaacaacttctgataaatgacgtctggatttgtcgttatctttgaagcctcattcattttagatatactcaagacctaggaaagctttttgtatgttgtttttacagttgtattttttgcagcatctcccagtttcattcactcttgctttatggattttttaaaaatctgcgtatttcttgtacatatgcatgcaaatgaaagaagggaggttgtattggtgccatttctcccttcagttactggttaatgggatttgctagaataaattcccctgattgaagggtgaagctaagcccttttgtgtatatctgtacagagatgtgtatatgggatgtggtggcactttgctgaatgtgaacttgccttgtcgatggaaagattgagaagtattatgtttatttatacatttgtataaatctatatatacacgtatgtatatgtgtgtgtatagataaatctatatacatatatttccctaaaagaaaaaaagtgtgtgtgtaacagataaacagcctttgttaagcaagattatatatctttggagaattgtggattattctataagcaagaagagggacagtctagtgtaattatcagagcatacaaagatggaagtccttaggattatagtcttgtttatgaattccttttagaactgttcttacttgccactcccactattcttcattttcatggacttctaagtcaatctctcaccacttaaaaatcacactactttgtgtttttttctcctttattaggtcctttttgccagaatcatttggcctaaccatatttcattaacacttcacttgtctctgaaatttcccggaagacacaaattttggcaatactttctaggtaattttaaaattgggcatcattgtctcaaaaacaaccaaccaataacaaa

SEQ ID NO: 30432 - DNA, 1202 bp, Bovine  19866880945945
acaaataaaaaggatatggaaaatttaagtaaaaatgaattaatctttaaattttggtaatcatttctttatctaacttcatctgctttcttttttcctttttgcttctcattcagtcttcagccattaattgaatgattgaaagaaagttaaagctacaggttttcatatgtggaaaggccttttcttaatgtctttgttgatctcatgccgttctctcctgctgctcacattaattactttgcagatggctctaattgacccagtaaaagaaccttatctgtgttcagtccttcccaggctttaaagactctgcagcttctgaagacgtagaatgcagtgcttatgctcagctcttcctagtctgagtacttggtcctagagttccctttccttaggaggttcgaacttctctgcttaaacctgtgttctgtctggtcccgatcctgcttttaaacaccatcaccccatgcctgatgccctagccactggacttctagccactcccagaatatcctctctggctgcacactttgatccctgtctatgttacctgctctttcctgcctacttccctatctgtattttgtcctgaatctaccctggccttgttttcttttctttttcttttttttttcagatttatttctttttggctgccctgggtcttcattgctgcacatgcgttttctgtagttatggcaggtggaggctgctctctagtcgtctctcattgcagtggcatctctttttgcagagcatggtctctagatgcgtgggcttagttgctcccaggaagcccggaccaggggttgaacctgtgtcccctgcatttgcaggcggattcttaaccactagaccaccagggaagccctggccctattttctcattgcaaagctcccaatcatcttgaaagtgaaagtcagatcagatcagatcagatcagccgctcagtcgtgtccgactccttgcgaccccatgaattgcagcacgccaggcctccctgtccatcaccaactcccggagttcacccagactcatgtccatcgagtcagtgatgccatccagccatctcatcctctgtcgtccccttctcctcctgcccccaatccctcccagcatcagagtcttttccaatgagtcaactctgtgcatgaggggccaaagtactggagtttcagctttagcatcagtccttcca

SEQ ID NO: 30433 - DNA, 1550 bp, Bovine  19866880948298
acgcagtcctggaacccagcaagaggagagccatcaggtttcagttaagaaccacagagctcttctctctgtgcttgtccatatttttctggcttgttaccttcacaaacatttctttttcttcgtcatgtcccaatggtaagtgttcgctctgtttttggacacatgcttttacttcttcgccaatttccctccccactagcactaatctgatcttcatttgcatccccttgcttgcgtgagagacatagttgtgcacgagtgtcaagcagacaaaaagactcatagggaaagtttatgtgtctttggaggcctcccaaaaggtaactgttgacccccatgcaccccattcatagagcttccaaatttgttcagcttgctaacaagtcagagagtgttttgagaggagggatgagtcaaatggggaccatgaacagatggaaaagagccagttgttatgctccaagtacatttcccacattggaacacgcgcatcaatgcctggcggtatatactgcatacaaggcacccacgtaggataaaactgggttaatttactaccaagcgctttgtttctccattgcataatcacaaatgtgcccccaaagaggcagtgttggaatgtaagccagggcaaggagccaaccagacaggagttcctgtcctcatcagacagcttcttctgctttcctgccagtcctccggggccattctggtctgtgacagggacacacctggatgccactcatgtctgttgacttgtcttccatgtaccaagctggtgatgtgtgtgtgtgttgccagccagatcccagagcaagctggtgacctataaagggtaagagacctggtgcctttaggtgtggaatgactcccagctcccccaccctgttgctgcctcttgtcttatgaaaattgctgctctgaaaatagaactcagtgtctcttgagaagggcctggaaaggacagcgctcatcgtgtttgcctccaaggccttaccattaaatctcccacaagcttgaggaacagattgtcagagacccacttagcaggccccaaacacctcagttgcctctactgggtgaggaaattgcgttcagggaaagatgcatctcaagaaagttgcctatagaatgggtttctataaagagaattccattttcttctggcttccattacaaaattggaaaatttatcacactgggggaaaaagtctctctggagactaaaatgaacatttggggtgaaaaaaaaatgactgtaaaccctcagcaatggcacgtctctcgttgcaatgaaccaggaactgctgagaaccacctaatggttcacttttcctttgaatcatttccagcattttgttggcactcatgaacctcacctacacatgccgtcaatctttttccctccctgcccaaatatatgagaactgtctccatgactgaaggtcccatttccgtgttcttgcacctctcaaaatgcggactgttcattcatgttagtctgaatctggcattaggctgcagcataagatttattcattcattca

SEQ ID NO: 30434 - DNA, 1544 bp, Bovine  19866880953305
tattctggatcggttggatcgagattatggcattcagtttccaaagggaaaaaaaattgtcatttccactagcccctcttgctggaatgaaatgtcaggtgcgatttgggtgcaatctgtcaggcctctgagcagcacttctggtggttcatcttgaccttgtgcttgaggccgtcgtagagctcgaagttgtagttctccagcgtggtgcagctgcgggagctcaggccagagtaggaacaggtgcagtagagcagaagccccgcacatgtggccccgaggaggacgcccagcgagctcatggcaatgatggtgatgagaatggggtctagagtgtaaagccaactcttctctttgtcagccagaggggccccagacccggaggttggggaagaagagttgctccagtccacttcgtagtcatctaggatgtaaaggacacaagagactgcagacactgcttcttttagaaataactgagactccccccatcccagttcagaggtttttcagaacctgaggctgagctgttcgacactggtactatactgaaagtgaaagtcgctcagttgtgtctgactctttgtgactccatggactatacagtccacggaattctccaggccagaatactggagtgggtagcctttcccttcttcaggggatcttcccaacccagggatcaaacccaggtctcttgcattgcaggcggattctttaccagctgagccaaaagggaagccctgcttggcttcaaaacccagccccaccttgtcctagctgtgtaaccttgggcaagttatttggtttctctttgcctcagttcattcatctgtgaaatggcactactaataacctcacagggttgttaggaggtttgaatgaattaacatttgcacagtgcttggtgtccagcccaaagtaagtatggtctaagtatctgatacttaaacagtctgagtcagagtaagtgagcttagattttcacagggtgcctgcagagctcttggaatggccctctgttctgtacacccttcttcctttgtctccttaccccgtgtctccttacctccagctgcttcatgttaaatcaaagaacaggctgagactatttcaacatgacaagttctccaatttggcattcctggccacccaagcagtagattttttttttttttgatccaccaggcctcacgacctaaactttaccttactgctatgtgttacagattcagatgttgaattctgacccctagtacctcacaatgtgaccttaccttgaggataggtctttactgaggtagtcaagttaacatgaggtccttaggatgggccctaatctagtatgaccagtgtccttgtaaaaaggggaaatctggaggcagatacaggtgggagaataccatggaaacatgtagatggccatttacaagccaaggaaaaaggtttggtccacatccttccctcacaggccacagaagaagccagccctgtgggtaccttgatcttggacttctagcccccagaacggtagaaaataattt

SEQ ID NO: 30435 - DNA, 1086 bp, Bovine  19866880961685
cctgccctgcgctccaccttattcaacctcaaaccacaggccctgccacctccggacttgggacagtttctcaagggatgtgctctattttaaaggatcgtttcagttcctccacccgagtatctcaaaaacaaatcgtaactacacactacccacccaaattcaattagaccctgacttttcaggccagagggctgtggctgttgatttagggaagggaaaaaaaaaaaccttgctcatgataataaagtaatccgtttatgtctgaatctggcctccagatgtcagtggctaagagacttcattttcatttcgaagctacatctgtaaaaggcatttatttgctcgggagggaccctgttgcgggggagctgctgggaacccgccgccttccccttgtgcggcagaagcctggctgggtcccacctccacccagcagcggccccagagcatctccagagtctcctgaacaggatgaggcccacggatcacgaccaccctccctgttccctgggaagcaccccatccatccttccgagtggggcctccctcctctgcaggcccccaccctcctcccgggtagagctggcacggatctcagctaagccagagtcgagcttgcgtgctgcctgccagacggagctggcgcgccgcaccagagacagcaggagctgtagtcaggacccgggccccaggtatctccattttcctgtctgtaaggtacctgtcagcagctcacccagcaggggaaggtgaaggattaataagggcatgtcggagaagtgcttctggctccccgggagaaaaatgctgcctgtgtgctgttaccgtggcgcccaggaggtgtcccgttgaggcgcgccggccgggaatccggccgaattagcctttctcacctccagatggaaggcagccccagtgaatgcattttagtgggaagacactttattccccatcatgaaggagtgaggccaggttccctgcagcccgctgagtgcgcctgacctgtcctcttgctgccgctgaaaacggccctccggcagcgacccaagcggctgctttggggccagcatcagagcattagag

SEQ ID NO: 30436 - DNA, 1775 bp, Bovine  19866880978782
tgcgcgtagaacagagagccgctgggagcacgctgggtagcaggggacctcctcagcgctgtgtgtggccccagtggggagcaaatccaaacaggaggggacacgtgtgtccatacagctgattcatttgctgtacaacggaaactgacagcagtgtaaaacaactatactcccaattgaaaaaaaaacaaaaacaaaaaacagtttcacttagggacatccttgagtataagcttatacacttatacacttatatacacttaatttcattaaattcccactgctcagtatatacattttaaattatatgtgtaagggcaattggaaacatttctgaaatacatcatctgcctactaaagtacagtggttgtctttggcttatgcaattgagtgacgagctgaactacctcctttttttttttttttttttgtaagaaacactatttttacttgaaagaacagctgacagacagctatggttattcagactttggtatttggcagaaattttcttgaaaatgaaaaaagtaagactgtcagttcaaggaactaaactgacagtatttgctgccagtgataaaatttgagcttttgcgagaaaactggaattttggaagccctagattggccactaatgagcttaaattaacagtggtgaagatgtgttgattttgacggcaattcacaaattatggaatgatcgtatctatgtaaaaatagatctgtctacagtgctatcttattacccattgaatgtttttattgtaagcttgtatgaattctctgcatattgcaaatatttctctttgccctatacaaggccagaaaaacaaggtcccgtttgtttatgacttcaggggatccaccctttcttttgtgtttccctggtggctcagtagtaaagaatctgcctgccagtgcgggagacatgggcttgatgcttgggttaggaatagcccttggagaaggaaacggcaacgcacgccagtatccttacctggaggattccatggacagaggaacctggtggtctccagtccacggggctccacaagggtcagacatgacttagtgactcaacaacaaaacaaaatcctttaagtgcagaaagtaatccttgccacagtaattttataaataattatcttaaaaagtctatgactaagtttagatatcttattctttatttcaactttatcttggtatagagtatagtatttccacatctttttaaggccccccaacactaaatgaattgtcctagaatgctgtataaaataatcctttcctgctatctgacatttcctttattcatatacactcttacattgtgacactgatttaaaacagacactcattcttggatactcactcattttctggtgctttcttgaagagctgaatttatcttggcacaattaaaggcattgaaagactgcaatcaacacttgggcacatttacagcagttgctgctataacactgacatttgtagggtctttaacgccacacttcacatagttaattcacttcacatagttttcctagggcattatgccctctgagtaaaactattattcatattagttgcttaggattcaaaattcttttagtaaacatgtgcttttcctgtggcctgacagatgtaagaggcatcaccctgagagtaggtaggtatacacttatacagcaaaatcattcctactcactgatcagaatccagagcaactacaaaagctgcataacatttaacaacacaaacaaagctctgggaa

SEQ ID NO: 30437 - DNA, 1330 bp, Bovine  19866880980271
tggacacgactgagcgactgaactgaactgaactcactctgttttctgcaagggttttttaaaaaagaaataaaacattacagagaaagttgaagtatcttttgatcaaatttccctcccccacatcccagaagcaaccactgtcatgaatttagtgagtagactgatattttaagtatagtgttttcgtcaactattttacagctccatttccccctgtttctaatttactgctgtgtagatctgcagatgaaatttaaggaagctgaccctctcagaattctttaccactttattatttgtgactggcttctctttctatagcacgcagtgagggggttattatccaggctttggtgggaaagaactacttctaggaagaggcactctataaataccgccccctcccctgacccctggtctgagcaaaaacaatgctatatttattctatattgtccaacaccttcaccatgaatgttatcatctaaaactcagtagttgtgtatttctaggctgtcatacctgtaattttggagctataggtatgttgacaccacagcattttgccagacaaaatgtgtcaacactggcctggccagcactcctggtatcaatgtctctttgtttctatatatgcatagtactggcatgcagttcaacaccctttatgctacagactgaatgtcgtgtccctccacccccaaattcctgtgatgaaatctaattcccaacatgatggtatttggaagaagggactttgagacgtgattaggtcataagggtagagtcctcttgagtgggattagtgctttttataaacgagaccctggaaggtccctcatgtgaggacgcagtgagtagacagctgtctacaaaccaaccaggaagtgaggcttcactggacatttaatgtgctggtgccttgatcttggacttaccagactccagaactgtgagaaattaatttctgttgcttgcaagccaccctgtctatgggattctgttacagcaactccaaacgatgaatacactgtcgtagtgattctcagctctaccaggtgcataactggtagagttataactggtagataactggtagatatcataacttgtagataactcctccttttaaaatgtttataatgcccctcatcctatatcctttatagataacccacctactgtgctgtgcttagttgctcagtcatgtctgactctttgtgaccccatggaccatagcctgccaggctcctctttccatggggattctccaggcaagaatattggagtgggttttcatgccctcatccaagggatcttcccaaccca

SEQ ID NO: 30438 - DNA, 1878 bp, Bovine  19866881011333
aatatatatatgtaaattagactagattcaggtataaatagccaatggtatctcaagggacagtgaaacttctccagcaaaagcagagaacagatgcctttaaaatctagttccacccttgggcggagggtggggggtcagggagaaggcaggttaaaaagaaacctcacatattcatttcatagtcaccaacttactaaactatccaatatgatttttaaccttcaagatctggtatttcaaaaaaattccccaaacttaaacctaaatacttaaaattattttaaaagtaccaaagggtgagtaagatttatgtctaatttccatattttgctttgaaagaaaattttaaaatgtgtatccttcagatattacatgtcacttcacaactggtacattgattctacaagtgtcatcaacattttacaaactttaccaaagaatcactactgtaaacatgaaaaatcccaaagcaaaagatggatcaaggagttcacagatcccatctctccaaaccaatcttgaactatcctgcttttcacatcaaaacattttctttaattacatcttgtgaatatattccatggaagagggattcagaaacaaatgctgtctaaaaaggcaatacaaccaaccatcagacctcagaattgcagcaacccctgcagtcctggccaagctcttcaccacatccgccgggcactgatgtgaattcagctttttgtgttctgggctaacttagcagaaaagggttgtgctactcacgccaccagactgccacccttctccattcaccaaggtcggctaactcagtgggaaagaacgaccaaccttattagggctctgagatgtgggaaaggagaagagacttctacttattaggaaataagaaaaaaaaaaaccaacaatgggacagctgcttcctgccctgcacagaaatacacgcgtgggtgcacacacacacacaggcagtcaaaagactaattctttttctttttaattaaacatgatcacaattaggaatggaatcctggcctcatgtggtgtttgctgagcagttggtgctaagacagaggcttgaatctgcctctgcacaccatttgccatttcttacacagaactcgatgaacaggctcattctagctagaaccaccctgtgtaaagacctggtattagaatggaaagcattgatctacgatactaagaaatagtaaagggcactggtaatctgaggtatcttccacttctaggacttgctgctgaaagtcgattctatccagtcactgtgctgagccgctaaggaaaccactgggggggagggtggacccgccaggagggaacgagcaccagtgccaaggagcacatgtgaacactgaagcgagggccaccgcaggggggaacttgtttaactggaaaaggggagttctcctctagtccccgtctgttatttttaaaatcttctttaggaaaagggggcgagggggtgggtgataaagagggaaaagaagatagaaaacaccaggttccccacctgcctgcaaacacacagacacactcagttaggggaggtaaagggagaagatgcgttattggtacttgtagctgtggcacctgttactgtgaagcctgtgggaggcgctatcgagctgtggctgggctgcaggtccttgggaatgccactgtgagaactcagctggtggccgaaggctgcgctgaactgagggagttgctgcttgggggaggtggaggccagcagttcagcggaaggccccatgccactgaagctggtctgcggtaaccccgggagcacactggagctgctgggggtcacggtggcgaaggcaggctgtgtggtctctgagttcgaagtggtgggcg

SEQ ID NO: 30439 - DNA, 1286 bp, Bovine  19866881079875
tctacttactttattagggataaaatgtcgctttctatttttcagtcctgtatttcaagtgctctaattccaggcaccaaatgagcctccttcttcccttaaccagacgccgtctccagatttctgcaaccttctccacttaggactgccattcctcatgtctttcccctaactttcttctcttacacagctgtgtaccttgctgagggttaattgagactgctgccttggtgccctgtgactggaaagaaaccatctttggtcgaaaataaatcattgccacctcatttcacttttaatttactactgactttttttattttttttttttggttcagtctccccacagtctctcttttctcaccactcatgcattttcagcctcattgctctccattggacaatgcaaagctgaaaggtttatctgtaacctatttgtctctattataggtttctaaactttaattaaaccagagacagcgaggctctcaattgccctttccctgtatctacaggtgttgctggcgccatctagcggtgaggtgtggcatctatttttctcttgggagctttctcaaatctggaggcttatcgcctccaccaaattcacatcacatgggaggaaggaaaaggcatgcaaaaatttaaaaataacttttttttttaccttgaaaattctcacctgcaaaagctgagatgggttctggaaaaaaaaccaaaaaaatttgagttagatgagaggaatacataaggtgaacacagtgtatgatgaagatgagtttcatcaagctttttcatactaccccatgcccgccacaggctctgggtctaacacaccatcgtcatgggggccaggtgggaaggattctcaaagttgctttggaacaaaaagtcctttatagagtaatgggtccctgaagcattgtaatcagtcacttaccactgattactttctcagagcctggattagttttagatgccgggggcccagagagttgcctgaagggactagggcggtctcaggtgcttctgacatcatcaggcacacacacacccgggacccatgtgccaagaaaagcacttggtgagttattacagtcactctgcggagtgaatgtaggtctccttccttctcaggatttcctcttgcttttgggaatgtccatggctctgatgggaggtggtccatggagtgaactagatgacctggctgctcagtacttctgtccaaggagacagtgtcctttcggtgctggtcacttggcatgcaatgtttaatcttacaa

SEQ ID NO: 30440 - DNA, 902 bp, Bovine  19866881137067
tgattggagctgggcgaatcctgcctggctgttgacagtttaccacacggcagcctggccaagggacgggtttcattctgggttttgttttttcttcaaagagctcatgaaggttgagagacaagagaacggtattgcaagttaaccgagttctgcaggtggtcagtgtggtcaccgagcaacagagtgggtttgatacctgagagagattgctggtccttatctgacacgtgcacacacacgtattgaccagtgtctgagggatcacgggaaggacagcaattaaactgacggcacaaggccagaggaagtgacttctgaggccagctgcccagacaggtggtgcaggctaatatagaatgacacgcatgtactcacagagaggactcccaaagacaggtatttattgctttgtaatgtctgtctttggtgccagaactcatgagacagttgagtgaaagaaagaagcaaaagtgcctcctgggtgtttattaataaagcaggcttcccacgacgtatcagcccacccaagtctatcacacgtttacctgttatttcaataatggtgcatctggagtttgggagcatccgtagcctgcagcactaacagttcttgtgctttagattgtatttttaatttctattatgattcttatttatccacagcccaatttcttttaggtcaaatttagttgctttcagaccaagaggggctgtcaagctctgtgacttggcatcattgtttgtaaaatgtgagtgtagaattaggtctttaagatgaaggagtgcctgaaaggactcaccccttgaagggagcagcattttgggcgtctcgggggtttaaggctatgagacctaacttctgccctgaccatctctacctgccagactttcagtgcaat

SEQ ID NO: 30441 - DNA, 1450 bp, Bovine  19866881182268
cagggttgcagtcactatccacagtgatcaaataatttttgattatttgcaaaagtcagggctaataacggtaaatagcactgagcgtctattggcgaatacattgtcacatactctctacatcatcttatgaggtcagtatgatcatcaccactttagagacaggtagctgaagacacttgaagacaagagatggtcaatagctatctgggtcccccagcctgtcaatacaagagccacttgtaacccatccaccactgtgcctgactctcagatggtccatccccccaccgagaagtaggggagggtggagaggacatttgccaggtagtacacctcaaccttggtccaggatgactctgttcatcaaccccactccagtgagttggctggggcagggtgatggtgtaggatccaagtggcagagagcagtaacgccttagtgaagacccgggaggaagttgggaacacctctaaggaagggtggggatatcctgatgccaggtccttgggaaggagacctcaggcttctcagtagagcatggcttgcacttgtagccacggatactcaggtttccccaccccagcctttcatggcacaggcctggtttgtatcctggggaaggtgactgatattacggtagaggcaaagttctgtgttctgagacaaagccgcgtttcgtacaacagacacctataagacagttgatttacctgcaggtattcatatgccagttgctccactgtgttctctgctgggggcctgcatcctgtcgcttgattttgcagaacacagcctagagaacaggaggctttgaaagtgggtcccaaagcagtgtggctgcacctctctgaggcttcccctttaaaccctggataggaaaaaaatcaccatgaagaggcacagccccaggccaaacactgtcacactgagaaggtcaggagagggtcaggaaagaaacggatattgaaaggccacctggagagcagggctctgactgggtctccatcgccccctccctgccggccatctcacacctggggggtcgggaggcagatgctgggagggtacaaggcaaaggcctctttccccatcatcccaaatgctgtttatcaaagggatttggactcctaggtggtggaggtattcaaagcttgaaactgggaaggtataatgtgactaaaatgctgctttaataaagcacagggctgggtttgagctgctctctccataaatcaaagggtgacaccaccgtctctctgaagatcagcaagacagcgcattgtggggctgggacggctcttaaatctaatcaacggctctttgagcaaaaatatagccgtgactggaggacagaggtggctgcacgctggaaaatatcccgaggagcacgcacatttcccaggtgataagaatgctgaatgcttctgagccgagaaaccttggaaa

SEQ ID NO: 30442 - DNA, 963 bp, Bovine  19866881230976
aacccccaagggagctagttatggaaaacccttgtgatcagtggcagtaactcaaactgtgagtaatgtgttcttgacttttgttttaggttcaagtacctaaatttgcaggttaaattcctgcttcagaagcttcttcctttccatctttaagatctgaataattaattgctactagagaatatgttttcagaatgaaaatattttattcccttcaaaaatgtatgtaatcataaggctttattcaaagtattcagttcacaaatgacgtgggtatctgtagctctatggaaacctcattcattcacaatacacagagcctcttaattttgcaattttacaaaggagtttttgtgtttagaatttatataaattcagtacaatttaaatcaaatccagtgctaggaattgtattatgaaagggtggattcagttatcatattttagttagaataatgagaagttaaaaacaattacattcattcacagcaaatcaagatacgatttttgtgtcttaagaggaaatgagaggtgtgtcctccatcattggttaccaagtacaggcagagccagactgggaattatgttccagataaggttttgtaatacaggtgtcttctctggctcaagagtagacagagttactttcctcatctggaacattgcaaattaacgaattcaagatctatgttcaaatctattgtgataaatatttgtcaatgagaactgcctcagtgctaaatgttctcaaagctttctatttagacatagaatggatacaaatatgtatccaaatatctcttctactgatagacatgaattacagagagttaagttagacaaaccaatgaacagagaaatataagtgggacctcataaccagtgactgtattgccctttagctttgaattgttattatatagctggggacattcatctctttttttatttgcatggcagtgt

SEQ ID NO: 30443 - DNA, 1506 bp, Bovine  19866881255805
tgttagtaagctttttaattttaatgtactgtaatgaaatgattatgagtagttacctctgctcaaaagtgtcatttagttcactgaactctttcacatcccatataaccatcacatgctaattgtccattcttagtgattcgattccgtctccactgtgtactaatcacaggttgtagcagagcagcccattgactttcttttttactgagctaaaagtggtacatacacattgactttcttatcagcccttctttgacagtgaagggaaagtcatgggatgttgatttgaatttttctggcaatttgtcccttgtggtagctgcttaaaattcttcagttatggaaactgagtttgcagtaagttgcacattttattgtttgcaattttctgttttctgtgcatttttaagccctttcctgctttctggtaaggaggcatgaaatgatcaggaatgttgccagttacagcttcacaccaaaaacttttgagtaaattcgtttttgtgtagatgcccacgataaatagctgaagaaagggcacccgtagaaagtacctgtgtagatttaagaaagtagcgaaaaaacaaatttttcttctcactttgtctacttcaaaataaatatccatgcttgcgattcactttactcttgctgtttcttgtgagtccctttttggaaagagaagaacatctgtgaacccagagataacccttaggttgctgttttagctaatggagcaattttactctcttagtagcaggtttgctattaccatggaaagaaagaaacgaagtatcttttactccagaaataggaaaattagtgtcttttaaaatagcacttaaggctccaataaggcaatactggaatcagaaacaaatttgatataaggttctatctaattacgtggatactagctttcattttagtgttaaaactcaactcatgagaaataatggcaaagaaggttcactctgtttctgcagttctttgggaccatttataaaggccagttagatcagtttacaaagttgctgcagttaatggatacattctgtgctctgagaatctgaattccatgctaatgtataatgctcactggctgtgatctatagcatccgaaggaaagatgtgtttttctcctttacactctctacataactgttaatattattttagttaaagtacttaagacattgattttcccctgtaaaaatggcttagcaatttgcacatctgggtagattatgtagttagtaaacaatccgcagtagtaaatagcaattacatttaacccaccaagtgacagactatgcaatggaaaaattttctaattatcaccacatagcttatatgacaaaggattcttttctctagtaacctaccatgtgaactagaactgtctcataaatgacttcctgagcaatttcatgttggcaggcagtgtgatgtgcctagagtccctccagaaaagagtataatttaagagaagcaaatagtagg

SEQ ID NO: 30444 - DNA, 1542 bp, Bovine  19866881283640
attttctgctagaatctgattttacaaattttactgcagcattttattaggaaaccaattaatggtaggggagaagctgaagggaattcacctggaatctacttggatggggttgctgtttctctttcctttctgactctcaactggaattggaattttcttaaggccatataagtttaacagctgaaatgtggtccatttttcttgtaggtacatgaacactgaacagtagttaaaccaatatgttgacagtcctgacttttatctgtgaggctttatgtaagggtgcagtattctgcctcccatgatgaaaactgctttcagtctgcacccagaaaattgctatataagaagctgttgggccatagattctgcttctacactttcacttagaaattgagtcattaagtttaaacaacctctttttttagttagtcaatactttttttttttttcggttatatgaaaagtaggtaaataatatgacatattgaaggattatggtgaatataaacaaacaatttatataactcagagaccagttctttcaagactttatctgtcttgttcattgtgagcagttgctttactttggttcagaaagtgtcactgattttttaaaaaaaagcattcagtggaagatgaaggtgcataatatccaaagagtttaagggatcttttttttcctgcttactagtcattatttgagttaataatattttggaccccaagcagatttccataatggattatcagtacctttttctttattaacaacagaaaatagagtttctgtgttaaatattttactttggacttgtcgggaaggaagaaaactttcttctagctttctaggttcttctagctggtccaaatattaagttgacatgagttagattaacaagaaaaaatgaaatttactttcatatgtatacatgtgagggcctgaggcccctgcatacctgagagggtcagagatggaaagataaaatgaggcatatacaccatcttaagctaaggaatggcatagggccctggcgcttccagggacaggagggtaattcataaaatgataaaaagagtggatggttggtaattagatgtttgctggccatatagatggggccacttagctaaaatttatctctggtaataaatcttttctgggaaaagtcctcaatttaaattcttttgagtcgttaagggtgggagcagtgacttctcttgaacttgcagggtcttgattgcacctttagctcaaaataatcctgatgcagaagtgacacattttggggggaagtggttctgaacgcctgcagattatacctgttcagttgagaagagcagtcattttctaaacatctggaacttaaggaaagtagatggtttgcatcattactttccttagttttctaaaatataggtaacagtatttattcccattttccaaacggggagttagacatttaaggccatcagatgacttttcgtgactgtaaaaccaccagtataaaattcaggggacctgaatgtttaatatgt

SEQ ID NO: 30445 - DNA, 1715 bp, Bovine  19866881335041
tgtaactttttattacactggcactttcataggtaatgaaacctatgctccaatgttaaattatttgtgtgtatatgtaaaatacacgagctttaagctatctgtgtatgactatgaaagacaatgcaaccataccagttgtgaacagtggattatagttatgtttggtggtattagtttatgtaagatcaaggtctgttgtattttctcttgcacatgccattcatttgctgattcttgtggtgtgaatatgccagtttattcatttgagctcaaagcacaagcatctgaccgtttaatgttacccagcaagagttagtgtaaagtgatgacaggttcccatttcacccgttaacgtttgcttcatgaatcggtgacacctggagaggagatgtgcgctgacttcattgctcaccctgggatactgcatgaacccatcgaattagagctgctctccctagataaatgagcagtacacataggtgcatgttccaaaacatgaatcacatagagctgtggagttttgccaagtggtatgtgtgtgactttagtttctgtttttctttctttcttttttaactatgcagagatgggaaatgcacaaacttctcaaagactagtgtctgaagaactttccaaacagtacttgaatcctttctttaaagtcattccaccatcctttatagccattgttgcttccactgttaacttacatttttagatggtttccagttctttaagtgcacagcctgaagttctgctggaagctaaataaattcattcgtatcttggttgtctatagatggagattcagtagtcattgtatgcatcttcagtcaagtgtatattaaaactttcgttaacattgaatgttgtagttttatactttggtcatttttcttaaaccccttttctgttctctcttgtgttgttgattcaatggctgtgcaccagataacttttagcgccggtctctcaatcaaaggctcactgaaaatttaatcggtcaatggagcaaaataaaatcctgattgatggtaaatatattgctgattaggattcagcttcagtggatttattggaaatgctttgatttttataagtccggggggtggcaggggggacacagtagagtcatgccattactatatttctttctttgttgtctctcttctgagtttaaacaggggatggctagtcataacatccacacttttgaccctggtaccattagaatcaaactaaaaagaaaatagaagtgtttggttgtctacattgtaataccaaaaacattcaaaggaaggtatttcctcacaccttacataggattgttcatcaaataataatccttttttatgaatgtctctcagtgtctcctctctcttcccactgccctgctttggtctggcatcgacagctgcgtgtatctcacataaaggtactgcagtaacacagagcctaatctgactacatcattcctctgatagagtttgtagcagttcttcattttctataggataaagcccaaacctaacaatatgacttaaagtgctagctgcctttcatgacctcaccctcgtttattttcctagtcttcatcaattcttatcctcccataatcaccctgcttagagtccccctcaagagccttatctgctcaagtctgaagagtctgatgtaaattttatgtccgatcaccatgggtcatttggttt

SEQ ID NO: 30446 - DNA, 1668 bp, Bovine  19866881425872
tctttaaactccccccttgattgttatgacagattcatgtggttatttgatttacctatgtctctctctcgattgtaagctccctgaaggcaaggaccacatctattatgcatatcattgtctcctggcacctagcaaggtacatgtacttagatgttcagttgtgtctgattctttgtgaccccatggactgtatgtagcccatcagtctcctctgtccatgggattctccaggcaagaatactggagtgggtttccatttcctttgccagggaatattcccaacccagggatcaaattgagtctcctgcagtggcaggcagattctttaccactagtgccacctgcaaagccctagcaaggcacatagtgggcatttaatctattaataatacatgctgattacatgaatgaatgtatgcatgcatgcttcccataagagttagtgggacatagataagtaagcatgtcaatttctatgtaaatagctattagtgaagggctctgggaaaaagagcaattctgctgtgagggaatttggatttgggccagctccacaacagaatcaatcctgaagatgtgctcctggcctctcttcagggggcggggagggggatatctgcaaagctatgtgctcactgctttgaacatcacagattcagacaaccgaacagagctactccatcagctaagaggtcagagttcagggctcaaaattcatttaacccaaatgttcagtttacacctggaaaacatgagatatgcctgactttctcaaggtgacagaactagaggcaggactgaggaccctgggtgctgaactctgggaccagtgctctctcacctcctcagcatgttcaagttcaaggggtgaggagcactggtagactgcaaagccttctaaagttttctttgaactgtcacaggaattaaaaacagttggctggaaatagaaacgtgaatgctcaaggagaggtgagatgagggggtggaggagggaaaaaaggtgaagaaaaaaggtcgatccagaaaggccacctgccagggccctggagtcaaggcttggcaatgcggcagggctgccagcgggtgctcggagaggctgtgcctcaattcccagcggaggcagtcaagggcttcaggatggagatttattagcagagctgtgctccgcagtaacctggctatggatggctctgagaggctgggcagctgtggaggctgcagcctgctcttcgcaaacagagcctcctggctttccaagggaggtttgtttgaattagggtggggcggggggccactcctgaccacagttgcccgagcctgctggcttggtgaggggcccagaacagagcaccccaaaccacctgccccactcccgagctttacctctctgctggtggagggctgttctgggtgcttctgtgtatgtgtgggccaggctggctcaggtggcttctctgcaaagagaggagctctgcctacctggtggcatcagacagaaggcgggataaggaaccactcgcctatggccaacggtctctttctgttgtggcccttggaagccggctgtgatacccacatccggcacacacagttgtcctattgggttttctggctgggaagagagagcacccagttgtccttttcggagaagcacagaaacaa

SEQ ID NO: 30447 - DNA, 1430 bp, Bovine  19866881499354
aaaaggactaaatagaaaataaatattacacggatgcaaatcaagttggaaacaaacaaacaaaaaaaacaatgaaaacacattcaagaatcaatgataaaatgatacagcaataacagatgcagaagatagcataagtacattgttgatgtttccaaagaaaagaataaaacacatggaagaaaaaaaaggcaaaagtagaacataagtttcctaaaatcaaagaaagacttgaatttccagctcaaagagccaagtcacgttcctggaaaattttataaaacactattgacactaaagagtcatattaattctgggaaagttcaattaattccagtcaagcaaaatacaaatatctaggaagaatggagaaaccattgtaaaggatgcatggtggatgccgaatcctttaaggacaaatagtaacggtgaaaattgtggttactgaacaaaatgcaaacgtgataaaccttgacaacataaaaagtactataactaacaacagaaaaagtgtgttaattttaacttcattcaaatatacaatctagttgaaacaagtttttttctcatgactcagaacaatgttcttcacattagtagaactttttttaaaaggtaacatctcttgctatgaagaacttttttattttttattggggtatagtcaattaacagtgttgtgatagttcaggttaacagtgaagggactcagccatacatatacagatatcaattctcccccaaatccccacccccatccagactgccacataacactgagcagagttccatgtactacacaggagctccttcttggtggtctatttcaaatatagcagtggaacatgtccatcccaaactccctagcccttccccccatcctttccccttgttttcttttcttttgttaaatgtaatattcattaaatttgcatttcattaaatgtaatcatttatatttacaatattactataaaataaccctatttttgaaaattatctaccacacctatctgtatgcatagagagttcactaaaaatctatacaaataataataatggttatttctgaatggtaatttttaacttttcctctgtgctttttttgtactgactttaaattttataaagagacatatcattttatgaaaacaataaaatatttccatcagaaaattgcttttgatttaacagccagtcatctatgtattcattagaaggactgatgctgaagctgaaactccaatactttgtccacctgatgtgaagaccttgatggtgggaaagattgaaggcaggagaagaggggaacgacagaaggtgagatggttggatggcatcactgactccatggacatgagtttgagcaaaccctgggagatgggaaggacagggagcctagtgtgctgcagtccaggggcgcaaagagt

SEQ ID NO: 30448 - DNA, 1125 bp, Bovine  19866881520446
ataaagacaaaagtgctcagttgggtctgactctttgcaaccccatggactgtagcctaccagactcctctgtccatgggattttccaggcacatagacaagaatatcccctggaatatcctccaggggatattcctgacccagggatcaaacccacattgctggtgtctcctgcatttgcaagtggattctttaccactgcaccacctagggaacccaaagacagaaaagcctctgtgtaattccctgggatgtgaaatgtttaggatatttccttggtttgaacaaatgctgtagaatgattgtgatccctacaatcaaaattcttttagtgcttagcaaaagaaggtagttaaaaaccagggcatctgaaagggcagctcttagatgtattcactgctccatttctggcatgacctatcttttatgaaattatgctgagtgttttcatcataaccttcatgtcattcattcagacttgttagtaaatcgaggtaaagaaattattttcttcccccagatacctcttcacttaaaatttagaagacactgatacatggaatgtcttaattatgacggactaagaagtttaaacctcgtagagcattggattgtctctgctgcccgcttagtgttagaacactgtactcgttttcagctgctctactgaattctgttcctctcgtttcattgtgtatgctcatgagccaccagtttcagccctgtacatccagccccctttcctcaacctgcttttcccttttctaaaatgcacctcccatgtaatcaagttttgtgtttctctccctgtactttctaggtcggatgatgatgacatggagagtaggagctccagggtgacccaactttgcacttactttcagcagaaatataagcacctctgccgcctggagcgggcagaatctcgtcaaaagaaatgccggcacacattgaggaaggccttgctgcaggcggctagtagagaaccagagtgtgctggccagctgatccaggagctgcagagagctgcatgcagtcgagccaggtcagagctccacacagccacctgtttctaagagctcaccctgttttctctatttttgagaggatagtcaagacacagag

SEQ ID NO: 30449 - DNA, 811 bp, Bovine  19866881658715
gaaaagagaaaagagcacaaataggaagaaaaaaatgccggagatgccatatcctgctaggcaaggaagagaaatatccggctttgcagagactagtctctgtgtgtgctgtattcgtgtgtggtgttggcttttgtttttccttctcgtcttggtcttttcctgtgtttctgccctcacactgccacgtttattaatatgatggtaaggatgacttaaactgtctgagtttttctagagggcgggaatgagggggctaaggaaatgaatggacggaggctgcttagtcacaggacctcactcccaagagctcctaggctggtcgggtgagggagaccatcggaggaagccgctggcatgagacagacaacaagcacatctaacacaggaaggatgcccttgagcaggcctctgaaccccaggccaaggtccggctcctgcaggcgtgcactttggcggtcaaggagaatgtgctgtgcttgtttagagtctgtccacgggggtctgagtaggggactgtctggagagtgtgtaagtagggacggtggccctcatttccagtggctctaggttttcctccaatacttctgaaattctgttaaaatgtaggttctgactctttaggtctagggtgccattggatagtctgcatttctaacaagttcccaggtaatgctgctgtaataagagtggctctgggccactctttggatggcaaaatgtgtttggcacaaacgtagaggtacagaagtgaggagttggggcttgaggccgcagctgtgagggcatgttttattcagaattgttaaaa

SEQ ID NO: 30450 - DNA, 2045 bp, Bovine  19866880422034
aatgtgatttgctccttaagtatcggacaccgaaactggatatactttctcttggcatctcagaaaaacgttcttacagagtcaagtctcatagttcagcaccggcagcaccaatcttatgcagttctcctgaaagttttcagcagtaaatctctagaaatgtccacttaagcagtagaggtcataaatacttagcgagagcaataaaatagaacagaattttggaagttataattttagtggatataactgcactataaaaggaaggcctctgggacccagaataaatgcgaaattccatccaagtgaactgtagtgctaacccatctgcaagtggtaaattattcccagtcccaggtgtgctgcattatcctatgggtgtccagtgattaaaggtaagaacgtggctaaaatccaagggagcagtgaacattaatgatggctggaaattgtcgacaatttctctggaagtctgattcgttcctatttgctcacattagccaggtccaaagttcagcaaattgtctacggtcagtgagacaggcccagagagtgaaaaagagactttgcctctgcatttgccccagaagaagttcatagagaatgaaagtagagccataatcctattatctgtaagcccttcaggtttccacaaagtatagacacttactgtggtcattgtcctaaaattcaactgatgattgcaaagcaacataaacattgctttccatctgtgctctctccggtggtggtggtagtttagtcactaagttgtgcctgactcttttgtgaccccaaggactgtagcccgccaggctcctctgtccacggaattctccaggcaagaatactggaatgggttgccgttttctcctccaggggatcttctccacccagggatcgaatctgtgtctcctgcattgcaaacagattctttaccactgagctaccagagaagcccactctctctggtacatcacttatttcatttagtacatatttgcataaatgttatttttcatttaactctgtatcaggatcttagaaactcccaaagcatctgctgctgctgctgctgctgctaagtcgcttcagtcatgtccgactctgtgcaaccccatagacggcagcccaccaggctcctccatccatgggattttccaggcaagagtgctggagtggggtgccattgccttctccacccaaagcatctaggatatgtttaattgatttcctaatctcttctcccaccccctccccggcaccatgtacacataaagaacattatacagtgttgaatgcaagtgactattatttcatgattatattcataattttttggtagtgtttgtggtcaaaaagtccccatctttaattctttttaccaagttcctgaattgtctcctatgtcccaaacttattttgattattgccatctagaaaactgatgagaacaatattgtatgaaggtggcaggaataagaaacttccatctgaagagcagatgaagaaaatttttatgcaaggaagcccaagcttccagtttttaatcatcatttgattgtggcctattaaaatgccaaatcactttgcaatattgtgctgtgtcttcacaacttaaaatagtcactgttgaaatagtcattcaactccagctttcccatctgaaaataataacgcattgtaccttttgctgttgcttctaattttttgttttctattattgtgtaactaaaatgtcaacctcctgtatctaagggtcaccttctagtttatttggaaaataaaggaacaagaggatttgtctcatgtcaactcctgagtcatcgacttggcagctgctgtctatgtcctgtgctcctcttagctctgctttcagcatggcctttggtcattgtcctgttccctgctgtttactacctgaaacttgggtcttctaggtgatagaatgcccatccacgagggtcagacttgccgtcactcacctgtcactttgctcccattaatacccaaccacaaagtttatggatgtctcagctttggat

SEQ ID NO: 30451 - DNA, 1845 bp, Bovine  19866880498920
caaaaagtcggacatgactgagcaattaagcacagcccagcaaattcccagaccctttacttaaagttagatcatctaatatactattatttcactttttgcatagcttacaagaaaagacaatgacatccttagttgcctaatttagataaacatttcaaatttcagaggtacatattgactacaaaaatatatgagaacaaaaatatgaaataaagatagatcttctgagttacgcttatgtattcagtttcaaatccttgctttttgggaaaatgtgtgccctgttataaacaagaattaattggatattatggtgaataattaaagagtacaataaattatactcttccaaacctttcatccacttactagttacaatatctaggaaactatgcttgaagtgtggcttagaatataggaataaatcaccatgtaaatgtaccctgcctgtaagtaatatttgttagtgtctaaacatattctacatgtaaaaaaatctgatgctcttaaattctaaaaaggatatctggaaaaagataactttcagtgcttaaaattattttattctctccaagatatttctaaaatttttctcagttaccatataaaaagaaaagtaaatctagtgatttagtttattagtattgttctttctgttctactgatttctaatttccttcagccttattgttcaggaaaaaagtaaggcatggagtaaggaaaggctcccaaagaagcttagatagtgagtttccccaccaaatagcaaaccttcaaacgttaaaataatcatatttgtgtcaagtcgcttcagtcgtgtctgactgtgaccctaggaactatagcccaccaggttcctctgtccttcagattctccaggcaagaatattggagtgggttcccatgccctcctccaggggatcttcccaacccagggatcgaacccgaatctcttaagtctcctgcattggcaggcagattctttaccactagtgccacttgggaagctcgcaataatgataacaatagcaataacccattaaacatcattcagtgaagtttgtggaaaataacaaactggaaaagttgccttaggttggcttcctcactaatactaaaaaacgtagtaaaacttcatgaatataagcagttattttttgctcagtatctccctgaattgaattacatgtatctacatacctacatacatatatgtttacaagcaaatactttgaaaactgagacatagaaaattaaaggataaaacttttaatgcaaaatgtatggccattggccataatatcaaaatataatactggtattgctgtccaatatttaaaatatttcattccattgcatttcacaataagaaaaattcttggctctgtatgtgtgcgcgcgagtttgtgtgtgtgggtgcaggcactcacacactcagttgtgtccaactctgtgactctatggactgtaaccctccaggcttctctgtccatgcattttttccaggcaagaatgctggagagggttgccattgccttctccaggtaatcttccctacccaggcattgaacctgtctgtcatgtctcctgcattggcaggtgagttctttaccacctggtgagttgagccagcagggaaaaggaaaatcaaatgcaagcacccatctcctttcaagaggttttttgacaaaaggaaagagaagtgtttctgataaatgaccctcatgctctacaagctttaaatgggagaagagcaaatagaaacagagttttacctcaatggtatacataatcccccctaagtcaagacctacaggtttaatttcaaatctttgccttttt

SEQ ID NO: 30452 - DNA, 1651 bp, Bovine  19866880521131
atttgccttacagagttgtgttaggtggaagtatagtcccatcttctagaccttagaggtggtttctatcactgtctttgtcctcaatcttacctagtcaagcctatgtggccaaatattgtgcactttctatgtttatcattgtcttcatccttccaacaagcagtgactgagaaggtctacacctgcatatacaatgctgaaaaaaggttaaataaaccaggatataacaactgtggtcaatgattatcatgtcttcccaggtgttttgactccagacttctatactctgtggtcccccagacaatggcagataatctaaatccctgatgcagctcctaattacaagtagaattattacaaaggaaaaagaaatgaaaaccagcattatagtcacgtactgggtgaaatataagtgaagacaaagaaaacatcaactttaactgcagttcttaatccacctgtaattagatctttaagcacgtgaaatcattatcatcttcaaactagcagcctactcaactttgggaaaatctcctgtttgacttctgataaaattcctgtcttagtcactgaaggcattaactttctgctatgattctgtctctaagatctggttaactattaatggtggcaggtggctggtaaagtctagatacaaagaaaatcaagggaatggagcaatgtaaatctgtgtttgatccacacacctgttctggtctccaaattctactttataagagaaaggaggtcttttttctatccagtcatagatagctggcactacttaacaactggcaaactacttaactgctctgagtcctcatttcttgtgtgcagcatgaaagaggtgatctggagatgcccattggcagggaagcctgcgtcctttgtgatagttcaaggtgatgtccctaataacccctcactagcgacagtgtccttctgggttccccaactttgcttttccaaaaaatggaaatgtacaggctcttagatgagaattagaagtttcaccactcaatataataattattctatacataattaatatcaagaaaaagaactaatcccacaagccacacatataaatcaatttttgtcttgattaatatgtgatatcatccatataagtgtgcttagtccttgaaattattacattaacttcttattccttgatttcaaggaataagtaattccttgaaattgttacattaatttcaaggaataagtaattccttgatgtaataatttcaaggaataagtatatctgtgcgattcagtggaaatgaaatgactattagtaaccaaaatgtaaacacaggttttgtcttggatcttgttaaaattaaaaaatcacatattcttaaaagtatgcatttttttaaataaatgagcataaagacactgaggaactgactagactctatctcagtccaactgcaactatttctgggcaaattagtgggagacaaggcctctttctaaagctgatatgttacttcttgtaacacagagttagtctggaagccaatataaattcatcctccactaaagaataagattacctaaagatggtggttggatcaactgagactttttctgttgcaaacaataatatttcacctgcttttttaacctatttattttt

SEQ ID NO: 30453 - DNA, 823 bp, Bovine  19866880532993
ctggttgtgtctagaatttgaacaccatgtttttctgagtaatgtaatatttaatgttcttaaacgttacacttctatgcaaggactaatttctttttgatggtttctatccaaacactgccctcatagctgggacatagaagcatgatgaacattcttttaatcattggagcactctacaacccaattctggtgctcatgtgtgcatgcacacacataatcagtgagtgacaaagcacaagtgtatatgtaagactgtgataactggaatgcatagtttgcaaaatcaccaaaaaatgtataaaataactcctgcccacatcaatgaaaagtcagcagaatagaaaaagaaattccctttaatgaaaacgacagaggttcccaaattgcatgtgatttttaatggactagagacactcttctgcatttttatttcttggacaagaggaaaatatattacttatgcaaaaggatagttagcatttccaaccactaacacatggcctgtaaaaaataatcatctcatttttctattgtgcaatagccccctgttaggcaacagcaacgtacaacgtgctagtttcctgttcctttagtagagcctcccctttcactcactgcccagactaaatagttattccttggataataaaactctaatactgagtttcaagctacttccaagaatgtttctgcctgtattaagaaagaatcatatcagtttgctaataagcagaaatgcactgtaagttgaatatgttgtcacatgtagctagcaagcatataaatcaatccatgaccaagaaagaaacaatatattttt

SEQ ID NO: 30454 - DNA, 661 bp, Bovine  19866880561399
tggctctccattggctttaggtttaaagtaaaagggatggtttaggtttcagagacccagcaacaaaactgtacatgaggaaagaatcttgtacaggaagtgtgaacaaacattgaaatcattttatgcaatggccctcaaggtgctttaatatatagaaatgtcttgttccctccatgaattgctaagtgagagagtcagcatgaaagagttagacaggagagaagtgaaacctgccaagataaatgccaagataaatgttaacagtgttttataaattaactccgctgtctgtgtgtttgttttttctttggaagagcctaaaattaaggctattcgactcatcttggtaatggtttagaatttaaggggtggattgaggaagtaagtttgggctagaaagggcagagaaaatatcctgcactggaaaatctcggaaattttcacttgaaatatgttcttatctgatgaatgagggtatttctgcccccaaagtctatgaatgaagtagtttggttaaaaaacgattccacaaagcttgctgggtttgtaagcactccattatagtatgggcagtttattaaattcaaaggcaaacagttgacaatgaattcgagaacgtcaatgagatgtccacgtgggtactaaaacagtagaagag

SEQ ID NO: 30455 - DNA, 845 bp, Bovine  19866880640358
cttgccccagagtcccttgcttattttgtgtaatgctctcataaaattttgtaggtgatatagtaagcatggtacatccaatgccaaagaaagaaaagcactagaaatatgtaatttgtaagtaaaattttatatcaaaaaattatcatgcccattttatagtaaataacaataatcagttcaattattccaagcttatataccctcaattattttttcttcctagttcacaaatcttgatttttcttttaaataatgaaacaaacctgttcatactaataggatgataaatatttctcaaataaggatgtttaatctcatgtaagtgtttttcaaaagtacatttgcttctctttccttagggagtagagtttggcaaaggatgttgctgagatacggtttgaggcatcatctcatctgctaacagtctgctcctgatgacacatatttattccatttttcacatgtggctgaaactgtaccagcaaaatggggaactcagttttcctattttaaaaaaagataccatttggctgcatcatgaaacaatccaaatgtacttcagaagaaacagccaagatggatagttacatggaatcgctggagaacactgggaaataagtcatcagacatttcattgctttttttttctttctttctttttctgattaaccaaaatgccagttttagccaggctgcgtgaaggatattttacattccagtctcttctatcagaaactgttaaatgtggacagtaggtcaaatgtaccgaggctacaagttgtaatacatttaagagactcttactcagttttgatgattaaccattccctctctttcaacaa

SEQ ID NO: 30456 - DNA, 1540 bp, Bovine  19866880641466
tatttctttgcaacatgttctctcagacagtgttggtcacccaaccttgcccaaacgtcccctgctgagtctcatccactggttgatctaaccctcccccgctttagaagcgccctactctgaaaccaaagtctaattcacacattagtgataaagaattgacttagctctgtcactgtctccttcttctcttccctcacagaagcctttctttctagaaacatattttgatttcacattggtctggggggtatgccccaggtatagggattttaaagcctgtataaggaatagaaaagtttctggtttgctggtggttctggcatgtggatgctagcctgcttttgactttttcccatttggcaggtgggggagctagtggagggcagggaagcctggcatggtgcagtccatggggttgcaaagagttggacacgacctagccactgaacaagagcaacagagttccaggacacttgtaggacaaagttctggacttaagtctaaaagtagagagctgttgtcatttggaactcatggaggaaaaacttgttggggcattgtagtcttgggagaagtcataagagcttctctatatggaggtaactcgagcctgatatttcccttcctttctttcttgtttcatgggctaagataagtgtgacttaagatttgtgaatacagcatagagagctcttcattaaaaagaactactgtttaaatgccttcttcctgagagcctttcttttgcctaccaacactgacaaatggacttatcattttcgtgcacaggaacataaggaatttaataaggtgaagccacgatctttactccctcagtattcattgattctctgacttaagaatggcacagtgattttgcctgactttacggtgaattttcatcatctgtggtcataagaattaatatttttagtagcatcataatttatgtaaaatatggtgtctttcatgtttttgttaaagacatgtggtatagtagttagaaatttgatgccagctcagcttctaatagataagtaataacctgaggatgtctctctcaagtaattatattagtatatacagcttgctttaccttttcctttatgtgcgctcatgactatatatttttttcacctgtttaatcccattgctgaaattgttcacaacattatgtatactacttgaaatcatcataattaaaaattaagtttaaatgcacatacccccaagaaagttaagaacaggtgaactattttaattaggttgttttttcttaacagatctctgacatgtggcaagggaagatcagcgtgtgcagggcattatgaaatgtgagtgtgtgggagatgtgtctaataaggatgctcagtgactatgggaggttgaaaaataaggacagaaacagaagctgcaagaaaaagcagcagaggggagatgtgactgtttcaaggatgaacttagttttctggaggtgagcaaatgaagcattaatgaaaatttaagttagacaccttcttgcaattcccttatcata

SEQ ID NO: 30457 - DNA, 1688 bp, Bovine  19866880654352
ctgtgctttttggcccgcacagctcaaacaaatggaaataacatttaaaatctagaaactttgtgtaaaatatgaatttataatctcttgtgaaaagttagaagtgtgggtagtgttggatgtacatccctacatggctggacaggcaggcactgattgagcctatcctcttcaagctgggcatgagctagtttgccattatcatcagcacttaaaggctgcaaacccagacctcatgccttgcaggcttcacacatttgcaaagtacctgcctgcttacatgaggcattttattttatgtgctgtgtgtgctgtactctattgctcagttgtgtccaaatctttgtgaccctatagactgtagccagccaggctccctctgtccacagaattttattttatagccctagcttaaatttccttgttttaatctggatttttttcatccttttttcattctttaatttactcccttgcatttatctctgatgactttatcctgtttctgtcagactctttccagtaaaatgaagttatatttgcttttaataattaaagatcaactcaatctataaggtaaataatagtttctatgttttaaatatatttgttttaatgggtattttgtctgtattaaaaatgcaaaatgggactgagattacatatcaggtagtgtatggacacaaatggattttttacacagtgtgaaccttttcagaagtatcatgttgcaagaatcctaatttattccaaggtatattactgcttgccacacacaatgaaaatcaagggtttagtttggataagcaatatcaactcaatacagacacatacacacacacacacacaagttagaaatggttttagtttgaattctggttgatgaaatacttggctacataactctcctaactctatacttaagtaccatttctgatatttaataacatggaaattttaggatttacaaagaatatttaatctaattgaattaaaatttcagaatatacaaggtaaaaaaaagacacaagcctaattttctaatctaatttgttgtcagagttgtacaaatatacaacacttataatgagcttgtgattgcattgtctcattgggttttaaccatggtcgtgtgggtattaccatctccctttagcaggtaagaaaactgaggctcacttaaaccatctgccaaaattcaaatagatggcatgtagagctgggactgaaatctgtttttgaatttaagttaattcaactttacaattagtatttattgaatatatgctttttgcagactttctgctaaattctggggctatggtaataaataaaacagtttctgctgtcaaggaactcagagatacccaaataagtaaaatagtattgttagtgttcagtcactaagtcgtgtcctactctgcgaccccatgaactgcaacatgccaggcttccctgtccttcaccatctcccagaatttgctcaaactcatgtccattgagtcagtgatggcatccacccatgatacaatagtcatgagggcacatcaggttgccttgagataagatttgtcttatctcatttcttcaagaaagtggcacctgtaagaagactcaaaggtataaaggagtcagatgaagcttcaaaggacaagtagaagttattgagataaaatggaaatgagaaa

SEQ ID NO: 30458 - DNA, 1651 bp, Bovine  19866880716515
tctaggtttcctagtgatctgcaggaccttcattttcttgactatcctaaaatataaatatactctccttttctctgaatgcatttgcttctcccagtgtgtgagatattcatatgccagcattctttaaaataagcttgctgccatttatcttgagaatgtgtgccaattctctaatgaggactctttccccactcccaatttgttctcaaccactttgatttctattgatcctaaaataatatggaagtaaaaattaaagtatttctatatgtgcatgctgtattggtgatttgaaacttcaggtactgagaactgactgtgaaggagagagccagccacaatctggattatttttcaaatgctttgggtttggcaaaaactaaaatgcttgttgccaagcccctttcctcctaatttttaaaaatcatgtgtgtttcaagggaaatttaatccacatgtttctgattcatttgcacttaagttgtcaaactgttttgtaatcataagtctctatctttctccacagaaagttgagtttttccaagtgtgcataaacaatcacctcttagaagaatgaactgaatttttaaattcagaaatccaggatgggcaaaactgtgtgtacctcacctgctcttgggagaggaaaagatttttgaagttttgactctgcatcaaatcttttgatgtggactttgacttacccttggaaatatgagattcttccctccaagaaaaagtgttttgagagtttaaaatatactgtagaaggtgctaaatgaccaatgatgcaggaagattctaattatttaaaattacaagtaaacatgactgtgaataatattagtgttatatttcataacaaaagacttattttaaacttcataatctacacaattgggtttatttacaactataaactcatcgtctcttagatgtgagcttaacaaagcaaaaagctcaaactttcttctcccaaaatactttatctaaaattagtttaagttactaataggaaaatttacaaggggaaaataaacacaatatttttaagagctcattccatctctgaaaagagcttagaatttgctgtatttacatatttttcttataaaaccttctgtagtgagacttgaaatgctgaagcttactataatagaatgtcccatttgggaacattaagaacttttattttatgggaactcacaatggttactcccatttgggtctcttaggaagtgctaattcccaacacttcctcctttatcatgagatcaaaccatttgaaccacttattatcatgtacccagtaaaactcaatctgttgtgttaattagttatgtaaacacattttataattgtggagacaaagcagagctaggcaactgggtaggtgagaaaagatcaaagatctcccttaataaattgttacgctaattagtgtttgtcttgtagtgcttctccagggggtcctttaaacccaagcttgggaaaacctgcttagagaacaaggaagctttggcaaaaacaaatctagccaaactcccaaaaccaacttaaaaaccagtgaagtgagagaaaaaaggaataccaaaagaaataggtggaaaagaactgtgaattcctcctgaggagatcctactcttaa

SEQ ID NO: 30459 - DNA, 784 bp, Bovine  19866880783910
tattgctaaggtagtaacaaagagggacatttcaccatatcctttgtttatacaaataaatgaagtatatttggttttatgtcatccacacagggaaaagagggtgaaaaagatgaaaatttaagtaaaattattattatttttatatttctccttattatagcgtttgatttgtttatttgatgcattcatctagagagtactcattattgctgaactaacctaaaaaaaaaaaaaaaaaatagaagggggcaccaaactgactctacatttttagtattacatttgtataaaagacacgaatgtcatttaaaatagttgtgggaacaagagtagaaaaagaccggaagattaacacacatgcagaagggaaaactaaaacttgaaatgggccaggtctttgagtgggccagatctgtgtgagaatactgtatcgtccaagaaaatttttcattgcaatgtatatcttattaaaatcctaattgctttcagtctccagcagagcagtaatggcatgacagtatttttatacttcaagaagtcatctagatttctcttggaggagctgtctttaacatttggtttactttttgcagtggcaatattttttccattgttttgcatgctaagacagcaattgattagtatagaagccttgagccaagttctgccctaggatatgtatgtgacccccactaacttcaaatagagttacacgcacatatcctggagtggaatttggctttcttccatagtagtcaatgagagtcattgaagtggatgg

SEQ ID NO: 30460 - DNA, 1732 bp, Bovine  19866880810036
ctgagacgtgcataaatcacactttttactggcctgccaactccatttagagagctctcctagcaatacgaactccattttaattttcctttcacacctcccatgtcttatactgtcatatctcattgtatggatgtacagtataacacagtttatttatctatttatctaccgaaggacatcttattcactttaaattttgacctatgaataaagctgttataaacactcgtgcttttgtgtggacataacttttctactcatttggataaatacccaggagtgtgactgctggatcacatgctaatagactgtttatttttataagaaactaccaaactgtcttccaaagtggctgtcccattttgcattcccactgtcatagtattttaattggctattaaatgttgttccaagtcaagaaaaaatttaaactctaaatcattaacatgagttttactgttcatttttatattgtgcaatgccagttttaaacgcaactataaaaacatttgctcatgtgcagaacaccaaaattacacaatttgtattttgtagcttgtacatgtatatgttggagaagggaatggcaacccactccagtactcttgcttggagaattcaatgaacagagaagcctggcggactacagtccgtgggatcgcagagtcagacacgactgagtgactagcacacacatatacacacacatgcatatgtatttcattctcacccaaagagtggaagcactgcacaaaactaactcaagtggttttgatatgtgcacattctaccaaaactctcttccttcaatttaataagcaagaaaagacccaaaagacacagaacctgtccattgccctgttacagcataaatggttgactaatatagagacgtaattgaagttaagaaagatccccctgtcgttctgttcctgagaatgccattgctttctttctgcctttaagggaagttgatttgaatggaaagcagtttttcaacttagtcagtggtagtcctattaatatgaaacaggagtagggaattctggtgctcagagagattcaaagcacccagctttcacgacacacttctcttgtactcattttgaatctcagtgaactgccacgcttggtgcgcacaggaattcagagctcctggggcattccaaacactctgtgggaatggggcagtgaggaatggaggacacacacgttgcacggacctgctctgctcatgagcaggctccaagacctaagttcacagataaaattattgtaaatttcaagatggccagcagagcattggatcaagcccagagcccttctgcatgtggggcttgatgagactgcacaggctgagcatccgtgacactggccctgagtttccttgaggacattctgctccattcaggtcaaagctctgtcctgcctctgtgttgtgtcacccccttccctctttcacttccaggaggtcacaggaacagagctcttcctcctgtcatctatctgcctgatggtcaaaccagaaacctgaatattgccttgcatcctctctctccctctaagtccttattcgcccaccaccccctatcaatgctcctctggaagcatcacttgactcctctctcctcccgtctccactgccgtcacctggtctgcttacaaaccctgcacatagctgcctgatggatttccctgttcccacttcctcctttcgggtggaacccca

SEQ ID NO: 30461 - DNA, 988 bp, Bovine  19866880827600
tttaggatcaaaaactattgagaaagtgggttagggggaaaactttatctttgttttccttatagctctgccatgaagtaaagcgtcggaggaaaatcaacgtgagtgaacgtgctaaggtcattgatcttgattgtgagaaggctgttggagataaaatggaatcttctccagattaccccaattcaggacaatgtaaatttacagggatacatcccagggacattctgggaaaaaaagataaaacagagcagagtttactcagggaaagaaatcaagtgtgcaaggaacaaaaaacaatcaaaaaatcaaaagtagggtatatggattctgaagccagagacaaccaaaaagaacatggggcctggcctgacctgaggacttctgaggcagagaacaagagctgctctggcgccctcaacacagtaagtaagacgggatttgccttggactgtttctaaagaaatatttacatttcaaagggctaacatgatattgcttatatgtataaaggctcttgaagaacttgccaaagttagtgaagaattatgcaactttcaagaggaaattcgaaagcggtctaaccacagaaggtaggctggtacatctatgatgatttttatgttgaaaaatcaagacggatattgttttaagttaatgaatccaaattacctttcacatttaacactttgttagcaagaattagtaatgttactaaaatctgttattttaggagataaaagcttaaattgtacatttctttgttcattaattcttaaagtaaatcttgttttatttataatttgactattatgtgtactttactttttattgatgtttagtttagttatacttgcccttgtgctcagtcactcagtcatatctgactcttttcgaccctaggaactgtatagcccaccaggttcctctgtccaggaattttccaggcaaaaatacggagtgggtgccatgccctcctccaggggat

SEQ ID NO: 30462 - DNA, 1641 bp, Bovine  19866881083090
atgggattctccaagcaagcacactggagtgggttgccatgctgtcctccaggggatattcccaacctagggatcgaacccacatgtcctgcatctcctgcgtcgaaggtggattcattattgctgagcccccagggaaacctttttacctgttatacttggagctgtatgttgctaatcaggtttgttgcctggcatcctgtcctctgtaataggttaccatgtaggactgcttctggagcaggaaatatgctagaaattcagtatatgaagtattttgagtagggaaaaaatagtaaatcagtagaatttcatgaaatcacagtccaaagccagtagcatagttccagtgggagttgctctgtagacaattttactttggtgaatctcagcactgccctttctcctcctacctaaagtggtttggataggtttcctgtagccaaaaggtcttatgctgtccatctcactggcaatttacagagtataaaactggactcagtcatgttgagtcatgctgattgagtgattgagaacactcactgacgttacctacttagaaatactgctgagttggtggatagatatgaaaatctgtaacaaaatgaagtatcttgccccaggcataaagaatgacatatggaaaatctttgctccagtacagaagttggtgcaggccacagtcttttgagtcctcatccctctgcatgtaaatttcccttttagtgttaatttagtaaaaactacataataattaaaaattgagtttataatgtgcttagttcctcagttgtgtccgactctttgcaacccggtggagtgtagcccccccaggctcctctgtccatggaattctctaggcaagaatactggagtgggttgccatgtcctcctgcaggggatcttccccacccagggatcgaacctaggtctcccacattgcaggtggattgtttaccgtctgagccatcagggatacctactcttaatgtacctgatttttaatttagttttagtttttgctttgttttggagaaaaaagagactgggagtgaggagtggttaaccaacagttagaatctgtcagtacatacttcccagcttttcatcttaagatttcaagtggttagatagagcttcatgacaagaacaaatgaaatagcataaatgctatagttaatcaattatacaaatgttactttaaaaaatatttcatctccaggaaagaagccactttaaaaataaaaaattaattaaaaatcagaatttgactgttagaaccttgattaacccccagattgccatcctgggggcttcccaggtggcttagatggaaaagaatctgcctgcaatgcaggacacccgggtttaatccccagaccaggaagatcccctggagaagggaatggctacccacttgagtattcttgcctggagaattccatggacagaggagcctgccgggttacaatccatggggtcgtactactgagcaactttcactttttctgtctcagaggaatcattttggcaatgaaagtggaactgaaagtaaatgtttgaggcagaaatttaaatgaaatgcttattgcctttggactggaatacagtcagctaagcaatgactctctcatctaccta

SEQ ID NO: 30463 - DNA, 1707 bp, Bovine  19866881151726
actgatctcctctaggataggctggttggatcgccttgcagtccaagggactgtcaagagtcttctccaacaccacagttcaaaagcatcaattctttggcacttctctttttttatggtccaactctcacatccatacatgactactggaaaaaccatagccttgactagactcacctttgtttctcagccataaaaagaaacacatttgaattagttctgatgaggtggatgaacctagagcctattatacagagtgaaggaagtcagaaagagaaagataaatatcccatactaacacatatacacagaatctagaaaaatggtactgaagaatttatttgcaggacagcaatggagagacagacatagagaatagacttatgggcatggggagaggggaggagagggtgagatggtgagatgtatgggaagagtaacatggaaacttacattaccatatgtaaaatagatagccaatgggaatttgctgtaggtctcaggaaactcaaacaggggctctgtatcaacctagagggtaggatggggagggagatgggatcgaggttcaaaagggagggggtatatgtattccaatggctgatttatgttgaagtttgacagaaagaaaaaaaaaatctgtaatgcaattatccttcaattaaaaaataaattaatttaaaaaaaagaaactccataaaaagatgctgcattgaaagaatgtacattacagaaggggcagttggaatttcaacacatcgatgtgcagtatctgccattttgagaatatcagaaaacatagccagctaacccaggattcctagaagaaaatgatatttagatcttaataggccactcttttgaatgaatggggaaagcacgttcccaagtaggagaatccatactttaaaaactcagaaatgaaagaggatgtcacagtcaagatagttaaagtagcttggtatgcagaaagggtagaaacaactaggaaaaaagacgaaagatgaggtgagagagatggcagaggccagatggctaaaggcctggtagtcatcagctcattaagaagtgtaaactcttattccataaattatggagatttactacaaagtctggtagttctcagtttcatcttctcattcttaataagaataggaatttcctcactttcacttttaattttttgtttcagaagttatttggacacatactcatgataccagacctagtggcagagaacccaggaagaggaaactgttattccctccaagccaccagataaaaagccaaaaccatgcatcttcctaccaaattgaagcaaagaccctatatcaccaggcagtaactaacgctgaattgttctcatttaagtttataagcataagcgatatgttatgttttgcaaaatgttaggcagaagaaggatagaaagatggaatgcttctaatatcctctaaggtattaatacaaatgtttgatttttggaagacttcaactgattgaaaagtcattaagaccaccaaaaatgaccttattaatataacaacttctaggtaaacccactctggggtttctttgccctggagaatcccagggacaggggagcctggtgggctgccgtctatggggtccacagagtcagacacgactgaagcgacttagcagcagcaggtacactcttagaaagtgaaaagtgaaagtgctagt

SEQ ID NO: 30464 - DNA, 802 bp, Bovine  19866881162807
ccgcagctcagggctcggacagtttgaaagtacaatagttggtttccctgaccacccgaccccgctgcgtttgccatcccggctcgcctgtcggatctgagtggagaagttgtccgcagctggggttagcgcttgctctctccatacgcctaacacctacgtgtatttctgaaacagtcaatcttaattaacaatcaaaagaaaaaaaaaaggagcaaaggaagggaaacattattgggttactatgcacttgcgactgatttcttggttttttatcattttgaactttatggaatacatcggcagccaaaacgcctcccggggaaggcgccagcgaagaagtaagtgcaggcttttttacgcatttgctccctcccgccgcgttcacctgtcgggtcgcttttccttaacttgagtcggctcacagcggcggcagtcctcccacccaacaccccacgcctggagaagaggtaacagttgaggctcctgtgtttcacgcattcttttcggccgctcctctcttgccccgcatcttcctgggtgccatagtcccggcggacccggcgctcctgtgcctcccgcgcccccataaccgcaggttagcgggaaaagttcgctccttctttaagaccagctcaggggatgtgtgctttccccccaagactgggacaggagcctccagcccccagcggttcgcggacgcccggctagcgggatgcccctgacccactgagtgcccgccggggggaaggcgcggccgcggcacccgctcaccttgcgtcgccaccctcgcgtggggaga

SEQ ID NO: 30465 - DNA, 1393 bp, Bovine  19866881168541
cctattaatgtgttatattagaaaagtgtctgtttagctagactactgcctacttctctcttttttccagaaatggcaagtcttttgaagacatcgcctaacgctgtaaagaaaagattgctgcatcagataggattgtcactttataatacttctcatggcttccatgaagaagaagtgaaaaaaaaacttgaacagtttcctggtggatccattgaccttcagaaggaaaacagtggcattggcattcttactctgaacaatccaagcaaaatgaacgccttctcaggtatagagatctttgttatgttaaagaatgatactaaatctaacctgctatcttgtgatttttattcttaaactctgtagacagaattcttgaaagtcatggtactctttgtagaacatgtaaaaatgaaaagctgtcacatgaaccaggaatatttttaaaatttatttatttttaattggaggataactatgttgtaatattgttttggtttctgccatacatcagtcagtcataggtatacatatggccccttcctcctgaacccccccttccacctcccacctgatcccttctatgttgccacagagcactggtttgagctccctgcatcatacagaaaattcctactggctatctgttttacatatggtagtgtatctgtttccatgctcctctctaaatctcccccagcttctccttccctcaccgtgtccacaagtctattctctatgtctgtgtctccattgctgccctgcaaataggttcatcagttccattgttctagattccatgtatatgtgttaatatatgatacttgtttttctccttctgacataacttcactctgaatattaggctctagtttcatccacctcattagaactgaactgactcaaatgcattcctttttatgactgagtaatatttcatcgtatatatgtaccacatcttctttatccattcacctattgatgggcatctaggttgcttccatgtcctaggtcttgtaatagtgctgcagtggacattggggtacatgtgtccttttcaggtttggttttctcagagtgtatgcccagtagtacaattgctgggtcatatggtagttttattcctagttttttaaggaatctccatactatgccccatagtggctgtaccagtttacattcccaccaacagcgctagaggctttccttttctccacaccctctcttaacatttattttttgtagttttttgatgatggccattctgacctgtgtgaggtgataccttgtgattttgatttgcatttctctaataatgagctgtcgacattgagcatcttttcatatgtttattagctatctgtattcttggagaaatgtctgtttaggt

SEQ ID NO: 30466 - DNA, 1482 bp, Bovine  19866881197350
ccttttagtgatctttggcccaaaatgtttcccttcccttccgattcaacaagagacagattaattttgataaattctaatatttattaaattataaagtctgtaatcaaaaaaaaaatgtggagcaagagaaacctcttaactacaaggactagacagcaaagcctatgagaacgccatgaagtgtgttacaaacaagattctgaaacataagttataagctgtttcctttacatttccatttcagtaactttactgttaagtagttgttattttaaaaccccaaattcacatttgttctcacgttatttaagctttctgttcatactgataccagacatcttgtaggtgccaaattttggtaatggttttacgtcaatccatgcagaaaaatatgaaccaaggcaatagtcagatgaggaccattaatgcacaaatacacacacgctggccaaaagaactgaaggtattttaaaaaactataaaataaacagacctcaagaaaactgcgttattactaaacagctctcaactattaacacccaagttctttatattaaataaatttctcaacagagatgtgttagacatattaattacaagtctatccttcccataccccttcccaccccaactcccaaaatgcactacttgggatgagtataatattacatgggcaaaaatttacagataaccattttcatcttgagcatggatctgaaaacttttatttaaacttccgttactgtgcactgtccatcaggccttcgagatctgacactcactgttccacccgctgccactgatcgatcagatactgtctgacttggattaggaaccaaaagtctctgttgggtcaaggagtgttgtgcaacaagcgcagatacatcctcactatcactactggcatcggattcggtttcttcaatcgaagtgtctggtgctggtaccctgcctgaagatggtgattcatgctcttcttctccttcccctctatgactcctttccactatgctgtctccaccaagttgtaaatgtgcaaaagagtcttccagagaagtgcctgcatcaggggatggtgtggcggggcttgttagctgaccgtctactgacgtcaggggcctcacagaagacgactgaacagaagctccgctctgagctggtacactgtccgctccgtcagcagagctctctctcgccaggtttacagtattagcatcacagtccagcctaagtccagctactcccttctttggtatatctattatatcccgcttgatcttcctgcgacgtccatgttcgtttctcctatactgtaccatattttcaagatcggcaacatacagaaacccggcaattaacatttcagtgctctttttacctttggaaaaagcatcttccagctctctgctagtgcgctcgtcatactgccaccacccatttcttccttcataataccaagcatattcaccgtttcctcta

SEQ ID NO: 30467 - DNA, 747 bp, Bovine  19866881263086
tcttacacactacttaatactagtaaaggctacatgggacttttctatgttttccaagctagttaagaagtcaagagtttagcatcaagtctataacaaaaaagaaaagtgaaaatatttgaggatgtagggaaggtacattaaaaaattagccttacgtaagtaatcaataaatttctgaaaacagtaaattatgactacaaaagagtgtgacatctttactaaaaatgtggagtagcacatgctaaatgagacacttggtagttgtttttccccctgtgatgtaattccagattagagttacatttttttcccccatagagcagtaaaaagcttcaaaggaaggaaagagtgggatgtgatagaatgagaattagacagcacagtcagctggtacataaaatgatgaaagagactagaataatatcaacatcttgtataatcaatcactgcaaatgtgtcaccaagtatgaggccatctccaactgtcaatacgaccgtgtagacaatccgggtaagggaggaagtacagcatagtcaaacacgcctatcaacacttctttttttgtctccgaagaacaaaattctgagacgagacaagttcttggagcaaatggaaatttatccaaatgaaaatcaaacgataaatgccaagagaatattctttctttggatttatttcagttctttaatttaaccagcggaataattttcaagtagcattctgttcagccttttaaaggagga

SEQ ID NO: 30468 - DNA, 1181 bp, Bovine  19866881293418
tatttttagagatgaacttaaacacctccaaaacgctcttcaaatggaaatattatgtaatctaaccttttcagccatgttctttggaaaatcaaccacataccacaaaaaccagcatctctctctttcagtttgtacagatttatgaaaattatagtacacatgcaagacaataaattagcttttcagttttctcttagttactaagttcatatcagcactgaaaatgtgtaaagcagcatgaaaaataagaaaaaaaacaccctgaatttcttctatagaaatcttatcaatccagcaatagtcttttaagtgaaaagagtagtggaattcatgaatctgtatacgactagtcagccctagatgtaatactcaactctaatattttttgttctctacgtatcccaaataatttgcctgatatttgatttacgtggtctgaattcttatttttgtttactcttcttttaaagtccaaaatttggagatttttatgttgagcccaacaaggcaagttttcacaacgtaactggaagactttataaatatagtctcagacaaagctagttgtggcataaaatcgaaggagacggtgttggctgagcatacatatgcagtattaataatgttggttcctagaattccataaccagagctcaagaaaaggaaagccaaaccactgaattcaatatttgcagcctatttcagggacgtgaaaatattttggttctcccatgcaaataatttctcgaaaatactttttgttcaaaatgactttttgtagactgaaactaatttcagattctacatgactcagtatgtggggatacacccaatcagaatttcttccacacccaggtatacttggttcttagttttcacttactgtattgatttgaatcagtaatttctcactgggatatgtgtgttaatggagattgctaaaccatgccctcaaaattactttacaatgtaggttgtatgtgtaaaatgttaacataataataaaatatagctgatatactaatttgaaattttaaaacaattcatctaatttggtgccagactcgctactttgatcaaattgtgtgctaagtcatttcagtcgtgtctgactctttgtgaccctgtggaccgtagcctgacaggcttctctgtccatgggattctccaggcaagaa

SEQ ID NO: 30469 - DNA, 1816 bp, Bovine  19866881402771
cacctcatcaagacactctattagttcttgatcacatttaggacaaaacccaaacactttaagatggcctaaaagaccttcagtggtcccatctctttctttcctcacgcttatctcctatcccactcactcagcttgttctttgtctagacactttgatctttctttgaataggcctcaggacctttgcatgctcttctgtctcttgctgcaattcctcttctctcactccctgatttccccatgacccctgctctcatttttttcatttctctgctcagatgttccctccctcccccacccaccaccttggtcctcttctccctctgcttcattgcacacttgctcaatctctacacttgggggatgctttactttttcattttatttaatatctgcaattatattgaacatttattcatttatatctgtaattttcaactttaatataaagtctgtgaatgcatagatttcatctatcttgttcatctttgtccagcactcagcatccatgaaaagctctcatgaataaaaggggcaataagctgttatattatatagcatgatggagttattaagggcaagatatttcatcatactctaattgcatgattataccttattgtttttgcaagggatccaaatctccatgtatcaaaagtgtgtgttggaaaatacagcccaggaccttgcttctcatgaatattcttcatcataaccaaggtttttcatttgcttgttttcttagtgaatgtgatatccttaatgatatcctaagcagaagcaaaaagctatggcattgctttgatttatataatttttattacttgacattttgggggttagaaatgcagacaaggctctaactaaaagattgcatcacagtaattcaatgatgtaaattcactcaaatgacttttgatttttagcctgtctcttttattctaagaacaggccaactgataatacatatctgttttccagagagctgactcagaacaaatagtgaaaaattgtttatacaagcttatattactaggtgggttgaaatagaaacacaaattccagccctattttccactactctttcttctccacacttaatggaggaaatgaaaatgcttccagggtcaatctcaagggtcctcatagaaaaaaaaagaatgtgtggctaaactggtctccagagaaggatagcaacagcattagctttaccacactgcctgtcagcgcttttatgaagaaaaactttcctctaagcggaaattttgccccccaaaatataaggaaaaggtcataaaacactgagtaagattgagtatcctatatataagactgaaaaataaatttcttagctgcttttgattttttaaatgaaaatatgtcatggggatggaagtttctaacacatacttttgggtatctttattttggatgttatagaaacaatgtagttttggagttttaatacacttaaaaaaaaaaattcaatgaaactccaatactttggccacctgattcaaagaactgactcattggaaaagaccctgatgttgggaaagactgaaggcaggagaaggggatgacagaggatgagatggctggatggcatcaccgacttgacagacatgagtttgagcagctccgggagttggtgatggacagggaggcctggcgtgcctgcagtccatggggtcacaaagagtcgcacacaactaagcgactgaactgactgacttaagacaaaaattatttagaagataattgctttacaatgttggattagtttctgctgcacaacaatgtgaatcagcta

SEQ ID NO: 30470 - DNA, 1061 bp, Bovine  19866881419271
atggcaaagaaaatggaaaaaaccatatttcccactcaggggtataccagcccccagtctacagtgatgaagacatgtacttcactgggcaagtcatatgagccttaaccaaaaaccccttgcaagcttcttggaattatcactgtcccccctcgtctttagtcttcaggcaaggttgacagaactaatggaaaaactgaattcaagccagaacaaggattaattacatgggattgaatgaactgatgaatatattttataattttatgcttttttgtctcaaatattactgctaatttaaatcttttgctttccagatacaaagactttaaaaaaaatacttagagcaacttgataaattatacctttattatccaaatggaagcatttagctttttatttttacctgatccctctggaattcagaaactctcagtgagtattcttattttttggcactatagttatttcaaaagttcaataagaatctgttctccttataacaggacagaattggaaaccctggttacattatcagtgctttgactagaatgtcataaatgaaattcagataaacatgtagactcagatatgaccagacagttggaaggaacttttgacttttagagccaatgaagctccttggaaaatcagcctggtaccttacttatggtattcacagcagccttacaaggtgagtaaggaaggtcactttctggcaggtacaggaacctcaggatattttgaggacctcaagaagacagaaattcaccaaatccataggtattacaggtgagcctggtgataagttttcagtgtggtttccaggccttgagagaagttcagtctggagatttactatgaaaaattccagcagagtaggtttaaaagtgcctctatggccaaccactattcttgctggacttatacagataatcaggccaagcttattgaatttaaacttactttgcaaacaaagtagtcttaatttgtctatctttgatagaaatgaggggattttagagagaaaagttatgtttcaatagaaactagaatacata

SEQ ID NO: 30471 - DNA, 1687 bp, Bovine  19866880488420
atgaaatgcatttgttcttctctccaagttttatttagccccacttagggtcagctttgtgcaaagtcctggaaagagatagattattaacatagtccactgggggaaacatatcagaacatgacccttttcaattgagtttattttatttttatttcagcagtttagtgggatgggtatcctgaattatcctcttgtttgaaacaaaatgctgagctgagcaggcacaataaaataaggaaaattcaaatttggaataagaaatgatgtagctacagactcctaggagataaattagactcttttgatagctgcatggggtagtaaaaatggaatataacaattaggatgctggcacaatgggggaatctgaaaccagactcctacacaggcagtagaagctgttacccttggtataagatgaactgaatcctgccaagtggagagatacaacatgctgtagttttcagctgtgttgaagagatctctactcagaatccgtatcactgagtgtctttcatcagttttggtctacattcatacaaccagagtagactaacaacttcaagctaataattaaattgtgagggactcttcttgtctggaaaatcccatggatggaggagcctggtaggctacagtccatggggtcgcaaagagtcagacacgactgagcgacttcacttcacttcacttcacttcactacattagaagtgtcccctagactggctgatgaaagtacagtctctgagaagctcaatttcaattcacatcttcacaaattcccaaaaatcaagtttaaaggcatgctttgcttagagtcagaaatcacaaaacaaaactctataaatgagaataagtagaacaatacaaagttgaaatagacccacaaaaagaattatcaaagtataagacagttacatttaatatgttttagagaaaaaaaaagaatgaaagtatgaccagagaataagtgactaccaaaataaataaataaataaccaaatcaatcagacaaagcacttctagaagtggtatgcatagtaattgcaattaaaaaccccatggacatccctcccactctccccatatggctgattcacactgttatacagcagaaactaacacaacattgtaaagcaataatacggcaatataaaaaaaggaaagaaaaatcacaaatacatgacaatcattaaaggctctgagaggtcctgcaaaaaaaaaaaaaaaaaaaaagattaaacggctaaatagaaacagctaaaggaggaaagagcagacatctagtgttactatagcattctatgtgggagtatatttatttttccatctttacatgtctttctctcacccttttatctatctctgtgtgattctattcttctctggattcagctttaccttggcttcaggcagctgcctttgctctcaggcatgaggctgagttgctgaatcaggcttggttctgctccatttctgctctgtaatgggatgcatgggtgagtgatacaagtttcctctagttacgatccagaatctgaattggtgatgtccctaggtgaccagtgagtagcagaactaaaacagtcgtgtggagaaccaccctcctcctgtttaagtgagagaagaattttcacgctatatgacctaacaggaattttcactcatagggttttgaacaga

SEQ ID NO: 30472 - DNA, 821 bp, Bovine  19866880582796
tttcatgtttctttttccaggttccactgaccatctcctgtgacccattctgtccttctgcagtggtttagtccatttaagtctgcctcaggatgggatgctgtgagtacaatttgcataccatttctagtctttgcctgtgtgtttgttcagcgttcatttgaatttgagtttttatcactgccttacctaggagtttttatttctttgtgcaaaatattgttctccattactcatgccatgggagcagctttgctctctgtgaggcaccagttctgactgttcctctcatctcatcactctgtgtcttttttgcctctggcctttgtgtttggaacctcctgtggccaatggctgccatgagaaggtcaaagctgcagtgtgactgtaaccaagcaggaccctatgaagccttccgagaatagacctctgcccatgtcctctgactgccttttttctgtagaactttagtcaaaggatgcatttaatcaggcaattgagggaaggcagaaagaaaggaaaacaatcaagccagacaaaataataatacttgagccattaaacgaagtcaaggacttttagttctttctcaaggaccatagttttaatattctgagccatgtcctttgagctattttgcagaaactgaaagcccccaccaggtggaagaagttaactgtctgctgcccagaagcacttagactccaggttggtaggaaccagaaggttgatgatgctgactcctgactaactccactcagtcagaagaatgtccatgagtagatcgtgccctattcctcactagtggctccagcatgggt

SEQ ID NO: 30473 - DNA, 2581 bp, Bovine  19866880603529
ttttttaaaaagttgatgatttcggtcataagcaattgcaatatattgattttgccctctggagggatggggagcaagtggaggctttggaacagaagttgacgtcatctgactttctaaagaaaccctctgactgccaggcagagaaaaaggattgtgagtcgtggggaggaatgaggtatgagaaacctagttaggagacttttattcctatgatttaccctcccacactccccatctggtccgcatctgggtttctcttagctttctgttttgagaaacaaagagaattccagaccaacagaagttcaggtcatttatcatcagcaatgtgaccagaagccatagagctggggggtgggtgcagctcccaccacttggaatgagccatttaagttgtccacctatgaagtgtgtgttccctggagttcttcctacatcaccaaacagcctaggttgagacattcagcagaaaggctgaggtcctgtggtcagatctcaagtaacggtgaggagactggggactcaaggctctgatttctccaaaattcttgtgacaatccttcacaaccagttcagacaaggatggtgcagagtggtataacaaagtgttagaaaattccagatgcctcccagcccctgagatcttttgatacctcggcttacaaggtttttatttgttatgccttcaataaggatggatgactatcccggtgagtcatgggctggtgcccctgttttcctgatcacaaaaggattctttctcctggtttgtgctgagcttccaggagggcaaaaaaatgacatcagaggagtcaccaaaaaaaaattttttttgtccctcaaattagtctaaagaaaagacactggctcctagatacatcctaacattttgatctctagaaactacaatgccttagggaaataattcttcaagcagcttcagccatttgtgcttcagggagaatgttctctcagaacattggtgaaaagttttaatggggacaagggctttctgtgtacccaaggtgtaagaaagggtggcaggccaaagagcaggattatctgggcaaattattaaaatgcaggttatgaagtaggtctgttgtggagtctgagtaccagcatctctaggtggtttccagctgatgatgataccgcctgtttgtggacagcattttgagcagcaagaaccagggttccctccatcttagctttctctgggtcacacagtaacatgaaacaaagatctaacttctatctaacttttaatattggggttgggagagagagtgaagacagaggaagggagagaagggggaagacatgcggagagtggcttctcaaaggactcacagaggaggttgaagggatgcagccccagcagtcatctaggtgggcgcacagggtcctacctgggaagctaccagaaatgaccttggctcctgtgtctgtgctttctgatgagcatgcctgtgattccatcaggaagcacagaacattttcccttgtgttgctttaggactgggaaaataaatagctcaatattccatttgatttgaggagtgtggatgctgtctctcctaaattagaaagataattttgtaaaagcagctatgagaacaataagtgggttactctgtcagagaaatgccactttatagctgggtcttagttctagtttctttgtgaaccaatttgttagacttaaaaacattatgctgatgaatagtaaaatttcatatcacccaggggcagccataaagataatgggctgtcattgctgtggggagaaaacagtggcttgtttcatccagggaagcaagaatgaaagaggcaaacctaatcaaggataaagagctatgaataaaattcagagcaaagaattcggttgcagcaatgaatagtctagtctgcaaattcctgtgatgaatcctgtttgtgaatgtcataaaagattagaagctacatgaaaatagtcagcaatagctgtgttcatggtcagtgcgatgcgtatattatgcatttatttttctatctattaacaaataacatgaaatttaccagtgtcattagctgaccactgtgtcgtcacattcaaatgaatgctttacaagcagtactgtcttttctttgcacttccaatgacttcctgcatctatcaacaagcatttactgagaaactgctacacagaggtgctgggctaaatattatattaataaagaatattaatatagtgcacttgattttctatcattagagtcctccttctgactctgatccagtacctgtcatttctctgcaggtgtggcttctgtcaaaaagcaagttctctctttacttccacataaaatgaggcatacaaggaacacaaggcttggtatttttgatactgttagttaatgatgctttccaagtccataagaatgccccacattaatttcaatccttgcacatcttatagatgtaaatacttaagaatttggtgagatgttagtgtgaagacatactgttcagtggtcataacgtgtaacacatcaaggctggaattgcaccagcttgctctggtcagtaagtctg

SEQ ID NO: 30474 - DNA, 1219 bp, Bovine  19866880607526
taattcatgtgccattatttgttatttctattatgcgttgcgaacattagacagaacttaacatcaattttatctctattcttttccttagtttcgcttaactgctaggaaaacgtgaaacataaataagtagacaggaacagatggagttctgttatagtgatattcttattctttaagttcctctggcattttaggctaacaatcacaccatgatctgatcattatttttaatgatgtatcagctgttgactccattaggacttctaacgcaaagaatcacaaactgccctacttgcaaaaactgtgtgctatccgtcaaccaagttccctccctgtcttaacctcaaacacaattatttcaaacaccctttgtgtggcagcccaggggcaccatgccacagaaagatcagggatgggggagtggggcaaggatgctggccaagggggagatgaggaaggaaaagtcgtgtccttagggaaatttaggaaagcgtgctaggaaagctgagatctagacactgagtgtttaaatatatgtgtgactgtttaccccttggaaaatctgcagatccagccaggtacccaaggcccagcagaagacgactgggctacaagtcctgtaccctctgtgtgcctctcaccacagccttctatgttccacccctgtgactctcagccttgctctggccacagctgacctgcttgctagtctttcaatgcactccctgttcttcagccttggggcctcttcccaagctgttcaaaagtcaccttgatcatgaggacttcttcaaccaccttattataaatagcagtcacccacacatacacattcctatctcccttcttttatttttctccctggtgatatatatacacctgggagtatttctcccaggtatatatttctccctgctccatatatacttgttgaatgcgttaatctctatgggctgtaagctagtgtgtcaacatcagccatgacagagccctccatgtttaggactgtgtttgggttgggagaagggcatcttctaaggatgtggcatcttctaaggcatgctgccttccagtgtgccaggaggcggtgtgggaagcctaccggatctttctggatcgcctccctgagccgggggaataccaggactgggtcagcgtctgccagcaggagaccttctgcctctttgacatcgggaaaaatttcagcaactcccag

SEQ ID NO: 30475 - DNA, 1084 bp, Bovine  19866880617101
gttgatgactgctgtctatctgccggtaaaattctatccctattatgaatgtgaatctttttctcaaaatgagtatgtttgtaaggtgtttttattagcttatgaacaaatacatgttttcagtactgaaattacattattagacacataatgcagactaaagtgaagggatgtggcctagtgtgtctcccggtacagacagcatatgtagggatttctccttatggacatacaaaaaggacttcaactcttctttcccctttttatttctataaatacatttcaggggatttatttcatagagacccacactgtctgtaggttcggttctatttattaaattcaaccatactaggagggcagtgtcttcagtagagttatcagtgttttcctaggaggatccattttgcttaacaaataccccacatatcatgtaaaacactatcgcaaaaagatagaaatacaaactactccaaaggcatttccaacaaaggcttctacttacccttacgttcctcctcatgtttttctctaaacctctgactgtgtgcctgtctgcattttcttccccctgatcattttcagctgaagtagaacaggcagtaaaatcataaattctgtttgtttcctgcttgcagacgttcatgcagttacaccgcagcctccttttgaggtgtgccagtagaaaatctgaaaatttcaatgattagtttgtaaacaaattgcaagtcatttgtggatttggtcacttaggaactgcactgaaataatgatttatatcagctgtgataagggcattgatgctaagcagaataaatgtcttatcatttcttaatggaaaacctgaagcaattttctcataatttgagtgcctaagtgttgaatacattagcttaatccttacttcatttcttttaaattgaatagtacattttttcttgttgaagtgcatttgttaatatatttgccattgaaagacttaatcaatgatttatgagtatgtggcacccaatatctggaatcttttaaattaactcaataagactcttactatagtttcttagtttttatggctttttttttt

SEQ ID NO: 30476 - DNA, 2447 bp, Bovine  19866880640372
atgaaaagccaagtgtggtctagtttattgagtgaaagctacagctgtgaaagaaagcccaaggatgtggaggtaagcaggccagcaactgtgaagtgagctaccaggtagggactaatagagattgtcttgttggggctgatgcccttcccgagagcctgaggaaagtgaggtaggggaaaggatgaaacaccagcgagaggctgtctgagttacagctctctaagtcacagagtggactgattttttaaaagaatattctctatgtttaggaatgagttttgaagcatgtaaaggatatttgaggggataatcttaagtaccaaaacatatttctatcatcaatggaagtgaaaaaccttcagatagttttaaacagagcagttgaagagatgtgcacagtgcctggcacattgcaggtacttaaatgaacttttggacaaatagatgagaaatgtagagggccttatcacaatttttttttttcagtttttggtaggttgagaggagttatgtttatcagtatagagattctgtgtttgggggttaaaaaagccaaagaccaagaatctgatgttttgcaaaactgtgtgctgaaattagcaagacttaatggagaaaatggagtgagggtgagaggtgaccactcacactcgtacaactttgtgactagagcactaaccaagttagcattgatgccttgggagataacagactactcaggcaggcagttcagtatagctagaggctgtcccagaggatcctaaaatgtacagaaaaaaatctagtggaaagtctggcaactccttaattagcaacagactagcaggtagatagaagcagagatcttgagcagtgggggtcctttgaagatgagtttggagtgtgaagactgtcaagaggataaactataggactctgggatgttcctctctggggagggcttatttcaattttttttgaaaatggggctgaaaaagtttctgctgcttgagcagacatggactgagggctttctccttcattgttgaaggttttatttctattcctgcttttttggctcccctcaactggcaaaatttcatatgaacccgattatctccacattatactgacatttctctcccagttcttcatgagctaattcatgttgtagaaatgaaacaggagggaaggaggcaaggcacaacctttgaaagaatgacatagccacgtgtgtgtgtgctcattcacttagtcgggtccgactctttgagaccccatggactgtagcccaccaggctcctctgtacatggaattttccagtcaggaatactggagtgggttgccgtttcctcctccaggggatcttcctgaccgagaatcggacttgagactctcgtctcctgcgttggcaggtggattctttgccactgtgccatctgggaagcccataggacacggcaaaagctgattagaaccaaatgggcccaagatgacagatgagtcaacttccactagacctggagcctcagtatatgttcactgtaacacatccgggttttggctcaatcagaggtgcacggtttcagcaaaatactccagttttggagtattttgagtacaaaatactctagtacagtagtagaacagattgtttaacaatttggaattttgtgaagaatgaagttaactatattagatctttgaagatcttagtagccatataacaagtctaattttacaaatgtggaagcagagattagagaaatcatatcatttgtggtagggcctataataattcaatatttaccaagttaaaacaattaaaaaagctctaatattgggaatactttgtaaatttatgttagatgaaagaaataaaatagaattttaagaagccatctaattccacagcaatttattaattataccacacacaaatatcctgcttttctgactgttttatggaggattaaagcaaaaatttcactggacaaaagtaaacaggcaaggaagattttattcaaggctatagggaaaaaaggctacaaatctgtctgagttcaactctgtggaagcaaagcactggagagttttgatgagctggagggaggcgaatagaaggccatttgtgtttgctagttggattcacccagacaaaaagcaaactttctcttatccttgtgataggaaataacccacaagtcacaaacaggagatagtttaaaatggttaaaaacaaacaagcaaacaaaaagcaacaataattaaattcacattcatatattattatgaaattcttagtagcattaaaagtagaaggtagaaataagagtaaaaacatagatatactttaagtaaaaaaggacagcatttctccaatgttatgtatttccatataaatacatatttataatagtatcatatggtatttatagttttcttttatttccccaaagtttat

SEQ ID NO: 30477 - DNA, 1020 bp, Bovine  19866880661122
ccaggaacataaagatttttaaaaagcatttaatggagaattacctggtgggctagtggttaggagttggcacattctgactcttgtggtcctgggttcaatctctggtcagggaaataagatcccacaagccatgtggtgtggcaaaaaaaaaacaaaaacaaaaaaaaaaaaacacacaaatcagtgcacttaatggcactcgaaagagtttccatatgccttcatgctgtgttttcagttacccaaaagtgttgtaggttacacagaaatatgccaactgaaacttaaaaaagaatgtgcaatgccttttagaatccatcacacttatttcctactgggcttaatttcagaacccagtcagttagttcagtcactcacttgtgtctgactctttgtgaccccatgaaccacagcacgccaggcctccctgtccataaccaactcctggatatcagacaaacccatcgagttgatgatgccatccaaccctctcatcctctgtcttccccttctcctcctgccctcaatctttcccagcatcaggggcttttccaaagagtcagctctttgcatcaggtggccaaggtattggagtttcagcttcaacatcagtcctatcaatgaacacccaggactgatctcctttaggatggactggttggatcttcttgcagtccaagggactctcaagagtcttctccaacaccacagttcaaaagcatcaattcttcggtgctcaactttatgtatagcccaactctgacatccatacatgaccactggaaaaaccatagccttgactagatggacctgttagcaaagtaatgtctctgattttcaatatgctgtttaggttgttcataactttccttccaaggagtaagtgtcttttaatttcatggctgcaatcaccatctgcagtgattttggagcccagaaaaataaagtctgacacagtttccactgtttccccatctatctgccatgaagtgatgggaccagatgccagatcttcat

SEQ ID NO: 30478 - DNA, 2470 bp, Bovine  19866880842427
ctgagaaaattggtgagagtggtcatcctagtcttgtttctgatcttagacaaaatgctttcagattttcaatgttttttatgatactggctgtatgtttgtcatatgcatgcatgcttaatgagtcatgtccaactctctgcgaccctttggactgtagcccaccaggctcctcagtccaagggattctccaggcaagaatgctggagggggatgccatgccctcatctaggggatcttcctgactcagaggttgaactgcattgctggtgaattctttagctgctgagccattggggaaacccaggtttgtcatatatggcctttattatgatgaggtatacagtccattggtggactcaaaatgaatccttcctcatcagtattttggaatagtttgagaaaaatcggtgttaattcatttttaactgcttggtaagccatctggtgttggtatttagttttctggaagtttttaaaaatactgataaatttcattgctggcaattggtctgctcatgttttatatttctcttgattcagtctggggacatttctgtgaatttagaaatctaaattctaaatccatttgtgctaagatgcccattttatgggcattttctgagttttgttgctctttctgtagcctcctaacggatatgaggtggcatctcactgtgattttgattttgatttccgtagtgattagtgatgttgaatatttttcatatgcttgctggccatttgtatatcttctttagagaaatgtctattcatatattttgcccatttttaaattggcttgtttcttttgctcttgttgcattattaggaattctttatatattctggatattaacctcttaaccgatgaatgatttgcaagtatttctcatattttaggttgccttttcactctgttaatcgagtgctttgaagcacagaagtttaaattttatttagtgcaatttatatagttttacttttgtcccctatacttttgttgtcacatctaagaaatgattgtcatttgcagtgtcaaaaagctttcctacatataggtttatgttttatgtttagattttgatccacttaaatttttttatttaaggcttccctggtggctcagaggttaaagcatctgcctgcaaggcgggagacctgggttcaatccctgggtgggggaagatcccctggaaaaggaaatggcaacccaccccagtattcttgcctggagaatcccatggatggagaagcctggtgggctacagtctatggggtcccaaagagttggacacgactgagcaacttaacttacactttcaaatttttttattatgtaacaagtccaaattcatttctccccatatgtttatacactttccccaacaccatttgttgaaaatactgtcctttctccactgaatgatcttggcatccttgtcaaaagttatttgactgtgtacctgaagttttatttctggcttccctattttattcattggtacatatgtctgtgggaaggtacactttaaaatacattttatgtctgaaatatctttaaaaatatcatcaaaaatagctaatattttggctgggtagagaattgagtttccttttataatttaaaggcattattctactaacttttatcttctagagttgctgtttaaaaccagtaagctgggcgtttggtgtaacctttcaatctggaaattcaaggtctttttttctgctgaaatttcctgtgatatttcttaaataattttcttcccttctactgtctctcttctctcttttgagcatatattatatgggtgttgcacttcatgaactaattctctcctctcttattttctttcttgtttccatttctttttcttgttgccgattttctagggatttgtacacatttatcttgcaatccttcactgatatttttaaatttttgcctgcatgaattttgtttccaaaactgctttattgcattctttacatttttacagagtcagtatcttctctcattttttcaagatgaataatatatttttgaaattttattctccctccatggtctcagtttcttttattttgatcctgttttcctatcttccaagttataagtcttgctcagggggctgataattcttggttcccagttcccagttaaaaatctgggggacaaaaatcttattggtaactttgatggattgtcaggaattgtgaactttgaatttctctttggggtaggatttctcaacctcagcactatttaaaattggagatagattttttttttctgttttctgtcattagaggtggagactgtcctgatacatagcagcattcccgacctctacctgctagatactagtaaactctcctttctgttgtgtcagcaaaatgtgttcagatattgctaaatttttccctgggggagtggggtgggaaaattgctctcagttgaata

SEQ ID NO: 30479 - DNA, 755 bp, Bovine  19866881129504
tagctgctcagtgggcatcactggtccgggtgggcttttatagctgcccccaacaagttccatgagattattaaatactactgctctcctaagccatttattgtgtttaataagtgaatgtctccattttgtatctaacgtgttgtcaatatgctatcctggggagaattaagaataagccgacatactaagtagatctgctaacctgagaatatattgcatggaaaacacaaggcatatgaaggaagtaaatctgcagaagttcctgctttattccaatctgtgtaataccagcatgcattctcagtcactcagtcgtgtctgactctttgcaaccccatgcactgtagcccaccaggctcctctgtccatgtgatttcccaggcaagagcactggagggggttatcatgccctgcttcaggagatctttctgatccagggattgaatctgagtctcctgagtctcttgcattggcaggtggattctttaccactgagccacctgggaacctagagctgtagaaattcagttagcaaaaatctacagttagtctgaacttttaaacactgtccagttgcaggcagaagcaaggcaaaggcaatttcagacagggctggcatgagacccagacttgtgagggacactgcagaggatcaaggggtgaaccaaacaggactcccagtaagactaggaccaagagggttcctgcagatgctgctagtgaacagctgggaataaatttgtttccatagt

SEQ ID NO: 30480 - DNA, 1021 bp, Bovine  19866881161794
cagtactgtttacaatagctaggacatgaagcaacttagatgtccatcagcagatgaatggataagaaagtaattgtacatatacacgatggaatattactcagctataaaaaaagaatgcatttgagtcagttctaatgaggtggatgaaactggaacctatgatacagaatgaaataagtcagaaagaaaaacaccaatatagtgtattaatgcatacatatggaatttagaaagacagtaacgatgaccctctatgcaagacagcaaaaaagacacagatgtaaagaatagttttttggactctgtgggagaaggtgagggtgggatgatttgagaaaatagcactgaaacatgtatattaccatatgtaaaatagatcaccagtccaagtttgatgaatgaaacagggcactcaaagctggtgcactgttacaacccagagggatgggatgaggggaggtgggagggggtttcaggatggggacacatgtacacccatggctgattcatgtcaatgtatgggaaaaaccatcacagcattgtaaagtaattagcctccaattaaaataaattaatttaaaaaatccagaaaaaatgcaaattagctatgaaataggtataattagacccttaattagtaatgattgagcacattataatgttcatgtggattttatgctattgcctgtcatttttgaatttattaagcaaataattctttccttgatgtattttccttgaaagcattttaaaaatatacagtccttctttaaaaaaaataaacaaggagacatttataagatggggagaagtgaagtaatttaccaaagatcacatagttaataagttccagagttgtagatcaaacctggtgatgagcctgtaaagtctattctgtgaaccatggcatttagttgcttttcttttgaagcctaatttactgagcacaaaggaaggaaagccaagcatattggcagaaaatatacgagataggtttaaagggaaaaggattgcaagt

SEQ ID NO: 30481 - DNA, 554 bp, Bovine  19866881169584
actgagtgaacccacgcatatgtggaacctaaacaaaaacccaaaccagggtcatagatacaaaaaacagactggtgactgtcagaggcagagctgggtggaggggagcagaaatgggtgaaagcggtcaaaaagcaaaataaataaataagagtaaaaagaatgcttgatcgccagaagaagagtagaagggatttatgggctcccagatctaagtcacaccttgggctctggttgcgtggggtggatttgctcacctgaagctgagacttggctgcgacctcctggtaatacggggactgggagttatccagctctgacttgaacttctggtttgccagagagatacttagctctactttctgctccagtgcatcctcagcagcatccgtgaattctatttttctttcctgtgttagagttagaaaaaagagaagtgattctattactgtaaagcataagcaaatggttacatcatataatatgtatgcattgctactgtctcaagaagagggttatgaagcattaagtgcttttagagtaagtcctattaa

SEQ ID NO: 30482 - DNA, 2656 bp, Bovine  19866881198868
tcgaattttattttaacttaaagcttatactgtatattaaatcagtgctcatttttatgtacacagaagttttttctatatgaaatccactataagatggtgatgatgagaatgacaatgataatattcttgtcttgagcatttttcattttctcctttttgtctgcaaaattaagtaccaaaatcatgtcttcaaactttggcctttgtaattccttttatccttaaggggccttcccaggtggcactagtggtaaagaacccgcctacaaatgcaggagacataagagacggtggttcagtccctgggttgggaagacgccctggagtgacaacccactccagtatttttggctggagaatcctacggacagaggaacctgtcaagttacagtccacagggttgtaaagagttggacacacctgaagcaacttattacacacgcacacatccttaaggacctgattctcaggctctgtatcttagagattcttattagactagagagggatttggaattctgcaagtttaacaagtcctcaaggtattttagactcaggtgaaattaaacccactcagaaaaattgccttggtatgaccaataagcctttcacggttcagctatttctgactatcttttatctctcactattgcaaagccatcctatctatttcatttcaattatacttaagcatttggagtctctggatgttgtcagtttatgtgctagcagtgttttcttcactatcatgtgccctcttcaatttgtccatctgcaaccaccagttcatttgttcacatgcatcttttgtgctctttccttttaaagccatcaatcattttcagttgaactgtgtgagggaagggcttcttggaagccatctttaccaataccaccctactctagcacctactcccctctaagaaaccatcagaacaatccccaccattgtctgtgctcatttaacccagacactggaagatttctgtgatcccacagtcacccattaacaggggaattcctactgttgtgttgctctgatctgtataaccctcctatgttacccaaatctttccattgtgttcccagaagtgtggctaggtggttagtactgtatcctcagctttcttcctgaacatcccctctaccttctagcttaactgaacctaactgccccatgaatactctgcattctcgaaacattctgaagtaacagcttgggtaccccccttttcttccaaactattactttttcttccttttgcaagagacatctactgctgttaatactgctactgttactactacaacatcattataattctccatcttgctactctgtaattgctatcacctggtcactttcatcattcactgaagacaaacctgtctgtcattcaagatatctattatgcacatgtctgactttaagtaacttttaggtctaacacacttacacatgataggtagacatgggagttgccaatcttagaaacagtgtaaaaaataatcctcttccttcttatttgtctcagttgatctcagtaacttccaggttaattcattctgcctagtcctcaatagaattacagtatgtttcatatgctatacttatataattttcctattctgtggttacatattctgaatataaagtgtgaatacatatgtgtatatttcatatatatatatatatatgaatgaatataaagtctttgtacatacatatatgtgaataatgtgtttttgtattaagtatttgtgttctctaaatcttctgttaaatgttaaaactgtttagagaacaagggctatgatgtctatggcaacttgttcccagattttgtcttttcccagagctctgaccggtgagaaactggaatttttgttggagaacttccatactttagttataaaatcacggtactattatggaacattttcacctttttttcccccaagtgttcaataataagaaagtagcagggtcttttacttcagaacaaatatgaatatatgtaagatcatgttattgaatagtcaaaggactgctatggagactaaagaatactttcaagatagaataacgactttgaattaaggaaaaaatacttaggcacttgccctagatcagagatcagagctggtgtaagttgcccaagcactgactggctctgtgtttttcagagtgctattttattaagtcatctgatgaccagatttctaaacatagaccttgtaaatcagagggaaaaatccagaagacatttttgtacaccaaggtcagatgaaaatttccactctgtaatactttgtttgatgttatctgccctttgcttaaactttggggagcagaggaggagatttaattaagaaattctaatggaatatttatagaaatagcaaataatcaaatcattattatttagcttgacatttggtttttcctatctttatctttggattttactctcctctcccctttctttcatggtcagacatgcctcatagtgccgagaccagaaaaagccaaatttttccctgggaaaatgactacagaatagctgaggtcagagactagttaacttctataaccagttaggaattttagggataagaacaaaaaaatagaacagggcattaaaaacataca

SEQ ID NO: 30483 - DNA, 1425 bp, Bovine  19866881430731
ttgcagtagtgtgtcagaggtcgtgagaagccacggggatcaacacttagcttcttcctggtactaaatttacttgagcattttaggagaaaagttgaaaatgttaagaactgtaaacgattttcacatgaatacacaagcgaagtcagcaaaattctttctccctcaaataagccggtattgaaagtgagacgagttgggtatttctataagccatgattaactgtaaagtgtatttccttggaaaatggagagtggagttggattagtgctgaggtcaggttgaagtaaacggcatgtgaaactgaggtgagaacgattatgttgaagttgctggtcggcctggttaaggcttcttttcaggtgctgacaaaaagaaaccagtgttttccccagctagatgtttagcaacccctcaaatcaccctgggtagacaggtaccttctgcgtatccatacaggactaaccctgttaagcccctcgagaaagggatgatagaggatgttgttctggtcacctgatggttggatggcatcactgattcaatgggcatgaatttgagcaagctctgggatatggtgaaggacagggaagcctggtgtgctgcagtccatggggtcacaaagagttggatgcgactgaacaacgatcatctttttcttacattaacttctcctggcttccctggtatgttagttggtaaagaatctgcctgcaatgctggagactggggttgatccctgggtcaggaagattcccctggagaaggaaatggctggatttttgcctggattcatgcttggaaaatcctgtgggtagaggagcctagcgggctacagtccatggggtcgcaatagttgaacacgatttagcagctaaaccaccatcacaaactcttacttcttcccaggcactgacccatcacgaaaacttttagggcaccatctccataggtttcagaatgtggaggttaaacaaacacacaggttatgaataagagaatcagaatggaattttacaagttaatctgagatctgtgcatgatgagttgcgattgtatctcacaaatgtttatgggatgtgacagtattcggagcatttttctagcctggctggacagaagtttgaatgatacagagaccaaaggattttgctgaaaccatacaagggcattcacaagacaagtagcaaatcatgaagacctaccaagagtctataaaaaaaaatccccccaaattaggaagaagttaatttcagaagctgggagtgcactgaggaaatatatcactggcaggaatacagatttgcttaggggacacattaatgacatgtgcaaaatacccactttcttctggttctagctgaattggtgtgtttctccccgtgatccttagggctgctatctattggggcatatttatctca

SEQ ID NO: 30484 - DNA, 1112 bp, Bovine  19866881431831
tcccacatgctgctgtaggcccactgttggacaaggctgtcattaattgtctggagggaggattccaaaatggcccttgccagctttggtgccagcatggtagaataacatcttccaaagtggctttttccagcctctctgtggccagggagacccagctgccttctgctctccaggggctttccataatcaacaagtaggtctgacccaggtacctttcaaactgctggcctctgggctggtattcagagcatgtgaggtcttgtgtgtgccctgtaagtggtctttcttcccagtagtcctctggttttcctgaatgtgagccctgctgattttcaaagccagatgtccttgggactcatcttcctagtgcaggacccttcagctggggagcctgatgtgggtttagaccctttgcttctcagggaggacctctatgggtgtgatatccctctcatttttgggtcatcagtccaggcatgttaatcctgacttgattgcatctttatccctcttaatggtctcatttggctctttatttatatctttaagtgtggaaacttttttctggtagcctaaaagtcattgtcatagatagttgctctgtaggtaattgtaattttgatatacccatgggaggagatgagttctgggtcttcccattctgccatctagattcctcagctatgatttttaaatgactgtacatggctgtagagtaatttatttaaccatatctttattgttgaagaggtaaattgttcccataaaagtttatatagattttacacaagtaatatattaccaaagcttcatttagaaatggatttatgaacaccaagaaggtgccagtatttactgtcgaatttaattatgttagatttaatagaggataaaaataaaacatgacctatagaagtaaaactagagtattcagagaggttactcagttcccagattcttttgtggagccaaatttacctttaggttcaaggatgaccataaccaaaaaaaaaaggaatgccacattttgcaaagatagatcagggccgtaagttagaggagacacttgaagagcaatatttggtgttcagagatccgactgcacaggt

SEQ ID NO: 30485 - DNA, 1670 bp, Bovine  19866881469269
tttttgaagttttgttaaacatttacccagttgttatatccaagagtaagatagatgagtatggaaaaaagtccaatggtttaaaatgtcaaatatattcataggctagagcttttattgtttattgaagaaaatgaatttttctgcagaaacctgtgagtattggtactgtctgcattacttgggagaatgacagtcatctttattatccttctcatttgaagaaaacaaactttcagcaaagttttcatgaaagagattattctcctctctgtagggagccctttgagatctgtgttgtagatcaggaaactgaaccaggcaacaaagactcctttggacctgaatttgcttgttgagattctgccaactcaggctttattcttttttcttcactcctgatgattctcttattctcccttgtttggagcaggcagtactgaagtttcacgtattctcatcttcccagtcagcgccagatcttttcttctgatcagtgtgctaattcataattagaattatccccagtaacttgaccataccttcatctgatcaaataaaaatctggaagctgattaacaaggcaccatctccttcacttccttgtttatttaaggctgggggtgttgcaaactttctggaatccaaattgagttgaaacccaaacttcatgtatagtaaagtgtttgatcagtcattaactttctgagtttctgaatgcctaatttcttgacttattcaaatcatgatcattgtttgaacacctcgtttacatttcttcatttaaacaaaaagacataaagcatctgagttatgtactttgaaggcattattaatgcaaaacttccctgaaaaagagttttagaggttttttttttttttttggtaatactttttccttttttaagcatgatttatgtctatttagaaatctggaaaatactgagataatgcaaataaagaaagttataccaaatcacatcagggaggcaatgaaaccttatatttatttttccacatgtgtttatacatgtgcatagaatgtctgtgtttgtacacacacatatatacacatgcattacatatagataaattcatattgatatttattgtactcactggattttaggtaactgttgattcaattttaaacttacatacaatttgctagaatagtgcaaacagcttcagcatactctttactaacattcaacagttgtttatattttccccatttgtgctcaaagttttataacttgctggtttatttagcaagtatagcataccttctgatatttactaagtataattatattgcatcattctaaagatggtgatgctttcttggtggctcagacaatagtctgcctgcaatgcagggcacctggattcgatccttgggttgggaagatcccttggagaaggaaatggcaaccaactccagtattattgcctggaggattgcctgaggagcctggcaggctatggaccatgggggttgaaaagagtaggacacaactgagcaactaacccaaacacaaagataacaatggaggtgatgctgatagtaatgataatgattgctaaatacattttgggtatttttatgtgtcagacactgttctaagtgcctaacatattatgtctcttaaccttcagatatacctaga

SEQ ID NO: 30486 - DNA, 1381 bp, Bovine  19866880490813
ctgagcaccaaagaattgatgtttttgaactgtggtgttggagaagactcttgagagtcccttggactgcaaggagatccaaccagtctatcctaaaggagatcagtcctgggtgttcattggaaggagtgatgttgaagctgaaactccaatactttggccacctgatgcgaagagctgactcattggaaaagaccctgatgttgggaaagattgggggcaggaggagaaggggacaacagaggatgagatggttggatggcatcaccgactcaatggacatgcatttgggtagactccagcagttggtgatggacagggaggcctggtgtgctgcgattcatggggtcacaaagagttggacacgactgagcgactaaactgaactgaactgaactagtgggtttaaaaacaggaagatatttttattttcctgccttagaaactatagagggatagataatgaccttgtttattccttctcatagaaagtaagaaattttaattctattaatccttaattatctcatccctaaatagtgatatttatatcttctccctctgctaaacacttagaatcaattgataaccagttgaaaaagtgtcatgatatatcttttagagacagaaagcctatggctcatttctaaaagatcatacctctttatttacctcttcctccttttgggcgggcccagcttccttaaaaacatcagaagaaaggcattagttgaataatcaaggcaatagaaaaacacctcattcctgcccttcccattaagttgtgactcattctccaagtgcggttgccggctctggaagtttagtatcacctgcagattgctcccttagggagcaaatccagtatcttcaacaacacgagtgtataaatagtataattgcagcattctttatgtcacacaacagacactgcagagctattcacgttgtttattgcaaagctatggcattattagctacaattagaaagtaaaactaacactagtttaaaatatcatttcctggtaaatccagatttttcaatagaagaaaatgatagaagggagaagggatgagtttgagaggaaaactaataaagttatcacttagtgaaaggctttgattgttttcattgtttagtcactcaatcgtgtccaactctttgtgaccccgtggactgtagcccaccaggctcttctgtccatgggattctccaggcaagaatgctggagtgggtagtcatttccttctccagggaattttcctgaatcagggactgaacccacatctcctgcattggaaggtgattctttcccactggccaccagggaagaccaaaaatgaagtataaagatgcaaaaggaaatgacagaaacactga

SEQ ID NO: 30487 - DNA, 1074 bp, Bovine  19866880639628
gatagtttatagaatgctgaactttctggaaagaacactaaaagactaaaattgtatttgttcacttagttatgtgaatgtataaaaataatagtgaatcatttacaagagttgtctgctgctgctgctaagtcacttcagtcatgtccgactctgtgtgacctcatagatggcagcccaccaggttcccccatccctgggattctcaagacaagaacactggagtgggttgccatttcttctccaatgcatgaaagtgaaaagtgaaagttaagtcgctcagtggtgtccgactcttagcgaccccatggactgtagtccaccaggctccttcatccatgggattttccagacaagagtactggagtggggtgccattgccttctctgacaagagttgtctagagaaaactttcagcataagtagaaaaaactttcagcagtttgtgctgagcctggtacaaaatatggattagtgacttaatctgagtaaatgtagtctaattagtacaagagtgcaaatatgcatacatatatgaatctatgtgtgaatgagtctgcacagaccatttgctgcaagaacaagcacttttttaacaataaaaataagaatcaacattgcagcagcattcacaaccacataactggagaaaccacgtgattcaggtgctgcaaatagggaatagaactagtgtcagaggctggcatcaggagcatagacgtaggttctacattgcctaagctaagtggctacagtctggttgagtgtggggtgtggaatgtgaaattctaacaaaacattttaaagagattgatttggggtgagcaaaggtgatatgatattcatttctgtatagcttcttaaaactgatttactgcagtagcttgtagaagtaacagatgtttattcgaatgaatattcattcactgacatgaagtcctggtagatgacactttcctcttaacatgtcatagttttctcttactggatgtttgctactgtggttgccaaatgtctatttagaagatataacactaaggagctacataacgtgacgtattgaagtataatggt

SEQ ID NO: 30488 - DNA, 1099 bp, Bovine  19866880641060
acaaaaatgggtatcaatccacataatagaaaataattgatgaagttggagggcgtgattatttgtgattactttacagtcatgcacagaaagtaggagaaccacagctagtggttaatctctggctacctctttgaagataatgaaattggcttcctactgatgattattcattaacaattaattctttctcagtgatctgcctcattttcagcttctcactacaaacatgcaatggaataattacaagtggaaatgaaaaagcaattagtggcagataatgccaacatctgattaaaaaacagtagaacagattagcagttccgtaactgcaagtctgctgccttcggtggggaggtgtaagtcacccggttatactgcacttcaagctgtgctttctcttttattgcttcccctccatcatggtctgccacattaaatgctcccttttattctagggggcattagcttgttgtaaatactttctacagattaagcagctttggggatgatttgtgatcctacatgctgaaattctaaaaggcactgtctcataatacaatgctaaaatccatatctgtataccattctttggggatcacagaaaataccatatatttctttgctttcgtttcagcttaactcttgttaaatgtttccagaagaagagcatcactaaatcaaaaacaagcaccttctttaagcacccatggatgccttggtcttacaggttggtttctctccttgcaataaggcgggccacaaactgatggtggatcttcacttatcatttactaaggagtaagatagttctggctgctgtagaaataattcctcaataaaaggcttataatttcactgttctcagtgatccaactggtgtgtcagtgcttcatatgatgtagaactatatagggagtgtcaaaaccaacaattcataaggcaaacaaaatgcagttctcttaaataacttggcagatgctttaatatgaagatctaataagatcctgtcactgaatttgacacagtaggagtgtagaccatagctgttttaggaaaacagattttttttgggggaaaaaaaaagctatgtacttag

SEQ ID NO: 30489 - DNA, 757 bp, Bovine  19866880719909
atcactaactggtattttgagaaatcagtcagataacgagatgtagtcctgtataactaaggttggcatcttagttgctgggttttaagttccccaaaagagtcatggcccaaggccctatataacctagaagagagagagcttttagaagtcgtggttcttacattcacttggaccacagtcattttctttaattatgtaattttacaggtcataaaattgtgtgttgaatgcatattgatgaacccaaggaaaatgctatgttcgttttttcagaggtctatttcttagtatacatactgccctgcctagagaataaatatggcatttttcacatgaagaattaataagtttatagtctatactttttatgcattctacaataaggcttttaaacaaaattcctcttagtttattggatgtgtctgttcacacttcactaaatctggatgtcagcttaagttaattcaaatgaataaaaaccaataaaacttttacataattcagatgcttattaaatagctactatttgtcagcttgtttaaatatcaaacctggtactaactaaaatatgctggtagttatatattatgtcattaatacttgatggtaaaattttataagattttaaatgaattcttctatatttatgtatagttaacatatcaattcattgtagacttatctattagtttcctagaagcaccatagcaaattatttcaaactggggtggcttgaaacaacagaaatgtatcg

SEQ ID NO: 30490 - DNA, 1668 bp, Bovine  19866880779049
cctggagatgagatgaggctcatctgatgggctggagttcctgattgctctgaacaccatctggccagttaactattctgacattgagaagcattaaaatattggactttggtgttactgatacccataagaacttcccaaagaaaaagcaagccagctgttgatatttatgagacctctataaaatgaccaagaagaaaatatgtacttgaacagtttaatattatccataaatatcctgctaatttatctcaactaatgagaactttcaaaacagtttctaaaccttctgctgaacatctgtgttaaatgtgggtggttatgataatagcagataaatgcagcttttgctaatttactgccacgagttaaaatttataacataattttctcattaaaaataactgagggtgttaaaaccacagaacataatcttatatgaagaatgttatattttctttttttgtgaaattcaatattctgaggattagtgtgaaagtattttagatgaaaaaagtcatagaagttcttatagatgcatgaaacctgaaatcatttgcctgcaatcaatggcagttaaagagggcacagccaaatctggttctcttcaggtgaaatttccctttggtggtcaccattttttctcccttctagtttgagttagttccttcatctcccagtactaagccaggagtttagagcagtaaaggggtataagtatcaaacagctggattctctcctttgcttatgaacttaaggcagaatggttataaacttatatggtccttacgatgagtttacaacacaccattcatatcatctgcctctttgaattcattcaactctgtatttgccttttgcagatcaagcaggatgagaatggcaaagtaacaaatgtgatgacctggactcttcatggtatagaaattcactggaggagcctctacaaaatccaaagacaccaaggtccctccaggaaccacgatattcaatcttcattgccaagttacaaccaaagatagtttgtgaaagaaaagattaagttcaaaaggaatctactgatctaccccatccattcatccattctcacaggagaagaatctactgattaatcgtcatttatataaatttaggcctgagagaataatgaatattgactgaaacagaattctacaatttagagacagcatagaaacaagttaatataattaaaacaagaaatgagggagaagaaacaagacaaaaatccctactatttaaaggctacacaaagaaactttgatataattaaaacattttaaaaaggagaaacaaggacaaaattgatattcaacctctacactgtacttgttcagtctttgaaatggctaaaaaaagttggattaaagtcttggaatttaaaaattttaataaaagaaacacataaaatgtacattactcatctagataatataaagcaaaacaactctttttgtaaaactaccaattatttaagctgtgttttcctggctcttgttatttagttaagccttgacacttcattctactttgcaatttttaattgtactttggttttaacaggatgaggaggagagtgaagatagaggcaattattgccatgccctaaattaatgagtgttaacaagctctgtggaagaaatagattg

SEQ ID NO: 30491 - DNA, 1180 bp, Bovine  19866880800676
tggactgcagcctaccggctcctctgtccttttccggcaagagtacagcattgcttaaattatttttcaaccttaaaattctttctttatttactaactgagaagttgaggtaaaaccggagctggagtaagcgatttctacttatcctctctcggtcctctccttcctgggctgtcatcattcactcttctccagccgaaaactatatcgcagtggtgcttctggcttagcatcccctctaattgctgtccatctgtttccattaagcatctaagccatttgtctcatttcaatatctcgctcctttttctaaacacttcagataaaattgtgacctcaaatatttacataacattttcctagatttctgcatctgaggacagtgtcattttgctattattaaaagaatgttaattcagcacctttcacactgtgagtgctaaatatgcaattactgttactttgatagtatggtagtaaaaaaaagttgaatcaaatattaacgttcttccttttataagaaattctgtaatttaaggacaatagttccttctctgatccaacgtcaaagataattattttgacaaattcttttgagatttttagatcatagaaatatgattaaataaaaccagtgatcagttggagttatcataagagctccagagtattcctcctgtgatctaaaacaatgttttaacaacatccctggtctccaaattctgtcttgttaaatatgaaataaaagtttcaataaaagtttttcctcttgttaactttaaaattgtctgtagcttaagatagagccattttgccactgtactttcgctatggttcaagtccatatttcttgcccgttagggcactgggtccctcttctgcacagttttgacttctgtaaaataaactttcctaaactttgatgctatagcatcagtcagcttagagagatgctataagaaaatgcctgtgacacttatcactagtgtagaggtggtgttgatgatgccagcaaagagagccttactttataaggatgcatgggagagatgtctcacatatgtcagccctggaaataatcacacctcctgagcatctggacctgatggatcattaacccatcatatttttcccttaaagctaaatttgtagcccttctccagcaagtattccaagcca

SEQ ID NO: 30492 - DNA, 1228 bp, Bovine  19866880856632
tctttattttgatagttcatgaattaatgagaagcttttagtctcatcaatatctgtcaatttgcagtagaagagcatttgtgtattatatataatactattaaggattaaatatgtcatgttattttagaatctaattattttatgtagttattattgcaatgtataaggattatttataacaatggtggtgatgatgaccataactaatgctctttggattcttaatacgtaccaagtagtatccaaatattgttcatggatttatctaagtaaatctcacaacagcactaggacacattatttttattatttctattttacagagaagtcaaatgaaacaacaagtgtgtataacacatattcaatgttacttagctagcaatgactaaatccaaagctttcctcttaaccaaagtagattcaaagatgccaatttccatgtaactgaatgtttatatagatgttcttttctttttaaagtattttagtcataacatgttgctggttttaaagtccctttttctttgggttgtttactgtttatttgtgacagcatcctcaaagaacaaggacagaaatcttatttctatgttctttcatgtaaaactggagcttttacccagcatgaaaatattaatacaatcttttcccagagagatagattatcagtgaaagtaaacgagaacatactctggcaataaaaataacgagacaggtgggacaaaagtaatgacatcctctagcataatctcggcagcaaataactaaatcaccttgaaagagataaattgttacaaaacaccatccttgtctaatgtggattgacagggaatgacaggacccttcaaagggatggcagcccacaagcccatgtgcttccaaaggatcaaagggactgacaccgcctgccagccccatctaagcagaaaacaactagattctctccaggcggatatttactctaagatattatttctgggaaaagatagcttatttgcgatggatgacggcatttttttctacacagcctgtcatctgttagagcaggactggatgcggggagaatccgccaaacctgtccttgggatccaaatcagtcataaatctttagcaagctagggaaattgaactgtgacacaaccactttaaagacagcgtgtgcagagccttcagtttacagattgttagtgatttccctcctatcgatataaaagtttttaaaaag

SEQ ID NO: 30493 - DNA, 1876 bp, Bovine  19866880950351
tcttcagctgaacaaactctggttgcatgaaatttccactctttttcattttagtgactatatggggggggggggcggacaagggaaaccctccaaagggctccaagtttgatcatagaacatgtaactaagcaaatactctcatgtgttttttcctatcccagaatattttcataaaaataatgaaacatataatacagttcgaatacttgtttttgttataatttactataaatatttgtgttttctttgaagcaagatcatttttaagtgccactaatgaaagcatatccttaattccatgtttatagcaagataaatttttgcaaaagccagaaatgagagcagatcttgaattccacgtaaaatattttagtcatcttctttaaaatgttgaaattttaacatagctcttttgtattctttttaagtactgcatgaaagctgatccatattgcttaaatatctcatgccattttgggaaaatggacagtggaaaagaagccagtgttcacattcagttggaaggtcggccatccattttagaaatggtaagtctatgatacagtggcaactttgtagataagatttcagacagaccttacaaacacagccatcttatacaggtaggatggtaagtacggaggcattcaacaaattaagaaggtatgattgactgtaaaatctggaatgaaattctaaaactgttcccatttatcacttcaaaatacactgtctaaatgacatggttttagtaactaaacagataacatagactataaaatagactataattaagagattttagaaagcatgtccaactatttatgactgtcactcaaatcagttagctgcctcaacatttcatatatccttaagttatttacaaattatgctaaaagacctactattgtatatagtatacatttactaaaaattaagacttccataaaatctaaaacatcaaaatttaacaaaacacatacaagaacacaaacacacttttaaggacatgaactttgaaggcttgaattaaaaattacctaaatacatgttagacttcttcttggaaaggagtgtgtatatttatgagaagtactttgagatacaattttcttatctgatcaatatgggtaatagatctttttcagagttgttcagatgagatgatctttataaagaacttagtacatagcacataataagccaaaggaaaggacagctatcatgttctgttaagaggagaagttgaaattaccacaaggtggttaagaggaagacacatcagacagggaaatatgagcgctccattttagttgtaagttatttagacttttgcagtctgccttcttactctccagggtcagtgttctcaccagtgggtgccagtggcattttggaccaaatacttctttgttgccaggggccatcctgtgctagtaggatgcttatcagaatagctggcccctacccgctaaatgctaagcaccccttccccatgcctgccagctggaaatggctccagacgtaaatgaccatcctccagggtacagaatcatccttggtgaaaagcactgctccagctaaagcacataatttatttttagcttaaaattctgcatgttctctccaaaatgttaaataacctttagacagtagttttaacatttgcaggtcatagacttctataagaatttgatcaaaaaatatagtctcatctaccctaatgaatgcacatatgaaaaaaaaaatctcaattttgaataaaatttcaaagggccttagagtttgtgaagcccatctacagatgtctaagccctgaattcttggttatgaagtccctctctcggtgagatagtcaaactgaattcatcca

SEQ ID NO: 30494 - DNA, 3295 bp, Bovine  19866880992703
gtaagaaaatattgtctctgctggaggcacaaaaactgacatgagcgtaatgggcatttgtcttttggcttttgtaacagtttcattaaaaatggatgctagtaactgctcttctaaccttgaagcatagcccagtgagagcagcttaccacgaaagaaatagtcgtcagctttcctctggctcctctgtcccctcctgccccttcctaacaacagaaaatttgctttgcacctgctccaactgggctctaagtgataagcatcttgcaagcccagaaaattgtagtatcaaatctcagctccaactgtgaggcagcaccatatcccccgatcccgctgagagacgttgcttttccggttccccagggaagagttctttctctccggccccctttcaggtttgaactctgacctaagccctctttttagctcccagcgtgcattgctctagagctggccctgacctagccccgaatcctccaccctgagctcaccagcaggtcagccctgggtagccctggggtcaacggaatacccaattccaataatgagcatatttatccaaggagaggaaatggactttcctatttgttacagtctattgctttctctgcacccccgcccagaaacaggtgcttaagaaacattggatatattcactattattggtgatttggtaaatatacataaaaatcatctaatattcacaaagttgttttcattcacaccttccttcacaggttgaaaatgctttgttataactcaggacttaactttaagagagagattcctatttcattgctagggaatgtgaaatgtttgaaaataatgctgttattaataatgctgtcaaataaaaatagcaaatactaattaaatacatgtataacattttacctggctttagtgtgtggtttaaagggaaagaaaaaagtgctgacagaaagtttataatttctgtattcatattttcctcttaggtttttcaaacagaccaaagtcattaaaaatactccttaacccccaaagccacaaaaaagaagctactcaggtctattatgaaaaggttgaaccactgttgaagattgcaggaataaagactgacgtaacaagtaagtattttcagaacataatttcgccttttaaaaaaaatcatacttgaggaagcaagataaccttgagtttgttcttgagtcaaatttaggaaactacttgtaatatctaaagcttgtttatgtgctttgataacttactgcaaccagctacaggattataattcaattattttgtttcaatggtattattttttattggagtatcactattatctctttagacctttttcagactttaaaatttattagatatcatatttaagggggctgcacatgtatcagtatcttcattgagatgctggctgtttgcacattatctctgcagttcagcagtgattgatttgtgctcacttaaatgttagatgtcttccatgaaatccttcattaagtggtttttgttctgactctgacccctgctggttgggtcaaaactcagcacttaactgctgaattagatgaatttggagaagccagcagcttaaaatcattgtctaaaacaagagaggtgcttaggtttgtgcgcaggaaaacagaaatttggtaatgctgaagttcatagaaaaaagagtaaaattctttcagctgttaaaatttggtgaccaaatttctttgattgcttggcggtggtggtttagtcactaaattgtttccaactctggtgattccatggactgtagcctgctagtctcctcatccatgggattctccaggcgagaatactggagtgggttgccatttccttctccagaggatcttcccaacccaggaatctaacctgggtctcctgcattgcaggcagattctttaccaactatgagctatgagggaagcccagtgatttccctaacagggaattgaaccccagccgcaggagtgaaagcactgaatcctagacactagaccaccagggacctgctttgatttcttagagactcttatttttcccaaggggatgaggtgaggagggttgatgctgttgtgaatcacaccctcagttttgctggttttacttctaggtagcttctatttacacttaacagataatatacatgtgtagtgaattttaattgatgaagagtgttgcataagcctactcaggatacaaggccagaatgcacttggaatctcctagttataagttcccaaggaaggtgcccagagtgacctggctttgctcagctgcaaccaagggagatgggtctcacaatgtaaataaggtttaaaaccgacatctcatgacttgatggatgggtatgcctgtgtgcactgtgcccttagtattttggtatttctttcattaaccttggcttcatcttaaatatggtcctttccatcactgtaaaatggttgccaattaatttggttcttcttcattcaaatctagtgggatgggaagaggtgtgcatatgtgagagattcaacatgttttaatcctgaatgaggattaaaattttttcttattaatttgactgtccctaatgtattacgtctgctgcacctggagcgctttcttaggcagcaagacccttcctaggagatgcagtgggaccccttttcctagaggctgaggacacctgaactgaagttgggaaggctcccaacaaggcgcacaagaggaagtctgagtccagattaaggataaatcttcatgctacaattgggagtttactgtttgtgcattgatcccgaggggctttacattttttatcacggtgttgtaatttagtttagcaaagatgattacgtcatcaggataaagagcataaaacatgagggagacattggaggaaagaaaaccagtctatgaggcttgaactaaggtagaagaaatgataggaatgtgctttcctttttagtaattgttttggagagaaaaatattatgtctagaagctttttcccctacaatttaaatgttacaaatattgtatttagtttaacataaaattagaatattacataaatgcaaatttagaatttatttatatatttgtgcagaatggctaattattagctgcctaacactcctgctgcaagcaaaattataaaattacatcttttgcttatgaaaccatttaggtatgtatattggcttaacatttatatttttaaaatgtttcctattttatggaaataacaataaacatgggctatctgaaaaattttatcctgcctatctca

SEQ ID NO: 30495 - DNA, 1250 bp, Bovine  19866881015375
gggtcgctaagagtcggacacgactgagtgacttcacttcactttacttttcactttcatgcattggagaaggaaaaggcaacccactccagtgttcttgcctggagaatcccagggacgggggagcctggtgggctgccgtctatggggtcgcacagagtcggacacgactgactcgacttagcagcagcagcagcaggtgtgtatagggggcttccagatggtgctggtagtaaagaacccacctgccaaagcaggcagacataaaagatgcaggttggattcctggataaggaagatcctctggaggtggaaatggcaatccactccagtggagaatcccatggacagaggggcctggcagacttcagtccataggccacaaagagtcgaacatgactaaagcaacttagcatgtatgcactatggaatctaggttctgaagttcatggttcttcttagattttaattggagctacactttgttcttgaaactcctccagagttttccatttcttaagattccatttcttaaggtttgcccacaaattggtttagttattaaacctagcaaaaacgattgactttgagacaagattaggttttgattaggttctgatttccttaaaagggccaaatttggcagtttttcattggctttgctttccagacaataataaactagcatactatttaagtctgcctcaaaaatggaatgccatatacaagtatgtgtttatcaggtgtgggaagggattttgcttattcttacagtctcaatccagttgaaactgtattagaatgctgttgggatgccgatcagcatttcataatctctcagccacctcatgtttttctgtctaaagcatagcactctttcttctttcagattttgaaaatttaattctgaatcactttactggctccatgaagaagttaaacaaagctgtgttcagcttttcattatctttcaattaattatgatcctctaaacacgttaagcgtgagaatttaaactgtcaaatttgccttctgggatgcttttctttcacaaattagtgtttctctgaagcatcccataaaaataatgatactgacattctcaacaaacaaagcagctgctgttctttcaacagttctctttgagctaggagatataattttatatccataattacatcacaggctgcatttaaaaaaatatttaaaaacttgcatctgtgtcctgcagatgatgaaacttaggctcc

SEQ ID NO: 30496 - DNA, 2067 bp, Bovine  19866881021810
tttagggatgtgggaaatcttgagtttggcctactggaatcctgaagagatactactttaaggaggaaaggccaactctattcttggaaacatttcacagataaatgccaatggcatgtatgttacaaaagaaccagattattcaatatggactaacaattggttagagggaatgtttcaaaagaataaaaactaaaggactcagcgaattttgacctttttctctctctgagaagttattgccaacaatgccatgtagatgaatctactcttaattaaaaaaaaaaaaaaaaattagcctcgtagcagaaactgaaaaagtttaagaaccaaagccgctcctctcaactgtgactttttgttttgctgtttaatgtagaattttggatttcttctggattcactgtaatgaagaatcatctgctgtagtgacatctacaaggacacacttgatttggaaataacttactggcttatagggagtcatcttcaactataactttggaggtaaataaggcgtgatgttattgcttgttttgttatcctttttttttttttaatgaaaacttacgttgactaagaactcctttattatgaaagctttggtattaatataattgactgggacttgggattttatgaaaacactcttttacctactcttgctttgaatatgtgtattcatttaatgcttagttgagaatttaggatcttgttcactattgttctttagggtgctttgaagaaaatttcactgtatgaatccatgaaaggtattaacatctaatatcttggctgttttatgaatacttatgttttatgaatatgcaaggttgtttgaagtttattttttccattttattatcttaagtagagatttctctattgaaaagtataaagctacacagattggagaaacatatcaaggcagaaggatgtcccagtgattcagtaggtattttctctagacattaaagagatgatgtattagacagttcctggaacagggctagagcttgacatattatttttggttgatgacatggttgcccttcacagtcagaggtgaacacaggatgtgaaaagtaaacaaagtctgaaagagcgcttgtgctgtagcatttaatattctttctctgtcagcactgacccagcttgtttttctaagggcctacagtgtggtgaggcatcaggaggcaataatggactgtctgagcatgggaaaacagcaaagaaagatgagatctgaagtggaagtgaggctcagaattggaagccaaagtgtactttgtcagttaactacttggggaaagtcacataatctgtgagaccaaaaaaaaaaaaaaaaaaaagatataaagaaagaagaactggaacctagataaaaggatccagattgtatacaccattggcttttccagtatcagttctgtgttcctagctcatggctgggaacagggtcctgagggcatccaaccattacttcctcaccctgaataactgggtcacctggtgtgaccatatcctgataccttgtatccctaaactttttggtctctggtacggtggaggggccatctctgtggtaaggttagctttcctaggattactacaaattgctaattatcattgtaaactacatcaaaacctaataaagaattcctttgggcagagcttccagaaaccatattctaatgtaagcctcaaaagtaatggcatatgtgaaatactagataagagtctctgtgcgtctcaattgcctcttttagtaaatacatcaatctctactgatgccctgctgttaatactaaatgagatcaagcatgcatgacactttgagaggaataaggcatatatctgtatttgagctggataacttattttatgataagcagagaaagagcctcagacaaggcacctatgtgaagcatattccacgagaaaagtaaatcttgaggcttggtgcctacatttattcgtgggagatgcaggagaggggggaggaggagtgcaggaaatgggaacaggactaaataaataaagtagtagcaaaaaatatcaaggatt

SEQ ID NO: 30497 - DNA, 1494 bp, Bovine  19866881031135
aaatgcagaagtcataatatagttgtgggaaaataaatgaattgttttatgtatctgattctataaagatactgtttttcttgggggctataaattgtagatttatagatagagtataagaagtagtatggtagtaccaagaactttgaaaattcatatatttaactcagtaattccacttcttagaaatccatccaaagaaatgaattaaacgtggacaaagatttatttgtaaggatgttcactgtgactgtaaatagctatatcataaaatgcatggccatctgatgcgaagagctgactcattggaaaagaccctgatgctgggaaagattgaaggtgggaggagaaggggatgacagaggatgagatggttggatggcatcaccgactcaatggatatgagtttgggtaaactctgggagttgctgatggacagggaagcctggtgtgctgcagtccatggggttgcaaagagttggacatgaatgagcaactgaactgatctgaactgaaaatgtgttatgatataaatattaaatcattggggatgttacacacagtagagtatcctgtagcattaaaatcattaagactgtttaattggcaaagaaaaatgtgcatgatacattaaaggtagaagacaaaactacataaataacagaaccccaacttgaaaataaaacaggtgtgcactgactcaagactagaacaaatacataaaagtaccggcattgttatgtctggatagtgaattatgggtattttaaattttcctcattagttagcattgtcaacatatattttaaaataggcaaataggaattaaatattataattatatataaatttatataattgtatgaattatgtttatacataattatatatatttatataattttatataattatattattattatattagcagaatgcatacggtttgaaaaggctgaaaatcaactataacgtctttaaacatgaaacactgcaaattccctagctcctcttgagaatgtcactcatgtgttgggatttcttttctatactgaggatatggcaacaaattccaagaggaatcttgacactattcagttcagttcagttcagttctgttgctcagttgtgtccgactctttgtgatccaatgaaccgcagcacaacaggcctccctgtccatcaccaattctcagagtttactcaaactcatgtccattgagtcagtgatgccatccaaccatctcatctcctgtcgtccccttctcctcctgccttcaatctttcccagcatcagggtcttttcaaatgagtcagttcttcacatcagagggccaaagtattggagtttcagtttcagcatcagtccttccaatgaatattcatgactgacttcctttaggatggactggttggatctccttgcagtccaagggactctcaagagtctcctccaacaccagagttcaaaagcatcaatccttcagcgctcag

SEQ ID NO: 30498 - DNA, 778 bp, Bovine  19866881037668
aaaaaataagaggaaattttgaagtgcatgtttatgccagtgaaaatgaattgtaacaaaaacattatgtccattgaatgaatgagaattgaagctacgagcttgcttctgacaagattgaaagacttcacatctgaattattttaatgactgtcttttgatttcaaagtaaaagttattacctactagaaatacatattttttccaagaatcaccaacagatgtttgagacattccaagttttagactaatttagggatttttccacatactgttgctctctgcaaactcagtttgtttttcatcttgacatcatttgcgttaaaaacatctagttgtcctacagtatctcttttttcatgaatggaggtcatcaagataaataagctatttcaataaatcattttgaagaactaattattgttttattatattgctaatgctcaaagtgttcatgtaacacttatgctaccttggttctgagaaacttgaaaacaaggaatgtagtgaaagcaaggacactcttttatgttgctcaaaggcctatattgaacaggatgacctgctgtgctcttcaaagccagggggaaagattattcttaacctggtgtgaaaccagaaactaatctgtgttcaattagcatttccaaaagtctagaaacatcttgaaatgtatcatttagtatgtggcttatatttagtaaagttcatattcatattctaaagatgaatatgatttattactcagaaattaaagttaaattttcatttcagtaaa

SEQ ID NO: 30499 - DNA, 1140 bp, Bovine  19866881039054
attatttgtttaaaggctagtgaagtacctaaatatacagaaaactacttaggaaataatgttcatcagcagacaatactgattcaaatgacaactataagggacaaacatcttggctctctactcaataagacaaaatatgtgcctgacttatgtctgaaaattcctagcatacactattatatataacatatatgttaaaaacccaatctaattgatgttgttaatctaatcaggattgcctcacaaaaaaggaatacatatactattaaaaactgtcattcttgacaaaggacaaaacaaatctgtagctggtaatcacactcctttctctcaaaagaagacaataattaatttctcccctccaacctaataactgagtcctttacctcacagtggaacaaaatagagctgcccttacacataaaatcaaagtttaattctgaaaatactaaaggaacaggaaaacatgatgcattctatggagtccacttttcctaataaaactctctcagggaatttaagaacaaataaacagaaatcactgtccatattgtgaaattaaatagttggaaaaaatgttatagccaatctttattatttgttcttcctaaaagcagttaaaagtaagatacatggctcattcacttcaaacaaataaaacaataaataatggtatgatacaatttttataacactacttgccagaggatctcagtgattaaactgttatagctcatacaaaccggcattcagatgaaagctaaagaatggaagagcattacctgacaactaatacagggagaaatgatgtttctgtatcatgctttctttgcagctactgggttatcttgctgaaagaaaattttgcttgaggaacactagaaagaacactggtctggagcttttgttttggctctgatcaaaaaatgagacctcatgccaagtcactaaatcactccttgattttattcactaacaacattgggggctaatagttgctaagtccacaaaggccctgtcttttatgatgtgcagttgaagtagtaagtcttcagtattaagtcctaactcagggcactcactaataaagaaatcagtgggctcacttctgcagaggtacccaagacacacagcagt

SEQ ID NO: 30500 - DNA, 1425 bp, Bovine  19866881049077
acttatgattacaggtgtccataaatacaactcatgtcactcttaaactctggttgtcactatgatgagaaaggcacagcctgaaggtaaattattttcctaagtttgagtttaattcattcagccagtttgaattttgagaagaggaaaacatatgcttccttccccagtggcatttttacactcaaataagtcaaaagtaactattctgtcaaaaattcaagtaatttaaataatggataattttgaagattcatacatttaaacacacatggatatttcatagcatgtttgcaggtatttcgggttttcaaatgtgaccttggggtttgatttcattttatgttctctgttctaagtttatctatctttaagcttacaataacaattaaaaattaaattggccatattggagagataatttacctgtgatgcagattgaaacagaaataattcagactgtatttataaagcagtttgcctctgtaaacgccaatgctttataaaaataccatctagtgataagtttgaaattattgtgttgattgcatagaaaccaactatatgcttctgtgacttgaatgttcacagaaatcccccatgatcttgttaacattcagattctgattttgaccgtctgggataaggagaaggttttaccatttcagacatccagatgatgctgaaattgcaggccagcaggtcacattctgaatagcagaggtttagagaactataacttttctttaagtatttccctttttacttcacagtttttgacttattcatttagaattttaacctttagaatagctaagttacgtaaaaagattgtacacttggaatttcccttagaaatcgataagaactgctcactccaacaaggctcattttgtttgttcctctgtctctggaacagagatagagagccctgattatttaaagaccaactcttgcagcaaattttacggtatttacgaaatgtactattgtgaaaatctaaaaaatagtcacagattcagaagatatctccagacctgaccaacaataacatttttggcgacacatagaggaacgggaagctgtaatgagtttcttttagtccccaaagcaaccacaaactatatttcatctgttattggaacaacagaatcaatgtcctccagatgagccagcaaaaaagacaccattaaaatgctattggaacccatgaattgaaaaatggtgcagactaagagtgtaatgatacaagcaggacactaacaggaagccaggaaatcttaaggtagatcttccatagcctcaactctactaaaaaaaggatgcaaatacacatggaaatagtttcttctgattttgtatttctagttttaaatttattctagtgaagagcaaaaaaatctacctcaagagattctgacactg

SEQ ID NO: 30501 - DNA, 2118 bp, Bovine  19866881174491
tatgttaataatttagtgaatatacaattagctgtatattaatgattaatagtcctgttttcatcaactaaaatatgaatatgattttatcccctttgttttaccacttttctccaagttataaaaatagtatttttatgttcaataatatgagaaaaatgtgacaagtgaaagatcgttctaaaggtgctattagtctgcttgtccagttcagccactgccatttcatccattgttattagtacttatttatctctatctccaaggcatgaggatatagtttggaagattgactagatttcagttaagtagaagacagacaaactgggtttggaagaccctttgagttgcagaaagttggcacagttaaaaggcatggagtaattcccaaagtaatttcaatcactttgaaatcaagtagttcttgatatcaaactgacatgtgaccaaagaaagtaaaagcacatggaatcatcagggaaaaggtatcataaaatcataaaattttacactcatcacagaatttggaatgccaaatacttcacttataaactcacctgatctcactctatactcaagatatatatcacccatcactcaagacactctgttactgatcagcagcagttacaaactgatttgtctcttccaaacccatctactataactctgctctcattatcttgctaaaatttcaagctggatccctaaggctcctaatagtcttgatccaaaaacattcattccccaaaccacaccctctatatcaagccacagcgatcttcttaccattttctcagacacatttccatctttcactatttcatgactttatatatgcagttttgtttttctcaaacatgctgaccttctaacacactgatgaacttctcatccttcaaaacatttcagccattttttatctttgacaactttttgaattccaccaaactgagttattcttatcttccatattcctatagcactttgcatttctctctcctgtaaaataaatatcatttttttagggtttatatgtctaggtccctcaggcctcatgtcacctaaaggtagacctccatcttattcttctttggatctatcctaaacttaagaaaaatttggcccattgtctatgctcaacaaataattattgactgggtaaatgaatgtcaactgaatttctggtatcctgacataatctctgagaaaggaggggtctttaacgtgtgttatatcttccttgttactaaaaggtgtgtcttttgagatttgtgcatatactgtacgatctaccttcactttaaacactaaaatgaaatttatagttttccatgtttcatcttgctttagcttaatttgtgtactggtctttataagtgtaaattaaagtcttatgctatttagggaagctgagataatcaaaacccctgtgctttaaaaagaatatcaatattatttgaattctatactattctgtttattttaacatttttctggatatatttttgaatctcattgactagatgtccattttcaacaccatcacatcatatactattcacaggagtgttttgtttaaaaatgcacaaaggtatcttattaaataatgtcacaaacatgaagttcattattatgcaaatgccatccttggaacagatttgttaattgaaactcatttgcataattaatgaactcccaaatgaattatgcctttgcagatttgtgcagcattgttttaaaataaattataaaatacatgtcaaaggaagagtgctttctgggttcccatagcattgtttgaaaattaattaccaaatgcttgtcaaattaaaatgagtttgtagtttttacaatgttattttaaaattaatcacaaaataaaatgtcactgcattaaagtaaacaacttgttattttctgcaaaaagaaccacagaaaatagcattttaacttcaattatattggttagtatagtgattctagtgttttattcatttcatctttacactgtgacttaaaattggtagttgttagcatgttaatgttttgataaattgagatttaatttaattttattaagtggcttattttatacagttgatgattaatgcattg

SEQ ID NO: 30502 - DNA, 1536 bp, Bovine  19866881219577
agcttttagatgtcttgagtagaatgacttaccctttcttaagtagcatccttgcccccattccttgtacattttaaagtttggagcaaagcaaaagagagattaacgtccaaaattaattacattaatttgtccaaagtttaagctttgccattatactgtaaatctgtatcatgtgtcaatcatatttaacagatcgtctcattttaatttaccatcctctactgaatactttaggacagactatgaccgggtgagacacaactaagagatgataaatggaccaagctctagtctagtttatcatgaaggttaaattaagcacacatctcttcttttagtttttctgtatgttttgttttaaaatttgagcaccaagtatgaactgtttgtgctgtacgctccattttccttcaaaactttatgaagcccacactgaatccctgacctgcaaaaatctttcaaaattaaataaatctatttcctgcttatgttctattttatgaaaatctttttccttagtggataacataattataaagcttcataacataggtagtacatatagatataaaacagtaagcaaggtactttcaaattcagcgctaatggcccatttttgtaacatttactgagcagccactatatgctgggcactgttaggtactgaaaatagtgatgaacagaaaagacatgatctttgccctcacagaggctgtacaaatactgcacaaatatcacaaaattatgaacatgaaatgaaaagagaaagtgatgttgctcagtcgtatccaactctttgcgaccccatggactatagcctaccaggctcctctgtccatgggattttccagacaagaatactggagcgagttgccatttccttctccaggagatcttcccgactcagggattgaacccaggtctcctgtatcgtaggcagatgctttaccgtctgagctaccagggaagtcttgaaatatgaaacatgaaataatgctggttaaatgcaaagtcatttacacaagcaggttttctcccaaaaagagtacttaacgaactagtcctttgttttatgttttgtcctaacacatctagggaatggactatattcctttcagttaacactggttcactcaagtaataaagggagagggaggggaggaacattgtggactaaatctcccaggtgattttaataagcaacattcttaagaacagaagcagaagatattaagatgtggcaagaatacacaaaagaactgtacaaaaaagatctccacaaccaacataatcacgatggtgtgatcactcatctagagccagacatccgggaatgtgaagtcaagtgggccttagaaagcatcgctacaaacaaagctagtggaggtgatggaatttcagttgagctatttcaaatcctgaaagatgatactgtgaaagtgctgcactcaatatgccagcaaacttggaaaactcagcagggccacaggacggaaaaggtcagtttgcatttcaatcccaaagaaaggcaat

SEQ ID NO: 30503 - DNA, 1311 bp, Bovine  19866881224844
aactaagagtcgtatgtcctgggtccagctttgccttaaattcaaccccaagtaatggtttctccattttactcagagcctgaaacttactcatttataaagaggcttctgacacaactggagttttccagtgagcaagggttaaaaggtcggtcagtaataatgttacctctaccctctgaatatgaaactgctagagttcaaaggtattttatctatcctgataaaaacatctcattgtttttcacaagacactcaaaagtaaggttcagaggggatgtacggctggcgcattatgacactaacctcttctagcgggagatatcaaccacttcattggaagccaatgactgaaaaatacaaggaaaaacatgagacgattgtgaggtccaaagaaaagggaatcttgttatcccaaataagcatctttaaaaattactaagttctattgttccagtgatgaaattagtatgtctttgttgacctaaacttaaatttgacacaatgggtaaacttgagcctgaggcttttatgccattatcagagcctctgtcagtgagtgctttaacctaattacatttgatgcagcaaatcaacaaaaccactgctggttatgacctctgccaagagcactagtgagctagacaaatggagcttaagatgctattagttgttctgttgcaaagttccagatacaaaccgacaggaggctgttgcatgactggggcatgcatcctccagatggcattctgcattggcttgtggcaaagctcacaggggtactggcacattttctctgtcaaaatgaaagttttccaattacaaggagataatgcgaggagatgcaaacttaatctcttgaacaaaaggttgcaagctgtgtaatagccatttcaggggagagatttcactgtcgttcaattgatttaaacattgcagatcaccaaatgggctatctttcctaataaaatcaagaaatcagctgcagttgattttattccctggaataatgctgtaatggtttcatcatttaagggagaattcttttaaattagtgctcttccattgaactgaaccctgcaattatttttttttcccctaaattgttaacaggtacaaagaaggcagttttccctttagtgaaacacccaatgccttaaatgaaggcttcaggtgtgatgccataacagatccctattggatactagatcacagaatttcattagaaagattagacatgttaaatggtaagaaggcactattagcattaaaacctggagacagtttagcaaaaacgttgcttcttcattt

SEQ ID NO: 30504 - DNA, 1472 bp, Bovine  19866881243030
tggggaaatataaaaggaccctaaggataccgtggtaagtgaaataagtcagagaaagacgaaagccatatgatcccacttatatgtggaatatttttaaaaattcccccaaacaaacaaatcaaaacatgtagatacagagaacaggtttccagaggtttggtggtggggggtaaaagggttgaagggtgtcaaaaggtacagacttccagtttaaaaaaaagattctcaccacattaataatagtatattaatttcattttggttagtgctgaaagtctaactccttctaaatatagatcggcatcttttgaaatagttgagctaaaggagtatctcccctctgctgctactttcaatgcagtatcttatctaataatcatatcagaagacctgaagaaccttaaaaaagagttatttattcctaacaacttgatacatgaatcaaagagcaagagtggaaagcccattctggcatatgataccatttctttctcttcctctcaaagcagagcagactttaagaattacgaggggaattctggacatcataggataactcagagaacaatgagattaaaaaagtcaaggcagcagagaaattaaactggaaagaactgtggaggccatctagttcaatttctctcctgtggtggagtgcaggagtgtggcattcctagtggaagaagtgccgctcctggggtgctccacagcctgggcctgggcatcgtgtggtggagtcagtgcgtgctgttactggacaatactgatgggcgttctcaactgcagttcagagtcactgtgcccctgtacatattagaaaaaggcgcctcctctgtcctcacttactaacaggtgctcgctcttctgggctgatgtagtccaaagtcacctaacatgttgaataagagtattagctggattgcagacctacttgaccctttgccaaatgtctgtgggaaatgcacactgcaagaagaacttgtgagctgatgtttgcctccttgtgactttccgcgctgacatttatcttttgtgcctgctaacttgcttcagtgctgtccaactctttgtgaccctggatgtagcctgccaggctcctctgccgtgggggattctctaggcaagaatactgcggtaggttgccatgctctccttcagaggaatcttcccgatcaaggatcaaacccgtgtctctcaggtctcctgtattggcaggcgggttctttaccactagcgccaccataaaaagtaaatggaataagtgtgtcccatcttgtgtgtacagtcttggaggtatttgcaaacagatatcatgtagtcccttgatctcacttgttcaagacaggcaattccattttcttcagtcaatctttatagtcacacagctcctagaccttgttatgttcatcatcagtatcgtggtcaaagacacttctctgaatgtagctttgatctctgccagctcaggg

SEQ ID NO: 30505 - DNA, 667 bp, Bovine  19866881267828
ctgacctactaataaatagaacgctttcaagttcatcaaaaggctaaatcagagggcagaaatgttaaaatgagcaaccagggaaaaaaggtcctttgtagacacagacacactctaatgagaaaagtgattctgttagttaaaatgccaagccagtggttgatatgcttgggaataaaaccaagcattattactctggtaggcagatggtgctttttttttttttctctcttaattcaaagcttcacttttgtaaataacaatggaaattgaacaactggaacacaccaagctttgcagactgtgttaagggtgttcagaaatgagtttccttaacagtctctgcctttggagtatttaaatgtataccgacttgcagtatgatttattcagtatttcacatctgtgtgttatcctttcattctgggcacagatgcccaggaacagggaccttatctatgtacatggtgggcacacagtaatacttgttgaataaataaaatatttagacaaacttggatgtgtgtgtggcataccagatatggatccggtattcagcagagaagagtcaggaagggtcaggaagtggaatttgaggcatgtaaccttgagtggattcccagactggagagagactgcacatatgttggatatgaaatttcttttt

SEQ ID NO: 30506 - DNA, 2016 bp, Bovine  19866881290297
ccactgaatgagaaatcagtgtggtctacttgcatttgagctttattcaacaggtagtttggggtaagcaaagattttacatcatagacgtaggactagaattgatctctaggaaaataaatgataaatctgacagtagagggaatattggggatagggaatccagctagtgaatattttaacatggtaagaaggaaggcttgaattgtgattgcagtgttgaaaacaaagagaaagaaacaaatcagagataaattccggaagtggagtcaattgccaggtaaccagcagtggaaaggggggggtgactaaaatgattccaagcttcggaactgaagtgatgctagttccattaatagatagaaacagcacagaagaaggaggaagagaatgtttcagggagaatatgacaaattgatcagctacacatttgtcatataagtagagataatagattacctataaaattagatatgtgggttggaggaaataaaaccttggcaattccctgatatcatgtctgctacttttctgggtttgactataatcgattaaaatgaaaggtgaattacagttacaaacgtatcctcccaagtttactaagaattaagtacaatatggtcttaatcctacaatactctcatctgtgtagcctcctcctactcacatgtgtttcctcacctgggtctctaactcagcagtcttaattagatcctcagcaaatagagaacctctgtctctcccctttaccactatgtgacagctggaaaaggttctgaacccagatagcttctttgtctttctaaactctgataattaatcttttgctggctgacaataattctactgtcttcatttcacagacccaaactcatatggctttgtagcacttcagataacgtattgccaagttgaaaaggaatggaggtactccttcaggcttctctagcttcgcctgtgctgtcaggccaacattttcaacacaagtaagcagggacagatggtgcctgttccctctgtgacagattcatccagcagtgtcaacggcatttacctttttgagacagagagagatgcttcatgactaaaagtttcccaccatgtgtactccagaatacagaaatgaaattctaaaaacaattcatgtccagttgttaaactttaattatgtgaacatttagaaataaactcactctgttttattattaagtgtccaaagacactttctagaaggatattagtgtgcttgacttgaagatgtctatactattgattatgcaaaattcaaaattggatacactgtcctataataaatctcaagtattttaaccctctgtattaaaactgaaaaaggaaatgtgaaatactgttgaggaaaaatttcactaatttagataacataacatatatcttgtattttatgaattttcatatcctttattttacatattactgtaatgaattttttgattgtttctatacacgtggccttaaatcacctgcttaagtaacatataagtttgatattaaagacattggaagctttccccaacctatccatttccttctctgcttcaaggatagctagtattaatttttaaaatataatttgaaactctggaagaatctggtggcctgaattttagttgcaattctgaaactatttgcataatctttgcataatattggcaaactatttgccagcttaattttctctgaatctcagactccttgtatataaagggtaaagttattaagctaagctctccccatttttgaaattctattactaaaaaattctattggtgatcagatgaaaatagtaaacagataatgagaaagtttagttacatataaaattttatttttcttcatgaaagttatattattttttggtttaaaatataaagtaaaaaaacctgtcaagttggaaatgaaaatattttaatcttgaaaataccagacatctccatatagtttatatttttctctctctgaacatttgtacgcacaggg

SEQ ID NO: 30507 - DNA, 570 bp, Bovine  19866881301408
ttattaagaatagcactcctaagattgttaccttgtgtctgaccacagaaggagaggtaaagtacaattacagccaggattctccaacccaaatgtgcttcttaagtttgtttatccagtcaaaccacatggtacacagctgtgaactatttagagaaggtttactggacactcctctgtctaggaatttgtttctttctttttgatttttagcctcattattgtactggggactactttatatgactacattaagtgttttctgaacagctgctatttctaagtagttctgatgtctttgggggcatatttccatcaaaagccaaatttccttgaaagggattctggttcaattaattcatttagcatattgagtatataagttgatacaaacaagaataattattgttttgtccaacagtgacctggatgctggggctgaaacaggaaatgggagacacaggtggctgcttttatagagagtacatcctggtggggagacctaaagtcagtaaacatccagatcattaaaagagaacaatccagcaagaactgatatgcacatacaga

SEQ ID NO: 30508 - DNA, 1256 bp, Bovine  19866881315049
atcataaataatcatagcattgttgcagaagcacactttatagtggttgtaaaatgactccttgggagaaataattcacatggtaaacatatttagtaaaaccaggacattttgcccttactgcaagtggatttttatttcccttctttcatgtacttcttgtctgagctcagggtgatgaatttgtagatggcaatttcaattgcaactctgtctctgaggcactgaatcttggttattgtagttctgaagatgagttttattttctaaatataaagaatgatgcaagattcatttgaagtttgtaggagtgatgtagattttatatttatgttcccttgaagtaagtagataaaatccttccagaagaataagttactcctaaagtataaatgaacacttgaggaattatataaattatttcaaataccacttatgaattattgctcctgtgtaatgaatgacatttcagaagactattagatgtagcttgttttgcaaggaaacttttttatttttcaattttttacactgaggtataattggcatacattatattagtttcaggtgtacaacatgattcaatatttgtgtatattgtgaaagtgtcaccaaaacaatcatccctcgtcatacataattgcaaatttttttcttgttttttttttaatttttttaaatttttttcttgtgatgagaaattttaaggtctactctcttagcatctttcaaatgtgcaatacagtataattaattgcagctccctggtagctcagtttgtaaagaatccacctgcaatgcaggagactctggttcaattcctgggtcaggaagatccactggagaagggatagggtacccacttcagtattcttgggcttcccttgtggctcaactggtaaggaatccacgtgcaatgtgggagatctgggttcaatccctgggttgggaagatcccctggagaagggaaaggctacccacttaggaattcttgggctcccctgtggctcagctggtaaggaatccacctgcaacacgggagacctgggtttgatccctgggttgggaagatcccctggagaagggaaaggctacccactccaatattctggcctagagaattccatgaacagtagagtccatagggtcacaaagagttggaacatgactgagcgactttcactttcaccatgccatacattacatccccatgacttatgggaattttgtattttgatcttcttcacctgtattt

SEQ ID NO: 30509 - DNA, 950 bp, Bovine  19866881339494
ctgatagtgcttatcttttggctcttcagttgaacttgattttgatcttccaaaatgaaaggattggaggggtactaacttcacattgcttgcttactcacgaaatatgattttatcaaacatgaggaaaaccacttaaaactgacatttctcttcaaaccattggaaaattctgtaagattttgaagcctgcaggatccttacctcttcagaatgtaactcagaggaagtaagccttgattcagagacaaatattgctaattaggaattccaacctgtaggttccaaatccttaaatctttctaataaaaggagaacacagtttcaatatgaaattctattttttttcttttataagggcagagatgtttttcccatgtttgagaaagtgtttgggatttccttacttcagttaagacataaggctgaatcccttctttgctatttttttttcccttctttgctatttttgcaagttcatctttgagtatgtaagattatcttctaaaatattagattaaagtgtgattaactgcactctcctaaatattatatataatctttaaaaaaaatcagagaacatgagaactgagctttgttgtttcctttaaaaaataaaacagatgttctttattaaggggacataccataatatgtcacaacttttcagaattgtgtcaagattacatttcagatcgccaagaagatatcatatcagcaaaatacttagatccaaccaagcaggcagataaaattttacaggatataatactaacaagttgtatagttcaagaacaacttttgaattcacttaaaccctagctgtgctatgtaagaagacaaaggagcagtgagaacttagctgggtttcagacccataaagctggctctcagtagcatgagtcactcggagataaaggcatccagtgatttacttgaattattcactg

SEQ ID NO: 30510 - DNA, 722 bp, Bovine  19866881371776
gtaatctgagagttgtcacacatgtagtgcatatatatacttaacagctccagggcaaaaatctaggcttagttttgacgtaaatgtaagcactttttgcttctgtacactgctgcttgagaaatctggtaaaagcattcagagttgtttcatggtctgtaggtgcattcctagtgtgagtgtatcccgtctttttgcttatagtctcttgaaggatccagcatactccatggttttagaacctggcaaatgaggttcagttggtgaattggagaaagaagagttttcttctttgccttgggggtgctaggcttgcattagtgtattttttttttttttaatcattcagacagaatcattttcttttttagggagcattccccaagttgccagctcagctctcttctctctttccttgtaaggaagaaggtcagggaatgaatatgatcataacagagaaggcacatctttgttctctgactcgtagttccttgtgtaaggcttttctttgagcaaaggaatgactttaaatctacctctctttttttctctctgcctattttggagggatttggaccagttctgccagtctgaagtttctttcctgcttcactgtcccagagtaaatatactttgtcattctgtttaacttctagcttgtctggggaaaaataaagacatctctagtctgaaattgcttttgggagtaagctccacatgtt

SEQ ID NO: 30511 - DNA, 613 bp, Bovine  19866881373571
aacccccaaccccacaaatcgcttagagctattggatggagctcgacgcggctgtgatttggggagtgatttagcaccagacttccccaactcggtccgcctgggctcttttatttattatttacgagctcctaatccctccagggcgtgggcagctcccctcatggcgcctacagaccccaagggacttcatcttcgattcccaggcaagagtgaggggctttccttaaaccatccatccaacacccgtatcaccaacgcaaaatcaactcagctccaagtaatggctggagcgggttactgacacaattgcccaaggctttgtgtgtcagatgggctatgtgtgtgcctatgggagtgtgcttaagtgtacagtgtatgtgactgagtgtacaaaagaatatgtgtgaatgtgcatatgagcctatgtgatcgttaatatctgtgtaatttgtcagtgtgaatgtgtaagttttgtgagggggtgagtgtgcacgagtgtgtgttcgtgggttctcctgctctcaggtgaggaccataaacagaggggactcacacctgtttcagcggattgagaaagagcatgctgtctaaaggggaccgcaacggggtg

SEQ ID NO: 30512 - DNA, 1216 bp, Bovine  19866881374403
cgtcttttaacttatggttgcggtcaccccctggacatttggagaagggagcaggagctgcgtcctggtggccacagtaactgggagaggccctgccagcatgaagctcaaagatactcagtgtcttctaaagcaaagcacgtgctgctgcgcaccaagttgctccagtcgtgtctgactctctccaaccccacagactgcagcccaccaagatcctctgtctacaggagtttccaggcaagaatacttgagtgggttgccatttccttctacaggggatcttcctgacccagggatcttccgcgcatctcttacatctgcattagcaggcgtgttctttaccactagtgccacttgggaagtccaaggcaaagcacaacgcagtccaaaatgccgaaggggacactgataagaaacactgtagatggacagagaacactgcttttcttgtatatttagataaaataaagttcatttttaaatttaattcttgtgattaatttgattctgataaaggtctctgcattccaccttaatctattttaattgaaaatttaaaaacagacatatagttctaatataggaatttcagttactaagacattgattatcccttcacaaattaagatagagccaggagaatatcttatgtttaaagcgacagcttcaagaagtattcagttttcaaaataatacctagggcaatggttgagttgaataacacctttgcattgttaccaccaaatatgtccatgcaacttctatgcatgcaaagtttcctaacagcggccatatactgaaggaccgcaattgaatgaaagagaacaaatacaagttcatgaatcagaaaaggataggtaaccaactcactattttgaaaaggagcaaaaaaataaatctgataaacaagaggaaaaattaagcacttattctgccttcactatagaacttaccagactggtaaccaaatagaagacgtgggcaagtttctctttagacaagtattccagtggctaccagcatcacaaaaacacaaccagattttcaggtgtttcctgatgaaatagttcactaccacctatgaaagcagttttgtcaaaagaaaaaaaaagggggggggggggtaatcaatcctgaatatccagtacctaactcccaaatttacaggaaacgctgaacaaaaagatactaaactttgccgtcagagtgcaacaag

SEQ ID NO: 30513 - DNA, 1328 bp, Bovine  19866881384544
ataaacatgctcctgaaggcatagtttcctgtcgtaatattttaagtcagttttgttagaaggcgtgtctgagatgattgttgttgaaataaaaatgtgaatatgaagattgactacgaaggactagtacaaataaatcatttattaaatggaaaacatttcaaatcttataaatgtgtagagtttttgtcctctaagtcctaatgagagaatacatgagcttaaatatacagaaatacatttttaaccattggtctcaaaaacacataaagctctactttgatgatgtgacatcaaaataacataaaatcctggcttaaaagatttgatatccaaaatggtgacttctgtccaccattgggcaatattgtcaaataactttaatccggtatcccttctgtgtctttcatgctttttttttttttttaacttatcctgttcctgagttttcatggtgttttttggtgtatattatcatacttattatggcacttgccaagcagagatagctggttgaacacaaactttcgtctatcctgaaggtagaatagtattccagattagtgtgcagatgtagcattaattctcagttgaaaaaatagagaattttaagggtttacaggttatatggatttcttctttctagttattaattattaaatactagatttcttacaggagttaatttacttttcaatatttagattggtcagcagagtataaatgttttcctctggctgggatagttattaaggtaattccctggtcatgctgcaggtttgtggaatatggggatatgtcttatccagtccaaaagttggaaatagagtaccatcttaaaatgtgtagaatgaaactcttagcatagaagtaccgttgctccaagataataaagcaaagcatttcgaattgtacatagccttacaaagaatgatggactcctgctagagtacttgtcagtagaagtcttaaaccagcgtaaaataaaatcacgctttcacttaacacccctactctccaaataactcctcgttacaaaagtacaccaaacaggcttaggcccgtgaaaacctctgagccttgaatattaaaagcagtaactaataatatgaactggagtcaagtcagtgtgatgagaatgggggattttttatgtaagctcttgaggatttctatgtaggtgaagggtagaaagtagtttttacccacttccaccattgtacgttctgtaccctagattaataaactctcgatgccagaaaagtgttcatcatactgaatatcaggatatttgggggatgcgattcttgaacttccttcatttgcta

SEQ ID NO: 30514 - DNA, 874 bp, Bovine  19866881495282
caataatcgtcagtgaccttgtggaaacattcctgggttaatgggcagagcacatttcagccactgcagcactactgctcgcagggcatccagcacgtgtctactgggctgaccagattcacacacaaacaccatttaatagtttgtgccatttgcagaaaatcaacaaaaacctttaaaaaatgtttgaccttatatgtaattttaaaacaataaagacttttgaacccatagatctttacatcttctataatgagaaataccagaatacactctccatgttaaataattcttccagagagcaaatttaacctgacctccctaaatggctacagatttgacacaccatttagaagcctgaaaggaaatactgatttatttattctctaaagcagtgctgttcaacagaaatacaacatgtgccacatatgtaattttaaattgtctagtaaccgtattaaaacaggaaaacaataaattaattttaaaacattttacataccgaaataaccaaaacccaacatatcaaaatattagtatttcaacatgtaataaatattttttgaaaatcagtaaaatattgtgcattcctttcttcatattgttttcaaaatctgatgtgtattttacacttacagaacatctcattttggactacaaccgaagtggtcaacagccacaagtggttagtggctgcattactggagagtgcagctagctcctgagtactactttgatatctgacatactactatctgtttaaaattagctcacattcatgtttccgttttgaactgaaatgtctgataacaaatattaatataagcaaataaacatcagatcaccttatcagaggacctagttaacatacaca

SEQ ID NO: 30515 - DNA, 732 bp, Bovine  19866881569333
cagcatagttcagactagccactttatcagtccttaatagccacatataactaatggctgctgtattgggcagcatggatttagaatgtttgccgtgtctttctgtcatgggttaacttgtcttttactccctctcaccactgtttattatgcatagatttcaagaactggggcacaccccactttgtaaaaggaagattaaaaacccttcttggctggaggtaatcagatgtgaaaggtcctaaagaaagctcagtacccagtgtagaaatgcaggctgttttccaagggattctgccttgaaatatatctctctgcccgtgattcttcactattgctgtcttatggtagtatgtgcttactttttgtttgagaagggatctttttgagaatggggagtttatcttgaatatcacttttgtaacaggaagtgtatttggtttaattaggattcctaggtggaggagtttatttagtaaggaggttacagaggacttaaaatgtatttttattgcccttctaagttgaaatgtcatttgttataagtttaattttttacattaacacctttaaagcaagggtgagtgtatgtattaggctggccaaaaagtttgttcgggtcccccttatctatgtatcttatacagtgacaaccaaggctgctgttgcttcttggccttttgttacatgtagtttgaaggctagtagtggtatactaaatgttaagatata

SEQ ID NO: 30516 - DNA, 772 bp, Bovine  19866881631545
tatagaaatagcagaaattatacagaagtttaacaaacattttaattttaaatgcaagtatttcagaggaagaatttaagatttgcttggagagatttttttcttgcaggctttgatattaaaaagttagggatttccatacagccaacaaatgatacttttcttgtcattttaaaaaagaaaattgtgttgactaatcttttttctttctaaagctgcttattctaaatgtctgaatctgataaacccatgagccccaacttaacccaacctcagtgaaacttaaccttttctctctcctcacatctgtggacaatgggcctcagctgcagggagcatttgagaagcttgcctaaactctaggccagctggaaagtcaggctcccctgctttcagccaaatagacactggcactgagttacctgagggcagaggtttaacacggcttgaatgaagcttggatttgagagtatccatcccctcaggttgatgtcactgggagtccaagactcttctttcattaaccagcctctcacatggatagcaatggtgacgcaaaacagccaacccctaaaacagttggttcttttttattatttgtaattttgtctatttgcatgagagcctggcagcatatggcctgatgaattaaaaaaaacaaaaccctgtacaaccctcatctactggctagagcctccagttcgtggcatcagtaggggcttgtgtggctccacctgccacttgtctggagagtcggggcataaactgatga

SEQ ID NO: 30517 - DNA, 1944 bp, Bovine  19866881696793
ccatttccttctccaacgcatgaaagtgaaaagtgaaaagtgaaagtcacccagtcgtgtccgactctttctcgacccccatgactgcaggcccatcagggctcctctgtccatgggattttccaggcaagagtactggaagtggggtgccatggccttctcccacattaattagactattagattgcaatttcattctgtataagaattttcatgcatagttttgcataaaatttgttgagccacatgcctcgaagtgattcttgccataggactcctggcctggtaaatgactaagaaatcatctagtctgattcttaaaactttgtaggtgtgaaaactgacacccagagaggataacagatttctcagattatagacttgctttaaacattttgtacagtaattttcattcacacttaattcttcatgctgggagctgacaccatcttatatgtaatggtcaacttttttacatccctcaagtgtacttctttttcttacattacaggtcaactaccagtatccatctgtggttttttccccgtggtttgttttacacatacttcttttccgtggtgtatttgctctttcacttctatatggaaatttagagtttggtcacatggtggcgctgtagttaatacattgattttcttgtgtatttttccattgccttcttagctttgtttttaaatcgcagttatgtgaaaaatgtcttttaaaccctgctgcaggtgaaatgatttaatggcttttggcttctagattaattttaaacattaggaacattgtaaaaacagactcttgctaataatgatcattaccataatggcttgaggcataatcacttaccaacattaactgaatgattaaaatccatcatgagtttaatttgaaaagatttaagttcctttgcaataaatggctaatgatattagcttcatctctgagaggccaaaatttatcattatatgactttgtatttccacggctagacagatagaaaacccactcttgttaacacaggccacatcatgcctgttgtttaccaagctcatggcatcccctgtattagcactgaattgggccatatggcgtactgtgtatgggtgactgtcactcttttatagccctgctatttgataagttattattgcacaaggcaagtgaccttagcagatgttcagattaactaccatggtcagtaaaacctgtaaggaaggagaaactagtttcataaaaactaggtatgatctttatatgatcagatcttttttgataaaatattttcataactttgtgacaatgtcttttaaaagcgcctatccaaaacttagcaataaccatccagaaatacacagtctcaactgacgggaaaaaaaaccaaaaggagattcaggaccagatttttttcacagagaacctgcccctggactttcagtcacctcctcattacttcttttgatgaatcatgaacaaaatcttgacctgctacccaaaagataccccacaagaataatgatcttacttccaaaactctgtcagaaaattagaagggggaaaaacccacaacaaacaacaatccaaacaaacaaactttggcaactgtgaaaggaaaaaacctgaatttcataatgggtgctgtttcatttccagaagttttccccaaaggaaaacaacccagtaaataactttcactgattggtgttacagattagccttccagaggctcagggatgaattttgatctttacggcttgttagctatttcctcctcaaaaataggtcaacatcattatttccagttttcaaagagtcagagacccaagatggagaattaacatgcccacgattgtttagtgagtgggtagaaggcatgtcagttggccaataaaatgctaatggaaaagtaaatatctgctttctaatcacgttctttca

SEQ ID NO: 30518 - DNA, 1264 bp, Bovine  19866881765243
acagtttcctgcataaatgttgtgttaacaagtagcaggggcctgtgcaagagaggcagagcagggacttggtctcagcagggtggtagcacttccctggaatggctgggctgatcatctggatgaagcttcttaaacatgtataatatcatgtatgaaacgagtcgccagtccaggttcgatgcacgatactggatgcttggggctggtgcaatgggatgacccagagggatgggtatggggagggaggaggagggttcaggatggggaacacaggtatacctgtggcggattcattttgatatttggcaaaactaatacaatattgtaaagttaaaaaaaaaaaaaaagaactagcagaggagtaaagtgtgatgtcatatgcaaaataataacttgtgcatattttattgacctctaaatttcctctcccttctattgattgtctaacatccctccaatactagcacctgcaaagaaatcactctgaaatttctgggggtgggcaggggtggtggcagtgatttctgtggactttgtacctcactgtacaagctgtcttagtttgagtgttccaggtacgttgcttttgataaaagcaacagacataatgtgagaatgaggttaagtaagtgtttatttgaggatttaatatctcacacactctaggaataaagcaattatcatgctgttaatttcatattcatgtatggcttatttatttgttgtttacctctctgcataatgaaaatgccatggaaatctgcatcttctggtgctctaattttaaatgatgctaaatgttatgtataattttaagttacagattgctaattctattctatttaaaatactctatgtatgagatgcccctatgttcttgcagaatcctttttaagcagaatcaaagcgtaattgtctaagtaattacagaataagtagttaattaaaacatgaattttaagcattatattttgaactatatatttattggaagcatatatttatatatgtatgtgtgtatatatatatatatgtatatgtatatatatctgctgtacctctaagaatcaacaccttaattacttttttgacaaatgtaatataggcagaagataacagcacatttcccctactggtaaattatttgtatctggtttacttattatctcatggcagaatcagtgtttgaagtggttctgaaagcttcagggcactgctattttcatctgtttacatgacatgatatttttaaagaacctgt

SEQ ID NO: 30519 - DNA, 1369 bp, Bovine  19866881831470
tgttttctactcacagtaatctcaccatttcctttttgcacatgcatctctaccaaaaatgtacattttctttccctttcattttgccttcaacagcctgtcttaaactcacttctgttagtgaatccttttctttccattactttactctgtccctgtaagtaacaggaagcctcttgcatgatactaatttattattactgaaatgttgctttgtttttgttcctggaattcttcatgcattgaatatgtgtggcagggactctcttccatttttttctatctatgggataatggacctaatttttccttttttccctccccatctcatataggacttgacataaagcataatcagatgataaatatttttgagttttttcactatttattattcatacatataagaatataaacacaatggttttgacttgaaattttaatttcttttcaggtgattccaagtatgattttctacataaagaagaatttgttgaactcaaggacatattctctgtcaaactgaaacggcgttattcaattaaacagcagggaagtggtactttattaggaatcactctcttcatatgtttgaaaacggaaaaaaataaattaaaggattctacacttgatcttattaatttaagtgaagaccactgtgacatatggtttagacagttcaagaaaattttggcaggtaagtactccttatggaaatttttaatgagtctcgtttccttgatgtagattattaatctaaacatggtatcatatttatcaataacccttaattatattgaggttgtttgtttctattttggacttccctggtggctcagacggtaaagcgtctgtctacaatgcgggagacctgggttcgatccctgggtcaggaagattcccaggataaggcaatggcaacccactccagtactcttgcctggaaaatcccatggacggaggagcttggtgcaggctcctgtccatggggtcgcaaagagccgggcacgactcagcgacttcactttctttacttttgtctaagtctactggtgtttcttggttgccagtttttctagcatccagcctggaatacaccaggcaacaacagcaaaaaaacacactggaaactcactgctgggtcattcctttaggtcccgaggccctctcaccagtctatccttttatctctacccttttatctttacgttcttttaaatacaatgcccagagtttttagcagcacttagtaagagggttgcaagagatgcaggtttgatccctggctcaggaagattcccctggagaaggaaatggcaatccactgcagtattcttacctgaggaattccagggacagagagcccggt

SEQ ID NO: 30520 - DNA, 2563 bp, Bovine  19866880186640
tccaccccagaaaatctctcctatagatttacctagagtagcttctatccagggatgaaattcaaattatcttttgggccatctgttcctcactcaagcaaagttattttaagagggagttggaggtgttaacttcggaaatctctctcttccttattttaacaaactccttgagacagagaatcactgtactcactcctggctactcacacccaccctggagcagcctgtaacccaataaaaatgacacaatgcagagtcctcataattggtgccatcatctgataactaatccttactaagatgctaaaggctattaatgacttgatataatcaactgccatattagaaagagcactgaccttggaatcagaagatactctcataatctttctgcaccacttgtaggttatctgaacctccatttaacagtgtagttcatatgactgagtacctattatctgccactattctcgggactggagatacaaaaataattgagaaaaaactggtcaatgtgctcgactagtttgccaatagtgaatgaaacataaaagtgaaaaaagatcacgtccatacaatgatattagatacatattctgcagggaggaactggaaagctaactgacattcaggattttttcctttttcctgaaagtataaagccttggtaaataccactcagaaaagataagttcccctcttactggaacaggaaagtctttttacttcctttcattaaaccttgtttgtcctagtttaaagacagtacctgaagtagttagaaagaacacacactaagcttgcttagagatgttgctgctgatttaggagatctgcagtgaagtcactgctaactgggtttatgtcaaaagtaatggatgagaagatctaatctaaccaatggaaacaaataaggaaacatctgcttcctcttttacaggtgaggagatgaagtttggagaggtccagtggcttgtccaaggccacatagtgagtggctaagaaaacttattactttgccaacaaaggtccgtctagtcaaggctatggtttttcctgtggtcatgtatggatgtgagagttggactgtgaagaaagctgagtgccgaagaattgatgcttttgaactgtggtgttggagaagactcttgagagtcccttggactgcaaggagatccagccagtccattctgaaggagatcagccctgggatttctttggaaggaatgatgctaaagctgaaactccagtactttggccatctcatgcgaagagttgactcactggaaaagactctgatgctgggagggattggggacaggaggagaagggcacgacagaggatgagatggctggatggcatcactgactccatggacgtgagtctcagtgaactccgggagttggtgatggacagggagccctggcatgctgccgattcatggggtcgcaaagagtcagacactactgagtgattgaactcagtgaagcgactttcacttcactaccagggatttcccttttaaaacgtacttggcaatataagatagaagaatataaagattgggagggttaaggagagggatcaagagtaaaaacagaactgaaatacttcagctctttttgaaaatgaccagaaatctcaaagcataaaacactttcaaagttgcaactgaaatggaaaaaaaagaacagtgtgaaatgaaagcgggcccaaagcattgcctcagctgtcccggtgtcctcccgaaacggcactgaaagtctctgtgccgagcatctggatgcttcagaggcgtccctgccgacctcatgccccttcgctgagctcatcttggatggcttcatggacaggcaaatcgtgtttcatgtgcggcttttaatatctgtacttgttttctggcttctctttgcagaacctccagaatgatgtcagctccaaactttcctgaaagactgtttccaaggagctcccattttgccatcctgagcagttaacagtagcctcttcagaagccatccctttggtgggttttgccataggctgttccttacaggcagacgtgatggacactagctggctgctctcccagctgagtgtcattccctcctgggcatccagctactccatttcccagcattaggggcaccctgtgcctgggttctaggcaaagaaggtggccagaatgatggacgcgattttcattctggcccctgaaaccctcccacatgccgtgtgagctctgcttcagtcctgttgagtttgacatgccagtgagacatccagagctgcacgtttagagaaacgtctgaactcgagatgcaatcactggtacagatgtgattgtccagaggcaggagaatgaggaagggccgaggacagatccatgaagaccacctgcccttcacaaggaaggctacccaaagaagctggcgatgcattctgagaaggaaatggaaaaagaaaagcagggtgaacttttccatgaacatgaaggaagcagagtgtttccaggagaccgcaaccaatagagacaactgtcactgcatgttcaataaa

SEQ ID NO: 30521 - DNA, 1667 bp, Bovine  19866880422833
tcgtgtccgactctgtgcgaccccatggaacagcagcccaccaggctcctccgtccacaggattctctaggcaagaatactggagtgggttgccactgcattgcagatgctcgagtaataatctgctattccctacaggagaggcttccttagtggctcagatggtaaagcatctgcctgcaatgcaggagacctgggtttgacccttgggttgggaaaatcccctggagaaggaaatggcaacccactccagtccccttgcctggaaaatcctatggatggaggagcctggtgggctacagtccatgggggtcgcaaagaggtccacagtgctctacgggtctatgggtctactacccctttacaacacactccagccagcaagccgtgtcgactcgccccgctcggggaccaccagccccgcgaggcaggctccgtgccggccacttactgcagcaggcagttgatgtccggggagtgtctccagtagcggtacagggagatccgcagtgtcgggtggcacctgtactccttcaggatgctccgcgtgctgccaagggaagggcacagtcagggacgcgggggcctggcctgctcccgggggcggggcgggccgagagcccaggcacctactccttgaacttattggtcatgagcaggaactggctccgcgtgagcctcctgacgtcaaatttgcagaggttctgaaactcgcggtagacctgctgctcgctgaccccaggccacttcctgacggtgaggatgaagatgggggggcggatgctaggggagtctgggcccgcaaagttctagaagacagggaggggaagcagaagagatttcccacagctcctatggacggaccacccacccagcttgttctagaaggcagggaggagaagagatttcccacagctcctacggactgaccacccacccagcttgaacatcctgaaagagaaactaggaaaggccctgtctgccaggggtggtggtggtgggagagaaagaaggaacaagcgaggtcaccttgcttctggcatggaagcacgagaaagaaaataacaggctcagtgtgagcacccttctcgactctgagtctggctcctgtcagaagccctagagagcccagaggagcatgctgcatcctagcacgagcctgtccccctcccctacaaagggcagagtgaagtctacttacgattttggggaccccggctcggataagattcacctggttcacgtagggagccagcacgtccaggtagagcgggaagctgggctcggggatgggaacagcgctgcgagggcggaaaacgccgtggtgctcagcctacgggcgccgtgcccggccctcggccgaagctggggcctggggacagcgggactgtgctgcccgacaccaccctcctacccctccttgcaagctctagggctcctgttgctggatgtccccctcacaaccagcgagctctcagcatagccccagcccagggggagcgtccaggggtcaccatctgctggcaacacttcggtgaacacctctgggctgacgagcaccagccacaggtcagagaatgagaggaaggtccctttctgtcgcccctcgagaggggcatcaccccccactttgtccaaaggaccgtccctccccccacagcctggtt

SEQ ID NO: 30522 - DNA, 1719 bp, Bovine  19866880641316
atggctatagactattaatcttattaagcacttgaaattttaagtactccttcttaaagatggtacttcataataacataattatatatgcaacatgcaatttgctttctaacttgaagaactatcttactgaaataatcataatgcaataaatatagataggctacttttcctaatagtcattaagcaaaattagacaacccttaatatcatacaaaactgaaataaaggtttgaaaagtgatatacgacagggttttctcaattattacttttacagattgaaatcaaatttgaattaaactttcctgttcaccaatagacaagtgaaatgatgatttatgttgctgtcaaagcaaaaatatgacttcatatggcattttatcagtcatactactatgttaaagcaaactccagttttagagatagtatggtcaactgaaagcttcaaatatataaaaatatctttggagagaatgtgcaaaactattttccaaatgaggaaagctggaaagaagtagcaatttattcactttcagagagtgagtaaagaaaaagagggagggggactctaatcattgttaacaacatgacatgaggaggtcactttacaccactccaagttaactagattttaaccttgttccagtctgatgagcaaagcaagaaggtaattagtaatctaaatggtgactatatcatatcctgtgttcattctggcatcttggcagacactagggaaagaaaactaaatcacagtctttaccctccagcaactcctagaggaaggctaatatataaatgaagaacttttaaaataattataatgtgtccttttttttttttttttttttgcagaccatgtatctttcagttacattcccctagctgattacattcaaacagcttttagataatcacatctgacactttacactgaaggtaataagcttactcccatacatcaatcccccaaagtggaatagaactgttgttccttgtaatagatcctgattagaacaggcagcaatttgtaagtgtccctgttacttaatgaaaccaggccaaccccaagctgaaccttgaacacctacagacaaagctgtcaatttcccctttgtcaaaggaataaagtaacacatgctagcttccatccactcactcccctttggttttctgccatcattaaggcttagatttgtccctaaaatgggacgagtgacaggtccttcaccattgaaatttagcgtaagctgaagagtcacttgaattatgacatcatctttcaccaaaatctctttatatttttccttggtagcattcaagttatttgcacaatttacatgatatttacaatggttacaactgcatgatttgggcattattgctaggccccaaggcaccataatcataagcatagtcagggaggctgtgcaaaagcgttaagaatatacaataagacttttcctggtggtgcagtagataagaatctgcctaccagtgcaggatacaaagatttgatccctgatccaggaaagatcatgccacataccacatgccatagagcaactaagcttgcgtgccacaactactgagcctgtgctctagaccctggtgagtcacaactactgagccttcatgctgcaactactgaagcccacgtgcctagagccctgtggttctgtaacaagagaagccactgcagtgagaagccagggca

SEQ ID NO: 30523 - DNA, 1850 bp, Bovine  19866880689644
aggtgtcctgctcccctccctggtagaaagcagactgcgtgaccctcccaccttccacctgtcttaaaagattcggatttctcagctcataaaattataccctctttctgtacatgtgttaatccctcagtcatgtctgactctttgcaaccgcatggactgtagcctgccaggctcctctgtccatggaattctgccggcaggaatacttgaatggattgctagtcccttctccatggaatcttccagacttagggatcgaactcaggtctcctgcattgtaggcagattctttactgtttgagctatcagggaagccctctctgtacacacacacacacacacacacacacacactgtgtgtatacaataaacacacacacacacactgttgtgaatcaaatcagaaaagtgaagaagaggatgtaaatcattattccagttgtgatacgtggtttaaactagagaggagctgtgactcatctttgtccctcggtcaagcgcagctacagcgtcaattaggatttagatgatgttctcagacccagggaatgaattgctgagtgccaggaaaataatactacagtgttctgtgcatgcacggagctagctggacagcttctcaaatggatttcctttgtgtgatcaaccatctgagctctgtagaaattctctcttctcaaagccatcttggaatccctgagccctcagattccagcagtatctaattttttttttaacctctccattgacataaagacctaagatgtttattcatactttctatacgctgaaattcgctctcaaaaatatggaagaacgtgtttgagaatattgatgctcacctcataatgacagagggacactttcttcctctggactccttccggggtttgcccgagcctctaaccttggcctcggagtgcggcaggtggagtgatgtacacagaccacaggagacaaagtcagattttaactaaatcgagagtgcgactgagggactttcctggcagtccagtgtttaaggctttgccttccagtgtgggggatgagggtttgattccttgccatcgagctaagatcccacatgcctcgcagccaaaaaaccaaaacataaaatagaagcagtgttgtaagaaattcagtaaagacttttaaaatggctcacattaaaaacgaagttttttttttttttttaaagagcactattaaaagaagtggacatttgaatgatggtagtttgccatcttgaagcaaaatcatagttttaaatcagaatgttctatcaacttagaaacagatgtgagtgaaatatgacatgtgaatgacaaggattgggattatactgaatatttttctcatatttctctaagtctcactgggtgactctggagtacagaacacctggtctgttccaagggctatgtatgaatgaacttgtataattcccacacccaatgaagcagatgttgctgtgatcctcattcgacaggagaagatgccaaggcacagagagcaaatggcatagctctcatcaaagcctgatgcttaatttctagagcccgtaacctttcttgactgacatctcaggtgctcagcatgcgtgcatgctcagtcgttcagtcctgtccaactctttgagaccccatgggttcctctgtccatgggattctccaggcaagaatactggagtgggttcccactttttccagggaatcttcctgacccaggaagatcctgacccaaatcctctgcattttcaggcagattatttatcactgagctacctggggagccctaggctctcaaaacttctacttatgttctggaagagtgatgcccatcaatgg

SEQ ID NO: 30524 - DNA, 2688 bp, Bovine  19866880929051
acatgagggtgcagatatctctctacgactctgatttcctttccttgggtggatatatatctagtctcatcttcaacccactccagtattcttgcctggagaattccatggacagaggagcctggagaactgggattgcaaagagttggatacccctgagcgactgagcacacagcacacatagagataccaatagtttacacaaggcagaggcaataatattagctgtgttaccatttcctgtgaaaggcacaaaggtaatatagcatgaaacctcaacccacgagacatgtataatccatttgtagagataagactaaaaataatttcagttacaattcaagctgacatcaaatgttcattgaaatcgtattttatcaaagctcaggacctacacaagtaaccaccaactcccaatgcccagatctctcctgtgaagtcagcatggctatcacatagagactcctgagtgtcatacaatcttcagaattctggagtgaagttgggaccccgatgaacctatctgtagggcagcaatggagatgcagacatggagaacagacttgtgcacacagtgtgggaaggagagggcaggataaatttagagaggagcgttgaaacatatacattaccatatgtaaaacagacagccagtgagaatttgctgtatgatacagagagctcagcctggtgctctgtgacaaccagtggagtgggatggggtgggatggggtgggaggtaggagggaggttcaagaaggaaggaacgtatgtatacctatggctgattcatgttgatgtatggcagagactcacacaatattgtaaagcaattactctccaattaaaaataaacaacaacaacaacaaaaaagatgggacccggcagagggagcatgggcaggaagggaaggtcagaggtcaaggaagaaacagaaagagcccctggccagttcaagcctccctccagccatgctccccagccttgacacccctgccaccgcatccctgccttctttccttgttgaggaaggagaggcaggcaagaagagaccagaaagagggaaggaaacaaaaaatgtattaaggaaaagatggaaaaaaaaaaaaactgccagcaaaagagaaggttttaatgatctttgcactgctctgaaagtgagaaagagaaagaaaatctctacaaaaataacccttcatgcttagcaatttcaagcaatggctttgtaatatttgcttctctggagaagaggaaacaggcagaaggaaatgaatggacagggcttctctacatgggatgcatgttcctcagaggaatctgtaaactcaaaagtttttcaaattactcagtttcagtgatttctgtcaggaaatggttctggggctcccatcagcacctcaaggattttccagtcctgcagatgaaggcagagatatgttagaagatgaagctttttaaagttctcacttggcaggctattgtgaatcttcccccagggggcttcccctgaaaggataaaatagtgacttgatcagactttccagaagcccagatgttacatagagtcgtttccaggcacatgtccatgtccttcaaccatgtctcttatgataagatttcagcttttctcactattccccagttgcttctaaacatacactggtcaatttctttcttagcatgtggcatccacagagccggcattgtactccagagtaagtccaaacagcacagagaaaagagagtcaccagccatgttttggacactgtgcttctgctgaaataatctaagatcacaagaactttttgaaagaagtatataaccctcttgccttacatcaagcctttttgacaagtgaaatttctaagtctttctgtatctgtcacctctgaattctatcagttttcatttctcttctacttatatggttgattttgagaggaataaagggaaaaaattatgtttatctttttcgaattttatcttattggattcagtcattgttatcagatgctgatttaggttgatcaatgaatcaatgctcttcaagcagaaagtgatcaaacagttgtcaatcaagctgagtattacagcatccagcccacatcactccaccatggtgatttgaatttcatgaaattctttcttaagcaacttgctgaaacttacccttctcaggtggtacagcggtaaagaatccactggtccatacaggagatgcaatcgggaagatctcctggagtaggaaatgtcaacctactccaatattcttgcctagaaaattccatggacaaaggagcctggtggggtacagtccatgggggtcacaaagagtcagatacaactgagcaactgagcccacgcacacacattcacaatttgcctcgtgaaaactgtggtcgagagacagattttggctcagcgattaaagctccttggaaacagaattgatgctccagatggctgtgagtgtcctgtcattgaatattgtctaatgtctagctggtcatggatcagaaaaaaaaaaatagaaaaggttcaggtatcataagaagtattgaattctgcaatctgtatggtgacttgcaattccagaatttttgaccatagatgacttcagcaggtaatgaataaatcaagtggtggcttcaggtgcagcttgatccagagcacgatgatgtcatca

SEQ ID NO: 30525 - DNA, 2417 bp, Bovine  19866881014027
accctatggaactgtagcctaccaggtcttctctgttaagagtactggagtgggttgccatttccttcttcaggggatcttcccaacccagggatcacacctgggtttcctgccattgtaggcagacgctttactgtctgagccaccaggggagtcactttgtagatgctcactacattttcgttcattatttaaaaagctgcctagtgcaaggtgggcatagagggttaaccaacattatatgagctgatacttctcatgtggatcatgatacactgcaaatgctcataccttgagtatgatttctgagagcacatgcgttgtaggtcagcaggaaaaataccttgtttgtggtccaccccactgacaggttttgctgaataattgtaactcaccagtgtgagtacataaaacatgaaatctcaaaggtccaacgaggcaaatatttagcaggtggatgggttttaacacctagaagaaagacgggaggcaaatacagaggaaaagtgagaaatggagattggtcacgcagagagccctcagcatggaggatatggttgttcctacctaaacccaggaatgtctgtaagcccctagccacactccagaggacttagcaagcttacggcattttgctgagtgcgtttgacttggagagggttccgcctccaccagttcttgaaatgaatgaatttgttcagtagaaagacctggagcaaaagaatgtttatgaagtctctgtagttgaggctgagagatgtttgtgcttaagttgtgtttaatgtttgtgcattaaagagtgaaacgtgagaatttgtaggtaaggaactgctctctctgcagttaacatggctgtcctgaagcttccagggtctgaggaaactgacgtggccgcaggatggagcagagccagaatgtgaagctcagtagacgatcacgacgttgagcaagaccaggccagaggagagtctgcaagtcacaccacagacgcatatgtgtgctttgtgcaatttgtggtctgcctctttgcttcattctttttttcgtaccttggcatggacccaccaaacatcaatagaggttacttcaggccttgtctgctgtgagctatcagtaactttggtttcttctttacaaactaaccttgttcattctcaacttttttttttctttttggttgggagcatctgcagaaggtctctgcctggagatggtgtgctaacctatgtctagcagacaccagcaaggcacccaggtttgatcatggcaacaaggcaaggctttagggaggatcattgagagcaatgaggtaaaagaagctcctagcacaggtgactgctttgcacctcgcctgtaggatgtgatgttgtttgcggtgacttatttaacaagcggctagagaacggagatttgtgttttagctcatgaatggagggtgaaggcctggaattttgttgttgtttttactttctattttgggatgatttttgacttatagaaaaaatttccaaccagatttcttcacccagatcacccaaatgtgaacacttttccacatttcttattgttctccatctccccacttccactgtctgtcatctctatttttacctgtatctccagctacatcatgttctgtctctttctggctgtacacatatacatttccacggcaggcagctagttttaattaggttgtttattgactggggaagaatgttaggtggcatgggcgacactgggggaatagctgatgaaaatcatggagtatgaatgcccctcaaaatttgctctgcttcgttatttacaagtatgtgtctttcttgaggggagttatctgacgtattgattgccataggttttgagatttctcagctaaagcatgtttattttcattggaaaggaaatactgtggtcattttcagggctgagggatgttggttcttttggagatatgtaaaaagggaggaatgtagggattttatttggggttttaatttaataagctcaatcttgtgggttttacatcctttgaggcttttctgagagtggagggaagctgagcatgtgtggaatggcagggtttacaatgcagggtcacctcctttacatcacagccagtcctggttagaaaatcataaaaataaaaacaaagttgcgacagaatggctttctgaatatatttctgtattgagtgtgaaacttaattacttttagcctggcactttaagcctcaacaaagaggactcgggtaacatgattatcacgattttaaacatgaaaagctgtctttctaagtggtatttactcttctgtgtgctttggaggctctcccagtcaatgtcagcatgatgaatcacttatttaactttgcttcttaaagtctcttttagtttaatgcaactggacctttcttt

SEQ ID NO: 30526 - DNA, 1906 bp, Bovine  19866881054206
ttgactcactggaagactctgatgctgggagggattggggacaagaggagaaggggacgacagaggatgagatggctggatggcatcagactcaatggatgtgagtctcagtgaactctgggagttggtgatggacagggaggcctggcgtgcttcgattcatggggttgcaaagagtcagacacaactgagcgactgatctgatctgattcattatggtgatctgaataaccatttgacctagaataagccaaaacaattggagaaggcaatggcaacccactccagtactcttgcctggaaaatcccacggacataggggcctggtgggctgcagtccgtggggtcgctaggagtcggacacaactgatcgacttcactttttcactttcatgcattggagaaggaaatggcaacccactccagtgttcttgcctagagaatcccagggactggggagcctggtgggctgccgtctatggggtcacacagagtcggacacgactgaagcaacttagctgcagcagcagcagcaagccaaaacaatatcgacaaaataggaaacagggaggtttgatctttggtattaccactatagcttgctccaaggctcagatgatggttagtgtgtttttaacaataaggtatttataaattaaggtatgtacattgtttttttatagtgctattgcacacttaatacactgcacatactgtacagtgtagaaatatggtggatatcactttaatcaagtgagcaaagttgacataacctgagataaactccaacatgtatcctgataagatacatgaaaaaatgtaaaaatgaaaaaatatcatcatccaatactttcccacattatattctaatgcgttagaatattctaatgttatattccaatgtgttatctaatcttgaggaaacatcaggaaaatcaggattggtgacatctgacaaaggaactggtccctacccttcaaaaataccaaggttaagaaacatggagatatgctgaggaccagttgcaaataaaaactgaagagattgacagtgaaatgcagtgtgtgatcatggattggatgatactgaacaaattagctataaagggcatccctgggacaacaggtggaccttgactgtagactgagcgtggagataacagtattttatgagtgttgcatttcctgattttggtagctgtggttatgtaagaagctggcttttcttgtggggaaataatacactgacattaaaatttagagataaatgggcatgatacctacaactttccatcaaacggttcagaaaccaaatgagaaggcaaatggggccaaaaaataggaacaattggtgaagcagcaagaaggaaatttctgaaaggtattttatagaaaggaaagcagaaggaaggcagcaaagaaagaaaacggcttcttaagaatccttgcaacctttccacacctggcgggaggcaggagtgccacagaggactgtctcagcgcaccagcgggcccgccggtgttggccatcagtgcttgagccagcgccagaagccgtcctgaaaatgtttgtttttctttcacagctgaaaatgtggccaaacaatggcaagtgagtagagaagaccaggacaaggttgcagttctgtcccaaaacaggacagagcatgcacagaaggcgggccattttgacaaagagatcgtaccagtttttgtatcttctaaaaaaggtgggtgtgtcaatcgtaaaggtttaaaggtcaacagggctgtctataaggcaatcattactagtctataagaaaagcattaatagtccaaaggataccatacaggaatgtctgtgcattgttatctttttatgtctctcaggatgcaaagaaaagctgtattcagggtcgatctg

SEQ ID NO: 30527 - DNA, 1316 bp, Bovine  19866881254182
acttgggtgggagagtgattcatgaaagagttggtgctggaattgagctttgaatgagaattagggcattaagcaccgaagaattgatgcttttgaactgtggtgttggagaagactcttgagagtcccttggactgcaaggagatacaaccagtccatcctaaggaagatcagtcctgggtgttcattggtaggactgatgttgaagctgaaactccagtactttggccacctgatgcgaagagctgactcattggaaaagaccctgatgttgggaaagattgagggcaggaggagaaagggacgacagagaatgggatggttggatggcatcaccgactcaataaacttgagtttatttggtaaactctgggagttggtgatggacagggagccctggcttgctgcagttcatggggtcacaaagagttggacatgactgagtgaactgagataaagggggtgactgtgaggttctgctacaaattataactggaatgaatttgagaatcacctgagttctctgcttagctggtctgtctgtcttcttggttgaaatgctcattttcacctctgtgtgaacatcccattactggagaattacagaactatgcttttggtcaatgatggattaatctgtttttgcaatgcctgtgctgggttaagaacatacacacttctacaaatactcagggcaactgaagatgtaaacctgggccttgacccctaaccttcttctacctgaattactccatcttttaggttcccatttccatcaatgattctacatttctgatttctcaggttggaaagctttgagtcatctttcatttgccttcattctcaaaatctattgttttacaaagatttctttacataagtttctctgatttctcctcttgggctccagtcatcactcttgggtaaatgaatatgctgtctttcttcaaagtttctctgactccagtttctccagtctatttgtatactctttacagattcatctcccaaactagagctctcattatgctatttttctgactccaaacttgtattggctccttattgcctctcatataaactctactcctttgttgactattgaggaagcaccatagtcgggttaattctatttacctaaccttttctctattattcgtaaacctggaatttctgttctaagctgggaaaaccaaaatatggttacttaaacagactttagataatctatactaagcacccagcccaagaggcaaaacaaaaaaatagaacaaaccctgatttgcgttgttttttcattttcctccaagggaagc

SEQ ID NO: 30528 - DNA, 642 bp, Bovine  19866881396040
ttgttatagtcgaagccatactggttcaaaaactgaacactggaagcctggaaagagaactctgagtccaaaaccccaaatgtcgtagggaagaggaagaagttacatgaatgagctacatacctagcaacaaaaacaaacagaaggagaaaaagacagaaaacacttaaaattctggctcatggagcaggcttcctagtgggctcctccttccccttgagaagtccagctgacccctgaacaacatgggggttaggggcaccagctgttcttacagccagacatctgagtatactttagagcctgccctgggtccagccacaggccctctgcacccacagaccccactgtggggcgtacagtaccacagtgtgtatttagtgagtgtaagtgggctcaggcagttcaaaccctgtgttattcaagggttcgctgtatttgaatgccagctgtgtttcaagtactatgactggtgctgggggccagtgaacaaaggcacacagtctgacccccactgagagaggggggtgccattcacatcctttctggccgctggggcctgggagctgcgtccccctcattgtaacactgctgactgcaatcctgaagaaacacacaggagtgaaggacgcgggcaagggg

SEQ ID NO: 30529 - DNA, 723 bp, Bovine  19866881463849
atcttacctgttctcttattacacacaaaaataataataaagagtgtgggataaaacctttcaaggtgatatataagtttatggcatagatcacggtgatgatttcacaagggtagattcatctccaaacacctcaagttttatatattaactatatacaggttttgtatgttaatcatagctcaataaaatggtttaaaaatgaaaacgaagtatgaatctgtacttggaaaggcctctggaacttagttaggatttattacaattggctattacagatgtatggatggatgtactaatgatattcaccttgtatttgacccatgaagcagattacaagctattttccaactcagtcattacaaattaactcagagataccctgactatggacaaagccctgactttctaccaagaaactctttggaccggtcaacaagctttgtacctctcaggctaccatttgtttttcattaaccagaacattcccaaaggagagactacattttctgattcagcatcaaaaacagaacagagcagtggtcaccaaagaaatatttcctatacaacgaggcagcccagaaatgctggaagcggaatttagcgcgtctcgaagcagctgggtttcacacggacatagcacagcacagatgacagcccccagagaaacaaacataaaacacccatgacttacgtgtaacttccccaagctttttaaaatgt

SEQ ID NO: 30530 - DNA, 1374 bp, Bovine  19866881634922
ttagcaacctcttacatgaagaactccctgtgactgccttcctcagaaagggctgtattggtatggaaaacactgaagacggtactaatgtaatgtcacaataatttgtattactgtggacttttctattagaagtattttataataaatttttcttccaaatgtgaatctttctgtatcacatttgaggaatccatcatttctagtaccctgactgccatctttgtactaatcttgggtcatttattttcttttcaggtcttactgaagttaaaacagatgagtttcctcgccatgggagcaacatggaggccgtgtctaagctaaagccttgcttccttatggatggaacaggaactgtcaccccagctaatgcttcaggttagattatttgaagggcggtttggggaataccatcttctgcaaggagtaccatgtactaagattcttcttttttggatgggggtagggggcctgtgcctgtggctcgtgggatcttagttccctaagcagggatcaaacccatgccccctgcattgggagcactgagtcctgactagtgggccaccaaagaggttcctgtacaagttattctaaaatcttgtttcagttgctttagggaaaaatgtaggtttgaccatttgtttctttatattagactcatatataatataccgaaaaatggatttggcttccctgcagtatcctaatgggacatacacatgaaaaaagccaatcagattttatctactacctttgtgcttttccaaaaccagaaactccgataaccttctgtgatgtctgggctacttcttccacttcattaatctcctgtcctccagtgcttccatcttcctgttctttctcccgtggaaatgttctgtaatcagttgtatcagattggcaaacctaccatttctaattacactgtaaagcctaacagtacatgactttgccaagatgtgttaaggctgacttaactcacgtctcctggtgttagagaaagtagacacagctacttaacgaggatggcttcctatttacaggaattaatgacggtgctgcagcagtggttcttatgaagaagtcggaagctggcaaccgtgggctcacacccttagcacagatagtttcctgggcacaagcaggtgtggagccttcgattatgggaataggaccaattccagcaataaagcaagctgtgagtttaattttcagtgttggtacctgtcctttgtcgccaaaacctctatgggagcacacccgtaacttgtaaatgctttatttctgtcttcttcaaacctttgctcagatccttcccactccaaaatgctagacgaggctgatttgttttcatcttattccatcaggttt

SEQ ID NO: 30531 - DNA, 1401 bp, Bovine  19866881660187
ggacaagccgggttgctgactgacagggtggtaaaagccagtagccaagaaaatatggagatccactttgggaatctgtgctaagctgaaaactggggggaaccagaaatccatgcagcccagctgaacaccagcagagagcctatcttaagtaaaagactcttcttgatgttttcaaatactgccatttatacctatgtacctgccagcattgggtctgaaatgtcagatccaagccagctctgtttacataatgtttgcagttttgtagggtcagtctgtggttcagttatgtttagaactgtgcaaaatattatctgttatcaacagattgagattaatcctccttttcaaactggaatgctctatttttccatatttacagtattcaccacggaaatgaatggatagataatccttgggtaacctgttaacaccaatactggctgggagaagtggtttctagcctgggaaagaatgtttggctaacaaatggttaatgatgaaccttgctctcctagttcaaacttccaactagatttttaataatttcccaacccaaccctctagaaggaccccggagtcttttacgctttatctgaacttgtaatcactgccacttactccgtaaagtcctccatatatacggcaaggccttggaaatatgtggacggggacttcattcatctattgatttcttttgtttgatgaggtggagaggcaaagatggcctgaggtctgatgggccgagaggagaaaagaacggaagccgtcacctcccttcactgccaaggcttcatgttgtcctgatcgcttgctggtggatctgggagcatgaggcacgtaatagcacatctccaatagagtaactttgtaaaaccaaaactgggtttttagggacttcccttgtggcccaagggttaagaatctgccttgcaatgcagggatgcaggttcaatccctggtcagggaactaagatcccacatgccatggagcaaccaagcctgagccaaaactatagagtctgcatgctgcaatgaaaaatcctgcatgtcactatgaaagatcccgtgtgctgcaactaagacccaatgcagccaaaccataagaattaaaaaaaattttttttaactgggtctttattgtaaactcagtttaagtgggagagtttatagaattcaatatattaattcattcagtaaatacttactgagagttaatatcatgcttggtatattctagatgctggggattcagcaataaaggtaagtccatccctcaattgggagtcttaacagatacgctctaccatatataaaatagacaagcaacatggatttactgtagagcacagggagctatatccaatattttgcaataaaccgtacaaactgtaatgg

SEQ ID NO: 30532 - DNA, 769 bp, Bovine  19866881887922
ctcagtgcagagtatgaaagtgtagactctcccaggggcagtgaaaactctctcacacaccactcaaatgacacagactccagtcattaagagtctgttctcctctgcaagaggagaaaccagtgagtgggaaaggtaaccgaactgcagcttcccgccacgttcagaatggcttggcctcaagtgtaaatgtacagggttcagttttgtaaaaaaaaaaaaatccagcaaattcttatacagtgtcacttaatttggaagaggatactgtccatttaattaacgcatacttttgtcacaatttgccttttttgtggggttttttttctttttttccctttttctttgcttcaatacctctgccactttggaaattgtaacagttaattactttgaatgttgctaaaaggacatttttgtgtagggtcaggttatttttatatgagttaatgtgaagttgtaaatggaactttttgcttaaagtataacacagtgatgtctgtgtgaatctgtgtctaccctagaacctgtgctgtgtgagggcattcttactcatgctgttactatgcttatgcaccattcagacttgtcagagtagatgtgggtttatgactgccaagtttgcccagtacagtagttttatcactaaaagttggacttgttgaaggagtcctatagtagtttcagtgttagatacagtttttgccaccatacatctgtgcattttctctttaggtgattgaatgtttaagaaatttgtgtgcatagt

SEQ ID NO: 30533 - DNA, 1435 bp, Bovine  19866880196904
aaaccagcttgaacatcaggaagttcacagttcacatattgctgaagcctggcttggagaattttgagcattactttactagcatgtgagatgagtgcaattgtggggtagtttgagcattctttggcattgcctttctttgggattggaatgaaaactgaccttttccagtcctgtggccactgctgagttttccaaatttgctggcatattgagtgcagtattttcacagcatcatctttcaggatttggaatagctcaaccggaattccatcacctccattagctttgttcgtagtgatgctttccaaggcccacttgacttcacattccaggatgtctgggtctaggtcagtgatcacaccatcgtgattatctgggtcatgaagatctttttgtacagttcttctgtgtattcttgccacctcttcttaatatcttctgcttctgttaagtccataccatctgtcctttatcaagcccatctttgcatgaaatgttcctttggtatctctgattttcttgaagagatctctagtctttcccattctgttgttttcctctatttcttagtggaattaaatatttttaaatgatgtcttaatagttgtcgaaattcctgggcttctgctgtgacttgacaacttggtaattgctaattcacttttatgctaatttaactccatcctagttgacgattttcctgttaaactcttaagacttgttcagatggagtctgggcggatcctcccagcctgacttgatggagggtgtggatggcaggggttcccacagaccctgcggcccgagcacctcacacaggaagaggctcagtacacatgcattttgtgagtaaaagatgtaaaagggagtggggaaaatcggtgattcttcagccctgcaagcattcatttacagccattgcagagagccgattcaggggaaagagtacaagttttaaagtaggacacagctgggttcagatcacttctctgccatcttatttactagctgagtgactttggaaaattacttaacctccctaggtgtatttcctcatgtacgaaatgcaaataatgtacttaccttagggtgttacatgcatttaaattatcaatgtattggcagtgtgactatggcacgtggtattcaagaaacacaggcttcatttttctttctccttttaagcagttgggatgctattttctgctgtttctgttatagtccttccttttcccccaaagcactaagagatgagcaagctctgcctctgtcctccaaggtctaatgggcaaaggaggcagggaggtcacatggaggcccgagccaggcagggaggttgaggctcagactgcctgcagagtccttggcacagggacggcgcacaggaaaccaccaggaagtacccggggcctcccagcgaacgcgtacccct

SEQ ID NO: 30534 - DNA, 1472 bp, Bovine  19866880380832
cggcagcttctgtctgaggacccacgtcttcccgggtgacagtattaggacggtgctcgccctccctatagaggggcatctgcggcaaatacaccctcccgctgtgttgtaggcactgctgtaaacaatcacacagggtaattcattttaccctcccaacaatctgacaaaatcaaccattttatccctatatgtggtagcagaaaactggctccccaaagatgtccatgtcctacaccctgggaccctgcatgaaaaagggattttgtaggtgtgattaaattaaagactgtgagctggagagattatcccagttgtccagggtgggtaagtgtagtcacagggtccttaaaagataggggagggaggtagagagagagagagatttgaagataccaggagataaaaccagtcaatcctaaaggaactcaaccctggatattcactggaaggaccgatgctgaagctcaagctccaaaactttggccacgttggttcgaagagccaactcattggaaaagatcctgatgctgggaaagattgagggcaggaagagaagggggtgacagaggatgaatgagatggttggctggcatcactgactcaaaggacatgactttgagcaaactccggaaggtggtgaaggacagggaagcctggtgtgccgcaatctatggggtcacaaacagttggacatgacgagcaaccaaaaaacaacaacatttctgcccttgagggtgaaggagccaagggccaaggagtttgaacagcttccggaagctggaagaggtcaggcatcagattcctccagcctccagaaaggaatgtggccctaccaacgccttcagtttagttagtccagcaagagctgctttggatttctatcttcaggattgcaagataacatgcatgtgtggttttgagaccctcagtttgtggtcacctgttacagcagcaatggaaacaccacatcacaggtggggaaatggcctgaaggctccagtgacctgcccaaggctgcaggtgtggtcagcgctcctgaccatgtgcatggccccctctcgtgggccgtgacccctaggaaagccccaccatcgccggttacatggccttgggcaagccatcgaatcctgtccttctcaggtgtgacgatgagccaggagccctcttgacctcgtgtggggctcagagatactaacccccagcttgtgtggggatgctgtctgaggctctggcgatggctcccaagcagtgtccgcccggccctcctcttagatgggctgcagctcctcttccagcttcttcttccgggctccttccacgaagaaagaagtcaaggccgatgaagggttttccccagaggcgtgtccacccggctgcccacggcccggttcgtggaattggggacagtgtcagagaagcgaggcacatggtctggcagcttcacgggctccttcttgttgccctgagga

SEQ ID NO: 30535 - DNA, 1568 bp, Bovine  19866880437821
ttgtagaaacctaccgcccacgaagctgagttctgtcatcccatctaggtaggctgccaacaggcctgaagttaagccatcctgagatgtcggcagcaggaagcgggaatgtcctagaacatgtgggatcaagactgaggacagaaaggtagacaagctggaaggagagatgaccaaactcaaatcccagagaagtgtccttgtaggacggtgggccacagagctggaaacggggattctccaaagatctgagcagttgggtgtcagatacacgtgggacctggcaagtgggcgatggatcagacccggtgtgtcagctcacgtgggaaaggcgtgcagtctgccctcattcgtgtttcctgtcaggtgtggctgaagcaggtgacactgcaggagacggtgtatccgaatcctgcagggagctgggggtcctctctggaccaggaagctctggttttctctttgaggagctatccgctctgatgatggaatctggagcctctgccatccccgacacatcgtaatataaactcacggcaatgcctacatacatcaatggctggaggaagggtgagatttgttttatgacttggtcaatttggatcatttaatttgatttgcctacatctaattctgcccagtaatgagagatgtgcatgcataaatatggctggcttgcatgtgtgcatgctaagttgcttccatcttgtccaaccctgtgtgaccctatggacggtagctcaccacgctcctctgtccatggaattctttgtgcaagtatgctggagtgggttgccatgacctcctttcggggatctttccgaccctaggacttttctagtgcaaattttaaagtttctcacatcactagagtcactgcttttattttatgtatggtaggaaaatctttgatatttgaaagactttttcttggcctgaaagagagcttccaatattggattgggatgggatctccctggcattgttcatgcttgggctacagcataacttctggagaggtctgtcaattatttctcagaagggctggttagagcttgtgcagactgcactgtggagctgagataaggaaaaacccaatttttcataattaaaattatcctctccttgattttcaaaaaagaaagaaaaaggaaggcttttgttcaatatatttacagatattcctcacctctgcctataatgttaatgttaactcatttgttcagtcattcatcacatattcattttcagaaagccatccatgccttttgcagaagagctgttgggggccatgccctgtgcttggaactggggagagagaacttggttcctgccttcacaggctgatagccccgtggggtatgtgctacacagagggagagaagagaggaaagacgggtgccacgtgaaagcagggagacccatgatgctacctctgacgggctccttggatgactgactgggcattaacagtgtgatcgggttctggttcagaatggtgaactgagcatatacatatttacctctcctgcctccaaaatggtgatcaccagaacacatattataat

SEQ ID NO: 30536 - DNA, 866 bp, Bovine  19866880596577
gatggggcaggattagggatggctgggacacaaaagtcgcctcgactcagcttcttaactgctggtcttcaaatctctttcctgcagggactacaaagcaaaacagataagggagaaaccaggtaaaaggcaggccttcggatgcaaaagcacccggccaggggcggccagatcacctaccaggctcaactccatctggaggaaggggagtgggccagcctgcacctctgcccaccagacggccactgttgtgacctccatgaatttctgaagtcagaggaggctcttcagatggttccactactgatttattctcgtttctctcctcggattttctattaaaagagtaaggctagatgcagctatcctgacaacctgacattacatacctgtccattataaagtgggatcagagtcatcgcaagcaggaccatgtttagctagagacgatcttccttctcccggcaattcattgtggaccagaacaaaggcttctgggaaaggtggaaggaatcgggctgagaggaagatgaatggcaggtggtatagctcaaggtcacagctagtgtccgcaggttagcaggcctggcgggggcgtccacctggggaggtgcggctgctccccacccacccactccctctgctgcttatgctttctcttccctggtaacaaaacattcttcctgcctaaagaggttgcagctatttcataacaggaagacggttctctcgttattgctgttggggatgggactgtatggggaacagaaacacgatttcttgattttcttctataaactgcaagtgtggaaaacaacaggagtaaataacaagtgttctgcaaacacctcgtggggagggtcggt

SEQ ID NO: 30537 - DNA, 2815 bp, Bovine  19866880641325
acattgtaaataaataacagaaaacacactccaattaggataatttgaggaaagactcttcatgaaagggcatgtgagtgcgtgaggactgttggagaagcacaggggatggtacagaaacccaggtagacggatgttgtcacacctgtaggctgtaggaggcgagaggaattgggtcaccggaactgggagggaaccggattcacagcctcctcagctcctattgaatcgcctggggagccagagggcagggagcctgaatgtctccatcaggctgcacacctgaaggtatttatcacacactcccaggggcctggttctttacacgcactgttccaaactctgtgagaggaggggtgtcacggccatgttgctgaggaaacaggatgagattagctcggtcccttgccccagctatgattaggaagaggcagaacaactatcctaagaaatgccaacatctgtggagattttaaacccaggtggcccagagctgtggggcccacagacagactggatagttgggaggcaaattattaatactactctgggcctcagtctccccatctggaaaagggaatgatacctatcttcgagaattattgagatgattcaataacagtgatatagaaattggcacgtggtcaacaaaaggaaaatgttgacgtgcaaagagtatgaaacatggttttgggtgggagagtatggttgttcatttctggttaattactttatacttgtattcatcagttttttggccccaaacagataatggttagataccaaagcaagttgctttccccactactctgttctttttttccctccctcctctgtctcttcctttaacctggggcctttcggggtcctctgcctcagttttgtgtgttggaccctaggcccctgggccatcctctgagtggccacatggccagtgcctgccacagctggggagtcgtcctccacttggaattcagggacctcttcctcctccctgcctgcagccgctccctcctgggagccaggagaaccaggagagggcccgaggcaaagatgtggatcctcaatgcgactggcctacttcctcctgcaattctaactgatgggcttccagaagcggacactctttgctatttagtctattaacatttataacaattcctcaaaatggatatcatcccattttacaaagaagggaactatggatcacagagattaaataaatttggccacaaatcatacatgtggcagagccacagcaaatgggaatgcctctgcatctcctgtcttatcctttcttaacctttctggagcctccagtatgttttctgaagacttaaagagctttaattttctaattataaaagcaatttgttgttgttgtttagtcgctgagtcgtgtttgactcttttctgaccctatggattacagcccaccatgctcctctgtccacggatttttgcacgcaagagtactggagtgggttgccattttcttctcaagggaatcttcctgacccaaggatagaacctacctctcctgcattggccggcaggttctttactactgagccaccagggaagccctataaaagcaatactggattataatagaaaatatgtaaagtaggagggacattttcacatagctgcagccgtacggtctgtataagtttgcagctttttttcatgtaacattatagtacatgcctcgttccacagtcctagaaattctttgtaaaccttattttcagttcagttcagttcagtcgctcagtcgtgtctgactgtttgcaaccccatgggtcacagcacgccaggcctccctgtccatcaccaactcccggagttcacccagactcacgtccatcgagtcagtgatgccatccagccatctcattctctgtcgtccccttctcctcttgcccccaatccctcccagcatcagagtcttttccaatgagtcaactcttcgcatgaggtgcccaaagtgctggagtttcagctttagcatcattccttccaaagaaatcccagggctgatctccttcagaatggactggttgatcgccttgcagtccaagggactctcaagagtcttctccaacaccacagttctaaagtggctgctaataatccctcagctgggtacactagcatttacttaaacaatcgtctattgtcagaccatccggtggtttccagttccttgctgtcagcaacatggctgcaaagagcatctttttattcagaaagctttttctgtttgtcctgtttccttaagatggtttctcagaagtggaaatactggttcaattaccagtttgcgttttatgtttctttgtacatattgccaaattgttccccaaagggtggccccggcagagtggagagcattttgagggtagttttctgctcttaactggctttgtattccttcccaaaagtctcataaggagaatggcccagagcgtggtggaagtgatggaagactccaagggaaaggtccaggagaaccttctggccaacggaggtaggtccctgaagcacgcttatgatggtcctttcccagcttattctagtccattcgtggtcccagctgtggccacacaggagggctgaaatgacacggcaccgcggaggctccaaactgacatgccaggcagaggctgtccacgccgcttagagcacagtggcaccgctgtttggaagactcagtctcccttatattccttctgtctcatttctaaagcacctggcttttcttacctgtggctgagctcctcagtgaaatttgagattaaaatggattcaa

SEQ ID NO: 30538 - DNA, 1273 bp, Bovine  19866880689621
tggccccaccagcaacaagcccattgtgaggtgctggggcagccatagaggaaggaaaagccatctgtgccttaaagtttatagtccagtggacaagaggcacaactcaacaaataatgatggtgtttttgtgtgcctcttctgaacatttccactctgccggttcttttcctggtgaattctattcatccttccagacccagctgcagcatcagctcaccttgctagccgtcctatcccaagctgagctggtggcccgtctgtatactgagtgttttctctaccaggacccgggccactggccctttgttgctgttctccctctgctacgtgaaaggtgttcagtcgtgtctgactttttgcgaccccatggactatacagtccttggaattctccaggccagaatcctggagtgggtaggctttcccttctgcagtggatctttccaaccccaaccccaaccccagggatcaaacccaggtctcccgcattgcaagcagattctttaccagctgagccaccagggaagcccacccccagggaagtctccctctgctgcccaccccctaaatgtgagccccataaggtgggacctggggattttttgtctgtgagtcccctgaacatggaagaaactggataagtactgaatgaatgaatgaaatgtgtgtgtatagaggcccgagggcaaaaaggaggtaatggtgaagaaatgccgagttggatggagaaacaatttcagctgatgctttgttaagcctgtttgctggtgcccttctggcattccccccaccccgagaacaatgctgacaggcatccaatcaaacaaattaatattctcttcccaccatgaaaggctcatttcatgggaacaacaagtccacacagccatgtgtgggtgtgtgccccatacatcaacctgaccagaaaccaccatgggtttgcctgcgtcttcctgctgcaagaggtgaggagtgttcagctttcctttctcatgggagctgttgaccctcatctgacctttgtgatggctgaaaaatgaagaggtaggagcgtagagaggggagatgagaggggaaatgtttatcaaatgtgaatacaggcacctctattgtaagaaaaaccaacatagtttccactatttaaaggtcataaactttgggcctgtggaatattctcctggacgtttcaatttttaaaaagcactattttttttttttttttatgaacaggaaaatggagactctcttctcaagacagtaaaaataaatt

SEQ ID NO: 30539 - DNA, 3174 bp, Bovine  19866880711804
taaccccgctagggaaccccgataggcccgctgcggggcagagcgacagagagagagagaatgagggcgagggtgaggtaagcaacccccccgggagccctggggttccccggctcgcacatcctcgcccgcccgcgcaggcacctttgggagaaaacaaatcctcgcctttcctgttacctactgtggctttcgaggtcttaaattcaaggacccccagaatcacgcttcctcctaatctgcagggcctcttgggagctgccctccgctcccccagcagtgatgggtgcttgctggccagggtgccttggttctggctggaggtggctggagctggtgatggggcacatcctggctggggccgggggggtggtggtggttgggcatctcagctgtcttccctggatgccccagctggacccacccctgacctctttgggcatccgtggaagacagccatgccagcattagtgatagctgctgtggctgatgggctgtggccccgtgaagtggggccgtgaggagacccctgaaagcggtggccggtggatgatgccaggacctggcagaagggggactcgttggcagcgcagtgtcagacagagaagtctgccagctgcctgcggaaagccctgggtcagctactgcagcttggttggcagtggccccgtgcgtgtgccaggtgggctggcccaccgaaccaccctggcaccggtggcccctggagaacacacaaccaggcctggccctgggccttgtccgaccgacctgctgcttctgtgggccactgggcatttcttctcggcttggggctcgttctgccaaaacccacgtccctctgttggccaggcgtcgggtggagtggccgggaggggtcaccgctctcctatcctctgcagggcccgctgctgcgatggctcaaggtccacttcagcgaagcctttgttgcctggatccacatcaaggcactgagagtgtttgtggagtctgtgctcaggtgcgtagacgtgatgctctggggccacctgggctctgccaccttccttccaaccaggacccccccaccctgccaggctctgggacagccctggccttcctaccctcttctgcaattcttggctcttggaaacaagcttagggattcctgactccaacaaaccttccctcagtcctgaggcccctgctctcctgtgctctgagtctcctgtcaggctggcgtcttgctcctgcaggaaacaccagcactgtctccgtccttgagttttgaggcctagccctcaaggcagcacaaaatataaaacccaaacaaaccaacaacaacaaaacttactttacctcttttttaacaaatgcaaaataggttcactcttttgtggaaaacttggcaactacaggtaagcacaaagaatgaagaaaaatcacctgtaactttaacaccaagaagaaacactgctaactcgctggtgttcctagcatccttcaggctttttgagtttgtttttttaaatttgcagatatgcatgatttttataaaatgtttacaaaaatggagtcaagcaggaaacttttcctgaagcccatttgaacatctgtgtcctgaactattggtgtgtgtgtgggggggtcttggcagcactgcatgtagctgactgcacccccattcccaaagcttggtttgctcaggcctgcaggtccagtggccccttggcccctctgggtggtcttgctgggccccttccgtgtgcacaccaaaggcgtcctcaggaccccatcccacacctgcctggtggagtgccccgctctcttttccttgcccaggcttcctgggtgccccctgctattcattttcccagaggcttcccctggactcctggctcatcttccctcccagtcctttcctcctgatcctcgtatctgccaatggcctcaggttcctccccaaacttcagggcccccttggacgcctccctcccctcatccttacggccttccccctccctctacatcacagcacccctgacaagcctccatcctgccttgacccttgctctctctctctgtctctctctttcaccatctccttcccagctgttcccaaaggctcttccttggtcctctgcctccagctcatccttcatgtgggtgccaacgtggttttgtccaagcacaagctgggtctgacgtggctcctcgtcctctctcagacatctcagacctctgtcatggcaagcattgtgacaatgggctgaagggcagactcaggataacccagagtgttccagacatcaacaggccccagtctgtccctgctcaccttgaaaatcattggtcctcaggctcagtacagcaaagcctgccatccttactggaggcccattttgctcaagagtgaggtccagatggtccacagaggtcccaaatattgtgtttaagctcaataaaagggaagtatatgcaaaaacaattctattcaaaactataaatgtatgacattcttaaaacctatacttttatttctcctgaatagttgtaatacatcactactgttaaaaaaaaattcaagttcagaaataggtactgtggaaagtaagttcctgtcagttccaccacccatggattaacccagttaatggttttaagactcttctttcccaagttgggtcatttatacttgatgttctacaattttttttttcatctacttatagtctcatcactatgcatagagatacttgatcttttttcatgactttttcatattccatcgtatggagcacgcataagctaagaaaacagatgttaaagcaacttgattagagcagatggctacagttcacctgttatcttattcctccgacccctcggccttgccctcaattgccctcaattgccctcaattggtccttggtctttcctcagagttggttctgtcctttttccctactctgggagctggaggggagggccggggtgacttgcctctctgcctgtcacccagcccggagtcggatagagaggaggtgttgtacgtttgtgggctgaatgacatcaaagagaagtggaccaaccctcagtggaggaagtgctggttcattgtcaggcgcttaaatcacccaagatgaaaatggaaatgggccctgggtgagggtgggacgggagagacggagaagccag

SEQ ID NO: 30540 - DNA, 2430 bp, Bovine  19866880730167
agggagtgagaatctgtcttctcacccagagacctccttcagcctagtccgtgcctggtagctggtgaagcatgtgctggtaactgtgtgtagagaaagaagcatttcctttgtcatattaagtggacatcatggcagaatttaagagttttttttttaacctctgctgatgcttgctgtatggtatgggataattcaccagcctgtctttccagtttgctcgagtatatctgggaaggaaaccatggcacaagagtgagttaatgctattaatggtgatacaggatgagcgaagacagaagcttggccacctgaagacagtagtcagccatgagcatgcattgaaaacctgccatagacaagatgctcttgtgggttgcaaagagggtaaaactccagcctgttctaaagagggcagaacccgaacatatctcctcttggagggaagaggatcagggagacggagatgagcagatggctgccctagaggggagggcatggcggaggaggcagtgagaacacggagatgggaagagggtgccaagggtcccatcttggctctgccgatgctctgggtgactccaacaagtcctttaactcctggtttttcccagtaaatgatggagttgctctcgtcccttttggttccaaccctccacaactgaagtctcatccagctgacgggcggttggaacttcttcctgggaaccagaatgtatttggaccacatggctttccctgactccccccctccaccccgagaaaggagactttccagggtctgaggggagagcagtgaagagagcattctgttgacttcagcatgtgttctttctgcaccaattctgtgttgagtgtgttgagtgaggatgcaggaaggcagccttcttaaaacaaacaaacaaaaaaaaaccttttattttatattggagaatatcttattaacaatgttgggataatttcaggtggacagcaaaggggctcagccatacatatacaggtatccattctcccccaaactcccctcccatccaggccgaagggcagccttttgaaaacagaaatctggaggtctgaggctgaatgaagccagataaatcttatttttctatttggaatttccttccaacagaaacagatgttctctccatccctcatttgtaaaaaggacctaataataatgattaataataataataagcatgtcaatgagttttcatgagccctgggagatgacacatggaaaggtctggaacaggtcagtctcggtggagactgttattaacttcaccatccttcctgccacttaacttttgtcatctccatgagttctgagaaaagtcccccagggtgcttcagttcccagcttttctcttgggcaaagctactttcgttattttttgctttgaattcaattgaattaaaaaaaaatatttcctgttcttgctactgtatctcttcctttcaaagaatttcacacaagggaatgcagccttggcagccatattatatttcaagaaaattaaaaagaagaaatgttatctgaaaattatagaaaattggcaggtaatggggcacagctctgattcacattcagaatagacttcctcttgtttggcaaaggcttggctgagggagagcaggcagaaggatatgaaaggcagagaaatgcctagaaatgcctcttactttctctttctcatctacattttgggacaattggtaatctccttctgtctcttttaggggaaatataattttgaaatagtgtgcctccttctttctgctgttaagtcgcttcagtcgtgtctgactgtgcgaccccatagacagcagtccaccaggctcccccgtccctgggattctccaggcaagaacaccgaagtgggttgccatctccttctccaggcatgaaagtgaaaagtgaaagtgcagtcgctcagtcatgtccgaccctcagcgaccccatggactgcagcctaccaggctcctctgcccatgggattttccagggtactgtagtggggtgccatttccttctagaatctttaaaataaagtatttccacgtattatgtaaaaaggtgaagaatcttgacaatatctaaataccatagatcacataaaacacttattaaggctcaaatttaattaatagttaaattgaagagatctttcaacaataagttgaatgagctcagttttatattattaaatttaagctcaaattcccaattaaaagctgttcatgaagtgaaaatatgattaactataaatactaaagcagcataatttaaattcttaatttaggtacttcatgatgtatagcaaaatgcagcatttgaagtaattatttaaaaaattacttggagataactatgagccaaccaagaggtaatgtggtcaaattaaatttaaatgaatttttaaa

SEQ ID NO: 30541 - DNA, 1757 bp, Bovine  19866880869916
tgatggcctttttgcacaggtgccccccccaacccctggccttacctgaggtcaccactgtctctagagggtccaacaggagccagaacagggggagacgtgcagtgtgttctgtccagctccctttccctttgtcagcatcagttaagacagggctgctcggggtggacacagcccatctcctgggctgccagagctgggtgagttaattggagggtttagggtggagacgatagatggccctgtgaatggacacgccaaggtttagaaaataataacatgaattccttggtgaccagtggttaggactctgtgcttccaatgccaagtgtttgggtttgatccctggtcagggaactaagataccacataccatgctgcagggccaaaaacagtaaatgaaaatttaaaaaaggatattgctaaatttaaaacacaaccaaaaagaagaagaaaagtaataataaaagctgaggaagaacagaaagtgaggagacacgaacagaagcctcagatggtgtggcccctggggacttacccttagggtgagcgggtgggtctgagcccccgacctgaggtttttcatatagtttcatggagggtctgttactcagctctccttgaagaaaggagaacatgctggcttcccttcatgtggggctacatttgactacatgaaaggcaaagaccctacttccaggccaaaccctcaggggaaataattattttccagcagacgtttcttaaatgactcttcaaagatccatgccccatttcccactggtagcaggaatgcccccccccacccccgccatcctggtggctgaagagagaggcccacggatctggaaccatctaccattaccgagggccaccatgtctgccaaccgggagctctcattagggaggagagctgagtgtcagcttggctgggccgcaggtaccaaccttcggtcaggtgtgtatgtgcgcgcgcgttcgaatggggtagaccgggtgaagcagctgggcctccccagggcgagtgggcctcatccggtcatctggagcctgaacctaacaagagggcagaactagagggaactcctcacgcccgactgcgagctcggacactggtctttttctgacctttggactcagactgaaaaactggctcttcttgggaaagacccaagccagcttgctggctgcatggcttgggacttgtcagcctccatcatcacatgggccaattaactgctaatagtaaatctctttatgtagatgtaaaatctcctattggttctgttctctggggaaccctgactaatagagtcagcgtggttaatagcgtgaccatgtctccaatttatgcagcccaacaaacacccagagcctgtggagctcattaactcagaatcattaattaagtgcctgctgtgtgcatgggagaataaccacacaggtctcgccacagatgcagaagttaacagtcacagcggtggctggctgtccacagaagaccactaaggcaagtaaggagtcgggagcttcttggttacaacagaaaccagcgaaatagagttcaattattattgtgagttatagccacgcctcttctacgtgtgtttttcaaacaaacttgttgtcatggtaactctcttaaaacaagatgcaacaaggtttaaagagcctgagagctaattacaatagtgctttatatttagttacacctttcttctgaggagtttaatggacctcattcattaagctccatc

SEQ ID NO: 30542 - DNA, 1906 bp, Bovine  19866880870050
aacctcttaggagtgtctagtagggaggacagaatgtgctaatttcttcaaacataaattttaatcgatttgtaaattttcagttgcggtttgaattggtacctgtctaacgtttcccaattaccagagaaggaccacgttttgctaatccatgtcattttaagtaacgtagccataacagaaaacacccaaaggtgttctagggtgaactttctctgtatcaaaagttactgaagtaaagctttgaaagatacaaggaagcaaaatacttaatagtggtgtgtttcagagaaacacacacttgctaagtttaagcctgaatgttgtcttttttttttttttaaagaccctaaacggcccagtctatcactggtgaccctatttaaatgttacttatgtaaacagaatgtgtgtgctggctgttggtctgttcccttctcctctgggcgaattaggaaactaggaggttgacaaagccagcaagtcacattagatcaagtctcgaaagttctcccatgcatgggtttggatttatggcaggctcgtccccctgggcctctcatagtgtcccatgccagagtaaatccggcccgaaccattgcctggcctctggcagtaggctgcaggcactgaagtgggttgcacagtggaaaagatgccctccctatcagattaaatagattaaaataattattttaaggtaactcattgacctatgtcacgtttcatgaacgccaaggacagtggctctgatggttaaatgagctttgtttttgtttattcataaatcattgtttgctaatttttgtaattcatagttgagaatgactcccaggtgattatcattcatagccaagcatgtaagttagagtgcctgtgaggatagttgggattcccagaatcccaagtagttaagtaggcagcactggttttagaatattgattgccattcagatacagcagctgtaatacattctgttgattttttttagattgcattttttaaaaaaacacatgcctagcatgaaaattagctcatttctcaggaaaatttagagcactcagtaaattgataacaatgcctgttgttcactaaaagttcttctgtataagacttagcaaatgtcagaaatagcaaggtgtttatatggcagctttgctaaattgctatcatggtgttttaagcttcgagagaaaaacaggtctgaaataaagtaagctaactgtcatgaagccttttccctctcagtggactaagtgcaggaaagtttctgaaacctgtattctgcattttagcaggaatgtttggagtgccttttttgaggtggacaaaactatatgggcttccttggtagctgagctggtaaagaatccacctgcaatgctgggttccatccccgggtcgggaagattctctagagaagggcatggcaacccactccagtattcttgcctggagaatcccatggacagaggagcctggcgagctacggtccatggggtcacaaagagttggacacgactgagtgattaacacttatgcttacagaaatgttgtccaggatagttcagagatttctgtatatcctaaatcctgtttaccctattgttcatattttacattcttatactacatttatcacacttttgaaagagtattcttaactaaagttcatgctttatttagatttctttagtttttaatctgagatcctgtttttttttttttcccccagttccttctgtaatactacactacatgcagtcatcacgtctccttacaataccttggactgtaaaagtttctcagattttccttgatgtgatagccttgagagttttaaggcatactagccagatactgtttaggatgttcctatattcatatttgtctaacatttttcta

SEQ ID NO: 30543 - DNA, 1085 bp, Bovine  19866881128139
ctggggagggtcctggagctggtgggcagcccagcctctcctcctgctgtgggcgagggtagggggtacagatcaggcctctgccccatccccccaggagcacctggaacctctaagcacacgcatctgtgtgcccctttgcaggcgatatataaaatggtgtcctccgtgatgaagatgccagaggacgagtccacgccggagaaacgcacagacaagatttttaggcagatggataccaacaatgacggtaggacccctgcatgtctgtgccacactgctgggagcagagaggcgtttggggcctttccccgcagcttctgggaccttgcccagcccagtgctggccagtgcaactatgctgagagctgggctttggagtccagtatcctgccccctgagcggtagtctcctcacttctagaatggggagactgtgtgcgtgtgggcatgtcccaggggagaagaggcaggtgtgcccatggcacattggacccccgaggggctgggatcaggagtcctgtgtggtggatggatggatggcccccatcatccctcctccaggccccagtggccccggggactctgtcgggaggtgctggcctgcagcagctgtgccaggcttgctgggaccacaccacagtagaagtggtaggttccaggggggcggccatgggggcctggcagggaggatgtgccccgtgtttccttctctgccttggctgtgagcttctttggggtacacgccggggagggtaaccatgaaacaggctggatccgcatgaagtgcagccccagagccatgtcggatttgcttttgaaggataaagaaatgcagcatttagaaaagaaaaagagaaaatatcctctgcactgtgcttgggggttgaaaataagctaatgcatgggaaagccccccaccccccggccaaaccttaaagtgcagtttgcagatgaaggccaaggactgagccagcaggggaaggggtgcggcggggcctgcaggcgcatctacccatggagacagttttcaaaacatgatcaacataagacaagacggcctttgcgcctggcatggcctttggg

SEQ ID NO: 30544 - DNA, 991 bp, Bovine  19866881165598
ttgagttttatgctccctggtgtggacactgcaaaaacctagagccagaatgggccgcggccgctacagaggtgaaagagcaaacgaaaggcaaagtgaaactcgcagctgtggatgccagtgtgaaccaggttctcgccagcagatacgggattaggggattccctacaatcaagatatttcagaaaggtgagtctcctgtggattacgacgggggacgcaggagatccgacattgtttcccgggccctcgatctgttttctgataataatgctccacctcctgagctgcttgagatcatcaacgaggacgtcgccaagaagacgtgtgaggagcatcagctctgtgtcgtggccgtggtgccccacattcttgacacaggagctgcaggcagaaattcttacttggaagttcttctgaagttggcggacaaatacaagaagaaaatgtgggggtggctgtggacagaagctggagcccaatctgaacctgagaacacgctggggattggagagtttggataccctgctatggcagctattaacgcacgcgagatgaaatttgctctcctaaagggatcgttcagtgagcaaggcattaatgagtttctcagggagctgtcttttgggcgtggatctacggcgcctgtaggcggtggtgctttccccaccatcagcaccagggagccctgggacggcaaggacggcgaacttcccgtggaagatgacattgacctgagtgacgtggagctggacgacctggagaaaggtgaattgtgagaggctccgcaaagacttcagctttcttttcttgggagcagattttcctgtggtgaaggaacgtcctttccagtccaaggaacctaccagtggcctttttaacggagaagtaacccttgactggtcatttgaaaacactgcagcagtgaacttttgcatctcaagaaaacaatgaaaaattctatgagttgtcatagccagtgaaatgagtt

SEQ ID NO: 30545 - DNA, 745 bp, Bovine  19866881255401
ctctctctttcttgaggtcttacctgactccccctacactagctccaaagagatgtgacttttatttttcttctgaaattagaagaattatgattctcagatcttcttggtacctttcttaaggctcgtatcacattctacccttcattatgactatataattctcctatgtccctaaatagttgacagactccctcaaaagcaggtgttcggttttcaaacacacaacactgccttacattcatttttaaatgaatattatatataatattctttgaaaaaaatctcaatttgaaacaaattaactctttatcttctataattcagagtcctgaagtaagacaactctttacagctagatgttgaaaacaataaaaatataacaaatcacatacaaattttctctgtagtaggtaaatcctataaaaggtagctgatttcccacaaaagccttgggaattgggaaggtttctacatctcctttatcatcttcaatgtcatcaaaattgctgctgtctatgtcactgctgagttcaggtaccacaggagctgcagctattaaaagaaaagaaacattgtttaataataatatatatgatttaaaaagacagaaaccacccctgttatgttttatattagttattatagattattaatgttatattgatattagcacactatataaatattaatacattatatattgatatttgattagcaaacaatactatattgtcatgattta

SEQ ID NO: 30546 - DNA, 494 bp, Bovine  19866881327374
ccctcccccacccccccctccccgggaacatttgccaagcttgggaacaaggaggcttggtgtccacgctgttcggaaaccagaacaaaaccgtgggcctgtaccaggaagggacttggaaataagacgccttagaaatgcaggatccttggaggctgtactctcagggacaagaagatggaacacggaaaaattaacagagcaagatgtcaaggaaacctttcaattcccactcctactccctaagaagcgaaagagagtcctccatgagaagccataatcacatacctgccctcgttgggtatggagtttgaactgacactatttggtctgcaaaccaaaatcaagaaattatctatgagtgacctagggttgacggttccctgtgtgcttggcagaaataactgcaaattctctctggagcagcatgccctcaacccaaggtgtataggagttccaagataaatcccagtcttttgtaagatcaaccttaa

SEQ ID NO: 30547 - DNA, 1356 bp, Bovine  19866881329557
atgtgcctgcatgtgtaggaagaattaatgccttttacaaaaacataagtacatcatggttaaaatccacatttcatacaaggagatctaatatatccatctatagaacaggaatcttcttccctatccaactgtgtatgtgtgtgtgtgcacgcatgctcagttgtgtctgactctttctggccccagcaggcttgcttctctgtccatgggattttccagggaagaatactggagtaggttgccgtttcctactccaggatatcttcctgacttagggattgaaccaacatctcttgtgtctcctgcattggcaggcattctttaccactagcaccaccttggctctctatccaattatgtatgaataaaacgtccagggatttcagcctgactgccccagacacaggccaagaggccatccaaatttcatccgtgtttgccctggacgagagcgtatctccctctcaccactttggaactacaaacaccatggaggcccaagttcagcttctggggcctgaagctctttcttgctgtcttccaactcttctacttaggcccagggctaaggaagccattgcggggcctggttcttggcctgcagctcagctgtggtggacaccccagggccgactggctaggaacagagacctcagtgggcacacgagcagctctgactccctctgcagtcacttgactcaatctcctcttattattattattttttaaactcaaagtccaccaatttaaaccacttttaaaaacaatcatcttctttgcagagtttccttggtggctcagctggtaaagaatctgctcacaatgtgggagacctgggttcgatctctgggttgggaagatcccctggagaagggaacagctacccactccagtattctggcctggggaattccatggactagtgcatgggcttgcaaagagttggacacaactgagcgacttccattttcatgcccagtttacaatcaggcttcaagatcgtgacacacattaaaaactgacattatacagagacttacttgttttccagagctgtagccactgccccggccgccaaggcggtctttcacaagctggcgcagagcactgagggcagcgtccacgatggcctcaccagttctgccacctgcagggagataggggcatcaggtgaacagcagtgggcaggctgagtgtctatatctgatgctagctaaagactggaacagacatgtctgtcagcttcatctggtgttcaaatagacctaacaactcgagtgtctttaagacaggaccagtttcttctaggatgttatttcctgcttaaactttaccctgggaaaactaattcct

SEQ ID NO: 30548 - DNA, 711 bp, Bovine  19866881370032
aatgtggctgaaatggaaaaaaataataaattatactcaccgacatctttcttctgaagtgccctcttcttcctgtcagaaagccacttaaagaaagtgaagagacttcattttaaaacacatttacttgaactgtctctctgcttacaaaaaataatacgtgctcatatttaaaaactgaaacttaaagaaatatgtaacatagaaaaggaaaatactctgtaatcctaaccctactgttacatcctggaatacagatttttcctggtatgcattttcctatactagacaatatattttaagaaccaccatatttttacacaagagaaaactagctcatctaatcaacctaagggaaaggagtaagcctcaaatagtatgggttataactaatatatggaaccacctgaagtgaaattttaaaaagcaaaacattaaatggagaaactgtctcaaataaatatattttttacaaaacaaaaacctagataaatagctgagacttgatgataaataaatgatacttttaaaactcatattcacagacaccacattttgttctgtaattactataccttattttagctagcaatataatcccattgcatgaacaggtccaatgatgaagcaccataaagtacaattaccttaaaggtaaagtctccattttcaactaggggcaattcttaaagcgtattttggttggcacaa

SEQ ID NO: 30549 - DNA, 1300 bp, Bovine  19866881378183
tttacttttgttttattcatagagaaatattttaggaatgaatctgtcataatattaatgctgagtagtagcaacagcaacacagtagtgaatgcatttactatgtgccaggctatattcaggattttatatatattcactcatttgaagcttatagcaaaattttacagtatagctactattattaccaccattttacaaatagtacagctgagactcagagagggtaagtagcttgtttaaggtcacacagctagtatggagtggaagctggattacttctcatctaggtatataaagagcttgctagaatttccttattgctttgaaagggatttttaaaggttggatgaacaggtaatgataaaaaccagtaaactctcattatctttttttttttttttcacattggtttgaagtaccgattttattttcttaaattgtaacaccatgatgcatccttgaataataaaagagttatctgctctttacttccagaatttgctgtttataatagcaacatatttattgagtgtcttataaactctagacactgtgctgagcatgttatagttttttcatttaatcctcatgatgactatatgaagttggtgaacaccgttttgcagagaaaagaaaattcaagcctagcacggtggactcaacaggctggtcaagcctccagattggtgtttgatagcctgtgttattttgctttgggggaagattattgagaaatttgatcttttggcaggatagtggttttgaagcgcgcccttccgtgtctcaccccctggcaggtagagtgtctccccgcggtctgacaatccagggcgagcccttcggtgtctcaccccctggcaggtagagtgtcaccccgaggtctgacaatccagggcgagccctttggtgtctcaccccctggcaggtggagtgtcaccccgaggtctgaaactccagggcccttgtgcccagcactgggccttgtgctgcctcggtgcttttcatatgcagatgatcgagaacctgctggctgccgccttctccatggcagtgggttcctgtttgtttaggaagtttaggggagtgtctctccccctaaagcagatgctaaaactctctcccttatcactttactgttttagggagaataatgtttgtgacataaattcagtgcatggcttatttgccacaggaacgatagaggtaagcatacattgacttcattttgaaaaacatttgccctgcatttgctaacagagtttcatgtaaagacagggttactggttcctaagagcag

SEQ ID NO: 30550 - DNA, 796 bp, Bovine  19866881404325
acgtttgaaagagactgctttatgagtatacattaattatgtccttacatgtgtatgtgtgagattcttgactgcaaagacgttatcacattcatttctacttccttctcgacagcacccagattaataagaagtgtgtggtgggaggggcttgtgaaatgtttggtggcaccctgatggatgggcgatggagggatatagtgatcaaccatcctccctgtaagaatctagccaatagcccttatacttgcgtccccaggcatgggctgggaccacgactctgaatattcagtcctctctcctttcgtgtgaaaggttaagtgagaaggagaaaggattgtttttctggcatttcttgggttccagatcagaggatgccctgtccagcttcttggctctgagtctgccctcacccagatctggctccattggccttctcacgtctgctgggatagaaaagggtacacagcacctgtggtctgaaaacagtcacagaaaccccttcaaaagccatcgtggccatgtaggaggtaggcgcacttctcagccttcatccttcttacagcaatttgggtgttcagctacgttcatttgaaagtcaatttaccccaggagatggggaatagagtgctctagagctcaaatgggggtgatttttgcaaaagtcgggcgctggggaaaatcaacatcactcccattttaaaaccatcaaaatcaaggtctatttgtttaagctgtttatttggtacagacaggctgccaggactacaaatgaaacatttgttcctgctgatgg

SEQ ID NO: 30551 - DNA, 679 bp, Bovine  19866880446492
aattttaagaaaaaggtgatggctcttttaattgctctaggtcaggaccttaagttctcactcaaaacacacttattaatcccaaattagagctaaacataatgcacataaagagtagttttgatttatttttgttaccaggattttcacagtttgcctagcatgtttgtacaatattactgaatcttccaaatttgaatgtcagatgttttaacaaaataaaaaatatcaagaagcaagtttctagaatgttgttcaccatgtgactacttgtctgattatgtcctgcagtggccggtccatgagcggaagtgctgaccgcatccaaaagctgcggaaagagtattatcaggctcggagagaaggtttcgctttatatgaggatgacgaaggaagagcaagacctgagtatgaccttcactgggtaagtctatgcctgaattcattgcactcatctttactgatgtagttaagagcagaagaacatggctaggaatgtcctatacatatcaatgtatatttaggttacttgggtttcatggatatgaacattacctaaaccacagcccattttctcctacagaagttgtttctataaatcaaaccacactaatgcacagtagttcattttaattgctttcatatttactccctcttggacttgtatgcctgcttgttt

SEQ ID NO: 30552 - DNA, 1134 bp, Bovine  19866880482569
gattactggttggttagtagcatattgttttgcctccatgtgttgttgttttcctttcttttttttttttttcctgtgtcctggtgtgcatgagaccatgtctacaccaaaagtggagtcttgcttcccctgctactgctactgctgctgctaagtcgcttcagtcatgcctgactctgtgtgaccccatagacggcagcccaccaggctccgccgtccctgggattctccaggcaagaacactggagtgggttgccatttccttctccaatgcgtgaaagtgaaaagtgaaagggaagtcactcagtcgtatccgactcttagcgaccccatagactgcagcccaccaggctcctccatccatgggattttccaggcaaaagtactggagtggggtgccattgccttctccctagtcttatggaattcctgtgatcaaaccccactggtcttcagagccagattctctgggggcttttcctcccattgctagacctgccagctggtgagcctgatgtggggctcaaaactccttgggagaatttctgcaatataattaatttccagtttgtgggttgcctacctaccaggtatgggccttgattttatcatgattacatgcctcctaccatcttgttgtatcttcttctttttctttggatgtaggatatcttttctggccagttccagtgattttttttttatcgatggttattctgcaagttagttgtgattttggtatcttcataagaccaggtgagctcacgtccttctactctgccatcttatctccctaaaaacttttgttttaaatatgtgtgtgtgcgcacataatatttgcaatcactgagaagttctagtaaaagccaatcctcaattttgagcaaagagtttttataaacaacagcaacccactcccccaccaccgaagaaagaaaaatccttccagcactctgtgaaccttaaagagtgtttttataggccagctcattgtttgtcttctctctgaaaaattagaaaggataactgctttgatgagttctacagaaaaagacaatttccatgatttcatttcttgacaaagaacagctacctcacttggtttctgccacatgtaagcaaattcccagatgt

SEQ ID NO: 30553 - DNA, 1368 bp, Bovine  19866880524782
ctctagttattagcagcaagttataccatagacttaacttctcttggcttatgggaactcctagagactttgtcccttgagtccttcctgctggactgctcccaagaacatcttttcttcaataccctgaggatgtgccttcagagtggcatggcaaaccttgcaaacaaggaagaggtctgtagggagaaaaagacggaagacacttagtcatttttcatcttgctctctagttgtcttaatgatgtggtgaaattaaaattatacattgttttctagaagagtagctcccagactttctgcgggctaatcaatgttataaaaatagaagttactataaggcaaccaagtttttattttgtcaagtaaaagcataaacaaagctccccgtttgctataatcagtgtttcataaagaaaagcacatttacgtattaacaaaatagaaaagatataatcatagaatgtgggagaattcttcaaattaagcaaatggagttagactttcccgaagtggagttgtacttatttttctcattgtgttgctacttggtaagaacttatcctagaccagcatggaataataagcaataagcactgtttttgaggaagggagggatgactgcaaacaggaggaaaatgagtaggaggagaagcaaggagttactccctgctgctcataactgaccttgtggaatcaccaactgcccagagggagactcagttcatcctgtccttctcctgatgcttctgctgctaaggattgctcttgggttgagtagtgaaagtgaagtcgctcagtcgcgtccgactctttgcgacccccaatggctgtagcctaccaggctcctctgtccatgggattttctaggcaatagtcctggagtggattgccatggaacctatatcttgaaaactgagttcaagctgttacttaagaatttctgaaaatattgacagacaacagcagtacttttaactttgaggaaaagagcactttaagtgcattctgtcatcttggttacttactgaaatctatcaatggtgaagtgggtaataagccattgtttgcattggcatggcaaccatctacttaaaactaattatatccatgtatgagttgtcgtgtgttgcttcaagcttgtgggtggtctacagtccttatttcttacatcatttcaaccacaggtacccctggatgaacagctgtgagcacttggtattgctaaagtccccccacctaacttttatcgcactgcctagcttttctgttggcaccttatcttaccaagatcaagtgcttgacatccttaatcatagatctatgttctagtgattttattcttataattaaaatcatctcagaaaa

SEQ ID NO: 30554 - DNA, 3322 bp, Bovine  19866880591027
taagtgctcgcagtgggtaactatttggacttctggatttctactgactctagggaaaagggacatcctcatagaaaaatcaatactttggaaaatagtgctctgaaataaatggtaaaaaaaagggaggcattctttcctgcaacttagttatataaaaacaaatctataaaaacaaaatctcatctgtgtactggtgtaattaaaacccactgtatacatggtcctatgttaggtcctgttgataggtgcaaaaatgatgggtatagaacaatatcctttgtttcaaggaatttataatctaatagtggtggaaagggtcagtgaagaatcaaaatctagtctaagatgttttcagtggcactggtaaagtggtaaactaatgttatggaagttaaaaggaggaagagctaaagaaagatggcagagggcttgggttttagcatgggggctttgaggtattagaggcttcccaatggctcagcagcaaagaatctgcctgcaatgcaggagatgctggttcgatccctgggttgggaagatccccctggaagagggcatggcaactctctccagtattcttgtctagagaatcccatggacagaagagcctggctggttgcagtccatagggttgcaaagagtcagacacgactgaagcgactgagcccacatgcgtgcactttgaggtatcttggagatagaaggacgggtacttaagcaggcagtgagatacgaagattggccaggttcattttggattcatcatcatagggataagaattgaatctataagaatggcggagggacttccctagtggttcagtggtaaataagctacctgccaatgcgggggacatgggtttgacccctggtccaggaagattccacatgccatggggtaactaagcccgtgtgccacagctactgagcctgcgtcctgcgtgtccttgagccatgctctggaacaagagaagccaccggaatgagaaacctgtgcaccgctactaaagggtagctactgctcgctgcaactagaggaagcctgtacacagtgacaaagacccagtgcagcctaactagtaagtaaataaaatttaaaaattaaagtttaaaaaaaagagaatggaggaagcagctcagagagacgctatatagaaaacagggctagaaagaataaatacatgtataactgagtcactttgctgtgcccctgaaactaacacaatattataaatcaactacactccaatattacacaaaaagaaaaggcctggaggcagagtcagctgggagcatcagcggcatggtcagaagcctggggcaagaggtgagagttcagaggctggtgtggaaagagagccaattctttcccaaaaaagtagcaaaatgaggatttgaggaggaaggagggttgagggaagatctctgttttctctgatggaataaaatcaagttcatggggtcggtctgccacctgagcctggctcagctacgagtcctgacagctggaggcttggtcagcgtgtcaggtcctgagccgacaggagtatctctgtcatatcccaggacattcccccaccggtcaatagcgggcccctcccttaccatatctgtcctgtgacaagagcgtcatgtccagccttgctggttaattcacaatggtgggtctctaccactcaggagacactgggtctgaatctaagccttgttggccaggggccgtggcctcttaccgagacctgagttagctcccatgtccctgacttgagctccctatctataagaacagcaggccactttagtttgtaatgtccccttcatgatcatctggacttgggtctttctttacgagctggctgatccctcagcctcagttatgcccccagcatatctccctgagccactggctctccttttctgcacgctggggaactcccagcgaactatgcagctgagcctctgcattcacagttgtaagcacagggaggaaagccactgccaagggcttaatgatatagatgagagaagggtagttgatgatgtagggtccctgaaaagccagtgagaatgagctctgctatacaggtctgactcattaaaaaagggaacacatcatttccagagagaaaattaaaaagaactaacagtattaaaaaaaaaatccttaaaattcgtcagccagcttcttcactaagggttttgctcgaatcactgaatttaatactcatacaagcattatacagagtccctaatatcatccccaatttgcagattaaaaaactgagcctggaccagttggatacttgcccaagatcccacaggtgagaagtgatggatggggctataattatggcctgactccaagtccatgccttcgcatctccccttgggaagtgtgtgttggtgaagacagagcgagtctgaccggcagggagctgaagctgaggaactaaggttgaatgtctcaaggtcgtaaagaaaaggaagtgagatcatctctagagattgggcctggggggcttagtcatctttgcagaacttaacgggagcagaaaagggttggaacggccactgtgggacagtcaagggagttgacagcacgactaaaaggaattctggacagcagcaggggcccagctggggctggataatgtgaattttgtagtggaaccaatgaacgcttttctgagtttctccagcaacctttcatcgcccttgcatgcaggaccacagaagagatggagagcctttttgctccctcctcaggactcaacactcgattacaagcccggaagagcaacatcatgtgctgatgcactgagccatctgcagagaagggataatggggtcccgtgggggtcggggatgggccaggtgggaatgatggaggctggagatgggagaggagagagtttactgccgaacggccggaccaggaggaggtctgtaaaatcagaatggggcctgggagaattgaaagaggctgggaggctgaagtgaaaaagaagctgtttgcaaaaatacatacattgttgttcacacgttatagcagcccaggaaacagccacttccctgctcacccagggtgagtaataatttgtgtcaggcaagaatagggggaggctgatttccctctgtttactaccaaaaaaagtgggggccggacggcctgggtaaaacgctggccttgggaaaagcctgacgctctctaacgaggttgtattacaaccacgctctgctttccaaaacagcaccctcaggagaaaagaaataaagtcatttttcttcagaggtaaaagatttaacatgccttaacaat

SEQ ID NO: 30555 - DNA, 1091 bp, Bovine  19866880627789
atgtaggtcctcctttatagctgagacagacagatctcagtctgaataacttctaataccactgaagtaaagcaaggggggacatacactcttagtttcctggaaaactaaaaacatacagaaaaagtctgtttggggaaattctaagataaggatgatgaaatatagaaaaagtattaaccggaaagcttcctggccagctatgaacttttcttgtgctcctggggcaatgagggatcattgatgtctcttccccaaacagtttcttgatatcagaggattaatatttccctgagtcacagctgtgtcatgcacaattgttacctctgttgatgtttgtccccagtctttctctcatgatttttcctgttaaatttgctttcatttcactgcttttttttttcctctcacttctgttcacagctttgtgaggctgtgtgtagggatttgaacagtgaacacagtagattacttggagatgtgctttttagtttctgcaaacagagccaaatcagtttgggaatcccagtgataaatgccatatccatagagagttaaaattcatcagttgagcaaagtaatcagatttttttcttaaaacatattaccatcaatttttaagtgacttttaaagaataatgagaaatctcttaatgaaagaatctatggccagataagtgctaatagtaactgatataccattaactctactttgctctatcccctctctttcaaacttgatgtcctcattaatttttttttttttttccatctctgagagccctactcttgggactctgctagacttatgtctgcctaagttgtcagcttccaggagtgacaaatgtagacaacattccctttattatgcatgagctaggcaaggaaacttggtactcaatgcccatccatttccaagacctccacctccgtgccatcctcaatcactgctagtaagggagcacatttgaggaatgcttggcaaagggctactctgatttcttaaggctgtcatgtaagcactgacttgactgcttttcaaacaaatgtcctgatccttaagaatttattcctctgatttatcctgttta

SEQ ID NO: 30556 - DNA, 1163 bp, Bovine  19866880759901
ttatgaacctgactttgataatcttcccatattaagacattctgctaaaatgctacaagtttagaggaaaggcaactgacaatatcccatctaaacaaaaagaaactaatcaaaataagctgttcaattattttccttttgcaatgtgaagtatattattcctgaaatatgtatttacgaatacgtatccagagaagcaaaagtacacacactcgttcaaaccattatttctgaagtgtttattttctctaatttaatttcagtaattttgtcaaataactgggtattcagcttatagacttgcttagaacatctgctagtttagaaactacagcaaataaaatattttaaaaataactcttggataagcctttttaaccattttgtgcctaaattttccttccttgtaaaatgttagagttaacactacaaatctttaagtctcttctaacctacacacatttataaatgttaccttgtatataacttctacattatgttaatcaattacaccttattaataagtacccaaatgtagttacataattataattattttaaagctgaataacaaagtaaagcaacctgcaacattataaagttataaaacatttactgggatttaaacattaaacctcatgctagcaccatccaagtcctagctatatgtacaggggacatagcctcaacaatctctcttctgattatcttcggagaaaataaaatcagacatcttctgcccagctctgtttgtgtctcgggtctaagatacagttaccatagaaactatgattgtggatacaatttacaaatttggcttcatccatcagatgcactttgtgtgtgagagtgtgtgtgtgtgtgtatgtgggtacatgtccatatgtgtcttgccaataagcttgaagagcaaactctggctctgtgtctttaattaaagagccagacaccactcctcatttcctttccccatctgtctacctacaaatagagacattgtaacactggctgacatataaactcttacttggaagatgacaaaagtctgatgaaaagatgagaaaaacagtattaggaaaagaattccccaagaaatttgtctgttcacctgtcctgtattttcaagaacagaataaaagccctttggtggagttttggttatt

SEQ ID NO: 30557 - DNA, 2221 bp, Bovine  19866880788298
tctctttaagatgttggacacttacgagtactaacattaaaactagcttttactgtgctttctcatcccactgattatttattgtttgaaaggataaatacaggaaagcaattgacctaacaatggcctattcttgattactcactgcattaaatacagaaattatgaagaagaatctgtctctagcatcagcaaagattatataatgaaaaggtatgtggcttcgcctaaaagattaatgcaaaccacaggtcacaagaggcttgggctaagtgtggtaaatcaacacaaatctagcactactgcagagaagtaggtcaaagcctaaggcttctgatatgtctttgttcctccatacctttgagcaggatgttttgcacctatgggacatctaatattttttaacagaatgaataaatgagggagagaaggatggcagggtgtctggcaggtgaggagctacatgaatgctctttgcatgtttagtgaattccagccttttaaacatcaatctacagtgataagtgtattttgcatcatgtcccagtattcacccacatacatcccctgtatacatatggctcagagttgaaagaatctccctgcaatgcaggagacctgggttcaatccctgggttgggaagatcccctggagaagggaatggcaacccactccagtattctcgcccgggggaagtccatagacagagcagcctggttacattccatgggatcgcaaagagccggacatgaccgagcgactaacactttcacttttaccttatttttaagacacgatgctattgcacgcttagagactacagcatagagcaagcgtaaagtctcggggctcatgttattgtgacattcccgttacaggtggtggtctggggctgagctagcagcacggccacgtctgcctgtgtatgtctcatacaaattaaacgtaaacatttttagtgaaattggatcatactgtatggacttttttgtaagcttgttcacttaatatctgattatttatacaacattaatacctactttatcactttaagtagctgcctcatctcctttgtaagtagacaacacaattcatcaacctaatcctcggttgttggacattcagattgtttccaggttttcaccattatagacagaatgatgaatatgcttttcgctacatctaatgtgaatatcgaaattatttctttacaataaattcctaggagtggaactgttaatttttaagcatgttctagttggagaaggcaatggcaccccactccagtacttttgcctggaaaatcccatggatggaggacccagtccatggggtcgctgggagtcagatatgactgagcgacttcactttcactttccactttcatgcactggagaaggaaatggcaacccactccagtgttcttgcttggagaatcccagggacgggggagcctggtgggctgccgtctaatggggtcacacagagtcggacacgactgaagcaacttagcagcagcagcatttttaacatctttattgaatttgttacaatattgcttctgctttatgcccttaggaataagggatcttagctcttgcaccagggatgaaactgtaccccctgcatcagaaggcaaactcaaaaccactggaccacctgggaagtccctacaagtatgttttctatgtctgtgagcctgtgtttgttatgtaaataagttcatttgtatcatttctttagcttccatatataagggatatcatatgatatttgtctttctgtgcaattttaatggctgcttagtatttactaatatgaatacagcttcagttcagttcagttgctcagtcatgtctgactatttgcaaccctgtggactgcagcacgccaggcctccctgtccatcaccatctcccggagcttgttcaaattcatgtccaagtcagtgatgccatccaaccatctcatctgctgtcatccccttctcctcccaccttcaaacattcccagcatcaaggttgtttcaaatgagtcagttcttcacatcaggtggccaaactattggagtttcagcttcagcatcagaccttccaatgaatattcaggactgatttcctttaagatggaatggttggatctccttgtagtccaagggactctcaagagtcttctccaacatcacagttcaaaagcatcaattcttcagagctcagcttt

SEQ ID NO: 30558 - DNA, 1193 bp, Bovine  19866880876062
ctgataggctgccatgggctgtcataatccagacaaaaaaagatcccccaccgtgcaaggcacacccaaggattagcttttcaacttgttttgaataagctctctgaagtttcacttcctgcgcagtagaaagatagatatgtcccaaatccaagcctaagttctaacattacattgttgtagaaaaatctaggtttctgttatggcttaagtcaagattatttctatcagacatatatttaggtcattacattaaaaaaaaaaaaaaacctgcatgataccaagtgagataaagagcttctttaaaagattaattggatcaaagctgctgaccttattttttttatgataagagaaattacctaataaggaattcttcaaggaggaacaattctgagtcttgttgagcatagaacaaaatgaggaatgaacttataaatgcctctgccagttctctctcccttcactccctccaaaagtggcttgacttcctaaggacctgactaaaacttataattagtgcctctttggcaacccttctatttcctactttcagttcacagctatttgcaagaagctttgtccccagcacaataatttgtattgccgccatttctgaaatagtaaaagtgatcaaatcacaagagaagactagataaattatgatttatccataaatcagatattatattgccataaaaattcacatttgtagaaatatacctgctagcacaggaaaatgccaataataaacaggtgggaaaaattctatataccactaaaatatttatatatttataaatgttaacagaggtcatctttgagtaatttagggaggaaaaaaaactgttaaatctgttttttaaataattgaacacaaatgtattcctatcatctcccttgactaacaggtgtttctctgagcaggaaatggcttttctaatctccgtatcttagagtacttagcatacggctctctacttaagagacactaacaaatgtttatttacttgaaagtatttctctcattttctgagcatgatagaataagacagtatatccagtggttgtttatttattagaatactataaagattttcaacaccgtagagtctggctttctctccccatcaatcctttgaaatcacgctcaataaagcaccaatcagcgtctcattgccaattcccacata

SEQ ID NO: 30559 - DNA, 1354 bp, Bovine  19866880893240
cacactttagagaaggtaggccagtataatttgctgacgttttagctttgaattaaatttagcttctcatccttattagaatctaactgccaaatagcactctacttggattaataaagttttctaataagcatatcactttctagtactctgccgaggcagctgaaatcttgagtacggctaaagggagaactgccaaatggaaacagtattgatacattctctgtccagtacaatcattctttttattgtcaagcccagctctgggtaaaagagaacggactatgttagaaatgggatatggtcactatttatgaagccagtccagcagaagacttagaaaaccatgaaaacccactcaagctaatgctccagattaatttagaatttaaagtgcttgcaattaacattttcaggagaaactagggcttatgactggagtagagggacgagtaggtaagctactgcagggtaattgggaagcttttaagcaccactcattgcccccaggctgatgacagaaattcaatcttaatttagtccaaggctttgatctccattaaaatacagatggtgctggatgtctgtctctataagacaccattcatctgtatatgagtgaaggctttggttcagttcagtctcacagtcatgtctgactcttagcaaccccatggactgtagcacaccaggcctccctgtccatcaccaactcccggagtttactcaaactcatgccatcaaatcagtgatgccatccaaccatctcatcctctgtcatccccttcttcttctgtcttcaatctttcccagcatcagggtcttttcaaatgagtcttttcttcgcatcaggcggccaaagtattggagttttaactttagcattagtccttccagtgaatattcaggactgatctcctttaggatggactgattggatctccttgcagtccaagagactctcaagagtcttctccaacaccacagttcaaaaacatcaattctttggtgttcagctttctttgtagtccaactctcacatccatatatgactactagaaaaaccatagctttgactagatggaagactttgataccagaaggcaaagttggtgaacctgagggcctggaagacttggggtggggttggttgtgctgaagtggggcttccctatctaaaacctctccatgctccacattcttctccacgtctagctgtgcactgaactaatggtggtactgaagaccagtcattgatggccaaaaaataaaaaaaagtacttcacacagcctgcttcggtgagaagattcaggaagaaaattataactattttagaaaaaccaaaaagccttt

SEQ ID NO: 30560 - DNA, 1119 bp, Bovine  19866880902517
cacacgacagacactagttccctgtgtcctcggcgctatgacgttgctattctagggtgggcaggaccagacctaccccattcattcatcaaatcttaacacaagtcagtggtgggtgaaaaccaggactctcttactgactgaataaagctttattttaatgcaaaataaacaagaaaaatttatatattcatatataacaatatccaaaatgtttctgtggtacaaatgggatcatccaaaaaagactgtaaagaattcattctccaccctcaatcatatgccaaaatatgatttcacataatttatcttcagaacttatgaacagacttggtatcatataagcaaaggaaaacactagaaaaagtgactgtataaacagcaggttttgtttgtatgttcccagtagtaaacagcactgcagtcagcatagatggaacgtaacacttctgaaaaagctgagtcaggagacagtctcggtggttagttcactctccattctgcgctgtagtgaagcccaccttcaaaagtcaggctgtgtgagattctagtactatttaaggacacgagggagaaagagttccccttagaagctgagctgcatatgagattctaggcttattttagatacctcactttcattctcttttttatcagaaaggtgactttgtagggatatcttacggagacttctctttctggtctcattgtggcatcatttccacttaagtcggtgtgaactgggagtacagagaaataccatcgtgggctgtttctgactcccaacaccctcctgcctaattgcactagatctgagatatattttgctcacggactcagaaagcagcaggatgtctacccaatttagcaccaatgtgaaggctgttcattgtaaatttcagagtttaatgctgatgggaattttatagacacaccttgctgtccacactgaactctccagctctgtctgtccccctgaaatgctaagatgctcctccaaagaaaaggaagggacataccaaccctatgcatggcaactctaaaactcatcaggtggatttccttcagaaaatagatttcattcaagaagttcataaatcttcggaaggaataatgaac

SEQ ID NO: 30561 - DNA, 1308 bp, Bovine  19866880948017
aagatgtggaatccatatggttagtgactcgtgttagatctccaggttgtctctgtccctcaggatcacagtttataaaagaaaaactgtgaatttagcattgaaaggaaacagatttgagtgtcatctgtatgctgacaggctgcatgataagataaagaactaacctggaagctaacagagctgtgttctggcattagctctgcctctcaggcatgctgtgacatttctattcctctgggtccccacgtgtaaaaggcagggaatcacaggatcttttaaactcttcagaaaaagatacttcgtaaatataagctgcggtaataaccactgatagaacaaaacattaggctgtcatcatatataagtagggaatccttcaccgctgcctatttaagcactgcacagcaaattcaagagttgagtcaacacttgattattagcctacggggattattcaggaaaaatttaaaattctaattcctctgaccccaaaatatgagttctttctcctttccatcactatatgggtgcttgtggaatttaaaactaatttcaatacttccagagttgaatatcatgaggaaaggaaaaacaggaatttaaatgaattctgcagagttccaggtgaataaagatagagagacagacagacagacaggacagaggcagagataatctcttgctttacttgttggagtgacggtgtcactgactccttcccaccgtgtcctggccactccgtgcactcactttccctccgtgctgtgctgtgcttagttgctcaattgtgtccacttttcctctacctctttccaaatcctattttcaaatactactgaattagcaccccgtgatgactatgtgcggtaatagagcaaaatgtcacttttcttcaacagagtttattaatttattcacccaaagactatcttaaatacatcagtgtgaataataagaggaaaataacaaatgacacaagtaacaacacactacgcttggaatgtctttccttctggaaagataaatgctcctcgttgtctctaagacgcctgggcacaagtccctaaagaagatacatttaatgaaagccaactatcattaagttttttttttttttttcaaatgatattagttttgcttttcccttttctctagattaaaaagaaaaagtttttgagcagacatagccctgatgtgatacctggagggcagcaagaagggaaagtgagcatgttatctacaaaatagtctgatgctacgggcgaagaagaacgtctgacctgctaggctatagcagactttcta

SEQ ID NO: 30562 - DNA, 1507 bp, Bovine  19866880997547
ctacataagtggctggctgtctagtgactccttttttcatctcttagaacattctacatggaaatctttttgtaattttagtatttattttcttaaatttgagaatgattctggtcacctgggagtgatttaattaacccttatgttttccattattgatttttaaactgggtgatgaaagacatttttaacgtatattttaaaattaacctgagaagaaaaagatgtttcttggccacaagcttaattcttatttatgataaaaggtgacaggggtaaggtagtgagagaagttacggaaggtgatgaaaatgagtttttatttccaacattcattattttgaattaacctatgaaaacttccacacacggaacatctagtagctagaagaataaaaaagccacttaaaggtctgtttagagtatggacttcatttatttgtcttctgtcatcaaggtataaaacagtatatctaggcaccagagtacttctcacacttcagccccactgctgaattgttttatttatgatcattactttccctctgccttcttctgggagaagagaatgcagaaattaaaatttataaattcaaaatatccacatcttaaagagaatatgtctaatattttccttgagtgaaaaaagagggacggacatattttgctttcctttctttgcaatgaaagttgacacagttattttgtgttattataacactcatcatttctccctctaatttggatggtttttaataaagctccattgattccactgaaaggcattcctcctggcaaaagcagaacacacacactgattgctaaatatgcagcaattatcatattcagcagcacactttaatatcttatttatagatgtatctatctgtaatttgctttaattaagttgcattgattttaatgacaggagcgatctgcagacaaggggctggtgtcatgctcctatgagtcctggtctgtcattcactctttaagatgtggtcctacaccttcgtgactttctttgggctccaggcaagcccatccaacttagccaagtttcagagaaattctccaagtgttgacacctcggaattgatcctcttgatcacaggatggtatgaactgaaaggtaacttggtggaacggaaagggcggctgaattttgaaatgggttcgggtgtatgtataatgccatcaccagccccaaatcactctactttgacagctgctttcttagatgtggcaacagcatcttgcccctcttattgctcagctttgggttttgctttttgatttgccaataacaccaaacagccctcagaaggatcttgggacctaaattatttttgattttttgactatttttcatacctcctctgggtgaaaattctgggaaaactggaagcaagaacttctaacagttttgcctttcatggcatccgtgttcaaaagtgaaggggctggctggctggctggctaacaaacacaaagaaacataagagag

SEQ ID NO: 30563 - DNA, 1390 bp, Bovine  19866881035109
attggtatttatgacttcttttcctaaaatgttggtaaatgtgtgcatccagaatatgccagtcagaaagccggcaggatctctcaggctgcgattccatacgtgtttccccatcttgatagcaagctcaactttgatgtcaaactgttcatctgtctgtggcacttactacctaaccatatttccattcttaacttggaaacaatacgatagacgccacattccacattgctaccttttttagttctagggaggaaaatgctcaattaattgacatgagaaaatttaaacttaaaaaagtccctctgagttttggcttggtgctttgtctttaatgattattgcatttttttctagtttaacattcttgagttctgcaaacccaaagcacaacttcactggtttgatttcctgttctttagaaatatcatctaggggtagcacggagtaggggatgcatcaataatgagaagtgattttaaaataatttgaaatgatttttctattcatacatccacaccccctttccaagtaaatctcagtcagggatacaagtggtgattgagactccattagctttcaagatagtgaagaagtcaaacgaaagatttgcagctctaaataaaatagcacaagtgtaggaccatcactagacatgcaagtgtaactacaatgaaaattatcttgaacaaatcagttcccaggatgacattcaattcttttgataaatatgcctgatacgatgaagtacagcttccagaaagataatggagcagataattaatctatttggaaatataaacacacacactcatacacacacactcacacacacatacacacactgcagggagacaaggactgttggttagcaaaatcttgtcggaacaacctaaatgtccttctctagaagtgtgtgtagcctcagataaggggaaaaaaaatagaaaagacatttttgactgcagtaacgtttttgattctgtggtgtaaggccaaaatcaataaaggacaaaagagccaagctctcacttcttttacatatgtgggcggtgtttgggagcgctggtaaacaagtcattaatgtttcagtttcagttgtctacagcacaccaaatggggcttcccaggtggtccggcagtaaagaatctgcctgccaaggcaggaggcgcaagacacacgggttcgatccctgggttgggaagattctctagagaaggaaatggcaatccactccaatattcttgcccagcaagtcccatggacagaggagcctggcagactttgtgatcatggggatcacaaagaatcagacacgaccgagagcatgcacacacacgcataccaagtagtcttctctctagggataactgatcagttaaagaaggg

SEQ ID NO: 30564 - DNA, 3095 bp, Bovine  19866881068525
tgctttactcttattccctgacttggtctctctttcttccctttccggcaatgatgccctaaaaagattaaccccctctctgaggttggagccaattctttcaatggatgccaaaagttcacctccaaaattcaattgatgagctgtgtctctaatggaatatgatttttgtttactttagattatgcaattgaggaagttgtgctaaatacattggcagaatataaagtgccattaagacatggtgtcactgtttcctgctttgctacgcaaaatgcatccatctttgcaaagcactctcttatctccagcagacagtttttaatagcaattttcaaataggagctgtaataaaggccaaatctattttgttacagcagcgggaactaacaccagttatctgctcagggctagtaagctacatgacaactcagtttccaccacccactgggaacaacacacttcacatgcaaatcaacaaattaggcagttttcacagatcctatttcctcagatttaaagcttcataaaataccacatgatttttgcatttagatacatgagcaatgaagtctaaaatagtatgtttttgtgtttatttgcttttataattacaggtaaattataataaaggactatgaaattcaataaccttctctgcatttattataggcaattaaatataaacctatatttattataggcaattcttattttaaccacattcatgtagccttcttggtagacagatacctccaaagtgggaacagaaaaaatgtctcatttcaatacaggatgtctaactattcaaagtagtgggatgatatgaaaactatcttgccagccttgagtgaagggaggatggtcgtcagcaaggattcccaaggtgatccttgaacttaacacttaagtaagactaaaaattggccatagatatagagtggccattggtatagagtgggttcaaggctgggtaatacatttgacttccaaaatattgatggctgaatgctttcacggtacagtctgacacttgcaggtacttatctatggctgcaggacagaataaaggtgaggcactgcatgacatcttggaaatttcagcatttcaaggcactgtatacagccactttgaacattttggcaggggatcagatttatctttggggaggtcatacggctaatgctgcagagggtggttgaaagagaaacttaagactgctcagacagccactgttttaatctggggagaagctgaactaagggagtacaacaaagggtaaaaagaaagaatttagatacttagggacttggtaatggattgaatttgagggggaggggaaagaatgcatcactctcttgacctcctggatagcctcagtaagggcagacgagcaaagctaagttcacaatgtacaggttgagtttggggtacctacagatgcatatgagaaaactatttaataaattttgtgtctatgaatccagagcttgggtaaatgtctgatttatagctgaaattgccaggagaggtagggaggggtgagaagaaagggaaagaggaaggagagaaagaaaaaacagcagaagggtaagaagaaacagctgaacatagagaactggggaatgctaactctccataagaggctaggatgaggagctagaggcagcagctagaaagctaaaaggagtaccttgagagcaatatcccagaatatgggaataggtatacagttaaagggagaaggcaatggcaacccactccagtactcttgcctggaaaatcccatggatggaggagcctggttaggctgcagtccatggggtcgctaagagttgggcattactgagcgacttcactttcacttttaagcattggagaaggaaatggcaacccactccattattcttgcctggagaatcccagggatgggggagcctggtgggctgctgtctatggggtcacacagagttggacacaactgaagcaacttagcagcgtacagttaaagtaatttatgcagagtcaagacaattcatttttaaacattactaattttaaaaggaaggcttatacattatactgcaacttgacttatattgctcattgcctgacctttcaagaaaagaaattagatattttcttgaataataatttgtgtctttgttttttgaggaagtatcaatttaaaaaaattttaataaaaatgagtattgctctataaattatttgactataacattaaaattatatgccagcaaatttggaaaactcagcagtggccacaggaatgaaaaaggtcacctttcattccaatcacaaagaaaggcaatgccaaagaaaattcaaactatggtacaactgcgctcatttcacatgctagcaaggtaatcctcaaaatccttcaagctaggcttcaacagtatgtgaactgagaacttccagatgcacaagctggatttaggaaaggcagaggaaccagagatcaaactgccaacatcccctggatcacaaaaagcaaggaaattccaaaaaaacatctacttgtgcttcactgactatgctaaacctgtgtggatcacaacaaactgtggaaaattcttcaagagatgggactgccagaccaccttacctgtttcctgagagaaatgtatgcaggtcaagaagcaacagttagaactggacatggaaaaatgcacaggttcaaaactggtaaaggagtacatcaaggctgtatattgtcacctacttatttaaactctgtgcagagtgagtgtgtgtgtgtgtgtgtgttagtccctcagctatgtccaattctttgcaatggactgtagcccgccaagctagagtacatcatacaaaatgctaagctggatgaagcacaagctggaattaagactgtcgggagaaatatcaacaacttcagatatgcagatgatatctctctaatggcagaaagcaaagaggaactaaagagcctcttgatgaaggtgaaagaagagagtgaaaaagctggcttgaaactcaacattcaaaaaacaaagatcatggcatctattcccataactttcagggtaaatagatgggggaaaaa

SEQ ID NO: 30565 - DNA, 1989 bp, Bovine  19866881089599
tgtatgatggttcccagggggaggtttcccagggagacgggcaagaactaccccgtcactattccatgtgcatcttgttttacacttattcacacactcaagctatcgtaggtagttgctcttctagaataattccaaaaatacctataccaacagttctcatttgtgaactctgttcttctcagagagaccttctaatcattcctggtagtaaatactgccccctcaccccccgcccatctcctaacaaatgccagaatcagtaaagactcgttgactttgtgccctaactgggggcaacgtcacatcattctaacaggttgcctgaaacaggaggcgacgtccttctcctcagagtgacagtaatgagtttaaaaatgggaattcctgggataaagtatataggataatattttgttcttttctgtgttggtaaggagagggccctgagacctgtaggagttctaaggtgacagaaccactgaggagttaacaagagatgccctcccaaaggtagcatttacagacttgaaaaaagagcctgtggcttcatctgtctctgtcgatggcccatctcaaaagtaactttaagagagatgggggggaaggtcactggctgcctctttaactgttctttggctctggtaagagcaaagcatgttccacatcagggtacatttttgagtatcctgtttgctgtttcaaaaaccaaccaaacataaagagtatccattggagccaaaaaaagcaaatgtttggagaaaatgctttttctgaggtttaggtttaaaatgtgccagggaaatgggaaaagattataaataggtgctaattcaaaggatttgatgcacagtgggtgataggtgaattttttaaggagaaaacaaatctacatggattttatatttaaatcccagcctggccaaattacacaacaaaaaacaaaacaaaacaaaaacctaaggagaataaaagtaaagcggataatagatatttaaatatttcacaaagatagcttaaagataaataatgttcgcaaagaattttgtttccatgagatcaaaaaaccatatggaaataactattttaataggagcctttcatatgtttgagtgagtgagtgaagtcactcagttgtgtctgacttttggtgaccccaaggactgtagcctaccaggctcctctgtccatgggatgattttccaggcaggagtactggagtgggttgccatttccttcattcatatgtttacagtgtctcaagtctccttattcttgacatatggtttaatacaatggcttttgaaggtacctgggtaaccttctgggttcttgacctgctttgtgggttggttcagaagcagctattactttccaaagaaagatattctttattttgtggactgttctttgacatttacatctgaacattgataagagtaatgctgataagaagcggcccaggccctagacagataccaagcctttgcaggagccacttcactgaattgttctctgcatcgatgaccatccaccctttagtaagttctagatagtttctcaccagggctactaacaaaagccctacatctattaaccatagagcaactgctcttccaccagttaggcccagtaaccaccctagaagtcggtttcctgcagactctcttcctctcccttttcttaccttatcttgacaggtgttctcagtgcattagaccaaataaacttccataagtcaattgactgtagacaaatgccaaataatactatgttaggtaaagtttcattagcatcatgtcattcaaagcaagtgtttaaactccttgtcaactctttaaccatgtgccttcaaagtagaagatcctcccccagaagcaagaccgttcattctcttgcatgcatttgtgacatttaagaagttaggaaaggtacatctataacctttaccatcactgtggcacgtatatggaagctacactgaaatta

SEQ ID NO: 30566 - DNA, 1099 bp, Bovine  19866881164067
ataattataatttatgggacgttgtatagaaaatatatagatacagactttcacttactactcaattctgctcagaacagatatcacttaatcaattactagcattccttccccataatcctagacatggtcttagaatctttcttaacccaaaactttagaaagctattaccatctataggagctggcacttgagttgagttatatagttgtgttaacaggtgctgtaaatatttcaaaatcacagaagaataaagataacttttatggttctgctccatagacatgagaaatctgaggctcatgactactagatatacaaggtctgactttaaagaaggctctttctgtcattgtttaatacctttcaacctgtgtctcctccttcatctaattagtatcttaaagattgggtcctctaacaacatactggaccagaatgaaagctaagcctagctttgaggacttactttctgaggacttctgtttttccttcctctatttacatgttaacttctattttcctggctttatggaactcagtagtagagattctaagaattttgtctgatagcttcagaagttatatcagcttatgatgtaactcacctactcttgcaaccatataaaatctggtaaagtatcagtaatcccatctccaggtttcgagttagaaaatttaggcttgctgtattatttgttcactggataaggtagaggttagtcagtcattcttaccaaaaaagttcctattgtagctatatacatatgtaggtgatcaatgccactcctgcactttcaatgtgctgaaattttattttaaattaactcaagcagtataacaaaacagatttatattgtagtgatttcttgtaaattatgctgcctttgcctttaaaagcagatgtatagtaaaacaggcttttcttataacactttaaagctggacagagttttaaagttgtaatgaaattcagaaaccaatgtcattttcttcatcgtcacctagtagtaatatattcccaaatgcaatacacatcacagtaaggcattatctgctccactggaatctaaccttattcttcctagttgataatta

SEQ ID NO: 30567 - DNA, 1047 bp, Bovine  19866881408683
tcacttaattgaatagcctacgttttttaaagaaatgtttgtcaaaaatcccacgtcgtatgttctgcttacaggttcaaacctttccatttatctcatcatgtactttataggttgatgcctttaattatatgtacacgaaaatttttagcattgattgattattctgtgagaatactggcagccattttgagctgtattaggaatttatgggaattattcatctgtgccattgaagaaaggaaaaattagccattggtacagcaaagggaggaacaagccaatatactcgcatggcagaagagtggtttcacagtctagtgggcaagcaaataagggcctgatgctttggacagattataaatcaatttctgatttctttggtcaaactgtaaatcactgggctaagctactatgaatttccaggtgaaagcctattttgtgattgtatgttactaataatagctctttctgaattacaagcgattagaaaaccttgtcagaaatcacattgttcttgttgtgtaagcctggatatattttctttagtgatattaaattgctggagaatgagattatattcattcatataaagctgtattaaaatgggaaacctattcctatgggttttttgtccaggtccctctgaacaaagggaaatgttattggttgatggctctgtagtgactgtcaccttgcccgatttcttttggtataaggtgtgctcgacctggaagctgcctataatatcccctgtgcacttcagtgaataaacagcaactctatttaaaataataaattattactcctctttttattgttggcaaccccatattatttatgggttccaagttttaaaaattgagaaaagctaaggaaagggagtttttagacattttaagaaaaagtgcagacacttgcaggcaacacaggtttgaaacatttcagagacttgtgacttttctgggagagtcagagtgtgatgtagaatttcacttgagatatttagcataggtatattttttcctcctagcctatttatagtta

SEQ ID NO: 30568 - DNA, 851 bp, Bovine  19866881419856
cttttatcttaagtcacatacatatttgaggcagggaatattttagcataatgtcagttttcttggcattgaatttctgtttgctggtaaaaagaattaggcttcttcaagaattgacagcccatttcttaacactttgcaaaatgttctggttcaatttaatgtttctttgtcaggacttacttgttcatcctttgaaattggtgaagtaaatacataattattgtgaaaagaattgattgttaaaacctcaaaaaagtactaaagctagtttttaatctgctgtgcaaaatataggaacatactcaatctgggtttaataatgtccaaagaagccaactgtaatgctgaaccatttgttaaagctatgatcttgtttttccaaagcagaatatttaatggtcattgcaggattttttttttaatatgcatttatgtgactgttacaaaattcagctctgaaatttaaaagcccaaactagtaaattatcctcttttggctttcttattacatccagtataagaagattaaaaacatatgaattatagtatgcattttcttgacttggagattttttttcctttaaacaaagtcaacgcactaaagtatcctttgattctcattcaggtaaaaatgttatattttttgcaaagatatattattttatttgaaaatatgtttaagtgcctagaatacatatttttagcacttgaaactttctctggctatcacaacttctattagagaccatgaaacactttaggattattgaacaaatatcaattatgtctatgtcctcagtgtcaatctgaattggaaatgtgccatcttttacatcttcactaataga

SEQ ID NO: 30569 - DNA, 1256 bp, Bovine  19866881624901
tgtgcaattaataagggcttccctgatggcttagatggtaaagattctgccttcaatgcaggagacctgggtttgatccctagattgagaagatcccctggagaagagaatgactatccactctactattcttgcctggagaattccatggaattcccagagaaccctgctgggctatagtccatggggtcgcaaagagttggacacaactgagcaactaacacttttactttcaataggagtactaattgcaaataagatgtaaatagtttttaaataaatagtttaataactaattttttaataaaacaggaatgttattaactgcataaataattaaaaaaagagaaaggccaagattttacttttgtaattgctagaaacaaatcattacagagattgagcaaaaatgaatagtacagatgctttaagagatgttgatgcttagaaacataaagtatattgtggaaaattataaataagtattttggtcacaatccagagacctcttttctttcaatgccattagggttacataaaagtgaaaaatgatttagggaagagaaatgccacttgtcactttgccttaggctattaaggtatcataaaaacatgattaaaagttataaaaatacaataaaggaaaagaaacaaaaagaaaatagtattttgggaagtgctcgtaaaagtggtgacggaggagaacctgacaccaaaatagcagcactttgggggagggaggaagttttgaacaagattacagtctctcataaagtcaatattatttcagtgcaatcagctgcatcactaatgtgcaaaatctaactttataagatgtggcaaagcggaggagaaagttgcgtttgaatgattaccctgaaagtctaatcaaagacattctcctatgttatcaaacacagatgtgcaaagtaaggaggctagagatggtttcttattgaaaaagattggcaataagattgagtaccttgaagtgaattcatctcctcatcatatgaaatcctacatatacctgggaggctcttcaaagtcgacacacactgaataatgctcaacatatgtttgcctatgatgtgcttttaacctaaacccaaatcttcataaaccaatccagaaacccagggctttctgataaacagcagtgtacaaagactactgatctaactcaagaaacatccaggggtcggaatagagttgaaggggagccagatgaaccaccacaaaacatggctgcttgg

SEQ ID NO: 30570 - DNA, 1867 bp, Bovine  19866881655258
cttgctccaactcatgtccatcaagtcagtgatgccatccaaccatctcatcctctgtcttccccttctcctgccttcaatctttcccagcatcggggtctttttcaatgagtcagttcttcgcatcaggtggcccaagtattggagtttcagcttcagcatcagttccctaagtgcccagctgctcaattaatgtttgccgaattatagaaaaattcagtccaaaaataattaaaaagtccaaagtgaatcacagcagaaagaatctacccaaatcttctaagtggaaatactttctatgactctagttgacctcatattcaaaggcctaagatgtatcttagatatatcaaaggtatatcttgagaaaaaagatctagggacataaaaatcggttgtgaattctaggaaatgatttaaaatattaaaattcatcaatatacaaatttctctcacatctaaaatctttcttttagaattcaaactgggaactgttcaactgaaatgaccaaataaagttaatctttcacatgagaaatatgaaaaataaaaaagggaaaagaaaaaaagtgaatagaagatggtaaggattagcaatggtttattgggttagaaaaaaacatgctcttagatgttaaaatgcacaggaagtaggtgggactcacaaggacctcagtggagggcccatggagaaggccagcctctagcatacatcctgtctgaatggtacctagacactgttgaccaagaacagattcagaaatatttctgcacttcaataaaaggtaaaacgggttggcttgatcatctaagaaaggttgaagcatatggggatcaagctggaaggccatgaagaattggtgcagagatgtgctcaataaactctgtatgagatgggacacaccatcttccatatatagagatgacgtgcttgatggtcctctcaggtcctctcaggtgttcccttagcttgaaggcctttctctaagagaatacatttttagatgttcacctgggattgaagatacagttttgggctacttataagaactgtaagttgcctgatgataaagatcccctcttgatccatttaaaaaattaatatgagtcattagatcctattacagaatctggatcacaataagtgctgaactgagtatttaatgcatcaatagttcataaaggggtatggtttttataatattgcccttattagcacattgcctttactatttgagccaaacagctgtctgcattgaaacaaattaacaaatctccctgcatggtgcactcacctgcaggccaggccttcagtagcatttcaaggataaagtgtaagggtgagtgtgttatttttcccacagagtgttcccttccctctatgacatgttttcttgtttcctttcaacacctccctcctccttccaactaaccaattctcttcgtggtattcttttatacagtatgtgaactgatggtgtgaaacaattcatttaatctgaaaactgctacttttccaatcagtcaaggaatgattagtaaatgcttgagatggggttgagaaggtaaactaccctactgggcactatgaaacctgaatgtgatttacttacctatgtaactatcacacacacacacacacaattatagatggtctcacaaaccaggtaaaacttccaggccatctaaggtgctcttaataccagaaagatcctttcagatgccacaaaggaataaaataaaacataagcacttctgagctagtctatgtctgatagtttctcatattcctttagatgaaaaaattcttttcttacattatctgattataaggcaatgtaaaaatgaatgtgtaaacagaatcata

SEQ ID NO: 30571 - DNA, 1027 bp, Bovine  19866881821313
tttatggggttgcaaagagtcagacacgactgagtgactgaactgaacttaacttatgctgattaatgatccaaggcaatggttctcaaatttgagtttgcaaaagaacctgaagggcttgttaaaccacagatcttggctccatcccagagtttcagatatagtaggtctaggatggtgccctaaaattgacattccctgacaagttgcctggtgatacagatgctgctggcctgggttctgtacttgttgaatcactagtttaaagtgtcgttcttctttcagcaggttgctgttattattgttcagttggtaagtcatgtctttgcaacctcatgaactacagcacaccaggtttccctgtccttcagcaggttaacaatcaccattagttccttaactcaaatcagacctatacattgtgtgtaactgctgcatttgcctaatgaaaccatacctttctgtaggcaagacttaccttaagtatctgtattcacagtgcttgggacatcataggtacccaatgcatgctgattaaatgagttggttaatgaaggaatcactcaatggatctggttcagtggattttatacattatcctttggaaagctcacatgattcctttcagtccgaaaggccttcttggagaataaattattgccattctctttgaatataacctcagaaattctggagtcaagatatgcttgcattttaagtacctacttggattaaaaactgaattgccgacaggattacataatgccaagtttgctgaggcccaaactgcttatgtgcaggtttggttctgagttcttttgtcaatcagtacatttctgtgtctaattgcaatcttaaatgttttgggtttttgtgggggtttttttgacacctgcacatgttattttcagtcaaaaccagctttggtaatttgcacaggtataatataactaaaatgagactcataaccaccgatgtatcacctacatcatatgagtaatgaattcagaggtgctgtacctcaatt

SEQ ID NO: 30572 - DNA, 755 bp, Bovine  19866881902770
tcttattttcctgcccttcgaaacctatttctatgcataactgagaaccaatttaaatgctgttgctaataaagctgttggaaatagggaagaaatgaaagtgtttatgtaatgtatagattacagatcagacagcttgttttgccttggtatgataaaaataaaaaggaaaagcctttttatatgaagtgccaaaaaaaagaaatactcacttcttcccacacatgacttcaccatgatgaataaaaggcataactgacatcatgtttattgaaaaaaacagcaactgtcatactgtcgagaggctcctgaaagctggaagaaggcatgttgtttattcattttcactgtggattatttatagagttcaattgtcagcatcaacctcatgcctaattttccctcttcttggatagcccgtaattcattcacttttcagatcaagaagacagctacaaattgctccagggcaggtattcgggcaccactgttacctggcctgaatggagcaatggctgtttattcactgagcttctgtgactactttccgtaaagtgccagtgaaaataaaagtcattgtcagcgcataatgggttggtttcatttgttttatttttttcactttttgccctctgatttggcagccagtgctctcttcctaaagggaagtttatcactctattaaaatgcatcatgcttcagcaccagttaatgttactggttaaccaagagctctagttatagaaaacattcag

SEQ ID NO: 30573 - DNA, 733 bp, Bovine  19866881940728
aactgcctgatatttgaaatacgtttagaattgttcagttcaccgagagtggcaattgaacaggcagagagcagtggagatctacagcatggccacctctctggaacacagacatgcatagcattggcgtcatggcggggagaggggccagtctctgtctgggacatcatccattcagaggctaagcttcagccacctcctcaagttgttaagtctgtgaagagtagctgcaaatatgggcatcctaagagagtagtctttgcattgagaaaacaacaacaaacatgaagagtgagctccttgaaatgttttgtacccagagaaaggctgcatttatttgtagaatttctcaggttctcagtaccacttacttggtataagcatttcatgtttcctcgatttttatataaaagatgtgaatgcagtattagtgtcctgggagaattcacaaagctagtcagagcttccagaagaactctatgcctaggatcaaggcaatcaagttaaaaggctaaaattcccttggtcctcaccttcctttctcccacatcccaggcaagatagcatagagatatctggcttcagactcatccccagatctcctgcttgtcattattgtaactggggcctttactttaagactcccacttgagagctgagatgtactcaggaaagagagggccctctggttaggtcacccaggaagcagtgctctggagatgccaattctaga

SEQ ID NO: 30574 - DNA, 2060 bp, Bovine  19866880348991
acgtttttagagcctgattttctgatgtataaagtggatacaggcccacctaggaatagcacccagcacagggcctggcacagagcatgcgctcaggtcctcctgccttgtcccagtccccacaggatttttcttctttcctcttccctgggctctgagactctgatacagtcattatttctaggtatcatacctgctacatccaaaggtctcaactcaaaggagtgactcaaatgacgaacgttttagtcactgatgttatctgtggagcagatacattccgggcagccggtcccatcagcaaccttcaaattacactcaagacaggtcaccctctatctcctccccacaaaggacccatctgaggaggaaagcaaccagaggggacaggaggacatggagttgggagtcacttctggccagaggcaggagatgaataaagttgttaagataagggtagcacttccacacgcaattaaaaccccaaaagaaaaatgcccataattccacatttacatgtaaaactttcaaattaattctgacagcaagaacacctgccagttttgctagaaacaccatctggttcacttctgataaggcccaggcacaacttcacacgggccaggaactgtctacagtctggttcccaaaaggtggcatcctagatgacagctccaaggcaggtgccattcccccctccctagagccccagagccgctgctgccagctcctgcttaggcctgaaataaacccagagtttgattcttccctaagtttctcctctaagacctccaggcactacccttacaatcaggattaatttaggcaagtctgtcttcaaaaaccagataaatactacagcaacatgacaaacagcctgaaccacttgagtttcagaggggcttttacagagtgggtgggagggctacttcttcactcaagagtcttaaatttgtgattagctaactgtaagagggtcccctccacgaggcctttaaggtcctccaagtgtcttcctttcaccaagccaacaggaaacactttgatgcacttcatgaggccttcaggccgccataaataaggaaaagaaagcagcctgggagtcagagcagacttgtctcgaggtgcaatgacttggcttggtggtagcgccacagcaggcccactgttcagatcctgatgggaaattaagcataaaatgtgaactcaacacccacagcaaggatacactccaaggaaaaatggactacaaggctcaccagccaccaccaaatgcaaatggaaaagggtgtgttcgaaacacagggtaacaggataaaagctatcaagggcaagactctgcacaagtatgcacacgcttttttccagtacgccagacaaacctgggctgctaaagctgcaaacactgcaatgcctatactgttcaccaattctgggtaaggacttcgtgacccctgtgaagaagggagcaaggcaaatgtggtcacgcctgttatgtaaaaagagaactgaaaaggggagggtgagaagcatactgtacaaacccaaggtgagaagccagggcaaaatcagctctggccccacaagtgggtttggtgactagaacctctcattctcctgaaaacaagactgggcagaaatcactcagggtctttatttttttttttttttccctctcaaaatgtgaatacacagaaaaggaagctcaacactgatttcccaccaagtctggcttcagctcacccagtcagccgcacagacaggcagctagctgaggagcaggtggaaagtcaccggcagcccccaaggggtgtggagagagaagctgagaggccttgtgctagccttccaggacaggaggaggaggcctgggaggctgttggtgtggactagcggcagggcaggttagcagagaaggctagactgaaggagcggggaaaactgaacccactacaagggcagtattcaggagtcccccacaagacaagcaggaggatgtgaaagaaaagcaagaggaaacgagcccctcccttctgtcagtctggatgcagtccatgtgc

SEQ ID NO: 30575 - DNA, 1499 bp, Bovine  19866880392216
cgcctatcacgtgaggttgtgttttccatggtgggcatcactagattgtgtcttaaggtccctccaagtccagtgccttgagtgagcctggcatgttgtggggcatccgtgatggttacaaaattcaagacttgtagactgcgaggtttctattctcccttgaccgatggggctttgttaggggcgtctttcatgtgttcatctttccctgtcccacatcacaggaggtggttctcatgggtggtttcaactccagagtttctgagtagtacaagatccccgtctgataagtggggagcatgtctaagtctgctcttgggctggttcctgttaggtgtttttcccatgagcccaacaccctccctcacttgtccctggaggaacaagcacccagaacctcgtggcgcccttgggccttgggtccccattgtagtaggtgccgtgtcccctggaagccatgctgggcttttccctgactccctcagtggaggagtagccttgcctcagtgggaggagggagactctagttgaccttttccctcaagggatgaatgaagacatttcaagtgtccctcagaggattaagtaagaagggcctcactggccagaactgaaaggcaggtgaaggcagagaacctgacctaggctgcttcacttcctctccttcctcatgccaggagctctccatagagaagaagaaaaccctagagatgctggaggagaatgagaaccagctgcagacgctggccaatcagagcgagcagccgcctcccagcggaggtctccatagcaacctgaggcagattgaggagaagatgcagcagctcttggaggagaagctcctggcggagaagcggtgagggagccctgaaggcctgagcccacgggggtagctttccttgaacctgggcccttgggttccagttggccttgatctgatggatcactcccttttgcctagctctcaggttccccaccaggcaagtgggaagcaatccttcactatcctaagctaacttgaaatgatgtgagtcattaggactgtctgatagacaggctgaacaggtcctcccagctgctttttactgatgagaagtctgagacttggaggaccttcctgagctcacagaactagcaagacctgaacccaggattccttgcactgaccaggtcactcccattaccattggggtggggggacaggacccagcccagctctggggctcaccaagcagggtctctgggtttctctagccagctccctgcacaggagccaccctcttaccggatgccccattggcaaatggggccctgagtgagcgcctctccccgggggggcaggatgaaggagaatgaggagcggtccagggccctggaggaggagcgggagttctactccagccagtcccaggcactgcaaaactcgctgcaggagctgacggtggagaagcagcaggctgagcgtgagctcaaggtgctgggtcactggggagcgtttg

SEQ ID NO: 30576 - DNA, 1817 bp, Bovine  19866880506218
aaaaacctgcattcctgcttccttctaggcaagtctcccaagcagcagggctcctcgggctgttgactgcaatacatctcccctgccagggttccctcagagctgccctttgggcaaagtgcttccaggcttcctgcgagcccctgggtcatcccatcaggctcctccctggtggtaagcctgcttgggggcatgttcctccccaagaacttgtgtggccaggtttggggttaagacaagggtttcccagcctgagtaggaaggacacaggcacttctcctcttccaggagaagggtcgtggacacatctagaagccagtaattcacctgtcctctgtcccacaacctcctttccaagaaggaaaggtaaaattcaacgcttgttacttccttgggtctggacaaggggaggcaccttcccctgaatgagaaactgtggcctctgggactgagcagagaatgagaggggctggacccagatcggtcctcaggacatagtgcctgtgggcgtgctcggaagtgggagggggggagcagtgaggggatgtggagaagagatataaggcctcttgtcccagaagcagccaggaggtgagaagaggtgttagtggcacccaggaaggcagaagaggctgaggaattcaggaggggcaagaacagccctacagaaaaggctctgggcacactctctctctcttttgcggccaaagccagggaaagaacagccagttgcataatccttctatttgctcagatctacattttgccttgaagctccctgccctgggaagtgattgaggaaggcacccagcaaggactgggcagggcagggagtcagtagaccaaccaggggtgcgcagggtcttcagcctttcttccaccactgccgtccaggaggatggaggccttcaacgaatcttccccgttcaacttctccctcccgcacaactttggcaagcggcccaccgaccgggcgctgagtgtcattctggtgatcatgctgttaaccatcatgctctcgctgggttgcaccatggagttcagcaagatcaaggcgcacttctggaggcccaaggggctggccgtcgctctggtggcgcagtttggcatcatgcccctcactgcctttggactgggcaagttcttccagctgaataacgtcgaggccctagccatcctgatctgcggctgctcaccgggggggaacctctccaacgtctttgccctggccatcaagggggacatgaacctgaggtaggactgggggtgagaagggagctacctggggagattgcagtcaaggcaaagagccaggaggggagtgaatgggggctgggagggtgttagggcagggggtggcagccatttatgctcaaaagctaacactgggctgggggcagacgctggggtacatcttggcttaggctccaagccaaaggggctcagctggtccagggacatcctggagagaccccgcccctactcccagggttgtctcaaatggcacaaggactgtcttgaaggaatactgtattgatttaaagcaaagggacctctggtgaactttcacccatctgccagggtaggcagaattctgcttcaaggccagagatacgaaagggagtgcagattagtcccaaagatctccaaggagatcaaggcggctcagaaccaaagagcacctccagttcctgcagaccaggaaggaattgccaaagatccccccaactgtctgtgcaagtgggctgtcctctctgaacctcccctctccacccatcagaggcaagaacacttcagcgcaaagacacagccaggta

SEQ ID NO: 30577 - DNA, 1807 bp, Bovine  19866880506613
atctcaagctgctgtatatggccgatggggagcattcattcattcatcctttctttccttccgtcaacaaagatgtctgagtcccttctgtatgccagacactagtccaggtactgaagatgcagcgatgaacaaaacaggtgagatcccttgccccgtggagcttacagtgtagcaaggaaagtgtctttctcagcggcctctccctttgtttgagaaaccgcagcctgtgcccctgcagtcctgaggctgattgctccagagtcgcacaggccctcaggaagctctgcctgccccccttcccctcgagggcaggggctgcagctgccggcagtgtgatcagtgccagcccgtaccctgctgcctcccttctcctgaaggcaagatcgtggggaacatgtcgtcatttctccttcctgacgagcgcctgcaaaggtgtacaagggagttgagaggcgtgatggatcgaggccctgtggaagtgaatcactgcccagcgtggagagcaaggagacgtgctcaaaggacagaccatgccaaggccaccatgcttctcccccacagaggtgaattgaagattttattctccccagggagtcaaattaacaaggtgctgagagttttccaaatcagcaaaaaaaaaaaaaaagtcactaccaggctctcaaatcagatagactggtgggtggttttgtcgacaggctcattgtacttggcatccgatgctaaaacgggggtgaaggcaaggagtttgtattgaaaatgcatccacctctgagcaggcggtacaaatcagcatcattgtgttctcagaggcaggaatcacggcgttccccgagaccgactacctcagtgaccacaaagctgaattttcacaaattatgaggtaggaaattgtcagtcattatacaaattgatttacctcgggattccttctaggtggccagttccctcagtactttaaaatatgacttaatttataaacatttgatatataaacagattttttttttatattctcagcatgagctggtagaaaaagcttgcattataattcttagaggcctggttttccattttatttctgactccagcaaaagcatgctattacctccattgatcagcccattcatgcttcattgtgggtgttccttccttcgatagagacatgacaggatgagcactaaatgtagcattcattcatttattcattcacaaaattcactgagtgtcttacacgtgctgagcactgtgaaaaatgccaaggatatattagtgagcaaactctttcaagacagtgagcttggcttagaggagcagccccatcaatggtccatatcctcatgcagcttatagcccagtggcagaagaaagtaaataaacagctagaaaaattaaacaagtttaggctgagataggtgctgtgaaggaaagaagcaggctgcttcagactcacatagataggatggtttgggatagtccctctgaagtggtgacatccaaagcacacccagaaaagataaggagatgccaattacatgaagacctagaggaacaatgttctacggaaaaggactagtccatgcaaaggccttaaaggcaaggcaggcttattgtgttctagaatgtgtattctaggatgtgaagaaaaaaccttactagaataagtgtgagatggtgtaaaaggaattggatgaatagacagaaacttcatcatacaggttcttagaagctacgtgtattagcatctttggggttgctggaacgaaataccataaaccacatgggttcaagcagcaaaaactta

SEQ ID NO: 30578 - DNA, 2085 bp, Bovine  19866880508433
tcagcagacattcatggagctcatacagtgggctgagcactgtgagaagaggcaccccccccctgtcttcagggagtcccaggcaggcggggaaagggagtgcgtgtgagcattgctgtgaaagagggagccctgagcctcagccacacagggactcctgcctgccttttgtcacaatttatcgtcattattacttatttggcaatgtcgggtcttagtggcagcacccgggatctctcattgcgatgcggggagctctagttgtggcgctccagctcagtagttgtggcatgtgggcttggtagttgcttggagcttgcagactccagagcatgtggggttcagtagttgcagctcgcaagctttctagttgtggcacatgggctcagttgctctgaggtgtgtgggatcttagttccccgaataggaattgaaccctcgtcccctgccttgcaaggtggattcttaaccactcgaccaccagggaagtctccttttgtcgtgattcagtttggagtcattaaaggtgacttgcacacctcctcctctagtccacttagaagaacttgttaggaagaagggcgggttggctgcggcttgtggggcatgcgtagataaaagtagaagttgacttcaggagtaaatggtcccacagcaggctgcgtcctcagatcagagcagcacttggttctctttcatcacacatcctaggggcacaaaagatgcttgttaaatgaatgaatgaacgaacagaggcctggtcctctggctctctaccgcctcctggttgcaacaagctggggagatatgggatttgaacgcacttctcaggtatgagctccagggatgcccaccatcccccactctccgtgcttcctcctcttctctcccggggtctgcgagaccaccgagattccccagagccctctctacttcaggcatcccagctcctcccaagcccaacccctcccagcaccagctccacagaaggtctgctcctggactattccgctacctctgagcacaggctgcctttgatgctcaggagacaccctgtaattcaattaggagctccctccagggagcatgtcattatgtcctgtctgggccttgtaatgacagccccccgccactgcgcagggagctgccctgctcagctgtccagaaacctttccctggaagggcactaatctacttagcccagattggatgcagttccacacagcacctccctgaaggcctcagaaatcagtccccactagcagaaaggactgccttaggggagcctgagggttagctctgctctgctctttgccgtgagcccccgacccccacccctgggattgttcttggctgaatggaggctgagagagctccatctcagccagagcccctgggtgacccctagccctcgtggagcttagaagggagacgaaaggagactgaaggaatttgcctcttttccatgtaagtttggggaaagagggtgcagggtgaattgaatccttggtgtggtacctggatagtgttgcactttgaaggggaagcggtctgggctgttttgagctatgggggaagttgccttcttctctgcatgacttaacttttgtccgttggacttgatttctgttttagatgcaagggtgcggcctcagtcgggcatggacgctgctcaggttggtctgtctcctccatctccccacccatatcaaggtttacctgagactttcccttgaggaacccaaatcctctccttgctgttatgtgggatcagccaaaaatgccgctggcaagctatgcggggttaaatagagtcccccgctccctgctcccaaatccatgtctacccataacctcagaatgtgaccttatttggaaatagagtctttgcagatttcattagttacagtgagttatgctcagttagggtgggccttagagcctatgactagcatcaacataatgaggccgtgtgacaatggagataaaagttgcagagtgatgccatctgcagacccaggggatgccaaggattgctggcaaataccagaagctaggagagaagcaggactagatgcccctcag

SEQ ID NO: 30579 - DNA, 1047 bp, Bovine  19866880545666
ttgctttgtttccagctgcccccatccccaggagaccccttgctgtgtttttgtttactctgtgtgtgtgctgtgccctttagcctgtgccccaagaatctttctgtaagtaaggcagcagcggcggcaggaaaacaatgaaactttggactctggtcggtctctgttcagatgcaaatgacgagtctcttcccatcagagtttgtacctttgggttctccatcccacctcctgaggagtctttgaacggcaggggtgggctgaatcagtagctcagaaaagctctgatttagcctgtgcttcaagtcttgtttctttctggccttgtgtggatgtaggcacgactgagtgacttgactttcacttttcactttcatgcattggagaaggaaatggcaacccactccagtgttcttgcctggagaatcccagggactggggagcctggttgccagccgtctatggggtctcactgactcgatttagcagcaacagtggatgtaggcaagaggcaaagagaaaggaagttgtcctcctgagtgtcggtgactctgggtttggaagttctgaactggtgtgtatgtgtgtgtgtgtacatgtgcacaagctgtgcaaggaggtggagttaggacggaatgtggacagtcttgaaagtcatctttacaagtgaggagatgacagagcagggaataaaagggcagtatatcctaaaccagggcttctcaaacttttctaacttctcaaaccggaggaatcttattaaaatgcagattttcattctgtagatcagggatgagggagaaagaagtggcagcccactccaatattcttgcctggagaatcccagggacagaggagcctggtgggctgccatctgtggagtcacacagagtcaggacacgactgaagtgacttaggagcagaccctgagactcagtgtctctgttaagctcccaagtgattccagggctgctcttcagtggcccgagcctccccctcctcctcttaacactgatgaataagatgacctaaaaggcagaagggaga

SEQ ID NO: 30580 - DNA, 2070 bp, Bovine  19866880546880
tcccctcacacaatacccaaagggagacgtgccccagcgcccacctcgaataaactgcgctcattggacgccgtcctccgcacagagagcagccctgaccactcgcgatctgagcggccatgaagaagcctcgatccgagaagcctttccctcaaagtgagccactcacctaccggacaggatctttggcagctgagacacagagaggtccgtagtctgcgatagagccggccgcctccccgcagaccaggactcaactcgtctacgtctctccacaactgacgcacttagctgctctggcgtcccacaaaatggagggcgcgtccctgcgtcacttccgggaccgcccttgacaacaccccttgggtcgggggacagaggtgtccgcggggcggggcctctttacggtgctggccccagtgaccctgagtcgaggtgggcgggactgaggggcggggtgtggtatgggcgtggccgtcaggtgctcggggctgggaggccatggtccagaatgttcgcacctcctaggcaatgacgttcggttcatcattactcccccataaaactaccgtaaggcaaatggtcaccttttttatctgaactttttttttaatacccgaaagagtactgggtgaaaggaactggggctttgcaaaatatgtctgaccatctctgaccccttgttccttagcttcctgcataatgttttttataaaagaaatcagtctttcaattgcaattattctctgcattctgtgttgaatatggaagcaacatcttgtgaattcactcactaaacattatttttgctgcaatgagagtaatctgaaaaatattttctggggtgaaaaacaagaataacggtgctatcaccatttaaaaagttgctgctcttaggccgaagtggtgtgattttcttcagtattaattttttaatacagtatcttgacttatttaacgttaaaaagtttctgacttctataaaggtaattggtcttgagtagtgcctagtgacttaatctattgtattttaaaccatttgtcttctgcagtgattgtttcttctgtgaaaactattgaataagtctccctactagattttctgaccagcttctccaataaaaaacgtcatatttcatgagtagaattactctcccttctatgtgatccagcggtagtctgtgtacaccccaataattccttcaacactgacataaagaagatatgtgttattcatgttttgttttccagaaatgcttagcatagaaaagattcaatatttgtagaactgggtttacattagcatttttttctcaagtgttcctattgctgtattaatgtttcaacaaaatgacttggcatcctttttctaagatagccgagtagcaaatctatagtaaaggaaaaaagatgcagagatataagattaaagtttatcaaatcatctctttgggagactttcagcataactggaatgtttccttcattacatccctgattttatctaaccggtaatttaaaaaaaacccacctcaacctgtgtcacttgttaaagctgccccatctcacctttcctaagccaatgtatttagctatagaccaagtagtttcttgctgtttggttttttggccacacctcgaagcatgctggatctcggttgtgaaatgtcatttctgcaaccaaggatcaaacccatgtcccctgtagtgaaagcctggagtcttaatcactggaccgacagcagagttccaagagcaggtagtttttacactctgaggtgccactttctcaagctctcattcacctacagccagacctccaccccacctctccactgaactgctttcaatgttcatcatcaatccaactacaaaatccagcagcctctttacaattttcagcctccttaatgaaagctgccattcattttcccttactgtgcaccacacatagtgcttggggctttggattgatcagccaattcagcctttgtacaactctctgttgtcagttcatatccttttttttttttttttaatatgttgaaaccaaagctcaaagttacacag

SEQ ID NO: 30581 - DNA, 1942 bp, Bovine  19866880548635
cctcatgaagcacgtacatcaatttccctgtgcctgcctaagtgcccctccatcaggggctccccaggatgagaatgtcaccatcaggctcagcagtgcggtaggtttgtcctgactctaccaccttaccacatgcacccatcaagctggtcaacttctttctgttgctggaattattgagaaatctactggagtaagtgaatatgcttgagatggccccccagtatctggcagcacaaagtgcggagggaaaagacactgcaatagtcctttccatccgtaacaccacaggctgctctctagccagaaagcttgtttccaagtggttgctggtccaaaagtctacattattctggatttcaaccatatagcttagtttaaaatatgagcaactgctttccaagttactttgctcagcaaagtaattttgctttccctccggttggcatgggaggccttttgtaaccatggctatcattcaaacgatgcattttcttctcccgactcctcccaagcccagagaaggttagaaattccagagaactactagtcccaaacatcgtctctctgccaggctcaatcgtctgatccaagcaaaagtgaaattgacaagttccttctttccctggaggccaagcttacggtccaaaaataaatctagctctcctggcatctggtctgtccagtttcagccttgcttcttgtcctgtgggacttctgtttgcaaggggatatttcagtgaggaaaaataatactttatatcccatgttgaggtctgagagcttcaaatatttattagcaactaggaacgcccatttcaaatatatgtttctgtacaggccaggagtcttgtctcatattcagaatagattctttctattcattttaacaagcactttgatgcatctctttctatgcctaacacaatgctcattataaaaaggatctttgaatgcataccctgccctctgaaaggttataatctaagacacagcagacagagacctggagaatatatttaagaataaagactgcagtgtgttttggggactcagagagcagagacctactaaaaacctaatggcagggaatgtttcagaaaggtaggtctttaatgctgctttggagaaaggtgcttctgtaatataaatacaccttgatttatacttgcttcacgtgtgatactactaccaacagagaaaggtgagtggtgtctaaggttcaggactcttttcaaatatacgacggagatcagaaacctggaacatcaagaatcctgggctctgtttctagatttgtgacagacttgctgaaaaacttagcattgggctgagatagttattattatttccattatgcaggtgagattgacccacagaaggtaatcttaccacagtcagtccttacactttaaatatacatgacaactgataacacacacaaaagtaaataggtgaggtaatggatgtgttaattaactcgatgggcagaatcctttcataaaatgtgtatattacattgtacactttacatatcttacaattttacttgtcatttataccttaataaagctgaaaaatatatatacatgacaaaaatagtttagaatgacaaaaatttagattatctcttttggacacaaactcccttcaaggtctagggtagctctctctaacccaggcttcttctatttgtctatttgtcagcttgtctatttgtaacaagcaacttctccctcataatccaagatgcctgctcaatctccaggcatcacatttgtcttccagcccacagggaggaaaaagggggaaagaagagcatgcccctctctttaaagataactcccagaagtcacagtcaccatatctcatcggttaaaacctagtgacctgaccacacttagccacaaataaggctaaaaaaatttgttattaatttaag

SEQ ID NO: 30582 - DNA, 1344 bp, Bovine  19866880614242
ttggctttcgttctcaaaccagtggctgaatcttgaccagccacaagtaggactgaaaaaggaggaggtgagtagaaaaactccagactaagacatgagggaattgcaactagacacaaaggtaaaaagacaatgctgctgctcctgctaagtcacttcagtcgtgtccaactctgtgcgaccccatagacggcagcccatcaggctcccccgtccctgggactctccaggcaagaacactggagtgggttgccatttccttctccaaagaaagacaatagggagacctaaatcccaaaaggaccacgggatgaaaggaagaggtcttagaaaagaccaagagagagaaagcttttcagggctatatgcataagaagaccagagcagggttaccagaaaactataggctgccctgttaaatgaacatcaaacaacaaataattttttgtaataagttacgtcccaaatactgtacaaccttattttattgtaagggacatactaatactaaaaatgtattcatgtttacctgacattcaaattcaactgggcttcctgtgtttttagttgttaaatctagctgtcctaggccagaggtaccactcatccgtcactactttgcactgtcagcttaccatgattatagatcctagaatatcctggtatctaacaatctggacagcccagcgggtgggagagcagagaatggaacaggattcttcactttacaaatatactcgttcacagctgaggtcctataaatagcaaactctcaacagtcttatcacagaaactcatttttaaaacttaaatgtaacagccccacttttgaagcagcccacctgtcaaaactgaaggcaactgccaggcacagtcccaaaagctgtggttgtcctggcttcagagatcaggagaggggataacaccgtaccagcggccactgcagaagaggggcccccacgataaaggctgaagcgccaccctgggccccagggtctggcctcttccccgcaggcccggcttggatcggccccagcacctcctgcccaggctgctgcagccacttgcacaaagggctgtcgaagatcctctgacatttcagcagagacctaaaaaagggctctctatgtccaaccaaacgcaattccccaacctcagccctaaactgattaaaagctggaggccattcgttttgttttgagaagtgccagggttttaagcccgcggtccccctcttccctcctcactagttccagctgcaggggcacttcagtgtgaaagaccacacaccagcaggcccagcggtgcggaggcctggcggagattaaaccccaggcggccgcg

SEQ ID NO: 30583 - DNA, 4722 bp, Bovine  19866880641880
tacaactaaaacctagacagaaaaggaggcaaaggggaagggatccttttcctcatcaaggcttgtcatgaagacatggagctattccgctgccgtttactgcccagggagttgggcaggtggtggagtctaggctctgctagggagcacttcgcccatgaactgttccctctttgtgtgattagatacctttggattttgtttctctgtgttattcatccaagtacctcccccactgttcctcagtccaattgccttgttccatttttgcatttgaatatattgcttaaaaattattttccccagattgtggatcttatctttttcctgaaaggcgtgggacagtgggacctaaaacaataatacctaccgtccgttgaggcaaaaaagagcagagagaaggtagcctagcaggaagccgatgaaaggcatcagggaggaggtggccagcaagtgtggtgtcatgacaaataagatgctcttgcccacgttgatggcggagagcactacaacagccacactgcacaaaagcaggaggatgatccctccctgcgaataaggacaagaagaaaaggcagttagaagggtgtggggatatggaggagcgcagagagctagggaagcgctggtggataccgaaggtggaaaacattttaataaacatatttgaagtgaaagggagtacgcaagacctttatcatcatcttggatttcttacctgtagctgggcagcttgctggcggtcataggtctgattacctttttactgaaagctcagccagacatagtttctgatagacatctctgagtagcaggttttcagtgaagtgctgtgactctgaaggatgagactattcagccctccggcaaagtgggtattgtaaatgaaagttctctttacgcatcccaacaatgctttggatgctctggatatcttggaactgagtagaagctgttcttagaacttgtggtacttgtcttaaatacctcttttatgggtagggacttcatctattttaggatgaatctgatttctggaagttgccaaaaatcatttgaagcaatgctggttaaagcaggtaatgaagtcagataatgtgcttttagatctgaatgatgtatagggatgagtgcttttcttgagtgacttgcaaattgggatgataggaaagttcctaaaaggagtttcaaatagctcaggtaatgaatctttagaaacagtgcaggtccaccctaccccaggtgagagctgtgaaagcaactgtcatcaggagcaatggtatgtttttttttcttttaagattatgattttatagttggatcttccataccacttagaattttcagtaggcaatttatcatgaaattagaatgttaagaattttctctactaaggaggattcaaggtttcaaagagtgttacatgtctgcattttagagtgacatctaaactgatgaaaatgcatgcataaacttaagctctgtccctcttatcttctgagttgtggtgtttagtcactaacttgtggccgactctttgcaacccaatggactgcaaccaccaggctcctctgtccatgggatttcccaggcaagaatactggatgggttgccatttccttctccaggtgatcttcctgacccggggattgaaccctcatctcctgcaccagcaggcggattctttatccctgagctaccagggaagccttttctgaaatacaagtgtgtgcagcaaaccttccttgaacttactgtgttctgtaatggttatggttccatttccagctcatttcacacctgtgtttggtatttcctaatgcaattttttaaaaaaaatgtggtaaaatatatagaacacacaagttgtcattttaaccttttttgagtgtataattcagtggcattaattacattcacagtgttgtcctagtgacagtttaacgtttgtttatgttgctctacttgtaactgcgcagttccgtgtttctaaatcatgttgcaactgataatcatataaaacagcacctgtactgttggtggtcctgtcccaggacaggaaggaatctcactagtaacgacttaagttttattgagagactattaactgatacaactgacagggaggcctggagtgctgcagtccatggggttgcaagaagtcaaacatgactgagtaacaacaaaaattaactgataaactgcttagttcacccttgggttttgagttaatttctccttttggattttttgcctcttgggtttgtcctctacctgatgtccagattttgttctgaagagggtaatgaagaatgtaggaggtattgggctacaaggattgtgaatccggaagccctctttgtctgcgtgagtattaatctcaagccctcattctcattctcccattcttggggcctttagagtggtggtgagcatagacattgatgtgacccaggtgtgaaaactggcttagccctcctcaagatatgtaaactggtgagtccttcagcttttggaatgaggttgacaacacagcacctagcatcttagaaccactgactgctttgtagcttgtagggaaaggagtggagtgtaacatctcacactttcttgtcactcggatctcctgtccatgacctcttgctaagaagagaggccacagtagttgtttgttcataggtgaccatgttttctgtcacctgcattgccctgtcattgctgactaaagctgtgatgagtgtctgtccattcatgggcagccagctcagcttgccagggatccaggagataacctggcctaactcttcccatgtaggtgacctggttggtgagcgacccaacgaggaaatcaattctcttatttagggagtttgtagagttacagagaaggggaggcaagagcagagacaagtgtgaaaattttgacatggaggcccgcaggctgcagaagtcacaaggtggcataaactgagacaaaggagagtcaggtcttcggtcagtagcaacaggtatggggaaagcataggtagcgtggttgagtcaatgtcagggtgggatccttataatgagagtggtgagtggcttatgctgagtggcacctggactgtgtcatgctcaggttcaccaactttctaaccacataggcttgaataaactcctgcatgggtgagttacagtattacttgaattacctttccaaatggtgaaagtgttgctcagttgtgtctgactctgtgacccccctgtagcctgccagtatcctccgttcatgggatcttccaggcaaggagtgggttgccagttccttctccaggggatcttctagacccaggtctcccacattgcaggcaaatgctttaccatctgagctaccagggtagcccaaatagggcatccttaaaattgtatcttggtgtgtccaaatgtgacctctcactagggaatgctactggttgagcagagtttgaacagatagcttctgtcagagccagttatcagaagttgggtaattttgatttgaaagtctctaggagtgttcggtatgcaaagaagctgggacagttgttccagcttgtaactcactacattatgaattggggagattaagaatgagcatagtcctcaaagaaatgtaaaagcaagaaaatttcagcctttacatcttggccactcacttttatctgcaacctcgtgggaatgataccttgtttgggagcaattgattaatggagctgttgcccttctgcttgtctaaccttggaggtttggccagcggcaaagcaggtcctaaggtacacttatattttatgtgattctttgttactggctcctgtccttcctgtccaggtgtatctcagcccttttaatgttctctggggtcatttactgtagaattgagtcatggatgtgtaacaaaacaggaatgagagacattccctgggcctcagttattctatatataaaatgagaataaggcaggagactacctcatcttgaagccctctctagccttaagatctgagattcttttttccatcctcagaacactttaaaaaaaaaaaattgaagtgtacttgatttacagtgttgtgttaatttctgctgtacagcaaagtgactcagatacatttcacattcttttacatttcctcacaggatagtgaatatagctgacagtgctatgcagtgggcccttgtccatccatctgtatacatcagtttactaaccccaaacccccattccatccttctgtactgcccctctccctcttggcaacaagtctgttctctaggtctgtgagcctgtttctgtttcacagttaagttcattcatgtcatattttagattccacgtataagtgatctcttagagtatttgccattctcagaagaatacttagatcaggagacacgttatatcagttgcttttggggttctagtctctggtttcacctacaaagtggaggagggcaaagttgctttaagtgatatcggggtcatttcacttttttttttttttttgtgtgtccttaaagatgtctttttttttttttcatttcacatttttatcttctgtgtgatatatttttccttttgtttctacattccacaagctcttcagtaagtgagatgacaggttcatgtttctggttttttgtttgtctactcatgtgtgggagagacaggatttggcctctattcctttgtttattctcaggcat

SEQ ID NO: 30584 - DNA, 4431 bp, Bovine  19866880664792
ccatgatacaaacgagaaaactgaggcccagggagacttagaaaactggtcccataacaagtcagtggcagagtcaggtctgaaccccctccactctcatgcatgtcttacaaggtttttcagcatcatcactgttaacactttggcctggataattctttgttggcggggtgggcagtggggtggggggaggtttgcaggtgttatcctggttatggcaggatgtttaacagcatcgctggcctctacccacgagatgccagcaacatctcccgacttgtgccaaccaaaaatctctgctgacattgccaaatgacctctgggaggcaaaaccatgaccaactgagaaccactgatgtattggaagctttgcctgggcttctgggtgctgccttagatcagagagacagggctctgcgaggtgctggctgtttgaaagtcctgctccagctgccttccagctactgctctccccacagggcaaggagtctatggaaccgaggagacatgcccacctggaacaaccccacccttctggaccacgttctgttttccagggcctgtgaggactcactgccagttctcctggctgttggagcgcctgcacgtctgctcccgaggggtggctcagtgtgtctgctgagtggggagggaggcatgctaaacatgcaaactatgcgttttggactcaaacacgcacgcagggctccgtctgtgaaggatggtggtggaggtgggaagaaaaggatggtaggctcttggcaggggcctccctggaatcttgactcagcctgcagatatgcgggtggcctctccagaccccggctgctggtgtggttgtagctcacacatttttgacccatcaacatgaagacctcagaatcatatctgccaacagaaaaagcctgttagggctccaggttttctcctgaaatccacattttctctagagaaattttcactgtatttctcacttggtggtcatttctcaccaagaaacagcatgtttttttccttctggaaaagcagaaaggagtcaaggacccaaagacacactgagaggtggggctcagctaggctctgtcaccagccgggggctcctcacccacagcagccttctggagggggtacagtcagctttgcagaagagagataacggccccccaaacctcccctcatcccccacaaatggaactatctttaccgtttttacttgaggaaataaaattgagatgacctctagatacacttgatcacaactagtatggggtgggactgttttaacacatttggaatcactcaaagcaaaagtctacccataatcctcattaatggataattataatgtttttcccagttaaatttttttattgtgatataattgagatacattatagtttcaggcataaaacacgatatttgtatatattgtgaaaagttcaccacaataagtctagctaacatctgtcaccatacatagttatagaattttttttcttgtgatgagagcttttaagattgcttttatcaacaagttccaaacatgcaatacagggttattaccatggtcaccatgctgtatattacatccccacaacttatttattttataactagaagcttctaccctttgaccccttccaccaatttttcccacctccaacctcctcaactctggcaagcaccagactgttctctatatctatgaggctgttttcagttttttgaacattataaataatacatgtctgtcaggggaggactgattattcattcatagtatgtccatatgctggaacccagtgcaaccattacaaccagcagcaaacttaaaaagaccagctaagattcatttcttcattcactcatgtaacaaatatattctgggcacatagtatgtgtaggtaccaggttaagtgctgaataataaagaaatacatgttttgacttgcaaagatgttcataagacattatgaaatctgaaaactccagctcacagtgtgtaataaaatcacatatatgctatcatatattggtataatgctaacaataaccatttactgaatgctgagacccattatgcctgaattactagactaagcactcagacatgataattacacataatcctcatatctacaaggattgtatatcctatctattttgcaaaagggatagttgaggccttagaagtttaggtaacatagttaagttcatccagtacaatcttaaactgcagagctgggatcaactctgactaaagagcctgaaatatctgcaactgtgctgtatatctttcccaaaattgtgtacacatgtaagacaatccagtaaaattctcaaaagaagtaatctgtgctgtttaggattatgggtaaattgcagattattactactttctatatatttaattgaattatataataaatttgtcaagttccagaaagaaatttgagattttgattaagattgcatttaacttagagaatactgtggggtagaaattaccatacataatagtcagaattcctacctagtactttggctgattttcccatacatattcaagttatttctgacttacccttaaattaagtgtgataatttaaaacgcatagacctcacatctttcctgttcagtttaatccttggtacttcatggtttctgttgctgctttaaaatgaactttccctccagtttccttttctaactgggtatttctgctctatgtcaaggtaactgattcttgggtgttaattttctattcaaccactgtattaaaccatcttatgtttaaatttgaggtgaaattcacacaacataaaattagccattttaaagtgaacgattcagtgacatttagcacatttacagtgttatgcaacccttgcttctgtgtagttccaaaacatttaatcatcctgaaatcaatccccttgcccgttaagctgttatttcccaagaaccatattatttttttgaattgattatcaggaactggggttatgaaaccctcccatggaagtcatcaggctgtgtggcggtgccacctgatggaggtggtcgtgatggtgttgtcatgagctaggctgtggatcttcttgtctcctaaattgtgggaaagcccacagatgtggaattttttttccattacagaatctcactgggattccagtcttcccttcttgcagctggccctccccacttccaagataaagctgaggccctgctgacctgcttcctctcctcttaagactactgcctcaaattcctgggagtttccaaggaaagcccgggacaggacacatgttttaggatgagctgtgtcggaaaatgaaatgggtctaagatttctccaagtcttagacacatctctacgcccattctaagcctgcttgaaaataaacagttcaagagattcacactggaatggccctcagacttcctttggtcagtcacaagcctaggtcttgctgccaaggataattggtgcttccgcccggctggagccaagctacatgctgccaggctggtcaagaaaccctgggggtttagtggaagttgagggctgggagtgagggcaaacgcctgggaaacctgttcatctgtgattgtcaagactcagggatatttgcatggtatctcatattatttgtataaggtgaaatttattcttaaatttctcattctttagaaggtttataatgatgcaaataacacaggaaaacttttccagtgtttttactgtcattgtgagtctgttttctattccattttccatccatcactgagccagtgttgtgtgtgtatgtgtgtgtatctgggtgccaggtcctgtgctaggctgaagatattaagacagtgtattttattgagtttctgttgggaggactagaaccccaactccgttggcctccacctccatcttatgttgctgtcttcacatgcagccacaactgggattgtgggactgagttagttacatgagcagaaatgaggtataaggtgaagtaggctcatatgcgaagagtcagctcccagtggatccccgtagtgccaggaaatttgtgacctttagtttggaaaccctgcatgctctgagcccctgccttggggtttggtatctgttacagactgaatatccatgttgctcccaaattcatgtactgaaaccctacccccaaaagtgatggtattaggaagtggttagaattagatgcagtcgtgaggatggagcctcatgaatgggattagtgccctttaagagttgtgagagagattgcttcctgtctctgccttcctccgtgtgaagatgcagcaagaagacagccgtctgcaagccagcagaactcaaccgtgatctcagacatccagcctccagaattgtgaaaaatacatttctgtttcttataagcttatagtcgtagccc

SEQ ID NO: 30585 - DNA, 1095 bp, Bovine  19866880686588
cctggtgggctgtagtccacagggtcgcagagaccgacacaactgagcgactaagcacagcacgtagtacctaattttaaatcgctagataaattttcagtcaaaggcaactctaatatatctacttgaaccactattttggggtagttgaggtatttccagaatttctatagttataaaataattaactgtaactaactttcataaggttaaatctttcccccaaatcacagtaatttcctccaatggaagtgctgggttcaaatgaatatagatttttaaggaatgcgtgctaaattgcttcagttgtgtccagctctttgtgaccctatggactgtagcctgccaggctcctctgtccatgggattcaacaggcaagaatactgcagtgggttgccgtttcaccctccagggtttcttcccgacccagggatcaaaccagcatctgttatatcccctgcattggcaggcaggttctttactgctagagccacctgctgaattcatcaagaagtgcttaccaatgtatattccacaaacaacatattacattatgcttacacttggtggcttctctgttcattcacatttcttaaattataataatgttgcatattttattttattagaattacaatactattgtaataacatttatattttattcacgctttttaaatttctttttttgaattttccatgaatatccttgatccagaagcacttactttttctgagtaattttggttctgtttagatatgtagcacccttgtctcaggtcaagaaagcattagcaaaagaggaatttgtatcaccgtgtttttgaaaagcaccgtctttccttacagtgcatttaaagttctcttttcccctctcatctcagtaaccgccagcccacccagcacttcccatcttgcttgtctgctcccatcaggagtttgtgtggacatcctgagcagcccattcagagtcctcacagtcctcgaaacggggaaactgtacccagcactctctaccaaaaggccaccacttgataaagcatcctttttaaaaatctttcctgttcccctatttgtgacgtggacttttcatt

SEQ ID NO: 30586 - DNA, 1763 bp, Bovine  19866880772188
ttaaacttacatcagttaataccaagtctccccttcccccttagttatcctaaacacttagtcctcaggagtggggctcctatggtgtcaaaacccagattcttaacccctaacgcttcctgcagcggagagggcatttgcttagggtacaatgtttctcaaagtgtggccaacctcaccacctgaaacagtgtgttaaatagcttctgcctctggaacaaatgaaacctgcacccttgttttcttctgttcaggaaagagaactgaaaggaggggagattgtttgatattattttaaaaaaacttttatgcagattgctgggctgcactccagacaaactgaatggttctttgtgggcatggggtatgtgaacctgattttaaaagcacagggaagctgggaaagcatcacccagaggatgttagttttctcagtctgatgaagaactaaaatctcatcaccatttctgcatcccagaatcttaggcggccaaatgccaaactctcctttccagctctccttggtttggatcctgccttcccaccaggcccagcgttaagtctcagctctctggaagccttcctggatgatgtcaggcttaattctcttccttctaatggcactcagtacctgaaccgctcaagggaatgaagatgcattctatcttatcttttcccccaattagactgtgaggacttcagcttctggcagaaggcccagtgcatacgtaacagtttaacacttatgtgggttgatctgctaaagacaatgacattggaaagtcagtgttaaacacacacacaaacacaatgtagtacaaagagcatttcacttgcaatgggaggacctgggttcaaaaccagctttatcctttcctggctgtggtaagtcactgcgaggacaccagtgtgacatgatacccaagacagttgtcaactgccaacagcagcaagcaaccattatttctctgatcttgggaggtggttcatattatttatttctctttagagccaagaaagtaaaaactgaaacaggcatcgctatcatacaaacacagagagaaagccttggagacaattcccaaggtctgtggttagtcacaagctctgctggaacctcacgggctcaggcctctgtgcttccaccagggcagggaagagggggcagggaaacgctcagtaactagaccgtgcctggcacacctcgtaggtctgcaaatgttgagtgatgaaaagcttgcacacactacctgggacaagagagccccagggccctctccccctggggccccttctcacacagcccccttcccacctgcataccaagaacaaagcagagtttcataggagcaaggtaagtgagccagaggcccccaagtgggtgtgaactgaagagcagcaacagtctcggcttctggaagtactgtcaaagctggtcattaaaatcatcctcaaactgctcttccagtaaatgaaaaagcagagtgcagtatccagctgcctcagattaaagcagaggagtggggggaaatgagaaacagagtcaggatttccaattactgctagcatgagcgtgttcagaagggagaaaattaatggaatcatcaaaaggctggtgatttcacttaaaatgagttaaatcagcctcaatcttcccctgtttccagggagacctcaggctagtcactgcttgagctgcctgaaagccacccaggcaggatcagagcggctaagtgacagtcagccaagacagaggctgggga

SEQ ID NO: 30587 - DNA, 1236 bp, Bovine  19866880791083
ctgtcactcaaaagattaacagaaagagacccagggatgcccaagggaacactgcaacagccagatgtttctgctcctctcatgacactgctgcccacaaccaggaccgcatttctgacgccaccaagaagccacagaagagaactgcaggcttccggaataggttgaaactcaaggcatcaccctttagcgatgcagacacaaaaaaatcttgttaatagtgctttcttacagacagactcgcctgatgcccatttcacaggaatggcaccgctagtcggatgaacacttcctgcagctgcttggtggtgtgaaaagcacacaatgcccacaacgtgcacatccaatatatactgggacgtggctcccaccgctacgcatgcaccatgttccaagcaaggcttttaccctcctgagtctcactttcaaaatgacactaaaaagacccaccttcttgctcttataaacataagtgatcatggaaagtgcccggcccaagaattcataaatgcgggctcttactggggtctataaatgcatccaggtcaacacagcagctttcccttggtactttctaaatgtgtgtgtgtgtatgtgtttgtgtctgtgtgacagagagacagagaaaaggagaaagagagagaaaaaaattcggctggaacacacagaggcctatttacacttcctatttgtgttccaccatttctatcaaattaataaactaaagaagcccgagggaaaactaacccatgtctctgttttcccttgaagtccctagctttcccctaagagctgcttcctccagtttcaggaggcaaggaaggagagccatatggcttgagaccctagactcgcccagcaacaaacgagccccccaccatttgtctccgggcctctcatgtgggcgggcatccagctttcagttgggtgctctggtctgcgtctctgtcttgactgttcctaattattggagggaacgccgtggctctcctgacctcggagtttaaaagctgcgagtcctaatatcaaaccaagcagcttcatttaaaaggcatcctcatctgcatccataaaagtcactcccggagccctggcttgccccagcttcgggaatgcctgctgtcgaggatttatgacacgccctggctctaatcggccgcactttaactgctgctgttgcacatctggtcataaaagcaagggccggcccaacatggggacaaacacttttctttc

SEQ ID NO: 30588 - DNA, 1364 bp, Bovine  19866880811811
atgctcaggactaatccctgtttggggaactaagattacgcatgctgcagggcagctaagcccgtgggctgcaaggaagatttccaaatgctgcaactaagactcaaagcacccaaaagtaaaataaataaatatatattaaaaaaataaataatatctttgataggtttttttttttaaaaaagaaagacattcaggactggttcaaacagcttctcttgggaccagtcaggaggacccaggggttccaacgtcgcaaggacaaccttggggcccacaagcacactctgttcagggcagggttgtcccaggctcagtgcttcaccttcctttgcaggattttctcctggctctgtgtggtcccctctcagcccctggagggcccctccttccttgagcgtccagaaagagagtggagggtgtagcaggtactactggagaaatggctacatcgtgagaaagctggggaccccgctggcacaagttatttacagcttccccagcctcagcctgttggtgaagaattataggacttcccaggtggctcagtgggcaaagaatctacctgcaatgcaggagacgcaggaggatacaggtttgatccctgggtcaggaagatcccctggaggagggcatagcaacccactccagtattcttacctgaagaattccacggacagaggagccatgggacagaggagggctacagtccatagggtcacaaagggtcggacacaactgaagtgactgagtacaaggaacaattacaaaagcactgagtttggcacctcataaaccccttcgcgtccccctctctcacttcccacgtccccccccaccgtgctccagcttctcagacacttttagggtatcttcccctgggttcaccgagccaaatagcccgcgggaggcttgtaactgttagctcaaacagcaggctggctgcttggttgccatggcaacagctgttgtgagtaagtggtctttttggcagaagatttaatttaataaactaaatttgggggcccagtgggaagatctggtacaggctttattgggtatcttctgtggcgctgggctgcggcagagggtatgccggagaagggctggaagcttttgtcctgcagaggtaggcccggggatgagagctacaccctgtgtcctcagacaccctgagactccgctctccacatcacctaggagtgtctggccaaggtcttgcactactgcttccagctatcaggtgttggagcagccttcccttggggaacaaccggaaaatctggacgaagcatgcaggacttctctgcgaggtcgagaccgaggtagacacggccggtgtccactccagggacccatttcag

SEQ ID NO: 30589 - DNA, 795 bp, Bovine  19866880821049
tgggagactggggtttaagtctcagctctgtagtcacctagagcagtggcacccaacctttttggcaccagaaactgatgttgtggaagataattttccacagacagaggtgtgtcagggggtggtttggggaagattcaagtgcatcacttttactgtgcaccttatctctaatctaacactgccactgacctaacaggagctactggtctgtggcccagaggtgggggctggggggggctcccctgacctagagggatgaccctctctgacttttacctctctgagcctcagtttcctaatctgcaatgatcctgtgaggattacgatgatggatgtgaagcaaaagcacactgcctggtacacctggaagtttaacacacgcagggccctcccctttccctgggcacacatggaccagcagaggccagcaagcccaccagcacccctctgccagtccagggccagcccccaacagtgacgcctgctgccaccgccactgggctcaccggctgtgatggaaagacttcagctttggctgcagcagcacaaacagcaccacgaggaggagaatgagcgccacggagctggcagtggaagccacgatggacagcgtggggaccccgagcgaagtgtggatatctttgtctatggaaacaagccatcatcaccagtgttttgtacccagacacatggaacgcgagcctcatggctgaccttcaaaggccccctgcatggtgccccagtggagacgtgctaggtatggccagggtcgcttttggagcaacagtgcag

SEQ ID NO: 30590 - DNA, 887 bp, Bovine  19866880832395
catcttcctgtcagctgccaaccatgctgaggacgtgatgtaatctctccatggtgtaattacctgtgactataaaaagacttggggattgtggtaggaggctgggtgggtcattatagagctggctgaaccctggcatcatgaaaagacgttgagaaattgccctctgcttgctgattgttgtgccatgattagaacaccgccagtgcatggtatgagctttgcactgtgacttccgaacaaaacaagccacaagtctaccagactgaacacctcagtgactctcctctgggttaaagcctcattaaacacacattccacctcccaaacaaaggtgccccactactctggtccttaaatacaagcttacaggttatccttacccacatctttctgtaaaagagggtcacagggtgctaataaaaaaaaaaaaacaactaggtgagtgctcagtctttaattgttctaggtaggtttgtagatgaattctttcaccacctctcaccgactgggagattcctttcttcttcatcaccccagcagcacctacaagggtgtgagcagtcctcccattccaggtggctgatactggtgtagtcagctgcctggactgtggccagatcaggagtgaccttggccgccgcgtgttcagctttggagcctagaggaacggcagtgtttagcgacgactgttccgcagtgtgctgtgactgagagggatgcctgctgctgggtctccctgccctgtttacccagctcaccttaagccagcctacagtttgaactctccacgaagaggatgagtactgcctcggtgcctcactgcctgccttaccttggataatcctgctgacctcgttgtcggtatttcgctagaatagggaaga

SEQ ID NO: 30591 - DNA, 1180 bp, Bovine  19866880859479
gccttgcgaagcctggaacaagggctcaactccaaggtgcggaacaaggagaaggaggagaggatgcgggctgacgtgagccacctgaagagtaagccctgccctcggtaccagcccagccccagagctctgcatggcagtccaggccagcgtggatggagtttctgctccagacgccctgccttcgggcgtgctcttggcgtggctgcctttggctcttggatctggggcgggggtagggaagcctgtgtttcttcccccttcagcaggtgactctgatcttccaaaggatggggtcagggtatttccctctggagcccaccaggatcctgggaaggggaggggcagccaggaagggaggttgcagtgaaactgtggctgcagggttctttgaagagtgtatccggaatgcggagctggaggccaagatgccggtcatcatgaagaactcggtgtacatccacaaggcggccactcgccgcatcaagagctgccgcttccaccggcgcaggtccagcacctcctggaacgacggtaggtgtggcagcccctgggcaccagtgggcgggatgctcacggctgtcagtgacaatgggcaggaagaaggcagggtggggaggtggggaggctgacccagccctgaagtcagacagtgtggcctgagcccttgtggccccagccttaggcttcccccagggtcacaggagcccatggaccagcatgaggaggatggggagcaggggggtggggtggggcccggctcggggttggggacagggctgtgtcccagtggcgggaaggctgttcacggccaggcccctggggccaccatctccccagtgaagccgtcccagtcctttatgacctcccagctggaagccaacaatatggaggagctgaaggaggtagccaagcggctcagcagggaccagcgcttccgagagtccatctaccacatcatggccacgcagcctggagccccctctgcgcttccccgggggggaaagtgatgggcacccctcccctggccccccaaggccttcctcactgggggcagaggcgtggcagggggaggcctaactccacccagttcctctctgccagtgctccacctgggggtgggcagcctcaccctcagaggacaggagtgccaccccgtccccctcaccccagatcctac

SEQ ID NO: 30592 - DNA, 1151 bp, Bovine  19866880874071
ttactcgtgagctgcgtgttcatcagttccaggtactgggtcagagacccatctccgtcatctttggttaccactccccacactcacgccagcaggtatcaataaatcaaggctgggctggactgagggtttacggcaagggctgcccgtgctataagccaagcaaccccaggcttgttgcaaggcgctgggggaacaaatcagaatcactgttgtagggaattcccagctaccctgaacacacagacaagagggctgacttccccagtcctgactcccacctcacccccgagaggaaaagcagcagctgcaggagcaggggcagccagaggtcacttagagggaaatggcagaactgcccttgcacaacctctgaggcagccgggaatcaggacaatatgacgcagcattatccagcccctcccgctgggccaaatgggggacccataaatgtggcacttcaaaggcaaggtaatgctgccttcagtaaccgaaatggagttgctttagagtagagtacaggccagtctataaataccagggattaaaaggcttcctgccgggcccaactgccactggcctgaagacaaaggctctctggttctccagaccccaaacagactccgagacgagtccttcgggttagagctgccatcggccaatggtcaacccctccaaagcaatacccaaaactctttttccttcttttccagcttggccagcctctcctttccacatccttcacccaggaccatccactccccagaacccctccacagcagctcccccacgcactctggtctctccaggctccccctgtctccctcaccacctcatcctccaccccaacttcttcatcagtatatatttttatctgccatgaaaacaacaaagactttggaatcattttaaccttggtttgaggtacacacacttacactacttttttttgggggggggggggggcggcctgtgccagagtcttcattgctgcgtgggcttcctctagttgcagcaagcaggagatactctctaattgaggtgtgtgggcttctcactgcggtggcttctcttgttgcagagcatgggctctaagggctcgtgggctttagcagttgtgacttccaggctctagggcacaggctcaacag

SEQ ID NO: 30593 - DNA, 2454 bp, Bovine  19866880978021
ccctgggggctgggtgggagtggaaggtaggtgggggcagtggatgtctgctgggagcatggctaggaaggggaggaaagacaggtgttggctgaaacaggaagtccagtccagtgactacttactgaaaaaaaggagagatgtaaaccagaactgatgttgattgggaagaattaatacggtgtcattctaaaaatgagagtgaggaggaggctgtgggaataagaggatgtgatgaataaaagattactgagaagcaagggtgaaaacagaagatgctgtccagagcagagtggggtgaccagccatttggcaggagacttcacatcttccaacaggtcgggaggggaactgtggccgtggtattaggactgcaccagggcaagggcaaaaatctacctttgacaatggcactgtgaaaatggaaagaccctggaaatctgaccaaacctctgttccaggcctaaagctgctgccaagccttgcgcttccaagtagtgtaccctgtagaccggctcaaaggcatagatccaggggcaggaacaaaaacaggccttcaggatgcagagtttatcccgaggaccaggttggcacttggatcccaggggtgagcagtgaaccagaggagagactgatggggagtgagctccaaggtcataagagttggcagagggagctctctaagggtctggtttttccaaggcaaggcagtggtatggtgccctcatggcactcccccacaccctttgggaccaactctccacttcctccatcccattcccaaagcgctgtgagtgtgcctcccagctcttctggtctcttcccctccaccttcttatctagtcagccatgtttgcctttggtctccctctgaactcctctattcagacatttccttaggcttacccaaatctgaccctttattcatggtctcgctcaagaccacccctccttccatcctccagagaagcctttcttgactacctggcccttcttaaccttaccttccttgcattctgccaatgcctgactatacactcttgtgtcttgtttctcacgtgttactgattttctgtgattaaactctttgaggacagtgaatccttagtagcataaaacgtaacatctagtaggtacatgattaaaagcttaattatcaaaatggttgtatgttgtgtgtggtgttttcctttttttcctgctaacgcttcaaaaatactctcatatgcattacaatctcataaagtaggttgtatcaatagcagactttttttttaatcaaggaaagaaaactgacacagaaaaagcccaaatgactcggatcaagccatttactgctatgatggtggggttctcactccctgcccagacccctaggttcttaccttggtgacatagcgtacgtattgtggccgtttggatttgaggatgatgcctatggtgcaagggatgagaatcaggatcagtgatatcatgatgccgccgtacggcaccttgtccttcagggacccatcatagatgcccctggagtaaaggtacaggaggaggggcatcatgcccagggcgaagaaggtggagcaggtggtcatcacgatgctgagagggagacataggaaaaatggagagagagagggcgctcattaattcaggcatacctcattttattgcagttcacagttgtgtttttataaatgagccttcatggcagtcctgcatcaagcaagtctattggtgctgtttttccaacagcgtttgctcacttggtgtctcgtcgtgttttagcaagtcttgcagtatttcatgctttttcattgtatttgtcacagtgatttttgatattactattgtaattgtttaggggcactgtgagtcatgctcatgtaagatggtgaatttcaaggatataaatgtgtgtgttttgactgctcccccttttctctctcctcaagcctccttgtttcttgagacataatactgaaattaggccaattacaaaccccacactggtctcttaagtgttcaagtgaaaggtagggtcagatgtctcttatgtttttaagttaaaaggtagaaatgtttactcttaggagattctgtggaaatcccaggcaggctgaaggccaggccttttgcaccaaacgccagttgtaagtgcaagggcaaagttcttgaagaaaattataagtgctaccctagtgaacttacgaatgagaagaaagcaaaacagccttatggagaaagttgtagtgatctaaagagaccatcaaaccagccacaacagtcctttaagccaaagcttgatccagatcaaggcctgaactctcttcaattctaggaaggctcagagaggtgaggaatctgcagaagaaacatggatgtttcttgccatatgcatatatgtgcaagtgcagggtgaagcagcaagttatccagaagatcttcctaagatcatca

SEQ ID NO: 30594 - DNA, 864 bp, Bovine  19866881019393
ttatgtatgtacatgtctagaaaagactgtgtcttattcctctctatatacacagggcctaagccagagcctgatccaatgcagttgtttaacacatgtttgaagaatggatgggggaatatcaaaccttacctaaaagatatcccaaagaagctcctttttctattacttactataaaaagagatattctttgtcaaactaccaccaaatgcttaacactcgcaaattttttttccttttttttttaaaagaaacatctattatataaaggaagccatacattaaccacaggactttccccttgaattaaggaggaaaaaatttcctgagccattgaaaagaatgcagctgagtggctgacagtgtccatggaatttattcccagtgaaactggcgttagcctgagaatcctcctcacaaaacttggaagtcactccaccccccagataactcacgtcacccacaagacaggcagtaatctgagatgcccaaggttgctaagcctgaaatgtgtacgttaaggcaggaaaccctgacaatttaacagccaatgtgattagcactctggtttttctggcagctataatatgcatgtacttgagtaaaaacaaaaggcagattcatttataaaaaatatttttgacaccctgaatttactttttttccatagactcaacgttgtaaataatgggtgagtgtcccagcccaatatgctaatgtcgaattggaaggaagagaaggagaaggagccttccccgtgtgcctgatgagtaggtaacaggcacagtcaaggcttccagggccaggccccccagccgggtagaaatccctggcccttcacactgttccttcctgcctcagga

SEQ ID NO: 30595 - DNA, 1181 bp, Bovine  19866881064458
aacccacgccctttgcaatgaaagcacagaaccttaactactggactactggggaagtcctaaaggcattatcttttgatctcagggcagaagagcccaggacagtgccctttgaactctcagctcgtgccccttgagttcctggccctttctaccacgcggaggatgtcagagctacacgatcacacagcgcccatcggcccaggccttaccggtccacaaagcaccccctgccttctgtttcaatgagccccacagcaacctgggagccagccaggtatagccatcactcttaccggagcaacacggaggcaaacgtgcccacggtcacacagttagtgatagattggtaccagaccctgcgtctcctctgaagccaaactacctcttaaagatcagagaatcttccacttatcactgggccagggtaccacatgcctttctaagtggcccaagcaaggcattcccagagcatctctgtgacctgatgcagatgggaaaggatacgggggcaggtggatccataatatagatgaacaaggcaagggagggaaaccctggacagcatgactcagggagttctattctccatctagagcacacagctgccccagaaatgtgaacttgaacaccctcctctccctcctgccaccccggggcagccttcaccggggcaccagctggactctagtgagtctcactcacattttgtacctaaaacccaggaaattcacagctggccggcctctctccttcagcgtgctagggctttaagcgaggcctgtgagcagtgggtctctgctggcctcatttcctggctaaagacctagatagagtgtctaaattttcctcgggctgactgctgccccagatttagcctctctgatggataagtctgtctccccctgccagtggctgtatctgtcactccatcccatcccctggcttcctaaattacctgcctttaagttgctgacaatctaccccgtttcacttctcaaaatgtacagaacagtcaaaagaaaatgcccacactctaatacaggagggacccatttgagagcctgatcctaggggccacatgtagctgggggggagaaggctcaatgctgtcaccacgccaatcctcaaatccatgcgatcctaataaaaatcctcagatttccttctctgtctgtttg

SEQ ID NO: 30596 - DNA, 945 bp, Bovine  19866881093049
cagccacaccctagacccaccgcccatgaggtttccttctcagctgctgcaccaaagtccaaactcgttactcaaaaggcaactgcggtgtcaatttacaatgtaccaaagtacaggttgtttctaagacaaacttttaaaagctgactgctcagcactgtttcagaaccacctcacgaggtatccgatttgcactcttttgccccttacaccctagccccaaaggcccgaatatgaatgaggaatgtgtctaaggatcactggcactcagcaacacacacatacctgcacttcacaaagaagccaggactgcagccagggtgcataggtttgcatggcaccaagggaagccaagctagtcggcacacgccataggcctgttactcatcctgggtttccgattctctctgccttgttgatggaaaaggcttgttacatgtgcaagtggcgatcctgagtcttcgcaggtacttctcgcagtggaataatgtgagcagaacaatagtctctccctccccacctcacccccagctgctgggagtaactaggcctacaggaaagagaatccacgtgcttcatagactccacaggagtgggtgggcaatcctctggggctagtctatttgtacttgcagtccatgtgcaaaaccaaatgaaaccatacactccaagatggcagagaagttgcagagcaactgattctgaactgtgggcctgctgctttctctcacacaatcctctcaattttcccagccagcctcacctctctgagggacagagataataaagagcaaagagagctgtgtgtgtcacagaaatcccttgcattcctatacactaacaatgagaaaacagaaagagagattaaggaaacaattccattcaccattgcaaagaaaagaataaaatacttaggaatatatctacctaaagaaacaaaaagac

SEQ ID NO: 30597 - DNA, 950 bp, Bovine  19866881112179
tttattcttgttacttgtttccgtcttgtcactctgtgtttgggacccaggactgtaatatctgggttaatcaactaagttattcattggacttggttataacctaaccatggctgttttcccaaaatcaaatcttccctcaaagatttgcctcctttgaggatatgcaggctctgagcggtggaatgttctggaaaatcatgacagcatcctttgggagacagctgttcctgagatgacagttctagaagggagaatgctaatttcaaagttattactgagccttattgactatgcaatttatttagttaaaaacacctacagatctccctggtagcaatctgccttccaacgcaggagaagcaggttccatccctaggcaaggaaccaggatcccacatgtcatggggtaactaagcccttgaaccacaactagcgagaaacctgggtgccaaaaggaaggacctgtgcaccaaaacaagatctgggacaccaaaatcaaataaaataaaactgtttattgagtgcccattctgtgacaggcattgttctaggggctggagataaggcagtgaacaagacagataaattcctcttgcctcatggagcttactgtcaaatgtgggaagatgacaataacattaattgcccacatagaagctccgtgacgataagggtgacggaggaaaagaagcagggagtgctggggaagggtcagtctgcaaacgcagaggtcaggggggtctcctgcaggagggacagatgactcaagacctggaggaggtaaggagtgacataggcaagatgctgagaaggatgctgaaataaaaaaggatcgactctgcccagcctcaggcccccagtcattacagcttactgtcctgtagcctacatacatacaccatttgcatgttggctcctcatttgctcattctaccctgggtcgccaa

SEQ ID NO: 30598 - DNA, 1060 bp, Bovine  19866881115133
acacctgtggttttagtctgcctaatatctattctctcttccctggtgatagaatctctgtcttctttttactctcagtgcccgtcatcgaagtgcactgattcctcctcctagttgcgggctacaggtgtgacctggacttgatcaatgagtatgtgctctctcttgggtcagggatggtcatgagacccaacctggaccatgaatttgattctaaggcttaggtacaactgttgggggatggaattctggttgggctgggacactgtgaggatataggcctagactggttggtggtcacttggtccttatgaatgaacagtttgctggagaataaaaccagcacagagcaaagcaaagcagagagaggaaagagacaggtttctgataatatgttgtgagcatctgaatacagctatgcttaaagagcccctgttttctcccatttatatatatcagtaacttcctgtgatagataaagcatggccacagtttctttgtggctccttccacaggaggtagagtctatgtccctgcctcttgaatctgggctggcctgtgacttgctttgactcgtagaatgtgttgggagcaactctttgtgaggtctggagactaggccttaaggggccttgtagcttctgccttcaccctctgggacttctgccctgaagccaccaagtaagaaagtcagcctaacctactggaggatgagtggccatgcatagcagaactgacgtgctctagccaactgctcataccagttgcccaccttgtcagggagggcctgacagcctaatggaccttccagcctgataagcagctgaatgcatccgcacgagtgaaaccatcagaggaagctccccgtcagcccacagaatcgtaagttgttattttaagccactaaatcttgacattttgttctacatcaataacggcccatacactccttttttggcttaaatcagtttgatgttatttgctatcattgcaaatgagactgatttgcaatagttcgatcaatgtagttatgtaataaactaagctgatcagaaaggac

SEQ ID NO: 30599 - DNA, 1611 bp, Bovine  19866881136460
caactgatctttgatgtttccagaaggctcttaatcagtcctaagccatactcatggaggtgacccagcttgagatccccagaactgcccgaaacaagaaagatattagtgacagtaaataacgcttaaaagcagatattgtgtgcataaagtttgaatgtattatttcatcttcataacaaccctattagttgttgttagagatcagtactattttaatccctattttacattttgggaaactgagtcgtagttaagtcatttgagtcatttactccaagtataaagcaaagaagtagcagaaccagagctcacatagagatgacataaagttgatggtcccaatcactccaccttacgaggatgtcccaatttgttgcagaacacccacgagccccagtcagcttccagtcttctgtggtcttagaagcaatctggctgccctacgtactctcacaggagagccaaccatttggttgagttgactgctccccaggtttcctggggtgtcctgatcgcccaaggccatctcccacccaaatattctccttctatcagttcagttggacaaacattaacaagtgcctgtgattttgccaggcctgtcctagcggtcgctggacaaaataaactatgatacggggttttccctccaaggcaccactgagcaggggtggagagatgcacacacaggcactcctactatcaccagcgaaggtgtgggctgagtgctgccgaacacaagcagggcaccgagccaactcggggtttcagggaggcgttctgaaggaggtgatccctgaaatgaggcttcaagcatgagtgcactttagttaaaaaaagaagaagaaagacagaggaaaaaaaaagaaagaacatgggaagggcatctgagtcaaagagaacagccgaagcaaagacgtggggcaggaaagccctctgtatacataggattacaggcaaatgagtgtgaggcaggagggacagaagatgaggctggacacagagggaggacccaattcatggcaagtcttatatgccaggctgagaagatgggattttatcctaagggcagtgaaaagccaatgataggattttgaacagagaatgacatggtattccagaaaaaccaatttggctagataggttttacggtggctgtaagtaggacaaaaccaaagcaggaagatcagtcagaaatctattggaaacagaacagatacagataaagagggtgggccgagggtacattctgcatgtgatgaccctctgacccctcagctcagcccacggcctctcattttttccctggattattttcctaaaccccccagggccatctgcagggtgtctgtgtcctcagcagtggctcctgacatcttttaatatcactggcaaatttaattaaagtcactttcctctgctcttccagatcattaataaaacagagccaccaggccagactgagcaaattctccctcttgctacgccctccactttctccaatgggaacactgctccgggtctgtcaccagccctgggtagacgcatcctgctctgcttctaaatctgggcccctgcacagacgtcacagccaatttacattaaagt

SEQ ID NO: 30600 - DNA, 1913 bp, Bovine  19866881170060
cctagagaaaccatctgcccaaaggttacccttcacacaagtcctttacaggaaattgtgtgttttctgtttggaatggggtgtgttcattcttttgagaagcctttttacaatagtataatggttcctctggaactcctagcagtgttctctttctgccctctactgtatttacagctgctttttccctaggggagcattcatctgttttaaaaaacagagagagaaaacaagaagttctctctaacagtgaggtttggaaatcaaaaccgtgtttgcccttcaggagggcaagttcttgaggggctgttgttggggtggaagacaaggaagtccggctgtagtgtcctgattccctgccctcactgcacccccgcgcccctctacccgcagcgtgcttgtgacagatgtgaaggggtttgagcacagggcccattatgaccccttggttgtactagatcaaacattgcttttcagcccctgagtaaggcagtttttctggcaggccactgtctggccccgcatatccatgtccagggtcctggactgatgttgggcctgaagggcaggaggagcctatggtgattgccctggagtgtggaggcagcagcaaagccacaagcgtttaggaaagacctctcatccttaggatgctttcattatactgatgcttcaaggccttggagctggggtctgccaggtctctgggtgcagttagtcaacgaacttcaccccagtactccttagcctctttttgcccagttttaaccacatagctggttgtggacgtgcacctttgtttgatgaggagaagaggatttctgctttgcagttgagtaactgtgccttctatttaggttctgtagagggttatatttgaaaagctaatgagtgtttttttccactctgcacacacagtgatccagagtgggctgcagcgcaggtgctgttgaaggcagatgttgagctgacagtaagggcagctgggccctgaagctccagcggcctggccccctggctgacagcccatcccccagggccaggtcgccagagagggcttcagcttccctgaaatgactgctttcttatggctagtgtgaccagccagaggagggggtgggtttcctggggaagagggtgggagagtttttaattaagccagtctagtttggcagttagctccgacttgcctccaagtctgtgttggctgataattcccttcagctctcagaacaagcctttttcgtttccaaacacacaccgccccccacgcccccaaaactacagccttccttgagtgttaactgtgtgtaccttctgcttcctttctggaagaggcaggtagctactcgtgaattttttcccctgagctgctctggctgcattggagttcctggagactcagggctaccggacattctcatctggcagaggcctggccaggagccattcctggagggctcagtggacagagcactgggaacagtgctggggctggcactcagtctggggggctcggtgggaggtatttgggaaaccttgctgagtgaagagttgggagagctgagttttggttcagccactaacaagccctgtgttcccggggcaagctgtagtccccctctaggcctcagtttccctctcttaacatggataggttgaactttaggctgtaatgtgttaggatcccaagacagaccccatgagtctgctcctaataaaagatgaccagaggcagcaaaggtgggtgcagaagaaccttggatgatactagagatgttttccaggttcatctcttggtggcagagcattgggtgtctttgccatcccacccccagggtggtctttggaggtgatgcttggcttgggccctgctcctttcgtttcctgccctggggaggggcgggcaggca

SEQ ID NO: 30601 - DNA, 929 bp, Bovine  19866881200395
cttgagataaagctgttcctgctccagccacagtccccattcttactgccctcgcgggtgcgcgaacttaacccaccacccggacaccacagtccattcaagaatgcagaggataaaaggagaaagggaacaggagctcgatggagcaggagacagctgttacccaggggagagtgggggaaagggtgtttctgaaagttcaggcctctgcccatcgactcagaccttgagctccttcgcagcaccgtcatcactaacctcagaaaagacaaggtggacaaacgatgagcaaaacctggtgggaaaacgaaagcaaccatgatactgacgacaatgaaaagagacccccgagccagccacggggacaggactcatttccacgcctcacgggcggagtgagaggatggtgatgtgtcaaactggacagacaggagaaaccctgtcccccccgaggaaagttagaaagcaaaggaacagtcagaagaaatgtggaagagaaggtggcgagagggtctgactttgctatgggtcagggacacggcggggagacgggctggaggtggatctgttgctgtcattggtgtggattgaattaaatattttgccaagtgggtgtttcctctgttccactggacggacggactctgccctttcagctcactcccggggcccagtccagtgatgctccagcggctcgggtcctgaggctgcctctctggggtgtggctcgtcccccagaggtcacaggtggggacgcacccttctctggggagaagttgcaggcctgcccagccagaggcctcgttctgtgactcagaaccccttgatgtagcagtaggcctccagcgtggcaaagagtatgtagagaagccacaggctcacaaagagccaagtcgggccagcttgcagccacgagggccgcccagctc

SEQ ID NO: 30602 - DNA, 1411 bp, Bovine  19866881208955
gctccatacctaatatgtctgcccagttaagattaattcgtgatctagcaattgagtttagaatgacatcaggtgcaaaaggaagtccaactaattgttctactgacctgtgtcgcttggggtctccttatgaggctattgggagtgttggtggagatccagttctcttaccccctcagggactcagggttcacgcactgcacgtttggacaacgctaaccctgtttggcagcctcacaagcagctctgatcgatttcccatccgcagctcaacccttgtcctctcccaaactgcttcacggtgacaaatgcagcaggagggggcctccacactgacatcacccccccaccagcagcagcgatgccaagaacttggccgcttaaacaatagaactctatgtggtcaggagagaaagggtgccctgtacctgctaagtgggggccatgctccccttcccagcctctgccatggggactgaagaaagaggccggaatgaaggcagggatcagccagaaacatgccttccccacccccacaggcaagtaaggcttctggcccaagcgtcagctagtgaacctttccgctccgcagggctgggaactcagatgtacaaggtcgatccccctgagcaaggaaggtgcacgatggcccacagagggctcagctttacaaatgagcccattggccaggaagatgtaggtatttacgccagagcctcggccggctcagggtctaactagacaagaattcaaacaaaaaccaataatcactcccaacatggtattgcgggtagtttctaactatgtacatctggaaaggatgacaggagggagcagaaggagacaagaaaggagtccctactcagggaatttgtgttcatctgatatcatgtgcaaagaactgaattaatcataatctttggctatgatttttccagtagtcatgtatggatgtgagagttggactataaagaaagctgagtgccgaagaattgatgcttttgaactgtggtgttggagaagactcttgagagtccattgaacggcaaggagatccaaccagtccatcctaaaggagatcaatcctgggtgttcattggaaggactgatgttgaagccgaaactccaataatttggccacctgatgcgaagagctgactcatttgaaaagaccctgatgctgggaaagattgagggaaggagaagaaggggacgacagaggataagatggttggatggcattagcaactcaatggacatgagtttgggtaaactctgggagttggtgatggacagggaggcctagcatgctgcggttcatggggtcgcaaagagtcggacacgactgagcggttgaactggactgaacctggttcatgacacactcaatatggcctatgcaggagccaca

SEQ ID NO: 30603 - DNA, 1326 bp, Bovine  19866881219282
agataaatctactactggaagagggggaaaggccactcatggagccagtaagtcaagaagcacactccaggacgtccagctgcagctcatccctgtcccaagctggccctgtccgcctgctgtcaccggcttcgccatctgcagaaccgggtttcggccctgttctctggggcgggggccgcgtccttgggaacgaggaggagccgagtcacatgaagacatccctcacccacccactatctaatccatcatcggccctgaaaatccacatccccacttttgcccgtgctctcacccttccctgacctcacagcccccgcatttacacaggtgcacaggagggcctcgctcagggcacctcagagcagtcccagagatggaggaggggagataagggaggtcaaagcgggtgggggctgcagcgtggcggtgtctgctcttcttctccacacctccccggcagggcctgacaacagcatgccgattaaagggcttttcatgctgctgagggaaagcagacggccccctccagctgctgggcagctggaagcgcctgtgttgttttagccaggagaggcctgacccccgtcaccccagccccgcccccctccccaagggaggaattccgtggccaccccggcttgtccacccagcttccctcctccactctgtcccccacagctctggagatgatcaagcaggacccaggagacaaggctgtcttacaccaggtgccattgttggggaggggtgaggaggtggtcagtgggttcaacaaagcagctgagaccctgggtggaaagaagcactaacaaggttgcaaaggtaaacctcctgactcagaccccatccgtatccccaggccatgccccatgccagcctatcagaatggcgagcacaaatcaagcgtgagttagggcccaggccatcagatttctaaaatatgaagccttcttctaagtgacagagccagacaaaaagctacatactgtctgattccatttatgtgacattctggaaaaggcaaaactatacaaatagaaatcagatctgcaattgctggaaactggacgtagggggagaaaaggagaagtggtgatatgctctatcttgattatggtggtgctgatacaactacataatcttgtttaaaaacatcaaagtgtacacctaaaaaggaggaagtgtactggatgtaaatcatatctcaataaacaaaaaagagagagagagagaaaagcacaaaccccccccccaaaaaaaggcatgaaacctcccacaggcacacaaagaggtttctggaaatttttctgcccactcccttca

SEQ ID NO: 30604 - DNA, 828 bp, Bovine  19866881247174
gcccaggggctcttcaccctagtcctaggatcactcggagccccacggtcactgacgtgctaagggaggctctgacgtgtgtaggcacacagacagaaccaacctggaccaaccgacagaactccctgcccgatgcagcagctgagacagaaaaaatggcagcagggagaagagggaaaatggcctttctttgtctctgtagcttcttccttcttgttgcctgtctcctgacatctggtgggatctagggaggaactgcccgcatcctgccctcccgtgaatctctccctctcactgccagcgtgaacagccaggctggcaacagcaagtagggtgccctcgctcttcccagggtccctggggcacctgaggggtaaactgaagtctctgaggagacaccaaaggcagttccccccagcccactccctcccccagcagctctgtgctcccaccttctccagacaccacattttgggccccctggctcccctgtcttctggaaagggaattaaaacaatccatccccgccagcctccaacgctgtcatttctgagaatgcttctgtgaatgcatttactcgtgctcctggggccggcgggaaggcagccgcagagctggttttcatagcaatcttctttattacaattgctccctgactattccagccacgaccattttttcattacagcattcattccactgacagcggcttacggccaaattcccaggcccatttcctgtccagcagagcagacagggtcagacaggcaggagttccactagcctgggacccccacaggagaagtcgtgagaggccttaaaataatt

SEQ ID NO: 30605 - DNA, 881 bp, Bovine  19866881265555
ccaatgcaggagacatgggtttgatccctctttctggaagattccacatgcctcagagcaacgaagctggattgccacaattactggagcttgcgcctcctagagcccttcctgaggaactagagagtagtccccactcatggcaactagagaaagcccacacaggatgacaaagacccagcacagccaaagataaataaatttaaaaaaaaaaaaaaaaggcagaaggtacttgagggaggaggttagccttgccagtgctccccagagcagaagccagcatagacccagtgtcacatagacatgtgtgtcctggagaagatggacaaggggacctcccgttcccacagaatgacttttgctgcttcctacctgcctcctccatacatcccctcccatgaaataatgaaaaattcatgttaaaagcttcacatgtgatctgatttttcaacactttaattggattcatagaagccgggagtagtaagcccagggcccttccaccccagggttcccctccccatacctccccctccctctccaccttgctccttctcctgcttagctctttctccctagacacactcttctgacttcctccacaatatgctcccatccagacctccctttcttcctttccttccagctcacgcccagcagcctcttcctctcagcacccagcacctttttgagagctcaaattttctctttcttccctaaaggagggaagagagcagtcccatcactcaaaaccctgatgaatggactgtttccaaatacttggtgaatggaatgcagctaaagaaatttgattttattgctttctagaatgtacactatctaccaagagttccaggacagcagcactcaaagtttttaat

SEQ ID NO: 30606 - DNA, 3873 bp, Bovine  19866881328454
aacaaagtcaacccttgaaactgctcaggtgtgtatcaagcaggggtagatgtagagagaatagacacagaatacacacagatttaaaatggtcacctctaccatgggaataggtttctccaaatgaccctttaatcaagggacggcagaggattcaatggttggatggcatcactgactcaatgaacatgaatctgagcaaactctgggagatagtgaaggacagggaagcctggcgtgctgcagtccacagggtcacaaagagccagacgcaacttagagactgaataacatgatgctaaagctgaaactccagtactttggccacctcatgcgaagagctgactcatttgaaaagactctgatgctgggagggattaggggcaggaggagaagaggacgacagaggatgagatggctggatggcatcactgactcgatggacgtgagtctgagtgaactctgggagttggtgatggacagcgaggatggggtcacaaaagaatcagacacgactgagcaactgaactgaactgaacaacaaagaggccttgacatgagagctgttgatgggttcggaaccctgggcaaggcccttattagtctgggctcctttttctcgtttagaatgaagcagtggtggagttccctgatggtccagtggttaagaatccaattgctaatgcaggggtagtgggcttgatccctggtctgggaacattccatatgtcatggagcaacttgacttctagcaagatggaagaagccaattacaagcctgtgtgctaccactgctgagcccaggcacctggagcccgagctctgcaacaagagaagccaccatgatgagaagcccatgcacaacaaagagtagctcccactcatcgcaactagaaaaaacctgcctgcaccaatgaagacccagagcagccaaaaataaacaaataatatgaagactcttgagagtcccttggactgtaaggagatcaaaccagtcaatcctgaaggaaatcaaccctacatattcattggaaggactggagctgaagctgaagctgaagctccattactttggccacctgatttgaagagtagactcagtggaaaagaccctgatgctgggaaagatcaagggcaggaggagaaggggacgacaggatgagatggttggatggcatcactgactcgatggacatgagtctgagcaaactccgggagatggtgaaggacagggaagcttggcagggtgcagtccatggggtcgcaaagggtcggaaacaactgagcgactgaacaacaacaatacatgtctttaaaaaggcaaatgcagcaggggtactagaggcggccacctcgatagcccaccaccttacagccaggccagagcttccccacggctccgggcctgagccagcttaggctccctgaccccaggagagccctagaaccaggaagcagctgagcacggggcaaggcttgccgttttgcccccatgccttgctcccccaacccccactcctgccacggccatactgcgtccaactgcttgtggcttagaacccacccccgccaaacaaaactaacaatgcccgcctcgtgtccccaacacacccactcacaggcgtgtgtgcagtaggctctgtaaatagggcccagtgctcggatgaagtgctgtgggtcaggaggcgtaagggaaaattacaaaccaaccagcctgtctaaataatttctctctggggcacctaaaatgggcatgcacggttcaccgttgtctgaagtcgtaccctctgtcttcccacacagacagacgctgagaactggaggaaaacaagatctaaattctacagaagatacttcttctaggatagactatcccaatatagcatagaggcactttttttaaactttttccccaaagcatcactgactcacagccactcgaattttagaaaaggcgccatctctattgactcatgctcatatgacccttccaccaaaaagaatatgaaactcttcacagtggttttgcaatgacaagtactcagaagtggtaagctggcatctctgtagtttttctcactaacttcgctgaccttgacctgacaagctcttcctttaaggacaaaagctagaaacaaaaattcaggtgagaaggaaggaggggtcgtggaagggggagatggaagagaggtcttttttaatttgtcaaataaagtatcataatttcactcttctcctccaaacaataacactgcacatatgagtgtgctcataaactatataccctgtctacttccaaagtcttcttacaaataaacccagaatgaggctgctcagaccaaagcagagatggcagctgacttctaacaagttggaagaagtcaattacaattatctcagcagggccttcgattagttttttctttttttccagcagcagaggccaaaagtagaacattaggatgcggtgggtttgctcttaccaccacaagcatacaaactcaataaaatctttgctagtggagcaagttccagacccctcccagtcacactgcacctctatgttccaaacagacaacatggggtgaaggagcaaggcgactgggaaaaccgatcttaaaacaagattaaaatggactgcaaggctaggctctctggggcctccaaatgtgtttcagatcctcttagcaaagggagaacttaagaaaggcctttgttgtcggagagaaagtcataagaatgaccacccatccccacccctggctcttattctgctggccatgatggaccaagacacctgcagaagatacgtgggcagacatccagaaggccagtgatagaaataaacatcaaggatttgtttttatacagatattctaaatgcacaccagcccagccccatctgcggctgctaacgttagtgggttactcattcttccttccaatcacgtcatgcgcaagtctccaggtggctgtggggtatttgcttacaacggctaccgctggtttccctgaaaactgtttatttttccaggcctcaggtcattacatcaccccgcggtttctgggcagaccaagagcactggtttagggggtggggggatccaaccgggaggtgctattgctctgtgaccccgaagtcccagctctaggagcagccaccccggcaggaacttccaggtaagggaagtgtatccaaaaggtgacggaggggcccaaagtaggcctaggagagcactgttccgaccctggcaggtcaggacaggatgctgaaaacagcttatttgtgactcggatggtgactgaggcaaacaccctcgtgttcaaggagggcaggggtgcatttccacctgtgtctccgctggtggctggtctccagggagcagggttaccagtggctgctgcatttgcagatggactaaaggaaggtctgccaggcaaacaggtgaggaaggaaagacacagtccatttgaattgaacccacagcgccaggtgctagggcctcttgaagtcagatcatgacgttaactagaaaagatggagataaaggaaagaaagggatgggaggagagaagtcaaatgacctcacaggtggccaccggtgggtatcaggccaggaaagagggaaagggctgtagtacacgccttcagggcatcgtctccatgaacagcaaagtgaaggctcacacgaccacatttcctgagagataatattttcccagaggagaaagcacagaattttgtcacacagaaagagagagaggggaaaaaaaaaaagacttttataaatcacatgctgtaggcacatgtccgcatgtaacaaaattagaagcagttaagatatggatgaaagatgagatgaagcctagttt

SEQ ID NO: 30607 - DNA, 1007 bp, Bovine  19866881354002
atttgaaccaaagtttgtctaactctcaaattgggactcttaactgttatattcctgcctctaatatgtgccttcaaaatacaagtttttctgtctttgcacagatgtctaattgtgcaagacatctggctaaaggcacaaaactggggattaaatatgtccaaggagtttttacatgttcttaatgaaaatacacctctcacatgggaaaacagtaatagcaaataatttctccttaatctacatttcatcctagttaattttcaaattttttcaagttggctgacccatagccctttacctcaatgttatctgaccatttaaatggtctatttaatggtgtgagtgagcatggattttgaccttagggggaagggtggagaagccagaaaatggaagtatggaccctaaccttgagatatttgtggtctacttggtcagagagagatgtgcccacttgagaggcattatgcagcagcacagacacaggaccacaggaggcggtgggctgctgggaggatgaaattcgggagactgaggccgattgcagtgaccttgtggacagtcagggagtgttcctggccgaggggcagggtgcctccatggctgggtgcaaggcctggtgtaatcgcaggcagttcatgatggaggaggctgtggctctgcagacctttctgtggaggctctccagcccctttctgagtgccactttgtgcagaggccaccacccctgattgcaccattagctttggacccaggtcccgtggagatcacaaggtctaaaggctgccttgtaggaaaagctccacctggctgtccagttcttccaacacaggctagtggtgaggaacacaggctttggggtcagatgtggtcaggttggaaagcagctttgctactgaggctgtagcaggaaagtgtctcagcctctctgagtttcagttccctcttctgaagtatgggaattttatcaggggtagtaaggttgcatgaagataaataagata

SEQ ID NO: 30608 - DNA, 1124 bp, Bovine  19866881390880
tgatgagtccagatttctgagctgagcattaaggagtctatttggcccttgccaaattccctgggcccagttgcccctgaattaaaggacagccaactcttgctgttaaggaagagatgtcctcttaactctttctacatgagaataaagtctgatgctttcaacttcctgaccttattctggtgctaaaatatgtaacgtagttgaaagaatatgtgatttataagcagaagatctaggtttggacactgacccttaaacgctttgtgtcctaaggtaaattaacatttcttaaattcagttaactcatccgaagacattgataatattaaaagtgcaatttttatttctatataaatattagaaatcttattatgtaaaaacataacagccacaacagtaatctttcccaaaggtctaaacaatgcggaagcctagaaaatcaacactgtgtcctatattctgatatattctccagcatagtccgatctccccaggggatcaccctcttcaaaacaactttaaacaattagtgcctaacattttcaaagtattttatatcgatttgttcctttgaaagtgagttcgtggctgtcttcattctactctctccccagtcctcaaaatagaaagtatatattcttccaacagtccacgggttaactaaaataacatttctgtctactttggctgaactgtattaactcattgttgtgacactagttaacttttgctgtggtttatgaaaaaaaaaaaaggaaacctaattaattgtcagctaagaattttctaaaacctggggtcccacaaggaggggtatataattaaaatggcctgttatgggaagctggctgggaacccacggtctggtttacaaagcccactatgttagcaaggactctggaagattctggtctgataaggttacctgcatcatgggtccagtggggatttaagtccctgtggattcaggaggaagaagagagcgattcacggaggttttcccctaggactggcccaggactggagagacagtgacaagttcatgctaacgcacctcagtgaaatggagactcctactttatcccatgaagctcttcccatctctcatcccaggactagag

SEQ ID NO: 30609 - DNA, 980 bp, Bovine  19866881406388
atttctgtagctcctacagttttctcaaacctggggactgcagcttgtctcctaagtgcttgggcttgagctgtgaagccgaagccggccttgaggctcctttgcagtgactcctctcccacccccacagtacaaaaccgcatgtcctgcaaccaaaaccccacccccaccccggctgagtggtatgactagcttgtcttggaaacacctgtgtttgccatcttggcctccgtcttccagattctcaggaagtgctaaaggtatgctttatgctaaaggtatggatctttgcatcacttgtgagcctttgtggaccaactgttgaacctctgataaaacactggcaggctggagcactgagtatcatcatgggggggaaggatttgtcctgtccttgatgagtccaagggctgcatcgttttgtgttaacgtgggactatcttacctgaagcaatagtgtgggcgtctcctcagtgcagagggttctgtaggtaaagtactaagagcctggctgcatccatagctggactcttctgagcttctctggccatatcaagttcctttggatgccccaagcacagccagttctgtgtgttttatggatggtgccaacttttttaaagcagtcacactgttaaatatttaagtccatcctctatgtacagatggcacagtggtcaagagacccaccgttgcgtcacttgtcgcttttctttgtccttttctgttgtgttcaataaacatattattattgttacagtttgagcatctactgtgcccagagcatcttactagttgttctacatgtgtttttctttgaattgcttttgttccaaacagccagatgctgcatatggtaatttatacaaaaatgctcacaacatagcacataacttgctgttcagcaaatgttagttttcttcctctttgggcttggtttgctcaactgtataatgggggagctagctgagctcctccag

SEQ ID NO: 30610 - DNA, 2124 bp, Bovine  19866881407513
cttagccctgtgtctcgaatattgccaagtgtctcctgaatgatcagtgagggaagaggacagaaagggttggagggaagaaaagaaaggttgaaatgaatgaatgaactgtgttatctcaaggaagaaaactgattaaaaaaaaaaaatccaaactcacttaaaactgtgggaatgattttttaggaaaagtcatcacttttgtaactgttacttctcagttgtccagagcttcctttttttaaaagcatgtgagcacatatatcaaatgggataaaagaaagaaagacgcacggtaaacacggaaaaacatgttcagacgccgttttgttaggacactgtcccacttttatgcccgaaacaagggcagcaacatggaaggcagatttcaatccgttgcgttttgaggagaggtgtgcttccctggacttaccctacctcccgaagctgatagacttagcaagaggcaaaaacaggcaggaggacaaagaaaactcagtcttcttaccggtggtggcatagagagctgcgcaagactgaaaggcgggaggagaagggacgacagaggatgagatggttggacagcatcaccgactggatggataagagtttgagcaagctccaggagttggtgatggacagggaagcctgacatgctgcagtctgtggggttgcaaagaacagacacgacttagcgactttctagctctgtttctaaggaaaaataatggtggaatgtattattaggcaaaactacttggggtgaaaatgacctctaattggtaatttatacctacactggtggtaagagacaggtttgtttttctaaatgcggtgactcttgtaacagaggcacgtctcttgcagtgacctacaagcattgtctatggacagtggctcctgctgtatacaaggcttctaagccaaggtagtccttgcacttacctgtcttgtctcttgcacctgacttaccacttgtctgtatgtgcagaggataatgcttagatggctgtttgaactgccatgagggctactcactcccgtggaagaggaacacttgatgatgctgggttagcaggctgttttctgtcctgtatgttttcaagtaaactggtgacaaatgtgacctactcaggtcttgtgaatccaaatatttctatatttaaagttcctttgatagtcaccagagattcgttatctagttatttattttggaagggcctcatattcccttcaagttctttgaggttaagaccatgtctttttcttctcaattaattaacgtaggttgtgctgtgcagcatgtgggatggttccaggaccagggatccaacctgggcctccacagcaaaaacatcgaatcctaactactcgggtcaccagggaactcctaagaccatgtctttttcacctagcaaagtgatctgaatcaatgtgaacctatttttttccaccattaataaaggaataattatttcctatctcaaagggttgctatgatgattaaattagatacatataaaaatgtttcccaagcagtaaatgctatgcctaagtggtgatcatactaacacataaatatatagtccctattctaaaagtatccctattaatgtagcaatgtttattaaacacttcatatattaactctgattttcattccaatcttaaaaattaataaaaacaatttgataaagaagtggtcgtaatgatatgaagctgatttcacactaagaaatgccctgccctctttcctccaacccaaagactctggtctacttttaggacagaaagaatctgtctgctcacccttgttgaaagtaaacagtttcccatcattctcacccaaacaatgggagtaagatatacaacctatcccaacatgccatatacatacacataaatgccaaaaatacccaaggcattttagtgagttgctggaaatattttaagccagagaaatacaagttgagtgagactgttaaaatatcccctttctaatcctgggacgtgttagatcaaacattaaaaaaatagaagcaagcagccctgtcaagaactattttagaaatttccaggtatataaaataagggggattacagaatatcaagatctttggtaat

SEQ ID NO: 30611 - DNA, 793 bp, Bovine  19866881775683
acctgagagaagatggaaagatcagagagggtccagcttgtcccccaagagtttgtcccactcagagattttcttgaaaccccagttcacgtggaactgtgttcattctagaagttggccagtgttcttggaaattgtggggaggtgcatgtgtgatgaatcctctctaaaggaggatatgaaaggtgcctggccatagggaagctcgtagcttaagggaacagaccatctggggcagtggtgagcagatgcagttcgatttgtttgtattagaggcaaattgattcctctgggaagtttagggatttaaataatattctataaatacatgtttttctttgctttgtcactgatgaggtttatggcttacgttacatgtttccttctaataatagaatcttacgtgaaattaaaagcagtatcttcctcttctgactcagacagaattataagtgtattgctgatttcctaccctgcttttatttcttacattcaaccaggactgtgcagacaggttggtacatctgtgggctgagaccagtttcagccagctgaattccctgtaatccagtctgcatctgagaggcacatctaacttactggagttctaggtaggaagtgtggttaaggaggcaaaaccatttaattgcagcttgtttgaaaataaaaccagcttgagttttcttctcacaaactttctctgaaacatttctttagatcttttatttttggcaaatgggttttggggtggcagcctcattacttgtgatggagaggtaaaataagccagtgg

SEQ ID NO: 30612 - DNA, 1025 bp, Bovine  19866882114681
ctggtatccggccgtgcctggagctgttggggtgaggactctcctgtgatttgatgtgtccaagtacagagaaccgtcgtgccttctagtggagatgtgtttccgctttggccacctgggatgcagttccttgaccagggatcgaacccctgccgtctgcagtggaggaacagagtcttaacccctgaatcaccagggacgtccccgtgtctcaaatttcttatgagagaccttcagcagaggaacccgttctccatgctattgctctcagcacctccttgtcaggcacttgagaagctttgtggtccctcttgttcagaattctgttactggtaacagaaagccctggccctgcaggaataattaacattatgaatgataggattaggtgagttagtacatgtaaaagttctgggtaaaccataaaagtctattccagtggaaaggattactgtaatgcttttttttttcctttagagagcatctcttttctgaattgctcgaagcacttggttaacactaactggttaatccttcatccatccctgggcagaaggctggcttttaaatagctcactttgtatagatcaaactaaagtttccaacagagccccaaatcttgaatctaaagcccaaatctgtggagtctaaagcttggatctcccaagtgtgagactgcctcactcctgggaacaaagaaggtgagagaagaaatggagggatcctttaaaaaattttttttaatttccactgacgtagtcatgtcagacaaggtggctgtagtcaggattttgagaagcctagaaatcttcctcttggaaagacccatgttcctcttggaaagccccagagtcttgttgggagtgagggcctggcatcagctagggaagcagaaggctaacccaggcacaagctaaccctggacacagagttctctttaggctgtggttggcggtacctgaggctccagattctgcaccatagtgccagccccacccccaccctggtacacccccatggaaacc

SEQ ID NO: 30613 - DNA, 792 bp, Bovine  19866880385910
ggcggaagagtggcagaatctgtaaactccagagggcagggacctcgccgggctcaatgcccagaagcagcaggtgtttccaagtatttgtggccggtgttgctgtgggttacctctatagctgctgacaaactggggtgtgcgcagcctggcctgaaagtcagattcttaaactcacgttgtcaagataaaaaaccccctacctggactgtctggtaatcggaagcgtcaattcctttcacagtcacctctcggaagactctgggctccagttcctctttggtcagatcacagtgataaatgatacctagaaggaaatggaagtcttagttcagtccataaactcactagatacaagaggggcaaggatcacaaagcacagtcactgcagaaagagactgcacaacagcctggcatgtggactgtgtaatgctgcgtaagtgttcacacttcatcatcgccatcacatgtggtcttcttttttacaacagtcacctctgtatcattttagaagattctaatgcattccaggactaagagcacaggtaaaacctaactgcagaaacataacaggtctttcccgacaccaggtcacttaggagtacaggtcaaagaagatgggacacttcatgtagggttatttcacctgagcagggatgaagacggaaaactcaaatgatgtgcccaaagtcaacagccaatcgaggtctcttgatgggaactctgggactattgcttcctcacacccacccctctgtggacacacaggtgcaatcagggaccaaagacagc

SEQ ID NO: 30614 - DNA, 2666 bp, Bovine  19866880472900
tctaatttgtctttattctttgtcttttgaacggttgataataacgtgtctcagtgcagatctctttaagttcatcttacttgaagttcgttgagcttcttggttgtttatactcatgtctttcattaaatttaggaaaactttcaccattatttcttcaaatattctttcttcctctttccctcttttccttctgggactcccatggtgggtgttgctctacttgacttccaaaataattgcatcagacagatttttccagtgggattgttatttaggtggggagatgaattcctgatacttcttactccaccatcttcccagaatctcctccagctgccattttgaacacatatgttgtaaccggctacatgcattttcagaaatctaattcaaatttgcataaaatttgtcaatcctaatgacccattgcttcctgaggagagcaaatgaggtgacctaaaagtatgcgtttttaaaatatttgtaaaataactaaggtatcttctttatttctcacattctttcaagaagcctgtgaatttagaaaatgcagaagtagctatggtataagattccttttgatttcttgtggtcatctctaccttttcagcttgtattgttgggatggggagagactaagagatttcttcaaaggataaggacatttcctacaaaagagaccggtaaggagaacttctgtgatgtaagtttttagtacatcaagaatagaaaattacatttgaactgtgtatttagagaagtcttcttagggttttcttaagaaacaaatgaatcaattcctgttacagttgtataacactgtagcacattaattatacagagaggaattatcctctgtagctactattttggttattcataaatgtttctgaaacatcatgccaacttatcagacaagtctacattcctaagctcactcatttcaggaaacaaccacagcttttttttctttttctttttacttagtttttattttgtaaggattgaaatataagccacctggaatttgctccctttcatctcaccttgtcattaaattcaagtatataatattaccctgatgtgttcagtgaaacattaaaattttacttaaaaagttaaaatctagtttgtaaaataatagtactaaatggattagtcacaaatgtattgtcatataatattagaattaagtgtttcttgctgacatccctgccttaatcagttagctagtccatagaggcttagtgagattgtatttagcctatttcccaaatgtcaattaagaaatggtttcatttcctagtaaaggttcacctgtgaaatctctctggcttgtccacctctgtgaattctgtatgtccatccctcctgctcccctccccacacctctctagaaactctcttcctttcctcatccctaagaccaaggctttccaaacattccctgtgtgtttgtacaatacatatcgaggaagaaatgattaagcagcgagatgtctgaaagtcagctaaatgcaaggattatcatctatttaactctttcttatcttgatctgagaggggcttaatggctggacctattgttctccttttcttgacattaatgaagaaatcatagcatcagctaatttccagaggtggctcaaagtgacctgctgaattgattcatttttttccctccttacaactagactggagtaatggaaagcatggtattgttagaataaatacagatgtgcttacgtgcttgcacacttaatacaagcacaccacctctgtccacactcaaaccagtgtgtttagcctctaataaaaggattgaaggggcctgcagatagtctgcttaagagatatactgctagtttctgttctactttctcggtgattaggaatcccatcagtagcagccagcagcttctctgtataaagcagactttccagttctaacctgtatcttgtaggctcaggtgttgtcagaatacatacctgtctacagtaggtcagaagtttacctatttcttatttttcatagttagaagaattattattaacttgtattttatgacttaagaataaaaactccatttttatgttaacatcatggtgtgtgtcctttattcccttcttccataatcatatatagaggaacatagagttatacaacattttctgtcattgtttttgaaaaatcaggttatattgtgtttcttgctcttctaaataaatgtgtgagggaaatccttctaaacctattacagatccaacttctatttaatttatgcctggaattcattggtatgactacgtcaatgtattcctcattctctgttaaagggcatcattaatttcttattttttcccactacaaaccacacaatcttctaggagaggtaatagtaacatagatgctgaaattgaactgcttggattagaatcctgttaacaccacttaccaactttttgatcttaggcaagttactcaaccactgtctgcctcattttcctcctctcaaaatggaaagaatgaaagcatttacctcccatatctcttgcccagcaaagctgagcacttgcctagctttagggcaaaaataattcagttcacctgttcagctctgtttggaagaaggggtcaatgtaaaccttcaggctgtgtcctt

SEQ ID NO: 30615 - DNA, 2020 bp, Bovine  19866880478569
ttggttttgcctacataatatgaatctgcccaggtatacacgtgttccctatcccgaacccccctccctccttttgaatcaaggtgattattgatatagttgtattaatgtctaccatatttgttgccattttctgtttgttattctttgtttgtatttttgtctgccttttgtggtttccttacttcttacatcgtttctgagatgttggatgtaattcttatctttattcttctttgaaatatggtgggggctttttccccctctgatttcttctaaaattttatctttatctttgattttctttagtttgaaaattatatacactaggtgtagttttttttgtttgtttagttggttagttggttgaggtttttttgcatttatcctgcttggtgttctctgaacttcctggatctgtggtttaatatctgacactcatttggggaaattctcagtcattagcatttcacatcatttcatctattaccatatcatatcattatcatttcaaacatttattacttctgctgttctcgttacatgtatgttacatgttgttgctatcccttgttgcagccgtcccacagtgcttggatcctctgttttcattttttaaagtctttgttctctttgctcttcagttttcaaggttttctattgatattttcaatatcagagatatcttcctcaagcatgcagtctgttacagtgtttgggatctctagcatttccctttggtctttctctagtatttgcatccctctgcgtacattgcccgtttgtgttgggtaccgtctattttggagaaggaaatgggaagccactctaatattcctgcctgggaaaccccatggtcagaggagcctggtgggctacagtccatggagccccaaagagtcagacacaacttagcaactaaacaacaacaaaacagctgtctactttatccatcagagctcttagcatattaatcatagttgtttaaactccctgtctgattattccaacacacctgtcatgtctggttatgatgttttctctggctcttcaaattgtatattttgccttttagtatgccttgtaatttttcttgatagttggacatgatgtactgggtaaaaggaactgctggaagcaggccttagtaatgtagtggtgaggcgtgggaggggggggaagtgttctgagttctgtgattggtctcaaccttttagtgagtctgcaggctggggctgtgaatttcacaagtgtttctcagttttgtttcctccccacctttggtgggacaggatggctagagtggtctggagctgggtatttcccttccccggggtcagttgggctctgcgaatacccccagcagcctaagctctggctcactagtctaccctgagggcagattttgttaagaagaacaagagtgggcatatttcataatggttccctttcccctccactgccaaaagtacaaggggattttttaaatttcctctgatactatgaggacctggtcaactcctggaggttagtcttagtacagtggagactggtctgctggagtttttaattctcagacttgtctacactgggctttcaacagttcattagttatagctcagatttcctaccctagcactggacatgatagtttccagccatgagtctctgccctgggaagctgtggctccgtgtcttcacctctgtctctccaatcttgggggcagtgactggccttatgtcttttacaaatctccctcttttacaaatccaagaagagttgctgacttttcattttgtttagctttttagttgttaggacagagtggcaacttccaaatttctgacatgtgggtccctataattaatagcttccatttagtaattttaagaagtatatcatctaattttaaagctattattcatatgtagtaaaatattttgtatatgaactgaaatttgtactcaccttgcagttggtgctgttatacggtttaaattttaaaaacaaaatcttcag

SEQ ID NO: 30616 - DNA, 747 bp, Bovine  19866880541192
caatgattgtactcagcccaaactagttatcatgccatcattgttaagtcatcaggagattagcaattgctaatatacacacagtttgggatctgtaaaagagacagacatctgttttccttggcagcagtctgtttccaggcccttacttgataccatgtgcgtgcctaactcctgttcacaacaatagcttttatccttagggtttggtaatatacttaattgatgcctttatcttttcatgagacatgccagctcacatcaaaaaaaaaaaaaagagagagagagagaggaaagaaataaaacgaaaacacactacaaaagcttggcttgatatctggtggaaatagtgaacctcaaagctggactgagagaaaaataaagattgctttcatccatgttgctgaaaaatttgcctgtgtcctctaatttgtcctgcccttattgagaattcaatgagtattcaggtctgaatattaaaatctggtttttgcctttgagaatcacaagtgtcagtcagagtagaacagaggaggcataaggtatgtgttttctggttggaagccagtgatgttaaacaatatggagggaccgtttctccttgtgctgggagggtgactaggaggcagctggaaggatgtattttagaaactctggaataaatgatcaggttgtttggttggttcatcgtaagtggttctcctgggatacctgtgtattgggaaaaagaagtctcctatcctactc

SEQ ID NO: 30617 - DNA, 1233 bp, Bovine  19866880556832
cctgagagtttctgccaattgtctttttctgcatgttttgagttgagttagctccttttaggacttgtaggccttcatgtattcgcagaagccttgctttcaatcgagttaacggtctctccagtttgcaatgcagaaacattgaaataactgttttttaaatgtatgacaagaaatgaaagcaataaatactagaaaagattactaatcttattaggaaaaagaaaatatagaagcgtaattccatcaaaagcggtatcaaactgattagactcagttactcaaaactttgtcttctgaaaagctctcaagttgaatttgtagcaggttttacagctgcaggaaacgagctaaaattttccactttcttatttttcctatttttctaatccaaaaagtgaaatgaaacattccttaaggagaagactcaactgacattatgatctctcattcgaaatttactgcctgcattgaacaattgcttctgtattggcacaagtcattcagtcactcaccatcgggggatgaatcactccccatgaaaaatcattccagaatttgggtaacagagaagtttgcctccatccaaaatttcgacaaatgttggtaaaatttaggaaaatcattatcatgaaaggctgccatggtttcaaagagcatctcttagtagttactgcactctctgacctctaaaaaaagtgcaagcaacttcatgcacacacacagcccctgccagtttcccttaaaaatttcattctcttcatcaccactgagtggaattaaaaacagttggtcaagctccactaatcgacagctgcttgcaattagatgaagcatttaaagccattctcttaactaccttcccaactgcctaagcattcagtatgagcaatacaccgtgataatttgccagaatgtttaacttatctccatctctagtggtttctataccttcctattttctccagtcttcccacacactgtctgactcttccagttcctcttgttaaatcaggggtgtacagagattagttgaaaccaggtcgagctgctttgtgctaagatggaaaattctacccaggcaactattagggggcagagtaaatcttgatgttttttgcaaagagaaaagactccttttttcctctttttttttttttattaaacaatgaactggaaagttcactgtaatttttctcatcaaggatgagaagaaaaacaaaagttcctagg

SEQ ID NO: 30618 - DNA, 4082 bp, Bovine  19866880642487
gagacatggcaataatctctcccttctcactatttctgtatctttcacacagtggtcccaatgaaatgaccacatgcaagttcttgtccccagtgaacaaaacgggtctgaggcttagatgtgtcttacccaaggtgacagcataatgaagactgagtgggacaggtctggctgtaaacctggtgccttttttaccagactgtgatgcagtggattgtgatgtctttggtatttctagcaatagaatcctttctttctgacaatagaaacttctcattttgggtgggggggaccctactctctgactttaggaatggacgtgtaatctaggatgtagatctcctccatttggttaaaagatagctgatctgagctggcccttcttccatttttacctgtccacaacatctttcacttttggtgaaaggtgctctcttcttgctgaggttgtgaagctggtagactgggggtcttaaacatccactggccatcatcacccctggaagaaggactcaaaagagatggagctgaaaattaaacctctgaggacagccatgtcagaaactagccctactcttggactgttcagttatatctgctaataaattatttttattgcttaagctcatttgagtgttctgtgttgctttgggggttttggtttggtttggtttggttactttcagctaagggtccaaactcaccaatgcccaatagaaacaacaagccacaatatgagtggctcaaagaagatctcctgaacacactatggggttcttcgccctcactttccactgccaggcccaccctcagtgatggtccactcatgctgtgagtagcctacatcctgtgatatgtcagggagctctaatctgttcctttctctagccagaatggtttcttccttccgctgtcttgaattctcaaaaagcacactatggataaagtcagtagttgggataagggtttctgggagcccttgggctcagagtccagggagtggaagggaagtgtagggtggggctatggtgggctacatttggcgatattgaagcaatcagagggagaggggtgggttttgttcatctcacttatttgcggtctttctaactgctttcaggacaccaagtcaataaagtagaatccttcacaagacctccatatggccagaaaggctcacgaggatttgcctactggagcccttaccactctcctatcatagaggctagctcagcagagatgaaccctgtgccccttcatgtctctcacttaatctaaacagggacagtgatggaaccaaaatatgtttgcttttcctatttctaccaaatatacagtgtttccaaagaaatgccttatgtaaacacaataacacaacctaataagcacataatgaagttgggaactgcgccctgtttcactactacaacttacaaattgcttctttggcaaagctcaattctaagaaaactatagctattttgaggcataaattccagcccccaaaccaaaacaaataactttgatttctttaaattaagacatataagaggtttgagccaaagctgtctcattgcctctcaagaatgcacacatcccaatgatgggcttgctgctggtagcagagcatgtcaacttgcatgatctagccccaggagcattgctgacatgttgttgtttgttttactcaggattagcagaaaatttttgtgggtgttttacatcactagagtaggaagcactgaaaagttgatatttttggaaaagaattctaaattattagaagagggggatggggagcagggtggccaggaaagaaaagaatgagtaagaatcaagaaagccccatcaggaaagtcccacatggaaaactgaactgatggtaaatgggatttattgcatgagcagtgttcagttctgctggacaaggagatgaaggttctcattgtctcagataggcagaaaaaagtatggaactgaattttggcaatcaacagtgagagttattacaaagcaggagtttccctttcagtaaactgcagattgtatatcattggatggaaagagctagcagagtttagtctggaaacatttggtatgaagtttgagatttttcagatagtccaaagaagtagaacagtcacggaaataatatctagcccacatttttttggcaggggagggtggggggtggagttgggaggacaggtacaagaaaaaaactaacactgagatataagaatgggcaaaagatgtgaatttactgcttgcaaaagaagaaaatataaatgccgagactcaaaacaagcagaaacaaaatcaaaaattcctgactttgttcataaccaaagagatgcagtataaaataataaatccctatttttatcctttaaatgatcaaaatatttttatgtgataatctcatctttgacagggtctcaagaaacagggatgtttacatactgattcaattaatgctaccattatggaaagtgattagccagtatatttttttaaggtagccttttgtccttgctaagctcacttctaggaatttatcctaaggaaaattttaagcagcacacaaatatttacattcatggcagcactgtttaaatattgaaatatgggaaataacccaatgtctaacaatagaaggggaaaatgaatgaaagtgtactcatataacggaatataacaaaaatgtttaaaaccatttctacggaagtgtttagggtcatgggaaaaatgctaaaaagaaaaatccaattccaaagttgtgtttaaaatatatatcttttatataatatatgcatatattaaatacatattatgtagtcaatattaaatagtatacagaattacatagtatagattatatagtaaatataatatatattatctatagcaaatatttatacatagaaaaatatcagagaaagtaaaatttgttcatggtagtaattactgggtgaagaaactataaattacatatatatttaattatttgtaatttttaaatatttgagacgtgggaaacctaaaagaaaagcctgccttagatgtcctaagttatatatctatggtagtcagatagccagacagccaaacacatcccggcaaagcatttactttttgatatttcattgtatttatttttaaataagtaaagtagaatggtgggatgaagttgtattagactcacaaatatgttatatgtcatataaaatatgacccgttatataaatacgtgtatatgatatacatcggagaaggcaatggcaccccactccagtactcttgcttggaaaatcccatggatggaggagcctgttaggctacagttcacggggtcgctaagagtcggacacgactgagcgacttcactttcacttttcactttcatgccttggagaaggaaatgacaacccactccaagtgttcttgcctggagaatcccagggacgggggaacctggtgggctgctgtctatggggtcgcacagagtcggacacgactgaagtgacagtgatatgatatacataaaagctcttaaagaacatgtattagaagcaggtaagttacaaatatataaaaggaaacctagaacttcggagtattagacaaaactgaaagttcatattaccagaaacagggagtatatttgtacaaatactatatttaaagttgagcttcttataagtaagccaaaatgaggaaacatagcaaattacacagttgtaattatctaatgaaaggcaacacacaggtatatctggaaagacagatatcttttttctaaggatttccagtaaaaatttgctttgtgtatcttttttttatgtttattttattttatttttttcttatataatattatacatgttttaatgccattctcccaaatcatcccccccctccctctctcacagagtccaaaagactgttctatacatctgtgtctcttttgctgtcttgcatacagggtcgtcgttaccatctttccgtgaacttcctgatgttcaagctggttttagaaaagacagaggaaccagagatcaaattgccaacatccactggat

SEQ ID NO: 30619 - DNA, 1835 bp, Bovine  19866880642899
ttgttcttttgagatttacccatactgatatatgctgcttttgttgattgcattatcaatgctgtagtattccatcaacaaacataagatcattttttttttttttaataattactactggtttcttttttttacctttatggaagtataattgatttacagtgctatgttaatttctgctgtacaacaaaatgattcagttatctttttcatattcttttccattatggtttatcacaggatattgaatatagttctctatgctatatagtaggaacataccatcattgatttagttttgtagtgtttgctatttaaaataatgctgctctgaaattctccaacatgtctccttgtgcaggttgtctctctagaatactacccagaaatgcagttatattgtcaccaacacttgttaggatcagactttcaaatatttccccacttcagatggagataaaatggtaattcactattgtcttaaattatattttcctaactactagtgagactgtactttagctataaatctggctttcctctgctctaaattacttgctcttatcctatacttatcttttcatatttggagtggtttgttttcttactaattttttttcattctggattctaattccttattggttatgtttgctataaaaatattttcctgttctgtggcttagccaggcattgtttatggtatctttaaaaatgcataaattttatttttaatattaagaaatatatttccttgaaagtttgtgttttctccctcttttaaaaatcttccttagcttgaagtcataggtaaatttacctatattttcttgtgagtttcctaaagttttgctttgtttttaatctacctaaaatgtatttttctgtttggtatgaagtctaaatctgttttccatccccaatagatatcttattgtccaagcacatttattatataactcatcctttccttatattttgaattgccaactccatcctatgtcagattcatgcatacatctttgtgtctctttcctttccattggtctgcttgtctgtctctccttgtaccagggcagtggaatcaattactttagtcttgacacctgataaattcctcagctgtgttcttcaaagttgtcttggttattcttggccttttactcttccattagataagggctagtgtgtgtgtatatatatatatatatatatatatgtatatatatgtatatatgtattttttttttcaaagtggaaaaacagattggggagtgtgctagtatctgtaaacaacgttttgttgaatttcaggttggaaatattcatttaatattttctgtctttaatatttggatcttcatcgaaatgcattatgtagttgacgctgcactacctccagatctgctgctgactttggctactctcctgaattttggtacatgaatggagttggaaaagtttagtttttatttttttttaaattagagtttgaccaagctgaaaagtgtttgattgcaaaaaaatgaggggttttttgttttcttaagtagcatttgaattgagatgtagaggtaaggccaggtaatcgctttcttttctccttttgtcattaagttgggatagaacaatggatgttatttgagagctgcccttctaacctctgctgctctgcaaatgccttcgggtcatcacaagtttcttagtgggtgttttaatttttttaatttaatgtttaacttcagagagaattgcttagaaacacttaacccttgttgagctgcagggaaatggttagataatagtatctggtggtgacaataaaggatttcata

SEQ ID NO: 30620 - DNA, 1684 bp, Bovine  19866880666222
tagttgatgggcagtggggtggtagcgaggtgaggaagacttggattaagtccagaaatgccatcctagccttgatccaggatgtatgtgtgtggacccagccagttcatgggtgaggggctctggggagccctgggagcctgaggagcattttacccattggtggcattatttttatttcagtagccaacactccacagggaaccatagggaatacttctgcatagtttttctgccctatgtgctacagtatttttttccccttcacattttaactcaggaagtagatttgccacttgtgcaatttaaaacaaatttcaagaaagctgtttgacaggcctctgggcatttttagtatgaagcccaggaatcacagtagcctggccatgtggtcccaagggtcatgtgttgggaatggatctacttgtttgtccactgacactccagacactaacctttctccagtcacaaacaaaaagcaaaatttgagtttcacttggtagacatgaataggagagatacttatagaaaagtgttagtgccctcaatgaaaaaaaaaaacctaaaagcccttcacaaatggttttcatgtttgccacttcatccattagcaagttcatggtaccatgcatgttaagaaaataatgttgcttatatttagacactcaaaactgcccagtgtttttttttttttttaatgtttcttctttatagtcacttaaacatctgtgccaagaatttgaaatgctgccagcattttactgtggagttaagaaaaccagaccctattgtcataaacgtgccaaatggtgctggatgcactactaaattctacagaaccattgtggtaataatttttcaaaacaaagcccaatcagatccagagtataacagttactaccattaatcattgttctttacttggcaaaacatacctttttttcttgagagttatatgtcttgagcacacttgtggacttagctgtttaatgaaacattacatgagaagatattcactaggagctcaagtctcccctgccgtcatctaccctgctgaacagagacttcaggcagctgtttgtatggcaaggcaaaaccaaagaagccacctttttaaatctttccttaaaagccctgttcagaaatgacacattcaattctctactgtaagaaaatacatagaatatagagttccatgggagcttataaggacatttctaaattttttcccttgggggacagaaaaccaatttagaacctttaagtttgtgtaagtgaacttattcctttatgtgtgtgtgtgtgtgtgtgtgtgtgtgtgtgtgaagccttctttaaaagaagataatgggaaaaggccagagcagagaaatgaaagtaattagaggcacatgctggaggatttctaatgtttctgggataatctggtccacaaaggaaggctgcaccacagagggtggcagctaaaaacgttaatgaatagaagcgaagttacatagaatgggatcattgaaccaactgaaaagacacttctatttcctttatgagaccatagagttctttgtccataacatgtctgtttcattatcaatgtctggccagaagaaatcagaccattctgagctcttctgggtatccagcagctgcaagaaatggtttcagtacacataagcctcccatcaca

SEQ ID NO: 30621 - DNA, 1664 bp, Bovine  19866880670612
aaataggaaactaggagcgggctaaaatggtctaaccttgactaattctgcagtattcgaaactcatccctaaaatggaatagttttacccactctgttcttctagcataaaaagtattaataaaaaatattggaccctcagtcaccagagaactagactattatacttggctgaatatttatttgcttatcatctgtgagtttaacagatagtcttccccaaaagtcaggctcgttgttaattatgtaggcacgattaatgtctgctctccatagcacaattttgttatcattggtggtattaccatttgacaattcaactcattgaaacgaaaagatcgattcatattttactgttgaactcactgtttcatatgttttaccccctttagattactggagtggtgagtaaagaatacataccaaagggaacacgttttggacctctaataggtgaaatctacaccagtgatgcagttcccaagaacgccaacaggaaatatttttggcgggtaagtagggaaatttttcccaactcattaagtatcagggggaaaaaatgaaactaaaattgctgggtcacttccttcttcaactgtcctggagctccccacaatattcagggtcctcacggacacagggaattctaagcaattgtgacgaaacgggttaaaaattcagcctgggaaacacagcttgaaggtagttggggtgaagaggtggtctgtgtgaatcttaactttttgcgattcattggagttttgtgatgaaaggaaacagtttgctgcttgcttcaagggtaagttcatttgcatttctgtgcaaggaagtagtaatgagtcaccaagtcttagatttcaccccttcttgatttcttgctgacttaactttaattgagtggacgagtaatcacaaatgaattaccttgaaaataaatgccatttaggaaggatggtactggaggaatggagatggactacaagactcatcctgtttaaatgcatctgtaccatgaaactgctggatttgacagcacataagttattccatagtgtaaggaagatgcttacaacattcaagaggataaacttccctttaacaccccatctagtcaatccagtttcctttggaatatcacagttagaaaaaaatctcacaggtgaactaattagatggaatctttaggtaaaagaccctggatgagaatgaatagaaaaaagcagactgttttacatttgcccatccatctctctggatactccgtttcctcaattagaaaataaatttaaaagcaattatatgtatgtatgtatatagacttgcataaaatgtacatgattactgggaaacctttattgaaattctttcaagaaacagttgcatggtagcaacaaaaactgtattgtacttacttgtttagtcgctcagttgtgtcctattcttttgtgaccccatggactatagcccaccaggctcctctgcccatgggatttcccagggaagaatactggagtgggttgccattcccttctccaggggatcttcccaacccagggattgaacctgtatctcctgcattggtaggcggattcttgaccactgagccaccagggaagcccatattatacttattctggtcggatttacctagaatgcttatattt

SEQ ID NO: 30622 - DNA, 1887 bp, Bovine  19866880770183
aaaaaaaaaaaaaaaaagccatcttagattgtccttaatagttaaaaaaggtatgtctctttctccctggttgttatgcgggtccccacctttgcaccaaaattttaggatctcttataataccaagggggtgcccaagctcaccaatgtaattgtgaggtcatcgagtgctaattaagcaaagagtcagagagggtttgatttttttttttttttttttgccattaggaaaagaaggatcttttacatgttttggctcacaattttaagtggttataaatatattctatatacatggtatagtggtataaatagatttataaatatacatcattgtccgctacaccttgaatgccaacgtgttatctttgggcttagcagaggacgaggcagaatgggatgcattccatctctctggtgcacacgtgctctctcctcttgagtagcaaatcattaaagatgccatcacttcctgcactactggacacactcaatgaggtaattgttgttgaacaactttgcaatgccctttcttcttcaattaaattaaccataaaatgtaaaaacacaaatactgaggaaaagtcttgagttgcacagaaaaaacaaatacaactgatgtgttggggacaggaatgttcattacccgctttgaccctaagacaacgagaatacccgttttctggcttttggtttttaaagtgtggcctgagcctatctaactcaaatccttcctggtggagcaccatgcttgtgcaattctgacgtaataacaaaagaccaacaacaaaaacacctggactcatgcccccagacctcacccatacaaaaccacctgtgctttggaaacattttgcagtggttttaaacatggcatttgtcttcttcacattttcagataatacattgggatgctaaagtctcatggccactgcaaatggtcacatgactttggggatgggacaaccctgtttttttgaagagggagacagactggcaacgccttatcacctttctggtaaatctgtgattgggggcaggaatgctgaactctctacatacaaggtttttatttcttccacctattactggttaattctgcaaacatacccccaaattatgttcaaatgatacaaggctgttcaaataatataatcctatgaatgaacacatcaactgcctaactttggcaatactcaaacctcactttcaaaccattattatagagggaggttgacttgaagtaatgtatctgtttattaaatcttaagatacttaaaacagatgtgcagaaattatctacaaagaatggccaccagacaaaaatataacacttaactcaaattacaaggaattcttccagtcattgtaaactttttttaattattgctttttgaatgataaactgtataataaattatgaaggattatcattgaaaaaataattatggctaggcaatagtcttagcaatggggaggctatgcaaacatattcacacaaatattcaaaatacaacaggttcaaatatatagatggggtgtaaataagtatatataataggtatatatattgtctttgcctcatttatgccctgagatttcagtaactttggggttccttctttaattccagagaggtgagggaaaccatctgccgtcagggagagctttgcagaattggaattatgtacaagcgcttgcgacaggcaccctgactcgccaagtcgtaagttaagaaacaagacaaaacaccttttgttttctgaaaatcttaaggatccataggttcgactgtttcttctttgacctttacaggtcccagaggtagtgggttgctgtgaggcaacttcaggagggacggactctgttgactcatagaggttatac

SEQ ID NO: 30623 - DNA, 1492 bp, Bovine  19866880851478
tgggtagccttgttatctctccttgaagtgtgatttagtaccacatgacactaagatatgataacctgaacactctattaacttgggaaagactactgagcaaaaatgctagttggaatagctctgttgatgatagctaggaggtgttatctgggaagaagatggaaaagaactcagagccgagagttgttttggatggttaaagggaattcaaatatagatgaagatctgcccacactttaagaaaatcctcaaagacacgacaactgtcaaggttgcacttcttagcagttatcacctactttttgttttctgcttcatcagctctataaccctgcaagtttcattattagggtttcctgctacacttttaattttcagttacagattgactaggggctgccagtatgtctggcctactgatgtttgctggtagattatccttgtaaaagttactattgtcaggtttcattttgtaaaggtagtgaagactggcaattcacataaattcctcagcctcattgctcgtgatggtctaacaactaagaacaaaacagaaagataggctcattttaaacaaatcttcttgcttcaaataatatactaaacagacatacagcacccccaccccccggcaaaaaaggaaaacaaaaaaagaaaaaacaccttacagttgaatttactgagctgaagaggtcaaactttgccagaatcagggactggtaactgacatccagttatccagttcagggattcattttcccttttttcaatagtgaatgaaattccctttttaaaggcttataatttattgtctaaaactggaactgggacaaattcaaagcaggatgaaaggaagtctccaaaacaatagcattgaaattctcccagggctgtttcaattgtgagaacttagagcacctgaatggctgcatagtggtgaggcagaggactcaagagagtggcaatgtgcccaaatgctgtatttttgtggtggcctcctttgctggatgaatattgcaagtttttattttttcctattttgctgaaaacattctacaattttccaggaattaaaggacactcaggctaaggcaaactctgatcataagtgaaaataagagttcatattccagtcctcaacacaacatttcagggatcgtcagtgagcatttattgtgtaccagcttctaggcaacgtgcattacatgcatgagttcatttgatcttcacaacaatattatgagcataggtactcttattcttactgtacagataaggaaacagagaggttaagcaatatgcctcaagccacatggctagtgagtggcctagtcctgtcatttccatactcttaactacttaacagaattgcctcccaagaaaagtaaattgcctaggttaaatgatgttagggattgatggtgaatagaagttgatatttggtccaaagaagcacagaatgtttagtttttgatgaatcctgataaca

SEQ ID NO: 30624 - DNA, 2383 bp, Bovine  19866880853684
accattgtggtgagcctcattatagggcactgtatgcattctgtgagaggactgtgggaacaatgccggttagaaaaacagaagctgctttctctgaaccattcagttagaaggtccttcaccgtcagacattttatgaaaatgtttgtgtgtttgccctgaccacaaggagatcagggcagtggaactgaaggtaggttttatgttctgcaaacaagtcatagctcctgtcttttcaccttaaaatacctgactacctctaaactggggctccccaggtggctcagtgtaaagaatccacctgccagtgctggagatgcaggtttgatcccctggagtaggaaatggcaacccaccccagtattcgtgcctaggaaatcccatgggcagaggaacctggcaggctgcagtccatggggtcacgaagagtcggacacgcctgagcacacatgcacttacctctaaactgtaagcactcatcaaagtgtcatgttccactcgtgactccactgctgtctgtctgtcctcaggtttagaaccttccactttctatttcacttcttgctgcagtttgagactgggaataggtctcttgctccaaggaataggtggccaagcctttgagagctggtatgtttctgcagaaatcatgtgtgtagcacttagcaagaaatgtccccaaaattataatagatctttaaatagaacgattttgcgatcactgaggtgctctatggaaggttttaaaatctccagtgtcataaaaatgtccacccatcctttggaaagcagagtaaagaaatgtggaataaacacttcccctaatatttcctgcccgaaggtgattcagattcctccccactcctccaaagttaaaagtctggagaagagataggattacatgcttcgaatgtcaggttagtatttttaacccgagcccagcacagaaatgtgcagcaccttccgaagtcctttgtatacttgctttacaagctagtccaggcagagaggttgccttctgcccagttctttgagtgtgtcttgcttcctgtccgtgttgagcgtggaatttctgagcagctctgctgctcatcacatgtatttgccacacttagcacaggcacacaagtggcctctgtcaagtctgatgaaaagggaagctcagcacccttttatgaacattctcctttcaacctgtcaggctctaaaattagataggagttgctatcaccagacgttcttctctgtggagggcttgccctttacagttttccttcatcttctgtggatgagcacattccactaccagtgataatgagcgtcctggtgtttggctcacagagcaccgagtctgcaccaggttcactgtgggggtgaagattgtgtggggaacttaaatggctgcacatgttcgaatatgttagtaaaactgatctactgtattatctccagaaaagtaatcatttcagcacagagagctgatcttttcattctcttgaagaacagtaatgttcccttcatttgttatgttcacttgctcctccttttcctttaaaggaagatgtttctatttatctattatatgaaacaagatccatgtgtgaaggcacctgtggtccagggtaaaaccaccttctatctggcaatgcctctgcccagtcactctgacagtagagatgggtcatttctgacatttcctctcttttcctcaagagttttttaatttaaaagattcagctcaagatctgtgagctctctgttaaacaatcattccctagaataatgggttttaatatgcaaaattagaagctgctttaaattgattacttagcagtagggttttcttatggttctctcaagcattgtttcctttctgaagtgaatttgccttttactattgaaactgagttttttagtagacatagtgagatttatattattgtgtaaataatctgtcctcaaggttgtacactgatgattgttttgagaaggatcatctttccaagcagacttattctgcttaaaacagacataataaacaataacccctataactggaataaggcttttgacatgcttcagtgagtctctttttcaagagggtaacaaaaacaaaaaagcaatagaaagcacaatacctttgccagaatatttgtcccttggattccctgctgctgctgctaagtcactttagtcatgtccgactctatgctaccccagagatggcagcccaccaggctcccctgtccctgggattctccaggcaagaacactggagtgggttgccatttccttctccaatgcatgaaagtgaaaagtgaaagtgaagtcgctcagttgtgtccgactcctagtgacccatggactgcagcctaccaggctc

SEQ ID NO: 30625 - DNA, 1500 bp, Bovine  19866880875555
tagaattatcgtaaaatgaatcactgaaaaggggcagtttgaattttttccagacagctgtgttcagaaagcctctgtcctcggaagaaagttctcaggtttcaatattgctttctacccaagttccagaatcttctttcctttatcttttttgcctgagctatcattctgcaagtcctcccatgggatctgtgtgctggtattagacctggcccaaaagagttttaggccgctgccttacattatgtttagatttaattcattaacattattcaaacaaatgtaatttgttccctcaagtataattatgtttattaatgtgacagagaaacataacattttaaaaatacatatatttagtataccaagcttttaagagcttagatttggttaaaaatgaacactaagtcttagttatttattaatctttttatgttgatatgtgtataggtaaatcaaaacaacattttttgaactattacaccctggaatatacattgatttgtatattttgagttaatacgctaatatgaagtgttgtaaagaagatttcttttgtcatatagatgctgtatttgatgagtatgttttgaaacctacacagattctttccctgaatgttctgaatcctacagcaggcactcaatctgttggcccttgttactgttgttttcttatccccgaagactatttcctaccaggcccttcctacacacactggccactcaatgaatactgtggacaggctgacaaaacctgaactgtatgtccacaatggtttactttttattctgtgtgtccttactggcaatatttgggggaattgtcaagatgacttttccctcttaaggaaaaatagctgttacttgtaaaccctgaaaaatgcaaaaaaaaaaaggcagatggtaggttaggacagggaaggagtgagggatgatgttgggcaaagaggattcggtgtctctccataaggatgagtattgactggagtggaggagtggtcccggcactccacagctgtcccctgaaccatgaagtagaacgtttgtttgcaggaagtggctagtggaatttcccaattgcagacagataatctattaggtggggcaagtggggagttactaattgcctctgggttatgacagagagtgtccataatcaggccattattctgggggaaggccatcatggaggattcatgttcctgaataaggctgaagaagtccaaaaagaaactttaatccttaaaaacccacagcctgtagggctggaataaatagagaaagaaatgattcaaagagtacaattcaaaaacaggtcaacagcatccgtaataatggaaagaacagaaggttccctctagcatgtcttaccaccatctatttttttatgtctcttcatgcttggtagtgaaggagagcaaatcttaaactcttgtgttaaaaaacaaaattcaattgagtaaattcagagatctaattggctttattaaatgattca

SEQ ID NO: 30626 - DNA, 1360 bp, Bovine  19866880894486
ctaaaattacaattatactacacatttgcagagggcttactgtgtgtccagcactggcttaaatgttcatcaaactctaatcaaaattacaagttcagggaaacttgcaaaatgactaaagtttatctggaaaataaacacacaagaatagcaaagaaaattctgggaaagaaggtaaagagtgcagattaaccaactgtaattgtggtttgtaacaatagagagctccatggaaagaattgagaaataaacacaagtttatacagagtgactttgataaagctgggatttccaatcaatggaaaaatagatttacaataacaagtttgggacacctagatagccatttagaaaaagataaggctagatttctatataattccttaaccacaaattacatggatcaaaggtgtgaatggaaaaaaaattaagctataaaagaactaaacataacctttaaaaatataggatagtatccatcattgacttggcaaaaacacatactcacgcacacgcacaagcaatgccagaagtcaaatgttaactggaggaaacattgtcaatttctaagacaagagattgagctttcatagatcaattaaaaatatgacaagcccattataataagaaggacaagaggcagacagttcagggtaaaagaaatacacacagttaataaaccatgtgaaaagatgccaaagttttgccacaaatttaaaacagaaaaatttaaacaacaaactgataggactttttacttatcacatgaattcagttaacataatttttgagcacttcctagatgccaggtggtttcagtatttttaagtgtatttcacatactttttgtgagcatattttccataatctaccaatttttcataatacgatcagtagtttgaatggaaacatgcctctgaagagcttgataatacttgaaaggtgattttcttacataagtcagacttttagcaatcttgtttatatgcttaatttgattaacacactctttttcgcagaatgcacagtcttcaaaagcgatctatttttttaaattttattttatttttaaattttattttatttttaaactttgcaatattgtattagttttgccaaatatcgaaatgaatccgccacaggtatacctgtgttccccatcctgaaccctcctccctcctccttcccccataccctcctctgggtcatcccagtgcaccagccccaagcatccagtatcgtgcatcgaacctggactggcgactcgtttcatacatgatattatacatgtttcaatgccattatacagagtgaagtaagccagaaagaaaaacaccaatacagtatattaacgcatata

SEQ ID NO: 30627 - DNA, 1733 bp, Bovine  19866880901392
ctggtcccctttgtctctcccctgttcagctgatgctgggtcctctgagtcctttgctagcaggctcactcccaccctgagtgaaggcagaagggaggatgggaggtcagcagcctcaggtcaccatctgcaagagtttataattgagttctattccccagatctgaaactcagtgactcagttgttactcctgggctcctaagcctcctttgtagcctagaaggtataagttctggggttctgggatactggggttttaggtatgaggtggcttgttgccagcaatttcatcagaggttcatagagtctaagaaggtttagttaaaagtcccaagtgttgactaagttaccctccttagtactttctaggtgttcttcaagattgagaccattaaaaaaaaaaaaaaaaaaagattgaggccactttattcccttcctccagagcaggagtcctataactgatgggccatgtgactcctgacttggactggagttcagagttcctttctgccaggttttatcccctgtgtgagatctctgatgccaagggttccctgaatctcatgtgaacaaccatgtggattactctgagcttgggaccattggctgctccatccagaatcactcaccacagcctggtcagtttgccctcgactttgtgcagtactggtaattttcttggaaagacagagttctagaaggaaatataatctgtctcagagcagtgatcatatgtgtaagtagatgctcaataaatgtgttgaaagaataaaaacaagtaaagttaaagccagaactggggccagtgttcaagtagcacagatcctcacatgcattggtcacccaataaccatttgctgatttgaagctgtttgaattggactacagtgtatctggggagataagatttatagatatgaaacaattaaagagcaataaaagacaacacactttggtgtctctatatcatttcaacgggcttgtggataaaggagattgcattagggaccaaccagggtgagcaaaaaacttacagaaaaggaaggacttgagatggactttgcccattaattcacttcatgcttttccaaatgagtttttcaaataattctacactagatatatcactctcatcttaccaaaaaaaaaaaaaagttcaaaagggctgagagaatgaaatgagaattttgttcaaatttgacaaatactgactgcctgctttgtgccatgttttactgccaagaataaaggatgtgaaatgaatgagaaagacacaatgtccccttcggagcaccacaatggtgtgctggggttataaataagaaattaaaaactatgcagtaaattctaaaacagaaatatataacaagtgctataagaacccagtggacaggtgttaaaaaccacctttttgtccatgacaggagtgggaagatatctgttaggaaaaattgtgagagctgagtcttgaaagttgaccttttgttccctgtactgggaagagaaagtatcagagaggaaattgcaggaggaagatttgtatccggaaaaaacacagtacacatccatgctggacaggaaggttaaggacaggctgtgaagtgccttgctaaggaggataagatgtccaaaaaagatgtccttttcattataggggactgaaatgaaaaagtaggaagtcaagagatacctggagtaacaggcaaatctggccttggagtacagaatgaag

SEQ ID NO: 30628 - DNA, 1128 bp, Bovine  19866880902490
tgaagatggaggccacagagaaaggaccccagacctttcctcagcttctgttgggacatgtgagctgggtgtgaccccaaagactcagaacagctttcgctctgtgaaagcgcgaaacagggagggttctctgaaaggaatggtatgggctgcggggaagaggtggggtagcacatatgactgagacccgggaggtttctagtgctgacatgactcggctcctaatccacagaactcagctgaaacaccctaagccaatgaataacagggtcccagtcataagcagaaaacgctcttccctttttcttccttccacctcacccatgcagccttgtgcaattagtcctcatacaaaggtttgcagaattatccaagtggaggccaagtctgctgtttcttggccatatctaccttcccagaggatcgaccagcatagctgaagcgcgctggaccatggcgcaaagcggggagaggggcgccacggctgctgggaaccgggccttctcgaactcagtttcagagaccaagaaacggtcttcttacttcaaacatgcaaacactctccctgtgaggcagctgccctttgaagctgtggaccaggggggaaataaaagctcctgtctgagaaaggataggtttctttcttacactctctgctgaccattctatttcctgcgggttttctgcatggaccctctgccggcagcatagggggagcctgcagcagccggcgcagcagggcccgagtgaaagtgactaacaccccagcctccacagctacctcggcctctgcagcacctttctccagcctgacctccccatgctgcctttctgctgctgctgtgggagccaaacacgaaagccgggctgaacaggctggttgaagaaaggagtgagtcaggtctcaagtctcagaaaggcaatgtgggctgaatcccggtgccaggggttaaagcccgcccatgcatctcacccataacacaggcaggaaagcgatacggctaaactcaagtgggacatttgtattcagagatcggtttatgttcacccacattgcctggtatggtgctgagaatgcatttaatatttatgggcccttttgacatttaaataaggcctggccaaggg

SEQ ID NO: 30629 - DNA, 708 bp, Bovine  19866880926533
aattttgaagacttactgcaacaaaatgccaactgaatacaagtgttctggtctgctcccaatcagctcctgccgttgatcagttagttcctatggaaagattaggaatttcagactcacaggctgaaatctggtataaccccccaatatttcccaataacttaaaatttaaagtgatctagatattggtatacctgaatatagtactttaaaaatcactggtatttcttgattctttgctttaaagctgctttatagccctggagtgttagagctggtgtattcagacttctgctagctcaaagtctgagcaggttttccacttacacccgaaaacatcccagggagagaaagaacttaccatacctttcagccacgtatgccccacctcagtgaccccatagggatgtgagacactagagtcaggaaaaaaaaaaaaatgctcttctgtattctcctatcatctcttggagtggctgaggatctctcatatgtaactaaaatgcattcatcgaggccacttgttatgattgtatagattgtccactgtacaatgagcacagtcacacatgatccccctgcttaggactgacatcaagccaatcagagttgatatttcaaatgagaagtcaaggtttttatattttctttaactcttacgatggctaaagctctttttcaatatgtagttaacactctgttagatgg

SEQ ID NO: 30630 - DNA, 1579 bp, Bovine  19866881010689
taaggataggtttagctttgtaataaactgcccaagtgtcttccaaagtggttttgcattcccaccagcagtgactgaaagtttctcttgctccacatgctctccaaatttgatgttgtgagtgttccagattttatccattctggtaggtgtgtagtggcatctcattgttcttttaagaccttgtctttttatcctttatccttagcataatgtggcaaatgctgggtatagaaaattcattcagaggatatttcttagttgattttccagattaaataaattctctctcctcccatatgtatatacatgcatacacatataagcatatgtgtaaacatattttagcctgaatatttttttactcttgctagcaacacacatttatgtgacaataaaagtattatctttagaaaagagataagaagtcttggttactcaatatgatgagctattgattcttacacctgagaaaaagttaaagcacctacattccttgaaataatcatctctatggcaagcaggacctttgttttcaaggttccacctgaaagtcaaatgttcctcctcctcacatttatgattttatttgcctatgatagataaaggagtcatttgaagtgacatagacctaaaatgctggttacaagaaattttgttgctagtttgtattaattattcctgtccaaatggagggtaagactcacaattgagtttgctgtctgactcatgtcttatttgacttcattcttaatccatctgtggagtgttttgtagattagtattgtgttttggaaatacaaagaatgctggaaaaattcaagtgaggctttaaaaaattcaccattaatttggtaaataacatcttcctagacagaatgttttaacttggccctttgaatataaacatttttaggaagtatattagctcgtttggtaattcagttagaatttgtatcttctattattttcttttactcaaatgctacagagttatttcccttgagtctaaattattgcacacctttctgttgtgaactgatcctcagtcgtgcactgaacacctcctatgagccctgcactaagttccaaggacacatctaagagatctataggataggatgccattgtgattatggaaggggctgagggtaatgcctgaatgaagaaataaagtagttagaaactagttatcattggcgtaaatgtgattgtgagaataaccaagcccactgttagtttcccttgtcatgtcttagacgcccaccatgaggctgtgcacacaggagccacctacaagtcaagcagactggtgaaagtgaatgtttcaccagtgaaactggtaaaagtgaaagttgtgtctgactctttgcaaccccatggactgtagcctgccagactcctctgtccatggaattctccaggttagaatactggagtaggtggctgttcccttctgcaggggatattcccaactcagggattgaacccaggtctcctgcattgcaggcagattctttattgtctgagccaccagcaaagcagactggtgacacccttcaataacaggcatgacaca

SEQ ID NO: 30631 - DNA, 1091 bp, Bovine  19866881018643
taactcttgaataaacttgttcttttgatgaaccagaaccaaaccatgttacataatgttaataagataaaaccacaatcagcggtcttcctcttccaaacggaggtgacttctcaaaatggcatggcctagttataccattttcagtgttaaaaatcatggggaggatcatagccacaatgactaaagttttccaaagaatgttctataaatccttgtaacaacaatttcactatttcaattctaggctgtgggaagatttcaaagggtttagttttttttttttttttcattcttaaattgttcattctgttttttcaaacagagcatttaggaaatgatcctgcagcaatttaatgaaaatagcaagatccattaacttcacactgaataatatgtaaacctcgatgtttaattagtctttgactctgtaaattacaaaatactttttctagtcatttgctgctgctgctaagttgatttagttgtgtctgactctttgcaactctatggactgtagcccgccaggctcctctgttttctccaggcaagaatactggagtgggcagccattcctttctccagaggatcttcccaatccagggatcgaactggtgtctccggcattgacaggcggattctttactgttgagccaccaggttcatttaggccagttcatcccctaagggtgggaagcgctcctttcccccaaatcaagggaatacccctatgtcctgattagggtacaggtgcagggaataaagggaggacatggcttgtgggtagactgcgtctagacaggggccaatcccaggcacaagatggggaagggagattttgcagcttcagtttctccaggtcaccttccttcttctgaagagggtaattttcatctgtcttttgttgatgcttggtctgggcctcatgatgcttccactaacaggcatatgcatttcctcaacactcagatgcaaaaaacaatttacaaaaataaaatgaactctgccaccatccactagttgtgggaaaatccagtgtcagtcactgaggacaggccagggggttgtctagtccttctccctgaggtttg

SEQ ID NO: 30632 - DNA, 2420 bp, Bovine  19866881048175
ttatcctgccacactaacactttcctccctcaactttaggagtgatgagggatggaggtgaaacaattcgtccttcattgctttttctcttaggacagagagaggaaaacaagaaagaaagaacttctgaataagttaaatacttttccctcatgtaactattctcaaactggggttaaaaaacagacatgaaatcataaaaaaaaaaaaaggtagaacaagatattttggcaaaaaaaaaaaaaaaagaacaaataagtagtcagagttattattgtacctaagactacacctcatatacattcctaacatagctctacacctgccatggtaaaaggaatgtagctttacatgaatctacttttatagtgaagggtgagtgcaagtctggtgggatctaaattcgtgcatgtgcatgctaagtcgatttagttgtgtccgactctttgtgtccctctggactgtacccctctaggctcctctctccgtgagatactccacacaagaacactggagtgggttgccatcccctcatcctgggatctttctgacccaagatggaactcaagtttatgtctcctgcattggcaggccggcttctttaccactagtgcctccaagttcatctcctgttaaatattcaaatccaagtgaaaaagagactctagacaaaacaactaactctttgcttccactgactgccttcatctgtgagtcaccaaagacccaatcagagattccctaaactctcagggaacttattattattacatagccaaagtccagaggaagatcagttccagaactgattaattccgtgattcagcagcagggtcctagacccagggtcattccatcctcccacctcatcattgggtcttctcatagtcacaaggcagttacagcatcacatcctcaaacaccgatgtccagaagtttgtgtctttttttaagagctaaggtgcccctttcaaaaactacttcccgtctccttgtggagaacttgatcataggtccatccaaagccactgacgaggaagaagaatgaagcctccatgacctgttcaggccagtcaggggttgagttgagtcccacagtggacacaagagccaaggcaaggctctgagtgagccactgagagcacaggtttgctgctgaaagccagtccctggtctacatcgatcaggttcaaaatgggcaatttccataatttttcttgtttaatattttgcctattaagaagtctgatgaataaaatgttagcaggaactaacctcatctgacccatctttatgccagtaatcagagctcattctaaatgagcaatttgaaacctttttccaggaaacattcctcctaaacaccaacaaatagccaaagaccacttaacttccttgttgagaaaaacactcactattaacatgaacaggtttgaaagctctgggtgtttatcagatagctaccttgttttgtctacccagaagtcttctttctattgaaaaacataatcccctaccaccctgtactcctctgcggtgctggtacacctgccaaacacagtgccaactacagaggcgacttgaggcccaggccttggcaatcagggagctcccatcccttgatacaaattagaccatcagtcagacacttaaccctgactcaagcaggcaacggtgaccaaaaaaaaaaaaaaaaaatccttctttgaggtttatcagatgaaaaaacaaaataagtgtcacctttcttttctgggatccggccgtgttcagatgctggggaccacacgagacaacatggccaagaacatgaaaaaaaaagaagaaaagaagcagagactagtggccatgagagagagacagagagggagagagagaaggcaacaaagaggtggatcactggggcttgatgctgtgacagatcacacagttgtcgccagttttctccctgtatctaccacttttgccctgagatgctgcagcttccctcacttccatggggagcgtatattttcccactccctgactctgggcttgatcaggggactgaccttggccaatggcatggtagcacacacgacccagcgagggctccgagtgcccttcccatcagcaggagaacctgctgggggagaagccaagggaccccgctctgcaccacagactcctgcagcccatctgctgatgcctgagcacacagtgagatcagcacagctgggacagccaccctcagatgtgtgaactaagtcactgctcgccgtcacaggtcaccgacatgtgtgtggttgtttattacacagaaatggccctgtttattacacagaaatggagccaggagatcactccccgcttttcttcacctaatgtctgcctgtttgtttgttttgatcaccaaaatggaggcttcaaacggggcaggg

SEQ ID NO: 30633 - DNA, 1340 bp, Bovine  19866881157787
gaaagatgctttaggaagacaccaacccccagtagctgggaaaaccgaccactccctgctcagccttccctggaaaccaaaagtaaaatacaagctgcttggttggagctctggttgttggttggtaagcactccagcctgcacacctgccctcagtgtagggagagatgatcagctgtgggtttgtatagatgccatcaggagagctcttggcctcagccttagaagaggacaggcttgggggaccttgctaagcctccgtaaaagcatcattttgttgtccctgcttgatttaatggaggaagaactctaggcttgatacccgataggtctagaaatgaactctgtggactccagagtctgaactcttcaaatccattctctaggctgacaggcttgagggattcggttccagtttgagagccccctcagaatgttatctctgctggctgttatcagttactcccgggtgagcccgaagccccagaataaacacagcccagacactatcagggaagatgtgatgggggcagtgatggaaagcttgttgagggagagggatttctgaggccactaaaccaaaataaatacccccttatcaggccaatatcagtctttcagtgaggctcagcaggcaggaagttcaacttgtcacttttgttttttaaagctgaaatggtataagaagagagacaactaagttggaaaactgataggcaaggcatctcagccacaggaggggattttgaggcaaaaaaagaatgatttggaggcaaccatataggctcaggttaaaaaaaaaaaaaaaagacgtaacccgaaaaaaaaagaaaacacagaagcttcaccatcacaactttctgccattgttatgtggcaaattacatctgagtctcctaattttttctagtagcttccacactctctgggttctaatattgaataaattaaagttataagcaggaagttttaatctgtccatagcactgccctcctatttatagtcaggtgttattgctgagcacctccataatccaattattgaactgctgcaaagctaacaatcgagccaacaacaagaaaagttggaatttattattttctatgcaaaatactgagcagagtgtacctagcgtatcatagctccacgataaatgctcactatcttacaccttcataaaaacacatttatttcctattaaaaaaaacaatatctggagagcaatgtcagcccccctcaggtgttctaaagtgtcaatcatggaatctatgcatgtgtgtgctaagtcacttcagtcgtgttcgactctgtgcgaccctatggactgcagcctgccagg

SEQ ID NO: 30634 - DNA, 2161 bp, Bovine  19866881172849
tcaaggcctttaggacctttctttgtgtggaagaaggtgagggatgtatgtgaaaaaactgctttgagttactgcaaaagtcaccaaggtgggtcatttaaaatggagttacagttcaaagaaaacaaaaaatcaaagtcttttttctgaatccatgaatgatgaagctcaaggaatgtgaggagaccctcaagaagcagcagcacattttcctgggagatggcctgttggagagtaagttgccttttgccactgggcctggcacctacagagggtggaagagcagaagggctcttgggatgctgggtactagtgatataatggggactcttgcaagtgctagagagatgagggaaaagacccaccaccattggccaggacctgattatacctactatgctcaagctggaagccaatttgtttccaaacatttcaaggttttttccccaaacctcaagggtaactatatgtgtgtacataaggaccacaaacacaaatgtaaagatattatggtagaggtctttaagcttttatagcctcagcttttcagaaaactacaaatatagtcttgagatcattgggagatcattgggatgagtaccaaatagctatagagttggattatgcctgactaggataagtaattggtttgttaattggctaaaaatttaagtcaaattctaatttatgttaatattaacattcatcccaaaggtctcaaaggccaaaatgtgaactaaaacaatttagactgcagataaagcaaatgggacagcatatggatgattgatgaatctgggtaaagtgtttctgggaattctttgtactgttcttccaacttctccttatgttggaaatgagatcaaaacaaaaggttacaaaaatttcagcttttagatgccgaactctgaaaccaaaaggagaggattttaaaaacctgctttaaaagcagtctgagaatatacaactatagttacaacaggttggaattttatggtaaatcttacatcattcctagagatcacttgagaatgactaaaacaaagtagccctttgcagagaggtcacgacagcaactttaaccaatagaaaagtaaaagcttataaacctaaggaactgaaaatttgttaagataaaagtgataggtggttactgtaataccgatcaggagatcagataattaggtttttaccataaggaaggaagcgaagatataaaatcttcagggttatccatttcgaataagatttaaaaaattatagctccaagtttttctaaaacaattatgtttcgcatcagaccataacttgataaccaaatgtgcatctacatttcaaagcttattttaagcactgagaaattaccacaaacaaggaactatacctttcatccttggcatgtcagaactaatctctattacaatataatcctacctgcccccttttggacagattaacattggacctttatttcttcctgtacattcagaattgctcttagtattttttaaatgatcaagtttcattatagggaatagagactgaaaaaaattgtttttctcttcccagtgctgagtttaagccacctacttggcccatcaaatgaagccatgtaattaaacaacatgttattagtgcaaaggggcagaactgacattactggcatttttaattttttttttcttctgtaatccacttactgagattcatcattgtcagctctccggaataagggtagtgaagcctttctgcaaagtcccggcagtaccacacaagaagctcctggttggcagggatgggcttaatggtgtagaagtagatgttcatgccgttctgacaggcggccaggttctgctcccgggcagtgtgcgctgggttcacgtagcgtagccagttgctcttctcctcattaaagccatcaatgaagtggtgaagctcccctctggaatagatctgcgcaaaagagaagagagacgtggaaaataaagcccccaatgcaatggaaagcttgccagcacatggcaagtgtgatttctggtccctgactgcctcattagaaaaggaaatcagtttagccgggagttgtcttgaatcagcagaaataagggaggaaacgggaggcacgctttatcagttaccttttccatttcagttttagggt

SEQ ID NO: 30635 - DNA, 2744 bp, Bovine  19866881238088
tcattcctgggctttctttgtgctctttcggaagtattacatctcttaatatgctaagattccatcattgtctcttttttcctttcggtttgtttcccttggaagtctgattgttgctataggcagttatttgtaatttagagagcagatgtcagaggaaaatggaaatgagggacaggcttgtacggaaaaaactattgtggcttcttttggcaaaagagattcggctcacaaaggtcctgctaatttgtgagaatcatgaactttccccaggaattaatatgctcatctgaaaggaatcaagattcttttaatggaaataatggcttgtgcttaaatcaaacctctgctcaagtgaagtaccatgaattctaggatgtttagtttagtggctttttgttttttcttccacatcttttttttttttttaatgccaagccttacttgcatgaagagtaagaaagatttaagtttgttgctgcaaaaaggaaagaagataaaaaatatgggagctaaagaagacaaagccaaccaagagaatccaaaaagacgttgaaaggaaacattctgttagcaaagcaatagaggcctcgatactgttctaacggttcaaggtttaaaaaagggaataaagacaaatgaagcagtcagagggaggagagggaaaggttaagccaagacagaaactgtgagtagatagatgtgaaaggggctgaaaataagtgaaaagtgaaaaattgctttatgaataaaccgttaaaaaatagtgagtgaaaaagcaatcgtgcttccagttattactgaatcacccgctggtggcagccagaggctgacctgagctgcgactccacgcttaacctacatgcagcagttggtgctgggctgctcctgtgggcggacaccgttttctacttgagtgtcagtttcactgtgattacttgccgtcaagacgcatgtggcccattttaccgccttgaacaccaaaaaacatgacttggtcatctctccaacctgctgacattacaaggcaggagatacagcctcttggtacattcaggacaccagcaaggcaaggagctagaaccgagggatgtgaggacaagcagatcttctacgggaaggtgatggggcgtgaaggctcagcctgcttctgtgtttttctgaaaatgaggccatgagtttatactcaatgatccttgtcattcctgatggcgtgtctgtcagggcagggacacagcaaccatcccacaatctcttctgcgctcggagtccacataatactcttctcccgagcacattcaggccagcaaacaaaatgccaatcatagcagacccgcctccgcccctgcctacttgaggaagcactggagccctaggaagtgaaccggttccaccagttgactccgccctccgagccgccgggaagagcaaagaccggaagtgctcgcacccaccagaagattggtcaagcatcacaaggaagggctagtgcagatggtacaggcaatttccaaagctgcagggtcgccctcctcctcattccaagtgtagagcacagttctctttccgagctgcctgcatgcagagctaacttttgattctctgtttcaacagaaaggaggtgggagatgggtgcttacaaattccaagaaaattttgcatggcagggcttcactggttgtctctggtggactgcagggaggcaggtggccctccagtgttactagggccccggggaagtcagttctggggaccatttgacccaagtgacccatggagcagtgagtgagcccatgcacacagatggcatggctgtgaaatcaaagaatgaggcccagttttaatgaaactgtttcatttttaagaaccaggataagactgtagttctgtacatctggccagttggggctacgatttccttcaaagcttcacacagttcttggtatctgttcttgttgttgctgcaagaagtacctagccttgtgctggtggaaggaaggtttaaggttttcatccttgagtgttttcatggagacaggtaaggatgggctttgagcatcttcattttataaatgggtctgtcaaagcatggaaggtcaggagagaggctcaggccacctgactagttcctgctgggcctggaaaccgaaatccccagcttcctgactctacttccacttctcacttccgaagtcagcactttagaagatgctgctattgcccagcaggcagggcccacaggagtcactgatgctgtttgtatttaggtcaggcttgccaaaatggcagggtttcacagcattaattgctgtcttttgcctggtcaggaacttgactgttaacaagttctgcagacatttcgggaaagcaaggtggggatggctggccttggagaaccgtggcctgctgcagcccagtattattcaccagttcgacacaatcattcacatctctgaaaccaagcttcttccagatgcccctttactgaaaggctttcatcactctagggtggccagttccccttcaaagcgccagactgagctggcgtttccacgtgcattcacagaggcagggggtgtgtgtcaggcttcagtggttccgggtcagcctcaggtcagcagtgctccaaagagaaaactgaggcagggagctcccaggcccccatcaggacatgccttgggggcctggcaactgcagctgaagagcacatagatgctcagacagaaggcacgggcatttgcaaa

SEQ ID NO: 30636 - DNA, 3302 bp, Bovine  19866881246487
atgctgtcctaaaaattgttgcttatctgcctctacttctctgccatgaatactttttttttaagtataattttattttttttaaatttttgactgtactgggtctttgttgctgcatgggcttttctctagctgtggtgaatggaaactactctctaggtgcagtgtgcgggtttctcattgacatggcttctcttgtggagcacaggctctagggaagatggacttaagaagttgtggcatgtgggctcagtaattgtggctcccagtctctagggcacaggcttaacagttgtggcgcacaggcttagttgctctgtgggatgtgattatcttcccagattagggatcaaacacatgtttcctgaattggcaggcagattctttaccagtgagccacaagggaagcctgatgtgaacactcttagaagggattgttgttcatcattctattcaaagaaactagcaaagtgcctggcatatataaaaaaatgtttgttgaatgaatgagtgaaagaatttcctgactctgaacttttatcatgagcatctaatcactggctctcttatttttttatttttattaatcttctaccatcttaattctactagtttgaacaagtgtcttggttttgcacataagtcttcaacactgtcaaatttacttagtcttcagaggtgtcatgcagacattagccatatccggatcactcctcccacactggatgtacacggagaagttctgtgcttggtttctcatcatggcaacatgcccagcccaaagatgccagtttatatgagttcaaatagcaaaagcatggtagacatggctcttttctagagccaagctaccatctcaatgttaaggaggttgaaactactcccaagaacaacctcttccaactgccagttctcaagtgatcaaaataagagaggaggtcattgtaaatgacctcgtaaaatgtcaagaagtgcgggaagtgagttgagagctaccccatgttctaaagttattactccaattaaactcctttatgtctttctgtataaattgtatataattatacatttgcatttatctaatacaatggaaatacaagggagaaagtaataaagtctcaattatgagatatctgcatatataacaattcagaaagatcacatttattgaataagacatgtttgtactttgaaaacatttcctttcagaatcactctgctcaaatctcctaggccccagtgaattttgagtaaggaagagctggacagagtatttacacatccataaaggctatccttttttttttttttttatagatatttacttgctgcccgactgcattcttgcttaagaaacttatgttgaaatggaatgttattttacgtgagtgaggctgcagggtgaaccctcttttaaaagagcagccttgacctgatgcaaatagactcaggatgacctgctgctccggatgttggttagcaatctttgcagttaggcactatctgagtctaatgtttgccggggtgtttccaccatagcaagattttgtcaaggcaaatcatattcctaggtcctgttttgttttgcatgttttattttttaattctcagcttaactggtaaatttaacaattctattcttttccataagtgtggatatgtaagggtccagattacccttactgtactagttatactgaatattttggaccagtttattttgccttccaaggaggtattataaggcagactacacatttaaaagaacaaatgttccacctagatgcaccgaggaatcgagaacaagaatctcctctatgaactgagataacaatgcattaactttagtgaattcctaggaccacgttttctagagactcaattaaataaactccttactaaatgtccatgagtatgaggcattcccaggtggcactactggtaaagaacccgcctgccaatacaggagagataagagacacaggttcgatccctgggctgggaagatcccctggagaagggcatgaagtcactccagtatttttgcctggagaatcccatggacagaggaggctggtgggctaccagtctgtagggttgcaaagagtcacacacaactgagatgactcagcatgcatgcattcatgtgtgtgaggcatgatgtggttttcgagggccataaagagtaaaaatcatttaactgtttctgaccctcagggagtttgcagcaaggttaaggacaatttaaccatgatcaagcttttaattaagctgaatgcaaataaaatattttaataacagatctaaatactggagatggtagctcttatgaggctgtccatgattaattgccaagagaattttataagcaggaagtgctctgagacctcagagaggaccagcttgggaaagcatctttcaggataaacagatgtagatagacccaggaggaggccaaacaaatctatccaattgtctgctgatcatgagaccaggcagatttgggctcagtcccacctaggactacatgagacaaggtcccttctactctgaaactgtcttctcagaataaaatagagacaatgaatctaccccatgagttgttgtgaggagtagatgagttcttggggtaagtaaagtcttggtacagagcctctcatatgttggcatttatgatatcagatattatattatgtaccattttgtcttttagtctactctttgcttccctcactcagaagtaggcatttgaaaatacagatttaacattatttcatgcttggatccacagccttactacaggctcaaaatagtgtctaatacacatttgttgaataaataaatcaataatttaacatcaaaaaaatagattaggggcttccctggcgtctcagtggtaaagaatccacctgccaatgcaggagatgcgagttcaatccctgctctgggaagataccacatgccacagagcaagtaagcccgtgtgccacaactaccgagcctgtgctctagaagctgggaactacaactactgaagcccgaatgctctagaacccatgctctgcaacaagagaagccacacaatgagaagcctacacacccaactagggagtagccgccacttgccacaactagagaaaagcccttgtagcccacaaagacccagcacagtcaaaaaataaaataaataaaaattttaagtagattagctaatattattgttcaatcctgtctttttcatatttcttttcatccttttccattttcttcaacttgggagcaataagagatattgcaagcag

SEQ ID NO: 30637 - DNA, 980 bp, Bovine  19866881250309
gattacacatcatttttattttcatggttttgctgtgttcccttaatttttcccccgaagaacacagactacttttataattagaaagaaaactattttcaaataaattttcaaaaatgtcaattctgatatcataaaggattttactccctgtcaggatgaagcctaaagaggagactcatgtccagcaagggagaaaaaaaaatcaagaaggacagcactcaataaacacctaattatgtttctgatctcgtgcctgtttgaagcactcacacttgttttgactcagctagataagtcagctcctctataacagtcacaatttccaccagctgttttcgatgtttgaggttatgtttttgtttgagtgaacttcactgcctatcccttgagcgagcttatgaacaattgtaaaggaagtctttgaggccgactcagaggaaagctgctaatctcatgacatccacaaggatttgaaaaggcagctccatctgtgctgtttctgttttccttccatggaaggtctcttgatgtcagaaaaatgggccacttctgggtccagttgttggatggaacattcgtgaccacagctgtgtccaggggttcccacagacacatttaacctagaagccatgagtgacaaaccctacgcagggtacgcttccagccctttcctgggttttgcttcccatgtggtagttctcttccaggagttcagagttggggagcgctctggcaggaagctatttatcattgagaaccaccaaaggagggatcctgccatctgtgcctgacacctctgagactttcttttgagctggaagccagggggttctcagtgcatgatgtggcagagtttctggaaacagatttggggaagaggaagctgacttatgtgggagtcaccatgtcagttgtcattctctggcaccccctcccccatgatgttttttttttttttcccaaaggaaaaaaaaatg

SEQ ID NO: 30638 - DNA, 1387 bp, Bovine  19866881278100
gcatattcataaaagaggatactgcagaatcctgcagtaagaattaatgaagtgctgctacacaaaacttgagggaaaagtatgcctccaaaatcctcttttgttctttctgaacttgaggattcaaactcctgccctcaactgaactgggagtctccgtctccagctctgtgcttcctggctctgagtcagtcacggggaagccacacagacgttccttgctccacccaccccccaactcacgcactcactggcagccagttaaggtcttcacgctcctattgctcagttttctggtgatcctgacatgaagtagtcaggggggcaatccatgccaggatagcccatatccttcaccattgtgtgcccagcactgaacaatgcctgacacaaagaaggggctcagtaaatattttttgaatgaaagggtgaatgttcactgatgtccctgtgacatcccatttgagatccattgaaatctaactgcttgaaaaagtgtactgtctgtgtaaggggctgaattcagtggtgtctcagatagtcttagttggcatcatgtgacatgttgctttgctgattttgcatgcacacacacgcacacaaacaccatcaaaatttgttttactttcagctctttttgaatttaaatataggatgggcagcttgtttttcccaggcaaggatgaattaaatttggtttcacttggtttgtccttataaatggagacttctctgtttaggaaggtgctctaaggcccttaaatgcagatagtttaaccaatgatttgaagaaatcttactcccacaagactttcttatctcctaatggtatcctttcctttttgtgtaaggcagactgtgcattatactgagattcaaagaaatgaaataggaaatccaattgtagagtgaatttcaatgaaaatgagctaattagtaaataaatggcatgactttctgacaccttggtagaaacagaatagaataaatagaattctaatgataatatttagcagctaccgtatactaataatgtattatatgccaggcagtgggttaacccttaactagataaaggcaggatacattgattttaccagggtgctagatccagcctagaagaattcagttcttacatggaatagataatacaatagttggtgctctggtgtgaactaaagtcagaatgactggtttccccttgtccttgctaaaattactctgccataaaatttggctgttggaaagtcctaaaattctgagaaatcacaggagatacaaagatgaatgtaggattcagtgcctgcctttccagttgctcaccatcttgagtaggaaagacagtgtgtctttgtggttcagttgctcagtcatgtctgactcttgg

SEQ ID NO: 30639 - DNA, 914 bp, Bovine  19866881341051
cccaagtttcttgagaaataattatatattaggcaaaataaattgttgtttaagttaaggctattcatataccacaaaaggcaacatgccttgaccatcttttgccaaatgttttcatgaaacttgggtgaaagaaatcaaggaagcaagatgttaactgaatccaagcccaacttaataactcccaacaatgtctcccagactggcagggtagagatgaaccattggctggcatccagaggtcttagatcaagaagtaacaatcaccctgttgcattttccaagaaatacaagttgaactttgaacatgactatttcctgaggagcaattagtcaaatgtcagttcttagtttataatgctcaggatgaaaaaaaatgatggaacagggaataatttctttcaagagccatgtggaattgtcccattatccatatccaaagaatgtccatatccactctttcaggaagtgaattcttttggtgtaggattcagtagatttggtaatatgggacgttagtctctgtctctaattctgctgaaagatcttaatgcagatgtaatggaagataaattgctcgtttcctgcccatttctatccatttaaatgagaattctgagcatgaaaaacagtgttttgagagtaatcaattcaagagtaatcaatattcaaagtatttattaagtgtatagcatcatgaggccatctagtggcgaacccacaagaaaaatgcctcaaaagtcccacagaaaatagaaattttccataaagtgaagaactataagagcttcttgatgaaagtgaaagaggagagtgaaaaagttggcttaaaactcaacattcagaaaactaagatcatggcatctggttccaccacttcatggcaaatagatgggaaacagtggaaacagtgt

SEQ ID NO: 30640 - DNA, 1384 bp, Bovine  19866881473476
tggcgctcccagggaggaggggtcgagtgaagccaggctgccagtttgtagagagtgataatagcaactattattagtgataatagcagttactgtcaaactctctagaggtcatatgaacttctacaacattgtttgagcacccaatataagatgaagggtgaattagaagctatttgtttccctcttattgatgaaaatcctgggaaaggaaaattcagtaactggctcatagcatagctggtgcataacagaactgtgtctcaaacccatctcttgggtcctatgcttttcccaggggaccgcacttgtggcagtgacctattttgtgatctgttctgagatagagcattgatgtgtaaatcaagtggaattgtgaatctaagactagttaaggagagaaagtagacattagacaagatttccagtcttgtaatggcatgaatgtgatactcttattctagctgccttagaggtgaactagtggaggacaagctactcacagccctaataccatgtatctgcctggcccatttccaaatgagaacgcaggaggattcaacatggagctagaaggaatcaaaatatgtaggctgggtgtgtatgtagaagagagagacagagagaaacactaagcagaaatggtaggggagagtatatttgcatattttctgcttcctagtttcttcagtgtgctccaagagcagacagacagactcaggaatggatcgttcttatatattcacattatacctcatgactaagaaaactgttctctgaagatgtctgagttttactaaatgtttgtctcctcttcttccacaacttttctcatactctacacagagacggaaagcacagcagtgaatcctgactgaccacatgctgactgcctctgtatttcagtgcactcatcttttctgtgtttggggaaatgtccagatagattagctgaggttgcgcccagcagcaggccgttgagaaagggtaatgattgtggccctcagctcgcgtcagctgacttgtaaaatgtcctgacagcacactattgcatgttgtaaaactcttggacatgagcttagggaaagctttttcagccacaataacactctgtgtgcccgaaagttctttccagccaagtcagtggcatcagtggtagaacggatttgcttctcaggaaaatatgaagtcagtgccagtaaaatctagtgtacactgaagaaccacattttaaaaaataatgttcataccaataacactgctcacggttagcaaaattacctcttctaggactccccagaagtgatttttccagcaacagggagaggcttggatatttacaggaatcctttatgctggtatttagaggaatgctctgcatgtg

SEQ ID NO: 30641 - DNA, 1389 bp, Bovine  19866881508259
ttccttaaactttccttttggacatacacacatgtgcgcatgcgcgcgcacacacacacacgcgcgcgtgttagagcactctattagaagtccctggacagtctgtgggtacagtttcagagaagtcttgtcggtttcaatctctgtcacgctgtggacagtttcctgtagatcttccctactcagcgaccccagctcttcccacagctgtctgactcctctccgcactcagccttcctggaggcatttaccctgttatctggtgtctttcagttaagtcgctgcagtatggaaatccttccctttcattgccttttctgcagataaagagaaaaatatggtaattgctgtttcattttcaaccttgctataatttttggagcagagctgtttgcctcactatcaaaagcaactgaaaaccttctagtaaaagttcatttgggtctttttgaacagcataatttcagtgtgtgatttttcctttctcttacattgttccacaagagttccatttggaaatgcttgttagtgtaaagttccatcttgactcccagacaagcatgcaaagcgtgcaagtcccttggtattggtgcctgccttttataagccatgtgtcacatggactctgcataatgaatatgatatataggcaacatggcaaaatatttaaaataaggactgtcccacaaaatccagtataagtggttgcttttgtcctgtttaatgatattccatttgggttatattaagtacattatgaaatatgaagctttcaaactgtgagatggtgatggccagatattatgtagtgcaggggttggtaaacattttctgcaaaggacaagacagtaaatattttcggctttgcaggtcatatggtctttgtcagaactatacagcttggtggttgtagctcaaaattagccataggtggtaagtcagtgagtcagtatagctctgtttcaataaaacttttattttaaggctactgaaatttgaatttcatataatttctaccacggaaatattcttcttttgatttttttccaactgttttttccaagtgtgaagccgttttcagcttgtgggttatataaaaacagtctgtaagctggatttggcctgtagatttgctgacttgatagtgaattcataagttaaggatttgattccggagaagaaagaggtaagatttcatacatgtttctgggccaggctgactttctctctccagctactggctgttctgaatatagtactcagttgtgtttcgttgtttgttcctggtgggagtaagtgagtatctcagggaacagatataaggagatttttttttttttttaatttactcctaataacagaactttaaatctgtaagaactcagccct

SEQ ID NO: 30642 - DNA, 1248 bp, Bovine  19866881581777
tgactgatggaccacaccaagtacagatgggctgggaagggggagggaggagactcacctactgtagacccttttaccttctaaactggtggggaccagaataaaagtaaaccagcctaattcagtgcctgggtgacccctcccttcaatgctttcttcacctgaggggttgagaggtgatggaggaaagggaaggcaatacaatgacaaacctaatttaacagacatcttatcttttgaaaaactctgttattgactaaggaaaccttttaacgagaagacagcgtggagatcgcagccggcagtcctggcttatctgatctccatctacagcccattgtttcctgcaaatatgcaggggaagccggggctgaggggttaatgttcactaggcatcttcccccttaaggtgctcccctggggacagaagggcagcccagcattaccctagaatgggaccaatcacagggagagccagggcttcgcgtttttcaggctggcttcccaacggctccttttaaaagaacaggcactggactttaggagagataatcccacaatggaggtccattagaagtattaggatgtagcccgccaccgagatcctcgggaggagagctctgtcctgacaatagacaattaaagctgataaacccaagctacttgctgctgttctaattccttctaattgtatgctacttgtccccggctccagcattcaggatgaagcacgctactctaatctccaaagtacctgacctacttcctacaggatctttccagcattcttttcttcccatctggacctctttttctcttctatttcccccctcttcctcataactcaaggagatgagaaggaagggtgttggagggaagcggggtgttagaacagaaggctaactccaaatcaatacctctggggcctcagacagtttattaatcggtaacagctaatcttgctttcggacacaccagtgagtaaactgcattaggcatcagactccacaagtggcacggggcacagaggatccaactgttagatcacggctggctgccaaatctgcatgtgctcatgcgtgcggagtatctgcctgggtgattctatttgtggctgacatctcactaattatgctgccaccaccaactacttagaggaaagtgttcattctcaaccagcaccacaaagcatataattctatctcaacaacagagctttaaatgccagtttggtgcccgcctgcgtgt

SEQ ID NO: 30643 - DNA, 1377 bp, Bovine  19866881609304
tcctgacctgcatacaggtttctcaagaggcagctcaggtggtctggtattcccatctcttgaagaattttccacagtttattgtgatccacacagtcaaaggctttggcatagtcaataaagcagaaatagatgtttttctggaactctcttgctttttcaatgatccagtggatgttggcaatttgatgctctggttcctctgccttttctaaaatcagcttgaacatctggaagttcacagttcatgtattgctgatatctttgtagccttccccaaaagactagaaagctagcattttccagaaccgaacaatttcatcatgacttcagttgtcctggttaaaaatatagtaacacattaaattttctaaatgtgttacgtgattctatcattttcagaccaagacatttcaaagctggtaagatgcctggacacataatgaagaagggaacggagcaagtggggaattaacattttctgagcacccagaatatgcctacactgggtttcatgcattctaaagattgtctcatgtcaatcatcccaggaactctgtgataggtgtcctatactcatttttaagatggaaatattaagcctcaaaatgataatttgcctaatatcacacagctctaaagaatcagctaaaagaatattaattacccagtgctctcctacttccatctgagtttcttcattttgttattggcttcattctacttaatgttccaagtgataataatggaagtatcctttaagacacagctattggaggcacaatcagtgaaaaggaaaatgctaaatctcccagtgctagaaaagcagaaacaccatcttggtcatttaaaggaaagaaactgcttaaggaaaaacttacaaaatgtaagttttctacactgacaacaaacttttcagtactgtggcttcagcatatgttccgagttctcagaaatcatcatgtttctgctcactcctgagagtctctgtcaccctggtggtgagtcctgtgcttaaaaagcctatgctcccctagtgtcagatgtgctatttacatatgaccacattagttgctttgattctcagtttcctgtacatctggctgaagaatggccggatggaaacttggggtgggggagatgcagttgttcaccaggccatggtacacagtggctgcagcatgctggattatataccagatttttaaactgtattctgaagatgacttcacacaggatcacctcatgggggttgaatttggactgcccctaagtcaggctgagaagttcctgtgttttgttcctggtagttcatcatctctgcttctgatagttcgactccactttggtccacatctctctctctctttcaatctc

SEQ ID NO: 30644 - DNA, 1050 bp, Bovine  19866881629343
ctgaactccaatttccgtgtttataaactggtgatggtaattacctctctgcctatctcagagaaccataatactcctcaaaagatgatatataggaaaatattttgtacaaagatatgatttccacaaaatatttaaatatatttcttacactttaagggctcagtttcgataagagctatctttgttagacaaaagttgagttatgaaactaaaagtacaactttccatatgatgtagagtttcctgttctattttacaaggcatgtcccagatgggcggctatttattaccatatgaccaactcaagctttgattgcagttattagaacatgaaaatattgacagggctgagatccctgttgtgaaatatgaggatcatgaaaatctaaaacgtcatggggcatcagcctttactcacaggttctaacagctaataagattgaaaatagtttcaacaaagtgattacagttagaaatagattaaatattaacttattggtgaatttaccaattagacttccctgctggtcctcagtggtcattctgagaggtggactctgatgtgcccatgaggcttacccaaggccgaggagaaggaagtcagtcctcctttctggggcaccaccctggcgtgctgctgggctgcaacccaggtgcctgccccctccactgccctgtaccttacgcattgctcaggacctggggtgggacctccctcccaaccctcctttccctttcagcctttgcctcagacttctcttcactcccaaagagcttctgcttgtctgtgaaactgctgctctggatccaggtttcctatgtctcatataagcgacaataaactcaactgctcagctaagttcaagggcctcactctgaattgattacagggggctaggcagaaaaaggaaatggtaagggacttccctggtggctcagaggctaagactcctcgctcccaatgcagggggcctggagtcaatcccttgtcagggaactagatcccacatgacacaaccaagagttcgcatgactaaactagagatc

SEQ ID NO: 30645 - DNA, 898 bp, Bovine  19866881648268
ccccagaggaggagaaaatatgctgaaaaaaaaaaaatagccataaagtactttttatgttaagaacaaaaaggcaggaaatgttttttttttttttttttttcaaatattgttgcattttctccatctggtgaaataaaataagacagatatgttatactccgctgttacacaaaaacatcaccagcaggccagtgagatggtggagggctgctgctgtccttggagcagtatggaaggcattccctattaccctctctcccccacccctaaaacagcacatggactgcttctctgaggccatcaaagctttttgcttataacttagacatatcttggttgacagaataaaaaaaaattacagaactgtcatcattacgtttgaggaaatcttcccagtttcctaacttccttccaaaacatttttactctaattacattttttgttggtggtttggagagggcaggacaacctaaaagaaagattctattttaattgcatctttccttttccaggaagtctgtgtcctttcatatccaccaaactcacttgatcgctttattagctgttgtccacttgttactgaggaaaaaaaccaccacccaaacaaaccctgtagatgctttgtttttgttttcctctgcagagatcacaaagtccgtgcatactctctgtcaggcaccccttcttatccagggctccaggtgtgatagaggagaggggtgtgtgtgtgtgtgtgtgtgtgtgcgcgcgcgtgtgcgtgttcctgaaatgtcaaacatgcatcccaaagtgttgtgtgttttcaagctaggatacatagcttgcgtccaatgttgaagaaatttgtgaccctccgaagttgaagaaccactgcgccaagcacctacattaatt

SEQ ID NO: 30646 - DNA, 1747 bp, Bovine  19866881652193
cagtctcactcctgatcttagaagcaagaatgaattttctctttgattcttccagaagaggaagtacattggaattccctacagataccttgttaaaatacccaagcacaccttaagacccatgctttttggaagggaaccaacttcattgatgtgtttttgtttagttaactttctattggtctctacatccaggtttttactttgtgctggaaaagcaacttcagttaagtgtctcttaccttcccagactgtcttctttgtcttggctttgggagaaaaggcaaacagccttcacacagtgggttgtgcagactttatcatggatcagacagctctgaggagaaaatctacttagacttaagattcaacctgttcaggattaggagaaagccaagacctcatcggctcttgtgagcagcaatctggcaaaaagtaatttagaaaattatggttcttcaagctgtagaaagggagagaatggctgagcacttgataaagtccttggctgctgggtttctattgcacagtctctggttctcagttgaaaggtttcctttctgtcatccagttagccaggcagtctgcgtttggaaagggagagtgagtttgcagggcttgccagtccagctgttgagttcctatttccaagtatcttgttgccgaaacagacaggaagtgctctcaccatgattttatttaataaactgatcttggatgtaactgacttgttttgtgagcaaagagaaaactcagaccttgctcagtcctggggaaactgggagaagagctgcggaattgtgaggaattgtggagacacacacctttgtaatattgcaggaatccagagatttcctactgcgtgagaaaggcagtgctccaaggagagccccagtcgattagtggctgatggcagtagagtgtgctgctccttctgtcaatctgggcctctcccatcaccctgcttccagctgtgctttcatttctaacagggtgaggctaaccaggctgtgattgattggtgccaggagagtggtttgcagtgctcatgcatatttgtaagaggaaggaaggtgtgtgtgtgtgtgcgtatgtgtgtgttggggaggtgaaagtatccaaaatgatagaaatgtgatctaataaatggttccatgctgtaagaaaaaaacacctacttttccaactcatggcaactcaccactttcagttagaactgatttggactctggggcacttcaatgcagtaaattttcttggacatgactgtgtctacaaggtacttgtgactctggggagctccaaagatgagtaagacctgggctctgccatttttaatctcacagtcttttctttggcactcgatgcactgtgatgctctgatggggtgaacatggtatgtattgggaggaatgagaaggagccctatttgcttggggacctggttgccctgctctggactttggagctcaaggggacagagcagtcatgacctgaaagcctttttaggaagtcagcttcagaactggcttccgaggagtatctacattgggtttagagtcagggaaggacttgataacagatggcttgttcctttccctttgcctctcctcctaagttgtttttagcagggagtttttgaggagttgtatatggttagttcaagggttgcctatgaagatgaaggcaattcaggggcctttccagcagccatcatctaaatcaagcaagagtcaacatgcggaga

SEQ ID NO: 30647 - DNA, 1002 bp, Bovine  19866881969664
gttagaccttttagcccgctcctagtttcctatttcttcttctccctcaaaccataaacacagtgtgcttaaggggaataaaatagttttaacctcagaaaccaaagtaatgttctttggttgttccacaaaggcctaaggaaccagaaacaaaacataatatatttttttcattccagatgaggtttttttttttttttctttctttataatttgtaagttctctttagtagaaggaaattctttcaagtaactttgctcttctctagcatcttctgctcaacggtggtcaaaagtcttcctctgaaatggaatttatacctaggagagctgtgggttctaagattgaggaaatggctttgttagactggatggatcacacatttgactttggagggccttgctaaaaagaaacatgttaactataccagttcctccctgatggtaaatttcttggggtcggggggtggggtttaaaaaaaaagtcaccaaccatgaatcaggaagtaattcgtcattattcaaaagaactctgtaacagtcctttacaacactgtgcagtacattttgttttttattcactcactttcccattttgattttcttttcacccaaaacagcctacaaatcacttactgaatgccttattgatatggaccaagaggagaggtaaaaacatatttatctccagtttttattatccctggtggctcctttctaattgtgcacctgaaatggtaggcctttatatatgaatcaataaatgtttgcaatggaatctaagattttggttttgatatacactgatacttcattaaatctcatcaacaaccgaaatctttgtttaaaaagatatagaacacacctacacgcttgtgacagaccagtctttctcatatacatgacttaaaaattaattttaaaaatttaatattcaatatacaagccaatggagcataccgagacggaaagacagaaaaaaagaaaatttcctatacccaa

SEQ ID NO: 30648 - DNA, 2576 bp, Bovine  19866880106619
attagaaatatgaaaataacatgataggatatattaccatgtgaagcaaatagtattggtttacttcatcttaaaaagtggcagcatttttaaaatagctttattgtgaccatggttactttggaggctttgtttttgttcagtaaaataagcattgaaggaattcttgtatctacactttgtatgaaaggtgcactttttaaatccctgattggatatttcagatgtagttatatacctactcctgaagccaatccaagcatttaaatggaactggcggtctgatttcataaggagacttgcaattatgttgttacttagaagcttagtttattttcttagagatttaatgcacagtgctagtattatcctttgctactaaacaaaatgcttctcaaaattttacatttgggcttactccttggaaggaaagttatgaccaacctagatagcatattcaaaagcagagacattactttgccaacaaaggttcatctagtcaaggctatggtttttcctgtggtcatgtatggatgtgagagttggactgtgaagaaggctgagcaccgaagaattgatgcttttgaactgtggtgttggagaagactcttgagagtcccttggactgcaaggagatccaaccagtccattctgaaggcagatcagccctgggatttctttggaaggaatgatgctaaagctgaaactccagtactttggccacctcatgcgaagagttgactcattggaaaagactctgatgctgggagggattgggggcaagaggagaaggggatgacagaggatgagatggctggatggcatcactgactcgatggacatgagtctgagtgaactctgggagttggtgatggacagggaggcctggcgtgctgcgattcatggggtcgcaaggagtcggacacgactgagcgactgatctgatctgatctgatcttgaatttatgtgacttttatggtgcttgtatatttaatttaaattctgtttagccttagtctaagactaaatccaatatgtgaaaatccaagtttatagaaaaaggtcaattagagggttatggtttgttttacagtagtattcctttaatattttcctttatggtcttagtatttgaatatcctcatatacctgttaaagaatatatgcatatatcatataaggtaaataccaattttacttctgtttatttgatcacaccttgttatattttgttactgaaaatgataatttttaacacatcatttttattttttccttctaaaaagtatttttcaagaacctgtggctagattttgagtataataaatcgtgtcccctacttttttccttcctgaacttgtgaaagtttttgatcttttatgttgcctttgcctttattttcttacttaatttcacacacaaggaacttttgttgtttagtcgcaagtcatgtccaactttatgcaaccccatgggctgtaacccaccaggttcctctgtccatgagatttcctaggcaagagtactggaatgagttgccatttctttctccagaggatcttcctgacccggaaatcaaacctgcatctcctgcattgactggtgggttctttaccactacaccagggaaccccacaagcaacttttccctctatctaaatgataaagtttgatcaagaggaaacttgatttgtatttattttgtttgtggtatcagtaattcagcagatgtttactgatcatgaactgcatgccatagattatgccaagccctagaaataaatatgcatgagtgaacaaacagaagtggtccttgccatagaacttgtattactattgttgttattattgtattaaatcacattattatagctaacaatgcaccacaactctgtgaggtaggtactattattggtgaggtacagagaaattgttatttattcatgtgatttatcccaataagtactgaaatcagatttaaatcaggaattttgttctcttaacccactcccactatatttctcacaaataaaataattatagttgtgacaaagggccacaaaggaggagtgaaagctaaaatgagtagctgtaacaagaaatttgatttagtcagagaggtaatgaaggcctctctgaggaagacattaaatatgagacatctggatgacaggagttagcctgtagaagaaaatgtcccaaatgtaattgcacagcacatgccaagatcctgaggtagaaaatggttaggtggttagagaaactaaaagcaggctttaggctgtaaatgagataggtaagaaaggaatactgatggagcagcatgtactgcagaagaacgggtttatccccacagaggcacaatttgttgaacagtataactttgccatatttctaattatagttgcttcatatgtaatcagatatcttcatttaaaaatgcatattattgatagacaatgaatgatttgaaagtaggaatatcattagctatgagattccccaaatgtttcctattcaagatcaaagagacctggagatacaaagtattttaatctataaatcagttacttaa

SEQ ID NO: 30649 - DNA, 611 bp, Bovine  19866880340143
aggttttcctatgaaaaaggaaaagtttaatggtagcacataattgtactctctttcttacttggtgtttctgcttgtcatgctttcagcagtaaacaaaaatgatatcttatctatagtgtctcacatgtgctttgacttttcatctcacactgattgtttttatctagttagcacagactcagaaatatggacggctgctaacttcaaaagtcttaccaccttgagacacgccaacagagagtctgaaaattctaattctgcaaattataaaacatgggaatgttctcagacagacattttgcctcacttttgagaaacattggtcatattatgcatgccatgaaagacagtccctgcaaaaactgtcatggggttcaccaagtcacagtagaagacaaaacaacttatttccaactgcctccctcagcacaggcagttatgcacatggttttgcattagagaatctccttttgggctttagttaatttagtcctctagttaattaaatattctccctttatcaagtgaaaatgtatacctatgttttcagtgaatatcagagcagtgtccatagagagacagtcaatatcaacttgacctccttggat

SEQ ID NO: 30650 - DNA, 1161 bp, Bovine  19866880412557
actgataactcatagatcctaattttgtaagaacaattgaaattttatttcctcttacagatcgtcatttgtctacatatcgataccaattctcgtcgctcttctgcttactcatgtttacagttatcattctacaatttatacacatgaagtcagcatttcatttcctggaagaatctagcgtacacataaacttgaatatttcactgtgaactctcacttctagatgagttatacatcagtgcattgagaccatgggcagacagatatccaaagcttcaggccatggtactaaatatgtggccaggctctttctattgatgtgattccttgtttttgatatagaaatggcagaaataagggtggaaaaggcattaccaagatgaaaaagacattattttatagattcttctacatagttaaaatggtcaatattaatcatatttgtacaataaaccatgatgtctaagaatcagtcattaggacttcctttgggaaaagctcaaagatatttattttaagaatgtagtttcccagtaaagactaattagaatatggaagaaaggacaatcacaatgctacaaaaagtagcattaagaaatacaaagatgtttgtgtcatcactcgtgatgattttaaaggttctactataggcctataaacattaattaagaatttagtaggtgaatatttatataataaagccactctcatttactaataaaatctacattccttatgttttcctcacacacacaaaattatacagctaaaataacaaagatatttaaaaatatataagcattagactaagaggctcacttactagtgataagttagttgcaaggctatgcattccagtgagctttagaaaagggacagaatatgttgtttttcgactgaattagtttgccttataaaacagatgtttaaaaggcatttattgaatcttaacagtggaacagaaaatactgcaaggtgaaaaacaatgttttcttaattaaagtgatgactaggtagttagaacaatgataaggaaactgacaccttaatctatcagtacctatcaaatagaactattactgttaaaaaatgaaaatttaactactgtccttgtgatgctggtctttgtacaaagatcataatatgattttattttaa

SEQ ID NO: 30651 - DNA, 755 bp, Bovine  19866880468524
aaaaagcacaacaaacataaggtcgggttctacattaaaagctgatactgttagacacctacttcatattaattactaaagagtcaacagatggtaatggctttctaccaacccaggacagatttaaactggtgacgtataattgcagttctccagatcacataactccttaagttaattactctattttgtcttctatcattctgccctacttgagataaacaaggacaggctcagataaaatggattaaatattattaccaaagaaatgggaaacaaatctaaagaagataaggaaaaataatgtactatgaatgctagtgactcatttttatctttcctatttgacctgccactcttaaactctattttcaacatcaacaccctcactactattacttcattttatgaacagcacttaaaaatcatttgttgttaataatgaaaactactatttttaattatgtgaatgtcatttcaacttaattccaatggaaactggtccttttggcagtctgactgccaaaagttacacctatgggaaatacttgtgtccaacctaatccatttacttcatttgattctgatatcatcttaatgacatacatggatgacataatttgtgaattctgtatttttctatcctattcttccttctgccctcctaattggggttttcagctcaatcctttgccttctacttatttttctccatattcacttccctgtggagcttatttgtactcaaaattttc

SEQ ID NO: 30652 - DNA, 1823 bp, Bovine  19866880542377
tgagaaacataaaatcactgccaagtgtgagactcaggcaggtgcatttttagggcaggcaaaagggaagagagatgggaacgacagtaagaatggtagtggtcatcatgggtaggaaaaaagaaatcttgctggacagatctttttatttttttattttttaaagggtgtttataaaggctgattctaaaaaacaaacaaacaaacaaacacgtaggtagctggatttggaccagggactgtagtgtaccaatccctgttctagactgtaagttaattccagatggtaaaacaatagattcctgccttctgttctgtttatctaaaataaatactccatactatttttaaaaaaggcagattctaaaccatttagattagtgcctccataaattggaagctttaaaaatatacagattgatagatcctatccaagaatttaaaataatgaaataaaatagatacccaccaaggacctactgtatagcacaggaaactctgctcaatattctgaaataattaaatgggaaaagaatttcaaaaagaatagatacatgtatatgtataactgaatctctttcctgtatacctgaaatgcaatactgcaagtcaactataccccaaatatagaataaaaatcttaaaaaaaaattcagaatctctaggaaggaggctcagccacaggtgactctatgtacagtcagacttttaaactactggtctgaacacttacatgtttttccttaagtgccagcaatgtaccactattgtaacaacccagtactgtcagcaaattattttattccttctttctccaaccaaagacgctttgctgctgctgctgctaaactgcttcagttgtgtccgactctgtgtgaccccatagacggtggcccaccaggctcccccgtccctgggattctccaggcaagaacactggagtgggttgccatttccctctccaatgcatgaaaaggaaaagtgaaagtgaagtcgctcagtcatgtccgactctttgcgaccccatggtctgcagcctaccaggctcctccatccatgggatttcccaggcaagagtactggagtggggtgccgttgccttctccaatagaccctttagtaaagattaaaatttaccctgttggtcatggcagaggactacccctcctttcccctccattttccaccatcttctgtagatgggaatcagatgtatatttaactcgcaacattagccagaaagaataattttgtagtgaaagagaatttctctattaaccccaaactgtatgaaatgctatgtttttagagttgtctctgggacagtcattcgcaacctggtgtatgggcaggatttctcagtgtcagcactgctgacatctgagctggacaattcttcgtggcagcaggctggtctatgtattgcagtatatttagtagcatctctggtctctaacaaatagatgccaggtatgacagaaaaatgtttccagacattgtcaaatgtcccctgggagcataggcaaaattgccccagttaagattcactggtgcataagtttgtaagaattcagcccatagcagaattacaatattcacactgaaccttccatttaccacactgagtatcattcattttgacatttatacaatgacaaatatttcagatttggcttatgtctaagagtttaattatatataatataccctaatgccaagtagaattttctattgaagtcagtttctgtggaagagtcataactagtttcctgtatagctttgggcaaaagagaaaagtaaggtctgacacacattctgcaata

SEQ ID NO: 30653 - DNA, 1924 bp, Bovine  19866880546764
ctcagcagtggccacaggactggaaaaggtcagttttcattccaatcccaaagaaaggcaatggcaaagaatgctcaactactgcacaattgcactcaatctcacatgctagtaaagtaatgctcaaaattctccaagccaggcttcaatagtacatgaactatgaaattccagatgttcaagctggatttagaaaaggcagaggaaccagagatcaaattgccaacatctgctggatcattgaaaaatcaagagagttccagtaaagtatctacttctgctttattgactatgccaaagactttgactatgtggatcacaacacactgtggaaaattctgaaagagatgggaataccagaccacctgacctgcctcttgagaaacctatatgtagatcaggaagcaacagttagaactgggcatggaacaacagactggttccaaataggaaaaggagtacgtcaaggctgtatattgtcaccctgcttatttaacttacatgcagagtacctcatgagaaatgcttggctggatgaagcccaaactggaatcaagattgctgggagaaatatcaataacctcagatatgcagatgacacacccttatggcagaaagcgaagaagaactggagaacctcttgatgaaagtgaaagaggagagtgaaaaagttggcttaaaactcaatattcagaagactaagatcatggcatctgttcccatcacttcatggcaaatagatggggaaaccacggaaacagtgagaggctttattttggggggcttcaaaatcactgcagatgctgactgaagccatgagattaaaagatgcttgctccttgggaaaaaagggaaagagggaggagaaggtgacggcagaggatgagatggttggatggcatcactgactcaatggacatgagtttcagtaaactctgggagttggtgatggacagggaggcctggcatgcttcaggtccatgggatcacaaacagttggacacaaatgagcgactgaaatgaactgatgataatatatagctatggtatatggtgacaggcatttattttcagaattatattatgcaatttatagctctcttttgggaggaagtctatcaaagttgtgttgctaataactatgttggtactacttgcaacttaattttcaataattagcagtaatttttcagaagagttcagaaaatatcctcattgttcagtgttctgggggagtagaccaatttcttgaataagcttctaattagtacttatcttcttgggagatgcgtaggtttctagagcaagtttgccaacaagaatctctgttaaataagtaattttaaaattagagggactgttacgatctatcatttgaaaagctccatagattctaccagatgaagaaagttcatattcagagcttgaaacagcctctgttatgaattttaaaaaactaccatattctaattttaactgcattcatagagcaactgtctagtaggctgcccaagccatttaacagtaagtgtgtgttgcggtgatgtacgaacctgaagctcacagtgcctggaatcagaaagacgagtgggtgaccacagggagctgccattgacaagctgaatacatacttctttaattacctgagggttcagattctctatatgaagatagggttaatctcaacagttattatttaaagataataacatttactcttcagatacttatagtctctctacctaaatagatttcaaggttttggaatagtagaaatagttaattaaaaagaaattaattccccacaaggcatctgtcataatggcttgaacatatgagtgaatcaaaacaattttcagttcacaatttgcttctattctgaatattgccatcaagtttccaaaacaggactgaaaaggagttt

SEQ ID NO: 30654 - DNA, 818 bp, Bovine  19866880587703
cgccctggagatacctctgaaagcccgttctgcttctactcgcctccgctggtggcaaccatctgaaaatgggcacttctacagtccctgggttatcgaccaggtcggtcccttcaagattaactattataattttgtcatttgcactgaatgtggctttagaaagcagttaggccaaccccttgctcagtagaggaggtccaggacccacaaattgggtgacttacccaagggcatgttactagattagatatggcatttagcttcctttcattctctggttcctcaaatgtctgagcctataaaaatgaatgacacaacagaaggcccaggtcctgctcatagaggattctgccatatggttagagggactttattaaccgcgattcaaggctataattctctgaaaaggaaaatgtgcaaattagcatttgtgccacatacagtagttcccatatcctctttcctaacctttgaagaaaaaaaataagtaaatctccctaacatccttatgaacagttctaaaggatcttcatacataataaaatgcatatccaatagaactcaaagaacttgttaaaaaaacagtagaatccctgcaaagaattggaactgaaatgccttaggatacaactgttcttaaatagaaattttacttggaaaaatcacatataaccaaattttgcattcccagcttgggtgcatgtagtttccaaaggcacagtttggcccatgaaggctgtgaatggttttgtcagtctttcaatttgtttctgtagcttcttgccagatgggcaagcagaccacataaacaggag

SEQ ID NO: 30655 - DNA, 1018 bp, Bovine  19866880588700
ttcttctaatggcacactttaaaaaaaaatagtatttcacttccctttggaagttcggccagttgtgcttagtggaagttgccttgataacttcagtttgtcggtactcttttgtgatcttaggtcacatctctgtagataccatcttatctcttctgtccaagaaagaggtatctgatacttcattgttctttttattgacaaggttaaaaattggtggggtgcaggtacgggggcagaaatcgttggctaaccagtcttcattgacttaagcgtcactgtccacttagtgctctaaactgttctgtcctctgacgtcttgtggatgtaatttcttacacacctaattagtaaagtttgatcacctaattagtaaagcttcatgaaagaggtgaaggtgatcagttttctctcttatcttagaacagtgttctgccttctactctagagaatggatattgagatcagaggaggtaaaattgtggccatatgaaaaaggagcagggaatcagggtcagtcaagaggagaaagtattgtacttggagaaagatgactgaatgagacctacctcatgttgaaaaatactggttgagcctgagtaaggtaaaatgggggcttcccaggtgatgcagtggtaaagaatccacctgcgaatgcaggagacgcaggttcaacccctgggtcgggaaaaatcccttgaagcaggaaatgacaacccactcattttattgcctggaaaattccatggacagagacacctcgtggactatagtccggggggtgcacgaagagtcagatatgactgagcacaaagcacacacaactatgataaataaactcaaaaatttcccattattgcttgtatttaggaaagtcacaggaagtatcatcattttgttagttgaaggaatttatgagattatttaagacctattactggatttctttaaaggctggcatgattttagaataagcatatgttaatgcatatgaataatcattgcaatatacataaat

SEQ ID NO: 30656 - DNA, 1737 bp, Bovine  19866880614998
ttaaagatgtggcttcccccaatacccttccctggtgacttgttttcctggagtataacaactgattagcatatttatttctgttgttaatgccaagcttgtttgccaccactggctttgcctgattggtggcatttagtgcggtgcttggcagttctctccggagctcttagacgtcagctgtaaatcacctgctcagcatccctgactgcgcacaccatacctcccaccaggtgccctgggcacaggcatccacacactttccatatgtggacagaattttgctcagcatggagggtggggtgaaaacactgcaaattagaaggtgaattcgtagctctctgggcaggcccttatgtgtgtaaattgttccttgtaattggaaatgtgtttgtaaatccctatacacccaagtgagactgttatgcccctgtacattgtttggaaaggaaaaaacaatctgctaaaagaggccaaatatatttatgaaaactgggaagtatgtgtgggctttttgcaaccacattatttcatgaaattcaatttcgatctttcatagagtactttatatttcttaaaaaaaaatcctgaaatctatattcagtgatagcttgctgctgctgctgctaagtcacttcagtcatgcttagttagtggtatttcaatctttagaaagagatcttgatgtcacctcttgtgacatctttatagggaatcattattgtaatctaagctgaaagtctgcctggctttcaggttgggtggggtggtgatgttttagggggtggtagtgaagttgcattgtattggcaaataaacttaagatagcttttactaataacttttgctaagtacaaatgatttttcctatttgatgttctttaatgaaaagtttaattgtcaaactttatcactgaatttatcactgtaactgtttatatgttcttttagagtttcttagtcagagattttcaatattaaaaaaaaaacacatgtatgaaaatgggggttacctctctgtaaaggtgcatgttgatttcaaaagtcatgtggactcttgcagtttccagttgagaacctagaacttttttctacacatgtttgtcaacatacttattttatgacataaattctttctcaccttcctgctgtccacacatctgactaatgtcctgcattgttttatgtggtgttacattctcttatactttgtattctaggcaaatttgaatcgtaaaatcactttttagaaaatgagttatttctttatgaaatgaaagtgaaagtcactcagttgtgtccaactctttgcgaccccctggactatacagtccatggaattttccaggctagaatactggagtgggtagcctttcccttcttcaggggatctttccaacccagggatcaaacccaggtctctcacattgcaggtggattctttaccagctgagccatcattgcctctcaacctaactctgagtcacagaaacatttttctctgagtaagagcagtgcagctcctcatgatcttcttcatttatttgagttatgttatgaagtcctaatccctggtatcccagaagatgaccttatttggaagtaagatcactgcacatataattaattaagatgagatcatactggagtaggatgggctcttaactcaaaatgactcatattttgagtcattaactcaaaaatgactctggactcacagagacacagggagaatgc

SEQ ID NO: 30657 - DNA, 3099 bp, Bovine  19866880642647
acataaccgaatcttttttgttatctgttacaatataactttttatgaactattataaatttgatagtcagtatatgttgatgggcatgaaaatgccatttgaatcaagagatgttagtatttcagagattttgtactgatgttctttctgcaaagaatattcttgcccagccagcatggctgactccctaatctcctttagatatttatgatgatgtcactgactcagtgaagtcctccttagacatctaaaattgcaacctccaatacacttatacgtgaaactcctcccaatctgctttaattttctcattaagaaatatataaaatccaaactatactataatataaaaacagtataagttataagacatatcttgtttgctaaacagtctcatttaacatattgcatttttcatttacatatcttgttcatgaacataaccaaatctttgagtccagcagtggtatttacagagctctatagttttagcaatatcttggatggtactgcaattttcctgaaaaggagtgttacttctctacagtttaaattgttttccccaaggaaatgtggttctttgtgaactgcatttgaaggaatgactgcctagagggaagaactctctacaataaagcaatttatatttattctttgatggctaattctaaaaaaacattccttacattatttattataaatacatgggtatctattatttataatagaatggggcaaagttgcaatacgcaaaaaaatttaataatcaataaaatgccttaaggcaactttgttccttagaggtagaagggcaaaataatatttaatttatattttagtgtatatccttctactttttgtatcaaaaagagaattctttttgtaagcaaaactaatttaaagaagtttttttttacctggaaagcttgtgatcctccctattagctgctttggaatgccttgagaatataattatattttaatcagctcacactttaatagttttaagaatgatacaaaagtataactgattcattttgttgtacacctgtaactaacacaatattgtaaatcagcaataccccaataaaaattaaaataaaaaatgatatggagtaaaacttaaaaattctcaccaaaaaaaacccagaagtgaaatgatagatatgctaattaattagattttatgtttatatatatcaaatcaacatgatgtacacttcagatatcttacaactttatatgtcaactgtatctcaataaagctgaaattaaaaatagtgttttcataagctaaaaaaaaatgatgaatactcttcaaagggcaatctggcagtacttatcaaaatgaaaattacatatatacatatatatgtatatgtatatatctgattttctaattgtcttttttcttcttttaggaatttctccttcagaaatactttaagtatacaaaaaatctatcacaatattctttgactatcaacagaggtccagatagataaattggtacagtgacattctgaaataatgatatatattcactgactaaaagagacattcataatatattgttaaatttttaaaaatcaagtttagtaaggaaaatttgaccctagagagtatttttgtatggtcatagaaaaatttctgaatggatatataccagaaaacatgtctacattttaacagtagggattcacattggaagacttttaatttttactttacacatttcctttcttttgcaaaaggaaaatcactttcagaaaaaggaagaaaaacattcaatttatatgtgttagaattcagaatgaaaagttaaattatttcatcatagattgatgaaaatactaagaatatgaacatagggaaacagaggtcttatattttaaataccttttcccccctactacaaatattgggtacaaaagcctctaaaaggtagtggaacatttcacatgatctatgaagatctgtttttattatattttccagaatatattaaaccacctaaagttgatgactttaggcttgaactaagatatagaatagagcctggctataagagcctacatttaccagattcataacatttttttatctactagaaattctctgagactgaataagttcattacatccataaggtctctatttgggatgaattctttgatatttaataaggaatgtgccatatgtaaagattcttccacattcatttatattcatgaggcttatctctagcataagtcctgtgaggtctagcaaggtgtatactttgactaaaggcttctccaccttcattgcatttataggtttttcctccagcatgacagcttaggtgaaggtaaaggatgagttctctttgaaggctttcctgtatgaactgcatttaaaaattcctttcttcaattggttctgctatatttcactcaaattcaattttgtcttaggtttttattacatgcattatttttatttacactcttgttggaataacattaataaagagtattggcttcagaatggtagaaaacactcagcttcctcaccaataaaacagaaatatgacctagactgaggatgtttagagaaaaagatatatcgcctggcatattacagtttcaaataatgtttgtttccttttctccccacccccaccacctcgtaaaatatagtgctatttttgttttaaaataagtcaaagtggcaattcaagtgaacttttaaattacaatgagtattttttcatattagaattagcagagcagcaatcttgcacaaagttgcagtacaacatgcaaaatgtaattgcttaatcaatcaatttaagcaaggccatacttagctgaaagaaaactgtactttctatcagtgggtcttttgtacagtccaagatttgggctacaaacctatctgggaatttaaatttattacttatgtgatctaaatggtcaagtggttttgctttaataataacgaatgtgcctgttaaaaaaaaaaaaaaaaaggagacccacttaatacaatgttaactcagactgtcaatctgtccttgattcacttatcctgaattataagcttaaataaaatcc

SEQ ID NO: 30658 - DNA, 1319 bp, Bovine  19866880649245
gaataagcgtccccggcagccggatgccccacgggtcccggctaaggcccgatccgcaggtggaggtgtgtggggcggacgcccgcggcccagccgggcgcccgttaactcagggtcgccgcacagggtcctgcgggtaaggcccggtctagcctgattccaggtggcacccagacaagtagacggaagctcacccgcccagcagcgcctccgattaggagcctctcggtgaaaccgcaaagccgccgccgcgccgcagaaaatagcaccgctcgggccaccgccgccgccgccatcgtctcagtttgggactgtaggaagggtgtgcttccggggtcatgacctgatgtcccagaggagagggcggaccccacctagcgaccatgatgggaatgacagtcctgtaagcggtcttggaatctttcaggacgtggtgctgactgaagaacacgaattagggagtctgtagaagcccctgtatcagcggttacttttatctcctacgacgtgcaagtgcacaaatgtagaaaaaggtaacttggggcaacatattatcccagtggtgggtaaaattgattggaaaaggagggatttgatccgtaatatgaggaacatgattcctcactgtccttagaggaagtctctagtgcatgggacgggcgtggtaaggggagagaagcaagtatcagtgttgacacctattcacatttcagcaccttacagtctggctcatcccatgccacagaaattgttgtgaagccactaactgctgaaagatggacatacaatccttgacatggatttctttcttcattgtatctgtttaaaatttttgtttatttattttcctgcatggggtcttagttgcagtacacggggttcttccttgcaaagcgcagacttctctagtggtggtggggctccagagcacgggggctctttagtttgggcgcctgtagttgactatgaactattgtagctcagtaattgctcgcggtgggtgtagttgcactgtggcatgtgagatcttagttcccgtgaccagggatcaaacccatatcccctgtgttggaagaggactctttctgttaagatttgtttgtttgtttggctgtgctgggtcttccttgctgtggcagtggggctttctctacttgcagagagaagggtgctattgttccattatatactgttctgttatcttgcacgggcttctcattggagtggcttctcttgggctcagtagttgtggcacacaaggcttagttgctctgaggtatgtgggatcttccctggaccagggatagaactgtgtccag

SEQ ID NO: 30659 - DNA, 2744 bp, Bovine  19866880683089
tctgttctgcttttcaatctctctcttcttatcatgacattctgctttttttccccttcatttaaataagaaaactctttccaagaataaaaattataccagcaggaataaaatgcctctacaaaaaggatgaatgcatatcattaggtttacattttcttttttaccacctggaatacatttcaaacacttgggaaaacatttagaagaaagtatccgttgcttcacttctagaaggaactgagttatcaaaagcaagaactatattcttaatttctcctcttttcactgaatcagatatttcataagctctatttatgcaggtgcagttgtcattatctccttctttaaatggctcaccagctctttgggtactgttttaaaaccgctgctttacatgctgctttcgtctgtctctgtccaaaaactgcataatgattctggtacttccagtctttgggtttaagtgttttcaggaagagaaactactctaattgcagttcctcatctcctgtttcctctgacccctcttccttgtcctctggttgaaaggtcagagtgtggtgatggcagtgctcaggacccaccctgcacacacagcagttcgcgtcctaggggcgggcattgagcatcctttcttgctctgcctcccagtctcagcctcccaccttaactctgcagaacccaggatccagcacatgaagaaagcaaaccacttccagttggagacttcctggtatggtcatttctttcagactttcaaaataacagattgctttgattttctacagactcctccagagactggaaaagatgggagtactttctttctctccttcagtcatattcattctgaaaatttagtgccagaaacactgacaaggatactgtgagaaaaaaaaatttacaggctatctttctcatgagtatagttgcaaaaggtcctacagaaaagtgtagcaaagtgaatttaagaatgtctttaaaaagataattacaccataagttgagtttaccctagggatatcagaatagtttcattctagataacctaaaaatgtcatctaagctatactccaatactttggccacctgatgtaaagagctgactcatttgaaaagaccctgatgctgggaaagattcaaggtgggaggagaaggggacgacagaggatgagatggttggatggtatcactgactcgatggacatgaatttgagcaagctcccggagttggtgatggacagggaggcctggggtgctgcagtccttggggtagcaaagagttggacatgactgagcaactgaactgaactgaactgaaccgaagccactctctcagtccgcccaacttctccctcccacactgtgtccacaagtctgttctgtctgtgcttccattgctgccctgcaaatagcttcatcggtaccatctttctagattccatacacatgtgttaatatacaatatccatctttctctttctaacttacttcactctgtacgataggctctaggttcatccccctctttaggactgactcaaatacacaaggagctcaatccagtgctctatgacaacctagaagggtgggatcggttgggagatggaaaggaggttcacgagggaggggacatatgtatacctgtgaccgattgatgttgatgtatggcagaaaccagcacaatattgtaaagcaaatatcttgcaataaaaaaattttttaaaaatgtcatctgttaacagattaaggagaaaaattttataacctcctcgatgaataagtgcataaaaacttttttcaaaacccattcataacttttaataatatctcctagtaaccaaaattaggagtaaaacttcctggaatctaatcaatgatgcactaaagcatcaaaccaaatggggaaatgttagaaggattttcttccaaaagaagatcagaataagatgccaactatcataaggtctacttaaggatgtatgacagtcccagccaatgaaaaaggcaagaaaatgaaatctaacaggggatggaataagaggagtggtcagagcatacgtaagagtacacaagaggtgtttgatacaggcagccatggagaagctgaggattaaatggtgccctatcaggagcactaaacataaagggaagtggataattttaatgaagttctttttatttgctcatgctactctgtacaatactttttcaaagctagcatactttatcaatgaaaaaagtaaacaaattgagccagatgtttaaaagctttaagaaaataaaaatacttgtacaaacctgaattttctttagtaccactggtgtttcctgatcccatacgtgattagttcccccatcagtaatatatgctttacatgctgtcaccatttggttggttacctaaaataaatataagtccaaaataactatatatagagaaagaaaaaaaacaagtttttaaaaacatgctgctgctgctgctgctgctgctaagtcgcttcagtcgtgtctgactctgtgcgaccccatagacagcagtccaccaggctcccccgtccctgggattctccaggcaagaacactggagtgggttgccatttccttctccagtgcatgaaagtgaagagtgaaagtgaagttgttcagttgtgcccgactcttagcgaccccatgggctgcagcccaccaggctcctccatccatgggattttccaggcaagagtactggagtggggtgc

SEQ ID NO: 30660 - DNA, 806 bp, Bovine  19866880754294
attagttttgcccaaatatcaaaatgaatccgccacaggtatacatgtgttcccccatcctgaaccctcctccttatgtcttttctgtaaatgtgttttggtttttttcttctatatttggactaacaatatctatattattagctatttatgaacagaatgtgaaactgccttgtattgccactcaattcccatgcgtctggtatgatattccacatatgctcataggggacccagtataacatgcatgaattaatactaatgaattccaatgcttacaaataagattatgaaaatctgtattgatggttacattaaacaactgaatcttcaaatgtaaaaataaggttggattaataggttacatgaaataatatttcacaagagctaaaataaaattgtaatttatctgtgtttacaacagctttgctctctcccaagtgattatatagatccaatcctaggttttttccttcaaaatatgggggactctagcagattatatagcagcttgagtagaaagtgtatttctgtaggcattcaaaagaactcaatgtcaaattcttctcgggcataaatcttgatattttgactttggactagataaagctgtcaaagagggaatgtatatagccctgagaactgaaaagaaggttgtttaaatctatgttcaatcatcttagcataaacagcatcagtccaaaacaccattcttcaggaaattaaaaaaggagtcagacccacctagagccagtggcaaggaattttactgtggccccggttagttctctctttatcattccctt

SEQ ID NO: 30661 - DNA, 897 bp, Bovine  19866880869048
tcttctcactgccccatgcccctaaatggaaactccatgtgcgcataagaaataggattcttctttgtaaacaattcacagacctcaaattttcttttaattaaataccgcagcacacaccaatctcagtcatagcccttgagtgaaaaacatcccaagacttggacttggcaccacaactgccccagtgtttgatgctcccagaggctctgctgttcccccacaaccagtgcccactggggtgtgccaggctgatcgggttatattgaattgcagggtaaatataacggagcacagtcttcctagagtagcatttattttccccaaaggtttgcaaatgacacaccactgtaggaaaaatggatatgggcttattatggaatagaacaggaaatgcacataaatttttgaggaattttgggggtttacttccagaatctgaggggtacaagttcactcacttctgccaattggatgcttcgggggaaagttttagaagcccttttcttggaaatagcccctatctccagagactagaggctggacacacccatgggcaataacagcctcctgaatcccttctgctttcagtgcaacacagttccgctggatccagaagggcgaagaaacagagaagcagagctgggcaatcgatcacgtgtacatcggagaggcttgccccaagctctgcagtgggcacggatactgcaccaccggtgccgtctgcatctgcgatgaaagtttccaaggtcagaatcctgttttgttgttcttgacccaggagactatagggttctcctcatctcaacatgtgtgcaaaggccactagggaatggatagaaactctggcctgagggatttgagatagatgatgcactctttgatcatgacttattt

SEQ ID NO: 30662 - DNA, 1862 bp, Bovine  19866880899262
ctatacttcctgcaacacgtgaatctctctgccaggtgtctccattctcaacgctgaccaggccagccctagatagaacagatggcccagctggcagcatatgcattttcatcattttgtagtttctcacaggtgcgatgagaaggtgggataactcagtgttttctaatgttttcataaccttggctgctgtctttcccatgggtcaattttgtcttggacatatttctaaattttaatatttgacaactgaagacattggtaggagaaataagaacgctttcctaaaaattgatcctccacacaggtaatcatacagctggctccttcccagacatcattaatctcctttcccttgagccattttttccccacttacatattactgcaatgtttatcaaaatatcataaaaactgcttgtaagcactttccacaagctgaagtttaatatgatagtgtatttaaataagacattcattcttttctaaagtaaaaaaactacaaaaatatgtttcttcccaacagtatcccacttgtttttcatctgtgttacttccagactacaaacagatggctgatttaagcagtcagttttaacatccatcgtcacaagcataaaggtggcatagcacatctaggtagaaaggcttacagatcctaagtgcaatttataagtaactttatttagaacctgtaaaatgatttaaaacacagatttagaattttatacctgcaaatacttcacatctttttaaagctgttttatctgttttatttttagctgacttgtaatgtagatcatgaatcattaccattcagttcagttcagtacagtagctcagtcgtgtccgactctttgcaacccatgaaccgtagaacgcctggcctccctgtccgtcaccaactcccggaatccacccaaacccatgtctattgagtcagtgttgccatccaaccatctcatcctctgtcatcccttctcctcctgcccctcaatctttcccagcatcagggtcttttcaaatcattaccattacaaagctacaatttcaactgcaaaaaaattaaggcatcaataattataagcttcgtatacacaatatccatttcattaattttttctccttcaaaggaagaatccttgcattaccatcacaattatcactaccgttgtcgtcagcagcagcatcttacatagtggtgaagagcacaatggttaagagtatgagctctgggaagtgggacctaggttcaaatccctgttccttcccttcctagccgtgtgacccagaacaagttgcttaatttctctgagcttttatgtctccatccaggacttaataagccctcaataaatatactttgtttgttgtctgccagttacttctcatagtacaccaaggcctctcctatcttaaacaaacaattctttccatctccatctccctctagctactgttctctttctcatttccttacttcctgttaaatgctcaatatgtcataatttggcctctgcttctactacaagtggtcttactgaggtcattggccacaagttctcattgctaaatctaatggacacttctcattcctcacctccttggactgcttgggagcatttgatcttgttgatcatgttgttcttctaaaaactctctcctcctttaatttctgtgacaaccctctctcttagttttacttcctatctctgtctgctccttctgatttcctataaacctctcctccttagtagaccctaagtaactgacatcatcaacaccctctgctttggattctttctggtacaacaaatatgaccctctctgatctatccctgcttacttctgcagcttcagtt

SEQ ID NO: 30663 - DNA, 3081 bp, Bovine  19866880910564
ctcaggccacctaccacgctgcttccagcctctgtgcctgtgcccagaattacattcactctgacaaggaatgctgtttcttttccctcactctccttccatttcccctacatcctaatcatctttcaaaagccaggttttgttctttgctttcctgagtccttgctcacctctaatctcccatgaagtgggtctctactcactgttatgtataatatcctatctctcccctctatataatcatcggtttcctcttctagactgtaaatccctcgagacaataccctgaattcccaggacccagctcagtccttgtctcactgatgaacacacacagtctttgtactggtgcatcatggttattgatagtgtatgtcattcttcctctctgtacttcacattatagaagactaagattactctgacatttttatttaattatttttctggagacctcttcctttattgtcttctagcctgtcatagaaagataacttcttccttcacatagccaaagagaaaaagatcaggtagatctgagagaggtctcataatatgaatccctattgcaaaaatctagttttaccactgattttactgttactcttcttgaatttgcccagttgtcaatgggatgaattgcaatgaattgggatgtgttatcgtaaagtgcagcagtgaccaaacctgccctctcaccacaatgttctgggcaaggttttaaaggattagtgtctggcctcactctgagcctcctgaattagggtcccataggtgaggtctggacagtgagtatttacttcacaggggtgtgggcatggatccctgtacctgagtacagcaaactgctttgaagctttcagtgcaacacaataggtcatgttaaagtatagcagaagaaataaaacatttctaaaatattagacatccttatttttattctcaaaagtcctttggctccccccaacagaaattcctcatttacacctattactatgaaggtcatttatcatttcctcatttctcttcctcctagaacctcaaaattctttctacctccttaagcatggacagaggagcctggcgggctacagtccatgggatcgcaaagagtcagacacaactgagcatgtatgcaggttcaggttcattaagcagggtaattatgtgcatgttttaaatgttcccaggaagattcaaaacatcttttgaatctggctttcaattctccctaaacttggaatctcctgaggtgctttttaaaaacttcaatgattgggctctataccagaccaattagcacagagcctcccagcagagcctctgggaggtggggcccagacatcttttttagcgcatcctaagatgaatcttggagaaggtgatggcatccaactccagtactcttgcctggaaaatcccatggacggaggagcctggtaggctgcagtccatggggtcgctaagagttggacatgactgagcgactttattttcacttttcactttcatgcattggacaaggaaatggcaacccactccagtgttcctgcctggagaatcccagagacgggggagcctggtgggctgccgtctgtggggttacacagagtcggacacgactgaatcgacttagcagcagcagcagcagcagcaagatgaatctaatgagcaggtaaagttaagaaccactggtttataacctaagacagacatgtatatgaaaaagacatcagaaaatcacaaataaatatttgaaaacaaagccaattaggaagctcttaggaaattaataatgaatcagtgacatgattaaagacagatgagattttttttaagtaaattttataaaatgacatgtttgctgtaattcaacataacattatacatatatatatatacacacacacacaccatgatataatatacttgctgaaaaatacatgaagtaagttatgaagaggaatgtgaaatataaggagatgatttagcagtaaaaaatgtatctttgcatttgccattttcgttctgggcactggttctcagccctggctgcacattggaatcatctgactctactgccagcaattctgatttacctggtctaggaggcaggcaaggattgagatttaaaagctccccaggtgattcttaatgcatagtcaaggttcaaaaccactgacttaggagatggcaatatatacactcacacctacctatcaaaccaaacaaaaagaaggaagctgaatagggtataaataaattgtgtgcaatgcattactattactactctttgcttatgtgtatctttgaaatacttaataaaaacttacaaaggagagaattatcaagcttgggtttctacagaaaagtcttatttctattcttatattctcacaacaaaagggaattgtgtataggtgggcagtgcaaatgctaacattttatgaaaatgctaaagaaaactgaaatcttagttattacaaacattccattcaagttttaaaataagagcaaatattaaaagaatttagaccccaaaacattagatgaactaggaaagccttagctatgtactctctgcagagttgccaaataaattataggatgtctagttaaatgtgaatgtcagataagtaacaaatggttagtataagtatgttccaaatattgcatccttatattaaaattttattatttatcccaatttagttacaattgagtatcttatattgtcctttgctaaatctggtaacaaatggcaacccactccagtgttcttgcctggagaatctcagggacaggggggcctggtgggctgccatctatggggtcgcacagagtcggacacgactgaagtgacttagcagcaggtcaggaagagacacagaaaagaggggattctcaaactcttttgaggtttcaggatcctggctacaatttttgtcctccttgagatatctatttggaagttcaaagatgtctcaactgagaaaggaaaaggactgctgggaagagtaaagaagaggatgttataataaagattgtcctttgggggaacttgtatgctcatcacaagaa

SEQ ID NO: 30664 - DNA, 1412 bp, Bovine  19866880919103
tttgcctgcaatccgggtgacctgggttcgatcgccaggtcaggaagataccctggagatgaaaatggcaatccactccaatattcctgcctggagaattccatagacggaggagcctggcgggctacagtctatggagtcgcaaagagtcagacacaactaagcaactaacacatttgtctttccattgaagtgtaagctcactgctctgcctaacacagtgtgtgacacatgaattcttacaaaggccatataggtctttcattccaaaaatatctttagcagcatttcagaggttttgataagtagcagttccactgtcatttggttctaattatttcataattttctcttatccatgggctgcttagaagtgtttttagtttccaaatgtatgggggttttaagccatctttagttatcgattgctaattatattgcaccatgtgaaactgcatttttttagaagttgtggtcagctgtacatgaccattttcaacatgatcagttattaccattgttacctacatgcttgtaaataatttgtattttctctgagttgggtggaagggtctatgtacattatattagattaaactggttaggtgtgttagtcaaatcctttatagacgtccaattttcgcatgcttgagcaagcagtttttgagagagagatattatcccagaatgactttaaattgacttccttggtggctcagatggtaaagaatctgcttgtaatgcaggagaacataagagacacaggttcaatcctgggttgggaagatcctctggacgaggatatgccaacccactctggtactgttgcctggaaaattccatgggcagaggagcctagtgggctactgtctatgggaatgcagaatcagacatgagtaagcaactttcactttcactttcccaaagagaacctaatctgatcttatgaagaagctgtctctggagctaattaggctaaagttgtagtcaccaaataaatacctgacaaaaaatttcttgtgaggtagatagtatcacatattaatgaagtgaaactttaaggtttaattccccttgtaatgctcttctcagaaaagccttagaatgactaaatcttctccattctactgaaattcttagaaataagcaaagtgaaccttgagatacaggagaggaggaggaaaaatacagaagggaaacaagtgccagtcagccgggaagttgcttacttacatacaccactgaaaagatcccactgtaccgctttgttttaactccaaacaggtattttaacatggaggtgaagacatgcacggctgcagcagtggtaaacccacggaccaggggctccgtgagatatatggccacaaatccaaatctacagacacctaggcaaaactttttttttttat

SEQ ID NO: 30665 - DNA, 1283 bp, Bovine  19866880951175
ccacgtcagtcagtgctagaagtggaatgctgggttggattagccaagggatcctgagaatgtgcttgaactacagtatgtgagatcatccccatttttaattttagggatagctctgtcctgacgggatctgtcacttcttttttttggttttaatttttatacggtagttgatttacaatgtagttgtgttagttttgggtatgtagctaagtgatacatatttatataaatccattcacagagtattacttaagagttccctgtggcatgcataggtccttgttattttatatatagtggtgtgtatacgttaatcccaaagtctgtgagtctgtttctcttttgtaaataggttcacttgtatctttgttttttaatattctacatttatataagtgatatatttgcttttctctgacttagtatgattattattttagaagtgggtgcaaattctaaggattaactcttttaacattatgactttctctgaggatgatgcattgggctggtgaggtaactataattcttagtttcattgaattttcactttttattgagatattgctgaataaaactgagaaactcagcctttttgggcagtcactatttctacatgtcatttttctttctggtagtctgcacatgtatacctacagttcttctggacaatttcttttcctttcagaatttatctagcaagctggcccagcttacctgtcatggcaacctctgccatagcttccagtctttcaacacttcctacacagatacaggattgtggggaatctatatggtttgtgaaccagccactgttgcagatatgctacatgttgttcaaaaagaatggtgagaaaataatttaaatcttgcttaagaattaccaattcagactattttcttttacactgttgacggtgattaattttttatggtgatagcattttattaagagaacaagactaagtactgttctacagtagcaactgttgcaatgttttaaagatcacatttcttctgggtttcatgtgaagctgatttatattatagaaacttctttttttttttaatattttgctttatgaatattcacagagatatttaatatccaaagagatctttttttttttcttttcatgtagacataagttgtcaaacatcttaaaacctataacttgattatcatcccttatgggaagtccctgtagcaagtttttactaccatactggctcaacatattgtaattcatacactatcaagatctctgaaaaatcattgt

SEQ ID NO: 30666 - DNA, 1911 bp, Bovine  19866881029376
tcacagttaatcttcctaaggcacaacaaagtgtgattgctcaaaacttggatagcctaagactttcttctaaaggccagctttttggagtgggtttgagggcactttcaaatcttgcagtttatcaactcctttcttgtctcccattacctctgcctcctgatgatcacaaattggcagcatatcccacaattccctaaacattccctgacttttctctttctccatgcttttcccttagcttggaatgcgtattctctcaaattcagttgttaaattcttactcattcttcaagctgccattcattcttaagtaaaaatcttttataaagctttctgagatatcagcaacataattgatgtgtattgtcacattttgcttataactctgttattcgtgtgtactaagtcacttcagtcatgtctgactctttgcgactctatggaccataacgagccaggctcctctgtccatgtgattctcttggcaagaatactggagtgggttgccatgccctttcccaggggatctttctgacccaggtattgaacttacgtctcttacgtctcctgcattagcaggtgggttctttactattaatgccacctgggaagcccaactctgttataatgctgactatattttactatttacttatatttgatttaaattcttgctttttctattagattagattggaaaaggacaaattcttatttcttcatgattcctcctcagttggttcaaggacttatatacacaggaatcacagaaaatatcctttgaattctgcatcctaggagactggggaaggggttattctaggaccttccacatgttctcaagtcccttatattaaacagcatggtagagtggaccctctatatctatggtttgtgtatccagggaaaaatccagggatattgagtgccaacattgtatcttttgtacaatgttgtctatttctttagtttaatagtaacctctgactcttttttggcacagtttgtcttactcatgttggcacttattaggataatttaaattcttgctattcataagctcttcatttaaaacaagaattactttaaaaaaaaacacacaaagtaaatctgtgccagctgtacagaactgcatatttacaaatagatacagtttttaatttaatctgttttaaaatgatatttaatggcttgtggcatcactgttcctgggatatcaaattgtattctcttagaaataatgtattgtgtgtcagctccaaacaatattttattagcatttggtaaaaaaaaaaaaaaaatacaatttggtaataggtaatttttactgattacaaagaagtttacataccctcacttatatttcctaataaaattttgatgatgcactttgcacctttcaactttcttagtaaatgtttaagtctatgcttattgtaagcaatgactatgttgaatgttacataacatagctgccacctgtgtgggcaagatgtttttattgatctcttttcctaattagtttgtgagagagtgtagggaaactgaagattaaacatgaactactgaacaattcatttgaaattttctgagctaaagtcttacaatttcttacctttgtttcttactgtagtatttattacatgttgagtagagctatatgtaaggatcagtatctgtaattagtatgtggccagcaatacttgaagaagatttctagtgttcaatattaatttaaacattacacacacacagaaaaaacccacaaaatcctatggcatttgaaacataaatatactttgattctgtattttctgactaacccccaaaattaaagcttttactttttaagatagggaaaattacttttagtaaattaaacttcaaccctacttacagcttttgtaa

SEQ ID NO: 30667 - DNA, 2035 bp, Bovine  19866881050178
acgcaacattcaaaaaacttagatcatggcatccggtcccttcacttcatggcaaatagatgggaaaaagtggaaatggtagcagattttatttttcttgggctttagaatcactgcagatggtgactgcagccaggaaattaaaagacacttgctccttgatagaaaagctatgacaaatctagacagtgtaataaaaaagcagacatcactttgctgacaaaagtctatctagtcaaaactatggtttttccagtagttgtgtatgaatgtgagagttggatcataaagaaggctgagcgccaaagaactgatgctttcaaattgtagtgctggagagaagactcttgagagtcccttggactgcaaggagatcaaaccagtcaatcctaaaggaaatcaaccctaaatattcattggaaggactgatgctgaaactgaagttccagtactttggctacctaatggaaagagccaactcattggaaaagatgctcatgctgggaaagattgaaggcagaaggaaaagagggtgacaggatgagatggttgaatggtatcactgacttaaaggacatgagtttgagcaaactccaggagatagtgaaggacagggaagcctggtgtgctagtatggggttgcaaacagttggacacaacttagtgactgaacaacaacagcagggataaaataattacttaaaaacaaaataacatgcataaacacagagtgaaagaaatatgcaaaattgaaaattgcctttgagctggcaaatactgataacatattttctaatattaatgtttgaattgaagtactattataaaattatttgaacaaaaatttctctaaaaaatatttgttggatggatgagcaaatgcatgaatatacgaatgaaaaacataccttaatgcataaaggtaccagaagactgtgttagaaaattaagagtttcttctatgttatttaaacttccatgcatgcactcgtgacatctgggtttatgttgcaacattttaaatttaaagtcacaagtctacataaaacttttgctgttaaattaaaaaaaaatagtttgaggaaataaaaatatttaaaccacatattttctggaattcgtagatcatcttttaaaaattgaagcagttcattttgagaaattgtcatatttaccactgagaaatattgaacaaaattatttccatctccatttagcacctcacaatactgagatcaggttttgtttatccacattggcaagtcctaagctggaaacaaaaatgtgttagtcaaatctcttccatttgtctccactactggtatttatagaagggattatgaataatatgaacataccagttatctgggctgacatatatttcaaagagcaatgccctaaaatattgtgcgaaagataaacagtagaaatgcttttaattaaaaatgtacactgtagttgcaaggagttggtcccttaatcaacccctggttttaacgtaagcaaatatattgaaaatatggctgtaaagctaagctacataagcctttcttctaaatctgcctgcaggcattaatgctcagatttgagatggcatccttatttgctaagtgcaaagatggttacaaaagggcttttctcactttgaggataaaagctaaagtattctttaattttggttactgcctggctcctctcagcaccataatagttatttggctcaaaaccaaaaagtagcaatgcagtgcttacatgtctatggatcaaaattagatgaaaaattgctgtttctcatctccaaagctatttgctgcacattttataaccctcaagatgccttttgtaatatatgataacagagccaactgcagcatctgcctggaaagagattactttaattatggactcaatgtcctattttctgcaagtgatccccagagacaggcttcctgccggaggagaggtgcaaggatgcacattaaagcttacatgtcaaccatgaagaggtggataaagtgagacaaggacacccata

SEQ ID NO: 30668 - DNA, 1478 bp, Bovine  19866881071403
cttgaaatgtaatatagttaaaatgctactatatctaggacccttgtattcaaatactatataatagcatcagattaacactctttgctgatgagacctcatttagagttccttgattacagattacaaagcagtaagaaaagggaaagattagtctgtattatatgtatgcatatatactacagcccaggaaaatccagtgctagccagctacaaaatgaaaaaaaaaaaaaagacttcttttccttcaaaatacatcccttacctgtctgaaatagtgcatgaggttttcatctttaagatccaccacttttggttaggttgctgttccaactgttcccattaaattgtatactagttgcctgggaagaataaatctggaaatgaatttgtttgaaacattctttagcaaccaagtcgcagaggcaggagtctgagtagaggaggcaggacagacaaatgtgtggcactggggaatctgtacaaaggttggaagggctaggtggggccagatggtgtccccttgggcagctagaggacttgttctgaggacctggggagagagagcagctgagggcgagggttcctcatgaggtggaaactggtggggggtgaagaggttagtgaaactcacttgaactcagtgttttctgatgcacctaagaaggcaaaatggctaatttttatctattttctactggtcctgtagaggcaacaaggcaaaccatttgaataactagcctcattgtcaccagcttattcctcacagaaatgctgttagctcattcaagcgctttatggcagaatcattcactggatagactcataatttggggcactaaaaaaagttctattggattttaatacgtgaaatgtgtttccctctgatgaaagaagttttagggttgattttttttttaattgtgttatgtctgccaagggaaattcacaatgaattaattctgctcaatgaatttttgctcttataaaaaattgttttaataccaaacattgcctgttccaaatattgtaccagaggcatttatttacaacctggtacatatgtagtttgagcttcttagcataacttacagtgaattaatgacttgttatttactgctcaggcactctttgggagtgatttatagggctgtgctgtgcactggcggttacttttcagtgtctgtgctggctgtctcatcaatatcattaaatgaattcacagtgacacagctctgctactgtagtttttgatatgagggataactgaacataaatcaggacttatgtttaattcataagatgtaccaatctctcatgtaggcgtgagttaggttagaggatgtcacagatgtatttcacagtacctcttgtgattaaacccaagcttttctgtatggctgtatgcaccaggtaaaaataataggttgctatacactatgccatttttcaggtaaatgcaattattttatttaggt

SEQ ID NO: 30669 - DNA, 1384 bp, Bovine  19866881073586
tagctcctgaatcattttagaattcaaaggccctaggtagttttgcctcaggatctcttcacctaatttgaaattcaaatgtatgaaacttccaaagctaaatatgacaaattagacacagtctgtgaagttaccatttaatgagctatgaacctagactttcatctccccaggaataatttctttattacttttttgtattttattgcaataaagcaccatttgaccttcaagtatgataattaagcttccaaaaatgttataaatttagagtgaaaatagttctctgtgtattcaggaatatacttatgatcagtataaaagattacttaatatttaaagatagttaaattatacacagaatcagcaatattagaaagcatttttctcttcccttcctctcctatttcccatctcaatttgatttgtgtctcataacaatttatcatcactcatattctaaaatacatgaaagaggagcaaaactaaaaaatatttttgtaacctacaaatggggaacagagaactctttcagtaagacttcttctaggagctgtcaataatgggatcttatacactaaaacctgtgactcattgtcttgctttaccttttctgggggtagatactcatgtactttctcatatacttggcttatgatatgaaaaaaagttttaagtgaaaaatcagagtgtagaacaatgtaacatctgaatcgctggtgaactgctttttttttaaatactactactatgtactaatttttaaaaaatcttatatcttgtacacccatggctgattcatgtcgatgtatgacaaaaaccactacaatattgtaaagtaattagcctccaattaaaataaataaaattttaaaaatcttagatttttgagaactttaagagatgaagttcatagatgggacaggaagtgcaactataaagtgacctttagcctggtcatatatgacctttaaataatgttcagagcgggcagaaaaatcattaaaatcaccatcatccaataataataataataacaacaacaatactaatatcactaataagaagaacaggaacaagaagaaaccttcttgctactgttagtagaaatttgttagaggtctcttgatatctattcttcccttatgtatttccactggactgcagcccccagttaaaggtgtatttgatagtgtcccctgcagcttctgggacaaaggtattaaattctgcttgtcggaaggtgaacagaagtgatgtggggcactttcagagccgcgtcatgcccttcaaaggagtgggcatgcttcttgaccctctacccattaggctgggaggacatggtcccaagatatggaagctatgtgctgtacacagagagcca

SEQ ID NO: 30670 - DNA, 923 bp, Bovine  19866881075125
tttctgcatttaataataaagtttttttttaaaacaaaaccatttttagcatatgtatagcatgaatgtagaatatttgagtttttactgtactttgacctccctctcttaatcctttcagtttttagtagttgcttaaaatggaaaatttactttcatataatggttctttttacaacactgtccttgaaatatgtttttttttttactggaaaaaatggtgaattccaccaaaagttatttcttggtgggcaaaaccaaggtatagacataaattctagattttcatattcagataatgcttaattgatcttttggggcagctgaagattttggacatgttgatttctctgacttgacaatttctgctaataaaataatgattttggtcaactttggtcatcatattttaccaaaattgaattcacttgctcttgacagatccaatagtaattcaaggatttcctctcatacagaatggaactattctaattaaagtaatatcctttcagtcacaattcccatccctgtcatttggaactgagaagccccaggatgcttcccgcctgggctgccacaaagcattatccgatacagtaaccatttttcccttccctgcctttagctatagtctgtgagcttcaacaaagcatgagctgctatctctgtgcaggcacaagccaggcaagctgagcctgtattttgtgagagcctgaagcagcactgcctggcaggcagtgtaggcagcgttcgacataggggcaacagtgcaagaatgcctcagaggagctggggagactggtgatcagccaagaacagcatccacgtactctgtggatacctgcggtccatgaaggtaataagtaacaaaaacaacttgtttcaaaggctatcaggtgagaagctaactcactgctagagga

SEQ ID NO: 30671 - DNA, 964 bp, Bovine  19866881171272
gtgtgtgtgtgtgtgtgcgcgcctgtgatacgtgatgatcagtagatagaaacagtacttttcccacatggttcttttcccacaatacaaaattattttggaactgtaacttcttttttgcctaaaattcaactttttattttgaagtaaaagaaataatatatagagatcttatgtaccttttatctatcttgtccaacagtaatattgttcataaatgtaatacaatatcacacccaggaaattaacttttgatatcaagtctaaaaattctttacctagccctacatcccaaagattttatgttatgtttttctaaaagttttatagttttacgtttaagtctatgattcaattttagttgatttttatataaggtgtgtgatttaggctgaggttcactgagggaagtggggagggtatctagaaatatccaactgctccagcaccatttgtgggaaagggtatcctttgaccattaaataactttctcatatttgccaaaaattagttggctagatgtgtgtgggtctatttctggcttgagataatcacaaaagattgagatgaaaatgacaaagcttcaagaacttggagagatgctaataaacatggaagacagataaagtaattcatcataaagagaactgttatccccaataaagaactcactgagtggaatgccagaatatgtaaacaaagagaattttcctaaaatgaagaaagatgtgaatctgcagattgaaaaaatatattgtgttccctgaaattttgatgaaaatcactgaacacaaaaattactcaaaaaaagaaaaaaattactcaatattatgatatatccatagttaagttattagacttcaagggtaaactatttttttcttagattttcaaacagacaaagtgagccatacttagggtagttaaatctggttagccctctgtttctccaaagcaatactga

SEQ ID NO: 30672 - DNA, 1518 bp, Bovine  19866881229391
tcaagattacatatctgagatataatacagttgcatgtctttctatgtctcaatatatctgtgttcaaataatcctataagataaagacctttgtgaaagataactattttttattcataaaataaagtctcttataatgaatgaaatcaatcatttccttatagttgttcaaataagctttctctctgtactccctcccccaaatgtaacaccatactgcctggaggagccgcttccccttactttaaactgcatcatatatcctggctgtataatgagttctctggaggagagtgcattgtgagtcttgtccttctttttatttggccagtagaggtggaaggatggattgccacagaatcctgctgtcctcactgcattaggataaaaactccagttttcttcatgggaggtgccttctgttaagataaattggaagtaatatggcatgttattctcttaaattaattggtttattgttgaactacttgaatgtctatgctctagctctttgcttaccctttaagattgatttttattttctttaattggtataatatatatatagcaatcaaatctagaaaagattattaaatgctagtaaacaattacccaacttttaaaatataattgctagtctgggtaacttttaccattgcaagatttttcctggaatactttcaaaccaataaaacatgtatctctgcatacagaaattcttaaagaaactgaaattatttggggctgctgaaatttcaaattatatttagagcaagacattttgtctttaatgggatttattaaattctttgttgacatttcaacaagcagtcaaccttgaagatgtataaactattaggcaaaataatagctaacattcgttgatcagtaaatatacagtaggcactcatctaaatgcttttcatgtagtaattcatgtaaagacataagcagacaaaagatacacagggaagattgctcaatgtcttgtttcttaccatcatcaaaagtgtcaaccagctgactgggattgatttccgctccgccaatcaaaatgttgtctagtgcccactgagcacgctctaccccggagaccacaagtccattgctgatcacaaaaggctgccaccagcggagtcgagttgtgttggtaagagcctcctcgggaagaagtatgtagtcatgtctgactgaaatgtatttctgataatccatctcatggagcaaagtccaagtaattcctataaaacaaatataccaacatagtaacatactggaaaaaacacaacaaaccaccaatatattgaagttactgcaagttctccaaagagatcttcagccatataatgagaagtgatttcactgactttaatgtaagtattcacacactgtttcaaaatgagagtgatgatataaagggaagggtatttagaaagtacttgggcaaaaataaaaatactgaggtaaaaattaaattttctgcttctaaagttttgtttcttgattcctatatccat

SEQ ID NO: 30673 - DNA, 2878 bp, Bovine  19866881289775
ttttactataattttaaaaaatagagatgcagagaatgaaatcgtataaatgatatatagagacatgtaagtgaccctcacatgcctatcaatctttagattcctttctcagaaataatcactcttaattccttgtgactcacctttctttttaatgcattgctatataagtcactatttgcatagtaaattggggcatttatttggaatatttttattccaggaatttctttcacctgaaaaataaaatgtcagtgaatttaatatatggaaatatttcagaatcaaaacttcaactgcctcccttttccaacttgaaaattaatacagatgttgccaaggaccctttgacagagtttaaataaaatgtcagtctagctgacctactcatgttctgaaggaaggcatgttgaatggaaggcctttaaaaatgcacatcttcccatttcttttaaaagtctttgtttcatttttttttaaaccataaaatacaaagaagaaacttaaagcgaatctaggagaggggagctgccactcaaactgtgagaagcagtcacataaaatgaacagaagtgtatattggtttattcacagaatgtaggtaggagtcaaaacagactcaggtgaaaattatatcaagaagcctcgtgaaattctggaatgcagatggaaacaggtaatcaagcacataattctttggaaggggaaaatacaccaatcctactagcagtctaatttattaatatcttacagtgagtctgagaaattcttcccaaacacaaaacaaacagataaaactagtttaagaagactttgtaaaagattctacataagagattccacatcagaaaagaaaattcaaagtcaaggatattttaagccatggttttaaccactaaaaatgaagcagaaaaaaaaaagaattccacagctccaccacctacattgtacacggttaatgttagaattttatcacccctttgaattcatcagaaggaaatcacgcacatacagaccaccctggcaaacagtcttggtattttgtaaacatatactttaagtccaagaatatatatttatcctcattaaaaaagaggaaaaataaatattaagagactgtgtaactgatgtatagtataaactataaaactgaatccagacagcaaatggaagttcagacttttcactctgaccaccacactttccacatctccacccctaactctctatcctgagtaaaaataataattagccaatcacaacatatgcttacaaccatttaaagtgatagaaaaaaggacctacctcctcatacgcatctatatcaatgtacacatcagtgtcaggaagctgcccaaggactttgtagcttggactgcagacagagaaggagtattatcatgctgacgttcaggtagtgatggaaacacaagattctgcacatttgcaaatccggtatggatttgctagtgacttcagggatacttggttcttttctctttttgtttatttggtccttttatggtcccttttcagaagggctccacttaaatttgcattcccagtaccatcccaaacctaacacatcccacaccccccacctacatacacctcacacatatacaatttacatacacagcacatatgcctcacaccacatacacacacacataacaccacacacatgctggtatataccatccacatattatacacacaatctgttccagacaaatgacttaaggatttaaatatgggaggtaaaatgagctgtgcagagttcaaaccacgtctaggacatgatttcatgtcactcggtacacagaattatcttcctgctctaattctgaagcaggagaggggattttcattttatttgaaataagagaactgacttgtggagcaagaggttggaggatcaacataaggtgtggggagaaaacaaaaaattcaaatcagcataggagtttccttaagtttagtgtgaatagattttttaaaaatttatatttaattgaaggacaattgctttacaatattatggttggtttctgctgtgtatcaacatatatcagccataggtatacatatctctcctccctcttgaccctccctcccacctccctcctcatcccacccctctaggttgtcacatagccctggtttgagttccctagtcatactgcaaattcccactggctggctgtttcacatatggtagcgtatatgtttccatgctgctctctcgatctgtcccaccgtctcctccccgcctctgtgtgtccacaagtctgttctttatgtatgcgtcttaactgctgtcctgcaaataggctcatcagtaccacttttgtagattccacgtatatgcgttaatacttgtttttctctttctgcttactccactctgtataataggctctaggttcatccacttctttagaactgactcaaatatgttcctttttatggccgagttatattccattgtatatatgtaccacagctttgtaccacagcttctttatccattcatctgtttacggacatctaggttgcttccatgtcctagctattgtaaatagctggggtacttgtctttttcaattatggttttctcagggtatatgcccagaaatgggattgttgagtcatatgggagttttattcctagttttttaagggatcaccatactgtattccatagttgctgtatcaatttacattcccaccaatagtgaaagaaggttctttttctccaccccctctccagcatttattatttgtagattttttgatgatggccattctgacaagtgtgaggtagtatctcattgtagttttgatttgcgtttctgtaataatgagtgatgttgag

SEQ ID NO: 30674 - DNA, 1601 bp, Bovine  19866881310832
gaggcacctcttaatattatgctccctggggtctaatggccctgatgattctttcggtatctgtagccttacaatttatttttgacgatatccttttagttggagtgagtatactgggcatttgggcaatgccagcttgcagagagctggtggcagatggaatgaaatctgcctggtgtgccttcccctccacatgagcagagagccatccatttcctccattaaggagttgtcactcagcccacccagctggaagaccatttttgatagccaagctggctggtggcagacaattcagatacaaagtgcactttaaaaggaagctaaaacatcatctgtaggaaaattgaaaatgcatggcttccaccacagccaattttttaatgactgtaatattttaagtgattatttttgccacttcagattgctccttagagaggagaggttttttaattaaaatctaggcaatgcaaacagatgagatatgaggagcagaggaaagagaaataagatgaataaaattaattaaaatggcattgttggcagagacataaattagccactgtctggttggaaacaaaatatactggtataaaagtttctggattaaagggagatgtgtgactgagtgaccagaaatggactgacctatagcattacatatcattgtgttttctaagcctgtcaccatgctatagccattatcatatagaaatatatattttctacatcctggttcaatggtctttaaaggtatagactttcatgtttataaagaaaaaaacaaaataggaagagagtgatttctttcatgaggcaaaatgaaagaaattcattttgcacacattaaatttctaggtaatttaataccagttaaaaaactgataacttggctataaacacagtccaggtgcaggagggctgaagtgcatttgagtcaacacaatagattcaaccacagtgagcaaattttagggagttctaagagtctttttttttttttctcattattttctggattcattaagcatttgaaccactttgtactatgattcataaagattcaatttatggtatattttatgacaagtgtgtaattatttggcaatagttacgacaattctaaaacagccatagtgacagatttgaatcggagtaatgagagaaagaataacaatgaaaaattccacagagcagttgttaaccttgtctgtagagatcaatatgactttcacagtgtctgaggttttcagtcctgcctcctcaaattaaggcccagaacaccagacacaacatggtgggctgcaagatactgaggaacaaaagggctgggactttattatacaatgtagctggctttgaaaatcaaagctgtttgatcttggagaggtcacttagctctaggacactctttattttcatctgtgaaatgggggcaattgtgaggattaaatgagatagtgcaagtaacatgcttattctaaagattgctaaaccttaggaaatcagtaaatgctaattcccttccttctttcatcccctatcttcattcatttaacaaatcttaccttaatgagtaccattatgcaaataattgagct

SEQ ID NO: 30675 - DNA, 733 bp, Bovine  19866881329598
tactagttattagagataaaacagaatacaaacccaggtttactgtactggtcatagaagatttccattagtaggttccaggtaatgcctccattgacagaatattctaaaagaacaccttggttacggttgtttggtgtgatcaggcatccatacatgaagtaaaactggataaactcagcattcgtgaggtttagatccacggtgaccaatagccgactgcagccctaagaagcagaatgcaccgatacggtgataaggaatcgtcatgacaggttccaggtgttctttggcttccatcctttcttttgtaatacagctcacacagtactgcagtaatgattttcttataatttctcctactatactagcttctatatggtctctagcgcacagtaggtacacagcaaacatatgctgaattttgaaattttagtattagaacttacaaagggcaatgtattctaaggagattctcttgtttttttctaagcaataggagagctgtaattaaagtaactattttatttctagttacttataggtatctgttagatttttaaaaaggcattggctattaacaaaatagtgcattgagatgactattttcatatggaattttaaaatgatgttcaaaaatacaacttaattataattagcaatactagttgtaagctttttaaacttttacaggttgattttaatattttctatattaattcattaacataga

SEQ ID NO: 30676 - DNA, 857 bp, Bovine  19866881345186
cttctattattctaaatttttaaacacaaacacagagggaaccacacagtctcatgatttttgttaaccagaggatttgtgtaaactgagatacaagattttgtccacaaacaaaacgtgctcatttgttgtccttgtattagaggatcaatatagggagtttatcccagatttaagaaaaaacaccctgaaactacgagtgacatcactctacagaaggcctgtaacaacatatgtgtgtctttagtcacatgccagatgaagagcagaacactgaaaagctgggaaggatcctttgaagttaattccaggaaaaattctataaaaagattacaaagcttataatattttctcccattttactctttaagctcagcttcctttttacttttgcttgtagcaacatctaagggtgattgtggtaaaaaaatacttctcttgttaagtttttgtttggcagtcttgcatttatcatttcgtaagttgacttttactttaaatgtataaaattacacttcgtataaaagcaatgtaaagagcacaggacgcctaatgcttaagagcttggctgccagggattaaagctgagctctagcaacatttagctgtgtgaccttgggacagttactgtgtgtctttgtgtctgtttcctcaagtgtaaacagggacaacgacagtactatgttatagggttatctgtgaattaaatgaggtgaaataaaaaacacctactgtagggcttggcatgaagtagggattcaaggtaatgttaattattatcactattattagtaaatgaatatacttaagggatgaaatatgtgttatcatgctttcccttcttaggcagctcaaaa

SEQ ID NO: 30677 - DNA, 1671 bp, Bovine  19866881404265
tccttgatatctgcgtgctttgctcgtcctgttaataaatgtttatatctgctcagctagcctggttaccctcagcttgcaaaggcataaatcactggcttctgtcaactctggaattgacccacagattaaatgcagatcactagaagataggtgctgttccatgtattttttatttttaagaaatcttcccactctgattgctgtgcctgcacctgctaatctttttctatttattatcctagttcattgtatggatagcaaagaatgccagattactccttctgcacatttatgtcaacttgtgttgagaagtaaatcaacattaaatgtcacagattctgttgtgaaggtttgtcctttagaataggctgtgatcaaatgtatttaaaataatttttcttaaaaagtaatttattaaattttgcagatgtatgtcaaggattgggagtaactaagtatacagaatttagaagggccatatcttaatcttttatttctacttccagttagactgcttcctctctctcccatttactgttgataaatatccaataataatgtcaattttcctagtttaacaaacaccaaaggccctaatgaggagccattaggtgaattaggtaaatcaacaacccattaaggaaaagcattaagtcagaaaagagagtctattaattttcttatagctcttgtacattatgcatttgccaaattcattatcccagtggacactaggcagatctccagtcctgaataagaattggagctttcattctggggttctgctgtcacttgtctaatactattatcacaaattgttgaatcattaatggataataaaggttataacatccaaattatggaaaaaatataaactaatttgtctgaaaatgtaaagtcttaacacaagttgacgctagtgaaaaaagtcaaagtcaaatggttaaagggatgattacattcaaagcagaatttatttctaaatgtgtgttttgagagtatagtcccctggcagagcaatatctgcctgctataatgcctaacttttcttccataagttgggcaccccagaaaaagatttcaaaaatccatttaatgattttctttttttagactgtaaggacaaacaggaggaaatcagatatactttccagaaatatgctttgcaaatcgctgtactggaaactatctggtctgtgacttgagggatttgagtactggctttctaatgaggataaacctgagctcagtaagacttgtggctagaccatgttctcatgtctttttctattaagaatcggaatgttaactacgattttctggccagattccagcttggttaattgcatgctgtctctctaaattcgctttgcttgggatgttcttcattttggattgcattgctcttattgtcatgtttcccccaagaggtgggtacatgatattgtaaaatgagccagaatataatttgttaaactaataagagtactttggggatgaagggttaaatgtaagtagtgtgttttccacaatttccccccaatgaggcctatttgtacagtaattaatgtggaatagcattagtgaaacatggaattgagccaaatcaccatgacaagagtggtaataacacagaaacaaataatttcaataaattctactaaaaat

SEQ ID NO: 30678 - DNA, 1107 bp, Bovine  19866881541207
gcaacgttggttggatccctgagttgggaagatcccctagtaggaaaacatggcaaccaactccagtattcttgcctggagaatcccatggatagagaaacctgacaggctggagaaaatagagtcgcacagagttggacatgactgaagtgacttagcacgcacgcagattgaagtacagagatgttagataacttacataacataactcagtgactgacacaacctggattcagaagacaatccagtttcaagcaagtgatttttgccactttactacattttcctctaaaatcatcacttaacctgttttatatgataaaatacctatggtattgatatgatgaaaactagagtttttaatgaaatattagacaagcactgatttaaacttctaaaatatggctgattaatatgtcaaacatgggcctgatcttgatatgcacgttataggttcattcattggatgctgattatatcccatccattgtcacaaggggaatcacatatagggagagaatgtgtgaattaaaggcaaaattgaacaccattagatttaactgcttggacagatgctagcataatattagaataaaagtggaacataaaagaagatcagatttgtgtctaaattaatgctgatttaaccttaaatgaacttgctgcaaacagcagactttatactgagaacagtataaagcaagcagtgttctatttaagatactgaagcaacaacaaagaattgaactcaagggcccaaagaagtacagaggtggaccatatttgagcatttgatattttaaaggaagattctcctagagggaccttaaaagtacactaaacaagaagacaaaaaaatcatttaaaaaattgaagacattagaactttctgaacactgaacatactcaaagtgatacagatgcagagatttgaaattctgcctagagtatatctctggtgcctttaatttttgatgagagctgttctagtctgtctggaggatacctcatgaaagatagtatggttgcccatttatttccattgatcagaagaaaacattggagatgtttgccttgttacttaaatgtttaaataagatcaggaac

SEQ ID NO: 30679 - DNA, 1437 bp, Bovine  19866881582733
accagtcatttgtggcaaacatgtatacatttcaaaatttcccttgagagaagcaaggtcattgaaggccagaggccacatatttgaacatgttcaaaaaatttttacttaataagataacatgctccaaaggttctacattgaaaaagaaaaaacaaaaacaaaaacaaaaaaacaacttgttttaggactagggagttacgataaatagttggtcaatatcatcatttgaattttaatattgcaataagtgtttcttaaaaacatcactaaaatgagttcacactgaactcggacaatatattcctcaacagcagcagagagaaaacggtgtcattaaaagaggctttattctgattcattggctaagaaaatgggaacagtttgaaaccttccatgttgtttcattttaatgagtagagagcatttttcatgtccttattaaagtggttaatgtgtttctctagtctcattatcaccaccagagtatactctctgttgtttcataaccaggacaactccttttcgtttcagagaagattagaaagtcaaatctgattgctcacatgtggctgttaataaaactcctatggcgttgctcaaggtgcccatggggattgtacaattatttatattttcttatggctttctataattactgtgattgtactttcacaaagtaaatgtatctccaccaattaaagcagtggtgggttaagaatactcatcaggcttgtgtgaaagaatattgttcttagggttttgatcaaagcacagaaattaaactgctgttatcatgcattcaacccaagtgttaaattaaaatgctcagcaactttggagtttatttgagcagatgtgaactatttatgaaaaaataaacatgatacaggacttgcattcgtgatatgattctttgttgtattagaagtgctggaaagaaaaactgctaaacaaacttgggggatacagtttatgatataagatcaatttggatggtggttaatttaggtcaatttaaaatttcagaatcataaaattccaagaactctcattttgctttacatttttgtatcttatttgcttcacccctttattttctttgaagactctgggactaagaaagaacatgcacaaaaataagcacctgaagctatcaactagaaaatacagaatataaccttttatattttgtcatatagaaatttcattttatctagttggacagtgctcacagcaaaagtgatcagctgtacttccattccattagctgtcattttgatgctagaatttcagcctgctgtgtgagatgtaactgtccatgcacagttcccatcaaaggtaattttatgtgcaatggtgtgtaaaatttacctctaattatgataaggtcactgatgggtcatttatgatatactctctggagacaattgcagt

SEQ ID NO: 30680 - DNA, 2126 bp, Bovine  19866881713835
tgataactgatgtgtgttttttttttttcccatataagtttgtatgtatatctgagttaatttctgggtcatttgacttgattgttctatctatgcactggtatcattccactttaattatgtaggttatacaatatattataatatcgtgtaggggatccctctatatttaaccaaaagtttaaactatttttgtcagtttatatttctagacataaagttcaaaaaaaactaccactaagactctggttgcaatagtataacatataaattaagagatatcttcatatcataatgttcagttttcctatccaaggatgctgtattattttccatttatttgttcacttccttcacaatttgaaagaagttttgaagctttattaaagttttctttacagagattctcagtattgttaaacttattccttatatttatgtattttccggcatggggtcttctgatagcttccaactcagaatctcttaaccattttagtgtcatagaagtctttgaaaatgtggtgagatagttaggacctaaagaaaaattcccttaaataaaaatggaatatatctggaatttaaaaaagctattgaatttttgtttgtctatatagtaacttcttactttactgaattctcagtaatttccagattgacaatgctattccttagaaaaaatatactttgaatagcttcaaactgtttaaaccagttggccccattatcaatttcctttctactgtatagggggaacctctccaggcttccatctcccacctaccatacctgactctcttcctggatattatgattctcgttagacccagttggctttcactggtttctgcctttcccctgtgtgccttagaagtaatgcttttggttggtctctctgcatatctaattgtgttatatcatggagagttatctctccttgaaatgactcaatgtttcaaacacagcaacatcacccttaaccttcctgaaaccattagaaggcaatcagaactggttacctgggtttgctgaagtctgagaagtacatttctgccagcaggtgccactggatgcccccgttgttgctgtacttggaggaggacaccctcctctctgctgtcaggcttgttgcaagcagaactctctccaccgatttggatgtagaactggacaaagtccacccaagaagtatccagatcccagctcaccaactgtcttttcccagcctttccaaagaacagagaaatcacagatccaattatctgggagcaatttgcggttttcagtttcaaatttgtatgagcatcctggctctatgtgaagttgatcatgttctcctttattgttgagaggagcaagttatgttatttaactgttcctggatacattctattaatatccaggacttgattatgagacccctgagaactgctaattacaccaaagagtattcaaaagtctttaataacaaagcaaaactcattttaattaaaacacttccagtattccctttgtaaatctcctccaggcagagtcatggagcagaaagatcatacacatactttgaaatcagttggagctgggtttgaatctcagcccatgattcatgctgttctctagctgcgtgacctttctgagcttttattttccttaaaagtacaatatgggtaataataccttccacatagggtgttgtgacaattaggtgaaataacatgctacataacttgcctatcacatggcatgctttcttgagggaataatctctgcatacatatgccttgaccctactcctacctgggcactgaagtgaaacaggtaagacagaaacttctgaacagagtgtactgaagtctcttgggctcccagtcagtcagcctgtgtgtctctcttggaaacagagaaggtaggagggatcactaaataagtttttgcaaccactaaatgatctctttgtgtcttaaaaatgttaaaaaacttcttcaaatccggtaacttgcttcctttgtttagtgtcacaggaagtgcccctgcctgtcacagttctgttgcaaaatgtattagacacaaattgacaagtttgtcatcatttatctgtaaatggtctcatgctgctgctgctg

SEQ ID NO: 30681 - DNA, 1593 bp, Bovine  19866881746860
atcccttttgagaaataaccctacctggaaaatatctgtaatattttaactttgtgtaacctgttgggatcaatagtaatttcaactttttactaaattgaattcataatcaattgtacattgtggtataacagagaatatagcatcctttctttctttaggtcattaactcataaaacacgtaacattttcaaattacttgacctttgatttttccaaatggcttttaggatgcgactgtgtacaagtgtcactgaaagtgaagttgcccgtgccaaaaatcttctgaaaacaaacatgttgctgcaacttgatggtaaaagaataaagacttaggtctttttttcacatggtttatctagattccagtccttagttttcttttttcattaaaacaggttccactcccatctgtgaagatataggtaggcaaatgttatgctataatcgaagaattcccatccctgagcttgaagcaagaattgatgtaagtagtccttagatactgttggatcttgtgtaaaacaatctttgttattaatacaacagctcaagataggtatcataaaatttgctttagctctaaaatattccaggtatacaatgtctttactaatacaaaaaacctcgaatgcttgtatcttcaatttttcaggctgtaaatgctgaggtaattcgagaagtgtgtaccaaatatatttatgataagagtccagctgttgctgctgttggtaagcctgactcctagtctcccatgcagaaagttggctaaggactttccttttatttagttataactgtcttttcttttaaatccttaggtcctattgagcaactaccagattttaaccagatttgcagtaacatgcgctggcttcatgattaaaaatgctcctaataaacatttggaacattataaaactgagaccctcaagttgtaaaggaaaaaaaaaaaatctatactggtaaatatgaataaaatactgtatgtcagactttgaaaagataagaccaccacagtgaatggtagattctcagagttcagagaaattatgctgggacacactttaagtataattttaagaatgaaaatttgtatagtattttcagttttattataaaaatgcacacgcaacaaagattgtcataagtcatttcttgcctctacttgcattcagcacttgctcttgtgcagctttctttgcttttaccatttcaaccagttcctaggaagaagacaaacattttacttagacaaaaagttgtcaagatttcagacatttctagtgtttgatataaatatgtaaaacattcaaattggataaatctgtactgaaaaggttgatttttttaaattaattgccagagctaggaaatgtctaatactggccccacaactatggtggtattgaagtaagtataacaccataatttaaatgataatggaatctataaactcaagatctacaaccttgtatcgtttcatgcagtccttctttgtcctgccaggcactgcttctgctattttttcccatctttcaggtgtatttactgggtatgttttcaaagcttgttccaaaagcttctgttctt

SEQ ID NO: 30682 - DNA, 730 bp, Bovine  19866881939280
tggaaaggtctattacccttctttaattctgaactgacgcactctgagcagccagtgtctgcttttgcagaggagcagaatggaaggaacagtttggctggaccatagatactagggaaaggcccccttcctttgtcatgtggacccttaaattatacagccagtgttaaacaattcaaacaagctaaaatgttgaaaagacctcttacccccaaatctatgacttaaatatttgtgacttcatattttaaaactacacaaagcatttggcatattctttttaaaaatatgtggctatatttggggtcataggtaaaccacattttccattcttttcaggtcagctagaatctgatagattcttattaatgagtggtggaaagccatctcggaagtgtggaatcctttccagtggaaacaacctctttttcaacgaagatggcttacgcatgttgatgacacgagatctggatttatcacatgctaggtaatcatttttaaatgctgttgaagaactaccttgtaatgtaaagtagcagaatgtaatcaagtcaaaaagaagcagacatctcaaggacaaggcctcccattggaaatgctatgcttctggcttgtcaaagactccattaagacacagtttacacaattttcattctaaaactgagagagatcatgcaataactagatcagaaatgaaatggagctaaacagaaagaggctaatacctggt

SEQ ID NO: 30683 - DNA, 1620 bp, Bovine  19866880290503
ttgaaaagcagagacattactttgccaacaaaggtccgtctagtcaaggctatggtttttccagtagtcatgtatggatgtgagagttggactataaagaaagttgagcgccaaagaattgatgcttttgaactgtggtgttggagaagactcttgagagtcccttggactgcaaggagatccaaccagtccattctaaaagaaatcagttctgaatattcattggaaggagtgatgctgaagctgaaattcccagtactttcgccacctgatgcaaagaactaactcatttgaaaagatgatgctgggaaagattgaaggcaggaggagacagggacgacagaggatgagatggctggatggcatcaccgactcaatggacatgagtttgagtagactccgggaactggtgatggacagggaatcctgcagtccatggggtcgaagagtcgaacacaactgagcaactgaactgatgctgttatcagctttaccacacataactagttagttactagtgagtttctagtttgattccatagtggacaaaaaattgtaacctgagtaatttccttttttgttttttaacttgctgagactttctgattgattttggttcattcatgtgcatttgcagggactgtaaattctgattctgttggatatactgtcaattagactaaggttagtaactacattgtccaatctggtacatacttactcacttacttgcctgcctatgctttcagctactaaaaggtgtttttcagtctttcagtatgactgcagatttctctttctttgttgatttttgcttcatgtattttgaaaatacattattggatgcatactgattcaggaagctaacactatctttaggaactatgattctttatttctaacaatgctttatgccttaaagcctactttgtctgacaataatgaagccaagtgctttatcttatttttttagtgcttccttggtatatttcccccatcttttcattttaggctttctggtgttaatattttaagggcatcttccttgtaggcagcatataatgttgtttcaatcaagtcttatattcttaaggcttttacttaatatattttgtccttctatactacatgtgattactattatagctgtatttgaatctaccattttattattgttctctagtttgctcatctatttattgttcctttttactttttttgttttcctatagattaattaaatatttcttaattgtatcattttccagcatttataaactaaagcattaaaactttagatttatctattaaaaaatatttcaaatgattcagcacttacctttaaacaatgcagtgtatcattttttgtgaacatcttaaacttagtgagttctccaataaaacgaacagttttgttctttgtttcaatattgatctggtccttttttcgtacctacaaatgaaaagaaaagaaacactgcttaacagtctgaaatctgtgataagaactgttattttaataagattgaattcactcaagatattttcaataaatttgggtatagtttcttgctatattcaaattattctaagttaagacataattagctccgtggaaca

SEQ ID NO: 30684 - DNA, 949 bp, Bovine  19866880367686
agcacgtacacatgtgcgtgttggacagatttaaaatcacggggcttaacttgacgccattcgattttatgggaacaagcattatgagagccagtggaaatatatttttcaggtgctggtaaaaggcagatccctcaccggggaactaactttctgaattttctgaagatctgagatgtgtgagatgcataaccccgttgccgggattaatgtattggagctgactttatgtttcctaaggaaactaaaagcgctgctcagtcctgtgtggcgtatattccacttttacttaagattctacacacatggtagggagagtaccagctttacaggggaaagaaaaaactttttaaatctaaatattgatttaaatcgagtcatggctctttggacaataccatttagtcgctgttgtttctgaggcaggaaacttgatgttctgggtggttgtaaaggagagagaacatggttccctggtgtacgtctcggggtggagtagaccacaggttatttagagtcagatcaggcgggaatctgaacctccctttttctctttattggttctgtgagcttgggcaagctaattcaccttctgaatcccagtttcccatctgtaaaacaagaacactcattcactttgcacagtgttgggaatttcaaagccaaacaggtaaaccatctgcccccagtaagtactgagtaaatacttgttcccttcattgttgtcaagtatcttgctgtcaaggctggagaggtgaaggaaagtatgaaaacatataatcatagagaaaaataatgaagcaataatgggcaacttcacttatttcacagaatatggtgagaaaaacgaaactgagttgggatccacttttcctaaggtccattgagaacctatgctccctgcttgattgcaggtgctagggatcaaaatcatacataggcttgccct

SEQ ID NO: 30685 - DNA, 2388 bp, Bovine  19866880426608
catgggatctgcttccggctcttttttttcttctatcgattctgactattgctgaaataatattaatctttttaaacttcaggcccaatcatgtcatttccctgcttcaaaccctttaatagagtgccagtgtgtactgagaaaagtccaaactcctcagcagagcgtgcccagtccgttctaatcttgtctcaatcaacactctccgtctccgtttcccattcttcactgccttctccagcccaactggattcgtcactcttctcccatggcttcgccctgctcacgctactcacgcagcctcagtgcattttcctcttgtgggtataagttgatgcccttttttcccccctcttttccagttttactgagatatgacatacagtactagataagtttaaggtgcagagtacagagaaatgacttcacttacatatatcatgaaatgttatatattcactattaagtcaatattcactgttaatcatacctactaccaatttaaaatatgaaaagtgaaagtcacccagtcgtgtctgactctttgaccccatggactgtagcctaccagctcctctgtccatggaattctccaggccagaacatactggagtgggtagtcattcccttctccagggtatcttcccaacccaaggagtgaacccaggtctcctgcattgcaggcggattatacctcatcctacttcatatataactgacaaacaatttatgtatttccaattaagtgtttttttaaaaaattatttttaattgaaggataattacaatattgtgttggtttctgctatacataaacatgaatcataggcatacatatgtccccttcctctcaagacccccatctccaacccgagatgcccttctttaatgaaccactttgtctcccctgaatgccctcagcattggaacaccaccttcaccctggcacacctttcatcttgtacaaagctttgttttttgcatcctgtctcctctactggactgcctcattccccaagagtacagataatgtctgggacatgtctctgtcccagggtctaacactctgcctcgcacgttaaggggtattcagtttctctgtccttgctgtgattgtatcagaaagacagactgtgttggcaggaaaatgttgaatcactggttctggaaattcttctgccataatgtttaataaatttgaatgaggcagaaggtggctgtgggaatcaccacctccagatcctcccgggaagttcagggacagcagaatagctttgcttcaggtagaaacagagaaactgagagtgaaattttaacttcaggtgcccggtgaagaacactctggccagtactctccagcatcgatgagcccctgattccgtaggcacatactgttgcgataggtcaattattcctgctgactgaatactgtggagtcaaatctcatcataaatgtgatatatctcattccaggccctgctgcagtgcactggcattttgataacaaaatgatggacaggtgcagcttgtcattacaggatgataaagccattgcccacatcaactgcaatgccatcagaaatacattgtgtaggagggggagctagtaatttccttcaccagggtgactttagggagccctctttccaacactcaattagatacatgtttttgctcctggccaaagacctgagagtttttaagtttaagatagcttggtatcacatattcaaaaaatgttaccatccatacaccactccaacatgtaggagacccatctctcatcatccacatactcttctgctgccattcattctgcttggtacctggtatctggtgagcactccggaggagataaacacagtctgggaatgtgaagcaatttctccaactcagcaaaaatcctgaaactcaaaatgtcaacttcacagaaaaaagataccatccccttgctttctatttttttccctgtgtattcttctctgagagactggaactgcacaattctctgtctctcatggtccaatctctctccaaactacctcccagcgacacactgacatgcaagccggccagtgtccctgagaaaatcaaacacacctaattctttttaaaaacccaatccgcgatgatcaatttctttctccgtggttcctcccctccatctcctcctgcccctttaagaaggaggaaagcacctttcccgggaatgtgcagaaacacatttttagataaaattttattttggtctcgccaggcaggaagctattacccctccgttgttatctttatgtgcatgattaggaataatagctgatttgtgaagttatctattacgggaaataatcaagattaatgagccccgtggcacttgctgaatgcctccgg

SEQ ID NO: 30686 - DNA, 2454 bp, Bovine  19866880445303
tttaagataaaagatattatggagtacatgctgatggaataatcctctagagcagatggattttactttcattgttgctactaaggccaaaagctatgataatgtataaatagcagttcagatacattagtctcaggaaccaaaggaacagaatactttggtagagtgtaaaggaagatccttttttaaatgagataatcagagaagacatctctgagatcatgacttttagacaagacaggtacaaaggaaccatctaggtgaaaaattaggattaatgtaaaaactgtgtcagaggtcctgatcagggcagaaaagtacttgtttgaaaaacttcaaaaagggcgccagtagtaatagaacatagtctgtctgtgggagggtcacagcatgagacaggtaattgggagtggcacagtcctttaaagagctggttcagattgtgtgttagtcgctcagtcgtgtccgattctttgaaaccctatagactgtaacctgccaggttctctgttcacgagattatccaggctaaaatactggagtggcttgccattcccttcccttctccagaggatcttcctgacctagagatcaaaccctggtctactgagacaggactaaaagcagagagactaaccaggggtgtggttagaaggctgtggtggtaacctagctgagagatgatggtcatctgtctaggagagtggcaggacacatggacagaagtctggatttgaaaagctttttaggcagaatgaactggatttatttggtgcttgattaggtagcagtatatggggccaaggagtcaaggatgacaccccgtcttgtggcttggatcactggcttgtctctaagaaacaggagagtgcgagtaggagttacacttggtaagtttgaggagcctttgaaggcatcagtgtaaatgtctggagagcaaaagagaaacataaacagcggttgttagagtacttttaaagccatggcaataactggctcatccagatgtaaagtgcggagacagaagagaagcaggttcaggattgagccctaacaaaccccaacatttagaaaaggtggaaaagctgatgaagtcaaaggaatgggaaatttcggtgtggttctgtggtcatcacttattgagagtgcttaagaagtgagctggaaaggtgagaggatgtgatcagagaggagggaagtttgaattcacatttttgcagttgtgtttatgtataggagaaaacttcatccactgttaggccctgattttaaatcattatcagatacccaaaatgaacagttgtacagacttttttcttttgctaaaaatcataggaagacacagtattgtaaagacatcatttctccataaatcatgtccttaaatttcatgcagtcctcattctgtcccatcagggaaatttgggggatagggtgagggttggaggaagagaaaaacagggacatggatgtagaatgaacctaataaaattgttcttaaattcttaaagaataaccgaacagttaagaaacttgtagaaaataaagtgtgacacacaagataataaaacattttaaatatacagcaatagtttggtataggaatggatagattaatcagaggagggtccaaaatagaccttgcattgcattgcctgtgtactcagttatgtgtgactctttgagaccccatggactgtagcccaccaggctcctctgtccatggattttccaggcaagaatattggaatgagttgccagaatctaaaatacaccttagaacacggcagtttaatcttgatgaagttaacatctcaaatcatgtgagggaaaatggtatcttcaacagaatggatttctgtttttaatttccaccctataattaattgcaaatctctcaaataattttaaagattgtaaaaactgttgagcactgcattgactttatgtttattcttcatacagtgcctttagctgttagatactgttcgtattcccatttttcagttaaagaaacaggcttggaaaaaacaacaaaataaacttgtttaaagtgaaaggggtagtgagtggtgcagtctcttatcaaccatttgttacactactttccagcacgaaatgccatagaaatctctttagaaataactaaccaggagaaaaaaatctatagctgacacaacacaagagtcagtatctgtactaagctaaagagattgtacaaaccagtgagaagaaatgaatgactcattttgttgttagaaagaatatagtgctaaagctcactgataatcaaatgataagcaaactaagaagggcctttttatcaggtcataaaatattaagatttaaaaagtgatggtacctgttgtggttaagtgtaggtaaacatctatacttggtcaatgttaagtgagtccagccttttttagagagaaatttagtaaacctgtcaga

SEQ ID NO: 30687 - DNA, 2733 bp, Bovine  19866880465662
atttacctctttgtcttatacatttcacagcaaaaccaagtgcatgttttctctttgccatccactgtcagcaagcctcgcagatgactcacacaagatgtgggtgggtcagggtgctaaaaaggaatttctgcttctcttttttgggacgctgaattcacagctggattcatctcttcctcaccccttgtcctcagaaagagtgacaaggtcaagacccttagccccactctggattgaggatggggaggacggaggttgcagaaacttggaaaggttttaactctgtgagcaccagagttttggagatcagggcataacccacctgcagcaggacttctaaaagaggcaggcaatgcaaagattgtttggtcatactgaaatcctaatagacagtggagcatatgcctcaaaagaccaattagaatgctcttttccaaaataagaaaaaactcctgcttctgtatttcattatcctcactgggcttagcatatacagttagccaaggaaatacacactgtactttgtgtttattggaattataagaattccaggcatattaaccaagtaaaacagtaagttaaacacacacaggaaagacaagatgctatggatggaatagtcagttgtccaaaactgcaaatgaaggctttgctccaggaggtgtgtgctgattggaagccaagaatgcgctcagcttggatggagcgacacagaacacagcctgaaacagagctggctcacagaacactggtttccccactcccgggatccaacacgtcacctgttctcatcagcacaatcgtgcacctcagtaataatctggactcaaaatatttgtgggaacaatagtggggtggggaaaatcatggtgcgccccattatcctctcttttggagatctggaatgcaccccagtatcttttttaaaagattttgtaaaatgtggaccatttttttaagtctttactgaacctgttataataatggttctatttttatgtgttttgttttactggggggacagggagcatgtgggatcttagttcccccactagcgactgagcctggacccctgcactggaaggtgacgtcttaaccactagaccaccaggtaagtaccacacccccaacatcttcctagatctctgacctctgaacttagtcttggcccacagataaggagatgaagatgttctagagggtgaagatgatgctctcagggttactgcccggtaatcacgcttagtttgtcaacagggctgataataacaagcagcagtgactgaaagcagtccccattcccatttctagatggcaagaagatcccatgatgaagcactggactgcgatcagagaatgaagccacagctctgcccttaaaacaagcagattttcacattgccttccttcatcatcatgtctgagagttagagagtgaatatataaaaatgaaggaccttgccaggggagacgtactatgtacaacctaaggtactcttttggagcaagatcaacatcatgtaaatgatttggaaccagagaccctgcagagagagggttttgagctatctccctagtcacctgtgttgagagctgaggcagggctcacctcccgtctctagagctctctttgccctgtagataaacaggggcaacaaatgctcattttatatttttaattaatttattttaattgattgctaaatttatactttattattaatacatatttagtatttattacatatatcactaatatcacctagctgtgctgggtctttgttgctgcatgtaggttttttctagtttccgcgagtggaagctactccttgttgcagtaaacgggcttctcattgtggtggcttctcctgttgaggagcacaggctctgagccggcgggcttccgtagttgtggtacatgggctcagttgccctgcagcatcttccttgaccagggaccgaacccatttccgctgcattggcaggcagattcttaacccttggactgccaggaagtcctgctcagttattttaaagccctggaggtgtgtataatgaaacgatgtattctgttagtgcaaatattaacaaagagtggaatgagtggcctgacacaggccatggttttgtgcatcagagcaaagtaaaaatacactgttctgacacaaaaccctattttaatacttccatccagtttctgacagggctaaactccgaggcaagtactaacatgtagcactaatgcatttgctaatccataaatagattcttagcactggaagccagggctgctgtgcatggggctattcctctagtgaaatgaattatggatctggagtagcaaggactgggatggaatcaaaccattaaatattttatattccctccacttccatttgagtctaggcacctaaaaaatgagaaagctattgaggtaagagtttagtgcttatccaaacaccagtaaggtgacacattgggggtcttacactctccagttgcctgtgctgaacttggggatagaaatatgagtgaatataaggcaggtgtgtcatactgcataggaatcctctgactccagatccacactggatcaatctttgtattcttaatccacccaatagaataaacgacatctagctgattcttaataagagtttgtgaaataaaggaatgaatttgtttttaacacttgagaagacttttattttccatattcctttatgtgct

SEQ ID NO: 30688 - DNA, 1356 bp, Bovine  19866880497830
ttgctccttatttactgggtacatccacctaatctgaaccccaattatatccaagaagaaatatttgtaattaaatatatctactttttaaaatttgccctttaaaataatttcccttctgtttctaagtattaggttctaaatctcaatgaatttatgagtatttttcaatctactgctctggcacaaacagctaattaaagcaaaacattaaaatgttagaaaagacatattctttatggaaacaaatgtcagtgatatgattttcatgtatatcaattaccatttaatcttctaggatcagttcctttatatctagtttgagaataaaaatgtttttaatgttggagaagtttgaaactgatttttctattttttctttttgaagtctcactgttttcacctgagaaaccattgcccatgttataaaaggaaagatttttgaagatgtgagacatgtttgccctgcgtagaaatgcattttataagcacataatcatatatcaaaaatcaatatattctgtagagacctttaacttaacgatttaacaggctggctagtgatagttcgtgaccaaaattaggagggcgaaagttctgacttctccttgaatttctaaactgtttatgtacctggatgccaaaagaggaagcagacatcagaaatcataatttacttaaacattagaaatattcctcttaactttgctttagtgctatgttccgtaagtccaccaaacaggcatattttaaatctccaagcattaaatactgtagaggcatgtctgataacaaggtatttgctagaatgataatggtgttacaagcgttctcaatcaatgagtttctttctgtagtttaacagagaggtaagtaataaatctctaacttaatccaaccaacatagctgcaaaatgcaaaaagccctatgaacggcagatattaaatttttcaaatgcacaaaaccacaaacaagcagtcctaaaagctcttcaatctggatagtctatacaaacaagattaaaacagataaaaagggtgttgagaaagaagaagaaaaaaaaaaaaacccagacatgcattaagctagtttgacagctccattgttcaacgggtcccattgtcagacccatagatgtattcagtgctacaatgtctgctagcaaataaacaaaagactacatttttcaaagcaggatgccaattctatcataattctttctctgcttccccaaaggtggctcattcttggtaagcggtaggacccttacacagatgcaggaaacaaatatttgctttcaatacagagggacccaggacgccatgcagaatagaggtctttaaacaggtacacat

SEQ ID NO: 30689 - DNA, 1734 bp, Bovine  19866880498801
ttgccagccctcaaggtaaaggggaatggacaggtcagaactcaagaaggaagagtcaggcaaagctgtagaaggtagtcccatcccactttcatcctgacacctcacagctcatgtgagcactgagctcacatcagaaaagggtctctctgtgaggcttgtagtaccttacaatgccttggttgttcagaggcctagggaagggaaaacaatgaacataccatgcagcctgtcagcacattacatatagactcacatttggattattattgctgttgtttgatgattgtgtgtttttatgctaatttaaaaaatgttccttgggcttccctggtggctcagtggtaaagaatccgcctgctaatgcaggagatgcaggttcgagccctgatccaggaagatcccacatgccgcagggcaactaagcccatgcaccacaacttctgagcgtgcactctagagcccaggagccgcaactactgaagcctgcgtgccaagagcctgtgctctgcaacaagagaagccactgcaatgtgaagctcgtgcacagctaaagattagccccgactcttcccaactagaaaaaagccctcacagcaataaagacccaacacagccaggaataaataaacaaaatttgagggggaaaaaaatattcgtttaagcaaaaatccactctgccttttagagtctgacatccatcaccagccgtgcattctgaccatgttgggggtgagtgacattttcctacaatgctggctcattatttttgctcctggatttgcaaatccaaggatcaaatggcacagtctgaatccagctcagaggggagggaatcccaccagaggtgccctgaaacaaagcaaacaaacaacttcaaaaccacatcaggcaatctggacctgttacaggacagatggaactctgaattgtttgattccatcagcagaacagaggaaggaaatgttttaaaatgagattatgttattttccccagttcttattatgaaaccttcctgaaatgaactttaaatatcggcagcccctttcatggagatgaatgggtttcagccagcaggagcattgcaggaaagtggctccattatgaaaaatgtggagaggcagaggttgagctgaatagtggatccctgtggggtcctttggctgggtgaaaaatcaggctctcaaacacagctgtgtgtgttaggaagggccagatgtctttgaaaaatctatgtgccccatataaacattaattaaggggtccttttgcaaaagacatcaattgtaatgaataaaaagtcctctgaattctttgccctcaacaggaaaatgattgacaactaactattgtgtggagaagaaaaaatacactggaagttatgaaaatttcccctaaataaaatcatgtgatagttctttataatgctaggttttctatacagaattttccaagggatgttgtctgtattatccagccccaaaccttgttaaataaaaataaaaactttaaaaaaaaatggtgtttttctagtgttccttgtcagtgagtatccaggcatggcttggctagggatgttttcatttgtctctgttgtatacacacacacgcacacacatgcacacacccctctaaatattgggttcctccagatcccctgagttatggagcgcatatccaactgctgatctgacattgcccctgagaagtctcagaacaactgaaatttaatt

SEQ ID NO: 30690 - DNA, 1470 bp, Bovine  19866880504800
tctctaaacagcatgcatgagtttaactcactgacttcatagcatctactttggaagctattagcttccttcagcccatgaaataacctttaaataaagtaaaggattattataaaaagaacaatgatagcaactcacactaatcgtaccccgcccctccacccaggcaggcgccacacagatcatgcatggttatttacactgctcttcacccactatactcccacacgcgcagactttactccagttcgaggagcaccttcccctcccttccgctcttctgcttctgggccagcgaatatccaatccccttcagctggcactctcctctccatgccgactcgtcccttgtcagtccaggagcggcctcttcaggaccatcttcaggggttctcttatggtgccttcataacttccttgacaggaagcaccacatctgtcaatgatttgtttgctttctgtcttctccactgaacccacaggttggtccgggtcattttattttccactgtaaaccactgccagccattacagtgtctggcacaaaactgatgctcactaaacttactgcatgactaagtgaacagacaagaaattcctaatttaatcctcatcacagcaccagtgacacaggaaccacggaagacttggagaggggacactggccattacccagtgggggtgccacaacccatacccaggtctttccatctccaaatcctgtgcacctcactgtgtcaatgcctgtaagtggttctataatggactgctgaggtctattcatctagtcttgaactactggtcaaaccctatcacaaacccaaggactattcagattatttccctggaattttgtttgatcaaatattctttgaaataattgggccagttcaattattaagcagaaatatttactaggcctcatggtacttcctggaaaaggctttaattgggtatgactaaacttatagaacattcctaaacaataggtgtgtattttcactaaagtacgctcaccctattaaccacagagcttgcagtctcacggttcttatcactaccagctctcactcgactgtacttcctgccaagaccaaacaacaaaatgccagccatcataagtaaaaggctcaaatatgcctagaggcgtggcatatacacaccaattaagaaaaaacaaaggttatattcagcaaagtgagacttactacaataattctattcatcaagaaaaaaaactaaaagccaaaaaaagaacagcagaataaaagagcttttgaatgacagtgaatttgaacaagtgagtcaggatagtgagtcatccttaagtgtgtacctcaaaaatgtgaacagataactaccgcaggtcctaagatgctaattataatcactgtcaaaataaggacataatgtagctttgtgctgaattcctgttttcaatggggttatagttttgccacctacattaga

SEQ ID NO: 30691 - DNA, 879 bp, Bovine  19866880524934
ctgctttgcaggcagattctttactgcttgagccaccagggaagcccttggtctgctttatttcaggattgggtaagaggtcctttctctaagggttccccaagtgaaaggcaggaattttgcccttcaagaacagggttgattttgcttctgtctttgtccttagtttttgtactcctggcttgagattatacatcactacaactcatggcatcatgggttagaagtcacagctgaaatcattcaggtcttacctttgcaaatataggtcagttcccagtactgtgaactccaggtctcacatcaaatattgcttgaagtacatgggctgtcagccaaagcttggaagagtttttgttatagagacatctctgttgtaacggtgtttgttgtgatgggatttgagctgtataatgacattcctcttggaggattacagcccttagccgcttacacatggagatcaaccatcaccactttacattatctttgtgttcataggtaaaacaatgagcccacatttacactggttctgactctattaacatagtaaaattgtcctgctttcctggggctgatgtcagagcctcagaaattagaaatttggaggctctctctaaacatggtttaaattatcgaaggctttcagggtagccttgatgaattgcattactgacatcagtggttccaaggaaggagacagaatcaggcatttacctaatacaggtgaattatgtttttcctctcattttctatgtgatgtgctatttaatcttgcggaataaaaacttttttctatctttgaaaatatcctttaaggaaacctaaactgtttcttctctcacataagtgtatgtgttcactgagcagcctcagcaa

SEQ ID NO: 30692 - DNA, 2149 bp, Bovine  19866880634069
atgttctcttgcccctcctccgtctcccatcccctagccctgtcatcaggccactgtctgaaaagcgggttggattcactatgtaaatgtgtatcaaatgcctggatttgagacatgagaaaaaggtaagatgaggctgataacttcattatctttctgtgcaaaattccactgtatgaggaaggaactgctgttgcctgcttctcaaatgtacatgacggagaaatgaatcatggaaaaaagactcggtgtagagaatctctgaacctctggggactcaggcatggagtctgtgcctggctagtccccccagacctgtcagcagaatttcgtttctctccattcttttcttgattttcattagcccgcaattcattctagtaagtagttcctctttgagatacaaatatatttaaaatacagatattgcaagtagaaatatcacggcactgccatttttcttcattcttttcgtcagcaaatattatttgagttcctgaataaaccgagagagaagtttgggggtctataatgacagtgacactcacagtagttgctgatgatttggggggcttatgtcatgccagtcactgtgctcagtcacttcaatcattgagttatttaatctgcacaacaaccacgtgagtgaggaggtaagtaactgttactactcattcaggaagcaagaatcagagaggttaagaaatctgtccagagtcacacagcttacagatcctggaatacagatcagtgtaacttcagagcaataaagcatcatttcttctgtcacgccctgaatgcacacctgtcgagtctaaggatggagagtgtaccctgaagccctccctccaggtgacagcctcgcagtggaaggccctgccgtgcgtggtccacacggaaacctcttgcttgttttttgtgctgagctgcaccgcccaggaaggggcagttgggcagagggtcctgggctgggacgggacatgtggtaccgcacgagtcctcagggcagctgggtgagtgtgccagccccagggccctctgtgctcatcacctgccttttcttttgggaaacgggtaaagggcctgctgctgacgtgccctctctctccccgctgcaggcatgaatgctttacagttacagaacctggccacgctggcggcggctgcagccgcagcccagacctcagccaccaccaccaatgcaaatcctctgtccaccacgagcagcgccctgggagctctcaccagtcccggtaaggggtggtcctgccgctgggagacaggacgcgggggcagggccaggtgcagagtggacatgcccagaccccgccaggcaccaacttagttaccgctttactttgtctttttaatgtatctttattgaaatagagttgatttacaacgttgtgtttgtttctgctgcacagcaaagtgactcagttacacatatgttgacattctgttttatattcttttccattacggattatgcctggattttgaatatagttccctgtgctgtacaggaggaccgcattgcttatccattctatacagaacagtttgcatctgccaattccaaactcagttcattcccgccctgctcccctcctggtagccacaagtctgttctctgtgtcgtgagtctgtctctgtttcatgggtaagttcgtttatgccctaatttagatccacacataagtggcagcatgtggtctctgtctttgtctgactaagtatgataacctctagttgcgtcttgtctgacttactacacttggtatgataatctctagttgatactgctgcagatggctttttttttttaatggctgagtactgttctattgtatacatgcaccacgtcttgtttatccattcagctggcagtgggcatttgggctgtttctgggtcttggctactatgaatagtgctgttatgaacataggtgtgcagttaccctttaaagaaacaaaagtttgagcatgtgcatttttatcttccaaggataaaatgagaagaaaaactttgtgagggaattctcacacattccttttgtttgaaaattgtgccgtcccttccatcctgctgaagttgcccagtgacgaggcacctcattccctcaggaatgctcttttctcctggttt

SEQ ID NO: 30693 - DNA, 856 bp, Bovine  19866880642651
agtacccaaagagttaatgatactgatgatttatacataatatattaagaagtggtgctccttcttgatggaaatttatcactatttttgtctggtcagataggatcagcgtcattaggaaaagaacaaaagttttcctgaaggaactctccagagttgagaagagagggaaagaggaagtgtgtgtgtgttgggacagggaggggggagatgcataaagactgggggccacaatgagttgtgagatagaacgttctggagagactccataaagacactgacacaagagaactgttttgttattctgaaccttttagatgtacgagggaaaagaagggacgtgtgtaactagttaggcacatcagcggggaacgtgtcagatgttcacagctttagaaagggcgctgactgtgctctcgagtgtctgaaggcacacctttgcagtgagtgaaaatgctaatgtatggacaaacttgacatcttcttacttgtttgttctgtcctttctgtgtatatgtccctgttcagatctaaagaggagacgtgagaggatccaagagtgttaaatttgatcagttaccaggaatcctttgaaaagagtaacaaaagtgatttaagggactagtctgagctttgtgtttgtaactttcaatttatatttctttccataagtttcataggagaatttacaaaggaatccctctccagctcagaggtgaagtctgggcactgctcctagagatcccaaaaatgaaggaagagaccagagacctgtacagtgtgagtactgagggccagcctggcgttttgaaaccatcagtcacagttggggcatattcgtaaggaaaattaacac

SEQ ID NO: 30694 - DNA, 1024 bp, Bovine  19866880684189
tggattttgtcggagtttctatgcagtgctcagctgctaatacactgcatttgttttgccctttaataacatcattaccaagttgattaaaattacattagactcattatatacataaaaaatattgtcacattcactagctaaacaaatgttactctcattttataacatatacttctgtaccttgaaagcttaaaagccccaatttacaagaagaaccatcaatgttaggttttctattctctactgttcgaacaagagcaaggtaagggtgaaaacaagctctccagtgaaacccaaagacatactttcttggagtgcccaaaacttggtcgctgttttggtcattgtagtgtaaaagaatattctgaaatacattgctgatttgttaccatgaaactgaacttttttcactgaaccaaccaaccaaaaaaaagatttctgaaaaaatgatagccacgctatttaaaaaaaaaaaaaaaaggaccaaaatctgagattcctagtaataattaggatcattttttacaattttacaaagcaataatttaatggcctaagagcagcaatatccactgactacattctttaaaggaagagggcgaggaaaagaccatgtaagtatctccctgccctttgtagggaggtttcacaggaatttaagggacagaagtaagaaaggaccatattattaatcctgctttcaaatgaatttcaaagcagttggttctgctatgagtgactggtgatcggtaacttgcaacttcagctggcatccactggagagttatgcacacacttcctgggcgtctggcaaagcatactctgctctgagctttgtaggagtcagaccagaaaaaagggcacagacacacaaaagcggacttctctgtgaacatggacacactgcgtgctgcacttctgaaaacaaaacttaaactgcactgatttttttaagcaccattaagtggttagcctttctctccaatgtctttaattttcagactgaaagctgaatgagaaa

SEQ ID NO: 30695 - DNA, 1198 bp, Bovine  19866880731638
ccaggctgtgcagaaccatcacggcactgggtcctttcctgtcactcaagcatatttcttcagaaaaccttctctgtcaaatctaaaccagcataatctctcatgttgtcatatttctttttctttaacatctttaagatgttaaaaaaatacattattttttacacatttgtggatccatatacattgtatggcattttttttacaagttttaaaattttatataaataatgtcatacatatatatcattctgcaacttgggtttttgctcaataatgtttctgaaatttgtaaacattgaagatatgcttctaggtcatttatttgaattaacagaagtgtaatccattttatgactgctgctgctgctgctaagttgcttctgtcgtgtccaactctgtgcaaccccatagacggcagcccatcaggctcccctgtccttgggattctccaggcaagaacactggagtgggttgccatttccttctccaatgcatgaaagtgaaaagtgaaagtgaagccgctcagtcgtatccaactcttagcgacctcatggactgcagcctaccaggctcctccgtgcatgggattttccaggcaagagtactggagtggggtgccactgccttctcccattcatacctataattcacctactctctttttgatggacatttagattgcttctgatgtttttctgctataaacaatattggaatgaacagtcttgggcatgtgtccttggagacatgggagaaagcatctgtataaaaaattctgtactcagaagggtcatgggtcttgaaaatattgaactttactagatgttgccacgtttctatctgagggagatgctagcagttcattcccccaacagcaatttatgagactttctttttctccatgtcaaacaatctgattttgttctgagaagatcacactagtgatgagtaaaaagtgagctgggtgagggtaggaaggcgtgcacgggggtccagacacacagagagctaagaaccgggacagtcaaggtttctcgctccaaactggcggtggagaacttcctgcacgatcctctgctgtctgttcccgttttcccttttatcattgggctggcgaggacggaattatctgcttgtcaagtgttatcaatcaaatatcaaattgtgtgggcaactgaaccgctcttctttgtag

SEQ ID NO: 30696 - DNA, 1342 bp, Bovine  19866880750399
tttaattatagacgccctttacactaaccctcagaatatgggacatctatatcttcgaaggagagcgagttcttactgctatgtcttacacaatcttaaaattacacagaagtaagaaagcatttaattataaagatttcacaaaagctagccttgttttaaatcttgacttctcgttacccacccaacttcaaggtcatttctttttagtaatgagtttaaaaattctttaaaatcagtgaagaaattatcttcagttggtggttttccctcgttggttcttcgtcgtgactagaagcttactccttgcaaaactcttaattcttttctctgtgtcagtttcatcttcacatttaagttgaatgtagtatgttggttttactactactaatattcctactagttacttgtttccatggtgtgtgtgtgggggggatgtcccttatttatttattttttttctttgataagtttaatacgaaaagggagagaccaaagaagccaggccctttagttaacaggtctacagagggcgttttctgtgattgcttcaccaggaaaagagcatccagccccacgccatagaccagagttggggaccctccccctatctccctgtctggctgctttgtggcctctgtagcaagtaccctccaggcccacagttgtccaaatgtagcaaaaggccttcagttgcaatatcgcaagggcttggtaaataggatatgctgtgccttactctgaaagtcaagaagtgagagttgctctttatgaatatgagggaccttattcaccttaaagtcttaaactacccttaaaacttaggcactccttttgtgaccatgcagagaagggaagagaagctcacgtgggtgcccctcaggcagcacctcccgcctgcggcacagccctgagttcacgctcactgtatactccgcccgcttgccttgttcttgaatggtcatctcttcagtttcccagctcagtgacacattagctgagtgcttggggtcctgttctctagttttcctccccgctgtggctttgttctaagaatgtccttggtactttgataggaaatggtttgattgcttacttgaaaagcatggtcttcaggagcaccagattattcagattctagataagactgaaactttaaaatcacatctgtgttgtttactctgagagaagaggattcagaagtcttgaggttcacgtccctgcctccccaacaccaaaccacagccctaagatgaagcagtttggcagtgaactgcctcccaaaactcagatctgggtcataaccgcaggaagtcagtcagtctccctccctcccctctcc

SEQ ID NO: 30697 - DNA, 1369 bp, Bovine  19866880840815
tgtgatcccatgatgagctgggaacattccacatttcctctgatcatggccgttgtgacaggaagtgctgttccctttaagcaagccaaagaacagagtcgtttggaagtgagctgccttcgacgtatctgggttacagcagtcagaggactgctgatctctaccagctgtatttcttttttcttcaccacataaaacagttgaaaatgtatattcaactactgatagaaggtcacattctccagaaacactgatccttaattaaagaaatacaaaagcattacagagcagtttccatattacttgtctgtggctgctttaaaatactgatgttgctcttatttataccaccaccatcatcaccagctcatctgctaaaaattcttactggaaaaaagagccaggaaagaactgggcaaaatccggcaggcattctggcaccactgaagaaggctgcacagctcagctgagagcccagtaagagtcggaagacaaacccatcatacgtcctaacagcctggtcctagccgaccaggcactctaccaaaaggattggcgattaaacccatcgcatagggcccacgaggacatcagatctcagcatagcctcatgtggcaatgttcagtatccaccaaaaatggaaacatatacttttactgcacagtaatgtttgctataatttccacagcagatagtgtcagtacaactttaggctaatgccctagttaactaaagaaatttgagacacctcttctgggttctgcagaatgctgaggatggacatttcatcaatacctgaaatgataatgaccttcagatcctggctttcagcttcatgaaggatgtcgctctggagagatttcagcatggccaatgacagcgcatttctcctctttggatcactcaagacgatgctcctgcaaagaacattttataattactgggttgtgtgccagtcaaaacaattgctgctgaggacccctgctgcaatttgggagctgtttggttttttttttttaactttgtactatgtattgaggtgtagccagttaacaaagttgtgacagtctcaggtgaacagggaaaggactcagccatacacacatatgtatccattctcccccaacccctcccatccaggctgccaggtaacactgagcagagtttcatgtgctatacagaaggtccttgctggttatccattttaaatatagcagtgtgtacatgctcatcccaaattccctaactatcccttccttctaacaaccgtaagttcattttctaagtctgtgaggctctttctgttttgtaattaagttcttttgtatcatttccttttaaattccacatataaagggatgtcatatg

SEQ ID NO: 30698 - DNA, 1189 bp, Bovine  19866880887973
tatatagcaccagatagttctaagttttgacaaatagtatgttcctctgtgcccacaaagtccaccttaaaatggttgaccattgtctttatcctacagttatgactgtagctttggagctgtgaatagatacatttatctctgtaggtatctcagcggtttctctgttagtccaggagtcggggaatctgtgcattcctaatgaaggttgtaggacagggagctgtgaaggaaagcggaggagacccagggttggaccctgattgacagagatgagttacgagaactactaagctccagagagatagcattagtcacgccatgttggattccatagatttaacacctggttgttaaaaattgtaaattgatgaattgtttaaggcagtgacgttattgagtctcccggtgtctggttacttaatagagattagacattaatatggatttatggctccaacactgggaacctttagctggttaagaggcagcagtagctgactatttgaatgtaaagggaactggatgtgcccctgtggacgtggcaagttcctttgtcctgagctgcctttctttttgacaggatgtttctctgtttttggtgttttttttttttttttttttcagcttctgcagcaggccacctcctccagcaacctgggtgcattcagtggcattcagcagatggcgggtaagtcatgaggcctgcctggcctttggaccgctctgttgtctgaatttgggatgggttcagagggtgaagaagatgggggaaagaaccacaaacctgtcctgttggcttaggtgttacaccttagagtaagctgctcagaagttgattttctatccctggcatctccaacagttctataacaagaaaactgggggctgagaattcctgcatagtaccctcgagaaagtggaaagtgttagtcactcagttgtgtctgtttgcgaccccatggactgtagcccaccaggcacttctgtccatgggattctccaggcaagcatactggagtgggttgccatttccttctccaggggatcttctggacccagagatcgaacccaggtcctcccacattgcaggcagattcttttaccctccagagttgtgtttattttttcttaaagggtttgactgctggaaggtggggaagggggagggggggatttccagcaagag

SEQ ID NO: 30699 - DNA, 799 bp, Bovine  19866880904658
cttggggatggtgggaatacctttcactgttagttttaatacacgggatcacagtgcacacttaggaaaagcacagagcccctcaataaaccaaacaccagttccaggctcaatcctacttaatttatgcataaacaagaacaggtgtttttctggcagctctggtggtgctaagctcttgtccccctttaatgtaaaactcatctgaatctaacatctgcatactatttcggacaacgtcaggcccatcgtccttctgatgtgtgactctagcaacctcttggttgcaaatacaaccacctccccagctggaggaaggatacctccccacttgtgatacctggacatggttctgcacggcagtttgacacactgtggtcacatgttcaaaacaattttttttcaagtgatgcagaatgaactctccattctccaccttggagacaaggacaattacagcagtttcctcctaataaaaccagcaaacagtgattatatatgtttctataacttaagagtctacactcttaagagaagtgcaagagaaaagcactcactcgcatctcttgccatgtggttacaaaacactgagctcaattgttctaacaggctcaccctacttaattaacaaagacatcctggtttgtatgcgcaggggccacgctcaaaaaaaggcttatgaggacaagttctgcacaagcattttattttttaatgactacagaagctcttggggcccatcatattaaaagtaacaaaaaaggagggaagtggaactggttcttaattacttttaact

SEQ ID NO: 30700 - DNA, 1036 bp, Bovine  19866880946791
ttaggttgctcctcggcggccgcggcgcgggctctcactgcaggctgctgttcggcaccccccgcccgagcccggggcagcgcccccaccgggtgtcacccggggcgtggacatcttgaaacccggctcgggaggcagctgcaagttaagtgcaggtctcgctccgcgaggctgccatcaacgcatccgcagcgttatcagtctcacactggctctcatgtggaaagaaaggcaaggttggatttctgctgcctttcccaccaccccgccctccacccctcttggaaggtttttggaagacaggagagaggtggtaataataaagtcacatgaaaagaaaatgaaacacttggcagtccgtcagatgactaatgcaagatgctggtgatgaatttgcagagcgcgcgaggcatccatgtgtgcatcaaattagtacgttgttgctgctcagaagagaaagtgctccagcaatgcggctgggtgcacccgattggctacccacgctggagaaaagggccctggctgggaggagggctcccgtttaaaaagcacattgtttacgggaccggggcacaaaggctttaattcagagaggcaaaggcgatctcagaattgcctgctttgtgataggaggggggaaaaaaaagcagtcccagaaagttgagttcccgctaaaggacactgaatatttcaaatctttcacactccataaattgctctctgtatatctgacatccagatgttgcacttgagttctaaacaatcacacgtttgggagagaaaagagtaagtctgcctttccttctcccagcttcaataaatatctggggctgatacaaagagcaaagaccataagcttttacatatcaatcctccttaatgctgttttccaaaaccctcatttgaaagagagaatgcttgtttagaacctgcaattcgagtcaccaacatgtaaaaggatgatgaaggcattcatatttgcttggatccctccaccatttaagctgcagtaaataataaagcaaagccacatact

SEQ ID NO: 30701 - DNA, 3406 bp, Bovine  19866880965818
atcaggtgtccaaagtattggagcttcagcatcagtccttccggtgaatattcagagttgatttccttcaggattgactggtttgatctccttgctgtacaagggactctcaagagtcttctccaacaccgcatcaattcttcagcgctcagtcttctttatggtccaactctcacgtccatacataactactggaaaaaccatagccttgtctagacagacctttgtgggcaaagtaatgtctctgcttttgaatatgccatctgtgtctatccttgttggttatctattttaaatagagcagtgtaaagtgtgtacattgctttttaaggcacaatggtattgcacgtggaatagactaatagttacagtatgaaagtgttagtcaagcagtcatgtccgactctttgcgaccctgtggatggtagcccactaggctcctcagtccctggaattctccagtcaggaatactggaatgggtagccatttccttgtccaggggatcttcctgaccagggaccaaacctgggtctcctgcactgcaggcagattctttactgtctgagccaccaggaaagcccagatatagtgaaaaatatacatatacgtaacttctgtatgcaccagaaaatcaaaaaatgtgtgcagctcactttgttgcattattcactttattgaaggggtctggaacacaacccatagtatctgcaaggtaagcctctattgaaatttttcaaacattaaaatgctagcaacttccagaaaaatacattcactcctttccaggtcctgaggacatactcctgcagctaaagatctcactactttttccttccacttcacattacctgttgtcctggcccacttaccctccagctggaataattcttgctcttactgagttgctcccttcatcagcacttaggattctgcgttggaaatgacgttcatgctggatgagttggttggaagtcttctaatatgcacaccattttttgtctttttcccttattggtaatgtcttgtatccctcgcatgggttacttgagctccatgcaaaccctgcaggatttcatgttgtttttccccagttcagaatccctacctaaggcactcatccaggttaccttcaccttttcagtgctccatgagcatcttcttatatttggaagtttctagaaatagctctgtatttatggtcatctcttttcttcaactctgtttctcttcaaaggctacccttgacttaaaaacaaaatcacagtgggggtggaatatctttactcctcacacaagggaaactatgaaataaaacgcacagatgtgcagaagtcagttcttcagctaaaaccgtgtagtcccggtacagccctggaccaatggcgctcatgtccagaccgcatttcccggttaatgccgggccactgggcacattttcattttcactctgtgggcctctggtgggtgtgtttcataaggacattatctggtggaaatgccacattttctgatgttggaacaaagtttcaacataattgcctctgaaagacattctcagctctgcatttgcagctcagtatctcactcatttaaggcaaggtctgaaaagcagcaggcgtgtgagtcaagagaagaagggaaaaacatctgtctcccagcctcagactgattcgttacctgggcaaggaggcaaaatacctaacttgtagtttgatgttgcataaataggtatagctgcggggtgccgtctgctcaggacagagcatggcgttctgtgtcagaatgtttactcttaggctccacaaatgggcagtgtgtcgtttgcagtggaatcatgcttattttgctttctctcccaactccgttggtagtttgatcttgagcaagccacttacaaaggaaagaaacttcagaaacaaatttaaagaaacattgaaagatttttttttttcccatagggttttcttggccctccctccccatggagccttcatagggatgtgctgattggagtaccaggaagctgaaaatacactacacaccaaggctctcttgtttatttctgtgttgaagccagggcagcttaatacaacttgagaatgactaaatccagccccgtagcataactgtctgcatccccgtaatgcagtagcccaaggtaatctgcttgtcaggcactttcctttctgatcccagcaagtcccacattctggaagcaaatgttgtatttaccataatccacgaaaggaaaaaaagccccggctaaaaatacaaaacagaacaaatgtgaaatgtcgctgccgctccagtcctgtaattggtccataaatgagtctccagcatctgtgaggcagagatacttttatgtatcactgaaagcactggctgcacttcagataggtttgcgagggcatcaggacgcctaagcggctgcacgaggcattttctgctgaccaagcaaatagcggcaggttgtacacaggactctcacgtttgcaagcgcgattgcctggtgagtgattacatttaatatgagaatcaggtagggttgttcgcccagaaccgattggtggggtggagatattaaaggctagaattgcttggggaaatctctattctcaaatcagttactggagaagggtggagatgctgaggaagtggaaatagagagaggaagtgagctgtggggagatgcggggtgactacagagagaggctggtaaacactgaactccctttaatctgaaagtggaataaccacagctgaaccaagtggatgatccagacaggcctctgtacagtacaggaagttgtttaattgatttttcttcatttagcatcattgtcaatattagtttaaagctgtatagagctttctgggtggtgcttggggtgtcatgacttttatatcctgctattcaccttgtataaagaaggctgagcactgaaaaatgatgctttcaaattgtgatgctggagaggactcttggacagcaaggagatcaaaccagtccatcctaaaggaaatcaaccctgaatattcattgaaaagactgatgccgaagctccaatcctttggccacctgatgcaaagagccaactcattggaaaagaccctgatgctgggaaagattgaggacaggaggagcaggaaatgacagaggatgagatggttggatggtatcagtgacttaacgaacatgagtttgagcaagctctggaagatggtgaaggacaggaaaggctggcatgctgcagtccatggggtcacaaaaagtcagatacaacttagtgactgaagaaccagcaccaccttgtatgagaaacagttattccttatttaagcactttcccacttctcagatattacttaaaaattaaagaaccatgggaaaacacttccatt

SEQ ID NO: 30702 - DNA, 743 bp, Bovine  19866880970248
ttcttctttctttttaaaggcaatttagttaagtgagcaaatactgcactggaaaaaaatcgtaaatcatcccaagtgggtccggtctgatttagttcaatatttaaggtgttctttaagtctttagtaactagaggcttgacaccataactgggagcaaaacatcaaaagtaattaggtcagcctgtggtgttagaagcctctgtcctccaaataatgtggttgtaaatatgtattcttctgcctcctggaaaatgatgcaagtcctctgagccctataaaaaatacacgttattagttctgttagcaaaacttaaagttggaactggaaagtcattaatttcagagttagctatttattgctaagagtgttcagcaccctgacactctcagaatggaaaggccaagtgagcctcttgacagctgaattatgaacgattcccccataatctttaccatccagcacacataaacataaagctaatttcacttttatgaactccagtcccatagctgtagaagttgtgtgtgaatagaagaaaaatttgtaggaggaagacaatcgtctgatacataaactgctacatcaggattgagacataaattctatatatgaggagttttgcaacaaaagcccaaaataatccttgagaaacaagtactgaagggaatggaaaaatacaaattagtttgggaaatgacctgcttagactgactagagcaagctgttttctgctggttca

SEQ ID NO: 30703 - DNA, 1718 bp, Bovine  19866881004646
ccccgtaacccttattccattaatagtcctctgagccggtcagcctcctccctggccttctgtcttcccacctgctcttaccaaccaccctccacctatgtgctgtagagatactccaaaaggcagatctcttcctgtccctctctccctccagattcctctttggctccctatttccctcaggataaagttcagtctccctgatgtggttcctaagtcctaccatgaccctgcctctctgatgctcttttctactcccctcctagatccttgcatggcttgtagttccctgtggacaccaagccttcgctcactctgttgctctgccccagtgccgttcctgcctcccttctggctgtctcctacttgtcctttccttcttacctgaagggttatttcccgaagacccttcctgctaccccctaccccacagacagaaaacttgtaacatttcacttggaaatgctgcaccatcttcgttggcttcagaaatctgacctttgcagatgctgcaataaagagttgtaattttaaaaaaaaggtctatgaagggcagggtcagctgtgggaactggtggtgttttgccccaggaggggtgtctgtggggttctgcgcagggaggggcatttgcaggggtcagtggcttcagcccagttaccaccaaccttcctgttgttcatcttggctgaccaggtggccacccagttcaagatgagcctcctggagctggtagagatcttgaagtcaaaggagcctgcctacgtccgctgcatcaagcccaatgactccaagcagcccggtaggccctccgccccgtaggccggtgggggcttggcctcccctgcagaggccggtcaaagcccgctgaccagccagtgatctctgcccccaggccgctttgatgaggtgctaatccggcaccaggtgaagtacctagggctgatggagaacctgcgtgtgcgcagagccggctttgcctaccgccgcaaatacgaggctttcctgcagaggtgggggcggggcctggcttggcgccagggggaagggctgggagggtgtgagcctctgagatcctgggcgggaggacagccctcagctgcggtgggagccacaccaggggcccctccatgctgcaggcctaatgttaagcttgagagggcaaagaccagccctccccacgcccaggccctggcctcacagagcagctggtcaggggtccaatgaggcacgcattcacatacctatcaccagtggagacagtaagagcctgtgaaggggacagagtttgcagtcagttcagaaagcaactttcgttgttatccctggtcaggggtctgaggagtcaccaggcatgtctttctaggcctgtgacctcaggcagatgttcaagttcagttcagtcactcagtccgactctttgcgaccccatggactgcagcatgccaggctcccctgtccatcaccaactcccggagcttactgaaattcatgtccatcaagtcagtgatgccatccaaccatctcatcctctgttggccccttttcctcctgccttcaatctttcccagcatcagggtcttttccaatgagtcagttcttcacatcaggtggccaaaggattggagtttcagcttcagcatcagtccttccaatgaatattcaggattgatttcctttaggattgactggttggatctcagatgagaaacctcaattt

SEQ ID NO: 30704 - DNA, 2514 bp, Bovine  19866881023636
ttgaaaagatgacagacctcacttgtaaaaattccaaagtttaagatatatgctttctacctgtcactacaaaatcatacattctcacttaaaaataagttgtttctctcttcaaatgtcccccccacctaacaaacggttaggaggaagccatgggtccacagttgtgagcaggcagatgccaccttgctttcatgtagctcatggtttaggtgatggtaactattatttacccacatatcataattttaagatattaaaaaagttcaatgagcttttccttggaagggagcggagaatgatggtaaataacctttaaatagatgagccgccagactcagagttactgagctaaaaataaactttgtgtttccctaattcagtgggtttttttaactttttaaaaggaaattcttcttctctaaccaactctcatatgaaactccaataaataaaaaaatataaacaaagctgctctaggtaaagtggaaggaagaagtaggggaggaaagaagactaagagagaattgaacatctggggaaaataataccacatcatatcctgtccctatgttctcatatccagagatttccatcctgaaatcttccggatacataaaaggcatgcatcagcaaagactaataggatgcatggtaaaatgcagaattgcaaatataaggcatgtatttctcaggaaaaggaatgaaaaaatgaggaagtaatagactgaggtggtaatttcatgcctgaagcaaaatggaaaggtatgtgttatacatatgagggatttttaatttttcaatataaagggtgagaaaagtattcaccttacacttaacactactttatattcaagccaatatacacatttctctaagaagagacattaatattctatgcatctacacatcatattagaattaaaagaaaattttagcatgttccatttactgaatggtcaagaggccaaaatccacactgggagggaaaaaatctgcaactgttttaaaacatccaaaaagtagcttcttaaaggtctttcacggtcacccataatacatctccctttcaccttaggagtcgataaccagctcaaagtgcagtcctacttattttgcagtctagtgtctaaaatagtaacagaatcacaactgaggttttgacagaatgtccactcattcatatgtaattattcttaattagagtaatgatgttatcactcaaataaacagtacagagacataacagtaataaatacccaagatctatatagctaagaaactagatatagcaggatttggagggaaaaaaaaaaattcagtgcaaacaaaaggacatgatgtctataattaactgctgaatgtcagtctctcactaggaacgaggactctaagaggtaacgatggatacctcaacttaacaaagctatttagaggatacagcccttagctcccataaagattgtaagtaggaaaaaaggagagtgctttgaaaggagcaatagacaagcatataagaaacagccttctaaaacctaggtgcttgaaaaccctaactcctccccatattatggatagtactgaaggttaagccagggggcctacgcgggagggtcagtgtgttcccaggcaccagggccggacccgcagtgctggggtctgcacaacttagaacagcacgggacagcagctcctgtccacagggacctgtgaccggggagcgggcagggccgtgactccgcacccacttctgtcctctaccagcagtcgctgactgacccaagccctctgaacagcgcaaatcctcagcagttcaagggcaagcaaatgtacacttgttcacgtttctaagggcctccgtggcagtgggaagggccctgtctctcaagaggagggacctaggagaaggaagggaaagaggggaggggaaggatgggccagaatcagggagaataatgggggcgatggggcggggagatacccacagcagagcgctgggcctcctgaggccgctgctggactgagtgaggcccaggactcatctggcaaccacagcagcaaaacccaggggccctgcgcccaggagagctgacctctgtgtctaagtacaggatcaggagaaaaatattctccgacttcattataaagtgattcctttctgaagcacatacaccattgtctcatgtgctgaagtacatataccattgtctcatgagctgataaatactctctgcccttttcccacacaagtagatccgtataagcattaaacattcttggacagtatctttcacagattcaaactattcaaactatgcagcgccccccccaccccgcccaacgtgcctaatacacacactgctgcatttggtctttggtttaaatatctcctttcacacctaagcaacggggtataactaaaagattcaagcataattgatgtcaaacagacggctataaataggcaataagtattaatatttattatccaactttcattcggacttcttttca

SEQ ID NO: 30705 - DNA, 2514 bp, Bovine  19866881070484
ataaattcttaaatatatggtagatactcttattaaaaatctcagaaatgagattttgttactttttgagaaccgtgtcagtaataaatgcattcttagacccttgattcaatgcacaggtgaaactaaaaaaatgggaaatgggtgaataaaatgacagtgactgtttaggaatgcaatgtgtagttttgctgtcctctgcatcagttaaggttcagccagagaaacagaaaccagtaagagatgtaaactgcaggatttgctgtgcggaactggcttacagcgtgccggaactgactagcaagttcagggtccgaagtgcaggtgtcaggaagggccttgggcgctcttacgaccttttgaccgattgcaccagggcttcccagattatggagggtaatctccctgacttcaagtcaactgattatgtgttttggttacatttacaaaagacctgtttcacagccacacctccattagagtttgaatatctggggattgcagcccagccaagtgtacataagaagctcagtatcacagaccacactcatcaacttaatttttgaataacgacaataaagttgtacttccttataatattcggtacttccacaactattctgcttacaactcaaaatatgccaaccccctcccgacagaatgatgctgagtccttggggatatgtactccttttgctttgatacgtataacctaaatgctgtgatataaagtcagctattattaaacatcttatggtagatggggacataagggaaaagagaaggagcaaagcacattaaaaatatatatgtatatccacagacattgataccaaaataaggaaaacatactcttaacagatgcagtcgtcatctccgtgactgggcatgtggtccctgctggtcataacttacttaccttccacttcccatcccgtgtaccctttgccctcaacaggcaccttggctgctgggggccctaaacctttattcttgaagagtctaccattagcagtcctgcctgaatttgattgtggcggtgttccgtggacttgaatcactgggttcggttatactcaaaggcaccttcagttattctctgtcccagacgtgctcttgcttatgtccaccgtgtcctagcagctcacctttccccttaacgaccaggatcagtcaccagccggcacactcgccgcctcctttgcccgctgattgagaggcatgcggagcccatagtggtaggggtggccaacctggctcccagttcggtggaagtgtttgtctcctagtggggacactcctctctttggagccaggacctctagagcagcagagcctaaggttgatggagcagaaagcaaacatgttgttagtggacaagaggcaacggtgggtggagccactcctgttcccacgcttggatcctgggccctgaatcctggccaggggagaggtgatgccagtcctggaagtcgatttccagcggacaccgccccctaggggacgtgcccccaccctgcaaggtgctgcgggatgctggccctgtgaatgaggcttcagcaggctggtccacagctccgtccagccggccccttctgtggcgatgattctatagtgagaactgaaagaggacaccaaattgaagacatggtgatgtgctttgtgctttttgttataaatcctttctgtcaaaatgagtgttatctagcctcaagtttgggctgtgtattgtttaaatttgagcttggggtcatttctttataataatagtagctttatctggattatctatttatcatcagtcaaactgtgtggtttttttttttttaagttcctaattttaaaagtgaaaaaactaaattgtgttccatgtaaatttctttcctctaggcaacaatccctgttccacgttcttgctgcatattctatttataatacggtaagtcagcgcctgcctgcctgcctgcctctttgagctgtgttctgagcacctggaggaaatctttgggcctccttcctgaaaaaacccccttggcctgtgttgcttcatctcaggactggacggtctgtgtggaccttcccaaggctccctcatctgccccagggtatcagagcagagttgcttggaaagtgggaagaaccacagtaggacagcaaagctcacttttccccccttactacagattgctttgttttgtggtggtgtttttcttgtttttattttaagcacttaggactgggaattggcagggcaagaggggcaggaagtagtggctagattaattctgtttgactcttggtgactcttcgttcccctggggggttgcctttcagaatcacatttcgtttatttggtgaggtccggatagcagaacgtaggtacctacttgctgtctcctggagtaagccaaaactaaacattttggtattagaacatgttattcttaaggcattgattactcttgagggagagagatttgggggaagagatcagctagtgtcaacgccagtata

SEQ ID NO: 30706 - DNA, 1357 bp, Bovine  19866881079112
acccttaaaaactatattgtttgtattattatgtatcagcttcaaaggcgactgatgctatgagttagggctgtgatagttcagcggtactaaattccaccaatctaatgtcctgtgagcaactggaactgctcagtaaatgaaatggacgagactgtacaccaatagagtaatggggaccaatggctgcactcaaggcttctagctttattcttggtataggtgggtgtaagtcaaggtcatatctacctaccaagtgctgcttaagcttggacaaaaatttattcagtattttttcatgatgttcttgaaacctcaagagtttgggaaaaccatggacaaaaaatcctagaatacaaacataaaaacaatacttcataaataataacaacagaaacccctagtttaaaatgcaacatatttcttttatcttttagctgttaacaacaataaaaacaaacctaatagttacccaaatatttttacttctctccaaggtaacaattatgtataagctttgattaatgaaaacttatagcctagtatgtgtttgctaaggatcgcctatcaccttgtaaaaatataaaagaggacagagtatttctgaattaaaagggaaaataagaaaataagaaaaaatggaaactgaagctttttatcaagattatctgtttccttgaagtactgggtaaacacacacttctataagttattctaatcttgatcacttattttgcttccgcattatataaaacaaacactgtattacttttttcgggcttactctaacagtatcattagagtaaccatgattcccaggttaatatcactttttaatcctttttataagtgatatgtaacataaactaaaacatacgggcatgtatgatcaatgttaacatagtctatcccaaatgattatgcaatacaatctataagatttctaggaagtaactgtaaatgggaagttagtattaactttgtgtatgtaactcatggaaatttacatctatttttattcacaagtttcctttcagatattctaatagtccattaaaaaggatgcacacacaatgaatttgatttctccatatgggttcttcagcctgggttctaggtaacttcaaaagacgttaataagtgttctatgtttttaaaagaatccaggagaaatactgtatgtcacatatacccttttttgcatatgttcacaggcatatgagcttttgaatgtttctaagttgtttcatagactaaagacacttgtttttcttggtttacctcatctcccagactcatctgattcttggagtccaatatttccccacagaacgcatgtttccaaaacgtaaaagta

SEQ ID NO: 30707 - DNA, 4248 bp, Bovine  19866881087837
ttggcttatctggaacattgacccccccaccccctggagggggaggattaattaatgtgagctccagcagcacttggaaaaggtgaagcctgatataaatcttatgcgtgatgattatttccctgttgccatttctaaaggttcatctacaaacttccctgacaaatcccttatgctctgcagtccacagaactctttctgataaatccctgaggacagtgagctccctgagccagggctgtccagagctgatacccaactgccttcccagcgagggcggtcatgtgttcagactccagggaccccctggatgtcgccacatttgctgctttgtggggcttttccagctttctgctttttaccagcagtccagttgagataagctagtaaggtctcccttttccttggtgagtccatatgcctgtgttgtgcagttttctgccggaatggtttcctgccagtcaggattgcgcttcatcctggcaattgaatgtacagcttttagacctgctgaatccacatacagtcctgcaccgactccagccgtccagtggaacacccatcacaagtgcatgctttccctgtgaatgaaatcgctgtcctgtccactgttaataaattgtttcttttcaaattttgtcaaagtccaggggtgaacattgtacatgtggttacacttgtaggaaacttggacttttcttcagaggagcacaaactgatttatttacaatttggagaaaggctttgccttcttcaacgatgctgggtattacttgatccatttgattttctgtgaattctcccatcctgtctgcagaagtctcacctccaagactgagggccccgtcctgttactggtgaggccactgtggggccctgttctgtaattggtggacaggaaactcacaaagcttcagctgcacatgagaaatgatatcagacccttccaggtaaatatgggaatggccttggtttcatcgtctgatgctgagaaaactgatacccagagagttttgttaggtctaccagaatcttccagccatccagcgtctccctgagtgagatgcagctgtgtcggtccactggcagaggtgctctgttgaaaggcagtcagagaagatgggaggtgttcttcacggcaaccccaaagtggtgtgttttcaaagggagctgcagttcgcagaactcgaggctggtgacggctgatgcctcttcctaaagggagaggttaggtttagagcagagggtcacgacactagtagtgcaggaccagtctctgatacgttcccccagagagtggcatgagaaagaactgatgatgtaccccgcgcaccgtgctgccagtccatcaagagaattctgctcttaaacagtaagccacagcaagagggacagtgtagaaggctgagtctcacgctgtcccgttccccaccaggaagccccaggcccattgccaagctcttctgcttgtgcctcacacagctcagccttgggcagtttcctccagtcaccacacaaagcctatttctccatgggctattacttaagtatgaggatattaaaaagtgctccctcggcccattaaaggagcagcctgtccactgactgcaaggatgggcctgcagttgggatgccaagcagacctggcacaagttgagagaaaggatgctctgggggcagccccgagccaccagccacttgcagaatcagagaagcaaagagccatatggggactgtggcgtctctttgttgtacacatacggaaactgagtggttactcgattaccgtgggatctcactgttaatttaatgctgagccaagacaagaacccaggcaggctggccagtccactgccgactgacttaataacttctgggtgactcaagcattggtgtcatattcatggcccctcattttgtttacccgaaacaacttcctgatgaaatgttttggtgaatctcaactctctatgggggctttagaaaataaaccacttacatttacatttatttaagttcattaaagtagaattttgaaatttggtttttcagttgcagtaacttcaagtgtgcagtagccacatgtaacccttggttaccatattggattgtgtgggctccattcccatcatggcacacagttggccgcactgatacaggaagtcccaaggaacaacaacaacaaaaaaattaaaatggataaaaaactatggagtaataaaactgttagtaactgtcaaggagattgggcttcccaggtggctcagtgtttaagaatctgcctgccaggcaggagatgcgcgttccatccctgggtcgggaggatcccctggagaagaaaatggcaacccactgcagtatttttgcctgggaaatcccatggacagaggagcttggtgggcagtggtccatggggtcgcaaaagagctggacatgacagtgactaagcaacaacaaccaaggagattggctaattttatccaaagtttttccaaggcaaggcatcttcctgtgttgttttcaggttggtatattttctgacggtggcattttatttacttttttcaacttttataaaattatttatagccacttgggatttctcatacccattttgtaagtttgttattctttcttttgtatagataagggagatataatacagaaagtttctgtccaaggaacaagataaaataatagaagttgtcatttattttgtttgcattctccaaaaagaagcctgcattccctgggcttcataaaagcttgcatcctagagttaataacaataataagaatgcattgaatcagttattataatgtctgtaatattttgctacttagaggaacctcagaagattttgcatatcctctgttgatctagttctctctactcgaaaatagagtagggaagtaggtcagtgtcagcacttaaagcaaagagtaagcactatcatttttccccccaacatcatcatattttcatcttggctctgagatcaatatcaccagtgcctgctggcttagtgccctccaacttgtggtccgattccatgtggcatctggcctggaggaaccttatgtggctctttgccaagagcaaaagtagaattgacacccaggatagtatcgtagtttgtaggtagcagagatgtatgggcttgtgtctcaggcctgccagcggccactgagtccacaggacacatcaccctcaagaaacccagttcacagactattaagcagtaactgttggcctttgttactgtgtccggattctgtgtactgtgttcagattctgcagacacctcttcttaggagagtgacattggaaaagtcactttacctctatgactctcagttgcttcatttccaaatcgaggataataatttcatctttgtgggagctgttgtggtgctcttgtgtcctgtacctggaaaacgctgtttggcaaagagtaggctgtcaataaatctttgaattagaagctaattcctgccctgtgctgggggccgaggatcgctagggagggtgggaagggagctagtctaatttcctaagtctgagatcagattgcaataaatagaaggtgttactgagagtcttagtgagagttggggtatctgttcccataattacccttctttgtagatcgaattgatttccctgtggcctctggcaagtaccccgaaaggtttaactgtcacacacatgatttctggcttccttagaagtatcagcgcttatagccccatgaggacaaaagagtcgttaagtcttctgtagagatgaatatcagccgggaagaaagttggaagtccaaaggaggaggagctcgtgtgttagaactaacttacccaggctcctgataacataccatcgggatccagggcatgggattcagcaacacaggggtcatcaatggggtaggaccactgatgcttcgatcaggaagatgtgcctttgctgtgagtttgtgtaacagctagacattgttggacttagttaatggatagtcatgctcttagcatttgatgcaaacctttgaaacatttgtttgcaaaatggccaggtagtgggaaggattcagatatggaggagaggtgctcattcatgagatcctgtgggagtagaaagggaggcagtctcgggagttggagacgctttgtgtgattatggagaaagtatgggttgtaatatagtcttaatagactcttaggttccatactttgcacccggattctcacaca

SEQ ID NO: 30708 - DNA, 1461 bp, Bovine  19866881101328
tttctggttggcaaacagctcttccttgagaagagaaccaccctcttttaacctcacaaagcactctgctcgggtggacatccttcaaaccaggggcaaataatctgagcgatgagaaatgcaaaacattgagataagttttaggaaatccaacaatgtgccaagatggccggggggtggggggaaagttaggcatacaggggttccacttttccctcattactctggaaaagacaacccatctccaaatgaggaaagtatgtaccgaagagtgcacactgtgcctacttgaaactgaaggtttttttttttttaaattatttataaggagaagggcatgaaaatttaattgaatgttcaccttaggtaattctgtgtcttattgttcagagcaattaccataaatctgcatttcaataagcgagaacagatgtcagttgttaccagcgcttgccaatcaggtctgttagaaagtgacagatgggtggttatggagcattctcgcattctcctaaggactattagcagggagtgcggggtgtggaggaggggaggctgggctctgggaagaacccggggcctttgtgggtccagtctgcacacctcccaggtgtgtccccaacgcgaggtccagttttggccaaagtcttccctcttctccgctcgtcacagacacgctgagaccgtctttgctctgagccggatctccgaccagtacagaagtcgctatgtggttctttcaggcagacacttgcccactatgatttccctctgactttggaaacttaggccagagattctgaaagcaaattactacacgcttctgactgtcggaagtcaagcgaagcagttttccctttgtcatcagatcttcttcttaggccaccgcttcataacctctgcaatttcttactaacaagcccccctcaccctagaaaaacatttcctctagcagaaaaccaccccctgataaatctgtgacgctgtccagaatgaaaggaggtttttctgcggccgacactggattgcttctcttggagcagttttggggttcttgtgcattgttcactgatggctcagatttgcttcttggttggtctcctcattcgtctgagtgattccatacctggatttgtggacgcgcagtgcactgagtggcggccgggggcgggggaggcgacagggagctcaggccagtttgaaatgcggacccgccatttcttaccttggtgactctgggcaagtttgttcattaacttctctcaccctcagttgccccacctgtagaatgggatgctaagagtccctatgtcacaaggctgctgcagtatgtgggagtgctgtagtggtggttttctccctggcgtgccgtaaagtgtgaggatgaaccccaggcttatttcaaggtgctctgtgaaaagcaaactggtgtactactacccttgtttttctaacatgatg

SEQ ID NO: 30709 - DNA, 1123 bp, Bovine  19866881111856
catgttctttcaacttgttgagctgaccaagaaatgtttatttaacatgtctttcttagaagtgaaggttccaatgaggtaactataataattaagctaataggtcagtggttcttaatttcttctggaaatcgacccctgctgagaatctaaagaaagctatagaccctcttccagaaaaatacagtcaggtccagagatttaaaatcattaaatgtcagaggatcatgggcctccaaaaacctactaaaggttaagaacactggtactgaagcaaaacatttaaaggtaaattcactagagtgtcagagactaagtaatagtttcaaatatacacagcatcaacagtaaatacgaagagaattaccattttaattaggttaaaaaggaaaacaaaacatatgtcccataaactaagtatcatcacataaattccctctagtgatgacttacatggaatcaatcactgtactgccgagactttaatagctctgcttcaatttctccatttacagatttgaatattgaaaattacttacatttcttatctatactttgtggggcactgaagcaattgataaactgagttaatttaggaaaactgaaatatattttgtccttgacctagaacaatttggtgcgggctacaaagaaagtgaactgcatcagtacaattatcattaggatgaaaaagaattaatgtggttgaatgttattaatatacaagctcagcactaccacaaatctcaggttgactactgttctatttcattaaaatttaccttctcggtggtaaccttggagagatctttgtacaagagcttccggacatattcctggagaggaggacgtttctttttcactgttttttcagctggaggggggtagcagtagtaatatgcattctccaccattgtgacatatcttgcatcaagatgcatcgcttgtttctttctcatcatttgttcctaagatgtataaagcttaaatcagtcaaaatactttctttataaggtttctttgttcctaactaaaggtgccctttcagggataaggtttcaagataaagagctagaaaagggaaaaaattattaccagatatttctaagagtatacaagcata

SEQ ID NO: 30710 - DNA, 1725 bp, Bovine  19866881124143
ggatccagcagtacgcggccgcggcgctgcccacgctgtacagccagagcctgctgcagcagcagagcgccgccggcagccagaaggaaggtgggtgcccgacccggcccgcgggcagcgtttggccccggagcagagtcccaagggaagttgtgataagccgctgtcctaagaagagcggcctcttcatttctcctactcacggtttaagacatccgacaggcctgaacactctgttgcagttttctagctgtcttggacctccaccctctgtgtgccatatcgcagttacctggtagctgctgcggccaaaccactgccaggagccccctctcccgaatcagaagggccatctcctttctcccctccacgtagactcctcgttagaagaaccccaagtcatcagtgcagcgtcctgggggctcaccggcttttgcagggtccacgcccccctgggcgtgacggggaagctggccttggagttggcgatgttgtccaggttaatgacgaaatccactcctaggatcgacccggtctttgtttagtcagggtcttctggggaagcaaataagtgattgattgccttgcttctctgccaataaggcaaaataaacatcaggaagtgaatgctaagaatacatgaaggctaattataaagcagttaatgaactggcccaaatagggagggtttctctctttcctccttttggttccttcttcctgactgaagttgcttgtaaagcaaaatctgcactgagatatttattctctttctgacttgttttgcataaaagaagcaaggataagaaagtgttgaagacatttttaaaattccttttcgttctatcctcacccatagttccaaactggtttttgtctgaagactttgactttaaacacggtctccaataagtagaatggttttactttgtcaagttgggaactgtaacagggacacaactctaaagatcgtgtcattttgtttgttttttttaagggtttttttctgtttatcagtaaacagcattcaaaatagaaggaacttgaaaatctgagtttctctcaactctctttcctctcagttatgatgttattgtagtttattttaaagctcgcatgactgttcagacagctgcattttcccaggtgtgtggagaccccgtgccataaatacctcagcttccccaaggaaagcctgtgtggcagtccctctttctgaggtctgacttccacggtaacagatgagggtggtaggaaatagcctgtgagataaccatgtcctcgggagacaccaggaaagacagttccccccgtgcatctgagtgctggtcacttccctgtcagccatggggcaaaccgtgtaacgtggatcccattaggcaccagcagactagaaagttagtggcttaggagagtctgggccccgaagttgcttcaccccagctcagagccctgaatttctgtgccttgagtttcaggcactgcttgtgcaataattaaccctctgggattaatgtaaagtaattcagaataaatactgtctccccagattacttatatttaggtgtgcgggctaccagtaacatgggttagtgctcagtctttgttggtgctgtttcgggattattcaggtcaggtctttttttaatctcccgcgttttcatatgtctcttctgatcatcatcttctcactctgttaacgtgtactcaacaaatttaaaccat

SEQ ID NO: 30711 - DNA, 698 bp, Bovine  19866881331744
ttctactgaaatacagctaattaggccccgcatctgactagagggttaaaaagtgtcatagatttacctctctaagtaatatgcttacaacagttccatgaaaaattaagaaaggattaacatccttcttcaatggggatgcttcgaaaagcattacgctcgcactttgttataacaattatttttcattcacgttctgtgcctcctattttgagcctattcatttttcctctaattttaagaataaataaagcaaaatggaagctcgtgttattacttagtatgaaaacacagaacctaattatagctaatgagtgtaataaacgccgggctgcacctccccttgcttgtgtgtgtttcctatacagaaggtaacacgggctgagtaacgaggacgccaagttacagatggggttgaggaatgctatttgacaggcgattagagtcatctgtcagaaatgatgacttaatcaccagagcagactctagctcccctcctgtaattccacccagagtaatctaattttcctgcaatattttatttattttattttttgccaggactaaatggttatgctgcttgactttccccctctcgtgtaccacacgactgtaactgaaatgtaaatagccagtaacattatagcaaaaaaaaaaaaaggctgcctttggagcccgagaaggcaaaagcagataca

SEQ ID NO: 30712 - DNA, 829 bp, Bovine  19866881353376
tgttgtattgttgggtagtcattgtatgttggtgatacatctaccacgcctcactgtttcacgtatctgtttttttctatatgttgtgtaaaaagatacagtcgattccacctaagtgaatatctgatttggggaaggggaactacacaccagccacctcggatttatgtacaacagcctattttaaccactgcttccaagacttacgtctgtggtccacctacataactgcctgcagagtcagatttgccaagaccttgtccggtcttttgaccacactggtacattgcactttctctcttctcctctgctctctgctcctctcttcttctcttgatatgtgtacgcagttcttaacactcaataacaatggctgccactttgctgcataaccttaggaaacgtgagaagagaggcagcagcgctggggtttcttctatctaccatgagtccaaaggcctatcattaccatcaaactcttctcagaaacaagtcacttttttttttaaaggtgagctccttaagggaagaaactaaactttacttacctggtgaatagatatgaaaggtattaaactgaaatccatgcgttgccatcaatcaatagctatgtgtagaaaagtaaattattttaaagagctagctgaatccaggagcagctttaattattaaaactaatggaagagaaaatacttgcaaaggctcaaatggaagctctactcagtctggttgggtgggaggggggaaggtaaagcttctcatgcccaagtcttcataacacatcatccatttccacatgaaaaccaagactgccagatacatccacaca

SEQ ID NO: 30713 - DNA, 834 bp, Bovine  19866881898660
aatacatgtaaagcacctagcatggtatctggtctagaattgctcactgaaagatgcctattattattacttaggatatgaactgtgtttgagtccacactaggaaaaactttggattgaaaagtagacttgtagtggtcactcatttctagtgcttcacaagtgcacagaaaagattaacggtgggaacaggtgacacccattagacactttgaacttggggccacatcctgtagttagcacatggctcaacagaggtgaagtctgttgtttccatcttacagatgaagagtctgaggcccagagcagcacagttaggaaatgatagtgccaggattcaaaccccaagtgctaacccccgctggcatcaggacacaagaggtctaaaggcatccgtgaaggatgactgaggggcagggattttaaatacacactccccaacataaagaccaaaaggtgaagcataagcccctcttcacggtgtctctccctttgcaccccagggagtgtgtatttatttatttattttgagaaagtagaaatgggcccttgtttggagacccatgaaagaacacttgctctagaattctaagttgaggtttaaggaccagtgtgctgccacctggtccgtctgttgtgttaactctgttcagaggagatgcaggagccccatgttctgaacttccgttctctgttagccgggacctgtggcaacgccttcctcttttcattctagctgattgtcaacagcggtaaccacaggcccttcctgtcccagaaataagtcttgccacactctcagctctcaacgagctgtgagcgctacattctgtt

SEQ ID NO: 30714 - DNA, 1433 bp, Bovine  19866880103575
tggtcatgtatggatgtgagagttggactgtgaaagaaggctgagtgccgaagaattgatgcttttgaactgtggtgttggagaagactcttgagagtcccttggattgcaaggagatccaactagtccattctgaagaagatcagccctgggatttctttggaaggaatgatgctaaagctgaaactccagtactttggccacctcatgcgaagagttgactcattggaaaagactctgatgctgggagggattgggagcaggaggagaaggggacgacagaggatgagaaggctggatggcatcaccgactagatggacatgagtttgagtgaactccgggagttggtgatggacagggagccctggcgtgctacaattcatggggtcgcaaagagtcggacacaactgagcaactgaactgaaatgaaaccataattacagagctgggatctaaaattcctgattctgtgtgctttctactatatcacagcaccaaaatacacagctgatctgataaataaaactatgtaattatttttctaattaaaaataaaatttcccctagtgttcacacatccccttagttactcatccatcagatcctttgcaggcagaagagttacgcaaatcccagccctaaccacagccccagtttccactttggtgatgccgtagcttctcccagctgctgaaaaagataaccatcttcaccttggagtgacgtacctgttcctgacatttctactgtagtcaaaatgcagtaatgtacatggacaggcgatggccgttggtggtctcttacctacagacacgagagagcttacgttgtctcctttagtacgacacacagaggctgttggaaatccagccgctctcagaaacatgatgatatgagtctgcacttcaatcaggtctggagttttgctagattcagtgttgcttattttgaggacacattcatttgggccatctgtagtgactttggttcttgcaatgcatacatggaagttttggtcatcatagctaggaagtggctggatcttggaaacttttaacccaaacactgattccactaatgcagaggcttgtacctcactgaaagagggcttggtgagagcctgtgattgctgaccatctccacttgacattatttctaaggaaacaaacaaacaaacaaactggaaaggggacttatattgaatatacttacttaaaagagttttcttaagacaaaccaataatgttttccaatactgatgcggtacgtctcttgtgaattttcactcataaagttaaaaaaatcaaatgagtaatgagatttaaaaagtagattaaaagcatagtcctgcctcatcccttcatatttatgcaataactttgttctttaatttccaagaggcaggtaggctagcggtccgatgtcatctact

SEQ ID NO: 30715 - DNA, 3480 bp, Bovine  19866880406389
ctctttgtgaccctacagactgtatcctacaagctcttctgtcctgggattttccaggcaagaatactggagtggtttgccatttccttctccgtggtattcattactaaaatgcatcaacacgtggaggggggaccatagcctgacaatctggtgggactgcctgcacagtgtcatcaccgctgaaccctctgtcccacacggtcaagcacagattggcccctggctcgctcactctatgatcccagaaccaaaacactctccaggctccctctcctcctttggttgtctttttatgactttttaccaaaacacatactgaaactacttctggaaatatcatgagccatctaaatatataacctctaaaatatacttttatgtatgtatttgatttgagttttgccacctccaatacaagaaattttcttagggattagttctactcaaagcaccgccattttctttttatagaataaaaaacagattcagcgaggttaagcaacttgtccaaggcctcacagcttgtcagaattaaatcccggatatttctgtctctgtagggccctcctacatcaccctccctttctaagtgcacaaacaagtgagtgggcatcaccgtcaacctttctcacaaacatcccaagtcaagcatgcctttcaaaacaagttactgtcattaggccagaaactgaaggccagtcctagtcaagggaggcaggcttgaagatgaagcggaataattgctgaggtgatggaccgcaccctgaccgtctttcacgggcaccgggtccaaaacgttcccctacagatcccacctggtgcttcctgtaactcctctgggcctgcgtcgactaacaaaacccccatcccccaggtctccggccgggcagtctgtcacaatcgttttgcgtctcacataatcctttcctgccggctggctggctccaccgcagcctgtctgcccgtccgttagtacgttccttatgggcagtgctgatgggcaccctcaatcagccaaccccttccccgcaagcctggacggacacacttgctccgtggttggggggattctaacaccccatggaagggacagacggcgggaaggagaaggctgagagctgggccccttccagagagccgactgccccgcccagctgcgtgcagggctacgacctgtcccctccccgactccatccatccggttgggctcactgcacccagtttaatgcgctcaggaatgtgctcggttgagacacccatgtttgctttggccccgttgagccgaaacgtgccccaggctctgctcatccgcccgcaggcttgctccacccagtcttcagagaacgtccatgggcgaaaagcgactgacgcccagaacagggcacctgcgtttaatatgtcttgaagcatagtaaacatccatccagcctggcctgcagagatcgcacgggccccaccctgggagccagaggaggcacagggctttgaagtcccttcagctccgctgtcggttcctttcctccctgactacttcgggctctgcagccccaggggcatctgctctctgaagcccacgtggggtctgaacgctggtctagaagcactgactgtgtgctggtctctgaaacggggtcctgggccgcagctgaacctgagcttccagcctgggggttgggcagatatgacctaagagataaatgggtgtggaaatggggccaacactaccaaattagatttgggatctgcttacaattttgtcccaacttgggtcttaagtatataagacaagaaagaaatttgattttggaatggttccagaaaacttgggttgtcaacttttttatatttatttatttggttacccaggtcttagttgcagcatatgggacctttagttgcagcattcaaactcttagttactgcaagtgggatctagttccctgaccagggattgaacccaggccccctgcattgggaggccagagtcttagccactgggccaccagggaagttcgcagttgtcagctttatagtggaaaaaaactcagatccagggaaggaaattgtgtccaagtggaggtgactggacagagcacatgagctggatctcggagggtgggtgcaggtggttggcaaagtggcctggcgcagatcaggaagtgtccagaaggtcaagcaaaggagaatggcctctgactggaaggtgtgagtcactgagagaggatatgaaattgcatctcacacacctgttcatcctttgtttagtctctctctccccgactcaaacataaccaccagttagacagggcaatttttctattttgttccttgctgcttccaccatgcctagaacagtctggcagatagtagatgcttaattaaatgtttggggaatgaatcaatgcacagaaaaatgatttcctgggagagggactattgaggaatttagtaataatactaaatttttaataatactggttctggggccaacacccttttttacaaaacaaatgtgctttgtaaaaaacacatttggagggaggcaattgttggggctgttagaagactaggttcaagtcccagatctgtgtcttgctctatggaagttgttgttcagtcattcagtcgtgtccgactctttgcaaccccatggactgcagcacaccaggcttcccttcaccatctcctggagtttgctcaaattcatatacactgagtcagtgatgccatccaacaattttcctcttttccttttgccttcaatcttttcccagcatcagagtctttttcaatgagccagcttttcgtatcaggtggccaaagtattggagcttcagcttcagcatcagtccttccagtgactattcagggttgatgtcctttaggatgaaaactaaaagtagagcctgcttttcagaaacctcccttctcaagaggccatgtcactgctggcccaccaaccaccctcaacaagcttctacacacttctttttcaactgggtgcttctcagttgtgggtaacactcatacacttgttctataaagaccatggagacacaccccaccttgggtagcctcagcagctgccattgcccacacagccagctcctgtctcttctgcctggcattcaggtctctgtacacactggcccccactatgatatttgtccaagattttcttgcgtgaagtctatgtctcagccacatcagaccagccagtgaaacacaaacatgttctcaacctgccctttttcacacctttgtccatcatggttttcttcatgcacgttgccttttctacccaaattgaaagcccagatgcctctgggaggcctgcctggtcctgacagttgggaggaagaccctctgctctgttctggtccagccaggcattctcatctctctccttggttttatttatttatttggcttcactaggtcttatttgtggcatgtgggatatttagtggcagcatg

SEQ ID NO: 30716 - DNA, 1152 bp, Bovine  19866880506893
ccgtgtggagctgggagggccttgtttctgagttaggaccctgagcctcccctggccaaaagtaccttcaggtagggaccttgcctttttcatccttcaccccagcatcaagcccaagatctgtgtggacagtaggtacccggggaaggtgttattctggctcctttcgtttccagctatgggaccttgggcaagtggcctgacttttctgcacctcacgttcatctgtggtcaacagatcacaagacttgttccacttggtgcatttgggaatacacaagatcacaaggttcccagaggccccttccccagccccttccaccccctccgttggcatttcatcgtatagccagatctctgaacctggagcctattatacagagtgaagttaagtcaggcgtgtgtgagctctccacccctggggatatgggcaacgtgctggcttgttgcctgcagctgcatgtgtcactgctcccttctccagggagtggggagtgcccaccggagccttcccaattcagttatgtgtggctgcagctgacatttcattctacagccagatctgtttcctaggaaacaagtgagagacattgactgtgcagcgcacacacacatgcacacacacacacccctggctgccaccaagaatgacaatgaacagaaagacagtaatgtcagcggaagcaaaaaaaataagtttatttgtgctccctgctgcccgggctgcaggggagggagggacgggccagcactccttgacgcaagaccacatcgtggcttgtggggcaacttctgaacaggcaggtttggggggacccctactgcacctcgcagcctctctcctccagggccagacccaggtggcctccacaggtggggtcccgattcgttgcttgtgcaccttctctctgaccgagtctgctcccagctttcctctccaccctgaagctggcaccctagactcctgtctgcagccagaaagacacggtcctccaggcacacacaggctgcatgtccactaccacccttgactccctgacacctgccctttatcctgccgatgcctcctccagtctctggcatcccaccctcctaaggtgctcaagccagagacctgggagtgtccttccgctcagttccaccatgcaggcc

SEQ ID NO: 30717 - DNA, 1725 bp, Bovine  19866880642699
aaataaagtagtgaaatgatatattgattaaaaaagaaaaataaaaatgacccatgtcatttattttatccaggatcttattaccagcaatggttctgatttttagatgtcggaacaagtattttctttacaaaagttaataaaatacatgaaaaaatgttataggataaataacagaaagagcttccaaaaactcaataaatacaatagaaaagcataaaaagttttcaaattatttccagacacaaggatttggaacaccccttgctgaaacaatagcaagaagaagaaaaaaaaattataaaaaagaaaaagaaaaaaacagccaaaggtgcagtgtggggcagtaagagatctaaggtttgtgcaaatgtcaggctggggacacagcctcccacacaacagtcttctgggatctgctagtcttcagtccaattgacagggccctggccgtccaggagttcatgggctagatgtgaagacaagatttgagtgcaggaaataatctgatggccattcctgagggtccctttggaaatcagcatggctcctggcccttgacagttggggaggtgttcctaaatgcaagcctcagtgactctttagtgaaggggaagtggcctattcccacatatctagccgtctggcagacttagaaacaactcccaaaggtggagccaggaagaagcagatcctttgaggtatagaagctcaaactggcaatccaggaggcagaggtactcagggacttgggtgctgggaccttcagcaaaccacctgacctcttcgtgcttcagcttctctatctgtaaaatgaagatataatagtgtccactcccagtgctgggaggaggatgatgtgagaccttgcatgtaaaagcattagtgccaacacatgggattcagcactcattcaccgtcacaattcgcctctgtctaatcatccttctcactgcccagatggctgctggcgagagtggaagctgttcttggacctttgtcccctgagctgactgacagttttgaaatttcccatgtggataatgtccatgactccctgtgatgttgtccctcatggcagtgtggggtcaggccccccttcctaagctgggtagttggcaggcaaaggccacagtgctttgaactatgggactatattgagaacaccccaatgtctccagggcttccagaacaatggctaatcagtcccatggcagcaactcagcatcctctttccaagtcaatcaacttgtgcattttcaaagccagttcttactcagcccagttttgctgtcccacgaaaggatgtgcttttttaggcatccctgtttagcaatctgtaccctaaattagcatttaaaattgtgcccttaatttggcaattcttatctatcaaagttacaaacacatatgcccttgacagcagccccagttctaggactttatccaacagttgtactcacctatatgcacagaggatagtcacagcaagagaggagaaataatctaaatacccaccagtaggagatgggtgacatacacacgtgatgaaatgtcaaccatccaacgtttatttggataactgacaatagctactgaatgtgtgttgtatgtcagctactgttctaagagtctattagtgagcaagacagaggtttcctgcccccatggagcttacattactgggttacgtgccacatgctaacaagctattaaaataaggct

SEQ ID NO: 30718 - DNA, 3091 bp, Bovine  19866880671337
ctgttggtccattctaacttttataagtactgaatagaattacattaaatctttgaacaaaattgaatctaacataatctcaggtttcagggtttcagatttctcaagttgccagctttccagaggtctcctggtgggagcatcttttctgaagctttgggaaacttggtgtcctgtgacataggaccaggaacttaagccagtgaggcttttctaagggaggtattgagaactgagttgccctgaaaggaaaagtgttagttgcttagtggtgtctgactctgtgacccaactgtagcctgccaggctcctctgtccatgggattctccaggcaagaacactggagtgggtagctattcccttctccaggggatcttcctgactcagggattgaacccaggtctcctgcatggcaggcagattctttattgtctgagatccaccaggagcttccctgagatgttggcatttagacaaaaagcagagaaggaatggcaaggagatttcagaagttgggttgtgcaatgaactaatgtcagatcatggcccagaccccaagtcacaggcctgcccagagactggagagagcaggttgaaatgttctgaacataaaggattgcattccaaatgtatcttgaagtaggagaagtaagttgccagaagctcatgttaagaagcaaaggaacttcaaagagctataatactgtgggggaattttaaacagtcacatttcctgagctagtctttcttctgagaaacgtcttgtctttcagaaccatatggcagtagcacactcgatgtataataaaatccttggttttggtaattatgatgaagctgttgccgtgttaaatgatgccacctgatggattgtgagcacacaagtgccacactcagcatagctgggagtttattatttttaacaatctctgaaggcccgagagggaatgaagcaagtgccaacggttgctcttggccagcttacggctcagagaagaaagagggaatgaggaggaggacgaggaggaggaggaacaggataaagagaagaaaatgagatggagagggggcagaatagaatctatttttctcttttgataaaagtcattataccgtcaacagaagctactttaagtagagactcgatttttcacggagcagagacaatctgcatgaagacggtcagctgttaagagtgccacctcctggtatcatctcttttcagagctgaggtgtcaacgtcgtgctcacggggagcagaggaggagcaggggtgtggaggggaggatgaggcttcagtgggtgaacatctttgtttacaggaattgatcctccttttcccacccccagactgtatacacacacccaggagtctgtccttcaggggaaaagaaatacaccagaggggccgaccccttcttttgtctcacccacttctcttttgccttgtatctgatacatttgctttctacccttccttctgactcggcaaattcttttagcacttgcattgccagtcccattgccacatttcagggcatttttggtggcacatctctcgcctctctcttccctttctgatctgtcttccaatacagagcacaaagcccttctctgctccccctaccatttcttggattacagggaacagccctcattcagcctccatgaccttccctgagttccatggggcagattcaagcagctgttaatcagggaagggaggggatgtaagaccagggagaaacaaacagagaagagaaacagtagtgcagcctcggggcaaggtcctcctttcccatcaaaggatacacacaacaatatctttgagctgttttgcagatactgaaacccctccaggtgggagaagttaacaattagtgatggtatgctgcccacaagcatgtagaccccagacctgaaggttgatgattctgactcctttttacctcacccaccaacccatcggaagaatgtccacaagccaaaaatatttgccctctttggacaattactataaaacttctcactatcttctccaagttgggacacatagtgttttgaggcaggagcccactgtgtccccctttgtctggcagagtaataaagctattcttttctatttctatctctgagattcgattctgtacggatgcacgaagaagctgagattttggtatcaattggcctgcagactcaggacaattaaaggtccctggttgaggctactcttcagcaggacccgaaggcctctgggatgggactcaactcactggccctaacgtgcattgtggagatgatctttcctcatcttcaacactgccgatggtctgaggtcgctggagatggggattgtacaccctggcagaggtgacttttggcagatctgaaacctggttgaacactgactgaccatccctgactgatcaggtggctgtgtcctttggccctaaccttggggctgctcgcttccacgcctggtgcagtcagcagcggcaatgtatcctggctaattccaggagtgccgtgagatcccttttccctttccattctcccttgaggacagtccacccagatctgccaacatctccagctactttaaatgaattgccgcaaaactgactttcttccatcaagctatgaatgatgacaaagattccaacctctggaaccaatatactcttgaccaggcctcctaaaatttctattcacacacactcccttagtcctattgttgattagcaaactgggatcccacaccaccctttctcagcagaagggagcccaaggtgatgtcctcatgagatgtcgatggtttcactttgctgatctctcaggggagaaacgtggaatgtaacaatagaacagccatcttaggctggggaggtcctttcaagataagacaatcacacccttccctaatggaaaattaccagcagtcagaagtagtcagcattcccggaagattgaacagcaacacgcccagccctaaccaccatatggatggaacattaacccaagcatgaccagaatgggccattaaagaagcctagtttctctccccgacagcagaacccctctggtctcttc

SEQ ID NO: 30719 - DNA, 2805 bp, Bovine  19866880705666
tcctcctatctctctgcctcagcttcttctagtcatgttgaccctcataattccaagatgctggcagcaagaagctccacaaatcagccaggcccaccagccgtcattagtagagataagccaaagctttcagagtctcctttccagaaggagcaaagcatcctttcccagaacctcctgagcagacctgccctcatatctcattggccagaattgagtcacatgctcactcctacaccaataactagcaagaaacccggaactctgtgactggcttagatttcaccacttctggttgtctgtactgggcccggtggtgtgatgaagcagaggacgctaagccacagagcatagtgacccaagctccagaccttgaggtggggggacgtttatgcaaggttgagcagcgacccctccatggggctcggggaagggcatcctccaggagagctgcggtcgcattagaggagaagctagcaccgggatggttccaaaggcgtcccgcgctggtgccaagtgttacattagctgctggcagagggaggtcctggcggtgctggaggcttgatggtttcgcagtctgggcatcgcgggggcaggtgtggctgaggcctggtctgtaggagggaggccgcgagggcacgggaaactgcacagcctgtttcaaacactcagcccacacaccacacacgcgcgtacccgtacacgcgtacagccttgcccgtttacaattgtgagctcttccaatggcacaacgcagcttttaagccaaagtgccaggcaaggccctggttcttcttcagagaagtacagaagtgttaattatatcttactgtccttttgacattttcaactggacatctcagaagctcccagtacccaccccctggaaataactgggaactggctgggaccctctttctccatgccagtttttccagcgggatggcagggcttttacatgacagctgtcttccaaaagggcaaaagagtagaagctacaggctttttaaggtctgggctcagaggtcctggaatatcactttttcccccctccaggtcaaagcaagttatagggccagcctagaatcaaggagaggagaaacagacttcatctgttgatgagaggaatggtgtggggacacagtgatgagaagccttgttggtggccatcttagaggaggaaagctctctatacagaattggtgagcaggggtgcgggggctcacgcccatgcctggctgataccaagtccacacctctacctcactgatcacatcgcgggcttttccagctggaaatgagatcacacagtggtccacaaccttcaatgtcttaacgtggaattcccaagaagcagatcctgaggccccactggagcatcagtggcttatttgggtggaagccctgatagataagtggagaagcaaaacaagatgggaactattaaatgaacagatgacattgtggcaaccagagctcagtcttgccagggacttctgggaggtcacgtggcgctctcctgaaggggccagtaagctcgtatattcatcctcccatttcctactctcctgcctagatcccatcccagactcctggaactggcgattgagttcctttgggggcttgttcaggacaacttcattgactcccagttctagaggcttcttattggctagagaggccttactgctggttaccctggagccacatgccacaacctgggtgagctctttagcagctgatagaactctagacttttctaaaacgacaaacagtactctctccttgtacccgtaggctgtcctgcctggctgtaagagctgtaattagaacttgtggtagactggtgctttggtgactgccgaagatctatgcctcttagtatagtaagtcccctaaatatcaaagagtttccagtcctagagcatgttcacaagtccaatttgttcctaagtccaacaaagttaatctgggtgcccaactaacacaattggctatatagtactgtactgtaataggtttataatatttttcacatattgttcagtcactaagtcatgtctgactgtttgcaaccccatggactacagcatgccaggctcctctgtcctctagtatctctaggagtttgctcaaactcaggtccattgagttggtgatgccatccaaccatctcatcctctcttgctcccttctccttttgccttcaatctttcctagcatcaaggtcttttccagtgagttggctcttcataccagacaggcaaagtattggagtttcagcttcagcatcagtccttccaatgaatattcagggattattttctttagggttgactggtttgatcttgcatttttcacataaataatacataaaaatcaaacacagaaaataaagaaaacatttttaatcttatagtacaaccttgaaaagtaaagtagcatattataacagccggcacataggggatggcatcgagtgaacaggcaagaagagttactgatggaggaggtgggagttggtagagctgaaggatcatcagcaatagaagacagaggacaagttgaggtgtcactcatgcctgatgttgatggcacaggttctgattccttatggagacaattctctctaccctcttgaaaaaatgattcagtgatgtctgggtggtagctcttttttttttttttttctcatcatagatgacatgatagtgctggattgcattctgaacagctgctgcaaccttcatgtactgttccacatttgggtcttgtgtctcaaaagctaacagtgcctcctca

SEQ ID NO: 30720 - DNA, 1139 bp, Bovine  19866880722378
gcttttgtgtatggaatgtatttcaatataaccaaatcattgatgaaggaaagtttgtctttatagaggttttccagcttgaaaaatgaaggaataatggaaatacaacatcatcattttgcagtccctaatgcagtctagatgatgatgatcagtcactggtagcatttcagaaagaaaagtgggtatcatggaagcaatggaagtaagatctataaagcatcattgcaaaaatataaaccctgactcttagcaggtcactagatttgacatctggttaacaagaaatacaggagggaaaacaacatatgaaatgatagtgtggcgatgtagtcagtgcagtctagatataggaactgtactacaaatgaccttatgtctttacataaagtatataaggggacaaagagggaaaaggaacatacagattataaaaaagtcttgagaaaactgaaggaatttataaaacatacctggatctgatttgagcaaaccaacagctaaaaaggaaaaccagggagatttgagtatttactggctagctgatactaagaagtttagaggttttgtttatttgtatcaaggtagtatttttaagtccatatcttttagagaaacaaactgaaacatgtccagttaaaatgtgatatcttgataaaaaagtggtttttttaaatgttttacagttaaataatgtgattattttccatctgaaataaaaactaacactcttgcagccttacccctcgtgaattcaactcttatggagcccgaagaggtaacgatgctgtaatgacaagaggcacttttgcaaatatcaagctttttaataagtttattggaaaaccagctcccaaaacaattcattttccatcaggacagacggtaaggatatatacagagtgtttaagcagttgctaactagattaaaatttgtattaaaatttttatgtttgttttaatctacagctggatgtatttgaggctgcagagctgtaccagaaggaaggtatcccactgattattttagcagggaagaaatatggttcaggaaattcaagagattgggctgccaaaggaccatacctgctggtattgcttcttaaattttatcttaaagttcaaagagttttaaatat

SEQ ID NO: 30721 - DNA, 1680 bp, Bovine  19866880727098
cccctcaccaccactggttctccataaacctccccagagcttaggcaccgttcagataaaacagggagggaaaattccaaattgactgcgattaaatttctaccacctgatagaagagggctcatcagtgaaacttagttcagttacagaccactgtcagttatggactaagttcaccctcattacgataacctcctaggaccggagtgcctctccctgctattgctgcttctcctgcactgtcaccaccatcaggccacctgccgaggagcaggaaagggtgccacctcacctagggtgagaacaaagatatacctactactggggatgtggcttcctcttccttggtcaagggtttctgatttttaggttgagccattccaagtgggtcgggttggggcatttctcttgactccagcagaaagcgctctctgattggctggagccatcaatcaccccactcactcatccaattatgcctgcagttctaccctcatctggaaagaatgaaggcagcaaagcactatggtcgtctaatgcaaaccatttgtgtagtcagaaggaaaatgggacgtgattcacacggactttccagcttcttttttaagaggcctgctgtcaataaagtgaaggcagggcattttgcagaaaaaagggacatttctggtcagcctgggttcattctcccgcaaccatctctggacttctttgggaagcagggtctgatccattcttggttccctgcagatgagctatgtgtgtgtataaaaggtcaggagttttagaaattccaagtgtgtgagtttcacatcatcttaatttctcacaagccatgtgccaagatgcaatgatgtatttcacacaccaaagaacacaaaggaaacatttaacagttatcatgttttagtagattgtaagctccttgagggcagacatgtttatgattggtttgacctcccagacctagcacaggcccctaggaggcagatgcagagttttatctcaacaccccttccagcctctcatccctccatgtatcctctgcctcaaccatccttggactgccactcttctgccacaggacctttgcacataccttccttaagcctggcgtgtcctccctcccttacttacctagttaacctctgtaacttctgagctctcagctcagacatcacatcttcagagaagtcagcctccctaattaggccagtttctgcaagacagattctcattccaggctgtcaccttccttgttgaatctgccacggttgtcattttatgctttttcacgtgtctctttgatgaaggtctgtctccctctccactttgccaagtctaggaggacttaccaccatctcccccactgtcctgcctagctcctggcacttggtaagtatggaatgtattggtcagccttcactgagcacctggtcctatgtaccaaatgctgaataacccccccaatgggtattaccctccctttgcagagaagcaaactgaggcccagagaggaaagaagaattgctcaaagttccatgctttgtaagggccagaggcaggctttgaatccagtttttctgacccaggtaccagcattctttctgctgcctctctatgggttggctgaaggactgacctgactacttgggatggacggcatcaatcttgcatgtgaag

SEQ ID NO: 30722 - DNA, 3038 bp, Bovine  19866880734469
aattgccgggaaaatgacagctctgggcccacatgaaaggcattcttgaaaaatctctctcccctccctccttcccctgctggagaattttgtgctgtgagttattgcagcaattggcagtccggatgggtttgagtagagggggctgggctttctcgttgctttattgctccaatgtgtgcggaatcaactcagtcctctggcaatctttcctcccagcctcttcatggaatgaagatgctcagagaagtggaagccatagacaaagagcctcagtttctttgcagtttgtcctgtaaagcaggggtccccaacctccaggatctaatgcctgatgatctgaggtgaggctgatgtaatcataatacaagcaaagtgcacaataaatgtaatacacttgaatcatcctgaaaccatcccctgctaccctggtctgtggaaaaattgtcttccacaaatctggtccctggtgctaaaaaggttgggaccactgcggtaaagctcccctgcacattgcagacctcctagcaaatagagagggtgagggaagagactggggttgggggggcaggttgcaaatctttgcactgaatccctgctccatgtctcccagaagtgacggccatggtcatgaccaaggtgcatccacagtagtgggcctggccatgaggaagagaaacctgcaatgtcagaccaaggacttcatctggacaagaacgatacttaatgcttatgcatttgatctcaagtagatttttatctgtccgtggccactccaggggtgtcagggaatgtcacatatcacacattgcaggggggcaggggggggtaattgtatttccaacaccttcctgtctgaagagcagggctatccaataggacttcttcgaggaagaaaatgttcaatatctgtgtcctcttaggatggaaggccctggtcacatgtggcccctgagcacttgaaatgtggctagtttacactatgtcttgaatttcaactaattttaattagtttgaatttaaatagccacacatggctaggggctatcatattggagagggtggttctaatgactagcaacatcagcatcacctgagagcttattagaactaagccccaccctagatctgttgaatcagactgagcattgtcacaggatcccaggtgaagcatattagcaattgagaagggtttctctggagcacagtcaagaacaaaggaggtgagaaaacagaaagcaaggaataaagctagtggacagaaagaacaactatcatcaaatctttgtatctttcacacagcatttatctggggggtattgatgcttactttggagtccattctcacagcactggctgtgggatttttttttttttcccccagtctgcagtagattggaagcagcagtagaggcaccatgggagcatctttgccgtctctaatgccacttgtttaatcagcataaagtgtctgtgaatataaggatcacgataaccagagccatttgggaaggtgaggtctggaccatctccctaagaccacactggagtctctcagcttgaattctgcaagccagggcagcatttcagaatctcatttttaagtgcacgttagtgtctgctgtaatgaaacacatgccgtagactgatgaaatttaatgttcaagctaaataataaaatcttttatttatgggcaagttttacgtctccctgaggggagataagctagtgtacaagtctttcccactttccctgggtctgatgtgaagccagcttgttcccccttgacatcacaggggaaatatgagtcggagggaggtggaaggtcgggggagaggaggctctatatttacaagcctgtggtatgatgcagccagatgcagattctactgggtttgtgggtgtgaggacattgagggaagtagttaaataggacttacctttctgacctcagccaagtctccagaaggactcatggggagggtcgcactggagaaattttaactctaaagagaccacagatgatcagacaatgctagaaagggctcccagccctcacagaccccatccttcactgataagcttgctctttcattccaggagtctatcagcaaataagaattgagctccttccatgtgccaggcactattctaggtggtaggggattaaacagtgtgaaacaaatcagagaagccctgtcctcaatgagtctgcctctgagtgggacacagacatgtacacaagtaatttcaggaactgagaagggttgtcaggaggataaaattagtagagaggcatgacagcagtccaagagggcttcatggaggaagtgacatttgcattatatccttagaggtagtgagaagaaggcagtccctgaaggtgtgagggaaaggcacttcaaggaggataggagtgggggtcggggggatggagtgaatcatgccaggccagagtggtgggattttattctaagcgaaatgggaaaccattagaaggccatgtcttaagaagaggagtggtatttcctacgcttactgtggttgccatatagagacaggactataactttggggggaagagcagcagcaaggagaacagggaagaggctgttgtgttccagatgacagaggatggagactgggttgagggttcatagtggaggtataagaagaggctggatttaagatatatcctgaaagaggggcagacaggtcttcctgtgacctggatgcgtgtgggaaggtcaagctcaggtgcctgaataaacgggtgaatgatgccatcacctccggaaaggaaaatgtttggaagaggaaatcagtgtttctctaaatctgagatgccattaggatatccaggtggattaacatttaggagtctggtgtgcaagttcttgagatttttaaaatgtggtcgtagtcagaatatagaaaagattgggagctacaggactaccagaaaacaaagaatgcctagggagggataagattaaagactgagcctagagggacaccaccacctagaaatctaaat

SEQ ID NO: 30723 - DNA, 3807 bp, Bovine  19866880734630
ttccggcaccaccaccaccaccatgagcaggaccacggaaggaagtggcagaaaagcctcaaaccactccaacaaccgccccgcactgctgcgcggaacccagaatcgcgcgagattgtgggtcccccgcgttggtgtggcgggagggagcccaggccgctgcacccttgtgggtagctcagagaagggtggactgaataaactccagaaccctggatatcagcggcctgtcttgcagaaaagtgagactttgcacttgccggcaggctgggagggccaagtggaggaaatcgcctcttttctccctttaatccgaaatatggcccaaacctaacgccccctcagtgcctccgctacgaaagtacaaacatttcaccacagctcttagagctttgcacgcagaccctataattcccttccagtctcttcccactcttctgccctcagtatgcctcggcaaactgcacaacccaggattctgggacctgccaggcatcttcccacctctaacatgcctgctgtgcaaccgtaggggaaagcccttttcctcctcgggtaaataaaatcttgctcactcacggaagtccacctttatgccatctctcttgaaattcagcttcctaatcaaatatgatgatttttctctgaacccactgagttctgtgtttggtcctgctcttgtttaaggtttaatcctgctattaaactgaactcctggagggcagtgattgagcctttgtcaacttgtcctctcttccacaggcttagccaggtggggctcagtcaataagcattgatctgaggagggtgtatgtaccctgcagcccagaggtagtgtgggggtgaagatccccagagggactgcaggaattgagtgcctgctgaacagggctctggacctctgcgggtgcctgggtctggggtcctgctctcaggccctgaggagctgatctagaaagcagctgaggacaggagaggggagaggggctgtccccagctgggaaagggtgtgggaagggcctctgtgtagtccacagagccatgcatttaggagggcctggcgtttggttcagtgctctcctactgccatcttgaagttattaaccacttttgggcaaggggtcctgtattttcatgttgcaccggatccacaaattatgtacctgatcctgagtgtgggaggcaaaggctagggctgccacagaatcaagcccactttatggagggtctggtgtctgcacagtgagggggcaaagtggaggtgccagtcaactaacgcagacctctgcccccatctagctctcctccccaacatggcctcctcaatcttcagaccaggctggggaggggttgaagcaggacagtggagggaagtaaagttgggagtcaaagccaagggaaagccttgaagtgactggcaggtattgcagcaaaggcactgagtgggcaaagagggggaaaggaaaagagacaggatggggagtcgtggtgcattgcccaggcactgagcaagggtgggagagggtccaggaagaggaggggaccgctagttcagagtgcaagctggtcccggggtcctgtgaacccactgtccttgttaatgaagttcagaggtggccagggcagacaggaggagctaagacttcttagatgccccaaaccttatcagagggcacatggagaggggggaatgcagctccctctctgacctggctactaggggaatgtcagagcctggggggcagcacaaaccccacgagggtggtatttctgagaacccagcctgagaatccagagcagagtccctgctaaggagaggtcagttggtggcctgggccaaaggacagataggcagaatcaccccgacttctctgggcctctctgctctcctccattccttctcttattttactcttccatccactaatcttgctgagttcagctctggggatggtgaccaatcaaagtccaggctctgtcttaagggcccaccatttacctggggggaaaatcctaggaaatctgttgtcccgtgtgggctaacagtgcctaaggggcaggcttttagcccagcgtgtgttgagcctttagagtcaatccagaggggctgagggagtgaggaggtctgattagaaagagcaacgtgtgcaaagccaggagctgtagaacagggctgtgggtttgaggactaattatcctttggggcagctggagtgcatcatctgaggagaggggagtgaggctagaggtgatataggaggtgagcagaagtcactccaccaaatgtgcatggctatgaagtggggttcttggagggggcatatagaagggttttaggagaggtgagccgtagtcctgtagcattttagcttcagtatggaagatggatcagatggggcaagcagaggtgcttttggcagtggagattggcaggggacaaatcagagaacagtggttcctaaatgccagtttgggacttgacgcaggcatcccagcaggctggaggggctttctaggaactcagattcctaggcccaacctgggagctttggattcagtaagtcagggtagggccgctggaactgtgtttggcaagttttctcctctgtacggtcaggttggctctgccatactgtatgactggctatgcctgggagggaaggaaaagtggaaggaagggaccagggtgaccctagtgtctgggttgtgcactggatggtctcatttgctgctgggggagcagcaggagatgagtcctcaggatgtgttggctgtgagttgtctggcgcatctaggacccagcagacagtgggcagtgtggtcccagagttccagagagaggtctgagataaggacaggggtgtgggtggtcgcatgctggggggcagttgaagacatgagtgtggatgagatgcccagggacagggcacacatagaaaagagcagactactaaggtggagcttggagactctcagcgtgcagggggcaggtgagcagggcagagtcaagcgggaggaaaatcaggggctcatgtcctaccagctaggacacagcctgtgtacaaaagaaggcatggcccatcagtgccagctgctccagggaggatcgtgaaggcaaggcagtgaacgcatgagtcaggtaactctaggcgactgcgaccagagcagtttcagaaggtggtggagtctgaaaggctgcagtgggttgagtctggaatggaaagagtgaaatggaagtggagaaggtagactcttctttagaaaagcaaggctatatgggggaggggagagagggcttagcagttatgagaggaggcggcattcaaaggactactgagggggggttcgtttgcatgttggatggaggagtttgatatttataggctgaaggtagagactaaagcaaaggtaggagatataggagaaagaagatagatacaggtggtaaaggggagagaggactagatgcagaatgtaggtggagatgtctgccttcagggggaggcaggaggaaagggagccagacatgaagggagttcctaagttctctccttgccccataagtaggagatggtcttctgcaaacttagaagagccccttctgaaaatgggagaggtgactcaggctgcacaaaagtgatgctgggcacgaggcagggttccagtgaggtctgacaggactggggcagagagaaatggaagggcttgagttctggatgtcctgtgaagctgaagaacatgtgtactgggggacagcaagaaagggccaggtcagagagcaagatgcggagtttaggatataagcca

SEQ ID NO: 30724 - DNA, 824 bp, Bovine  19866880775613
cccatggaatttcccagggaagaataccagagcagggtgtcattttatactccactgagcacccaccttcccagggaagccttccttgtccccacaccctgcccattctgttcccacttggtcgggtccgcttcccttgggctcttgtcagccccctagttgtcactgtatagaaccagcctctttgcctgcctgctccctgccaaagggagcttcctagatccaggagcacagttgggcatgctgatggtgtcccacaccttgccttccccaggcctgacacgtatcaacagctcagttacacactggttgaatgattgcatggccactgtagctcgtctgcttgaacacttctcttgccctgtgactaaaccaacgttaattcaccaccttcagtgcctcccagtccccactctggaaaacaatgctgtaaatcacttgctgggtgtgactgaatcatattttatcctttcatcctttttttggccacgtggcatgtgggatcttaggttcccgatcagggatcaaacccacaccccttgcactggaagcacagcatctcaaccactggactaccagagaaatcccaccctttccgtattttcaagcctttattttccttttccagtacttcctgtcataagactccagataaagtaaaccacgcagtgctggctgttgggtacggagaagagaaagggataccttactggatcgtgaagaattcttggggccctaactggggaatgaaggggtaagcagcttctaggtcccatgtactgagagggaggcgtgagtgcctaggtctggggggccctcggtgg

SEQ ID NO: 30725 - DNA, 2922 bp, Bovine  19866880795920
tcaaggcgcgtggggctgagcgcagagctgcagtctccgcctttgcagcttggagtgtgcccgctgtgccgcagctgtccgtgcctgccgccgccttcccgccgccgccaccgctgccaccatgcccaacttcgctggcacctggaagatgcgcagcagcgagaatttcgacgagctgctcaaggcgctgggtaagctggcccgggcagcgcgccccgacgagagtagcggccgaaggcgcccaggggcccgcggggagtcggctttagggaccaacaccaggcaggagggagtcctgggtgccttagatcggggcgaattccaaggagcatctcatctagaagtggcgaggagagcccgggatccactcatccagcgaacgtttgctggatccttggcgctttccccgacggctcggtctttatctcgcgctagatcatcgcgaggagagattattactgaaatcctgggagggtcagggactttaaatttgggaactcattttgagaccaggccctaccacgtgctaccgaaggaaagccatttaccctctctgagcctcagtttctcatcttgaaaatcagggcgagagccgggggaggaatggttcatttgtaagtcccccttctgtagtcagagggtttgggaaatgtcgggccaattctgggacaatgggcgggtgacgagaccccgtgacccgaacccgggtcttccccgttcttcccggggcaggtgtgaacgccatgctgaggaaagtggccgtggcggctgcgtccaagccgcacgtggagatccgccaggacggggaccagttctacatcaagacgtccaccacggtgcgcacgaccgagatcaacttcaaggtcggagaaggctttgaggaggagaccgtggacggacgcaagtgcaggggtgaggtcccagagtctgggcagccttcccagatccctgctccctactcaggaaccgttgcagccagatgagaccctcgtctccttttgcagcctgtggcgctccttccttgcagggcgtgtgcaccggctgtttgctcagaggatctgtgcaactcgttgccctgggctcaggagaaagtcccaccccagcccctcccaacctcctccctaaactgcctcccggggtgctaaccgccgcgcttaaagcgcgggctttgggttacaccgcgttccctgcaggcgtttctgcggcattttgcagcgatcctcgcgcgagcgcaggcggctggggaggaggaggaggtggctgggccgcgttgcctggccgtgcggctgccacgtttcctgtcgcaggtggagccgcagctcttgcgtcccgccctcccaggtccctgggcccttgggaatgctctggatccagtttcagcagtcttgatggccccggtacctctcctgccctccctcagttaggttccttaaaggaaaagacgaaacctttccaaaagcaaggcagattctgcccggaaaatggactgagtgccctcttttagtcctcaggggcaagaattctgtttctctccgtttatcggtcccagggatgaatcggtggactgaagcaagaggttgtaaatcccttttttagatgggcaaagtcgcattcggttggtctctggaatagaatggaaggttggctacccatgtattttgaggacagatggaaaaacaatcgctgatgctaccacttacttaaaaagtgacaaaatgatctccctcctctcccccaaggtttgaaaaaagaaaaactcatagcattccagagagtgagaaattgtttttcacctttccggagccgtgcctgtctgatctagagtgagactctctgggcactgggtttgggaggacatagagacacagccccccagaagcatcctggcccacgaagcaatatttgacccccagagttgacacagcctgaaaatgatatctgggcttggagctggcaagatccaagccctcagccactgctctgtttgcaaaaacaaaagagcaggacatctcttcagcgtagagggaaggtctgggagtctaaggtaaaaggcctggcaataggcagaactcagtttgggtacatccaacagtgagtactgctggagacagtaattctgatcagaaatcaaaggttcacaggacagcctggggagcggggctttatccatccccaccctgcctagtgaacgtgtcccgtgtgttagttaaaaacccagtatgtgcacattcagtacagccgcctcgcccaactgtatagcattttgcttcatgcagaagccagggaaaactacaggggaatcccttctttgcctcctacctctgacagcatgaagacccttcggatcttaaaaaaaaaatttttttttttttcctagagacatgtaacctgggaagtggcagtgtttttattctcagagtcagagaaactcaggattatcagagcaggctgtgtactgcatctgctgagtgcaaacagaaagcgaggcattatccccaaatccgtgcaaggaacaggtcctgatttgctgactagatgtggtcacaaatatggtgtcttaaccgttctaaaattttgtatttctgttgtgaagctttttgccctcaacagccaaattgcttgaagggggagcccattttgacataaatgaatcattttatgctctcaattttattcctgaagatgtaaggcatgcctgaggctttgctgcttctgtgtgtgtgtgtgtgtgtgtgtgtatgtgtgtgtgtgtgtaatataaggtatatttatactcccataaaatctgtggtcagccctctgaatttgggcttgataaggcacagcagagaaggttctgtgcgctgctgacagggaccatgtgttgcttctctgcacagcaattattctcctgtgctcattgttgatctgctccccgctgcc

SEQ ID NO: 30726 - DNA, 2787 bp, Bovine  19866880829740
tgacgttgcaaagggtcggacacgactgagtgagtaacacattcacaaaggaacatgtctgatccttttctgagggaaagttttattttcaaagagaatgggaagagaggttggaagaagaaaaagaagggaccagaagtcccaaaccaattcttactcctcaactcttgccaaggccacactggactcggacacaggcttttttgctctgggccaggacatttaaggggaagacaaaaactagctgctgaggctacagttaggttgtctaagagatgtggtcattttggcccatgagatacctgcagagagacagtgagctgtccctggctgctgccaacccagaagccatggccacccagaagctcttcaagtcagatgctatgcagatggacaaccatagcacagactgaagggctgagagaagccagcagggtccagtctggctccgagcgtgcaggtctagatgcgttttcagaggcatctttaatttgtggaccaggttggctgcccctagggcttccatggtggcctggcgggctacagtccgtgagaccacaaaaaagttggagaccactgagcgcctaacactttcactttgacacaacatagtagaaacaaggtatgtacaaaaataagcacatggtataggaacaggtacagacacaatgcactctgccactgtatgcatagtagtctagattatgggatgcctctgggctatgtgtctgtacagcaatgtataaaatgtaataccaagtgtggcttgtggtctggagctcagtaaggagaactagatggaaaccggacggccacgtggagagcgcagacctgactcttcaggaactgtggtgcgattccagctccagcttcgacgctcagtgactgactgtcattcaagggggcaagtcacttcccctctctgggcctcagtttctttgtttataaaattagacagttggcctttcgtgattcctgagtttcctcccagctctgagaatctgtgagtctataaagacggtgctgcacagaggtgcagatggacctagagtgtgtcatacagagtcaagcaagtcagaaagagaaaaacaaatttcatataatatcacttgtatgtggaatctggaaaaatggtacagatgaacttatttgaaaagcagaaatagagtcacagatatagagaacaaacttatggacaccaaaggggcaggagcagggggaggaattgggcaattgggatagacaggtatacactactacatataaaacagataactaacgagaacctgctggacagcacagggaactcgactcagtgctctgcggtgacctaaaagggaaggaactccaaaaaagaggggatatatgtatacatatcgacgaagcactttgctgtacagcagaaactaacacaacacggtaaagcagttatactccaataaaacgttttttttaaaccgaaaactgggggaggaggaggcaagggaggcaggcagcgaagacaggggaagggaagaaagggaggcacaaacagaccgaaccgtcctgccaataagactccagatcccagttttgaagcaccgctaagaacaaactgatgaaggctctgaattttcacactggtggagcaaggaggagagaccagcggtgtgaaaacggagtccttcctgttctcaactgcatttcctttgcaagtcaagataattaagcctcttgggaagttgggaaaacattaacacctgatattctagtttaaattcattataagagatgtaccaaagccttatttaaccaaagagttctctcttgtagcttgtcgtttacctctagaaggggatgggggaacaagcatggagctttgatttgagaatcaggtgttttcctccaggcacgggcatcaggtcctctgcccaccctctgcccctgccaccgccctgaggagagctgccagctcttcccgccacccctccccgccctttcagagcaccactgggcagagcctccttctctgacaccatcaagggaccggtctccactgcccaccacctctgtcacatagcccctctcctagagcaaagctgtttccccgccctcagcctcctgggatcctcatctccatcctgggggcttgtagggaggcaattattgtcccattttgccaagagggtctcccccataagttcttagggacttaaagaacttgtgtgaagtggcttctgagtttgaaacaaaagccactgtctctaagctgtcacaccacttaccagttgcatccagggaacctggaaggtcatgtcagtagattccagactgaacagtgtcctctcaatttaagtgggaggtcattggtgaccccagagaggcagccggctcctgtgggtgcagcatcctacttgccctctccctctgtccacagctaccggaccctggccacggagcacgaggcgctgatgcaaaaatacctgcacctgctgcagatcgtggagaccgagaagacggtggccaagcagctgcggcagcagatcgaggacggggaggtggagatcgagcgactgaaggcagaggtgaccgcaaccccgggagcagaggagtctggccagggatcccagcctccaacctcacacccgggctccccaggttcagggaggcacagggtaggcaggagggaccctctcccagccacagctatgccagccccaaacttaaaatcagtgatgctggcccagtggaaaggtcgggggtcagatctgggttcaaagcccacccctgcctcttaacagctgcaac

SEQ ID NO: 30727 - DNA, 2302 bp, Bovine  19866880856636
tcagcttcagcatcagtccttccaatggatattcagggttgatttcctttaggattgactggtttgatctccttgctgcccgagagactctcaagagtcttctacagcaccacagttcgaaagcatcaattctttggcactcaaccttctttctgaagaataggctttttatcgctagctgacaaggctgtgaagatcaagtgaggtcactgattggcaagctcctggttaatcttctgacaaccacatggactaaggggcaggtgtggggccagagcatggctggtaagtcctcagagtgtgggctcaggctcagctccaagacgatcccttccttctgcctgccatggccatctggaggctgattaagtcttccaaaacttctagaactagtcttctagtcttgctaggttaagtcttctagaccttcactactcaaagtgtgatatggcccatcagaaatgcagaacctggggtctcacccagatatcccgagtcagaacctgcactttaacagcatcccagcaattctcatttacctgagagatgctgactctcagcccacagatacccctcgccagctgttcacacctccacatgatgatctgatcgcctctcacggcctcatctcaccaggaggtcacaatgtgtgttaattgctcagtcttgtctgactgtttgtgacccccatggactgtagcccaccaggctcctctgtccatgggattctctgggcaagaatactggagtgggttgccattcccttctccagggtagcctcctgacccagggatagaaccccggtctcccacgttgtaggcagattcattaccatctgagccatcaggggattcccccaaaatgcaggggcatcaattctgcagcactcagccttttttattgtccagctctcacatccatacatgactactggaaaaaatcatagctttgactgtacggacctttgtaggctacagtccatagggtcccatagagttggacaagactgagtgactaggcacacacgcacagggaactgtatcccacatgtcgctagacaagatcaaaaaacttaagggaaaaaaaagggaggaagaactgagctgtgtggcagctatctgaaaaacaagaattacaaaggtcttagtaaaaccttggcagttaacaaagaggaaaacacctgggttaattccaccgtgaatgactgctctgaccaaatgcattctggactaaagacactgcctcttgagagggagcagggtggggcagaaaccgatgcaccctgtctcaaaattggggtggcaagcggggttttcctctgatggatcaaggaagccagaccactggtggcgagtggacagggtccagcagagacacctggctttgagcctggtcaggcagccgaagctagactctagccagtgacttgggcgtgagccaaagtccccaccctgcgtggccttcattgacaagggtcaactgagcagaccctggacatctagcaagcaaaccgaggtccaaagcagagccatctccagaagagaccggccagggtcggagaaaggctgcctccgtgggctcacctgacccttgctccaggcagagatgggccatagcccaggacttgtgttggggtcccaggcttgcaactccctcactagagctttgtcccccaccccagacctgatgatccttgaacagaggctccaaggctgccagtgctactgtgcatgcagcatagtgcctgacctaattgcatctattttttgccctggtccctgctgagtggatgtcctggaatgcctctttctgagacaagtgccaggtttaaatacaggacggacacacacacacagcacatgcacacacacaacccaccatgctaaagaaaaaaaaaaaagtggttccacgtgcaaagctcaaaagtagcaaagaaagcagaaggtgataataatcaggtcaaatgcgggcattgactgggcattcctgcatctctcagctctctaagagcctgcctgtgcgtgtgtgtgttcgcatgtattcctcagccctttaaaatacagatcaaagaaccagcctttatttcactgtgcagatgttcccagagaatcgaaataaaaggtggggggtgggggagaaagaagaaaagcctgtgtcggcgctgaatatgtctcagttagatattttcagccgctcttcaagcataggctggggtaattttagcaacccgagagtggagagcgggtaactgttccattttgctttcagagtgctcaattcgctcaatgtagagcccattcat

SEQ ID NO: 30728 - DNA, 1840 bp, Bovine  19866880869328
gttacagttatgttaaagtacttatctccttattctaacatctggatcacaagtgggtccacctttgtttttttccccacttgattatgttcacaatttcctgtcaatatgtctattgtgtttttttttggggtagtgctgaataggcagaatgaaaagggtgggaacctccacacctcaacattctgtgctatgtgctaaatcgcttcagttatgtctgaccctttgacatagcccaccaggctcctctgtcaaaatggggattctccaggcaagaatgctggagtgggttgccatgccctcctctaggggatcttcccaacacagggatcgaacccaggtttcctgcattgcaggtggattctttaccgactgagccactagggaacatcctaaaattataaaaatcacaaaaatcacaaacaaaaaatcaaaatccccaaataagaacatcatcccttgaatttacacagtgctttagacgcgggtttgatccctgggttgggatgatcccctggaggaggaaatggcaacctactccagtattcttgcctagagaattccacggacagcggagcctggcaggctacagtccatggagtcgcaaagcgctggacaggactgagtgactaacactttccaaccctgcattgcaggcagattctttaccatctgagccaccaagaaagcccccaacatctggcataactgtagttatatctcaagcagaaaattgacactgatatgatccacagaccatactcaggtttcactaattttacatacacttatttgtgtgtgtatttagtcttctgcaattttatcacacgtgtaatttctgtatccattgcccagtctagatatggaatggttccattagaaggatctcttgtgctgctcttttataaccagaaaatcttactgccatacttccccactccaacatgaccccaactctgacaactcccaatcagttcagaggcagtatttttgaacttgaggtggagttattaatatttccctttgctgagctccagcagcttctcactggggtagtaacccaaattgtctgtgcatgggtctgctccccaggcccagagaggtgtcttgtgtgaataagggtcactgcttccccgaaggctcatgggctggtctgagagcgatgggaggagcatccttcttgctcccgccctccctcagagtcagcaggggtccttctctggccccctcagcttgggagggcctggctccaggccaggtcagtctgagggccccccctctctctgcatgtgcaggaaggacctgtgtgcggccatgaaccagccctgcgagaccctgggcctgtcccacgtggcgggcatgtgccagccacaccgcagctgcaacatcaacgaggacacgggcctgcccttggccttcaccgtggcccacgagctcgggcacaggtaccctgccacccccactgccacactaagaacccagcctcacctcccaacctggaggcaccagccagccaggctgatggcccatgcaatcccagggaagggagccctgtcttgaggaacgagcccaacctagccacattctgtccttgccctgtccccaccccgcagccaggctgcttccctgttacacaggagaggactaagccttaagtgggattgagatgggccggaaagtcaccatgagtctttgtccctcccggttgccctcagcgcttgcatctttgactcttggtccctgccacctcccaccgcattcctaaatactctgcgaccctaggcaagctccctgccctctctgggcctctgtatgctccctgttggttgaggggagttgg

SEQ ID NO: 30729 - DNA, 1849 bp, Bovine  19866880926386
ttctgccctctgcagcccttgggaacctgaacttcagggtcattgggggtgtgttgagctggctctgcaccaaatgaagcgggggtatctatggaagttcatcacaatagttcatgtcctggttctgctgctgattcctgaagcccccttgggcaagcccctggctttctcaggcctcagtttccccaccatatactgaagactgtgaatcagctggtctgaggatttcgtcagcctggacttaacccaatgcaaatggaacccagttctatcaagcgtcagctgtaatgggagaagcactggcacaggcccagcggaaatgcctccagtcagcttgtgtggcttttctggtgtgcctcgtcactactgcctcctcccagctatctctgttcaagcctctttcatctggttctgtctgcagaggtgagtgcaggccacttccctcagtatccagcccagggtctgtctcagacccctgatttcccccaggcagcagaagcctagcgacaggcctcattcgtcttcgccaccacctccaagacaaaggcctaatgtgtgtgcagatgggcctgccctccatcatcccttacaaccaatggccgataatgggcctccaatgagtcccctgtggccaccagctgaccaaggggtggccgggcaatggcgcatgcaaatacagggaccggatgacaaagcaagcctcttgggggagggcatagagctggaggcatgattgtggccccatggcgaatcacataactcatttctgacacagatacgttatgcctctcaaagaccacttgcccctggacactgagctgccaaattaagtgacagggggtctgctgaggcagccactacagagcaggaacccccacccccagaggcctggccccaggaaccatcactttctgtgaggacagaaccatcccctgccaggccactgggctattgaagatcttggccaccacagagtgcctgtatttgtgtgattaagaaaatggggtctcaggaagagccacgatgtgctccaagcacatggctggttgggggcagagctgaggctagagcccaggtctcctaactgccctcccaaacccatcagaagggctatgatgcacagtggggcctcccgtcctctgaagggcaaggccagtgactccagcccatcctcccatagagccagcacagagcctaggccttccctggagcccagggcctggtcccccaccttggcaaaacccctgaaggccaggcccttcttaaaagcagatacagagcagatgtggagggtgggagatgggatggaggaggcgccagcagtcctgaagtcatagctggcccctcactgaagccaaaaagggctttgggtggagtaggctccaagagctcagctgtgctgctggcccgtctcagagtctctgtcagacttgccctctctttagacctcagtttgcctttcagcaaaatgaaagatgacgcaaaaactagtgactcaactcctaacggctcctatgtatggagcgcttgctgggagccaaggcctgtgccaagtgtggcgtagtcatcgcatcagctgaatcttcataatcaccccaagaagctctcgtctcttacagatgagaaaactgagacataaatagctgaaggcacttctaacagtagtggccaaatccaggttagaacccagcctgacaacgaagtcggtttcaggacatcaggctgcctgtggcactcctctggcttggggacaaagagagaggagggccaggaaacagggagggacagacttccagaggcccagctcccgccaggagggcaagaagcaggttctagagggcgaggccct

SEQ ID NO: 30730 - DNA, 1602 bp, Bovine  19866880981635
ctgtgttggcatggtggaaaatgtcctcaaattcttcttgtttatggatccttctaggactgtttttctggtgctgtttttggaactagagaatgggtcaagtttcttggcttgtttgacaaaagacaaaggggaagcagaggagaggtcttgagatatagctcccagcgtgcgggcttgttaagtcgcttcagttgtgtccgactctgcaatccagtggagtatagccctccaggctcctttgtccaagggattctccaggcaagaatactggagtgggttgccatgccgtccttcagggggatcttcccgacccaggatccaaccagtgcgtcttacgtccccttcgttggcaggcagattcttcaccattagcgccacctgggaagcccacagctcccagacccttgcagataagggaaggcttcagaaagtgtagaattgaaaagctaggaccgcgactagctacatcactagaggcaggggatccagctggtctctgggtagaaaaatagaggttcatagataaaacgtttattccttatcatgcagacaggctttcggcaatgatgaacctcctcatttttgctcacagagcaggcttgacatttatatagattaatttcagcttgacattttgaccaaaggaactattagcccctcctctccctgggggaaaacagcttgtggggcctgaccggtaggtgaccccatcaagctgttccagtcccttctctagctcaacatctggctggatatggatggcttctccatggctcccaggagttacagccaacgggaagcaaggtcgttctttcctgggctcatttttcatgctgcctggttttgctgcagatgcaatcaaagctaaatctcaatttgttgagcaggaggggcagctggtagcaggccagcacctgcagtgtgagataaacctccccacagcccgtgggagccaaaatcaagatctaaaagggaagaactcgattttgttgacaattgctttatgattcatttagtaaaattctttcccttcgtacagagctatgtgctttcactgtgttgttcaacggatcctctctaccgccctgcaagggggcagaatcgggctattctcgtttcactcaaagcccagagaggtcaattcagttgccccaagttgcacagcggctcggtgctttcagcccctgaaaactaagtgctctttttactctactactctacttctttcaggcaaatctagagggaaacttaaaaaaatccatgggactcaaactttgtttgttccacctggcccttctactgctgacagatctgaatgcacaccctctaggccctcttggggcccaccccttctccctgctggtgttcctccctctgtgttcttactgagcccatctcctcatacaaccaggcagcatgatgtggaccagagttcctccaaagggtaccacgggcctttgggacaattgttcattttaggggctgtcctctaggacattagctttcctggatcctggctactaaactccagtagttcctctccattctttaacctccctacctaccaaaacaccccagacatttccaaatttcctgggg

SEQ ID NO: 30731 - DNA, 1241 bp, Bovine  19866880999604
atgagggccatagttacagccacctcaagaggggacagggctgtcccccagtgcccataagaaggatgtggaggtgagttttctctgctgggagtagaggtgacttcgtgtctaaaatatctgagtttggcaaaaagagtagagttttcactgtttttggctattgcttttattgaaattgattcaggtttctttgttttaaaggagtggatagatgtgaagttgagatggaaccctgatgactacggtggaataaaacttatacgtgtcccttcagactctctctggactccagatatcgttttgtttgataagtaagttatagtcaaaataccattttatgttttcttaataaagaaatcatatcaccattaggcaccagtattttttttttattccctttgaacattgtttgcctacgtaaagtcccatgacttaatcttgtgttcttttgtttcatgagcctacaaatatgttctgtggattctctccatttttcttgtgaattattttctgatcataaaagtgtccttggattttaaaaatttgtaatccatttggaaagtccaggaaggtatgaagaagttgggggaaacataatcagtcccgtgagcccaccacatggagccagccacagctgctggcttacctgcacagtgagcttactctgcctggcagtgcgctcagtgccgtgcatgctttagccatctgagtctcaagataacctcacgaactagggatgactacatttatgtgccagatgagaaaatggaggccaagggtagttatgttttgtctaagatcacagctcacatgtggtggtgggggtggaggtgttcatagtaaagcagcctgacattcctgtttacctcctatcttcaagcctacatatttgctgactgccttccagattttttggtattattttttttaaatagttaaggtcatactttatgtttaaatgcgcatccttttaatttgcttagatgtttagatgtttgcttgatgtttcaataatttggaaaattatgttgtcataattttcccacagtgaggaatgttgggttgattattagctcgtattaatgagtattctacctaaatgtgtttcaattatggtttttgacttaggggagagggtatttctggatgccagtttcatttttttctaggaccaaccactccaggacactggggaatctgggctcatcctaatgtactttatcttatttgcaaaaagg

SEQ ID NO: 30732 - DNA, 1495 bp, Bovine  19866881020801
aaatgacacatatagatttaatccgttccttttaactgctgcggactattccattatgtgaatatactatattttgcttagtctctctcctattgatggacaattgagttgtttccagtttgacatgaataccaacatcctgtactgaatctccttggaggtatttcctgtgtacatgctgaactcctctctggcacatccttcaagatggaattgcaggcttataggaaattgcaggcttataggaaatacatgttccatttcatcaggtgcagccaaattgttctctattgggtttatatcagtttatactcttggggatttccctggtggcccagtggctaagattccacattcccaatgcaggaggcccaggtttgatccctgctcagggaactctagatcccacatgccacaactaaagatcctgctgcaactaagacccattatagccaaataagtacataaataaaaataaatatttttataaatttatcctctcactgtgccgtgctgtgcttagctgctcagttgtgtccacctctttgcgaccccatggactgtagctggccaggctccttctgtccacggggattctctaggcagggatactctcacttgcaatgtataaaagttaacctttcccatcaacacttggtgcagccattttttttttttttaccatttttgctgatccgagggagtctattcccattgcgggtgggtccagcatgtggataaacaacatccatcatgtgtgtctcaaaggggaaaaggttgggagtcactcggtctgtgagaatagtcgtgtttgaccacaaacatcataccgaggttcaaaagttgatgaattgcctaacagctcctcagagtaattcaccttagccagtgaaacacaaactgctcttaaaacaaagcagtcatcaaattaactgctgtgctgaaagaacttcccggtggacttcataaattcggtctgaagtctgtgcagtgggtccctgtggctgtgccttggcaatggaatcacactgagcctggaggtccaccctgcattccatgcggctctgcatgtgggcaggtgtgagatgaggggccttggcagttcctctgggatactcctcccgcatcccccactgcttgaccaagattggtgggcagacggttgatggcctgccagtcagcccaccagcggagaggccaggactggcccagcaaggctgcttcagaaagtgaggtttgccagggtgggagcttgtctgtactgagacccccctcccccaggcctttcagaccttccttgctcacctgttccctcctggtcacgtacctccacccctctagagtcacagtcttcagggtgtagataaaattcagcaggaagccaaggaatccaatctgggctctactctgcccatcacccagtgaccagggaactgctgtgttcaatggggagggtccctttacctggggacttctcagggttagtgtgaggagt

SEQ ID NO: 30733 - DNA, 2010 bp, Bovine  19866881078837
tcttgttaagcagtgactttggcaggtgagagtggagtggcagtggtccaggaggatacccaagcagctggccaggaagtttacgggggctagaggggtgatatggattggatacaggaggcagggagcaggcaggagcaaggtgatgagtctatattggaacaaggtgaatttgaggaggaagcaggccatccagacaagatgtgtgggtctgaaccccagggatgtattgcagctactctttagaaatccccaccaccaccaggtttgtgcatgctaagtcactgcagtcgtgtctgactatggactgtaggctactaggctcctctgtccatgggattctccagacaagaatactggagtgggttgccatgccctcctcaagggcatcttcccaacccagggatcaaaccctgaattggttcgatgtgcaatcccacatctctcatgtctcctgcattggcaagcaggttctttaccactcgcgccacccaccaagtttaggaaaccaataaatgggcatcccactccttgatcttggcagtggaggtacagggcagcccaggccaaatgctgtgtgacctgactcaattctgtcccctctcttcccatgctgggtgctcagctgggcccaggacagaggatctctgaaaggtgggctctgcgatttcatcccttctgtcccatcccaaggtctgggcactgtggctctgttcccctggcatgctgtaccatctccccaccaggatgtctgtgctggaagcagaaaatgtcccctaggatggctgcctagagtttgacccccaaacactctgattttaaaaaaaatatctttttttaagtcttgccctttcaaacctcaattttctcctcttttccattaaacaaaattttaaaaagctatttaaagataaatttaatattctttgtcagatccagtcattaaaaatgggattggattttttatttccaatgctccctgctggagtgagctatgtaaagacagatcaggaggcccagacaagggggtttttttgggctttcactggtgttactgaattaagcaggatgttctctgggaaacagtgaaggtcaacatttgtaatttgggatttcactgaggagaatacctgggaaattaccacgaactgggcaactgattcagagaatgattagatgttctaaccacacacttcctctctcctcagattttataatcctcattcaacaacctcttactgagcatctcctcatatgtcaaagattgtgccttgaaaaaaaaaaaacaaaacacaaagattgtgccttgtgccaggctttggagacacaagcaggatcccatgtggatgatccctagacctcagggacccaagcgtactgggtgtaatccaatccctcgccacctaagccaatcagggcagagcatagccccagccacagtgattggttcagaagagagtacttgaccttaagtattataatcaaggtgaacaggacttttgttcagtggtcaaagtaagaggagctttcttctggatgtttcagaggatagacgtgagacccaatacaatgggagtcattttgtaatcttgaaggatgctggacagagaaggaaacagttacaaagaggagagcagagcccagtgaatataaaaagccagagccaggaccctgatcaaactatgcctgaagcccgaccaattgccagcctatacattccttctgtttaaaccaatctgtagagagagttctaagtgaagtgaccacataataggtgcctactatttacatgaactaatctaatttagtactcacagcaactctttaatgttagagactggcagccccattttacagatgaaaaagtgaagccaataactaagtgacttcctgaggtcaccccattagtgaggcagttggtgttcctatccaagaagctggactccaaaatctattttctgcaaaacaagattgactgctgtgttggcatggtggaaatgtcctcaaatt

SEQ ID NO: 30734 - DNA, 1018 bp, Bovine  19866881113188
cactaacttctaaaaatttgttgcacaggattagctgaaccatccgttgttgccaaacacgaagatagtttgtttaaggatttatttcaagactacgaaagatgggttcgtcctgtggaacacctgaatgacagaataaaaataaagttcggcctcgcaatatctcagttagtggatgtggtaggtgtgcgcgtcattatgtattcgtttcacacaggtttatgcagagcgtcttgtgcacgcaagcgccgtgccaggccacagagataacgggtgaatgaacacggctgttgtcctcaaggagctcaccagggaaaaacaatgattacaccgcagacacaggaatactgtatgtttatgtaatctggtagagtttagaaatcattttatctcatttggtgattaaaataggcctattcttaataaattcgaagtgattaaatattttatatggaagtttctccttaaatgtgttttaaaaatatgaccaaaagatcaaaattttaaaagaaaaaatccaagagttagagttgtagatttttagaaccaaaaaggatctcaacagattattgcttcagtatcacacttacaacgtttctgagatcgtttcatgtgagatttaccaggaagtaaattctcttcataaacttgtttttgttgtcaagagattctttctattttaaactaaaaggttcacactaattttcaaactagtttcttcttgttctgatcatattaatcaatatttccctgttgtgttcccagaatagttgacaagtatgtgtgtgtgtgtgtgtgttggtgtgtataatgtaagtgtgcctttattttctgattatagaagcagtgcatagtttttggaaagagttttgaaagttcaaaaaaatacaaataagaaaacaaaaattgactgtaattctaccacccagaggtgaccactggtcatgttttgttgtatttcttgccagttttttctttatgagtatgttataaaattggatattattttagatataat

SEQ ID NO: 30735 - DNA, 811 bp, Bovine  19866881168366
agatcttcctaaaagaaactccagagctaataaataatgaatgctttccttgacccacaatttggttgaaactggagtattccatgtttgtaaattaatttccccccgtgcagccgaccaactaatttgtcgacatgttaacataagcagtaggttccccgaagccattgcttgatctattagcgctgcaggaggctatgggctaggcgtccagggtctggaagaatggtttccctgatgttctactttaattaagggctccttctggccctctccaggccacagcatgttcagacttgaaatctgctgaagcgagccttcacggggatgaacacagcttggggaggctgtcgctacagaggcaggggcatcacagctcccagagcaggtctatgggcacctccctgcatctgtgcatgcctctggtgaggacagccacctttatttcaaagcagataagaaagtgaggtgcagaccagcatgggaagtgtcccggctcacacagtgtaagagacagaagtgggatcaaatcctgagctctcagcagtgggataagccatgtgccatgttgggggagtggtagcttctgcctggggtgctggcagggggtgagtgcccaaaggcgttaggaacgggtgctgtccgaactcctttttggttggaaatgagaaaaaggctctgggtgctgctctgcctcagccagatgtgaccatcctccactggcccctcacatacacctacgggacttttaagggcttatctggggacttttctggtagtccagtggtaagaatcctgccttccaatgaag

SEQ ID NO: 30736 - DNA, 1050 bp, Bovine  19866881223248
ttgccatggtgattgatcgtatttttctgtgggtttttatcctggtgtgcattttagggacggcaggattgtttctacaacccttgatgaccagggacgacgcgtaagaactaaactgtgtgttatttatgaggttatttgtgggcgttgagggagagggggctcactttttagttttcattgtaaagtacacagcataaaatttatcatctaaaccacgtttaagtccacagttcagtggtaaatatattcacattgttatgtaaccatcaccaccatcccacccaactctagaccagttaaacaatcaccccccattctcccctctccccagcaaccatcataatactttgtctttatgattttgactaagctaagtactcatgtaagtgcaatcacacaatatttgtctttttgtgactggcctgtttcatgttgcagaatgtccctaaaggttcatccgtgttgtagcatattgcagaatttccttactttttaaggctaaataatactcagttgcaagtatacacattttattgtccatttatctgttgatggacacttgggttgctcccaggttttaccggttgtggataatgctgctacgaacatgggtgtacaaatctctcttctgtaccttgctttcagttcttttagggatataccgagaagtggaattgttcgatcatttgttaattctatttttaattttttgaggaactgccattctgttttccaccagggctgtgccgttttacattcccatcaacaacgcacgagtttctctacatcctcatcgtacttatcgttttctgggtttttttttgacaatagcaaacctaccggttgtgaagcggtatctcattgtagttttgatttgcatttctctaattattagtaattttgagcattcttcatgtgtttagtggccattcttgtgtctgctttggaggaatgtctcttcaagatctttgcccatttttgaattgggttgttttttaagttttaggagttctctttatattctggatattaatcctttatcagata

SEQ ID NO: 30737 - DNA, 1649 bp, Bovine  19866881237017
agggggtggggtgggcagaccaaagtcttaaacggtgcagaaattcatattctggttctatgggaatctaagaacaagaacggatttgtattcttggagaagcacatactaaagaagaaaacccagagaaaccaaacgactatgtacagtatcatagagcacgtgtccatgtgagcggctgaatctgggctgggtaccggcttcaggtggggagttttggttctattcggagagaagactcgtagaggctttcttcatccattacaaaagattggtccagtaaatactgggttacctgagaaaaggaaaagagaaggaggaatgcgaggtgatgcaatctccacaatatactaggtggtcactgagtgtctcccaggaatcaggcagcatcatggggagaggggcatcaggcttgcacatgaggcaaagatgcattaaaaacaatgtgtcttttttaaactgtttatgattttgcttctttattattattattttttggccacactgcaaggcatgggggatcttaattcgtcaaccaggattgaacccgtgtcccctgcattggaaggcggactcttaaccactggaccaccattgaggtccctgttgtgtcttaatactattttttagtattgccttaagtttttgtcttcatagtaatagaaaatcacatatggtcaaaattactcttgaccaccattcctatgtgttagaagacatattttaggctcatatcaaaaagtcgtctatatctatgggacttgcctagtggtccagtggctaagacttcacacccccagtgcaaggggccggggttccatcccggttggggaactagatccctacatgctgcaactaagagtccaagtgctgctgctaaagacccttcgtggtgcaacaaagacccagtgcagccaaatagatagatatttcaaaatataatcatctctatctatgggcttccctggtggttcagctggtaaagaatccgcctgcaatgtggaagacctgggaagatcccctggagaagggagaggctacccactccagtattctggcctggagaattccatggactgtatgggctctcaaagagttggacacaaatgagcaactttcacattcacatctatatctctatatctaaaatgtcaactgtagcatctgggctgtggatgtatgggtgttaacagttctttcatgcgtgtgtgctcagttgcttcagttgtgtctgactctttgtgaccctatggactgtagtccgccaggctcctctgtccatgggattctgtaggcaagaatactggagtgggttaccatttcctactccagagacagttctttcagtgtttccatatgttggaaaaatgttcttaaacatcgggattatgtagcatgagagaatcccccaggagccaaccgtggaagctgaggctgtgtaagaaaggaggctccccgttcttcccctcacaaggctcactccagggcaaaatctcagagtggaaaatcaggaagagtcaccacatggattaaactattctccttcctccacgtgtcccacttcacccagctcccgagtgctttgctggactcctgtgtgttaaatgtacgatgagagatcagagcccaatctcacagtcagaccccca

SEQ ID NO: 30738 - DNA, 1423 bp, Bovine  19866881241427
ttctctctaggcgagaatactggagggggtagccattcccttctccaggggatcttcctgacccagggattgaacccaggtctcttgcattgcaggaggattctttaccatcttgagtcaccagagaaaccaggatcttccataaatgaagccaaaagacaggccttcctgcccacctgcgtggggtgggttacacagccttgtctgaggtcggtggagggactgccgagaggaagagcacgatttcccagccagcgctgcagcccccagagtcgctcagccaggttcctgcactggagtcgctcataaaacacaaggcgtgacacccactggtctccctcagcctcacctgccgccctccccaacctgcatctcacacaacatctggaatctatttgcagttctgggttggtgagctgtacctgaggagtttttgcttttgaccgattttggtgtcgttggagatttggtgggggatgtctcagtgtcaccatcgtcactctggttttgatcattgtctgactcttccctcatggagacttctgagcctagaaggaaagaaggaagcaatttgatatttctcaaataatcactggctttttcaaaaagattttaatatttttggcctcaccatgtggcactcgaggtccttgtttcccaaccagggatcaaaaccaggtcctctgcattggaagcacagagtcttaatccccggacctctacccctagtcattttattttcagctaaagtccatgctttattcagatttctttagtttctacccaatgtcctctttgtattctaggattccacctcggaaacgaaatgacatttacttgccgtttcctggctaggattctgccctttgctcctgcaggatggcctctggggctctctggtaggctgtcactttggtaattgactttcagctatgtgcatcccgtttactgcacgtgccacagtaaatgtcacctggtatggaggtcctgggggcttcaccccttcccagccatgccctttgttggagattcccctgtcttcccccttctcaactcagaggagagaaattccaaccatcttaagttttttcccaaggcttgctccttgaaggctggggcttctgcccagcccagggttgagtatgtctgcgtgtgtgcgtgtgcatgcatatgtatgctaaccactgcaaggctggtgtcacgcaggatttgggctgacctaaccccagacagagccagacaaccctccaagggacaccgtcctggaatggtcgggtttctgagagcagggaaggcccagctgggccaccatcacctgtagccgtcgtctccacacccagcgtcgcaggtgtgctgtgcttcacgctgttccctgaacacatgacacccttcctcgccccttagtctcgcccactccattccg

SEQ ID NO: 30739 - DNA, 1108 bp, Bovine  19866881337119
tcaaggaggaggggatatatgtatacctatacctatgactgattcactttatggtacagccacaaagtgaaactaacgttgaaactttgaactaacacaacattcaaaagcaactatactctgattaaaaaacaaaaaagattgggtctgcttagaggctgctgtggccagagagacctatggtacctgagttccaaacctggacagcacactggaaggttggatgtggctcaaagtattcatgtgggagacaggaggtgacagcagccctcgcactttaattatgtccatctgagctgcaaacacactgctttctctccaatctccattggcagaaacctgagcagagcctgtgaaggggccccctggtcatccccctggtctccagccagagttcaggaccattggaaggcactcaggggagttgcttaaggagacatcagctgcagtttgggttgggatgggggtgccagggagcaggtaggcatgtcctgccatagcaggcagagatgggcatgtctagctatggtgtgtgctgtccaccaggccagagaccaactcttccccataggtggaaaagatgcccacaagacctcacaagtgcatctgggctttgccttgtttcattccatcctctccataaggctttcggacaagggttaataaccctgtttcacagatggagaaactgaggctggagagtggaagcaacatttgcagagaatctcgtagggcgacgctatgatggggatcctgattgttcagctacagctcattgcagagaacttgctctctgggtctcccaatttccagctctctgggctgaggtctctgcagataaggatacgataaggaggattaaggagtattttggtgggtttgagatctgcatttagaaatgactagctagtgacatggacattgcttagtccaaaatcctagtaagtcttcatgggcacatttctgcggggcttcagaagagtgctcagcttgggcatttgttgacctgggagttgtgtgggtctgacctgcctttaggccctgggaagagggagtctttggggggtgtgtgtgtgtaagtgtgatgtgatgtacacatgagaggtgt

SEQ ID NO: 30740 - DNA, 1580 bp, Bovine  19866881612419
ttctgggctttgaaaaggaggtagcttgagaatgagttgtggtttgaggtctctccatttctgcttcccaggcacataggaaggagagccaaggcaagatggcaagagccacatccagacggtgttctgaaagcatccttaggtggcagtgtaactcttgggatctctgaggatccctgccaccttagttcatcctgcagaattaagcattaagaattttaagtgagaggtagaatttattaggtcaaaagaagagggagccattgagataaaagggcagaagtaaaaatgagtttaacaagtggctgacagagtagttcggtctggccagagtgaagcaggcagtaaacgaaggaaaagaggaaaggtattttaggccaaatttagaacactctcaatgatagaattttttctctataggtagtgggaaaagaggattaaattgatgttttaggatgatgaagcctcatgatcttccatcccacatgttcctcctacaatgtggcatggatgcttcccactgagaggtgctgtgtccccttgccctgagtctgggtgggcgtgtgacttcaatggaagtaatatcatatgactttcaaaggcaggtcataaaatatatattcctgtcttgttctcttgggcaggtgtttcttggaaccccagcaccatgctgtgagggagcagagaccaaacggagagatgttccaccaacagcccagatgaggttccagcgtgtcccgcagatttgtgagtgaggattcctccagatgattttagtcttctgtcactgagtctcccccagccatgaaaccttccccagcattcaggttttcccagctaaggcctccgacatcgtggagcagagacaagctgtcctaatgcctgtctgaattcatgacctgaagacaccataagattaaaaaacattattgagcttttaagccactaagtttttggttaaattgtcacacagcaatataatgtaattagagtttttatctgcccctacctaatatgaaggatatagcccgccaggctcttctgtccacggaattctccaggcaagaagactggagtgggtggacattcccttctccaggggatcttcccgacccaagaattgaacccaggtctcttgcaatgcaggcagattctttactgtctgagccaaccaggaaaccttaatatgaaggatgtaggttggataataagaccagaaactaaagccctgttgcagtcgagaggggctaaaagcctggacaggaaaagatacttgcaagagtagagtctttgctggacaaatggtattaattcccaaacctagaactggattttctcctcattggtggaaagaaccaaagactggcacctggtagatggtgcgttcattctaacagttcatcagagagacctttattaaagggtgtgctaggggctgggcagggaacttggttctgaagataatgaaataaatattattcagtttatgccaccaaagagtttataagccacattgaactgattgactggagataagctgcagcaaaccccaaatagtaaaatagcaatgcaaggcagca

SEQ ID NO: 30741 - DNA, 1190 bp, Bovine  19866880452884
cccactccctcgcaagatttggtcagctcccagcaggtagcacgtggcaacctactgttggccttgcccgctccccttccttcttaagaatgggtttggttagatgaaatactaaagttttctcgttaaacttaactgaagcgtttaaccaacttacgcctgaataagatacttgataaagaagttcacagagctcgtcccggttttacgtgctataaataattgcctttccctgtctcttgccctcggcttgtgtgcgtgtgtgtgtgcatgcatgtgtgtatcttacagtcttcatcatgatctctctttagatttcttgctggtgtgtctgtatcaccaggatagggcccaacatcttattgacactgaatacaacttaaactgccatccttgtaattactgctgcttttgtttgaaaatattatctactataggcttttgtcagctttttgttaaagtgcttcatcttgtatttctagcattctgaactctgggcataaaagcataaagatctgggccatctaaagatttggcaatttttaaagtgcacagtgagtcctgggcttcagatgtaattgtaacacaatgagtgtaataaccttatgggtgttgttttcatacatgtttgcatgatagactcacatctgaaaagaaatcatctaatcaatgtgaattcccatcatttttcacctatcctgatgtgggattggcattttgtaaaaactttgtagctgaaagcttgtctcaggagattgtgaatatggtgtacatcacagtggagggggtatgtttattttgctttttgaattttatgtgttaaaggtccacttctctagtctttaaggggaaacctattcccagagttatctgtatcttgaaagtttgatgacaactgtttgacttttgtaaatggagctttttgttagattttgaaagcctgaagctaatgcatattgatacttctctttcatcatctctaagctaagacagagatgtttcttgaagtattttgctctgacaaattaatgaaggaaaatgacctatacgatactgtagaagcataaaccataccattcagtaggtgaaatgctgtagacatcttttttttttttcattgcaatggtgaatggaattgtttccttaatttctctttctgttttctcattattagtgtataggaatgcaag

SEQ ID NO: 30742 - DNA, 1560 bp, Bovine  19866880524269
aggtactggagtgggttgtcattgcctattccattaaggcaaatattatctattaattagatgaatgggcttcccaggtggcactagtaaacccacctgccaatgcaggaggtgtaagagacacaggttcagtccctgggtcggcaagatcccctgcaggaggaaatggcaacccacttcagtgttcttgcctctggaatctcatggacagaggaacctggtgggtcacagtccatgggatcaaaatgaattggacacgatttagcacagcacagcccaattagatgaatgacaaaatacaaagggcatttgtcacatttgacacatatacagaagtcactgactggcatagatcagataagtattattttcataattatttttagccagtggaaaattgcttcaaaagtttgaaactattgaggacgggtaggtataatacctagattgaaataggctgacatcatcaaaagaccatatgcttttgtgtttacacagtatttaaagcttcacagagccagctggctttatttcataatctaattacatataaaaatgttcagctaaatattgcaagcttgccaaaaattactttaaatatcttcatcctctgtgttattgaatttgcatgtttcataactcctatccttctaattactgctttgtttttcattgttcatcttttaataaaatatcatttacttcgcctaatatattttgttctgcctagtaaattagtatggctgcttgtgaattatggcttccctgatggctcagcaagtaaagaacctgcctgtaatgcaggagacacaggaaacagggggtttgatccctgggtcgggaagatcccctgaagaaggaaacggcaacccactccagtaatcttgcctgggaaatcccatgagcagaggagcctggtgggctacagtccatggggttgcaagagtcagacatgacttagaaactaaatcatcatgtgaattatagacggaaataatcttttgaaggcagatatatgtatacacacatatgtatgtatgtgtccatatatctatataacaccaagcatattatgcttcatattcatatgaatcaaggaaaaagaaaacattccacattccaatatgtgccattatcatgtaagcatacaatactcaacaaaaacaactattatgacaataaatgagatgtattatttaataatttaatgcatacaacagaatttttaatagtgcatattctcttcacagtacttatataatatagctgaattttggatgaaagggctgccattttttgattgatgtacctcttctctctaatactttctattataatttttagtaagatattgcaccacccttcttaaaatgtgtaaaaatcaatattttctgcccatatgttatgattttatgagtttttttaaaaattccctttggcccatggaagacatgcattggttaacagcaaaatgaatggcttctttggttttggtctcttaaatatttaagaacattgtttcatttttttttacaaaattatattttaaaagtagtctga

SEQ ID NO: 30743 - DNA, 1494 bp, Bovine  19866880581203
tatttagttatttagtttggggtaacgtgaggtccttttattactgttccttgattaaaccagagttcagatgttttattatgtcaccattctttgaatgtttttactaaatactgatgagcgtaaatgtgcttgtacatgttacctcatcagtatgttcatttttaaccattagtctttatttgttttttaattctatatgcaataaattaaaggactcaagaaatctgatgttacaggttgtgctctctaatttaacatctaaatctttccaactttatgaaatttccatttaggtaaactaaggtgaatatgaagatatttcctctgattcaatttagtcaattaggaaaaaatatcctcaattttcaatagatacacataggaatatgtcattaggtaagctacctgaaataatgagatgatatttgcagacaggcatgcatttttcttgtcagaaagacccaattttagtaagagagccaagatttaatttataataaaataacatgcagatgcccacactaaggagagagaaagagacaatctcacagcaaggaaaactgtcggcgtatttgaatcctaattaagaaaggaagcatgtgagctggaaaaatagccaagccaggtgggagggtgagtggcacccagcccacacagcacatttccatgctaagaatatggcaaccatggtctgtcctgttctagttattgtctagcagctaaagggcttgacatcatggtgagatgcacaagaatgtaaagaaggcctgcttacctttttcaaaacacaattacacttttcagaatgcgaacatgacctggaagtcagtgatttctttaaaaaaaagagagagagagacagagatccactgggttgtaatctcagaagtgccaaacccaatggtaattccatggcaattccaaaactataatcacacgcggggcaggctttgccaatgagacagatgctatccttggaagtcctttctcctttttttgggtagcatctgagccttctacattaccaaatgatgacaaataaaagatgatagtatttgtaattaccatgaacatttaaactgagtcatgtactacaaaaaatatgcatgaaaacgcacacctgtactgaaagtctacacacataataaaaatatgtgcatatcagttttctcttattcctcaaaagcaagttcatctgatggattgtacagatgaagtagcatcatgacattgtctttatctcctgtccttagacaagatgctttttggaatcttactgggtgacatgtggtaagagagtttgagacctgttcatttaaatccaatccagggctgtgtattctgaaacacattgcaggtcataggtaatgtctgtagagtttgtgttctatatgtggataccttctataatgtcgattttgaattttcctctaccgacagatttagaagcatttacttttcattgtcctcttattaaaaagttaaatgaga

SEQ ID NO: 30744 - DNA, 1552 bp, Bovine  19866880642761
ccttgtgctatgagaatgtagtgagaaatgctggaagtgatctttaacctcatggaattcacaattagtgagacaaacactaaaacaatattcatatagatgtataatgtaagattatgatagttattatgcgaagaaaatggaagtggcttcaaaataatgataggcatataaaaaaaatcaaatggaaattaaatttctattgctgaaaaataatttgccaagcctattaagaatcctgaaagatacttaaaaataagaagcccataaaagataattccaaataattttgttaatattcataagatgagcaaatttatcccattttagggaatgaacataaatcaaaataacattaatggtgaaatgtaataaaaataaaacataagtaaagaaagcctgattaattatgcaaggattgtacacaattcaggattatccaaatcctctgatcccttattttgttcccttactccatctctgcatattttaatccccagcttaaaccgttatctcctttccaaagtatcattctgaactctgccctccttccagccagcaaaatttgttcttttctctcaatatccaaaatacttgactgtgtctttcttaaggcactcaaaacatttggtgttgcactgtgggtatcagggttttagctctacctgaaccatctctttgtaccacggaacacctggaatgcttttcacaggcaacagctgttgagtgaacaattattctgttatcccctggcagttgatatttctattataaaaaagaaaaacagatttgtagctatgtttattgctacaccagccaatgcatattctagtgaaccaaacaatataattcattgactcagaaataacatgcaaatttaagctacctacattaaccatatttgagtgagtcactaggggtaggtttggtatggctctaaaattttttttacaagatatacatttcaaaacaagcaagtcatcttaagttgtacaatagatgttacgtacaagatgctctactgaatttatttgctcttgtcttctaatgccatcattgaaaaaacgtttcaaaaagcaaaaaggaattgagatcctgaaacacctaccacaaaatagtacaacgaacagaatgacataattttcagtttcaaaaattaaagacagggtggtccgtggttaagactctgtgctctcaaacccagggggtccaggttccatctctggtaaaggaactagatgttgcatgccccaactaagagcctaagtgtggaaaacaaagattcttttgtttgcatgcagtgaactaagaaccagaggagtcaaagagatttttttttaaaaataagcacagctacaacagaatatttagcatacttttatactattttttgacagtcacacagtattataacaataattgcaatgaaatgatactttaatttcacttgatattgatataaggtcaggtttttttttggtctgctattagttcgatttaatataaattaaaaaaaatacacagaatttaccaggaatgaaagtacagagaa

SEQ ID NO: 30745 - DNA, 1342 bp, Bovine  19866880719416
gttgcctttccttctccgtgcatgaaagtgaagtgaaagtgaagtcgctcagtcgtgtctgactctttgcgaccccatggactgcagcccaccaggctcctccatccatgggattttccaggcaagagtactggagtggggtgccattgccttttccagagtatatctctaatgtaactcatatgcagacacaaattagttcttattacataggctgaataaaaatgtctccttaatagcaggtgctaatcatccattcaatctacacctaataaaattttgtaatagttggcaatatattataatatccataacatatactgactctgtgatatttaaatatttccaaagaattgcaaatatgactatttaaaccctagaactaaaccattagttacaaatataatttagtactcatacagcatttcatgtctctagagaacatacagatattaagttaaatgcttaatggttagtcaccaaaattgtagatggaatcagaagttctttttctattttacaggcccccatgggggaataaagagagagcactgactcaccctcagtggggaatgctcactcccacacagttttttcttaaagccatgcacacttagctaagcaatgctttataaccaagttttcaaccttctctatacccacactgagaggcctgtaattgcacaaagccgcaaatgttcagagaaaatactttcctgtggaaaatgtttaatttcattccataaatcaggctttctctaagtgatccgtgcagcccttttatatgaaaatggctctgcacaaactctccagatagataaggctattgcttttgctcataattctagagaaataaattatttaaataaaataaatagacttgtgttttgagatttatagactcaatagccaaacaactcctcctttcatttgcgtaagagaaagagcataagggtcaataatggagagaaaaaggagatgatcagaaaggccaggagacggacgggaatgtgctgtgtggctcaggaaactcaaacaggggctctgtgtcaacctggaggggtgggatggggagggaggcgggagaggactcaggagggaggggatatatgtgtgcctatggctgattcatgctgaggcttgacagaaaacagcagaattctgtaaagcaattatccttcaatgaaataaataaatgaataaataaataaaaagacagacgcggggagtcagagtcagtagtagatgtgacaacagaagccacacaggcagataccagggacaggccacagtcaggaacagaggcatctctagaagacgaaaggacaaggaagcaggttcc

SEQ ID NO: 30746 - DNA, 1453 bp, Bovine  19866880802577
aaaaaccatagctttgattagacagacctttgttggcaaagtaatgcctctgctttttaatatgctgtctaggttggtcatagcttttcttccaaggagcaagcgtcttttaattttgtggctacagtcaccatctgcagtgattttggagcccaagaaaataaagtctgtcactgtttccattgtttccttatctatttgctgtgaagtgatgggcctggagtgccatgatcttaattttttgaatgttgagttttatgccagcttttttactctcttctttcaccttcatcaagaggctctttaactactctctgctttctgctgtacaacaaagggattcagttatattaatacaaatatatatatatacacacacatatatattctttatatatatatatgtgtatatatattcttttttatattcctttccactatggtttttatagaatattgaatatagttttctctgctatacagtagaccttcttgtttatccattctttgcataatactctgcgtttgttaacctgaactcctaacccaccccctcccgcatccccgcacccttggcaatccgtcccttctctgagtctgtgaatctgtttctgtgtcatagataagttcatttgtgtcgtattttattttacttttatatttttttagtttcagcattttattatacttgtttttaattaatttttattggagtataattgattttcaacgttgtgttgtgttgtactttggattccacatgcacgatacttttattttgaggaggaatagttactattcactctgaagaaaaattagaggttgatgtcatggtcctttaattctctgcaaataatttattccctaggaccttcttgctataaaacagggaaaggtttctgaaatacagagagtataaaattgatttgcacaaagaagtttgacctttgaaaacttggaatcatattaccatgccaaaacccgcttgatgcatattgcaggcatacaggaaagttcaacaaactcaaggctaccgttatttccaggggtccccgaaacggacagccatcctgtacatgtttatcaacaccccttttacctttccccagaaaggtgaatctagttccagaaacaaacaccctctgttttacatgactagaacaacatggaatttcaacacgaaagaacagaagttagttacttaactctgttttgaatgcatgcatacaaaatataagcacactcttgatgatttacattatgtgatgcttaaatatataaagcacctctacatgatttatctatagccaccgccatagccactctggtgttgatttcatcatcattttgcagttgctaagaaaagtgtccagaagttcaagtgtcttgtactggggtcttccagggaaaagacttagaagacagaacttagactccaaggcttcccttctca

SEQ ID NO: 30747 - DNA, 1654 bp, Bovine  19866880813342
tccaggagatgcatgagacactggttcgatcccctgggtctggaggatcccctggagaaggaaatagcaacgcgttccaatgttctcacctggaaagttccatagacagtgcagcctggcaggctacagtccaaggaatcacaaagagttagacaggactgagttactgagcacatactcaaggtggaagccaccatctacttataatctaatctcagaagtagcatgctgtcctttctgatatttctacttaaaaaatatagagactacttaaaagtcagtctctaagtaccatccatacttcaggacagagattaaactccatctcttgaagggaaaagtatcaaataatttattgacatcttaaaacccatctccaagagtacctcatcttcaacccacttattttgactaccagaaacagtacaaaattgatgtacattgtgttttgttttcatagaagttgcaatttattaaaatatctgtaacatttaaattgagaatggtatagtagagtgtacacagtctttttaattaagaatatctgaaattgaatccctattcttacacttgttaaatgtaatcatgggcaaattacttactttgattcttacttctgcaaatccaggaaaataatgacacttgtgaaaattaagtaagcttataaatttaaggaaattaaaataataactaagaaaattttcaataagtattagttaacatgattacttttaaagatttttttcaatttgtaaaaatctcttcatactcatatcccttaaagtaattttatgctgacaatcagtataaataataaaggattcattacactattgagagtttacttaaacaataaatccatatctgcacattcataagtggcagtaaaaatgaattggtgattttagctgacaagagcaccgaaatgcacagctaggcaggaaatgtgccatatgccgtgttacacctggactctgtgtgactgcaccttaatcactctcctaacatcctcaaagcacctgaatattggaagacataagggattttgcctcctcagtggtgcttttccatcctaaacttggttgacatttattaatcttcagttgtaaatatgaagatgcaactatatagctcttctctaagaagtacttactctggtgcattttatatgctcttccttgattggcatcaacttgggtcaggaattctgttacctgagttttttcaaccccttccaagcaattatttaatatgtaaacttccagtatgaaggtaattaagatagaataaaactctttaattccttaattgttctccatgttacagcatcctgtgaagaccactttctaatcttgggattccaagatttaaactgtgaaaagaagtccttaggcagaattaatctgaaaaaatatcctttaaaatattttttcagaatgcctgaattaatgggacttagaaataaccattctgttatttgataaaaagttctgagcaggtttgaggcagggtcaagatctgcttgaatctcaatcttcacctcattagacagtggactgtgagtgaaggaaaaggtatacaaaccatgttttgttttgtggtcctgggattaacaaatgatgccctgcctcttgcttataaatcctgccatttc

SEQ ID NO: 30748 - DNA, 924 bp, Bovine  19866880819847
ccactttgctgttgtggaataagtcaagtaaacataaaaatgcttcctccggagaaccaattatgatattcagaggggaagaacaccaggtgatgcctgaagaaatcttactttcctgtgattatctcccaccattaacaatggtgatttcatgaagctctaaggagaaaattgactacttctaggacaatttgataacttctggagcattatctgaatctacttacatggcataaaatgctgtggttttcattgaattgcttcatcctttaatgtctgacttatgacttctttgcctcctcgttggcattctttactcgaatatttgcagtgatacttgtgcacgttttcagtgtgaaaacatcataacccttgagtacaatcccatcagtgacacagggttgatatgaagtgcctctttatagcaatgacataacatccacaggaaatgctgatcttgggaaatatctcgccagctgctctaacaaagactagaactactctcacagctttatttcactttctccatgtgtctgaaaactaataaaaatgtactagacaatatctatgaagtgaaacatcaaatatgatgaattttaaagggcggcatttttggggcttcccaggtgggcgcagtaataaagaatctgcctgccaattcaggaaaaaacaggatcttgacatgggttcaatccctgggtcgggaagataccctggagaaggaaatagcaatccactccagtgttcttgcctgagaaatcccatgggcaggctacagtccgtgggatctcaaagaatcagacatggcttagtgactaagcaacaacagcatttatatttaactttaaaatgattaaaatataaacctttattccttttgtaggcatgaagactataacaaaggtacctttacattcgataata

SEQ ID NO: 30749 - DNA, 782 bp, Bovine  19866880937257
tgctgctgctgctgttgctaagtcgcgtcagttgtgtctgactctgtgggaccccatagacggaagcccaacaggctcccctatccctgggattctccaggcaagaacactggagtgggttgcccattttcccgtccaatgcatgaaagtgaaaagtgaaagtgaagtcgcccagttgtgtccaactcttaatgaccccatggactgcagcctaccaggctcctccgtccataggattttccaggcaagagtacttgtttctctaatgttaacataatctaatttggcatttatcctgaatttcaaacgtctttcagtctaatcagttcaacaatttgtgatcatacataacttcatgtctataaatttttatcattctcataaataacaacactattcttccaggaaactcaggtaagaaatcacagttacctttaacttacttctcttccagaattcccataacaaatcaatcatgggaaatgctttctaatttgttttttgggggaaaggttttcaaatgaataatgtgtcttaaaagaacttattgatttctaattcaatttaagaaaaactgttttaaacccaagacagtcaaaaaaacattgtgacagccatccaaaatccattacctggaatgaaacccaagctgttaaaaaacaggaagcagaatctaaaaattaaaaggttataaaggatttttttcagtaaaaatggattttttagtaaaaaaggattataaggattgttttagtaaaaggatgttaactacgaaaatgttt

SEQ ID NO: 30750 - DNA, 1383 bp, Bovine  19866880937666
catgtatttagaagctgttcataacatcctatttaaattcttacatgtttctttgtgaaatgagacagtgttagccagtcatgtccaattcttttgactccaaggactgtagcccgccaggctgccctgtccatggaattctccaggcaagaacactggaatggtttgccatttccttctttagatcatgttttatataagatgttaaaatagaggtatctaaataatataagacacgtggacagagtctgtaaatgcaaagttagaagatgaaatgttcatttatttttatctactttgttacaaaaagaataaatgacaagcagacacgtggtgcaagtgcggaggtgtcggaattgtgtgaatcagcttgttttaataaccagtgtttggaggcagttgcttgtcaatttatattcttgaagattcacaccatttaaatgttgctaagaatttcaccaggtgcacagaccatctcaaggagaatcaattaaaagttcattagggccctttcatttatcaacagccatggggtctcatgggagccagaactcggaacagtaactgtttaataaaaacacttgttcacctctattttaatgtgatcatttaaaaggactattcattaaatataccatttttcactattttgaggttttgggtttgacatttttatataaaattacatttgtgaagtaggaatatattaaatccacagaagatcagtattttcctatttttgtctaaacaagttttttatgctttatgagctatgtgtatttgtcttttaatttggtatttttattattttggcatttatcatgcttggtattctctgagcttcttggatctgtggtttgatacctgacattaattttgggaaattctcaggcattattttatcatatatttcttcttttcctttctctcttctcctcctgtattcccatgaccaatataataaaccttttgcagttaatctcctagtccttggatcttctattctagcttttacagtttttgttctctttacctttaggtttgaggattttttttcatacagtctccatatcagagattctttgctatgtccagtctactaaccagtaataagcccatgaaatgtgttcatttgtcttatatatatttataaatctctagcatatctttttggttctttcttaagatcctcacccatttgtatgctctctacttgcactaggagagccctcactctattaatcatagttgcttgaaatctctgctacatccctaccatatctgtttctgatgcttgctctgcctcttcacattgtgttttttgcttttcgtttgccttataattttttattgctcactggacatgatacactggtaaattcc

SEQ ID NO: 30751 - DNA, 1253 bp, Bovine  19866880976095
tcctgacatgtgttctggttcttgccaagtgccttggaggcagttggtaaggcgttaactgtgtaagagtgtggcacaggggcacagccacggtccctagacactccagagcagacctgtgagcaattggttgctttcatggatccttagtattacaagttaagtacatttcagattgaattttagcatcccagttcataaagcactctgacattattgagacactaggcagttaatcgttggaactcacagtgtttctcattttggaatccctgtgaaaagtgaaagtgaaactttctcacacacacgctcagtcgtgtccgactctttgtgaccccatggactatacagtcataggaattctctgggctggaatactggagtgggtagccattcccttctccaagggatcttcccaacccagggattgaacccaggtctcccccattgcaggtggattctttaccagctgagccaccagagaagccctggaatccctgtgctgtataatgtattagttggcttattatagttttttaaagatttttctcaatggaatggtgttttcattttatactggatggacgcagaaagcactaagtctttgaaagatgtgaatttaaaataatggttaagtcttttaggagatgctttgttaagtaacttttaaaaggtagtaaaccttctgtatttacggttaaagtttataggtgtacttattactggattatattattcaagactgataaggtcactttgcctaaataaattgctcacacctactcacctacacttatcttagttttgctaaattgaattagaatgtgtcaaagtgttccctttccttgaatgcctttatcctttttatatactttcttcacttgccatctgacctcatttcatcatttagaattgacttttgtggtggttgaatagaagtctttctggtaatataaatccccatgtgataatagaacctgtcccagccttgctggtgtcatatattaatatccattaataatcatatattaatatctgtgccttcttgttcactgtcttgctacttgatcacttcaagttttctctgagctcttaaataatgtcttagattaaatctaataactcccagaaaactagttttccaaaacagataaaagatcattttctctgttgtttgtatgtttcaattttcactgttgttttacagtttttaattgtcctgagttgcgttttgggtacagagaccatactgg

SEQ ID NO: 30752 - DNA, 2455 bp, Bovine  19866881197866
gagcgctggaaaacacaactcttccattcgtgtttgtgtcggaggaagcagtcaaggtttggggaccagggataagagtcagagcagcgctgggttgcatgggcagcggtgggtggaagccacagggataagacaaagcctggagcagatacccaacatcccaagagaacacacagaggagccaagcagctcaggctcagcctggaggccttgggaaagtcagctgacttcaaagtcaggtgctcgtcaataaaaaccatgtctttttttttcttgttgatagcaactttcttcataattgccaaagaaggcaatggcaacccactccagtactcttgcatggaaaatcccatggtcggaggagcctggcaggtttcagtccatggggttacacagagtcagacatgactgaagtgacttagcagcagcagcagtcttcataattgctaaatcttgaatgcaatgaaaatatccttcattaggtgaatggatagatgaacagtgtaaaaccatttgtcacacactctaaaggtttgctatgaggatcaaaatgcggaagcatcagggaaactgtcaaggactatgaaacgaagggcattattatcaacagtgtgattctgcgagaaggttcggccagggcactcctgcatctggggagcccctgcttcctccttgggcgatgtcttctggctgctctggaacagcacctgcctcttctgcacctcccgggtgaggctgcattgtgaacgtttggagatgatgcttcctgttctcaaactgacgctcgcaaggcctctggcaggctcgatcgcaccctgatgaatactctgtccaactagcaattctccccgtcagagaatttgcctgtgaaaaacagtttcctctggtaaaggggcagcttcccactgcggaaacacgccactcgctccaccaacacagacaacattggagaagggaacagaaagcgctttgctgcttccccagctcatgtaagggtcatttctcaacccgtttcgcctgcagtggaaggtttgatttgtatggctctagcagtgttgcctttttggaaattcagcatttctcaagggctgtgctgtcttcccccctacaccaagtttcattatgtttagtgcagaatgtgtaaatgatgtagttagaattgcaggcaaaataacctattctcaacccggggatttccaacccagggattgaacccaggtctccggcattgcaggcagattctttaccagctgagccacaagggaagccctaaataacccattaccacacctattgtcaactttctgcgtatttaatagaaatgcaggctgtaaaactatggtcatcaggactggcctgaataaaacagcttggtttctgactgtggatttgggcgactttatatatttttctctggggttctatttaaaatatggtaattcaccttggcacgaagagtaagaaaacaatttctcttagtgagaatgatttcttagtgttcctgttactgtgagttcactctgaagcaggtttacaggtaaggggagtgatggggcatacttcctcaggatggtgtgtttttattttagattttggtgccaaatacttgtcattaatattttaaattaacattaatgtgatagaatctaactttatgaggcatgactgcctggggagcatgccctcaacaatgtggatccttcagaaaactgtgataatgatcagagaaattctggagctgcgatttaaaaactggatgctcagtacattcgaaacgtcatgactgtccagtccctgccaagtctgagaggtgctgagaagatgggcattttggggagaagacatggcagttgtcactaaagctgagtcaccggtgtcctctgaggtttagatcaaaggctgggacccgaggctggcatctgatgctggtgtctctacatcaagggggagttgctagactccttgagggcactcatttgaagttaagaataataacttacttggaaagcactctctcctataaatatgaatggaaatttcaaaggtataaatgtgaatatgttcctaaagaacatattcagggtagcactgcttttcagcagtgacccagacccaaatatatgatttcgttttactgttgtttttcagttgctaagtcatgtccaattctgtgaccccatgggttgcagtaagccagggttccctgtcttttactatctcccagagtttgctcaaactcacgtccattgagtcggtaattgatgccatccaacaatctcatcctctgctgccctcttcttcacctgccctcaatctttcccaacatcagggtcttttccagtgagtctgctcttcacatcacgtggccaaaatactggagcttcagcttcaatccttccagtgaatattcagggttgacttccgttaggatggactggtttgatctccttacagt

SEQ ID NO: 30753 - DNA, 1327 bp, Bovine  19866881225677
aatctgagcagttaaaaaaaaggcaaaaaacacctcttcattccaagtgatagtatcactctctaaacctatctcagctctcccttcattctacttaaatctttctcatttgctacataatgtgtaggcaaccacttcaaacccttcgtgttatatcatccaacttcacctctctcagcatctaactcaatgtcttacatttaaattagaaagtgtttaatcaacacacctgtctgctgctggttgtgtgttcactcagtcatgcctgattctctgcagccctatggactgtagcccaccagactcttctgtccatgggattccccagtcaagggtactggagtgggttgccatttcctcctcccggggatcttctcgacccagagatcaaacctgcatctcctacattggcaggtggtttctttaccaccgagccaccagcgaagcccaagtatctgataaatggatgcaaaacagtgcaaatggttagctatgttaaagaatagaaaaaggagaatacatagtatgcacacattcagataagaggaaaggcaatttgaagaaatgaaatgattatgccgtgtgcgggggtgcttttccttctgtgtaaacagaaaatttgctttcagcatgactttgattattttatatatgaatataaaaatatacttctctactcccacattacactataaaactttatttcctagaaagagagattttgactacttaccaaggctgaatctacataaatgagtactaacgtcacatcagtaaaggggttaatgtgtgctcagttgtgttcatctctttagcccatcaggctcctctgtccatggactttttcaggtaagaatactagagcgggttgctattccttctctaggggatctttctgacccagggattgaacctgagcctcttgcatctcctgcaatggcaggcagattcttcaccactgtgacacctgtttgttgactttttcttagatcaggttggggaagttaaagatagaatttcatgtcattggagtaagtttttaaaaactttttctaaatctatgtcacgattaccctggaggagatgttagaagagagagttctttctgttttcaggttgccttattatttttagattgtctttcatattttcatttacatttccttgctacagcatctggttgaaaaattccccatgctacttgtgctgggatagaacgtttcaacttgtcctcatccagttgacaatctatggtccttaggcatcgactcctttactgccccctctgtgtaagccatggcatttagtgctctgtccctcttacctt

SEQ ID NO: 30754 - DNA, 1265 bp, Bovine  19866881258433
taagttttcagttttattgtactattctgctttttcaatttaaatggaatttaatattcttcttgaaaaatgaagggactaataaatacctctttaaccgatggatgaggtttggaggagacgttgatcactctttaaaatctggatttttgctattagaagatttaaaactgactcttgaaaaaataaagacctttcagcctttgagtagttaatccttttatcatttccttggcttgcagcctgcttctatcactccattagttacatttctttcgaaatataagattgtgcttttaaaaagagagagcatttttagtttaataagcttaatccttataatttttaacttcagaaaaatgattcacagccattctgtctttttagctggaaacagtacatctaagcaaagaacttaaacatcggtcttcatagttttactaacagaatgtcttttttccattttttagaaacttttgttttggaggcagcttttccagtgtctttggtttggcatgctacgtcgattctgcccttctgcacctcatctctcatcaggacactggcctgtatgaacctcaacaccagggattctcatttcctgttggccagtggaaaccctagaagaaggtcagagaaagggagtggcaagagatgaggactttcacttccactcaacgcttcaaagtcaccttcggctggaagcatctctaggaccatgtcccaagatgcatccttctgggttctggtgacttctctccaggagcacccagcactgctagctggaggtcactgccttgtcctgtgattccgccacactctgctcataatttgtaaatatcatctttattaaactttccctaaagaatactaatttaattgtaccaccactatctgttaggtctatgactgttccagcagtctttccaaagattccttcttgaaacatgagttttctgaagaatttttttaattcaataagcttatgcttgtttttagaggaatcacaatacttctaagttcttttgggtggtcgtaaatccttaggatgtaaaataaaagagcatttcagatattaaaatgtagtgacttgcagtcacacatgtttaatttggtttctactcaatgattcttgattaggatatattatttcaaatacacataatcctttactattgcatcctaaatgataaagccttctttgaaaggaaaatttccccatttttgctatttctaagttttcaaatttaagattcaaaatctta

SEQ ID NO: 30755 - DNA, 1619 bp, Bovine  19866881260916
tggggctacagatacaggctttattgaaaataactgatgggacagtgttctttcttcatttctcagctatagaacttacctcattttgcctttttctttaggaaataattgtaattatttgaaataattatatttcaaataattattatatgaaatatatatccataatactttcatgagaaacaatctaagtaaaatattgaatcattatttttggtcccaaaatatttagacacttgaacataaatagtgtccatatagttactaaatttcaaactattgtgcttaagttaaatataaccaacttggcaccagaaaatctttgctttacaaaatagctgcaactggaacaattctttccattatatagacagttgcagctcaggaccagcaaacatacagtgtttaagaccgtagcatcctgatggatggcagcatattcgaaaatatctcagtacttgaccaactgcagctgcacaattatgcctctccaaataattcatgcgacagctctgcctttaaagcactgttcacaattaaattcaaactcacgaagatgtatctgctagtaattcttaaactttttgttgtcatgactcatttttttgtaattcctcaatccttgcagcccatattcatcattgtttagtagctcagtcctgtctgactcttttcgactccaaggactgtagtctgccaggctcctctgttcatggaatttcccaggcaagaatgtcaaagtgagttgccatttcctactccaggggatcttcccgatccagagattgaacctgcgtctcctgcattggcaggcggattctttaccactgagccacctgggaagtcctgatattcttcatattgttgctcagtcgctaagtcgtgtccgctctttgataccccatggactatagcatgccaggcttcccctgtctttctatatctccctgagtttgctcaaacgcatgtccattgagtcggtgataccattcaaccatctcatcctctgttgccccttctcctcctgccttcagtctttcccagcatcaggatcttttccaaggagtcagctctttgcatcaggtggccaaagtattggagcttcctcttcagcatcaatcttttcaatgaatattcagagtttatctttctttaagattgacaaggatatatttatttcatcatgggatatatttatttcacttattttattagttaacattttattagttcattcaactattagttaattaatatttattgatcacttactatacaccaaagataagatgctaggaattaaggatattttataaagacactttgtaggtcataccaagttctttacttcctggaacttaccaactgaccttatctttcaaaataaagtatattctaatgcatttaaatgggaatcgagggctgcagaattttgcaggtggtgtttgacatacacagacatttataaagggtttggaatcattgcctaatagattttcaactacataatatccaggaatgaaagcatttatgtggctttattttgcttactgaaacaatggctgaagttctgcagaaggcagtcatgaatatctgcatttatcatatgctgaatttga

SEQ ID NO: 30756 - DNA, 1049 bp, Bovine  19866881363352
ctggacacacttttcgagctagttttaagtcagcacaaatctatcaggtacagttcagtcctttagcagatgaaggtattaaatccaatcagatttccgtcaatgtcttccctgatgtgcaaacagcagctttcagacattatctccacagtcataagaacctaacaaaactgcccctgatggaagctttcagtcctaatgagcaactgagtaacatagcttaaaagaaagccaactaaggatagccctgctgacatgctagccatcaataactgtttgaaatgcttaatggatactagcatactgaaacctccttgtttctactaagagaaaaccataaactgttgtatttgttaggcatgaaaactaggcacaaaattggtctgttatattggttctctgagaagacatttggaccattctgagacttcacagagattatgtacctgaggggtactcctgtgttattaaactgataaaataacaagggcaagtcattttttttttaaggcaggttaccctcctcattttctatttcgattcagtctgtctcaactgtttggctggatgtctggtctaatgaaacttgcttttcattaagcggctggtgacagcttgagagtcattgtgctgtgatgcagcaaacgacccacttttaaatgggttaatgatcaaacattaatgggaaaactcattgaaaacaagccaacttctattagtagtattgaccacacgatggtcaattgcctctttcccaccttttaaaatagaatgcttcttttaacacacaattccaaaatgtatgcttcccaggttcttgtataccccatctctgtttgaaatactaactcctctgggttattaaaccaaccccctcgtgccctttaccctcactaggcgcaccttgctgggtcctgtccactgccatgctaaccacatcactcccttcacagaactttttctaatggattcctctccatctttgcacatctgttttcttcttccattcttcgtctcttggcaatacccaagggagaaggagcacattt

SEQ ID NO: 30757 - DNA, 1463 bp, Bovine  19866881450673
ctcatatattatcctgttttttctctatttgatcattcccatcagggactttgactcactgttccttcttcctggaacctctgttcaacagttatctggatgattaactttcattaacatcttccacgtatttattcaaatctgaggccagacatcatacttaatattgcagcctgcactgaaaacaagaacactgcttttttcctccaggagtcatatgatttatatatgaattgtcttggtctctgttcactggaatgaaaattccttgcaaaagggatattcattttattcatatatagatttcaagtgcttagaatagtgtttgcatgtataaaaagaagaataaatggatgctgggtaggctaaagcaacagatgcccttctacttttgttaaatgtctttgccaagaaagaccataatttgcaaattctatagccttgatgtcctgaaacttccatatcccagataaattcagttcaatatttattgttgagtataatattgttgagtataataactgcattgttccaattgcttctctggtaaggccccaaccagtctggctgaaatctgggtagattccccaaaatttgtgattcaagaaaaatatgcttaaaccatgtatacaagcttgatcaaaatggcaatataacaaggtttggctatagtctaagacttggtaatatggagacagtgacttcaactaaaaaggacttgcaatttatgtaaactatttatctctatccttgaaaagaggaaaatgaaataaagactagaaaaggaaagcctgttagatgctgcagacaacagctcatagacccatttttatttttactataaatccttacctaaattgaactgcaaatgattgataatcagttttgattcatctttccattagtaatggagcaggacccattcccgtcactgaactgacatgtttagtattgggtcttctggccagtctgctccagggcatccatagtggggtgtcttcataatctctccagttcaggatttgattaagggtaatgaaggatcgcacaacttcaggtaagtgttgttgctgttcagtagctaagtcgtgtccgacttttttgttggggggactatagcccaccaacctcctctctccatgggagttttccaggcaagaatactggagtgggttgccatttccttctccaggggatcctcctggatgagggactgaacttgcgtctccagcaatggcaagaagattcttttaccactgagccaccatggaagccctcaggtaagtcacctgttaacaaattccctaaactcatgtaatgaagtctttgtaagaaataagtgagtatgacaatttgttgattataaatgatcagtatagactaattttccagatatttttaattggaactgaaatattctgaaccacttaaggaatataccacaatatactgtttacctggaa

SEQ ID NO: 30758 - DNA, 1734 bp, Bovine  19866881555054
aaaaagagagagaataagattcctttatttcctttcagattttcagacgatgctggttggttttcaagaaggcatctagtaaaggacccagaaggctagaaaaatttcccgatgagaaggcagcatatttcaggaactttcataaggtaagtcacggtctctagaatctctggggaataactggacccttggcaacaactgtggagacatttcttttgatagataaaatctgcagaggccataatgcatggctaggataaaatgtccctgtgctgataaaatgcaaaagttatttttctcctttattttaatcatctactgtaaatgccagtgttccctctgcaaaatgaaaggctcgtttttattgctactttgcaaaatgagatgcctcataactcaaccagatcatttcccaaggtgctgagtaggcagtttccctctgttcaggttaattgtgcatttgttactttgattttaactgtgggcaatgttgaggagataaaacttttgaggctggtgtgagcagtgttaatgacactgttaatgtacaaagcacttgctgtttacagcttaacaagaaagtgatcgttgtgcatgctgatatgcagagatgtggcataaatcctatgagtcaaatatcaatttcctaaaaatatgtgagtatgagttgaaagttaaaaatatgtaagaaatcaccatagaatgatgctgaatgtactgctgaaagttatctctggtgataatgtcaaaacgagttaggtatttgatagtagggtggaggattcacgatcagaatgcagaactgtggagcagcgttgccttttgacagaatgcccgcataagctcaggaaagactttaattccttcatgcggcaacatggaataagttaccctgaataaggtaatgagtctgtggaatttattttatgtgatatacagttctaatttcttcttttattaaaaaatagagtgtgttccagggatgtggagggtgacagggctacataagcatagcaccaaggattttttgtgaaggacagggaagccctggcttgctacagtccttggggtcacaaaagttgggcacagcttagcaactgaacaacaaaggttttacggagagtgaagctgcccttttattataacggtgaatgtatgccattatacatttatccaaagccataaaatatacaacaccaagagtgaaccttgctctaaaatatgaactttcagtgattatgttgtattaaagtagattcattcatgagttataacaaatgtgccatctggtgcggatgttactaatgggagaggctgtctgtgtgtgtgtgcgcgctcagtcatatctgactcttgcgacctcgtggacggtggccctccaggctcctttgtccatggtcctctccagacaagaatgctggagtgggttgccatgcactcctccaggggatcttcctgacccaggggttgaacccgtatctcttgtgtctcccgcattgacagatggattttttacccctgcatcacctgggaagcccacgtgtacatgggcgcaggcagtaaaagggaaatctctgtaatttctgctcagcattgcagtgaacataaaactgctctaaaaagtaaaatctattaaaaataggttattcagcaatcatgtgctaaccaattatattacacaaatagctggcagtcatttgtattagacttgaacctgtatcataaggcttaaaa

SEQ ID NO: 30759 - DNA, 1046 bp, Bovine  19866881690996
aagaaaggaaagtgttaatgaaaaacaaaagatccagtatcgatgactatattttgaatgagtcttttctaaacaataaaaatatcatgtgactaataatgaaggagttaaagtaagaataaatatttcagtgcaaaataaatcagagatgagcagaccaaggaaaattgaacagttcccagtaaaataggtcagtagaataattgtcttgatcacaataaacatagtaatgccagctctatcggactgattatttggcaatgcttatcagaattcttctgttataatattagttatatttatatttaggcttaatgtagtatgaattaaattgtgcatagatctctttccaaaagttgatttaaattattggcaaatcattttattgtgatggtacagtcacaggttaaataaaatcctacagtgtaattttgaacatgagtatgaaaggcaaaatagaggtagaattaattttaatattttggctaagtttcctatgtctagcatgaataggaattggcaaacattaccctttacagaattccatctaaataaaaataaattctggctagatgtattatttgttacacttttattatctggcctttaactcattattctactgtgatgaaatacaaatttagcataatgactggtatagcatttcctataattttcattcaaatattaggagatcatgttagctctctaaattaatattttttcaagaatgttttgatgactcccacaatgtagaacatgcaaatgtaaactcatttgcaagggcattagcctcaatctacaaacctgcctgagagatgctctctaggctgtattattattgctaaattaatatcgctaggattgtgctgctgacaaagcagatgttttacatgcaaatatttgtcttctgttgtttttatgcttatctcctgccccaaatcaaggtttgatgaatatctatgtgagcatggtaattagttcatcagtagaaatagggagaaactgcaggtaatgctgccataaaatagctccaagccaactat

SEQ ID NO: 30760 - DNA, 1044 bp, Bovine  19866881828362
tggtctgaaagtgttgtggggaacttttaccgggtgctgtatacagtgttcaaaaagaataatgtggaaaggtacttggcaaaagtgtaggaataaaaaactaaactcaatttccataaatggctagcatccatttatagtgtagtgtttttattcactgcagatgctgtaactcaatttcttccacaagattcaatacataaaggtggctggttagctcagttggctatcacatggtgctaacaacaatatgtaaaaacttgaaaaatggttgagaatatttgagaagtaataagctttaaaggcagttcggaggaagctgcaatacttatttttattaaatgtacatgttgaagcaaagaagaataatcttcgaagaatggcaatcttggtgctgcaatgcaatttagaggcaaataatttgaaacaaatgcactttttctatcttctaattaagataaagctcttaatcaggaaaatattaccaaatagacaaaattatttctatgcaaaggctactttaagtttcttatgtgtaatacattttgtgtaagaaacagtccttaattacaagtctggttatatgctttgtcagtatccaagacctttggccactttttgctacttcctaaacccattgtggggttgcggggttgggggcgggcagaaactggagaacaagttataaacaacagtacacagaaaagagtggataaaattctaattcatccattttgatatttcattaaagatagcaatagatatctaccaatacagacaattgacagtttaaatgaattttcagatattttgtgactttcagtttgaaacgaatggaagagaaaattcctttaaatcagtttagaaaagagtattatataataaaatatgcaaatatatttcacatttgtcatcattggtgttaagaattcaactcaaatgagtgttcctacctgtggtttgagtctgcacacaggaattcaagcatctgttgtttacagcaaagatatttttactcagagaatattaacaaagttcatactt

SEQ ID NO: 30761 - DNA, 1745 bp, Bovine  19866880362593
cccaccaggctcccccatccctgggattctccaggcaagaacactggagtgggttgccatttccttctccaatgcacgaaagtgaaaagtgaaagtgaagtcgcacagtcgtgtctgactctcagcgaccccgtggactgcagcccaccaggctcctccatccatgggattttccaggcaagagtactggagtggggtgccaggtacctggaattatctatgtctgcagagtagccacatctatcttgttaaaagttaataatctttgggatgctgaaagaaaatgagggaaagctggtcccttcccttttaaggcaagagtgcttctttacagatatttttagctttttcatgtgctatgtgatattttaaataagtacccccagaaaggggctcaagagagagaaatgtaccctccaaaggcaagcaatcagtccagaatgattcctgtgcaacatgaaccctctgtctcaatactgttatttatagcagcacttggttgaaatccccaggcggcttctctttctgtgaaactggaagtgagaagtgcttcggggagaggccttccaggcacctcagagctgctggaagatccccaccaacaactccaacaacgggtgtcaaattccccatctgtgtgcacagtgtgggtacttcctcctgttctctgcccagtccggatgtgaatgagtgaatctggtacacacgtgtcagctcttcctcttgaaaaggaaggggagcctgtggggagtgatgatgatgtgtgtatgtgcgtgtgtgtgtgtgtgtgtgtgtgtgtgtgtgtgtgactgtgtgtgagctgatgaaatgaaattctagtcaatttttctgacttttttcatttgcatccaaatgatcctgctcttcctcatactgttatcttgaggatggagacctgttgcctctttaaatatgatgttttactatcattgttgttcctatgattttcactcacttactgaagcacatgctgcatttggattgcattcccaagggattccagcccatgattatgaagaacaagggcttcagaatcatatacagaagagttcccattctgagcctgcctattacccgtcattcagtgacacgtgctgagcacctactacatgccggctgtgcaagttctcctcccagcttttgtgttgtaacctgggtaacagctgacaccgaagtgaatgccacctgatgtccaagatggggtcgagggttgtgaagaaaaggaaactaaggtgaagggtggccagggaaggtgggctgaggacactttacaggaaggatggaccacaccaaactcctcggaaaggacgtgctgtacaaataggaagagcagggccagcaacagaaatgtcctcttggagagtaaaaaaaaaaaaaaaaaaaaaaaacatttatacagatgaaaaaacagtgtcagaagagcacacaattagataaccttggtgaaagcctttgagctttggattgcaaactaaatacagggatagtaatacataaactggaggactattgtaaagcctggaacaaaaatttctaaggggctcattacatgcctggttccaagtaggtgggctagtcattttcaattttccatcccttctctctccatcctgtgggctggctctacatcctaggcattctgacctctgtgaaccacactttccaggctccctcggaggcttagccacaggccaggaggagcgagggcatttcctttctgcttt

SEQ ID NO: 30762 - DNA, 857 bp, Bovine  19866880405003
ccttggctcccggaaacacatccattactactaaacagattaatccccttacctggaatgggagacagatagattaactatatggattttaccattaagaccaacaaaatgaggctttgtccaaaagaaggaagtttccccaacatggactctatgtggagtcattccagacgtcaaacactccatgtttgaatctggtagggtttgcagacaaatattggtggtgataacgattgtcccttcagcttcagtgacacaggagcagtgctgtgccaaacgccctcgacagatcctaaaacgtgtgcatcaacacgggaaccaacaagcacctaagacaatgttcaaataaacaaaacaaaacaccaaaaaaaaaaaaaaaagaggcagcacttctctgtgccttctctgctttaaaatgagaaaaaaccaatgtcccagcctctccgggctgtcaagactgtcatgcctttagatttggctttgaagatagactgatgatatattgaccatggtttactaattcaaaattagaaatgtatggtttgctaaaaacaagtgtacaaccagcatgtgaaaacacaggactgtgcaagaaaattccagacacgtggccatctcagactgagatctttttgtccacacacatcattttttaaagggggaaactgagataagtcaagtagctatgtattgactagcctgggaccaggaatcatgctctctactctactgaggacttctctcctttattcttgagtcaaaaaaaaaaaaaaaatccaagtaccaatgtcatgaatatatcaagtaatcagagccacagggagaagaaaacaatgtcacagccaggaagaattcaa

SEQ ID NO: 30763 - DNA, 1666 bp, Bovine  19866880406638
cctgcattgattactatttggcttcatcagattaataactttgaaatcatttactcacagtcatagatttaggacagaatgagtcatcaaacatgaagggaaagctggtaatatttggtgaaagacaaaactaattatgttgatttttaaagacaaaattaagcagagggaagtcagaaagtctgatttcattaatattgagtaactattatctgcgtcacagttgcaggaaaaaaggcaagaaattggtctcatatttctcaactacaaaatgttagcgttgcacttgtcagggctgtgggcgtcccttgtggctcagctagtaaagaatccgcctgcaatgtgggagacctagattcagtctctgggttgggcagatcccctggagaagggaacactacccactccagtattctggcctggagaattccgtggactgtatagtctgtggcgttgcaaaggactgagtgactttcactttcactttgggagcgattgctccggagtaggaaatgaagttgctcagtgttgtgtatgtggagataagtctgaaataatgcatagaatatagatattttcccaatatgatgcaaagcaatcagactcagggagtttaaaggctgtaccaactgaataattgccaggacaaggttcaagcccaacttgcttcttggcatcaccttccagtatatcaagctccttcagtgcctggctgattcttacgttgcatggccatagtcttcctcttgttacttgctgtcaagagatgtcatgtaattagtgagaattcacaaacaaaaaagacactataagagaatagcataaagccattgatgctgatctggctctgataaagcttgccgcttcctacatttgtgctttgcatacgaaataaaaagaatgaagcctctgaaagtggggtgaagcacagtgtgttttcagagggattggaattttgccagggcgtggaagggtatatggcatgaaagagtataggacatgtttaactcagtggtgcctcggtgatttaaatggaccatgaccaagaatacctagacaaactgtaaatcaaaagagacattttctgattatgtaagtactacatggccactgtaaaaagtttgaaaaatatggaaatgttgcaagagatagcaaaatcactcttatcctgatgaagaaacaccactttgaagatatttttggtgtattttcaatgcatttgccatacatgattgatcctgtatttatataggatttccttcatttctctcattgcattttattgtaaacatattcccaatttattaagatttgttagttaatacatattgtagtgatgcagtgttatcacataatatatactctgtatttatttgttgcactcctgtggagatttaaggttgttccacatttgttgggaataagattatggtgaacttgttgattgttaaccctgcagttaaaatgccatgtaaatagggaggacttcttttttttaaattatgtactattttctcacattagttatttaagttaatacagtcagaagaaaagaaaatgccatttttataaagtctgttctttgggagttgttcattaaaaatcgccaacactgtgaaatagttcaccgaattaaaatgagagccaattggtcttgtaaagataa

SEQ ID NO: 30764 - DNA, 1965 bp, Bovine  19866880621987
caggcccaggaatgaagctatctcccatgtgcacgcccatgagttcaagccccattttcagccaggataggaaggcagacccaaccacaggcccaggagggtaaaaggaagggagagctgactttgggacccagagggaacccatcagtgtctaactcagggggacccaatcaggagtggtttaaaatcagagggaaccaatcagagtggtctaagtttagagggaaccaattagaatggcttcaagttcagagagaaaaagagtgggctcaaggtcagaatcatgaatgctaagaaagcctgtcacctgagcatgaccagtctcaatagcaaaccagagatctccaaatgtaggcaagtgtcagacagcagtcagtatcacttgttcagggctcaggggcgcaacctagaaacctcagcctcggaggatatggatatccagacaggtgacctaaccaaacatgattaacaaaaggctacaaaagaagagaaacaggaaatgcttatcctgagccaaggctgtgcttcctggagggaaatctccctgcttcctgtccaggaggcgattgttgaagattactcactctgtccctccatcccccaacagaagaaagtttgcccaagtgacaggagataaaagtgtgaggagtaatgctcaatagctttttgaaaagtctgcaaatctattagcaattacttttgagcagtattttaagaactatctattgtgtatctaccatgcaccaaatgttaaatcattatttccattctggactattcccccaaattaagtcctctgttcgtttttgtgatgatagcaagttgttggtactttctggacagaacatggaggaagttggagggaaacatatatatatatatatatatatgtcttgtgtaacaacaacaacaggttttcatttattctgcaaatattgctgattacttattatagtctattagtagataaaacttcatatgtgaactccaggagtttacaatgggaaaagaagcttggaattaaaataaactggtgaaattttgcaaagcacagaagaataaaatataattcttaaataaaagttaatgaatcttcaacttttttatgggctaaatatacacatggagattttacatagctggcacagggaatgtttttaaaaactcttttgctttatataacacttcacaactttaaaagttcttttacattatttatcagataaaataaataagttttgtaagagataagtagatctgggctttcatgtgcaagtatagccttctgtctacttggtttttttgtttgtttttttttaactgcaagttactaagctatttctcagattattccccagtttacatataatctttatgtagttgtgacagtgaaatcaggaagtttttgaacctaatttttctaattttaaaggtggtaaatgaaatacttaagttataggataaagcatggttgtttatcacatctttcttttacaacactcatgatactattatgttatctaaataaaggtatctaaaatagcacagatgaagaagaagattagaaatagtaagaaaggtagcagaaataaaaataaaagcacaagagtgtgaataacaggcaacatgacttaaaatgtaactatgctaattagaagaccagacccagaaactttcggtttatttccacctgaatttggactctttccaaataaatattcaatggtgtattaataatataaggctttaaattgtcagaggtagtcattcttcctagggcaaaataaaattcagagttgtagtgtctgtatcttattcgatctggggaagtacagaaataactgatgccaagagaaaatttcctattttgctttgagtgacagaatcagatatcaacattgtcatacaaacagtcaggtctgggattaattccttaaccaagatgaacagacacaaaagactttt

SEQ ID NO: 30765 - DNA, 1379 bp, Bovine  19866880637586
aatattaatagaaataatactcagataacttttacaattttgttcatatgattatttacattcttaatttgcttacatctgctttcttggggtatgaaacggatgtcttaaggcccatgaattctgggttagttaagtacaaaagcattctgcattctaaaaaacatttaaagtgaactttatcagggtgacaattatcctaattttatctctaagagtgacttgaaattgggatttacttttgaatacaggctgttaaactaatattcataaatatgtatttatatatagcatgaaatttccctatagaaaaatcacaaaatgcagaaaaaattcttgcctataatatcaccatgtagcattcacatgtcattttattgcattcataatcattttacaaaaatgaaactgtacaaaaggagccccttactttactaaatacctgttattttttctaataaaatacattttaaaattcattctatgttagttttcatttcatcagttttactgttcaactttgtgccccctggaacttgaaaagatgtagcttgcctttacaatttaagtgtaggcatcatttcatcaaggggataaaaaaggagatgttgtcctctactgtaaatcctcccgtgaccttccagattcctcaaggaaggaaaacatccctggtattccattctcagagtgatctttgagtgaggatagtgagtctatctttactccccaatgacatactttaaggagagccgctcctttaattatgcacagtggcaatgatatatttgaatagccacaaaagacaagtcaagtaacacttaatcgactttaattacgtattattcagaaagaattatttccctaacaagaattctagctcaaaattgcagctctgtgctgctagcctgggtgtttgacacatatttcagctcccaaacagtctggtggtcagatacacttttacataatattgcagaggactgtcttttaactgacaagtggaaatcgtgccaacatttctttcttttcctttttttttctttatttgttgcagcctcatgctctacagacagtatgcccatccttcaactatactgcttcaatagaattgtatttccctttatttctcacttttatgcctttgttttgaaaagcaatggtgtgtagataaaggcttaggagttagagagccagtgagcttagtttcagctgtacgtttgcttgctgtgtgaccttgggcatgttacttaacctgcctaatgctcgattttctaatttgtaaaatggacaggtcatattttttaaaatttgattgtgaaatctgaatgagaggcataaagatcagctgtcatcctgtgcgttggaatacaactttcctt

SEQ ID NO: 30766 - DNA, 3481 bp, Bovine  19866880642432
aaatcagtcctgaatattcacaggaaggactgatgctgaagctccaatactttggccacctgatggcaagaacggactaattagaaaagactgatgttgggaaagattccaagtgggaggaggggggatggtagaggatggggcggttggatggtattgccgactcaacaggcattgatttgagtaggctccgagagttggtgatgggcagggaaccctggcatgctgcagtgcatggggtcacaaagaatcagacatgtctgagtaactgaagtgaacttactaagtctgagggcttccctagtggcctagacatttaaaaatctgcctgcaatacaggagacccaggttcaattcctgggttgggaagatcccctggagaagggcatggcaacccgctccagtactctcgcctggggaatcatatggagagaggaacctggtgagatatcatccatgggatcacaaggagttgaacacgactgaatgactaacacacactcagtctaaagtacagattgaaacttctctggactgagaataagctgattgggctctaattctttctcagtcaacaagcagattgttttaagtaggatgtctgatttctcatgactggggcatgctcagaaagtggggagaatatctggtttaaaagattcctggtagtttaggaataaatcatatatgacatgaaagaaatacattttttggaaagttaagatagttaaataaacttaggctattttcattttaattttttctcagcaaacactctgggccaatcctggcaaaagcctttgcaccccagctggaaaacttcaccagctcataggaaatggtgtctcagaagcttttcacctcactgctgctgagccgcgagattggaggacttgctgaacgtatgcataatgcatttcaatatgcttttcatgtgggcgatctcagtcttcccacggtactctacttaagtatgattctttcaatgaaggagtcttcataagcaattgaaggtcaggtcaggtaaactggccaagaccacacaatgagaagaaattagcagaacttcaactacagcagattccttttcctccgggttcatgtctttgttctgctataagctgccttgtgttccatccccaccaggactctgctttaaacacacagatgatatgttcttagttcacattaggtgttggtgagccttttccctgagtgaccaagcgcagggtggcatgtcatacacagaattcagtggcccagcagttacatccccctgaagatatgtggtgccttttctgacctctcccattggtctaattttttcttattcttcaatttctttccttgccatcttttcccttttctctatacttttctctactcagtgctgtgtcttggggatttggtgagagaaaaatgagtgaggattaagtcattgcataagcgagggaagaaggctgaagcattttaggttttgttttccttttaaccaaccaaaatgagtgaaatatggttggtggtacctattttgttatttccaaaggccttgggattaaaaatataataaatgtactttcttaaaatgcaggttaaatgtatcttatgtcttatctctttatacaaatctccctattgtgagaaaaagagaccaaaagtatgctggcgtgcttaaaggaggcaaaagacctgtatgtactccaaaaaactataagacactgatgaaaaaaaaaaaaaaaaacctgaatatgcttaggctgaatgaatcaatattgttaaaatgaccatactacccaaggcaatctacagattgcctataaatttacccatggcatttttcacagaactgaaacaacagaaaaaaaaaagaaaatttgtatggaaacacaaaagaactcaaatagccaaaacagtctcgacaaagaagaatggggcttaaggaagcacattccctgagtgcatactatactacaaagctataccgatcagaaaagtgtgtaactcgtgcaaaaacagacacgtagatcagtggagcaatttagaaagctcagaaataaattcacacacatatggtcaattaatctataaaatggtggcaagaatatccaacagagaaaagagaatctcttcaataaatagtgctgggaatactagacagatacatgtcaaagaattaaattagagcattctctaacaccatatacaaaaataaactgaagtcaggatttaaatgtaaaactggatattataacactcctagagaaaagcatagtcagaacactctttgacatatatcacagccatatttttggattcatctcctagaataatggaaataaaaacaaaaataagtgaaacttaattaaacgttaaaaaggtcttcacagcaaaggaaaccatatacgaaatgagacaacttacacggtgggagaaaacactttcaaacagcatgatcaacaagggatagatttccaaatatacaatcatcttatatagctcaatagcaaaaacaaacaacccaatcaaaaaatgagaagaagacctaaatagacatttcaccaaaggaggcatccatattgccaacaaacacatgaaaaaatgctcactatcactaatttttagaaaaatgcaaatcaaagcttccgtgaggtgtcacttcacagtggtcagaatggccatcattaaaaaatctacaaataagaatactggtgaagacccagcaatcccagtactggtaatttatctggaaaagatgaaaactctaattcaaaaagaaacatgcccccacaatgttcatagcagtacaatttattgtagacaagacacacaaacaacctgtgtccatcaccagatgaatggataaagaaaatatgctatacatatatatgatatgtttatgtgcacacacacaatggaatattagccataaaaaagaatgaaataatgccatttgcagcaacatagacagtcctatagacagtaatacaaaagaacttattacaaagcagaaataggctcacagacagagaaaacaaacttacagaatcaaacgggaaagggaaggggagagatccattaggaatttgctgttaacaggcatgtgtgtgtgtgtgtgtgtgtgtgtgtgttgtttagtcgtgtcggactctctgcaaccccatagactgtagcccaccaggcccttctgtccacgggattctccaggcaagaacactggagtgggttgtcattttcttctccaaaagaaactatagaaagaaagtgaagtcgctcagccatgtccgactctttgcgaccccgtggactgtagcctaacaggctcctccatccatggaattttccaggcaagagtactggagtgggttgccatttccttctctttattaatagatagatactagtatatttaaaatagatagcaagaacctagtgtataacacaggtacctatattcagtatcatttataataacctataagga

SEQ ID NO: 30767 - DNA, 1210 bp, Bovine  19866880644465
acagtggtgaccagtctctgccctgtggtctaaaataaaaataattgaaacatggtgttactgaaatttctagcttcctctcacagtcactgaaagggaaaggacagtgaaccgggtgggtttcaaatttcagacttcctgtcccttagacagaaaccaactagagaacctaaaatcggaagaagaaaaacaaaaagacactagagttatcaagtagagaagaatgtggtagttgaaagtccataaatacattctgaggtggcgctgcattcatactctgttctgtctctaggattctccagcttctcacagctgttgaagggtctcaaaccactgagactgttgagttaatacactaaaagtcactatcagaataaaacatgaagtgctctttggaatgcacccgtcatggctggaaatatgcttagccctcacaagttacaaaaactgccccatctcaaaccattgcactacagcatgaatcatcttgggtaatcttgtccaatcttcgcttgggtagtttctaactcaactggcagaacaaagaaagtcagtgaatctcaacaatggcacacacagaaccacatgaaagcttgaaagccatgtgcagtggtgttattgcaagtaagagaccaaaactgattcactaaaacaagctcttgggttccaaatgtaatagctacatgtgaagttacagaaccacattagggtgaggtgaatgactctgagattgtctttgctgtgaacactgctagtcagagcacacaagtagtctaagtggttttggagaaggggctttcttacaaatggactaataccattcattctttttggatacaaatcgaagcagcttaaaataaaaaatgagccttctagttcaagaaatcaaatgatcaaatagcttattcctatgtatggatttgaaggtatttaaagttaaaacaaactgtttttcatgctctctcaattaatcattttcttaatatgtaaaaaataataactgcagcacagtaattggttgagacagaaagaaaaacaaaagactgaacaggtttgacaagacaatcttgcatcgcaggtaattaatttagtagggtggtttagatactttgtgtacctatggaaagtgatgcaaaaattaatatggaccgaacatagctgaccctgtgctgactttcatgtggattctaagaggtaatgcaagccttca

SEQ ID NO: 30768 - DNA, 2554 bp, Bovine  19866880662874
tctcctttgattctgatgtcaagtctctcttctctgtgatgcctgcctccctcttataaaggcccttgtgattactctgagttgaacaaaataatccaggatgctaccatcacaagtttcttaacttacttcatatctacaaagttcattttgctaagtaagtggcatattcacaggttccaaggattaggatgtgaatatctttagagggccattagtcagtctaccatactaatcaactgatatgtgatggaacatttacaagttattccttccttccatttaaaattgttgagtacctctcataatataaggaatctgttaagttttagagacacaaaaatgaataagatttttcaccattcataagaataagaaaattatttagctcttaatatatatgtgctaaatactctagatattgaattcttcctttactcttactggtaggaagcctatgatttaagctctattcctccttccattttacagctgagaaacctggatcactgagcagttcagttatgtcccagtttaaactggtggtgaaaggtaaaaccagcatctaacttgggtaccatgtctctgagtctgtcactcacctgatttgctccaagatggtcctccttacagttcaatatctacttcttgtcagtataaatcatttagagatcagctaactttaagaagagttcctggcatgtagtgagtagtctgtaaatcacaatgatcgcaatgatgatgatgacaagttatgatacttatgacttgaaaaataagttggctacatttattagggaaaggtttgactgaggagaagctgagctctaatgttcacttactcatgagccttgctagagtactgaacccaaatacagaaattttaaatgaaggggaattccagaagacaagccctgatgaagaagaataggcatttcttggttgcatttttatctgaagtctctactatttgctcctggaatgaaacagtgtatttgtcctatggcttttctaattatcaactaattagggaaatgatggataactgctgcctcttcccagtcctacaacaaggtaggtgggccagtgccctgagcaaagaggtgtgacaaatacccagcaaggcacctgccattagcagtgtaatctcagccccctaaacagtaaacccagccaatcttttaaactgtcccatgattcgatttactctgaattatgccttctctcagatggccaaatccaggaaattctacatcatctcatgcttaagcgaaatgtattgaagtacacaaattaacatcccagtttattagcagcaacaaaaggaaatgtccacaaatccaaacccagtcatgataattgaatttctattaagcaatcctgggaggtatagttttactaacaggagcgggaaggaaagtcattttagttgctaccgtgacgaaacgggcctctgcagagattaatcccaacattttgcttactttagtgattgagatcattttctcagtcactcacaccaccaccactgacactctcattcttctggaatttaatcctgaattttatttcagggatattattatactgcctttctttatgccacattagttttttatttgtgagtctattaaatggaataatatttaagcctttaaaataagttattgaatcaagcctaaatgtaagcacccacagaacagatgatgctgagaagccccttgtcttataagatctccagatcaattgcaagctggatacgcccatgagtagtcatcttgactgtcatgcatggctggtatcagaagaccttggggcttgtaacatctagtttgaaagatttggaaacacaactttaaaagattttcaagcaaatttagcattcattcatccaaagcttgttgagcgagcggttattatcctagtggggaatgtgctataggagtaggtatatttatatttagaagtgaggggtgaggatgggagaaattcagaagagcttcacataagagctgggttttaatatgtaaatttaaagagagacagatgggtgagtggaggagaggaagggaaaagaaatttcaggcagatataacatcaggaaaaagagtgaagaatcttgagagctgtgagtaccagccaagaggttttgggtcttcctttggtaggtaatggaatgttatacttaagaaacaccctagatcttaagctccctaactattcttctaagattgatgtggtggtggtggtgctttagtcactaagtcgtgttcaactcttgtgatcctgtggactgcagcctgtcaggcccttctgtccatgggattctccaggcaagaacactggagtgggttccattgccttctccagagattgacatgtacacactgctatatttaaaatgggtaactaacaaggacctactgtatagcacagggaactctgcttagtattatgtgacagtctagatgggaggggagtttatacatacacatatatgtatgtctaaatttctctgctttatgcctaagctatcacaatgctgtaaatcagc

SEQ ID NO: 30769 - DNA, 1253 bp, Bovine  19866880671069
gggaaaagcatatggcattgacactgatttctgaaagacttgaaagaattttatagatttattttataggtttatcttgagtacgatttgatgagtttgaaaatacagtccctttgttcaccacctcaaatgcctctggaattagtatggtcacataagttcaaataacatttacctcctttataaaaacagctccctcggaaaagcaaatttgaaacagcctctgtgtttggtgtctttcaaaagatgcccccaaaagtgaactgaggcctcagtttgtccaaattatttttccaccaaaatgtgacataatcatcgacgcatgaaagagtgtgtttttgcccatgattcccacacacactatgccccagggagggagatgaaaaggatgagggtgagaaatctcggatcgggtagttccctctctccgaaaagcttcaaatcaagaaaatgacatgtagcttcttttacagtgggatcaaaagaaacctacagacagctgtgtttttgtgcacatggatttttttaagcaagtttgtagttcgaatttttggtctcaaagaccagatgttggtgataatagaaacttccacgtgtacttgggaggaagaaagagaaaggagatgctttaccaattgaaagcatgtttttcttttctttctttttttaatcataaagtgtaactgtaaaatatcacacaacaaatagtcatttacaaactttaggatccaccaaagtcttgatttccaaaaacccatagagtcacagaaaaaaatgataagaagatgctaagcataattgaatcaggtgagcacaatggtcagtgaacttggctttggacttgtgcctaaaatatgacatgcttaaatcttatgtgttttgttttgctattaatttttctttttgctaagaaagagggaaaaagaatggtaaagataaatagagttcttcccatgtttagggaatagcatgaaggaagctgcatgctgcgtgctaagctgcttcagccatgtccaaccctgggcaacctatggactgtagcccaccaggctcctctgcccataggattcttcaggcaagaatactgaagtgggttgccgtgtccttctccagggaatctttctgaaccagggatcaaacctatgtctcttgaaggaaacttggaaaagccaaaaaaaagaaagaaagaaagacaaagaaaaacatgtatttaaagcaatagaattgcaaaggagaaaataaaatggaagcag

SEQ ID NO: 30770 - DNA, 1200 bp, Bovine  19866880681203
gaggctaacccggaagaggaagagattccaacccagcatcctgacaacgccgtccctcctttggaggatgaataagtgaaggagtggagagtacaagaaagttcagggaaacgctctcctcatcagaaagcagagaagggaggaagaagtgagcatcccaaagcagatgctgggtgtgctgggtgttacacactttacatgaggagttttcctcacgcaaacatccccagtttccaattttctttgggtactcatcactttcatatcagtctctgaaaatgctaccttctacaagcctactttctcagtggtaaagcatctgcctgccagtgcagtagatacacgaaatgtgggttcgatttctgggtcaggaaaatcccccggaggagggaatggaaacccaccacagtattcttgcctgggaaaccccacgggcagaggagcctggtgggctacagtccatggggtcgcaaagaagctgcaaagagttccctaaactttattgcaaagagcaactgagcacacaccacatacactagccttcttttagtctctgttgcaaagtcagttgcccattatttgaaaaaaaaaaaaaaacaaccctagagctatggacaatagaaggtttatagcatgctctatcctcttctctgagtattctctcccatgtgagtttctcagactatcatatcttcgaatgtactcattcaaggtagtcagcggtgacatttggcaattcaggtcccacagcataatccaaaggatggggtgggtgatgtggggtgaaatcttgatactgctaggccttcccagggagacaagaatggatcctctccctgacttccccctccatctgtgccttgagtggtctgagatgtgctttcctattcccttctgctactatttgcctagcagtaaatattgactttctcacagtcagaacccagggacagattcttccaggtaaaatgtcatagggtatagtttaccattaacagacataatgttcaggcaagttagagtaataatctttcaaaatttctatagctaatagactgtggtctactgatttaagactgttccttcagcactacatttttttttccccctcttttgagagccagatcacagttttctggacttttgtatagaatatccaattagtgactttccaacagtttaatccagttgccttaaagg

SEQ ID NO: 30771 - DNA, 1748 bp, Bovine  19866880720843
aaatcccctggaaattgtcatagtaaacctgcatgatttctctggataagaaattataatacctgaatgctactcctattctgtcaaaactatctctgtaatcttaagggagtggttgaattctaagattcagttgttgtattctaatattcttcatctctaaattggggaagttggacttataatcacgaaaatctcttccaaatatagtatttgttgattttattcttaataaatatcacagaatatctatattacttgagaaattatgctaaatgtcttatatgtattttctcttttaatccccaagtaaatcttatttaatcccaaaattcttactgaatctttgaggtaactagttatactagagtatagataagaacattgagcaatacatgttcaattacatgccccaaataacgtaactaaataactgttgagccaaggtttgacctcaaatttggattcagaatctttatttttagttacagtgctatcctaagtcaagatttctaaacaagactgttgttaataataaaatatttccttgtatgtgaaaaaggagttgcttgttaatgcttgtcattgtagttattggtattgggagaaacctcaaaaataaagtctagttaaaaagaaagcctttcaagttgaaactaacatgatgtaacttttgttcttaagggctttcggagaaaaacattttatttcttttacctcttaaacgagcctagttatttttctctctttttaggtttcaatttttcataatatggagtctcagttatgtttatgatacttcactcttcaggcaggccataattctctctttgagcacaaaaaatttttttctgaaagctggtgttctcattttacctgcctggaatgaatttatgcgtacatttgaccagaaagaaacactctagatgataaatctgacgccccctgttccagtgacctactcgttgctttcagtggtttctaacacaaataataggccttcatgcaccaaaaaaatatttcttttctaagaaccgtggtctcagtactctttctgagtcatatagaaatgactatgcccatgtgtcttagagacagtccaccttacacgcttagcttccaacgtagttagcctctcattgatgtcctctaccttcgctactttaaaaatctgtcttatgatatactacttagaatttagtatcactggatgccattttattatctccttcatgttcctaacttcctcatagtcttttctataacaattatttttctgatctgaattatgttccagcctctcccaatttaatgttatcagaaaatttcattaacatgctgtctgtactttcttacagatcattagtaccaaacctgaagaggtccactaggtatttcccccagaaggctctacagcctattagtcattatcttttacttatgatcttttagctcatttttaattcaagcaactgtgttattccccaggccaatttcaacagaatttacaaggaaagctacaggaacctggtgctctcaaggtcttaatatgtattttaaagaatctctgtatatatcttatactgcacttatacattgcctagctgccgctgctgctgctaagtcgcttcagtcgtgtccgactctgtgcgaccccatagacggcagcccatgaggctcccccgtccctgggattctccaggcaagaatgctggagtgggttgccatttccctctccaatgcatgaa

SEQ ID NO: 30772 - DNA, 1377 bp, Bovine  19866880723624
ttttgaatgagccgagttaaaagatgaaattctgcactggtttctagttataaaagaaacttctgttgcacagcatctctgttagttagaaagcacggaaatcctactctctgttaccttctgactgctgatcctaaagagccatatgggtctcgattctcctgttagtaacttaatgctctgtgtaattaagggggcatatgcttcctgcacaaaatcagtgttagatctcctttatgtggcagaaaccaacacgaaccaggttgtaataccaccttttatgctgctgccaataaactttaaaattgctttaataaaattcagagaaaataacgatacatcttgtagttttcccgtggattattcaagcttattctgggacttcctgatcaggagaacatagcactttgtcactccccagacccttctccctacaaacagacttttatggttacaatatgaccagatatcagacgaagctaaaattctcttcagaacctttttattctttgtgaaacttatgtactcggagcaacattccaacccactgatttttaaacatctcacagggaatcaatttttcttttctattagcccaggctctgtaaagcataaactacaggtatatggtcaaacaaatgtgagtcatctgtataattttatacatgaaggggacaaaatgtcatatcacctttttgtttcatgttctgaagaattgactgtctttgatcttaactcagaatagctgtagaattaagtcctttatcttgatgccttattctgcttcaagctgctggaagaatgatctaattcctttcctttgttctgcctagtacactttagagctatcagaaaatactgatttttactaaagcagtaattgtcagagaccccagctaggagtcatgtgatggggttctgcacaaatcagaacccactgtaagcagtgggattttgaaatttgaaaactggaatgaaaagcaaagtgatgtatgaatatgtgagtcaatttttatttgttctgtaggagaaggcgatggcaccccactccaatactcttgccttgaaaatcccatggagggaggagcctggtgggctgtagtccatgggatcacgaagaatcagaaaggactgagcaacttccctttcacttttcactttcctccattggagaaggaaatggcaacccactccagtgttcttgcctggagaatcccagggacgggggagcctggtgggctgccatctatggggtcacacagagttggacacgactcaagtgacttagcagcagcgacaggagtgtgcggtcatcactgcagttattctgtgctggggttgtgcttagtggtctcagtcatgtctgactctgtgacc

SEQ ID NO: 30773 - DNA, 1966 bp, Bovine  19866880729433
ctcatcacagagcactgggttgagctccccatgtcacacaacaaattcactaccttgttctttttgtttttgaaataatgtgtctcttttttaatataaagttatttattttaattggaggctaattactttacaatcttaaaacacttaaaacacttttggagccagggctattctcttttttttaaaaaatgcaactgaatccctgccaactttcttaagtatccaataacttttgttgtttctcataatacttagaaaagttgatgttaaccagcttgagaagtgaagtattagttgctcagttgtgtccagctctttgtgacctcatggactactagcccaccaggctcctctgtccactggaattctccaggcaagaatataagagtgggtagccattcccttcttcaagggatcttcttgactgtgggattgaacctgggtctcctgcattacaggcagattctttactgtctaagttaccaagggtagctagcctgtggcaatatccaattcacctgtaaatttagttaaaaatataaaaactgcaaataagaagttttaaattattatctaatgcaattgtacccttttttctttctttttaaattattcaaacctgcaatagtttgtgcctgtgtaattcaaagaacttgctatctgactctctttttaagagtcagggcatatttcaaaaacactttttaacttccagcttgatatttttagaatactttgcctatgaggaagttatatgtaaattataaggaatgaatctaaataattaattttcatttatttttatgtactctctcatctagatgaaagctgaatatgtataaacaaagtaatgttattattgtatctccgtcttttcaccaaactgatgaggtgacttctaaaaccatccagtgtttgaattgtgttcattttgtatcaagtattgttctaagtgactttacatattttaaattacttaacctcataagaatacaatgagataggatggttattattcacagcctaccacagaggatacaggtcacagagagtttgagttgattccccaagctcacagatgcatggagctcagattcacacccaggctcactagcagttgaagtccatagtcatcttattagacaagccttgaacagagaggcatgcaatgataatgtcatagaaataaaggcaagggaaaatatttaaaaaatcagccataacattccatgcatttctcaggttgagctctaaaacatttttctttgaggctcttcagaagaaacacactaacaaaccaagcaagccaaaaccagtcagctgcaaagatctcacagagaccatttcttttttaaattgaaaagaatagcagcttttcaaaacaccttccaaatattgaatttgagaattaattcttcaaattataaatgcattcatgctttgacccagccatcctgctctaggggatttatctaactggtagacatacatgcatacagaaatgattcatgaaagctaaccacagaagtattggacttaatagaaaggggctgaaaatagctcaaacgtctgtttctagggactagttagagacagtgcatcctatgtgtgatgccagaagggcaaaaaatatgtctttaaataagatgaaatgttcatatcataatatatagcataatacactgtaaatagatcaagaaactaaatataactttggctttccaggtggtgctagtggtgaagaacacacctgccagtgcaggagatgtcagagacaagggtttgatccctgagttggaaagatccccttgaggagagcatggtaaccaactccagtatttcttgcctggagaatcacatggacagaggagcctggcgggctacagtctacagtgtcacaaaaaatcagacatgacacgagtgaagtgacttagcctgcatgcaagtatgcctacttatatgt

SEQ ID NO: 30774 - DNA, 955 bp, Bovine  19866880772478
taagtgccaagtactgcgttttcttatagattctggtagagcagactgcaaatgccatatggtgaccgtggcagggaggtgaagggtgtacacttctggaaatgatccatcccaaagtctccattgcatacaaggaaaggcacagttcaggtaatgagtcacaggccaccatcacccttccctgagacctttaggtcgagttcagatcaagtctggttctgattagtctgtggggacaggtgagatcagagccagagtgtgtctgccttcagggtcattgacatacctctctgatggaatgaatggttcttccctgggaaaggcaacaggagaacaagttccctggtggttgactctgggctgtagagacagacaacaggttttaatctcggtagagggagacttgctgcgacgcgcctggcttttgacatgaatgctgcaactgcttgtgctcagaccttaaattggagtgagggaaaggcgagggtctgtcattggctgatgatggattttcatcagcttgtaacaaaatggaataactcagacagcctgttgaaataaatttaatacaattttgaaaaaaaagaaaaagaaagtagattcatttttggcagctaaattcaatcttgtgagaaagtcaagctaacacaatttgaagtgccacaaggaccttaattctcccccaggatttcgtggcttgcccttttctctctctctcccatgactgtttctctcttccttcaaggattctggtttcctattcctcgtggctttagtcccttcctgaactgtttccatttcctctggacatgaatctaagctacacacccttagtgttggttctaactgtctcacctaaggttgttcctggggacttcattctgctgtctggatagaaggtgagttcatcccaaatgggctccattttgtactcaggtctttctgtgtccttaaa

SEQ ID NO: 30775 - DNA, 876 bp, Bovine  19866880794521
cagtttttcttcccattgtgcccccgtttttataagtgaatctgtcagcctcccaggattaactgaagctcactgctgaaaatgaatcatacactttagggcactgatatattcacacttaaatttatatcagaaaagaaaagaaaatcattgccttttctggagtttgggtgacagtcccaggtaccattctaatttctttacagtaatggatgtatgatattctacaaatcgtggtcccactgtcgaaccaccgcggctcctcgctttggggcaaagaaccacacctttttgtcacaggacaacaggcttgagcaagttttctgttcctctttatgcatacgctcctccctggtgatctcatccagaattgaactaaccctccttccacacacccaggactccctcccttggctccccaccctgacgtcccctgaattccagggcgcagagtccactgccgctttccccaaatgtctaactggcacaatcagactcagcgtgtccaaaacagaactgaatccacccacagcctgtccacccgacctcagtccagagccccagcatgtaaaatgcaggccccaaatcttggaggaatccttgactcttttttctttggcacagtctccgctgagtctattaataactttaaagaactccaccttcccaagcaaacgtgcacacacaggatctgaccgtgtctcagcatcgacttcgctccctcttggaccagatcacagagtactcttgcctccgctgaactgtgttactgacagatcttcctgcctccagacagtcctccaaatgcaaagtaaatcaggtcattgcacaacgtactcagaagctgccagggtctccatcacattagaaagcaat

SEQ ID NO: 30776 - DNA, 1239 bp, Bovine  19866880805648
ttcagcaagtggccgtcactaccgtcagtctgtcgcactaagttgacgaggaaagggccaatatttttaatgttgcatgcggtgctgactttctcactgttacacaattcattgtttaaaatatgtgtgtgtgtatgtatatacatatctatctatctacagatatacagatatcgatagatggatagataggtacataggcacctggtttttttttccccaccagttttacaggtaaccattttgaaagctacgaaacattccactgcagcagcttttgtaacttgtgccagaacaaaaaaatcacaggcacactgtgttaactaggcagtgtgaaagcatattgcaaacattattatcagagaagaacatctttataagtccataatcattttgaataaatggcagcagtaacaatgataaccgatggatgataaaccaagaatagatggctacgcggctgtctctgaagagtcaccttgtaaatcagaggcccgagcaaagggaaggatgcgctggcttgacttgcaggcaggggctccaactccgatcatgggacaaagacagtgacactgcagcaaagggaggggaggtgggggtcgagcgtgctacagactatcctaaggaactttcatttcacgtgtgtggcttatctagctcagttcaggagcattcttgtacaaagcagattgctttaactcacagaaatgctcagtcacagacagctttcttggtgggtgaaattccgctgccttgtggtggggatgaaatgagtctgatggacaccttgatggccgcccctgctcctgaaatccagcctggcgctcagaatcccgggatctccttgcaaacctggcatctgagcagcagaaacacatccctctcagttggaacctcataccttctgatctgccctggcagtcctgatagaaatcagcttttggaaaccctttgaattcttggctttgagctgaccgacctctgcggtgaatctccgctcctcttccacccttcccgaggggtgcggtccccctgccagctgggcctctgaacctcgggcttctgttcccccggagctgtctttgaaggcagagggcgccctgcagcggctgatggcagccgggaggtgtgtggaggggaggacagggggccagctgagagccgtgttgctctgtgggactgcaagtttctcctttgcctctttatccagatagatcctcacttttattttaaatgcat

SEQ ID NO: 30777 - DNA, 1780 bp, Bovine  19866880805835
atatctcttgtgtatcctgcactgacagatggattctttaccactgagacacctgggtagctaaatggaataaggagagatgaacaggatgaatgcctgaggctccgaatcaaagctgtttagagctcgtattggaaaccctgccctaaactgtgcttcttcccacggggcggaagagctaatgaacaacctgcagcagcaatttgcagcctctctaaaggctgtggagagcaagagggtgcaggagggaagacagaggtggcccctttgttccagagaaccgttttccagccatggttctgctgctaagtgccttcacttttgagtgtcaaattgttcatctgtaaagaagggacgataccgcctccttggctgtactatccagaagattaaagcgaggaatatatgttaagtgcttagcacggtgtctgggaggggacgtggcttttaaggtgttcagtaaaccttccttctctattgcctgtaaaactgtttgggaaggcattttctagaattgggaaggaggcttattgcactaagtctttaagagattattcacagccttgtatgttcatactctgtacttcctctgattaatgatctgccattgagttcaccagtgaccagtctagaagtaaaacagtctttcttttcttgcagtctatgctgtaattgaaactctggctgtcagagacagtctcagaaacttaagagcaaaccctcagttattcggattgctttcaggtttgctactatcttaaatatgccaacagctatgtattttcatccccatagttatcttctggtgcctcgtatttggttgttttcctctatctgggcatagaagcagggatgttataatttgtctacaagtatctgctgtctccaaacagtagagagagccccttacacttataaagtgataaaacattatcattgttttgtgttcggtgcttacaaattcagaattgtacatgttattaaaagctttcaacacttccttttccttctttgaaaaataatcagcatgttgcctctagcattctttcaaggaaagtcaaagactatgctttccaacttctgaaaatctaatgcctaaagcaacagcagtgcaaacggcttgtaccttttgtgagtagcctaacaactcatttgttgattttgttttcaaacatgtttcagacgcagtttgccatattaaaacgattgcttgcttggtggtggaaatattctattgcatcagagaaaagacattacagacacccctcgaaagcccttcgcatatacccccaagagcaatgacacactacgcttagaggagagcaaaaatgctgataactaatccaaatccttgacgtgaaattcacacaatgcccacatgttgtgtatttctgtttagaaaagtgaaaagctgaatctgtccatgtgagctcctgatcttaaatactgttattcctctaaatatagctcaggacatttgtcagcgaactgtgaagctcttgttaaaaataaaatggaaattcaaatcttgaaataaataagacgcgatttgtaatgcattgcctgtttttcgtttggggttggcccatctgaggccctcggaatgggtgaccccatttaaataattattcagagactatcaagcgttataattctgatgtctctttttggtgttggtgtagaaaacaacaaaggcgaatcgattttttaaaatgtatttttatattttgtcaatatgtataaaaatggaggagaggaagtgaaatgattcattttaaat

SEQ ID NO: 30778 - DNA, 1120 bp, Bovine  19866880845931
acatatatgaacacataatttcttgagcaaacacagccgcattagaaggagaaaacacaactacttgtgaaaactctgcaaaaatcctgcaacacaaacagcatcttcactggctcattaattctggcctaaatttgctactgtcaggcaaatcaggcacactgtccggcagacacccacctgctattaggctgaatgtgcctggcgtcttgacattctattgattccaatccaaagcttatgtaaaaaaagtcagctcagagtccaaaaggaattttagccgcaaatactttgggacaaatccaaacaactaaaaacagaaaggaagacaagatgcaaatctgagtgacaaaattgagacaacccaaaccagcccggtagaagctcaaggacaaatcaacaaaggacccagcttccccttttgacaactaccgattttaggacattccaacagccaccgcattgaatgggacttcccaggtggctctggtaaagaattcaaccgagaatgcaggagatgcaagagacttgggttcgatccctgagttgggaagatcccctggagtaagaaatggcagcccgcttcagtattcttgcctggagagtttcacggacagaggagcctggtgggcttacagtccataggcttgcagacagtcagacatgactgagcaaccgaacacccacgctggacgaatctgcactatcactacccacaatgcatttcgttactgcgccacaggtgctgctttcaaagaggattgccatttctgcccccggagccctgtgagtcttcactagaaacttgctgtaccgtccataggctcctgatcacgacaaaggttctgaagctgttccgaagaaccagaaaccactcacagtgcttaagaatactgcatacgttaatcttcagaacagccccatgagctaagagttttattgccattttacagataaggaaagctgaggttctgagaggtaattttctccaagtgactgaaaaaatgagagactaaagaagatagggcatcaggattcatttcgaaagtttctggcacctccccggcctccctccactcctgaaataacctcaacctaaagggaatgggtgtgtgtccaa

SEQ ID NO: 30779 - DNA, 747 bp, Bovine  19866880860979
cacacagtgagactacacccggcctgaccaaatcccaaagagctagagactttaccattaaaattttcaaaatgctgaatacatgttgaaactctttaataagcctttaagcattccccccctctcaccccgtcccatcaaactcacaaaggcagagagagagaatgttgtgcccttttttcagtaattatgttcagacaggacctctcctggccagcaggaaaaacgagaatgggaaacaaatggcttccaaatttctaacgtggtgcacaaagcatggagaggggaagaaagcgtccgcccccatccccatcctttccccttttagccctgccagacatttcctttgttctatttcctatctctctgagattaaagtgctgatcgcctcctttttgaaaatgatgtcactttttattcttgccttggcagagagcaagttcattacaaatctgctgtgtgactgatggctttgaagagataaggcagaggggaaaacacatttgggaaaggtatgaaactcaagagacaggttgacaattaaactggcagtgggggcgatgacggaggataaggagaaacagaggctgggcgtaaataacttttccctagtctcttttacagccatcaagaagctatttttatttccttgatagttttctcctgaagcaatgccacgggctaaaattcatttcgtgtttttgcgaccgtattcatccactttgagacgtatttccggcaggtcat

SEQ ID NO: 30780 - DNA, 1541 bp, Bovine  19866880915612
tccccttgattgtgcagggtttgcactatgctaagaatgacaacaattatagaactgacttgcatctgccaagtgaacagatggtcttgtagtttggacgaacaatggtgaagaaagaaaaggcaagggggtgggggtgcgggagctggtgggctgggataaagatcttacaattcaaaagagcactaataaaatgaaagataaagacaaaggcatgttgccacgcattactgaaatgtgttttaaaaaggaaaaggtcttgctgattttactcttctcacgttcctctttcgaatctaattccaatgcacttgaggccgatgagcaatcaaattataatgttgacactcttatttatagaaatagttattgtaaagtgtcatcaatacgagtttgataagggataactctttgtctttaggagactatatatttccattttcatttttagcttgtgaaacaaacagaacatgagtaagaactaggacttcaccttcacaaacttcgaatattagagcagtgaggtaattgttttatctttataaagtcattttaccttttctgcctaaagtggaataaagctgtcttcttgggaggatcttcattaaataggatgtgtgtgtgtgtgtgtgcgcgcgcgtacgtttgtgtgttaggtaatgcatacaaatagtcctacttgcttgctttgaggtgtctggatcacatttgatgttgtatctttgaatttaaaactatttaaacctatcaacctgcaaggatcctcttgcttaaacagttttcttatagagaaaactgaattaccatttgagttgcattgaggtgacagtctatatatatatacatatatacatgtatatatagtcttgaaaaattattcagatatttattttctttcttttaaatagtatttatggtacttagtcaccaaactaaattataataactcccatattctaaatgttttcttagatactgtgctaaaaatttttttgtacattatctcatttaaaatgtacagcaccgctctgaggtgggtatagagttttactgtttctcttttgaaagatgaagcaatggaggttttcaaagcttgagggacttacctaacatcacacagttaataaatagggagtggagactgaaagctaaatttatatagctccaaaagctctacttaaccatctgagttggttaggataagttagacactgaatgtcagtggttggacatagtagatttttcactcatgtaacagtgatggatcagcgttccgttctgcaggaccactttctccaaatcatctcacacagatccaggcatcttggttgaagctcactcaccacctaggtaggaccttatatagtcttatttccaggggaaggaagaaggtgtggggtgcccccaagccaggcgtggatttgacaaaggcacatctgcttgtgttcctatagagacacttaagttgcatggagacttccaacctcaagagaggctggaaaataacctagattagatgtttgaacaaagggaaggaggaa

SEQ ID NO: 30781 - DNA, 1280 bp, Bovine  19866880921454
ttgaaatgcagatttacggacagtcacaatcctacatgtaccacgtgctgactgccagaaagaaacatattcttttcaatgccctaggggagtctgggacagaaattcttcagaagtgaacaggcaggcagcccatagagatgcaagttgcctgtgatggttattctaccagtgttcagtattgaaggacataaataaaatgtgatggaaatagaaagtaaagactccatttccatggggacatagaaaatattgtgataatattctaacaagagttacataactttttgccaaaacccatttttaaagtggaagattagagttgaattttgtttaaaaccatggaggctatgtgtgtgccctatcatttttgacatgtatgacagattaaaaactaaacacctcttatattaaatatgaaaccatagctttaggatcataaaccaagcatgatattgaaaataagaaacaccattttggtctgacaacataaccctggaataagggtgttaccgtctatggggtcacacagagtcggacacgactgaagtgacctagcagtagcagcagcagagctgaattatgcaccccccataattcatatgctgaagtcttaaatttcagaatgtgactgcttttgcaggcaaaacccttaaagaggtaattaaagtaaaatgtagtcatttggatgagacctaacctaatacgcaaacatgcctcattttataagtaagaggtgggtgggacacaaacatgaataggaaaagacccagtgaaaacatggacagaggaccacccacaaaacaaggagaaaaacttcactcagtaccttagtcttaagttctgtcatatttgtcatggcagccttagcaaactaatacaatgggattctcacataattcttttcaaagccctatttttccatttcaggttcatatgtcctaatagctgtgtgtgtgttctcatttgcttcttgtgacaagtctatgatttatatattgttattttgaatttatgatgcaaatgagaaaaatgaggttaagagaatttaagtaatttttcatggtcacccagctcatatgtcactaagccaaagactgagactagaacatgcctctgaaacatttcctttaatcactgttctatgtctgtgtggagctatctttgacaaaatattgcctgtgcactgttcaaatggtaacataactgtcaaagttttggttgaaaacaaaataagatcacttctattggttgaagaatgcctactgttatatttagaa

SEQ ID NO: 30782 - DNA, 1460 bp, Bovine  19866880945259
tttgcctctgaccttctgacatgtcattttgagagtcttgaatagttcacagcttttaattaggtataaaatgcattgataggcttaccaggtggcattagtggtaaagaacccacctgccaatgcaggagaggaggcataagagaggcgggtttgattcctgggcctggaagagcccctaggggaggaaatggcaacccaagcccacaccagtattcttggaatatctcatggacagaggagcctggcaggctacagtccatagtgtcacaaagaatcaggcatgactgaagtgaatgaatgaaatgcatgcaaaatgcattgatggggagaattgtagttagtgctcttccactgctagttgtagataatagcacttatttaaccataatacccatatatcttctgctatatgagaagaaaatttccctgccttaccaaatatgcttggttgaatttcatggagtttgatttattattttttataatcaggatttttgtcctataaacaataaagctccctcaaaacttgagttttgcaattcttgcgttaacagagaagtaggcagacactctaacccatataaaaagcacatctgaggatatatgatgaaccaaagaattagcaggttatagatttagcttatgatttttgtaaactgaacttagtttataataataaatttagaaccaaaaaaaatataatcttgtttataatattttgtgttcactctttatgttatcatagatcttgagttgattaatttgttacagtttatctgctgctttacatataattttttaaaatatcatacttaaatcttagacatttggttcaactaatgggtcatttaaaaaaaaaaggataagaaattaaatactttaataggtatgtctttattttttaaacagaaaagtacaatatgttcatgtatctgttttccaaagtaaattgtcacaaacagaaattttcaacagtcccacaatatccacagtcagagatagtcaatatcagaaattcgtctggttccctttgagtattttctcttgttgtttagtcaataagtcctgtctgactctttgtgaccccatggactgtagcatgcagcgattcctgtccttcactgtctcccagaatttgctcaaacttatgtccatagactctatgatgccatccaatcatctcatcctctgttgtccccttctcctcctgccctcaatctttcccagcttttccaatgagtcagctctttgtattgggtgtctaaagttattagagcttcagactcagcatcagcccttccagtgaatattcagagttgatttccttaaggattcgagtattttctaaagaggttcaatttttgtttttgtttttttacaattttgaggtttcctttaattgaaatatagtgacataaaatattatggtagcttccagtgtgaacatttacaaggat

SEQ ID NO: 30783 - DNA, 1273 bp, Bovine  19866880982785
tttcaataagctatacatactgaatgaaaatacagaattaaggaaagaaatcaataaatctttgtcttaaattaattcttaccctcttatgttttaaagtaaaccatatggctttttcaacttttccagattccctttgactctgcgaaaaatatcagaatactttattctcagttaattatactgtccactctgagtcctcaccttagggaccttaagactttacacacctttaataataatctgaatcatgaatcatttttatcttcaggtcagtaaagactcatttaggtaatgtgttgagggaaaaacaaaatcccaaaccaaaactccacatcactctctcttcagaattaaacggtcttgagtattacttcctttgctacttcagctgaaagaatgtgagtccaaaagcagttttacaagacttgaatggaattataaagtattcttaaagccaattttatcctcctgaattttaataataaaatgagccttgttcctaaaaaataggatcagaattgtggtctagaaatgatgtgcaattactagcctaggtaatatttgagtcagtggaatattaacttactgaacgattgcttgcttattacaaatttgggtggacatttggcagtgctgactgtggcacagtcattctctctgttcattatcttttaggtgtgttgcctcctaaagggtcatgagagcaatgtgctataacttgggtttgcctgcagctgcaggtctacctaatttgtactttggcactcaaaagattataataaatgaagtgctgctttcaaagtttcagacacaccaatttttccccctgtttggcaaaggtggatttaatttgactttcacgagtgcaaaatccgtcttcttagaagttggtcaaactattaattttatagctgggacaactgagtacagtaaaccttttcacaaagccagacagcttaacctaattacagggttgtttggacaggtggtttaaagtagaatgaatactatcaagaacgtttcaagaaatgaggctgatgaatacctagtgtgtgcacgtaggtgaaaatgtgttttggaagggtgtgacgacaggtctgtgtccaaaacgaatacctcaggattcatctgtgtgctcgtttgacaatttattgtttttatatagatattttaaggagatggataacataaaatccacgtgaatatcaaaaaatatcaaaacccgacactgttcaaataacatgcgatgtaactggcttgtcttcgaatt

SEQ ID NO: 30784 - DNA, 1511 bp, Bovine  19866880999414
tttgccttggctctagtatttagcacttggcatctaattaattagttatcaggggcggagtcccacagagaagcaattcccttttctcctgattatggattgcattttgatggtaaaattgtgggttgtgtccctctctagtgacagcttttgtgtgattaatgtctctagtataatttttcctttgtccccttcacacaaaagatgccacaaaatcagcatcaccaatcaaaacggagctttcagtcactctccccaaatcaccttccatctttccttgttatggttgatcttcagcttggtgcatttgaaaattaagaacaaaaggaaagaccaaaaggtgctatacttattacttccacttcaacttaagttatggctgcgtaattctgagctccactagattttaaacagatgagatcacctgcagagcatagtttcattaaatgtacttgttttaaaaaaatgtcactcaacagaacactgttgtctctaactgactgaaacgtgccggcgtttaactgtggttctgtgcatcgttgtttgtcaacgccctcaagcaaatccacctgattaacaaacatttgctcaaaacacaagaaatcaaaaacccgaaacatttgctcaaatgcatgagtaagatacagttttttcatagttaagataaatataacctcattgtgcacttagctgataaatttgttagtttatttgcattgttaagatgacatcactgactcagtggacatgagttgggcaaactctgggaaatggtaaaggatagcgaagcctggcatgctgcagtctatagagtcgcagagtcggacataacttagtgactgaacagcaacaaaaagatctgttcaagtcaccttaaaaacagtaactgacagacaggtatgtttaggaagccccttgtttcaccatcacagcttctgctctctttggccctagtttcatttccctggaaactaacttcctctgcatttgcatgttgctctctgttccctcccatctttgctgccctcgtggccctccgtggtgcccactgccatctctgggtcattctctgccttacctctatctggctgctgtctctaagcttcttaaaaccagttgctgagggagaagattcttactgattcacctcactttggagaacaaagttgccaagatgagatattagttaataagatggtggatataactgcccttgagttgtgctcattcttggtctaaattacatttaggtccaagaagcacatcctgcttatgcagaataaaatatggcttccttcaccagttctttagagctgtgtggataagagaggtcccaagtcacttcagtcgtgttcgactctttgtgactctatgaactgtataccctgccagcttccctctgtccatggggattctccaggcaagaatgctggagtggggttgctatgccctgctccaggggaccttcccaatctagggatcaaacccacggttctcacatctcctgcatt

SEQ ID NO: 30785 - DNA, 1344 bp, Bovine  19866881010913
ttcatagccccagtacatggaatacattttagagaattcaaaatgcaaaaatcaatgcttaattttttttaagtcctatctcaggaaattatgaccaaaggcattggataatgttcagagattcactacttaaaatatgcttattaattgatattacaataggttggaatttttaatgcagcaaaaatcacctcattcatgtcagctttgctaattataccaatctataaatgaaaatgcatagctatcactagaaccattgctcagaagctatcagaaagcatagtctgcaggtttgccccagaccttgcaccttcttaaacatagggcttataccctcagagatatctactaggtctccaaaaacaagagtggagtttttcagtcttcttcctttttgagtctctcagatgtggcaccccgattactattgaacatgattgagatacttacaaaagcaattacttaacctcagcaaatagtaactactccacaggaaccagacatctgtgattgacactggggatgcagagctgaataggaggctctcctagctgtgacccttcagagtttgaaactggaaaagacaacgttaagatgctttagttgacaagaatcctatgcaaggatcaaataaagcccatcaatggacgtccaacttcaaagtatcagtttgcttctgttccacatctaatcttcttaaaaacagatatctcctaaattcattagccatctaatgcttgtgaaaattacacattattttgtagaacttttctgttgattccagaacaaaatatggttttaaaatatattgtccttgtgctttgcacttcactgtgagtttacatgacaaacctttaagttaccaacagaagctgcaaagaactcatttcccagtaatttaataaatctcaaaacctttagggttcagcaagggtaatagttaaggagagagatggctgactgtgcctgacacggataaatctttctcttgggttttcccactttcaactactgctgccaatttacttcctaaaacccactgagtccctcagctgtaaactctgaccttttaccttaatgtctccatgtaaaccaaaagtccctccttttgattgtctactggtaaaactgaattagtctggaaattctcaaatcttcactgagtattaatagagaactggagtgggttgccatttccttctccataatagagaacaaataggaactaatgtataatataaaggaaaattttaatatttcctttgaaatattaaatgacagaaatattaatatttccctgataaggcagaagtatttggtctatagcaggtagcttcctta

SEQ ID NO: 30786 - DNA, 883 bp, Bovine  19866881047138
atcctgcagctgcacagatcagaacatgttagctgggccttgttatgtgatgtgttgactttcaattgattttaagcacactttaaatggtaatgaggatgccaggctgggagacagcatatggttttaacgatttgattctcagaaagcagacaaacattttaaaatgatagagttccactagtgtgaaactcaaggtgaaatcggagggtttgaatgacagaaactacttcttccatctttatgattattagctctgccttcatcatattgtattgtgcggggaagaaaaacaggaagaggaaaaccagaatttactatccaagtttggatcaaattaaatatgacataaggctctgctccaaagatacagcacttggtgcttttgaactcagatcagcctttccagcaaagtagaaaatgaaaagtcaattaaaatataataaaaaaaatgtaatttaaggagttggaaaatgagagaaaatgtggcagggtgtgaaagcaaaatgaagagaaatattaggcatttaggcatgaacaacaggtgtgtatatgacccactacaccgtctcctattaagtgagagagagatgtgggtcaatgaaatgagtcatttggagacatttgatctctttatgggaaaagacttggaggtaccattggaagttgttttcttaatctcttctgttagattttgccgactgtctttcccagctggatggcaaaagcctattggacagcattctgttgtgctcttatgtgccccaacttctatccatccctcggtcagtggccgtcttggttgctcctatgtcctgattattgtaaacagtgcttcaatgtgggtatctttttgaattactctttctcaaggtgctctgtg

SEQ ID NO: 30787 - DNA, 953 bp, Bovine  19866881051751
tctggatttctccttggtctcctccctacgtttctctgaattttcagattggctctcttcctatgagtcacatcctttctttaactgtttccatatttattcccctctcggcagcttatgtatgactctttgttaagcttttcaaaatattgcatgttcctgcgtcataatactttgccagtatctagcacctattattcttagaactcattggtgttcaaatgctgtcttcctaactcctatgtttaaaaatgattattcattttacaggtataaacttgcatcacagttttttacaaatatagttactagcttacactctgattttacagtgcttaatttaactcatgtttgtatggccattgaatgatatcttccaaattgtaatcacttctactgcgtcattgccttcttctacaatatcctacatgatatgtaatttcatatgcctctaaccaattttttgtcatccactggtagttctctctgatacattgactgagccaatatcttgttgtcccccatcccttatttctagccagtgaccaaactcttgtaattttgcctcagcaggggcactctagttctgcaaactgtggccgtgggtcagttcctgccagcttccttgttttgcaaataaagctttattgaagcacacatgttcatttgttgacatgctgtctatggcagggtcgaacagcaaaggcacaaactggatcttatgatttatttaaaaaccttcaatgactccctattcccttcagtataaaactcaactttttaaacacaagttgcaagccctgttattaaattctttctcttctgtttttcctctccttgacaatagatatcccaagcaaagtaagcagcttcatatttctgccacatttcataccctatcagaaagcatgcttgactccaaaagactgagttaggtgcttacttattctatg

SEQ ID NO: 30788 - DNA, 1891 bp, Bovine  19866881081638
gttgaggtatggcagaaaacaacccaatattttaaagcaattaacctccaaaaaaaaaaaaaaaaaaggacttgatagtaagcagccaagagaggagatgtcatttgggttgctaaagggaacatgaggggattctgggagtacaagggatatcataatgcttgatctgaatgctcatgatacgggtaccttcacttaatggaaaatcatttagatgaatacccatgagataagtatattttttaattaaaaaaaaaggcttagcatgtgttaattcacactctcaagagagttaaacatctctcagagaagtcctaatttttatagtattcaatagactaggaatatttcaggtatgaattgtgacttttcatctcagcttccaccagataaactttgtatctacttgttttttcaatacttcaaggttctgagtatattttattagaataaggataactgtatcagcttcctaggcctgctgtaacaaagtaccacaagcatgatgacttaaaacaacaacagtgtattatctcactcacatctggaaacagctggggggtgagaagactgaaatcaagttgccaacagggccatggtccttctgaagctctaaagaaagatttttccttgtgtcctccagctactggacacctcttatgttccttgccttgcagctgtaaacatgtcaacctccacttccagttggtatgtgacattctccccttatgtgtttctgtatgtttccatatttcccttttcttaggtgaccacaggccatactggattaagaggccactctaatttaccatgtcttcattgtaacttgattgtatctgcaaaaattctatttccaaataaagtttcatgcacaggtactgggagtcagaacttcaacatattggggggcggggggagcatgatttgatccataagagtgtccaaggctaaaataagccctcaaaaaccctagattacagaatgcaaactgcaaagagtcccaggggctttctattcaaatgatcttggtgtcactcattatgcctagccaagtggccataatgagtaataaagctgtcttagaatgcattgtgctgaggtacaaaatcagctgtcccattctactggatacctgccccccacacacacaaaaaatgctaggctttgctcaggttcctggatcctgttggtacaatgacgcacttgccaagatatgagtgcaccctttcgcatttcctcccaccactcttgcctctctgctaggctgatcatcttagtcctcctgtccaggaacataatttgacttggtcttctagatcctaagcctcacccttgtttgttgctgtttaggcacttaactcgtgcccagctcctttgtgaccccttgtactatggcctgtcaggcgcttctgtccatgagattggagtgggttgccatttccttctccaggggatcttcccgacccaggggttgaacgcacaccacctgtggcaggcgaattctttatcactgagccacctgggaagctcattaaagcttttagaaatccacgtttttgtttttattttccataacaagatgagccaaatgctttcccagctgagttgagatctcgttgagctacacgcttgctatttctgtgtaaatcaacaaagcgttcaccttcacctctcacccctttatcgtgatttagtatttcagcacagtacagaggattatagattttatttcttcttgaaccacataattcattttcatatatgagatcacaaatgattggaaaacagattctaattggcagctagccatttatggtaaacccagtagcaagtgttaagctctgacaccttcccttgaaaaggctttgaaataaaattaaaattcatcatt

SEQ ID NO: 30789 - DNA, 1776 bp, Bovine  19866881092263
tcactgagtcctcatctctgcgtgcatgcgcgttgtgttttatgaatttggggactgtaattaagactctccaattatgtgtccttcctagttctgtatattgctgtttagttgctaagtcatgtcctactcttttgtgaccccatggactgtatctgccaggctcctctgtccatgggattctccaggcaagaatactggagtgggtttccatttccttctccaggggattttcccatccaggaatcaaacctgagtctcctgcattgcaggcagtttccttacggctgggccaccaggaaagcccctgtatattcttagctgtctaaattaagagctccggtgcttaatctagaccgtggctgtcgctgtttggatgttcttttgccaccccatgcccatcatctgtcatgagaccactgtggatggggcagcataaaatgatttctgagttgggtcaatctggatggacttgtcaatggggttgtttatgcaggcaggctctgtccactttggtgagtggccctcagttccaggactgcatgagaacaccagctctgtttggctctctggtggattctgtattatttctgtctatgacagtgggaggtctagctggatccagtggaagcaaaacatttgctctctgcagttggcgactgagaagagatcaggccgcatgaaagacgctgaaacatacctgtgtcagtcctgctgaaaatggctgcctggtccctctggaccacctgcatctctaaagcatccacctgcaaccctgggtcccttattccccctccactccaagtgctgcattcacttggattttctgttagacttcaatgtcgatatgttttaaggggagctgctcattttcaacacaatttcattctgtgtaattcctatttctttattaaacaaaatgtactgtctagaaccaggagtttgactcatctttgattactccctttctctcattttcagctgttccatcaccagttttatgcatcttttaaaaatgctgtccgtcttggcctgactttggctccattgcagttgaacccaggtgtgtctttcctcccctgacctgcacaccatagctactcttggtcattctcctgcagatgatactacttttcattactcacgaggtcaaggctaaacttttaagcttgacactcaaggtctttctttctgtggctttcctttattttcccaaagaaaagttcatcttctcttctgaactaaatttaggatgagctctcacttttatctttataatagtctcattgcggtgtgaaatcctacctaatgctttgtgtccattgtctatgaactcatttaggggaaggctgtccccaataaatgtttgaggaactcagttgaactcaggtatccgactccaacttccctccaaaactcacaggacaaatctcctgtctccctctacatatactgctctccatcattttcagtattaagcagattaatattagcaaagtttgcagaagtaactcttgcttattagaagtgtaaaattgtcgaatagaagcttcctttgttccctctctggaacactctgtcaaagcagtgctctcttgctttgaaaacaggaaggtagaacattccagcagcatcacaaacgctctgttgacatttgtaaaatctgtagtctttccaagcctctaggcaagagcaaatagaaatagtcggaggcatcagacttgatgatgtgaatggattcttataactgaggctgatagccaaaatgagtggtgt

SEQ ID NO: 30790 - DNA, 867 bp, Bovine  19866881096143
atttcctcttgttatgtcttctcctgagacagtgattactcttatcagtgaaaccaggtatttacaaaggaaaaaaataagtctataagtagtttctgctattttccttatagctctgaggcaagggagtacaaaaaagttgacttttggttgtagtggacgaggagaaaaacacaaagtttaacagagataaacagctcaaataagatcttgccactgcattattcaggaatgtttacaataagaagttcaacattagccaacaaagcatttgtaaacacaaaaaagagcgaatgattcctagtttggaaatatctgtgtttgttgttgagactattgctccttccaatcttgagatgtaataaaatatactatacattttaaaactgtacttttaactaaactgttagagatggattgagataaacattggcaagtaattgctccaaactaagtcaaaaagcctatttttgtctccctgagtggaatctgagccctgataaaatttatccgtaaactctgaacccattctgtttagaattgagggaaaaatttgtcaaagtctatataacctgattgacatgaacaaagaagtgtggagaaaacatatgtaaagaatctttttgcttaatatgtaacttcaggatgaacaagggaaagtatgtattgatgtgcttttaagttttacttaagttgttaaagcttatattaaaatagaaatgagaagtgtttccttcctatttctatgccacataataggctttatttgaacatggccacacattggtgagcctaaggctatctgaaggacagggcatgcagaaatacaccgctcaggactttcaccctccagaattcagttatatt

SEQ ID NO: 30791 - DNA, 1331 bp, Bovine  19866881145646
acaaaagtttgtgtacatgatgaatatgcatacatgtacacctatctattgaaatctgttaataataagtcctacttttcaaattattgcaaaatacttctaatgaaaaatcataactcaaaatcagtttcattcctggggttaaaatattcagtttactagagagttgtttatgacgttttcttaaaatatgaattaaatcatgcccttctgtccaggaacactgtgcctatatagccaatatgaattagagacagtgcttcccaaggactgacccacctttgacttagcatgctcatttccaagtctactaacagagtttcttagatcttttgactttaataatttcttatcagacacttgtattggttgcataccagagcataagtttcctgagagtattttattaatatagtatctggttgcttgatacatatggcctcttcaactattactcctgggttagatactatataacatattcattgaaatctatacatttgtagtaagattgaaagaaaaaaaactacattgcccatatatagctcgtactgtcctcacactcatagaatgatgattgtggaaaagaactcagaagaaaaatgcaaactcatttatgctttatttttttaaatgagttttgttttttgaaatagtgcatcatcagtctaacggatattgccaaaaagaggaatttattggcttacataattgtactattcaagctgtgaaattgctttagctacctccgcatgcaaaaccttaaatcaatggatctcagtgggggagttaccaccctccagggtgcattttgtaaatttatgggggttatttttagttatcacaacacttgggggacgtggctaaactagagttggtgagtcgggccaggaaggttagatatcccgcaatgatcaggaatgtgctgcaaatatatatagtttgtattcagcagagatgttaaatagccttcatgtagccaaaacctgtttatacctaaactgtagattaaaaccccaatttatatataaattcagtttttttgacaaaccaaataaccaagaaataaaaatgttatataaattaaaggaagattgttctgttttaaacattaccaagaattgtacatcattttgaatatgtatgtggccacacttctcatggaatttaaatctggatctcaatttgcagattttgcatgcaaattttttaacaggggatgtggaagactctttttcacagccagctgaaaatattaaaagtagtggagacatgagataaaaagtagtggagatattacatttgattaataaagtttgtctaaagttaat

SEQ ID NO: 30792 - DNA, 968 bp, Bovine  19866881147510
aatattaaagataataattcctatttagaagaactttttaagattaaatgaattgcatttaatgtgaatattttgttaactgtaaagcaatacacacatgatgtattgaatagttatcttcagcatattttgaatgggcttaaaataataaatagaatactattcaactttgagatatctgctttataaatgtattcaaatttattatttttactcctagtatatagtgtttagactaagaccatgctggaatcagcattttgcaagacagagctagtctgtttttctcatcaactatattctgcagggtctgggtgataatcattttatggattcaggataacagattcatattatccatttttaactggtagctcacttcagcagggtaatcattacagaatctgttaatgatcccctatgacagcatttatagacacacaaccacatgtcatgaatctgtgatgtgtaaacatctgagattctttttaatgtgagaagagatttgtctaaaagaaccaagggaagtacaaaaccacaatgtgtcatacaaacggtatagattaacattaagaaacataattaccttgaaatttctatccaccatatatatgtagataatatgcttctctaacatgagtacagttatttctgaaaacagatgctttctactgccatgtgggatacgtctgtgtatggctgagccttacttctttgtggcagccaagataaataaagcaaaaccatcttctgaaaaagcacgggcagaatatctgcagaccattaatcttcatctgtcctcattttgcaggcagtgtataatgccactttctacattcacttagggatctcctttccaacttttttgctcattctctctctcactcagcttaactttaattctgctttgaatcattttatttgacagacacagcatccttccacccattggttcaaagttgtcaata

SEQ ID NO: 30793 - DNA, 2848 bp, Bovine  19866881200945
gaggaagctacttttactttgttttcaaatgctattaagaaagaagcatgtttgcattcgttcagcatttcaggacatgggcacaagtaacccagccttgaagctgcttcgtcatcaggtttgtatctggctaaggaacgaaaagtaacagaccttctcttggtctctaattgtcactcacagcagacgccagtgtgctaacggcaccaaaggattcccaaggaagagcttcttccacggtcccagattttccagacttgttttgtttgctcatttgacatataatcttgtggtttctggcccctttcaccacctaaagcagaaaaacatattcgattcttaggtctcgctcagcttctaactgtttcaacaaattaaaggacttgactgtggaatttttttttttttttaagtgaacactttgtgttactcaaaccctacgatgagttcagcagacaaacgcaaactgtctctttagatgtgctcacagttgacagttcaaaagaatgaaatcaaaaccctgaagacttgaaataaaaaaccattcttggaataaaagctcggatttcaaagaggatattaaaatgataataattttaaacatccccttttagcataaatttctctcgatgaaatactccccacaaaactgtaaggctgggttgtctgaatcatccttttagggaaatctctagaactctcacagggtaaatgatgaggaatgttctgggggattgattccattatagtttttcttattggtggagatgggattaaattaaaatagtctgctgctgctgctgctgctaagtcacttcagtcgtgtccgactctatgcgaccccataggcggcagcccaccaggcttccccgtccctgggaatctccaggcaagaacactggagtgggttgccatttccttttccaatgcatgaaagtgaaaagtgaaagtgaagtcgctcagtcctgtccgactctagcgaccccatggactgcagctcctccgtccgtgggattctccaggcaaaagcactggagtggggtgccattgccttctccgttaaaatagtctagactgaaccaaatgagactgtttgattctgaattttattttttaatactatctttaagcttaaactgttgcattatttctagtgcccacatattttcctttcttcatgtgctgttacatgaagtgacatgggcttattattaacaaaaaataattaaaaaatacttccagttctctaaacattccaataacagaatgaaggacttcacttgaattatctcttgcagtagctcacccatccatcaaggtaggggctgctgtattattaatagtattatacagataaagagacttgcatttcccgaagttcaataacttgttcaatgtcgtgtcactggttcagggtttctccactgcagcactatccacagtttgaactgaaattagctctttgttgtgggaagctgcactctgccttcttggagactgagcaacatccatggtctcatccaccgtctcctcccactaaatgccagttgcagccctaaccatgactagtaaaaagtctccagtattgccaaacgtcccctggggagaggggcagaattgccatactgagaatcactgtactagttacgtggcagagctgggggatgttttagatggattcccttcctcttaactctttgggggcctccctgatagctcagttggtcaagaatccgcctgcaatgcaggagaccctggttcaatccctaggttaggatgatcccctgggagaaggggaaaggctacccactccagtattctggcctggagaattccattgactgtaccgtccatagggttgcaaagagttggacacgctgagcaactttcagtttcactctcattcttcttcctgtgttgccactccctgttcatataggacatagcaacagtgatcagcttctcttctctcttctctctcctgtctttcttctgaacatagagatttagcccttggcaagtgaaggttagcgtctgctcgttcatcctgaggatggactgagtgcattgacagacgccttcctgttctcgccgtgggtgtggtcagtgtgaaatggtggcgggtctgtgcctcgtgcggcaatatcatgggcgtagcagcacgcatgaagagccacacactaaatgtttaagtgttcatctctcttgcttgctgagtgtgtgtctgctgagtcagacttctatcactgtgtctctgaatcactaagtggccttcagcaagtcactgaatcatttgtgcttcctctttttttttttttttctttttaagaaaatgagaaccatccttccatcacaatgccttttacctttcacttgggagagtggtgtgttcactcctaaaccttttggaaggaattctaagacctctggttcattgaaaagtaaataaagtttttgaaaaggaaaagtatattcattcactgagataactgactttcaagatgaaatagtccactggtcagccattagaataaaatactttaagaagaaagccaagaagtagccacgcacacctttcccgagtcatcgctggtttcagtttcctcaggagtagacacttcctcagactttcttgtagctgaggatttgggtataaatacaaaaccattttggaaaaaggtagtaaaagcacacattggtggtgtcctgatatccctgtctgtgttcatttcacaggagcggagggtgtgtcttgccctctttcagtgtcggtgcatttgaagtgcatatagtcctgtgtaaatttattctccaggttaaaaagtctgcagtgagaaagtgcttgggg

SEQ ID NO: 30794 - DNA, 1201 bp, Bovine  19866881205433
tgtgtgtgtgtgtgtgtgtgtgtgtgtgtgagtgtgtgtgtgcatgtgtgtctcaagtggaacgcttgtccttgtttgtccccttaattgcatctcatcagcaacgtgagctgttgttcattagcctcttcttattgtcattgcctgaaagtagagcatccagctggcaatttctagcacttgctgtttataaccaaagttacattgctcttgatgagagacaaagagaaataaaaaaagatgacatgtgggaaacgagtaactgaaaaagaaaggatattcattttggtaagagacaatagcccagttcttaatgagtagtcaaagtaaaaaggtctttagttgcaagtgtgtaaggagacatttgtttccctgtgctgcacatccatgcgattttagtgtattttgttcctcatccttaatctcaagttaagaggccctgacataactctattttatctaaccatcatccaaacgcagaatttgtccgatttgcactgccatcctcacccttaaacacagacgtgaacttatgtcagtaagtatcagcccttagtcggtggtttattggagatggtctgcagctgtaggacttgctctgtatattccccagggctatgtctgccttggccttgcatgaaattcagttctacaaatgttgacatgcattgttgctccgtgcttgaggtactggtttaattactcaaggtccaaaataccgaccttcatactaataactcatgaaatgaagggaaggaaaagcaaagttggcacacattaggaattccaaaagtacacgtagacaatggttggatttgtaaatgagcaaatgggagactgttcccattctcctccggcacagggcaaggataaaattcataatggacagcagtgggtacagttgcaaactagttctggaagaactgagagcccgatggacagaggtgcagaggatgaaagagacagagcacagcagggttaccgtgggtcccttgtgattagaccagctgcctccttactattccagaagagtgtagactacctctaataataatcttttaagtgataactcacgtaggtgtctgtgaaataataagcagaacttctctgttcaaagttttactaacttttacaggtagtacaagggacttccttggcagtctagtagttaagacttagccttccagtgtagaagatgtgg

SEQ ID NO: 30795 - DNA, 937 bp, Bovine  19866881223810
ctgtggctgtacgactgacctcagggaagtctagtagaagaaccgtccatccatagagaatggtttagaaaacttgtgttgtacgtagagtcttaatttgctcaaagtctccagtgctaaaatatccacttaaataattccagaatcattttgtttttaatttggattcatctgggatgtattttatagaataccaagctttccccatattgcctgaacagctatatcaagtgagtgttgatgaaattaatcatctgagaaattatgtcatcttcagtctgtcactgaggtggaacattttgttttgatgagcaaatccataaccatttggatcaaaaagaattgaaatgtattcaccagttacactcccattgattagagacagggataataagtgggtaaatagttattgatcttagaattccaattaggcatttaggctgtcagtccttggagaaaatctagaaatgtgctcaattttccaggaatttccaaacttgtttcttacacctagattgataaagcatgtgatgcttgcaaaatcattcagattttaatgggtttggtcttgtgaattcagatatgtttacctctagtagataaaatgaaatcttctttattgaatcctagctgcactaaaatattcagaaaaatatgtttaatcagtcatgtaccacttacagacagtacattagagctatggcccacgtaattgaaaggacagtggtgatgtcatgtagcagccttggggcatgcacattcctattagtatcctattattgtcatcatttgaatgtctgttatacttagcactgaagttacaagttgaaactctattctctatagaacataatttctccttctttttccattttatagaagcttatagctgagcctgagctttcaggccatttaaattattcctttatttctctag

SEQ ID NO: 30796 - DNA, 1252 bp, Bovine  19866881263588
cataaaagggcaaaacaagtcctctttcacaagagtgtgaggttctactagagtaatacacgaaaagcgtttagcacagtgcttggaaaatagtaagtgcttaacaaagcttagctctcattagtggcaataaatgagtccacacagagcatcacatcttattttgcattccattgcaagctctttacgaagcagacctaatatttatgttcctgctggtgtccttggaaacaaatgtctacaaactgttcctgatagggaaaatgcaatggaatttgctcttgcaccactgctttcttcttgggaaacttgagatgcaagtcagccacatcatgtgatgccctctgagcacagcccgagttatttatcctcatagacagaatctgcgatctgtacgacctctactgtggacgccctacaatactgttttaagtgcctatccttgacatcgtgttactaactgagcaatcctctaatgagtttctgggtgtttttggtagtaaaccacactgctgctgctgctgctgctaagtcacttcagtcatgtcccactctgtgccaccccatagatggcagcccaccaggctcccccgtccctgggattctctaggcaagaacactggagtgagttgccatttccttctccatcaatccaaatcagaactccctcacacctgggtcttagctgactggaatatgtgctgcttgggtttatttttggaagtcttctttaaaacttccatttcactttcagttgtcatcgtgccatctttattagtttaatctagaaggtaggaactttgggttacaaataagggaatgccaagctattgagttaaataaacaataaagacatgtaactgtcttgcagggcatgaagctagaggtcagtgtccccaggattggctcaaagcacagtactgtcataataaccgagtcagcttccattcctcttccttgttattagcagcttgtgttgttctcaatttcagacactggagctatatcaaaggtacctaaaatacattaatacaagttaaccaatgctcttcattataactgaataatacattgtcaaaatgaaaagaaaaggctaagtaagattagtatattttctagcataaaaaagcaagtgggtctttgagaaagcaatgtagccttttgaaacctctacttgctcttctgaaaagtgagtatgagtgttcccaagtcatcattaagagtgtcacttggcacctgtaacatgcaggca

SEQ ID NO: 30797 - DNA, 2495 bp, Bovine  19866881272589
gtcaaacccatgtctcctacattggcaggcgagttctttaccatagcaccacctggggatcccacacgcattatagccaaccctaaagctaacatcattggctcttaaaatcatgcactcttctagaaaaaaaaaaaaaaccttagcagaaagcgttctgtgataaaataaaagtatatccattttaaatttcagccttgaaatcagatgaagaaaagccctgagatccaaatccttaggatgtcagcagggccaaagacacactgtaatcaccttacaccacccaaacccaggaccactgagagccgtaagcaggtattttcttaggagatagttcttacaaacacgtgaagccacaaacactttaaaatctaaactcttgattcattgcagactgcaataagtgcaatggtatatattaagacattgggacagttttcaaggaaatgataaaaaattaaaggaaaacacaagcagaaagaatgcctttaaaccatgcgcttcactcttaagctctttcattaagagggtaaattaaagcacatctatgcaatgctaaatacacacacacacacacacaacctctaaatgcaaattcatttagctgcttccaatactgtggtcaggctgaggtaagaaagtccagctatgaattctaatgcctaaaatggaaagagttcagttattgcacgttcgatttttgtaggtatccacttagctattcagaatatcctcacatagattacaacctggagttggaatttgaaacctacaaaaccaagggctttcactttcaatattcaacacaaacttggctttggaatgagagaaaatcttcgaaggagccaaggtataatctggaacaaagagggtaacttgactcttgtgggtgatgactggtaataccagaaactagagaatgaggaaggaggtgatacacagtcttaaatagtgtgaaagtttgtcactttctcttcttgattttttcctaaggttgaaagatgatatgtccgtttggagaaagcctgtttaaaaagtatagattaaatggacataccaacatcccatcaatgccactaagactctctgtcacatttcattagcatgatccccaaactgaactggccaaaacttttcaaagaaaacatcttggtaatggcagcacttgtgatgatttttatcgctaacgcaaaatccttccaaagagacaggaaaaaaaaaaaagatgctttaaaaaaccttattttaggattggtatcctgccattgtctcactggtgttcagcaagataaatgtatcttttagtagctctgataagaccaaaataaactgctacaaccaaagggctcagagactaaacaaacttcatcggaaattctcaaaacacactcctggttgtgactttctgcagaattttatgagaactctaaaagtgcgctcactgttgtcctggatcctcctggttccttgtctccagcattcagctctaagggctgagctcagggcatccagggtggtgcttgctgcaggaaatgattccttcttcctgctaaccttgcctgctccagcccacagtcctggcacagaggtctgggttccacgctccctgttgaccctggtgccatttcttggtcagttcaagaaatagacgagcccagttgtgcccttctcaccttcccaggctcataaaaggaaacctgtgctaacaagggtctccttaacaatagatgctcagctggaaaggaagtgggataatggcggagctgcttgggtagacacagctcctcttttctttctagagggaattcaagaacattgcccagaggcaaaacgataacctcttctagtggctgaagtgccttctttctccctttgcagagccctcagtggtttgtcaccatgtcccaaaggtgcctcatgaatacagcccttcttctcagtgaagcgtcgtggttgctaggaaattcacgtcagaatgttaggacttttcatgatggggtttgctcatcaactggtgtcatggctggaatttctaagatcaaaattgaactgcaaatccgtaagacagtaggataagaggagacgggaagggatggaaagaaggagaagcagagagaagtgtctagcacagcaggcacggtgctagacacacgggaccatgtccattaacctcagaaatgattcgaggcttctccatgttacagacaaagaaaatgggtttcaaaagtcaagtaactaagaggtgagaggtaaagagaagaggaggaagtagccaaggtggagcctgcgatgggatatcttcattaattggtggggagtgggtgttggatggcaggatcaggacactggatccctgaggaagttcatggaaacaaagacaaaagaaatgacagggaaaccaagtgtgaagctcaattatcatcttgtgtgccatttgctccagagtcgctccaagcttcctgaacatgaggatactttttttttctgttcttttt

SEQ ID NO: 30798 - DNA, 910 bp, Bovine  19866881301645
aatatgcctttcaaaatttctatacatttagaacaaacctctaaataatcagatttagctgacctggggtaaggcattaacatttttaaaaagttattttactatgcagtcagtgctgatattcactaagaaagttggtgacaaggatattgaaagaaaagtccttcttaaaggcttactcaaaagaatcagataatcaatcacactttactatgccctgcttatgtattcaaacagggaacacaatttctaaacttaatgtattttctaacagaaatcaggcaaaatgaggcatccaaaaatgtctgatgattaagaataatacacttttcacagaggctgataacgaaatggcccgagatttctaaactctcctagccaaattcattttatcgcactttgttatgacattgacatttagccaaagtattccatctaaacagtgaagccgaccttaattgttttttggattctcagagtttgttgatcctattacaatatttatcttatttgcacttcagcccgaatgtgaaatggttgcatattaattcatatggtatcttgctacctattaacaatatggaaggttttatttaatgctggcttgtttggtgtctggagacgcccaggtgagaaggcatacgattctaacgtcttttcataagccacggttgaattagcatcgcacatcagtgtatcattttttcacagtttatcctttttcaatcagtttcctgtttcaccttgttagttctgacagaggcgaagtagaaatgccaaaagctgttgaataaatgctcgcattgagtcatataaatttcagctgcactccacaaaatccaattggtttttgtgggtaatgttgctactcatttcgtaggccttagttagaactgatgttgcttctcat

SEQ ID NO: 30799 - DNA, 769 bp, Bovine  19866881345921
ctggtaatggattgttatgaactgaactgtgtcctttaaaactcaaatgtcaaagttctaattcctaggacctcagaatgggacataaggtctttaaagaggcattgagttaaaatgaggtcattacagtgggccctaatccaatatgactggtctccttgtaacaagagattataggacatggacacacccagaaggaaggccatgatgtaaggaagcctcagaaccctgccttgattttggatttctaacctccagaattatgaaaaaataaatttctgttgtttaagtcacccagtatgtggtactttataacatcagtccaagcaaactaatacagagatatgctcagtttgatgattcataatacagtggaaaagaaagatatgccaaaactaatcgtaagacaaggtgattaaaaacagctcacttacatccaactctcagagcaagactgcaaagcagacttgtttgtaaaccgaaggaaggtttttcttctagacatccgctttaaacctaatctcagcttctagaactccccagaaggatttctgattcttggagctgaaaactttcttttcccaggtgccatggtcatgtccccagcagatccaagaatccacccatcagattattttcccttaagggtattaaaacacgatgcatatagttccctgtgctatgcggaaggtccttgttagttatctagtttaaatatagtagtgtgcatatgtaaatcccaccctcctaatttatactcccacttccc

SEQ ID NO: 30800 - DNA, 1278 bp, Bovine  19866881384849
tcctcaaggaaaatgacagcaggaaaagagaaaggcattgttttaaatctcattttagagcatttttcatatttttccccatcatgtttaggagtattctgtcgcactctgagatacctagatataagagggaaaaggtgatgcaggtagaatataaaatattaccaaggctagttgagaaaacacatggaactgtaaaacatcaatgaagaaaaactagataatcaccttcccctcgcactctaaatttacgacgccttgggtgatgcttcagtggtctggcgcctgctaatttctttctgtggaaaccggcaggcatttgccatgggagacccgctgtcagccaatcagggtgagccgtccgggccgctttgatgtaacgtaagttggagagtagcaggtggccttccctgctgtttggagtgcagcttggggagtcctgtcagatgcagcagctcctctttatctgcatggaatctgtgtaaatcacaaaagaacagatggaaaaatagtcacacacccccgttcacctcttagaagcagctcgtaaaccaccgtccaccacccgctcattttaaaaacaaccatgggtgggttagttcccccaactgctacagcgtacttgttttgtttacgaaaacatccaaatacatgaattagacaaagaaagcaagaacagcaaacaatttaaatgatcacagctggtatatacgtatcatttatcccgatatcctggattgaggttaagtagacactgaaaaatcagaaattatttctcatctgcccaccctaattactatctgtggtggtcttggtgatgtcagataactgcgctttagtgtgtctgtttgattcttgctgattttgaaattcaattatgtaattatttccgtttattttccctgaaaactctaaatacttttctaggaatcagctctatgtagtttcatgttagaaaccagaaaacaaaaactgaaaaaaagaaatgattttaaaagaattttacttgaattctatgcaagtggaggaagtagtttcaatttatacaaacatagtacttgaatttgtggtgttcagctaatgcacaatgtgtggttcaattgtgtatataaatagaaaaagaatttaaaaagcaaaacaaaaaaaacttagtcctaaaagagaaaatggcaggaacaaagttatcaaggtatgagaatgaaaaggagcatggcatgaactgtgtctcactttagtgtgatttgtgagacaaggtgctgaaagagatggagagatggg

SEQ ID NO: 30801 - DNA, 965 bp, Bovine  19866881434768
ctctcttgactgaaaagacttcaggacagaaagctcctgttagaaatcaattatgttaaactgtgaaatgttgaaagcacttcatcacaatgccccaagccttctcgttctgcctaaatgcaacctggtactggtctcacctcgagtcttttgtaaagtgtgcccagaggaactgtattatgcaacagtcaagactggaggtattcttcgcattctttacaaatcaagctccagcctccttaataagcaatctgacaaggtatagtatatgctcgctgggtaatcagtccagctcacacagaagccataaaagagcaagcagggctgctggggtaagtggctccttctgaaaagccccattgttcccccaattaaggctgaggagtccctggtggaagaggttctgaggatgtctgagggcagggtgtggggaggaaggagacttggcaatgtaaaccagagctgtccctggctcccgagaggtccccctcacaatgcaaaagatgctagtgtttgaataaagcaaaacaagcacacttaaccattgctcctgctgagccacgctgcttcagtgtgctgctaggagattgtaaactcacccacttcaccttttggactacatccaagcaagctatcacaaaacataaacagctggattcttttatctgatagatataattagaaatgaagtgggcttttaaaaacaggatttcaaatcacaaccagcaggttttatgattttccctatgtgctcaaagaaaagacacatttaagattggatgtcttcttcctccattaatggaatttaatgtttacttctttctttgtctcacggcaaagtgacagatacatacatgtaaagagtttaattgaacataaccaagtgtgtacatcttatctagataaactaagaaatatgcaacttgccaggagctacatctcgaggaggtaaagaggatagattt

SEQ ID NO: 30802 - DNA, 1562 bp, Bovine  19866881441966
tgcttaaagtaaaaaagtttaataacagtttttgatagaaagagggtgaccttaaacttaacactatgctaatcttggcagaaaccaataaaaatattttaagtgggcaagagcctgcatttaatgtaagtctgtaaaagggtagtcaatgaggacattggccaatgaacattgataacaatgaacattagtgctgtatgtgtatggtattaacaaacccaaaccaagaatgtgtatttttgtgtgaatgtgaatctgggtgtttgagcatctggggatgagttattcagaatgaacagaggaaacagagaaaactatactctgtggattctggtcctgtctacaggagtgaatatattgttcagccaacataaacactcccaggccaactggtaaacatatctgtttcatgggaaaaatgctttcatttagcttttgaaaattacatttctgatttaaaaagcagtaagaacttgagaatttggaaactcagaaacataaaaggaagcatgtttaagctgaccttataaacactaattttttttacaatgttttattatatgaacgtctacacttatccatagaggatatattccaagacacacagtagatacctgaaaacaaagatggtatcgaattccgtacatcatatactttttcctatatatacatacctgtgagaaaggttggggcttccctggtgactcagaggaaagaatctgtccgcaatgcaggagacctggcttccgtccctgtgtcgggaagatgccctggagaagggaatggcaatccactgcaatattcttgcctggagaatcccatggagagaggagcctggtgggctacagtccatggggtcgcagagtcggatgtgactgagcacacacacacgcacattcttaccatagatcttagcaaccacagcatattatttttccttattaaattgagaactttaaccttttcacttaaaggaagcactttatgatgtctccttggtgtattccaattgctagcctcactagtcttgaactttggggccattgttaactaaaagaaggtgactagaacgcaaggactgtgatactgcaagaggagacctagtaaccaagagggctcctgagtgaccggcaggtagtattctctggacagagagatggttcacgtcacaggccagacagaggaggacagtgagagaagttatcagctccttacaatgacgtgcgagtcggaactttggctttatttctgaatttccttttaatactttgggaccaaaattgactgggaaattgaaaccatgcaaactacagagggggagggaactactgcatatttatgtactttcatattattttgcaggcttctttcacttattctctcatgagtattttttgataatagaaaaaaaaattaatggtatttttaaatgcttatgtaatgactccctttacataaatatcagaattaaccagtgttatatttctagagctaaggtgactttttttttttttttccaaaaaacaaaattccccactccttgagtgtggactgcacagagt

SEQ ID NO: 30803 - DNA, 853 bp, Bovine  19866881458557
acttaatgatgacaaaaacaatattttattaattgggtcacagaattttattaatttttactttgtgctaagcacctcagtggggtttccaggtggctcagtggtaaagaatctatctgcctgcaatgcaggagacttgggttcgatccctgggtaaggaagatcctctgcagaagaaaatggcaacccactccagaattcttgcctggaaaatcccatggacagaggaacctagcaggctacatggggtcacaaaagagttggacatagcttagggacaaaacaacaataagcaccgtagtaatgcaaatatcgctcaaagttcagtcctcaaagagctaaggtcttatacatgatactgaagttctagcagctcactgaatacctctgttctcttcaatgtgcggatatcccgcttgaacacatttgcaagctctcggactactggcaatatttcagggctttgtggagatttttctgtttgtcatgagctgtgttgtatcagacaacagggtacatgggctggaataattacattatttctattattttgtagtgaaaacctccttttgaatctgtcttttcatttttatttctatcaaccccattccatttccatcatcttctttacatcttctctgcattctactgatagaaagttgacccagagacaggcaagtttagccttacatgaaacttctcatttaatagaggtcagagaaaagccagacatttttctcttcatttttcatgagtggactgcaggactttctggggaatatttcttgaaatgccaaaccagatgttgtaaaatgtcttctacccagtgctaaaaccttttctcctaaaacct

SEQ ID NO: 30804 - DNA, 1242 bp, Bovine  19866881477948
tgggaatttatgggtgaagtgcatatgtctctgactctatacttttctttaaaagaatgtgcggacataaaaaattaagagagacaactctagatcatatcaattaaaaagaaattttttttcgagacatatgtgtacatgcatacgtgcatgcacacacatacacacacagcttttttcctaaaatatatatattctctcataaaatgccacagaattattcactgcatttttaaagtgttctcagtatgtgtgatttataggaagacagatttatttaaaaatgatcagaggctcaaaagttctgttaactttgagaaacccttgtaattacataccagagaagcccatctgtattatcttcagaggcagaattcctgtggattttaatccttagccagcttctctgttcaggaactgcaaataattgcaagtccatttccaagtgtttccttgtaactaagacccattctatattaacgacagtgatgtttacaatagtaacttgttattgagcacccattaagtgccgggttcaatgccaagtgtctcagtataatgtgtggtcctttacgtacaccataatgtcattcaggaattgctttctcagactgaggcaagaatagcatgaaatttccttctttttaacagaagttgattgctggtataataaaacatgcaagcatttatggtagtatctccaagggagagatactggaaccatactggaacctccaggcggtatgacagttttctccagtactcgtattttcttaacatttattgagcatctactgtctcttagacatggtgctgggttctagatgatgaaagcaggcaagatagacattgctcctgcccagaaatcgcttacagtctaactggggtagaacacatcatgtgacgtgagtgtgaattggtggtcaaattggacattttaagccgtgaggctgggtcaaagtaactgtatcctgttcttcagtggacatgaacagatggagttattttctgtgaactctaccacttttggagaatatgttgttgccttttttattaagtatgtaagatatgtattcaaattagtgcatcttaattgattccccctgatgagtaaatacctgtaaagtttgtcgggagtattgtcacacactagatcctgggttcactgtgactgagaaccagaaaaagggacctgttattctgagttacttatgcaggcatggtgatagctgcagtcatggt

SEQ ID NO: 30805 - DNA, 986 bp, Bovine  19866881489055
gaggtggagtcctgcttggttccctgttctttctacagtaaacaaaatgagaataaatcctacagtagttagtgctccgtttttaagggactcattaaaaataaacagtttagaggagaggcaattactgttaacaaacatagacataaaaaccacaaataaagggccattaacacggaaaaataattactcagtctctcatccagatgctttgtcagtttcacttgctgacactgactcactgttttgtgagaggccgctgctggctgcaatgcatccgttcaacagttcctcctttgcctctcacaagaaaagaaaaaatgatcagcaatgtcagagaattgcactgaagtctatataaaatatggcattgacttctctcttcgtctttcctttctgtgagttttttaggttttacgttactttatgatggtgaaaaaaatataccatcatgatagttgttttactaatgatagaaggtaaaggtgaaataagctttcttcctttttaggaatatgaggtttgatagaagaggaatttgaatatggagaaaagcacagagcacagtgtgcaagagatctttcattgctccagggaatacctttgcaatttcttcaccggacatgttttgcaatcaagcctcataagctacatgtgagtgcatgtgtgtgtgtgtgtgtgtgtttggaaaaaacaagggggaaaaagcagtatattaatgctaacataattctaactatctagaaaaagcaaacaacataaagttgagtttttggctcattttatcagttcagtaaattgaatccattcagacctcacagaatgcagtgttagctagtcgtttataccaacacgcccagggttcaatctgccaatccctgcattaaaattgtctttatcattgccacgttacaaagtggaacgttctgaaagaatccatttcttgcataagtttgtgagtgatgctatcttaaaatttctcaaga

SEQ ID NO: 30806 - DNA, 1359 bp, Bovine  19866881508939
catcaggcttttttctaaggagtcaattctttgcattttataagtacttgataaataattgatatatcattagtgaaaaggtaaatctgtattcataaagtcttttcttatgtttttcatgtctatgttggtaaattgggaggtagtcctaggacaaggactaaaatgacatagaggcctccatccttagaaaaatatgttccctaactgcagtgtgaatggaaatgctagattatttattcaccagagaggtacaccaggcatagaaatgcagtgtcgtggtgaagcatgcaccctctggagtcagcctgcctggattcaaatcctgacttcattgctgacaggctaagcaaccctgtatagattgtatcctggtattttcatctacttaattcaattttggaaggtttttgtgagaattaaataaagcatgtaaaaacatggagatatacctagcccacagttctcaataaaattattgttataaattagagtttgttctatagggctcttctatagggctctaatcataggtataaacattgaaatattttggttgttaaacacttggaaactagcagtggaaatgtgaactgtcctgatgatgacgattgttagaaaacaatcttttcctcccggaaagctgtgttgaagtccttaaaaaagtgttaagagcaaagttggacttatttggcaaacgcttgcttggatatgctttcatcgaggaggtttccctgctggctcagagggtaaagaatctgcctgcgattcaggaaacctgggttcaatccctggcttgggaagatcccttggagaagggaatagcaacccactccagtattcttgtctggagaatcccatggacagaggagcttggcggggtccatagagtcacaaagagtgattgagcgactaagcatgagcactgtcttggcagttgcttgtatataaactatgttctgataatatgtttttcaataataaaagataaaatgttggcttttccagtttaccagttgcatgccaataaaacgtgagatatattcccagtaacttacagtttttgtggtgtgaactattcaaagaagaaaacttcgggtaaatcacaaaactataatttatatctagtcttacatctttgaccagatgtactgacttaatgcaggagttttaaataagaaactgtttaaatggaaaaagaaacccttggtagtcacaaagatttcgaacaaggaattttctatgacatcttttctttttatgaatacagtgagacaatatttttattattgtttttacctagtgtttatgagtatggggctttggcagttttcctgacaatcgttctgtttctgattg

SEQ ID NO: 30807 - DNA, 917 bp, Bovine  19866881552541
tttttaaatagaggccaaataatacacatctcataggatcactgtcatgaatagattaagtgaggcttgccacacatccaagtggggcttccctggtggttcacatggtaaagaatccccctgcaatacaggagacctgggtttaatccttgggtcagaaagattccctggagaaaggaatggctacttgctccagtattcttggctggagaatcccatggacagaggagccaggtgggcatggggtcacaaagaatcgaacccgactgactgatggagcgcgacacatgtcaagtactagtaagcattagctctttcctttttgcactccaacctgcaacaacatgaatgctgtggtttatacatggctatttttgtcctgcataggcaagtcagttctataatattgtgtcattgtttccctaaaggatctctctgtgcagtcataggacttcttgcccaatttctccttagcagtatttatttctggggtccagaagaggaaacgagattttagaaatagttatcactctgtctcaattaggacactcactgtcgaagaactcttaaaatcattttgctttctgggaaagaaagaaatctttccagcagtcttatcacctgaaaaacagtggggatcatgaattattagaaaagagttacccaaagagagtgctcttaaaaacaactgcccgcagaggactctggcttatcaacaggcaaaaagaagagaatctttgtactaaatttgatcttgtcactataagcacgaaaatagcaatgctcataatatattctgtggggatgatgctgtgagtgttgccgccatgtaaaaatctcagctaaaagcttctaagaatgaacgttatgaactcttcaagaactccagggaccgtctattaggaagcaggtaaaca

SEQ ID NO: 30808 - DNA, 748 bp, Bovine  19866881677259
aaaagtaagtaatggaactttattttcagcaaagaacaatttgatttttctttacttgctgttaacgttgtgttagcatttactgatacaatgaagacacgtctattgaactagctcctgattcgtgtgtggatattattctgttatacagcgactggacatattatatgggggcgaaggagctcacacattagctcaggggagaagaatgtctcagctccttctgttgggtgtgccagctctttcagctgtctgcgaaagacgatgcaaggagggactgtttagaaatgacagcatggggtggattctggcatcaggtgtcaaagatgctattttaggttgcgcttctgggttgctaatttagtgagtgattttccctcggtgtcctcatgtggctaaggaagaagtggtttgtgacagtattttcttaaccagtatttgttttacattgtaaccttggctattctcaagttcataccatcttaagatttaggacgtctgagccacctctaaagccatagtggagtgatgtgagccatcagagaaatctggcttattgtgtcttcctcatttatttttattagtctgggttaaaacagtcattctcaacccataggagaatgcacctctagggcaaggtcccaggagtctgcattttcaaagagcttcccaggaaagcatgaaaaatgccactgattaaggacttctggttgtgccattacccagctcgaaaatagttcattcacaa

SEQ ID NO: 30809 - DNA, 1113 bp, Bovine  19866880470037
ttcatgcatcatcttatttaatccacccaaagccacgctctgagtaaagaacgatgattttccctacttgacacgtgaggttaaataactcatccaaggtcacacaatgagcaagtgcgtggagccaggatcgtgcccagcctgtaaggcttcaaaacccatggcttaacccctctgcctccggtttctctttgtcgtggccttgccgccctcttagctctccaaggagaaggagctgttgcaggcaggcctgatgtgccacaaacctcccagcacatcctgcccctttgtcctcagacatctgtttatcatctccctgatctggagctggccgggccctgcctcctgccttgccgtgattcagatgttggggaggatggaagccagagcccagcttctgagcatctgaactggcagagcacaggacagcctggtgcacacttgcgtttgtgttgtcagcccacagcatggcattcgtcagagacagggacttgtggataccacccgagcctccccaggcttcttgctgtggccagccagccagcacagcaccgctgcccacagctctggggaaggtgatagacagagtaccctgcttcctgagcccctgcccaccgccttctactccactctctgatacactgcctcccccacacccaattctgccagaagcctgcaccgggatggaattcctcttcccactttgagcaagaacaggagcagccctggacatttctgaaagcaatgctcttttcaaagcatgttctctaaaatcttagccttgagagatgtcctgccaaaaaaaaaaaaaaaaaagaagaagaagaaatttcagaagatgctgtggactgtgtcctgctcttgctgttcccagggcatactggagtgatgcaggcactgagaaggtctgcagaatttcccaaattaccctttattctaggtgcgcttgctctgaatgggagaacaccttccatgacttggaagggaaaccaggtgcaggcagaagacgcctccctccggtaggtcacatgctcacccaccagcgggagacccctcctctctggacatgtgcaacctggaacccctccccctacttcttgctctgggcatctc

SEQ ID NO: 30810 - DNA, 2750 bp, Bovine  19866880675146
gtgcctttgaacttgaccgcctgcgtgtgccaagttgggagctctgcaggtgaccgggagtcttgggactcaccttcagtgcaaacttcttagctcaggcggcccaggaaagaatcctctggcccaggcctttttatcttctctgtcagaaagcagatggttctaaacacctggccctggggcaccgatggaatccaagtccagtccctttaatgggccttgttgagcaggccctgatccagcggtgataaggaggcctccccaccggggacaacacccagaaccggccaagagctccaatcttctgtcctcgcggcatctgctggagttcagtggcttccatctatcaggcagatgtaatctcctcaaatacctgccaagtccttctcttcctggagttccctaggataactgcttccccaggaggtgaaggggcctttccttccctgggaagagatgccatatgcatgcaggtttgcacaaagccactcacttctagtaacagaggttgctggttgctttccacaacatccattctccccgttctccttgataacagcttgtactcaaagcagccaaggctccagctaaaggactatttttggctttccctggggctgaagtggactatgtaattaggttctagccagtgaggtataagcacaagttgtatggtaactttaggaagtctcgtaaaagggatagtgtggattctactccttcttgttctgcttctagctacctggaatggagatgcaatggttggagctctggcaccttttctgagtatcaaggtaaaactacacactaggagcctcattctggaatcatgggtcagcaatattgaagatttagttcttcattttttggaagctataccaattccagactgtctgcctatgggcttctttatagaaaatctaataaattaccattttgcttaaagcactatggggctttctttcacatattgctaaatctaatcctaataagtatagtttgacttcaaagtctaacaacaccacattgctttatccattcactaattccctgaggtatttttagtcactcagcaaacattctctgtactaggcaatgtgttgggtgatggaagcctagagatgaatgaaatcctactttatgctttctgagagcccccagtacagaagcgattctcttctcctcagtagaggagagtcagtggctctctcccctttgccttgggcaccatgccctgcagagctccctgcccctcctccctgctccatgatggaccacttggtggctggtggtacagcctaggagtgagagcaaggaccatggagtcagctgttcctgggatgagatcagaggctgccctatgctagctgtgcggccctgatacattcctggaaatggctcacctgtttcctcatcaccctcacacaagactagagaattcgttgaaatagcatatgtatggcatgtaacacagttctctatacaggtgactcccactgtccaaaagtagagcattccttcagcctacaaaacctttcataagtcgaaatggcatgaaatgaagaaacagttactttaggacaccccttgctaatggatgcacaaaatagacagagatgaagcacagatgctcgcagacacagttcaaagctgtggcggcttgatgctgagacactgggcgcagtttttgagaaggagcttggcggtgccctctcactgcccaggatgccctgccgcctctgtaatggctcagctcgctgcaatacaatcactgaacactgtttgcgctttttgccttttctcgtaaaagtgaaaatcctctttggatttcttttgtgaaaataggtactagtgtaagtcttttgcagattgaagtggcataaagtggactttcgagaagtgggggatacctgtaatgcatataatgttttaatcactcttcgcttacttcagcttgccactttgactgtttttgaagcaaccactttgtgtcactactatattctccccaatgtccactcctctcactctttcgccagaggtccatctcccatccttccctggtgtctaggctctcagaaccctgagcccacctgccccggaggagcttcctaaggctcacaggaggttgaggtcagggtctcccttgtccagtctgtgcttgcttactcccaggtgccccgcttcatggatattgctttttatgggctgaggtcctcaggagccaagtccaggcccttgtttgtttctttctctccagtagtaactggtacttagaaaatgcttgctgactagatggatggacagacagacaaatggatggatggatggatagatggatgaatggatggatgtataaatggatgagtggataaatgcactaaagagctatccacagtcaaatgaatgtacaaagtaacatgagaggaagagggaattctaactcatttaggtaaggaagacgggacggggcggacattggcgctgaatgtcaatgggtgagtgggggtctccagggtgagtgggaatctttaggtgggcatttacctgtacaagggcttccttggggtctccgatggtaaagaatctgcttgcaatgcaggagacccaagtttgatccctgggttgggaagattcccctggaggaaggcatggcaacccattccagcatgcttgcctggagaatccccatggacagaggagcctagtgggctacagtccatggggtcacaaagagtcagacacaaaga

SEQ ID NO: 30811 - DNA, 2131 bp, Bovine  19866880964537
caggtaaatcttgagtagcacaaagagtctctttgacttgcattctcataacatcttcttgtcatttaaggtgatgtcacacaagccattaacttcaagctcatcctcagtttccttatctgtaaaatgggctcattgaggattggctaaaataatatgtagaaagtgctaatcacagtgcatggtctcactgctcaaagactgagccctagggctggttagaaaccctacgcattgggctgaattttctctgacctgcatccttgttcccctaccttctgctcccccaggccccgcccttaagccctcaaggcctggagcccgcttgaaatttccattctgaacctgggccagaccttaacctgctggtgaagtgctggctgagggttggctttcaaggaatccacagctgtttttcctgcctttattgctgcccagtatctggcccacaggcctgctcacccatggccattaccatacaggctgagagcagaggcccaggtcacccaagggaagccccatttgcctagcaacacaggccctgtgaccccccagacccagaaacttcgccctgtacacttgtcctcagggcagtggcaccaaagctatgccctgcaccatgtccttccagcacagcccggaagaggagaagatagggccattgtaccagttcctccctgcagcgtctgcagtgcatctggacaaagggaaaggatggtcagttaggcacctgctgtgcttctgactaggggcctggcacatgcagcggcccccaagtatctgctgaataagagtagatggctttgactataatcttgttaaagactcttggtaagattaagagatagattagcaatcccattttgaagacggggaaatgaaagctcagggagccttgagtatggtaggaactccctttccaatgagtgtttgggttcctactggtgcccatcgttcacagggccagtttctgcatcacttcctcctggcctgttcacaccaccagagactatagacattgatgctatggtcctaattcctcctggtcactagcctgttagcgtcattaggtttaacagagggaaggttgtatttatggcttggcatgaaggaagaacatgcagatctctgttgccaggctacaaatgactccttttcccccctagaagagagtaataatgattaaaaaatactcagttgcttggcaagcttctgggtagctacactgtgaatatttcaggaactttcacagaccctgctgcctctccaggctcccttggtttcggttcttaacttcatccatcttctgaaaaaagagaaggcgatgacctgtaatcaatgggggaaaaaaaaaaagcatccttcttttccagggagacgcacactctcgattatctgattcctctccttgaatggagtgagcagagttcccaaaagaaccagagacagcagtattctaaggggcaggtctatgaaggagtagagggaaggaagggtaaagtcaaggtgagaaagcagagggtcatcaatggctgagaacagccattggtcgggaagggagaggggccaggcagcaggaaggaagacactgcaaacggcagacttttgccacctccaccatgggcccaggcatagttgtctcgtacagaagcctggggtctgactacacacccctggagactgtcggctggctcacttaacatttgcaaacacagatctaagagccgtgacctcatgctggaagagtaccagtccttatggggagggcagccctctacatcccgagtttctgaattttgggggtgattctattatttttggtaaaaataacgtgttcaatgtgatttaatttgtatacctctctttaagactttttcctgcaaatgtatttataaaaaaatcgtcagactacgtattaccttttgttactgctattttggtttgtatgatgtggaaagaccctagcattcactgaaaatccaccaagagatgtaaacttctttctgtggtgtgtcagtctacaaaaccctgggaattggggtagttgttgttttcctctttaacaggttgctgctgctgctgctaagtcgcttcagtcgtgtctgactctgtgcgaccccatagacggcag

SEQ ID NO: 30812 - DNA, 2327 bp, Bovine  19866881025327
atagtaaaacttaaggggaagagaaccagttcccttgtcactgactttaaacacctaattcatatatgcagactaggaccaccccacatcctttatgatttaactggagcctaagtgtaattaaagggtttccctggtgactcagatggtaaagaatctgcctgccattgtaggagacccgggttcaatccctgggtcaggaagatcccttagagaagagaatggcaacccactccagtattcttgcctagagaattccatggacagaggagtctggtgggctaccgtgcatagggtcgcaaagacagacacgactgagcaactaacagttccactttctaagtataattaaaggtgctgttctgggcttagaggagaaatacacggtccctgcttcccaaggagtatgcacgtgcaggagaaagatgggggctcaaagaaggaggaaagtggggtctgggcaggcagggccgagctcagaaccaaatagctcccagttgtaaactggaaccttgccaccagcacgttgaaatccccatggtcccagcctcgtgtgccaaaccaggcactagcattcttgtgaaacagatcactagcactggccactctccacacatacctctcaaggcacagtcggtctcacagagggccagccttggccttcacacctgggctgcacagccctgcccctcccatctcccgttgggaggtgctggcactgacaccggcgggcagcggctctagaactggaactcccaggtggatccaggatctgcagccggaagacaaaacgttccttggtgttccctagcaacccaagccactcgcagcctacagttccatggctgacacccttccatccatttgcaccgaggcgtttggtgtttggtgctccagaacgcttcctaatgtcccttcaatgatccacgaagccatttgcttataaaatctccctccctcctcctcccgcccctaccccgcccttccactggcttttagtccagtgaaccctctgcggcagatgcagtgaacaggagccctgggtagcttgttgaacaaagccctcattccagagtggcagcagcgtgggggtgacccccctggcggtgatgctgcccactgtgggctgtgctgggggttggggggctggtgggaggagatggatgagattcagagacaggagcaaaacaagctcagctccagacagagggggagggagacggggcaaggagggggaagaaggggttgaagggattagaagaggaggaattggggtgcaggaggagggagaaacaaaggggaggagggagagacaaaggggaggagggaagggagggggaagaaggagggagggaggggaagagaaggagcaaggagaggagaggccacttcgtttatttattatgatgccagttgcagtgtcggtctcgtgtgtggggagcagactgtattttatgttttaatcctccaagctgtgtgtgtgggctggggataattacattgaaaaatgtgtataatatgcagaaggttctttttgtggggaacgggaatgctccggtggaatatcttcctcatggcaaccaatgccttttccatgagccgctcgggaggtgccagtaattgggagcacagtggaagcccagggctgcccccacccggagacagccaagccctcctctattttaggggcggctttggcatggaggaccagggctgggactccttcaccccgcctgcccatgggacccgcacacgacaggcaagatacaaatgggagcctcattgcttttttggtgcagccttggggccgctgatgaagaatgcaagagggagctgacaggcaggctgctaggagacggtgtccacagcctgtgcacggcacacatacacacaattgtgtgcacaagtcttcacccatccacacacaatacacctatatgcatacacacactcacaaacattatatgtacatatgcatacccatattcacccctattcctacacacacaaacacatgggcgtacacacactcactcatccacacctccagacaggcgcacacacacagtcatacacaatacatgcacacgtgcgcacacaatgcccacgggctcacatgcatgatcacacacactcaaatgcccacaaactcatgttaatgggcgtatacattttcacaaattcaaagtcttacccatggccatacatgggtccatgtacatcttccattctcttacttactcacatacacacaccctcatatggatttgcacacacacaagtacgcacaccactgctgaccactgtgaagtggaaatccaaactat

SEQ ID NO: 30813 - DNA, 697 bp, Bovine  19866881420482
ccccaacattcggaatatttttttttttggtgcacgtgctttagtgacagcaccgctcacttaatttgagctgcctggcgggtttgcaaactttccttcggcttatgccaactgctgatttgatgcctgtttacccagaaattgcagatccggtggaaaaaacaccccaacctatagaggtgccagtaagttgtgctttgcacagcgggccagcatcccacagaagaaaatccactcgcgcaacagtgtggtccccagaaagtcccgcgatgatgaatagggcttctggctcccttgggacttggctggttattttgtaggaaattgaatttcttggtacattaggggatgtgctaatgaacactaatgctgggccaggagggctgggggtgggctccgccccgggtcggtttccacttctgcctctggtaaccttggctcccccttccccactccccctctcctgctggactggcccagtgccaccctcacgtgctctctcccggccctgtccaggccctcttgagaatctgtgttgagttcaaactgcccaccggcctttggtcactcccaagcctgccatgggcagaagcccttaggacaacttagggcctatggaattcggcccaattttctcagccttttaaggctgcttctctgggatcagccaccttgcctaggctccttttctactggt

SEQ ID NO: 30814 - DNA, 876 bp, Bovine  19866880264687
aacaaaggtccgtctagacaaggctatggtttttccagtagtcatgtatggatgtgagagttggactataaagaaagctgagtgccaaagaattgatgcttttgaactgtggtgttggagaaaactcttgagagtcccttggactgcaaggagatccaaccagtccatcctaaaggagatcagtcctgggtgttcattggaaggattgatgttgaagctgaaactccaatactttggccacctgatgagaagagctgactcatttgaaaagaccctgatgctgggaaagattgagggtgggaggagaaggggatgacagaggatgagatggttggatggcatcattgactcagtggacatgggtttgggtggactccgggagttggtaatggacagggaggcctggtgtgctgtggttcatggggtcgcaaagagtcagacacgactgagtgactgaacttaactgaaaataacaaaaccaaccacttaatagtataaagaaactgacttttatttattttactaaaggaattttttgcaactttaaaatctattcttgtttttcaggatgcaaaattttaagatgatttattgttattacatgaagcaagctgaggtctacttctgaaatgaaaatgtgggtctaacagaggagaatagaattgttaattccttttaatgacttttcttaataaagtagccatcaagtggaaaaatggactggcatctctgttaaaggaaaagaaaccaggaagccttcatttaaatcttcattagctactgattaggccagaaaagggaaatcgccagatttcctcaaccatggattataaaccaggaataattaagggaaagactataacctccttacagggt

SEQ ID NO: 30815 - DNA, 1244 bp, Bovine  19866880362548
aatgaaaggagggcaagcagtcccaagctcccccactctccttccaaatgtcctttccgattgtgccttatggctggaagaatccagctcacttctgtgtttccacgttaccaagcacccacactgcagcagacatgattcatcacttggtttgtttaatcaatatttattcaggacccacgaggcgctgaatatagaatagcacttcctagacaagagagactgacaagaaaaacaaaagccccatgtttaagcagtgtgtgccctaatatggatgaaaactaaagtcgattaagaatgctcatggtgaagaaataacaagagacaagggcttgctctggtcctcgataccccttaaaggagataattttttaccaaggcagtattccatgtacactgctggcccaagccattatcatcctttttcatttgtatccccagatatagtctttgactggtcttgctgcatccttctttgccttgctttgatttattcaaaggaagctttcggaaatacaatcagataatgccatggacatggaacagtggactggttcaaaattgagaaaggagtatgtcaaggctgtatattgtcaccctgcttatttaacttatatgcagagtacatcatgtgaaatgctggcctgaatgactcacaagctggaatcaagatttccaggtgaaagatcaacaaccttagatatgcaaatgatgccactctaatggcaaaaagtgaagaggaactaaaaagtctcttgatgaaggaagaaagcaaaaaagttggcttaaaactcaactttcagaaaacaaagatcatggcattgttcccattacttgatggcaaatagatggggaagaagtggaaacagtgacagattttattttcttgggtgtcggaatcactgtggatggtgactgaagccttgaaattaaaagacgcctcctcttccctagtggctcagatggtaaagaatctacctgcaatacagaagacccagcttcgatccctggatcaggaagatcccctggagaaggaaatgacaacctactccaatattcttgcctggagaattccatgaacagagaagcctggcgggatatagtccatgggatcacaaagagtcagacacaactgagtgactaacactttcacttttctctttggaagaaaagatatgacaaagcaggacaggatattaaaaagccaaagacgtcactttgctgacaaaagtctgtagtcaaag

SEQ ID NO: 30816 - DNA, 820 bp, Bovine  19866880366097
tgcaagaaaaagatgtatttgaacgttattataagcaacacttggcaaggagacttcttacaaataaaagtgtttctgatgactctgaaaaaaatatgatttctaagttaaaggtaaggtgtatttaggatggaatggagtgcccttaactaatgtttatcacataattgagcaccaacaaacaagtaattgggaaataattgatttaaaatatttgtttctgtaaatgaacaaagctagattttgagggacctgtggtttttttgttttgttttttaaagagaaagttgtattgcgatttgttcaagttctgggacgttcacagtgtactgaaatttctcttggtgaggcagatacatttatggcgatctgggggaggatcagtacaaggaaagcagtaagtggaatatgacatacacttctgtttcacacagtgtgatccacaggccacctgtacacatatcacctgatatgggtgtttcttgttaaaaacacagagttctgggccctaccttcagttggctttatgaaaatctcagagtctggaaatttgcgttttaaaataaaattcttaggttattaatcccactaaagttggtgcctacaggcatagaacaactattattagaaagattcagaaaggatgacagtaacatggaagaggttgtatgtttcctcataacagaatccatcatttgtttgtgtatgtttgtgtttttcttctagactgaatgtggatgtcaattcacatcaaaactggaaggaatgtttagggatatgagcatctcaaacacaactaggagagttcaggcaacatcta

SEQ ID NO: 30817 - DNA, 1808 bp, Bovine  19866880404271
ccaaggttacacagcctggaaaccactgcttcctaatgataaaaagatacatttttcaaattgattgactaggaaccacataatggcttttgacttcaaaaaatggaagttaataaataaaccttccctgttagcactcagaaaggtcctaaaagagtcttatctgtgcatatgggtatgccaataaattttattactggcagtttcacagggaagttttatagctatgtaggtagacctactttaaatcaaaatggaacactttacattggaaaataaaatcctcttttgaataaatgacagattttaaaataatgtaaacaacatgaatgtaaatgattttaaatattagttctccagattcgaattttcttcttcaaaaaagttactgagctctgatagcactttcatttttgtgaaggttactcagctatagttaattcccattttctccttctgaagagtatgacaaagggacttttaagagctaatcaaataaacaacgagtgttcaaaaataacttaattatcatatttcattgaatagtacattttgtcaagttttttgtttgcttgttgccaagtcagatgttcaggcctgtgttctgtttatagaatgtgtgatctgaaagcccaaacagcactggtcattttgacagccttaatgagtcatttagactggcaattactaaaataattacatgaagacaagctcactgtggtcatcacaaacggtttcacctttttcaatagactctcctctatctcctgttgttaaactaccatttgggtgtttaacataaagaactgactcgcttccctacttttatatgtcaggagagggagttatgctgaaattgaataaggaaaagtgactattctcacatttagcagcacaattaaaggaacttctgatgatctgggtccattaattctgctattctcagaggcagacattcccaccaaaatccaattgcaaaatattaatgttttcaaaggcaagtgttttgctctattgccactaacttggtcacattcattaaattttattatttctacatcatttaatgtaggtcagcatgtcaagtccagcaaacacaagcatttcttttctttccagcccactgacgctgctgtgaatgacaagaggcgaacaaatctcatttcagtggggaggaaaaaaaaaaaaaccctctcctttgtaaacatgaacattaaaatcaagaccacaaaagacaaagtaacagatgtcatgcggcaatccaactactctatgcttatcttgccagaaatgtatttccacagaaggagaagaatcaaatgatgcccctttcaagagatgaagggaccactgtttgcaaagtttaacacactccgtgccagtcccgttcttgggaaagaactacactgacggtgtccagagttggtgtcattctcagtatacagctctggtgagaggtcataagtgaaaaattgttcatcagagcaaactcttctctcttaaccgcagctcttctctcgttcagaaactctttttcaaaacctcctcctatggctagtactctgaggtttcctttctctctttgctctctcgcatggatgctaactgcatgtttaatgagatctgcttgcctgcctggtggacccagtctgaagaatggagttatcgtggtgaatacagacccagagtcagactgcctgcatgtgactcctggattcctcacttaccagtcatttaccagatctggggcaagtttctgatctccaagcatctctttcctcatctatacaatacgaacaccaatcctt

SEQ ID NO: 30818 - DNA, 1290 bp, Bovine  19866880407054
cttcattctgtactccaaggcccaatttgcctgttactccaggtatttcttgacttcctatttttgcattccagtcccttataatgaaaaggacatctttttctggtgttagttctaaaagatcttataggtcttcatagaaccattcaacttcagcttcttcaggattactggttggggcatatgtttttcatatgtttagggctaatgccatgatctataaggttggatttatttaacaaaataatctagttagtttttcaagaggtttgcatcaagtaacatattgagaattattactacttccctgtttgtttgtttgttttttcctgtaaatttaagaaatcaataaccagagatgtattgtcttctgatttaggattagaggcatcacactggattgttccaagagggcaccttataaacaactgggtgtactgagttttgtgaatgtatgtagagcttatattgcttgagggcaaaacaaatacaatctggcagagcccaactgaatagggttatgcttttgaaaggaacttcttggcagacagctgttcatattcattttctaaaggaagggatttaagcctactcacaaaaataaacatggtattaatatccagagtctgtgtttttttttttttcttttaagtaatgaagaattcacttattaaagtaagagagattcatcacagccaataatgtaaaaagagataattataccagcattaatgataatagttaactttatcagaaaattctcgaaaggatttttgctcatcaagtgatgagagttcccatttcaaatgaggcaattttcaaagatatatacttgtttttccaggaatcattgcaagttcttgtgatgttcattataaatttcaacccctaatgtaccacgagctcattattttctactgatcctccaccgatttgcaggctgcctgtactcaaacttggagtcattgagaattccaccaggtaaggcagagttaacgctcattcagtggtccaatagagtattaagatcatttttgcttgtgacaatgcagagggctgaactggtagattccatggtgaactgaaaaatcttgctcaagattttgaagcttctcttatcaaaaggtggaatggtatttgaaaatattccttcatcctgggtggctttgggacttgctgtgaccaatagaatgtggcagaagtgacactgtgagcattctgagggctaatgctcaagagacccctgcagttgcctgcttgttttctcagaatacagccctggaacccctg

SEQ ID NO: 30819 - DNA, 1526 bp, Bovine  19866880443319
ggggtgaggggaggggatgggaggttccaaagagtcatccgcgactgagcactcactcactctggaggctaaccagagccaggaaatgtttgactttactctctccccttttagtataaaagaagcctgaattctgactcaggtgaaacagttctttgggacatcagtctaccagcttctccatttgtgctttccaaaatatgttgctattccatgcctcaacaactcatctctaaatttactggcctgtctcccgaagtccaagtaggatgaggttggactcggtaacggtagtggaggtcgttaagtctctagcgtttaagcataaacacactttgcttataaccacagttagagaagacaggctacttaaggcaaggccagtgtggaggaaaagagaatgagccaggcagtcaggcaaagaaaaggaaattcattaaagggaaacaaaaggatgagtggcccttgagaagaaccagcagcccgcccttctgatggatccctcttataccccatagatgggaaactgggtcccctaaagggggatggttagtttatctttagcctgcaactggagtctggcagtaagggaatctttagagagccggagggtagggtggtcacgtagtcttgggaaagtaaatgctataggtgaaaacaggatgttgcttgagcaatgtggtcagtttcatgggtcactgtgacttttgtttgcaaggtcagcataatgagccattttaacaatgagtccccacgcagaccctatcacttaatatatgcctgactatgaggccaaaataaaaattttagagcgtattgagacttttccccatgttttcactttaaacattttaatgaaagtgaacaaaaagacctttttgttaatagtgacacatcaatgcaggcagcaggaagcaggaagagctatcatttctcaagtctcattttgagtgtgtcttcccatcatgggcactggatgtgaatcccagattctctcccatcacaaatggtctttcctcatgcactctgcacgcagtaccagggcagttgacttatcagcctgactccaagggtagctcttaattgaaagagataagctggcatttcttcactgttttctaagaatttagaaaatccatggttaattgtgtggagggtattttctagtctttctggttcgcctgcatcatccagataaagccaatatgagcttgaatttcctaagttataaaggagtcaaataagaattaccatcaagctgtttttcagtagagttttctatgagcctaaaggaagtctgttgtttgcattcaggttgcttttaatcctcaacatcagaagaaataagttcaccttccatttgctattttataataccccaagtatctgaatgcaggtaccaaaaaagtgtgctaaagacataaagaaacaattcacaaagaagaaatacagatgatcaatgaatgtagaaaaaaaattagccctaccaaagtcataaaaatacaaatacagtatttttttttttt

SEQ ID NO: 30820 - DNA, 870 bp, Bovine  19866880446419
aaaaaaaaaaaaattttttaatgctgcttttaattatattacttaggccccagggtactgagtgttttctaatcatttgccttttgtacaagggttttgccaatcgtttggagattttattttcttagttatacttcagttaatagaattgttgaatcccttggaaattaaagtaatctaaagggtttattatttaacttgataattaaattccccgtgttctctcctaatgtggtgctccatacaaagaaaagacccaccattaaaaatgtaagtagagttggataagaactattctcagagtaacaacatctactctcattatctcccagcaaagtatccactttgtagataatatgctgaaaacttaaactcttattaaagagagcaagtgagaactaagctactggctttaactcttcagtgactttttgtggaagtttgagagctctgaaaacatgtatttcttggtgggaatggcaagaacaggtaactatgtaatgcatccatgtttccacgaagttataaaaattcccagctggggtcatcagcatatggtcaaagtccgaccttttgcaagactcaaggaaatattcaccaaactccttcagaagtatagtggagggcttccctggtggctcgctggtaaagaatcacttgccaatgcatgagacacaggttcagtccctgatctgggaagaccccacatgccgtggagcaactaagcctgtgcgccacaaccactgagcccgtgctctagagcccaggcgccacaactactgaaccctgtgctcctagagcctgtgctccacgatgagagaggccaccgcaatgagaagcccaccacagctagggagtagcctccgctcg

SEQ ID NO: 30821 - DNA, 2670 bp, Bovine  19866880448406
aatcgttccccagaatgaccctcacagccccactcccttcggagagaatgaatccacagggacttccctagtggtccagtggttaagacttcacctttcaaagcaggggttgctagttcaatccctggtcagagagctaagatcccacttgcctcacagccaaaaaatcagaacataaacaacagaagcaatgctgtaacaaattcaataaataattttaaaatggtctacatccaaaaaaaatttgtaaatttttttaaaaaaaattaaaaaggagaattctctgtaacttcacatttcttgatctctctaacctcctccatagctatcaactttgaacctcccttttccattatcccatcaatatctttctcttttgttctgtgttatggccctttttctcagaccccatatcttcctctaacttaacttattcccttgatggaacacaaagtccagtagcttccagaaagtgacatggtgatacatattttgagaacttgcttgtatgaaaatatccactattttctaaatgctgtgactcagactgtaaagaatctgcttgcaatgcaggagacccaggttcaatccctgggtcaggacaattcccctggagaagggaatggcaacccactccagtgtttttgcctggagaattccatggacagagaagcctggcaagccacagtccatggggtcagagagagtctaacaccactgagcaactggcaacaacaacaagcatacgtagcttttctctttcagggcctagaatctctgaatgttgaggtctttgacatccgtaccatgagcattctcgtctagcacacagcaacagttatcactctccctggtaattggataaccaggtagaacctaactgcatcagaacctaactgagcccaggttacacaacaccaggtctgaggaacgggcaggcagttccatgcacaaaagtgaagctggactggatcctaagtacttggacagagtccacattagaatcagaagtgctttgtaaactatgtgtgtctatagagacttaaaatctcctctaggacttaacaagcctgcttcttgcttcacatttaatgctaatggtaaactgaaaaagatttctagtgacagataattagtgacaatggtaattaccggcctttatacggtctttcacccaaacagatagtaaagagcttaaaaaatgaatgctctaaggcataatttcctccccttcttaaatacaagttcctctagggtcaacgatagtttgtatttaacacattgtcttatgctacccacacgaaataacaatttctgggcaattcagctagcttgttaatttgcttagcaattagctttgaatggatttctaccctgaatacattacaaatgtatgaatgcatgtatacctttatttattttcttattcatttatttaacttttataaaaaacctctgtgattaccatcaatcacgtggatggacttccaggtgacacgaggtttgggtcaacttagcaggcctctcaatgtggcctacacagcccagcttccctgaaagaagccagcctctttggatccactgggacagagccaagtttgagatttataggtgtttctgaatccctaggaccaaatatcaggctgcattttcttggtgtctttccccccttttgtgtataagttttaaagactctacacatcatattaaaaagacatcaatatttaatctaaattaattgtaaattaaactatcaaaggaacactgagactcttcccgacatctttcttcccttcgcccgcctcctgttttaggaaaggtgttgctgtctttgtattattcactatctggttcacagagatgctctgtgttgtgtgatgagagaaaaatgagagcaattgctttctagatctaaaaagattaagatattactttgcataagtaatgggagaatatgaatttctattcttcaccctcaggccaagcgtcagaaggaaatgggtctttgccttggtgaatgtgtttggttctgcttctcagcagagaaggtataagagtgggtaggtgtgggatcggggtttgaagaaagactcacttttcctcttttctgccttcccttctctgggcagactttcatagcctaagtcaaagctcagctctctcttcattagagcagaaatggatgagggagaaagcagaagagatattgtgatggagggcccaggataggcagtttaggttggaatcccacagcctgtggcaccaagaatttcattcatgcctgaggcctcaacgtcttcatacgtaaactatggttaacaattcccttagcactatattgtatataatataaattggatccctgttaaccatcattattgtcattgacacttggtgcctggggatatggaatttacctggttatttcttcagggaggggtaagaagcaccctaaaaagataagatgggatattagaggggaagacagttggaggatccaggatgggaaacaagagagaccagggttgggaagaaactcactctgaaagcttcagatgcctccttatggggttatccccttacccaggaaagtgaggtatgaattcttagccataatgaggtttaaacaaacggagcgtctaatttgcagacacgggaaggacctagata

SEQ ID NO: 30822 - DNA, 2652 bp, Bovine  19866880468477
tgtttctttgctgctttcctgactagaatatatattccctaaagatagggatttgtgtctcttttgttcactagctatggtccagggctttgaatgggacagggcacatggtaagaagtaaataaatattcatcgaatgaatgaatgaggtaataacaatagaaattacaaaatatttagagctaaatgatgaggaaaatattatgtaataaaataaggggaagacatttgggtacaactacaaaacattcttgaaatacttagagggagatttgaataaatgtcataataacgattcaatacagggcttcctttattggttcaatggtaaagaatccacctgccagtgcaggagacatagatttgatccctggcccaggaagatcccacatgccacagagcaactaagcccctggccacaactattcagcatgtgctctggagcccaggaggtgcaactactgagcccacatgcctagaacctacgcaacgagttgacagaagccactacaatgagaagcttgggcagtgcagctagagagtagcccccactcgccacaactagagaaaagtccctgcagcaacggagacccagcacagccaaaaataaataagtaaatatataaaaattttaaaaaaaagaagattcaatacagccaagatagatgtcaattcttctcaattgatccataaattccaaaaagagattttcatgaaactaaaaatcagggctaggcagagagaaatcctttgtggctatacaggtattcagtgcaaagctagaatcagaccacagatagatttcattcactacaattccaagcttgcccatcctccttctctgctcatctacaaagccctccccctacttgtctaatactagagagcagatagaatattcaaccaaaaaatctttcattttaaaacctgatgttactcaacaaacatgtatttaaaacttactaactttaaaacacgtcagagtatttatcattataaattcatttaatctgaggatagctatccttatgtctccttcacagataaagatacaggcttagaaaagaggaataacttggtcttgccgctgacagttcatagagccagatccttccaggatatcttgtgagaggcttaaacttgaatgtgaagtgaaagtcgctcagtcatgtccaactctttgtggctccatgtagcccaccaggctcctctgtccatggaattctctaagcaaaaatactggagtgggttgccatttccttctccaagggatcttcctgacacagggatcaaacccatgccttttatgtttcctgcattggcaggtgggttctctaccacctgagccaccacggaagccttggccctcagtaaatgttcatgacaacaagttgatcttggaaagctgtattacttttttggtccttagtttctcgtggaaagaactctatctccttgaagccacactcctaggaaaccaagagaatttatccattccctcaaacttgttttgctgtctccacacagtatatttgaaaggttgaattagttgcccattaaaaaagtgtaatgatctctcatgatatctggattccaacttcttttgaaaattctaaagaaccggaaacaccagaactagaaaaacacatgcctttcttcatgacaactgatgattggagctcagtagttgttgaactcaccatatcagtcaatcatttcacctgcctttattttatgagtaagatttaataatgagatagcgacagagtggcagtaacttaggacccagacctccaccctgtgcattatatcagtcatattttttgcacatgtgccaattgcaaggaagccttggcattcttactttcattggaaacttacacaggtccgtgatcatctatcagatggcaaatgtccctttccataactggctccatgcaagtctcttcatgcacaacagtcaagattatctcacatctggctgaacagggaagcggctcatcccttctatgtgaattgacccagagcattcttaaatgtccctttcacaggcttatcagtatttcatggaagctgtgcccgtcaaaaacttttcatctcctcctttgtttccacatgactgctccaccaccgtgtgacactcaaatgtcaaaaagatggcgggatggcagtctgtcagatccacttctgactcggggctcctggcaacaccagatgcttccagtcacctgggaaatcactgtgacgatagctacatatcaagttcaaggtcaaagtgaactctgcaaacgctgcaaacgccgaatttctgagcagctgtttaaataatttataacagcagagtgtacgcctgcttgaaaagtgagacataagacttcatgtaagtgacacttttctattatgtcttagagggcaaggccattgggtatctccacacggaaggacacacggccgggtggtgataatgcagtcaaaatccccgagttctaatctgaccttgcctatcctctgtcactgactaaaaccaaaggttctgacagataaaggagtcacatgtcaaccctacacaccatattccatcgaggcatgattttatgtccagacgaaagacacgctgtgacatcatctattgaagaagatggaaagcagaca

SEQ ID NO: 30823 - DNA, 1858 bp, Bovine  19866880599118
caaagctgatgtttccttcttctaaatatttgaaacaggcagggaaataaaagaaataaataatttacccaaatcaacaaaactcactaatcagttctaagttattaaataaaaatatgctcaaactattaatatttacctttttaactggtccatagaaggtggcattgagatctgcagaacccatgtgatgctggagtgtgagctgtcgaccactgtgtttggctaagtaaaaccttcagcaaatcaaaccaggtttttgagaattacacaacttatttatttgaaattataaacttccaatctttaacaaacatttatgtaagggagacttcaaaagcaaaaaaaaaatctcaggaatcaagttcagttccaattttttatagaaaagaaactataaattaaggggtgggggaaaagagacagaaaaagacagacctaagaaacttagctagacagtaagtgataaaagtagtacactaaatactttctacttgtatatttatttgtcctggctgctgctcagccaccgcagttcttaagacaacctttctccataattaaccccaaaacaattcacccccacctagtggaaaacatcaatacaaaatatactcctaactatgcactaatgctgaagaagggtattagtattcctctgaaaagagattatgcaattcatccttacatattgaaagcataaagggtaataagattaaaaatggagtatattcctcttcaatcagggacactaactgctccgattcatctcaattctggacaatttgtacttagaaatacaaagttcgatctacatttaccttctgaatatctcaaaagcatgtcttggtgctggtgggatgttgcactttggtgtggctgactgagtgggccagtatcctgttgtgagcacccggactgtgagatcaacaccacctaaagatacctgcagcaaaaagaagaaattgtccccgcgccaagttagctaggatgtgctatctgttgccaagccactgtgagagttatcagagttatcaaagtagttatctccaggtccaacagccagcaaataaaacacatcttcttaaaagttagactcatccaatgttttcctaattttaactatggtaaattttattgcttaagatgtttgcttagtcttactggtgtcactgaaatgtacaaagtttgaggcctttaagattttttccagataaaatgccaaggggtcatatcagtatcattttagagaaaactccagaataatacctttcatctcagtttttaagtacccctgccatcttaacacagaaacaaaatatttctaacatcccaatcacatttcaactaaactgaccaaaactttcaggttttcacatgtagctcacattctatcaatctctgcataggacgctaggcccagttctacacagtcggtgctctgtaactatttgcatgtttgactacctctataaaatacatgctagcattactgtcacaatgaggttattttttccctttaaacagatctcttaacaagataattttttaagaaaacagtaacaaagcatatcaacagacattattaaggggaaaagctccaatactctgggccaccctgatgtgaacagctgactcattggaaaagatccctgatgctgggaaagattaagggcaaaaggaaaaggggcaacagaggatgagatggtggataacatcactaactcaacggacatgagtttaagcaaattccagaagatagtggaggacagaggagcctggaatgctacactccatgaggtcgcaaatagtcagctgaacaacaatcactgttcagctttatcattaagattcacag

SEQ ID NO: 30824 - DNA, 1369 bp, Bovine  19866880627066
gtgtaagaatgaaagaaagtcacaggtcatgacgaaggccacaaaggtcataggaatgacaataaaatactgttctttccactccttttctgctaactctgcactcagaaatttgttagggggaaaaaattcacagtgaagatgtttctttgtgctagttttcacaccttgatgaaaaaatcttttccttaaatttggaaacatttttctcattgaaatggaagcagtaaatgtggcttgagctattgccctgtggggattctggttgacggcctcagaagtcagttctcttttgtgtcagtctgtcaattttagccacttacttctgaccttgaatcagacaaaactccataaagcatcaacaggaaaaaacctagcaggctggaagtcatgtgggatagggtcagacctcactacccctacagagtctcgaagaatgatgagaggctttgcttgcttttaacatcacacatcactgttttagcagtctggagtcaaggtactcacaatctgctgtattagtcttgaacacttctcagagaaattgttcaataaaaacacctgtaccaaaagcaatggaatcttttcaagctatacttggtgcaaatacatgcttttaagatgtatgctctctaagaacggcctcattcatctgtttattcattcagctaacgggcagggatgtctctcttaacatcacacaggcacaggcacagcgctaaacactggacatgcagtgtggaacaggacacgttcctgcctccaaaaagcccagagtcggtcagggaaacagcaaggaaacaggcgattacctgcttaacaggaactgtgctggtgaatgtgccttgttccttgtcgtcagttacagcccatttatgataccaagtatactctttgtgcagagaaggcaatggcaccccactccagtactcttgcctggaaaatcccatggacggaggagcctggtaggctgcagtccatggggtcacgaagagtcggacacgactgagcgacttcactttcacttttcactgtcatgcattggagaaggaaatggcagcccactccagtgttcttgcctggagaatcccagggacgggggagcctggtgggctgccgtctacggggtcgtgcagagtcggacacgactgaagtgactgagcagcagcagcatactcttcgtgatggtcaaacaccagtgaaagcgctttgcgagtataaagcaccataccgatgtgagctgtgatcagtattctcagatcacctcacattagctgtgggggaaaaaaaccagcatcggaatattttacccaaatttttatataatgagtatgtttttaatggtcaaaaatataaaacaagcaaaaaa

SEQ ID NO: 30825 - DNA, 1382 bp, Bovine  19866880627811
tagatgtgctttaggggtggtctggctcagattctacacacctctccctcccctccaatgatgggtttcattctacagcctctctttctcccagagtgcatgactttagggaatttcccactttggtaacttggaaatattaattaggcctcctgagggctgagatcatttgtcattttggtggccagagtttcctgatttaagggagattgggcaaagaagagatgttaaaatcttacaaaagcaaatcttgttgctattgtaaatgcatttcttagcttcaaaagacaaaaatcatatgaagataacaagaggcatcaatttaaactacatctttaatagtttactttaagaaagtataatggatagcattagatttcttaataattattctaatgtattctgcataatacatttgatatacagtatgaaccacataaatcaggatttaactgaaatagaaacataggggttatgagatcatagttctcttttcaattcatttggaaaattcatcataaccataaccagttcaagtcttcagaccaagtggtccaaagaccacatggcaatcgagatggacttcttaggatagaaattccaaattcaggataaaaatggcctctatcaccctaaaaagctaaagtacaacagctgtaggagaattttatggaaaggtagccatcaatctagacctcttggtttccttggtgattagcccaggagatcttggatgtttcactctcagttacatagcatcaccttcctggcccatttctaagcaaggtcaagctgtctgggtcaaggtcatctctcttggatcctttctttgcccctttgcatcagtgaagactcttcaagtctgactcccacccagttcattgcaagatgtagatagaattctagatgtaaagaattgctgagaatctacagaatactgggggaacttaggatctggattcaatgcacactgttttattctgcatattccaaagtcttcatttgttctgaaggcttcatcctctgcagtcacagacaggttttctccatgtggaagggacatgggcagttctgcaccccagggatgcactggtccgagtcccagaggagagctcagcaacaataggaaaacccagataaggtctctgagcagtttgtgtcataggtccctcctgaaccagttatcaaggtcagagggatagaagtggtaccgcagataatcctgtggtcccgtccattgcccttcacagtctatagccaagaaagggggtgggagacgggtgatgtgtagacaaatggtagtggctaatatgtactatgtccttaagcatgttctaggcattagtatatttgttttcagtatatgactttgttagtttcat

SEQ ID NO: 30826 - DNA, 3008 bp, Bovine  19866880644736
tttgctattgatctacatctacatatctttaacccactgcatggcagcctttaatttatgcccctaattttatttttttaaagttacctatcacattaatactcacatgacttttatttcaccttattaaagctttctcagccttgtcactactgacatgtttgatccagtaattctttgctgtggggggacggtcctgggcactgcagggtgttttgaagaatccctggcctctaccaactaaatgtagcagcaaatctctctctcagttctaataacccaaaatgtctccagacattgctaaattacacctgttaagaaccactaatcaactagtattatcctataacttttaaatagcattagatgtttgagtttcattctaaacattaatagtaattattaaggttttatttttacctcaattttgaacttttctctgccagtggatgcagtatccaaaactgcattctctcagtatcctaaaccctttagtaggcattgttgagttatgaaaaccataaccaaatagctgcatgagtatgacagtccaggtcatactggaaagtgaaagtcaactccagcatggtccaggcacctgccctgtagttcagtttattgtactggcttatatgatctgatcctagctgtcctcctctgtgtgtgtgtgtgtgtgtgtgtgtgtgtgtgtgtgtgtacacgtgtgacacgtgctcagtcatgtctgactctgcaactccatgaactataacccaccaggctcctctttccatggaattttctaggcaggaatactggagtgggttgccattcccttctccaggggatcttcccaacccagggaacgaacccacgaatcctgcaggtggattctttaccactgtgtcacccaggaagccctcctcctgtgtatgctccccccaaatgcctgcatcaggtaggacccacaggagcctcacgacaaaagcaagcagttgcctaactatgaatgatgccatagctatgcacgtcaagggccacctgggccccaggaagcagtgagttgaacaatactgcctctgtcacctgactgccaaggaagtaaaaacaacctgtatattcaaagcacagacatctgtggcattggggccagccctacatcaggttctgaagtatgcccaggtcatttgggtcacatgcttcatctttcagcaccctccgtcatcacaagtccaacctgtctcctaccccaggggagcttctggggcagcgcccaccatgagtttcctgtactaaaacatcctcttgtttaaatgtactttcctggaccctacttgtagctgatctcccaaactggcctgtagttatcaagatccaaatactaaactgatggctctgagctaggtccacccccacggagcatgtatctctttagtcagcaaggtgttctgttttgtttctttggtgtaactgccaacatttataaacccggaaattttatctcaaaattccagatttccagcttctcttaaggaacttgcctgtgacaccactggcattgaaacagctgcagctgagcctacgacctgtttagacagatcagatcatgtgttcctggtccattcctgagcctgctcccctcaattcttggtgttacctgccctcaccccccaaaggtgtctgagtatgtcatcttctcatttcaatccaagattcacatgccgaatctgtaattatttctggaaaacaggatcagcaagacaaatggaagatgtactaaaattgaaaacaataacttttgaatgctattcatgaacttttcctagacatcattttttccaaacagacaagcatcatgcacctcttatcaaggactatttttaggtgctgtagtcaaatgccagtcccagtttgaagcgctttacaagagttcatctgagtctcacagcagccatttgaaggaggtaccattattgtcctcttaggggagataaggaaactgaggcatagattggttaagaaacgtgttccaatgtcaggatctgtatggcaaagaacttgggtggtctgactgtagactccaagccaagtgtgccttgacttttaactgcctctcaaattgacagttctcacaataactcagaagcaatgagtattaactatcccacctttaaagatgagggaattggcattcatagaaattaaggaagtcttctaaaaatagttgtcaaagtgcttcagagaagagactgtctactctctccaccagtttccatggtcagccttaaacagtggtgctgggcctccactaccatgaaccacccaggccttcctgctccccgcccctccccaccacagaccctaacaagggagtgagtaggggtctgctctgctctgctgcagcccccaagcccagtgcagaatcagcacaggcacaggaaagtgtcaaaaccaccgaagccaagatttgccaaggcaggaggccacacccccagagggtgggacccaccagggtccacgctaagtccactgaacttgccctgcagagcggatcctgttctgttgaggtgaagagaaagctgcagaagtggggtgggctctgggggttggaaactgggacagttggagaaaaactgaaacaaaagttccagagtaatccaccactggttggacagaaagaacaaaacttaaaggattcaggaagtattaacatctcttctccagttggaccaaatctttatcccagtctgtgttctcattgaataccacacatactgacttaaatgaactcctattgcacaacacatggaattgtttcctttcaaaacacacagtggaactgagaagagtcgtagatttcccagcaaacaagtactcagccaaagccctggagtcattctagatccttctgttcctttcacttcccaagttctatccatgttggtccaagcagctcttctccaaaacttatcccaaatgcatcttgtctctatctcaactgctaaaacccttggccaaaccccaatcac

SEQ ID NO: 30827 - DNA, 1345 bp, Bovine  19866880666082
aataagtcccagacttttatcagttcctgcaaagggaacacatctgtttgtttgccttagcttctttgtttgtattcctgtttcctcagtcttagttttgtctgacattgtcatatgggcattagacccaggtaatcaggttaaaatgcagaaaataatagcatgtggtaaagagtacagcactgtatttctcaatttttgtttatgttttctttttcatcaaagagaaggcccacaaagccatacaattggtgcttgtaaatcaaagaacattaccctcgttactattgccaagttattactgcattaggcagactggttaagacagtcaaggggatcaaaatctattttagtcatttgtattatctgtttactacttacttcccaagtagctcagctagtaaagaatccaactgcaatgcaggagaccccggttcaattcctgggtctggaattcaccctggagaagggatagtttactatttatcaataagtaaaagggattgtttactatttatcagtagctcagagacctggtagtatctttgtagatctgatattatcaatagtaaacataaaaacatgtttcatagcaagcagatttctgatagaaggaaaagacagtgctcaagaagaaggctaagcattaaaataattctgttcatgacattctttcttaagaaaagaagtaaacaaccaaagccttgtcttgaaaagcaaagctttattgaagggattcacttgtattttaagacaatatattttaatttttcagtataaattacacatagttaatgaatatggtgtttatctgagtatgtatatagctgaactttttgtttatttatattaaattcagatcctttgacaccttcagaatcaatacaagaattacatgcatcaggtaaatgatttttattttctattacactatctcagcatcaataaccactttgtgtttcgataatattgatgagtatagacacttcatatttccagtttctagatgctaatagtcatatcatctaatcaaatatataaaaatattaaatatcatctaatcaaagtagtcaaaaagttgagtgagcttttcttttatcacaaataattaaacgcttccttagtttgaattttcttataccctattctccagagtttgaactctttttagtttcccaaagcatcagaaagttccttagagtgtaaccatacgtgaaattcccaattatatgtaataacatgcttattcaatgaaactatctttatatgatatttctatcaataagccacagcctggttctaacccttctctcaaaattgagtatcattagaatcatatcagttt

SEQ ID NO: 30828 - DNA, 1234 bp, Bovine  19866880720226
gaggggaacccctcggtccacaggtctgcgcgcccccttcacccccggtgtctggtgcgtcgaaggggaaaaggcgatcggaggtcctctcctgggctaaaacctgggagcctcacctgaacgctatcacagaaacaaatgcacttctcacccacctccctccaccgggcaaaaacccacaaaccgcttgatgggacttcagaaagggctgagggaaccagactggagaaaatgtgggtcattaagacgtgggtcagtggtttctggtatttttctaagatgttcgtggggttctccagccaagattgctttactggttacttccttattgaaatgccttctaagagagcggggtgatttccgcgggaaatccctggggcagcctccagcaatgctcatctgattcccaaatcatatccatagcttcccagaggttcagaagttccagtaggtgtcaccctccagggtggaagtctcaggaagagaaaaaaaataaatctactctggtgggaaagggagacgagtggcaacagccttaaagcaagacttgggttcagcagccacactcttggcttgcctctctggaccggaatcccactttgtggcttccatttttctttttgccaggaaatatcattaggaattaaacggcttcttttaagagtgtcaaagaaagtgttactcttgccagtcacccatgaggaaggagccaagggctacccagagccggttcccacagccaggacttttctttagagccataggtctgaaagttaaacagaacggaagctaattgcctggcagaggactaggcatcggatgcccaagagggtgtcggtgattggagtgtgaaatgagtaggtggccatatcttctctctctctctctctctctctctctctctctctctctctctctctctcaccactcactggctgcagtctgccattacccagagggaattcaaggcttagcagaataagtgggtgccctgattctgatatcagcatggacattttcaaggcaggaaggataaaccatcaaaaagaactctttttttttcccctgaaaagaaggttcaattggagtaagaagtagagatagtaatatcttccagcattcctagagaataatttttactttgaaatgattattcaggatggtggctttgtcattctctgccatgtgcctttaagataactttgttttgctattgattcattttaccaaatct

SEQ ID NO: 30829 - DNA, 4273 bp, Bovine  19866880747289
ccttcccctgtggttgtcatgaggattgaaagagactgtacatgtcaagtacctgccatttaggatgtggtcactatatttctatataattgcattttcaccacttgccaagtagaccatgaagaagatgactcaggaacatccttagcagatactgacaaccttgttttgaagtcataattctactgtgatccctcactggtatacacccagcccactctcctgactttccttaaatgttcatttgcagtgggaagggagacttccccctccttattttcatataataaagtgaaagtgttagtcactcagtcgtgtctgactctttgtgaccctatgaactgtaatccaccaggctcctctgtctatggaattctcaagacaaaaatactgggaggggttgccatttccttctccaggggatcttcccactcagggatcaaacctgggtctcccacattgcagacagactctttaccaactgagttaccagggaagccatttttatataataaacatagtgtaaaagtagtgaaacatacacgtttctctcaatggcacttatatgaaggcagaaaggttggaaaagagaaaaaagaatgaggaaagtgaagcacagtaatgggtgagagacgtctccactaggaggaggctggagaagatgcttgcatttgggaattcgggatgaatttcctgagtgggtgacagccgagaacccaagggatgagaagaagccatgagaactccaggacagagaaacggcaaatgtaaggactctctcatctagtcccctaatttcacagatggggaaactgagactccaaaaagggaagtgactaagcagagtcccagagacagggctggaattctggtcttcagtctcaataggatctgatatttcctataccaaatcccaaattggccaagttgttcaaaatgcatgaaggaacttcaacttagacagtcatgaggaggaaagggtctctcatgatgatatttcctataccaaatcccaaattggccaagttgttcaaaatgcatgaaggaacttcaacttagacagtcatgaggaggaaagggtctctcaagacggtggtgaaggaaagcaatcacagggctcctggaccacatttatcacaacctgtgaagatatcaagggctttaactccatggaatcccatccttagaacattcatccatgaacaagaaaaatctttttttctgagaatcaatgactgaaagaaaaaaaggttcatcattttctgattccagcagtcagattttctgatataaccatttattttcaaataactaaaagtttcagtacgatggcaacataaaaaaaaagaacaaaacaaaaacaataaggaattatcattacatgtcctactcgagttagagtgattttgctttcaaattctctggcgagtagggtgacaccggccttaccctgggacccaactttggtgttctaaccaagacgagaactttcatagactccaatcacaactctgtagtgtatgttatagagtgttttccttaatctcactctacaattaaggtgttagctacagaagcaaacagaatgcaaataagcaagggatttctctaaagtcacttagcaatgactcaatctcattttcatccctaggtggtcttatctttatctttgcctcaagagactctttcaaagagttataataggtctgcactatactagaccctcacacaattgcctttacctgacaatacactgcaaaaatagtctaaacatgtagctatgtgtgtgtgtgcatttctcaaatttcagtgtgcttacaaatcaccagaggatcttgttaaatttcatattctgatccaataggtctagtatggggcgcatttctaacatccaggcgatgccaatgctgttggccctggagcacattctaaggaatgaaggatccatcacagcatcatgatgtcctttgtgaacaattacagaaaagaactgtcttgttttcggaatctcagtccagttaaagctgaccatgtctaagtgccactaagaatgagatgaatttatactttatagatcaagttacccaactgcatgagaaactggaacaggatgtaggctttagcatcagacccctaatgtatttcacaatatgatactatgtgaagaaacttcttttggaattagaaatcttgttctgatgttgatctatttgataataaagtgcttatttgaagattaaaaaaaaaaaacctgaccatgtctagagtgaattattttcttttatctcaacgctctcttaatctcacgtctaatcatgttttcctctttgacttggtcgctaggatgtgcctttagcaagactatggttatatgtttcatatactgatcctacttcactgacctactcctgactacatccccctttcctaacctggctttttgttgttgttgcttatattgattttttcctctttactatattttgggttgttgcggtcttacaccaatctttgtaagacacttagaatcactccttcgaacaagatagcatgtgacaaaagactctcagcacaacctagtcaaatggaaatacgcatcgtcaaggacacacgatacactggaaaatttcaggcccttgcaggactgggtggaatgactgagaatggagaagcagcccgccctgggagagaagaggacttgagaagaagtaaccccaccctctttcacaacttgtttatggctttgccagatagatggcatggggatgactgagttcatattttaaggatttaataactgagctctggttgccttgggagggtcgattattaatacaggtaactggaagagcctctgctgtggcttttagtctcagaggaaaactcatgggaacacctgtggctgctctgcgatgccagagggaaggacagagctcttctttaggctgagctgcccatcagaaggcaaagtcagcgccttgagtcttccaacttagagatgctattggaagcagctacaaaactggttgttatccaggatgcaaaagaggctccatgtcacttaactcagagcaacctattaaccctagtgtctcaatggcctcttgtgtaatctgtaactataatgacttcctcataggatagctctgagaattaaataaaacacataatgctgtgtcaggcattttgtaggttctcaacaaatggtttattatgtaacgtttatgactgctctttttttacgttaggccttagagaagaaggttgtaaagaaaaagacaggtgagaatgtttattcattctttcattttttgacccatgcagaagttctctagagcccactgttgctccttgtgcaatgccctcgagaagtcaaaaacatgagttgatacagtcaataataacattcaaccttgatcttgtcagctaagtttgagttgacttcttcaccaggcaagggactttcctcatttgagactataaacgtgggactggaatttttgctaaagcctgtgatttctgctaaaatgtaaacacgcttgttgtgaagaatcccgtggaaaaaaacgaaaacaaagcaagggtgcagggaatgccaaacaaataggcttgtgctttgcatattgctttcattctagacactgacagtaaaacaagtgtttcattttccttcactatcatttcctgcatcttttcactgactctcactcccagcatgggattttgcagaaactctagtatctcccactcagtttcttaaaacccttcctactctcaactacctaaataccacaaagtttagaggggaggacattcttccttctaagaattcctcctgcccctgtaaacacagttacatattcactgcttctcaatcagagatcttcagtaggtcaaaggttctgcttcttattcaaagctctctaaaatatcaaaaggagtatcactggggaacagaggaagttaggaagcctcaaatccaagtttggatatggaatttgggagattactgaattaatgttgtccattctttaccacttggcctttctggctgggtggggagggaaaaaaacatactgattaagtacaatctcttctggcaggatgtttcctctttaaaagaagttaataaatttggatacaattcaagcacaaggtgcaaagaaatttctgtgtaacaacagaataaaggtcctaaagaatacatgtgaacaaagtgacatgttcccatcgaggaaccacgtaaaaggctttaagcaagaactgaccaaat

SEQ ID NO: 30830 - DNA, 1948 bp, Bovine  19866880896894
ccttgatttttgttctataggactccaaattggaaaaaaaaatcagaaagtatttcaagcaagaaagacatatagatgaaagcattcatctaatcatggtagtcctgacttctcatcataaatgaacccgtgacttaattaacacgtagagtatctcacagccactatcacacaggcctgaagagaatcaggctttgtataatgtaccttaagaaatctggcaacgctgtggtttgccctttttgtttcttcaagtgcgtctttgtttttccaaatcatgtggtcagcgaagctcatgacaagattgtccaattcattttgaaaagattcaggaaatctttgaggccgagaaagctaaagaaagaatggatcattgctttacaatgagatctgtgaaatactaagcctggaaaacataacctgtaagacttaacttcattctatttattatcaaacaaaaagtctttttggaaatttgaaagcaataatgaaattagaagccatttcaatttcaaggtcatgatttccacttttcagtgaatttttcttctattttggccaataaagctttcactttttcattataaattataacatatatgaattgcaaactattcagacaacatagaaatgtaacattttttataacctcttaataccccttcttgccttctcaggaaataactactatgaatagtttaatgactattattctagattttctttgattcacagttttctaatttaaaaatcaattattttgatttttaaaactattaataacaatcctccaataaacaactataagaaatcaatgaatgaataactgaatgagtacagatattagtttgaaatgtcctctaagttgtgagtaccagctagcttttttataaaagttatttcagttttataagagacataactgacatacaaaattataacatatttaaaccatacactctggtgttttcatgcacataataaattgtgaaagaatccccaccccttatctagttaattaagccatccatcagctcacatacatatttttggggcgagaacatttaagttctactctcctagcaaatttcaattatacaatacagtgctatcaactataatcaccatgttttccattagacgctcaaacgttattcatcttatagatggaagtctataccggctggtcttaactctggtattagcatatgcccatgacagttgtcagtgagacttcactgtcaaaacgcttttgccataagataaaaaatggtttggctgtgacattacacaactacactgagtagttgtgtacacagttacacaattacactcactacactgagtaaaactctacaggcccctaaagagtgcccttgggtacagaaatctacccctcctattttaactcggaaaatttcaggcagctgagttttcccatttctgtcactgctttgtgaatttatacaatttctttgcacaagataggtaagattcattcacctttagaagatggctttaaaattagacttgcaatttcactatagacagaaacagacaattgagagtttgactaacctttattttcttaatctaagcactcaaccttccatggtgcaagaataaaaaccatggaggctaaaattagagaaactgcagagcacaaatactgattaactacagaatgctgcagttggcttcgactggcttttttttagccatttttaccaggaaatgactgtcactttaagaatctcatggttactctctgtatatattcaaagtttactattgaaataaaattaaattgacaacaaataaacctaatggatttaactgtatacatcatttttcattctgctccatatcccttgagaaataagggtaaatgattcacctgttaaaacaacaatcaggttttagaaatcaaagcacaattgtcgttttc

SEQ ID NO: 30831 - DNA, 1545 bp, Bovine  19866880928199
tagttatgtttatgttgagtccatatctctgactgagctagattcacaaggaattaggcacgagtccaacatatggatggcagatacgctcgtaatcgacacccatgtcttcagggcttcagtttgttggtttagatttgtcaattggtcacatcgcttgactgaaagcatgggaacttacctaaattatacttatattttggctgccgatcctcatcataatgatcgtgaaatcagtagaccatgctttgcagaatgagagctgaacattaaacactttcagtcttttttccactctcacattccaccctgatacgcaagccagagctcatggttgtgtttgctaaggcgctctcagagatgagaggacgaaaccctccacttcagaatggaagatctggcagcagaagaatgtggatcaagcctctgtgtttgacagaaaatagtaggcattgaacagctggagccaaatggaagccaggagagagtagacgccaggagtagcaaaaatgggtttaaagaagaaaaccaggcaggagcatgggacactgaagtggggttggcttgaggatttgtatcgcagccaggaaaaaaaattaaaccacactctcttgagctttgaagttgccaaccctcaaattcacagttgtcttcttttttgttaaccatgagactctgctctagttcttggaaacccagagcgtgtattagttggggagtgtggtatttctccacatccattcaggaaactaccacatcgtgtggtcagggtgacagcctttgctcattcaaaatcccacacaccggaacagaggtcctgagggtatggagggttgcacaggcacaaaacctaatcagcaacatgtcagatgattggtctccactgtggcccaaccggtaggactatttcctgtcttagattattacttaagtgctcttaacagttcaaaagggaaggtttagaaaatggcagccactcagaattacattgttgctaatgggtagcagagctttacatacatttacatgagaacttggaaagacctagaattcccccagtttctgctgcaacttggtgctcttccgtgaaaccagctgaatccactgacctagggaaagaatgatggttaagatgaaatatacattgctcacttcacaggcccctgattcagtcctgcaaggaatagcagcttactccacaccagtccccggctctgtgcttctcccctccagctgctcagacccagagataaacagtttagtccccatgatcgctatgacacacagaagagaatagaggagactgagtgttttgttaaaaatcatggttatcaaaaagtcttcctcatacactgtttttcttggaaaatgtctgaatccagcacttggaaagcaagttgtcacctctgtaaaatattcctcaaaccttactttgtgtagaagattcagtcgaacatgagatgcggcatagctctcacctaggggccaccccaccatgaccgtgagtgcattattccaacagagtagctaaggaggaggggcccg

SEQ ID NO: 30832 - DNA, 1614 bp, Bovine  19866880928459
cttaaagatcaacatttagaaaacgaagatcatggcatctggtcccatcacttcatggcaaatagatggggaaacagtggaaacagtgtcagactttatttttgggggctccaaaatcactgcaaatggtggtgattgcagccatgaaattaaaagatgcttactccttggaaggaaagttacaaccaaccctagacagcatattgaaaagcagagacagtactttgccaacaaaggtctgtctagtcaaggctatgattttcccggtggtcatgtatggatgtgagagttggactgtgaagaaagctgagtgccgaagaattgatgcttttgaattgtggtgttggagaagactcttgagagtcccttggactgcaaggagatccaaccagtccattgtaagcatcactgacttgatggacatgcatgagtttgagtgaactccgggagttggtgatggacagggaggcctggcgtgctgtgattcatggggtcgcaagagtcggacacaactgagcgactgaactgaactgattctgctaacctgaaatggtttaatgttcttactgatagtgtacaaaatacttattgcctgactatatgcatcatactgaatacatgatctacaactgtggtacgttaactgctctcctccctagacttggacaaaaatagcattcatgagataccaggtgataatcaaggctataaggcaggcaaagataaaaccctgtaatgcttattcaaaatatgtacttaaaaactgcaaacaaaaacagcattatttggaatgaacatacaattattttctagaactgggaactaaatacttagaaagctgagatcatgcaaactagtctcctagggatgcagacgtaattgtaagatcactgcctgtcacctaagtctttcctgctacccaatgtacattctggcgggtggagcatcatcagtgctttgctgacaagatttttgccaagagaatacaccagcatctttgggggtggtggtgataccggtctatgtttacagtgctacatgggtgattttagtatattctttagcaagaaatacatccctctcccacccccttttaaaattcactgacataagaaccttacaatcacaaccacagtttattttgtgaggctgtgtgttccctaattgcaatgagttttcaatctttaaataatataactatataacaattcaaaataaacactgtcctggattcaaaaatgatagcagagaattacaattaaacaagtgaacaaagagtacatcatttttgcagttgaaaaactatgtatccatcctccttaaaattcttcaagtaagtcaccaatatctattcacatcaacaggattaaatgaatggttaggatcattgtttgagattaagacattaaaaaacaaagaagaaaaacagcatgaatgacctctcctgaaaagaaagcaacgtcaaaatgtatcactatgagctttatgaactaaaataaagctaatgcactaaaacatttaaaacacgttgggtgatccaattttgtttttcagtacagcatcatttttctgaccattcaactcaactgcaattgactgaaatgcaactgaatg

SEQ ID NO: 30833 - DNA, 1706 bp, Bovine  19866881059530
tgctcagctctttgaaaagtaagcttttttgtatataagaaatatgggtagagtgaaatttactttttcgaaaataattctgtgaaaatgaaaatattgtaaagttttccccgaggacttctggcccctcctgtgtaaatgagtacaatttaagatgcttctttaagcattttcaaataaattcttaagaaataatgctgtaggcttcagagttaagtatactacatgggagttttagggaagccatgtaaatgcttaagaattatggagcacctgctaaattacagttctgagactaagatctctcgagggtaaaaaagtaattaagccactggctctgtacctgagaagatagcgcagcaagacggcatttggcctgtgctaaataagtgaatacaatctaaagagaaataaggtaattaccacgagagaaacacaaagaaactgccttgaggtttcaacaggggcaataaagaaggcgggaacccatcctagaagagctagattatagactatataaagcagaggtccctaaccttttgggcatcagagaccagtttcgtagaaaacagttgttccaccgactagggcgatacgggcaatagggagcggctgtaaatacaaatgaagctttgctctctcacccactgttcccctcctgctgtgcagcctggttcccaacaggccatggactggtactggtccatgacctgggagttgagaacccctgatatatggcatcgtattgggagatgaggacagataagcaaactaccgaccagtcgtgtctaaacattgaccttgccatcaaaggtgcttaacagtggctgttgtggcacatgcagtcagtaaacatttacttaatattttctacatgccaagctctgcccctgcccctacacaacatgaaatttggtcactttcggcattctgaccagatcgcacactgtgaagttaaagcccttggcattgaatagttctattcttctatgcacttaaaaggttgaatgattatgttttggggaaaatatacattaccagatcctcaatataattgtgtcttagagtcaacctaataattattaatatatttcaagcaattaaaatctaattaataagagttgtcttctacaaaattagtatctcttatctgacatagtgatgttaacataacccaccaaagagaagcatttttgctgtggtcatctacagtagaagtaacttggcagtataagtggataggacagtcccatctctacccttagccattctgcattcatccttctcctagtcttgggctcatgaaatgtgagttctttgaacattgctcatcccttctaagggagaagaaaagaagaaaaattaatgaagagaagagggttctgcttttttggagtgcatgttgctgaaaggaaaatgtaaagttgaacttgttgatgatatccaagaccagtaatcatattttcctagaaatatttaaagcccaagatttaaacctatgaaataataaaaccaggttttattcctggtcccttgttttcctgtgcttctttaagtcctcaagaaggaattagtggtgaattgggtggtgtctatttcaaaaagttttgttgaaaaattaagctatgttgaagaatgatttgtatttagaaaattaaatgtcgactggttatcaaatagcttttcattttatagcaacttatcat

SEQ ID NO: 30834 - DNA, 2085 bp, Bovine  19866881135553
gagcctggtgggctgctgtctatggggttgcatagagttggacacgactgaagtgacttagcagcagcagcagcagtattactaagtagggcttctgtggtggctcagcggtaaagaattcacttgcccagtgcaggagatgtagatttaatctctgggtcgagaagattccctggagaaggaaatggcagcccactccaatattcttgcctgagaaatcccacggacagaggaggctagccgggctacagtccatgggactgcaaagagtcaaactcgacttagttactaaacaacaacaacagttactactaagtaaattctagaggattgtagaagcctcagttagggaggacagctacttcttcaaacagctgcacattgttaaaactcccttggaaaaagcagagagcgcaggctcaagctgagaccacagagaagtaaacgaattgtagctgaacagctttgccctggtgttctgcagaagacactgtgcttctctgaagctttactgcctggacttggcaaaccctactttcattttaccgctccaactttctgcctctttttaattgtagtttgtatcaatagatctgtgtgcttgcgtgtgtctatggctctgttttgcagtcaaagaaacttccccacactgtgttgtctttaaacattcagcgtcattatatccatatatgcacagttgatttacatgtctgaatccatgtagctgtatagccagatatggatagtatgtcagttagctagtagccagcgttttaaatggagcctggtgtgtctggaaaatgaaatctacttccttatttagccatttaagactggatctgttatttcagaaccttgtgatgataaagccaatgacaataaaatttttgagatagaaatcttagccgatattctcatcaccgactcaatggacatgagtttgagcaaactccaggggatggtgaaggacagggaagcctggtgggctacagtccatggggtcacaaaaaatcagacatgactgagcaactgaacaacaaaattctcatttcatctcttacattatagcaataaatgtcgatttatcactattttacgaagaataccaaaaatgcaatagcaaagggatgtgtcagtcccaaacagattaaaagaagtaacatgctgaagacctcataaggaagtggaaaattgagactaggggctgattggctgtgtagacctgcacttcataccttccaaagcacagccatttctggcagagaagggcttactgagccccagtacttgccctgacttggattattttgtgcttagactttgtgcttatgctttgtggtttaacgaatccagagtttaaactattcttagttcctagaggttattttctgatgctcttctttaaataccacatgggaataattttagtcagtgaaactagacataccattttctgttagctttgtccttgccatttttgtttctcacgtgatcaatttcccagccaatgctcccttttatgtgcttgattgtggccataatttaacattgttttacttttccagtggttatctgtctccacattgaaaggtgcagacttacatcaacccattgaaattcagctagtgatttctatgtaggtgtttcttcaaaataatgactagaaagctccggtggcagaagggtaaaagtcagggcagaataaagtctatcagttttttctcttttatattgttttatttcctataaataagtatataccatgtgagcaaggtaaatcatgtatatctgtataaaatgaaacagtgaaaatacttgagggatcttactcaaacctcttgctcacatttccacatttctctcatgcccctacacataatcatcattgttaataacatctacatatatgtggttttcctttttttgcaaaagtaataagatgtttagtatgtggtacaccaagagatctttgcagtcacaaaggtaagcatgattatgacccagaacatgaggacacagagtcagtttttggtctaatttctcattgcaatttggccagggggcctgtgatagtcactgatataa

SEQ ID NO: 30835 - DNA, 1235 bp, Bovine  19866881163170
aaaagccctggggacagctggggaccagtgttccaaggcagcgatgtgcctggaatgtttatggaactaatgcttaggccagtgtgattggggcagggcagagggatagagcaagggagtcatagcagatgaaatcagagaggagccacttcaatagcctctagcatgccgggcacacaaatgcttactgaaattcattgaaatacaaatagaagtagtagatcaaaacaactgactagtaaacatgtcataaaatttaaatacatataataattctgtatgaatgaaaaagaaataatactttctccagtaactcccacatacagccttggatcaatcaacctgatcatcctatttacaaagataagcaaaaaagcatcatgtatgtagaaaacataagtaagcaaatgtgcaaggaaaattaccaccatgaaaaattatctaatcattttgaacctattgcaaaagagcatttacgcttaagcatgagttgaatttccaaatggatacggagtgcatacctttcattcccaatgaaaaaacctcttcaggaaataggtcatgaaagctgttatctattgcatgttcttctcattcaagattaatgtttgacctgtatcttcttacattcccaaaatagccctcagcagcatttgcctgagcaaacactctaaaaccaaataacagcaaaaatgatcataagaaaacctaccaagaagtaattatatcatccttgacattatcttaagggattaaggtataattatcgacatctcatttaaataatctcatggcaattcatatgatttcctatattatttaagttttgacacctaatcaaaaggtgttgaaattaataatttaccccaaaggtacaaaactatgatatagcctacagaaaagacaaggaataactcttatgtgcccattttgatatgctcatgacagttggcgatcctatgaaacatccgataccagaaatagcaacagagaaaaaacttgagtggctgctcggatggtgagttcatgagagaaacaagaaattctgttccttgccggaaattttcagagtatcttctgtagacccaaagcaatattccagaactgtggattgatatgaaatgaaagatacaaagaaaagctctgttctgaaaaacaaaacccaggatgaataagtcatgggagatcctttacctcccttgatagcctaactccccaggtgctgaaagatggca

SEQ ID NO: 30836 - DNA, 1046 bp, Bovine  19866881174918
tcactggcataaattcacaggccaactgaaaaatgagaatataaacatgtcccaagtgaacatctgacgaaggccactggaggaagcagtgcacactgatgggatgggctagtggttcatgccggaggagaaaggacttaaccataccagaagcaggtacaaatatacagtaactgggaaaatgaaataatgcctgagaaaacaataaaaagagctaagaaaacattacagaagaaacagcacattcaacaaaccaacaggaggcatcttccttaaatttacagaggaatttcatatatttctaatgttgatttcaaaagaccatactttcgttttctcctgcacttctttctttgctttttctccccatataaatattcatttgcacatgtatgcattatttatatattgaaataatacattaagcccattaatgcaaaaaagaaggagttctaggtcactaaagggaaagttcagtatgactggggtgggcaccattcagctaaagaggggaactcctcacttattgcagacaggaaatgagacaagccacacagcacaaggggatacaaccaacgcccacgtggcaatttcataccttaatgtaggactggacagagtggtccagctgttcctcatggcacttggccacgatgtcggtcagaaccctggaagagcaaagctgttgagtggcctttctggagaaggcaggaaaataccacttggtttgtcactgaagtgcttggtgagctgggcacttaatcattactgaatgaatgaatgaaccaatttcaaactcagtaccgggtgttcagtatctataacatccattagccatttccaaccttgaaatttctaaacacgaagataaaagtaatgtcttatggctgctattacagtttgtgtctgctgacaatgtctttttggaaaaggaattgattttagtatcttattagaacttaagatctttaacctctaagtatcacattctgtttttaaagagcttgtcttccaacttagaggtgttatatatgtgcttttggaaa

SEQ ID NO: 30837 - DNA, 688 bp, Bovine  19866881205249
tgaaaatatggggcatctgaatcctctatccatccctgccctcctcccttccttttcagtaaagggtgacgtctctagtctggtttgtaaacaggtttttaaaggatttgttgcatttgatgcggcattagtcgccacatcttctacttgcattatgttgctgaaaattatattaagtgtctgatatttattaccacattcccctctcattgttttacagtcaagaaaggatagtctgagctgttattattcaattatatctgtggaaatccttctgaattaggagttggactgcacaatttcttgaagtcaaaatataatctctagccctacacagacattaacatcaaaatcattttccattcctatgagccagacatactgtaacatattacaggcagtgtagttctcactggctccttgaagctggaaccttgaattaaagggaaactaatggcatccggtcccatcacttcatgggaaatagatggggaaacagtggaaacagggtcagactatttttgggggctccaaaatgactgcagatggtgactgcagtcatgaaattaaaagacgcttactccttggaagaaaagttatgaccaacctagatagcatgttgaaaagcagagacattactttgccaacaaaggtccgtctagtcaaggctatggtttttcctgggtca

SEQ ID NO: 30838 - DNA, 999 bp, Bovine  19866881339321
gaagctgtgatcttgaaaagaagcagaatttacctgggagaagcaggaaggaccttctaagacaaggaccagcacatgcaaaggccctgtggtatgcagggccatggtggaatgaagggtttgttcatgtagctgctggtgccatgtgctaagacaggaaattctgcaggaagagcaggtttagctggatgtggccaggaagttttcatatatgagtttcagaagacgtcatatgatacagaatgttattagcaacccaggaaagaagaaagtcctgacagtatcagacaaataataataacgctaatacttattgaatatttactgtgtgccaggcactgttctaaatattggatctattaactaacttaaacatcacaacaactttatgaggtaggtactatgcttatttccattttatagatgagaacatcgagaaacagatggaaaaacataaaagcacagaagttttggtcatatgatacctgaatatgtaaaggcaaaataacttttaattatttgatgttttcattttctgttacaatagtaataattttacagaaaatttgaggttctccaaactggggactatgtactgaaacctgagcatttcaaaaacgtttgctacagaaagttgttcactgttagctgaatatatgtggcaaattttccacacaatgcacttgatttctgttcccctagtggaaaaatgttagctatttgtcaataatttgggttacaggtaaactagaattaataagctatagcaatattttcttactagaagcttaagaaacaatcccaaagaaataaaacaaaacaatgacaaaaaatcctgccagcctttgcaaaagggatcataagcgttatgaactctcatctgtgtgttagacaggtacacagccaacttaagtacttgcattcatgaagtgacacatctatgaattagtaaggatgacgccagctgactgggaaccataaacaattgttaaacatttt

SEQ ID NO: 30839 - DNA, 1315 bp, Bovine  19866881355195
gaatctttattctaatttgagtattttaacagaattaattctgtatctgaatgtcttcatcagcaacaaaactattcatcctggctagtgacccagaaaaagaaatgaaaatagcatttacttcaggaccaatacagaagcctctcgtagggcatgagatgcaaattaacattgtcttcacattctgacacatagacaaatagctaagggtgaggatccacagggtctttagacagacctcgaaaaaaaaaagaaagaaaccaatctccatgtcgccaaaacaaactagaaacaacacagctgttaattaatttcagtgttatcaagataactgattacatttcttaaaggaaataaaagatctaaatgacacacagatttgttagatcttaagttcatcaggaccctttggcctttgtgtaactggaatgggaccaacttccacactatttgtgtttaaaacaaacaagaaaattgcagagagcccgtacagctggatccatggccacagctgccagcctgtggttgtgtgacagatttacttcagcctttcatcaaagggagttccactagacaacctctcaaatgtttgagtttcagaaagcaagaccagctcttcttatggaaaaggaaatgattaagtaaggaataagccatcttatgctgaccctttaaccttttctctgtcttcaagtgcacagtttcgtgagaatggaaaaacaccagctaactcaaagttaagaactgtacagctgggtaaactcagattaagctgaatttggaaatggttcccttggtaacaaaaatggacagcgatctcggaagaaatcagccaggagtaactctttaaatgtcctagtccatttcagtgaaataaagcaggttaaacttgttggcaaataggatgattaattataattttctgtgttagttttttatagttagaaaaatcaggatattctatttcctgcttagttgctcagttgtgtccgactctttgagaccccatggactgcagcctgccaagctcctctgtccatggggattctctaggcaaggatactggagtgggttgccatgccctcctccagggtatcttcccaacccagggactgaatccaggtctcctacatttcaggtggtttctttattgtctgagctaccaggaagtcctgcagttagaaagtcaggatgttctattttattaattcataaattcattaggaaaatcaaggaactgaagagatttataggatctatgatggaaggtatactttcaaatgaatttaaatcttctcagtctattttttttaag

SEQ ID NO: 30840 - DNA, 1845 bp, Bovine  19866881361443
ttagctagattttaactgaaaagcagacatttatttttagaagaaaccatccctaaagcttttgtttaatatatctttaagaagcaaatcaaccattaatcttttttattttttgtgtattttttaatgctgacattttgttcttttttctgtttgataacatgtttgtctgtctttttttgaaggggcttttggttagcatttatttctaatgtatgtgaagaaaaaaatgtcgaacatagtctaaaatgactgagaacttgtacccgttttgttaagtcatattctaagttacaacagcatgaggacaactcgagataaataactgtacagtgtgctttccaattaaaattgttctaaatcctcatgttataaatcggttgcttatgggaaattgagcactttcgttaaagttgttctgaaagtctttctcgctacttctgttgcatgtttcacgtgaatctttaatgtgtttttactatcaagtggtttaacttcttttgacagaggcgcaataagaaatgcttgccagatgttaatgatattaggtctcgaaggacgatcagtctatgaagaagattttgaggctccttttttggaaatgtctgcagagttttttcaggtaatcagttataagatacaaatatcttatgtatttatttgtataagatataaatacatacttttaagatgttcttaagattaccaaatatagttactaatttaaacactttgacctttatgtcctgaggcccattggggaaaagaatgcaaattttatacccttcagcacaccaaccctacatgctcacattccagtgaaggagcttattggaaataaatcgaagaggttggacttagacatatgattttttttaatttatttttaaattgaaggataattgctttataggatttcattgttttatgattttttgaaattatatgcattttcctaatggtccagtggttgggactttgccttccagtgcagggatgtgggttcagtcactggtcaggcagctgatatcccacgtgcctctctgccaaaaaacaaaatgtaaaacagaaacagtgttgtaacgaatttaattaaatctttaaaaatggtctccatcaaaaagaaaaatctttaacaaattttatgtttatatgtttctaaaacatagaaactaaggaataaccttaagttttataatatttatatgttactgtaatttgccataaattcacaggcagtacatcaccaatgaagtctcattattcaggcttttggtaatttactagtaaatatagataagataataggtatgatcccgtagtgcatctatatgtcttaaaagctattgatgaggaaattataagatacaaatttgcagctgtatctacaaccccaaaccaactgaatggccaaaagtaaggataaactagtactgatttgtaatgaaataacaatgactgagtactgtgacagacaagacagtctttatagagtcatggtaattgggcattcttcctgaaagcctcaaccatctgagcagtttatagtaggagctttgtagtactgctaaagtagactcagttaaaactttactattcaatttcagtaataaactttttaaaaataagcagaaagttacaattactctacagtaggtcatttttaagagccgttcagatcagttgctcagtcgtgtccgactctgcgacctcatgaaccgtagcacactaggcttccctgtccgtcaccaactcccggagttaccccaactcatgtgcatcgagtcggtgatgccatccagccatctcatcctctgtcgtccccttctcctgctgctgccgcca

SEQ ID NO: 30841 - DNA, 1916 bp, Bovine  19866881390838
gagcctggcaggctacagtgcatgggatcgcaagagtccgatgcgatttagtgctatctttcctatctttctaggagggtgggaagctggtgtcaggcggtaatgcaagcaaagaagagcgatgcggagaggcagatgaagcttggctcacccgccactcacctcttgctgtgcggcctgcttcctaagtagctgagaactggtactggtgcacggcctgggggttgaggatccctgctttatatgcaatgaagggaaattgccacttaaaaaaaaaataggactcctatttaggaagtatttattaaatggtactcactgttttgccagttaaggttagaggttatcctttcttgcacccgtggaccaaagtgcatgcattggcttgtgttctagttccagttaaaccatattaaactgggagacccgaggcaatccacccattttccttagccttatattctcaatctaaaaaatcaggagggacttccgtggtggtctagtggttaagaatctgcctttccgcacaggggattcaggttcgatacctggccggggaaatgagactcacatgcctcgaggcaattaagccgggatgccacaactgctgagcatgcgctctagcttccatgtgccgcagctaagacccgatgcggccaattaagtaaattaagaaaaaaaagtcaggggatccaactagacttctaagctcccatctagctgttgagcttgatgacctcatgacgttaatagtaactttaattttcccatagtgtctctcgcctcctcccataaataacctcttccaacaggcgcttgcctctgaatgtgttggaagcctctgtaatggtttgggagccatgagtcaagatgtcctagttcttacccttcaagtatgactttgctaaacaggtaatttcttgtctagttttacccacagtaagtttcccacatatggtaactactcatctttttaattgaaaccagtgaacctaaatatatttatgttaaaatgtgggttatcaagagggttgcctagaattgattacactaaaaaatatgtggaccaagcaaacaagctgggactgaagagtaccagctgaaaatgcagcatacacagtgtctgagctaaaaaaaaaaaaatcaaccctgcgctagcgcacacgtaggttcttttcctcactaatccccacagcgaccaagggtagagccagcccatttggggaaggagctgctgctgctgctgctgctaagtcgtttcagtcgtgtctgactctctgcgaccccacagacggcaggccaccaggctcccccgtccctgcgattctccaggcaagaacactggagtgggttgccatttccttctcccaaatgcatgaaagtgaaaagtgaaagggaagtcgctcagtcgtgtgtccgactcctagcgaccccatggactgcagcccagcaggctcctccatccatgggattttccaggcaagagtactggagtggggtgccattgccttctcccgggggaaggagcaaagaaacttaattctgagcataaaagagcaacgattccaaaacaggtcttccccatcctcagaccagttttcttccctgtgttgcaactcagccttttaaattgtgtatttgagcagtattattgtttatacttagattgtgtgtgattcaagatctgttctcatttttctcctgcgttatgctacagaatagataccacagacacatttagaaaccttttcagaatgattcatattgggagaaaaatccagccacatgatatttgtatcaggtagccatagaaactgcaacttcaatcagtctctcataaaagttcttttgtgaagttgaatagacacaaattcctgcttcgtggtttaaaaacccatcgggttattaatgtgtac

SEQ ID NO: 30842 - DNA, 1516 bp, Bovine  19866881428389
tcataatctcttctagtgaaactgttttcagtcttgtcaactctggaactgttacagagtaaacgaggtactgaagctggtcatttgttctgcaacaataggaaactaacacacagggaggtttggaatatcccctgtgctgggtcagccacctaagtgggtcatctgtaattgtgaggggataatttaagtaagttggcacaaagtttgtatagtgacggcagtcagtagccttcatactttctttggagggacttagcaatctcagagaagaatattcaaaagctaaggaaaacctacgaattcagtttggcttattgggtacggggaataattctaagatcgtagcattgttaaaattgttggttgtcaatctatgctattttaagaagcgggcaattgaatcacaagttcccaggaaacaagtgttccatgttagagatcagtagacatgaagttctagttgaagtgaggagctgttgaaatgtacacagggagaggtgggaggaaaaagaggacctttaatacaagagatatttgaggtcttataatgatgaagctgaaagtctgtccatctcaatatgtgggtgaagggattcctgataagatgggagatgaaaatttaggcctctgtaaggagtgtgtcaaattggtcattattatgaaaattacagttatcagaggtgatatcaaggaaccaagttgagagataatataagctgtttgctaaagctaccaaggatttgtatgtccttggataccagaaagataggatgagaacatggagatcacagaatttgagagtctgccttttcttttgtagattttggtactttttagatccaaaaaaatatttcttctttactgtattctagattgagcactgagaaaagtttgaaaacagctgtattctagaggagcacagataggttgtttaaagtcttcttggtactttctctgctttcaaaatgatatcttagaggaaaataggatgtggcttttgggctgttaagcttcacactttttaattttttttttttctttaacttactccttttgcaagaagggcctgtacaagacgggctccccatatgtgctctagtttttgcatttgtgactgatagtataataccttggtgtctttttatggttagttcagaagccgagtactgggcatttatgtaaaataaaaccagggcaacatcataagtactgtaaaggttaagcatattgggcttgatagtttggatttccttccttgccatccatttaagttcccctttcagcaaattaacaaggaaatattgggcttgatagtttggatttccttccttgctatccatttaagttcccctttcagcaaattaacagaaccataaacacttttgattacttatgccctgtgaactgtttttttgtgtgtgcagtgatgatgtagcaatccatgacattgagtttagggagggaggctgctgctgttgctacgtcactgcattcgtgtccgactctctgcaac

SEQ ID NO: 30843 - DNA, 1271 bp, Bovine  19866881692574
taatgggaacagaggaatttcatgatagcataacccagatactgaacacttagcaagcaatttaatttaatttttttaattgctcagaggctgcatagagacactgctacagccactgtgcacacatcaacattaatattcagtgacaacataaagtaatgacttccacttcttgtttaggtcctttgacaactcccattgacccaactttgggtattttgtgtgtcttagtgaacatctttttatttttctcttttcaaattatggaagtatgataacacatttatgggagacttggaaaatacagaacaagtttatttccactatgttccaatatatttccactatatattataattattttttaaagtagataaattaagaattttaaattggagtttcaatatcaaactctcaaaaattaatagaatgaacatgcagagaagtagaaggatgtagtagacccgaaaagcactgtgaaccaattcaacgtaattaagatctatacaattttcacacaacagtaggaaactacttcttattcaagttcccataggctgtaaactaggagaccctggaacagattcagggacataaaacaaggtgcaaaaattccacagcccaaagctattgaaaccatacagagtctgttctcttatcactatggaattatattagaaatcaatatcaaaagatatttgacaataacccacatattttcaagtgcagtgcaacgtttactaagagagatcttggacttagctattgaaagcccttagtgagcatcttctcagagctctttgtgggggggaaactgacccaaccacatctcagtattcccacatgttggaaatcaactgtgtcttaaatttcaccaccttgagtatcctattctataatagtacttagctggtttggtgagtatttcaaagaacttgaatctttggagtgtgaagatgtgttcatgggtaacaggaaacccactgtctttctcttgtccctaaagaaagcagaataaaggagagagaaataaaaatttagtgaggctttacacaaagcatttactatttctacaaacatgtactatttttccaagtaccaaataatgcctaaagagttaaacattcaacttacatataccatactattttttttgtttagttgctcaagaaaacaatttggaatgcaagaaaatatattgtaactggcctttttgattaaaccagtgggatagtgctgataaaactaaaacttaaaactttttgaggaaa

SEQ ID NO: 30844 - DNA, 1239 bp, Bovine  19866881845470
tgctgtcctcagagggagggccgactccttccacaccctcccacacacttccccgggtgctgaagaaggaggtccataaaaccgcctgtgacctgcactgacagagagggtctaaggtcaaagacagtcgaccgagagcaggaatgaaagacagatgtgcgtcccatgacagtatcataccttcaaaacaccacaggaacagaatagaccctcaggaaagaatagaagtgctcagagcagatctaaagtagctgagtggggcaggatgcaaacaaatctcagtgttttcttgaaaacaaacaaatgaaagaatctgcttgactaatctgatgctgtaaataatggggaagggtagatgcaaagccgcgtaaaatgcttgtattaggtccaaattaaaagtggattgagctgcaacttgctttcaaatggagatgtcaaggaactaataaaaaattacaaaaattgattttctaaattgccttctgtatgtgaattaaatatggctgacaacgtcaacaatattacatattttaaaaaatctgagcaaaatataataagctcttgtttctcaaaaaggggtatttataaatgaaataaatattctattcacaatttctctcaaaagccaaattatctttttctccttggagtgaaagagaactactttcagtgcagagaagcttatgctggggaagattaagatgccttaagtggttttctatctcaccctctgtaatcttcaagataatggcatataaaacagcaaaaaagaaaggaccagaagtagaaaaccaatgggacattttaataaccgtgaaatgcaatgttaagtcattaaaatgataatcaagaagtaatcgtattcttcttctcactcctcaaatcttcctttattttcctgaaatcagtatccctggtgactgatacagtttctttgttcattcaagctcaccacagtctatctacatgacttcataaataaaaggaaactggaaatatgtcctaatgccatctgatgtgcttaatgagttgtggcaaatggattgcttttcacactgctcacctagaaaagctttgaaatagatacttcaatgaaaccactaaagccaatggaggatggaatattgaagggagttatccaagcaaaatatgccactgtacctgttctgttgctggcatctttgacagaattttgaagaaacaggagaagagccacacaacatcaaattcaggttagtg

SEQ ID NO: 30845 - DNA, 971 bp, Bovine  19866882121702
ttgagagtatcttcttagcaccaaggtccctttggccgcaagtggcaaggggtgaaccctttccttaaagatcctgttgtttttggaagcagctgaccctgagaaagaggttgacaagcatgatggtggctggtgggtctgaagattccttggaaatctgcttgcaaaagatggcctgggttcagaactgaccatggtgaatccggtgtcaacatttgtctctgcctccagcttctcgaagctgttttcccggccgaggaccttcattctggccccgggttcgaggtgaagagaagacagttgcggttgggattccgtggctgggctgctgggctgagctgagccaccagcgcttttccaccaagtgttactggaaccgtctgacactggccgcccaccaggctcaggcagctccacggagctcaccttgaacctcctgccccgaatccttcgactcctcaactctagggtcctgattgcagagacaggggtcagcctggagccatggggaagagtgtcagctcccaaggtgccattcagaaaaggaggctcaccattcctcacaccaagtcctggattcaactggacctacgggacaaggagaagagttaatgttttccattaagtaagtgccaagaacagcttccctggtggctcagaggttaaagcgtctgcctgcaatgaaggagacctgggttcgatccctgggttgggaagatcccctggagaaggaaatggcaactcaatccagttttcttgcctggagaatcccatggatggaggagcctggtggactacagtccatggggtcgcaaagagtcggacacgactgagtgacttcacttcactttcaaagaacagattacatcatactcaggcttctgccatgctgtgctcatgcagactttcaataaagtcagttgaactgaatagaagtaagaggtacagtccttcaacaggatagctgccac

SEQ ID NO: 30846 - DNA, 980 bp, Bovine  19866880579568
tgggctgaaggacagacccatgggcccccagacagaaagcagaaaagtggacacaggagacagggccggcgaggcatgggaagtgagcagggccaggtgcgggtccccagacgctacttatttactggtcacaggttttatatcgcggctttcagcgggaatccaggaccgctcacagaggaactcgaggaaactccgcccagcccgctgctccgtctgtgctcccgaggactccacggggcccgcagtcctgcacccctgctcctacccgccctcaggacggcccgttcttcagggcgtgggcgccagtcacccatcgcagcccccaggatggacgggtggtcctcagagtccctgactggggcgctggccggaaggtcacgccctgcagagcagtcaccacagccccccagggcccacacgctgccccctggatgaggccctacctctcggtgggtgctggcgggcagaacaggaatggtctcatccaccgtggccaacagcgtcctcagggccaggccaacttcctaacagacaggagaccacaccagcgttaggatgcacaccaggcagctccacgccagccgtgacggtgtctccttccagcgacaggactttcatttccttttcaatactttgggggaaatttctgtatttcttttccacagtcctgagcctgatctcgttatgaggcagattcagatctctggacacccactgctgtcctgtccggggaacaggggctcaggcagggaaagcgggccgcgtgtgcagagagactctcttccctccccggtgctttccgcagcctcaggggccagccgggaacgctgtggctgctgctacacgtgggagcaaatgccaggtggcaccagctctgggggcctcgctgaccccggggcttcgtccactgtgcacacggggcacaacagccctcccctggccactcagggtttaaagggatcaagtgtaatcacagg

SEQ ID NO: 30847 - DNA, 728 bp, Bovine  19866880614470
ttacatcaagatgtataatgcgacagacgtggaagcagcatgaaaccgacacgtgtagagaaacacgttgggctgtattgaacagtgagccacagtttgcacgctctttaggaaaaacaaccttccctcttctttatttcccccagcaagaacggctgctggattgaacctatctgggtggatttcccttcttcacacaacagctcaatttatcagatttggtggtggagagcagggggagaggcccttgacacatctacatacctgtttcccacatatctgaccaacccttgagaggaggaggccgttcaaccactgtgtagggtttcctgtctgtcaagaaacttgtagaacttctcctccgggccctgggcttggcgatcacagagttttccttaacgacgctcacccatctctgaagcgcacgggcgaggcgagtgtggagggcctcctgaaccagctggtcttggagcacctgcagctggctcctctgctgtggggtgagtactgcccgtcacctctgggtgtgcgcgctccttcgttcagaactcgcgggctggcgtttggtgctgctgtgtgccgaggtcttcagggaactgggcagggaggtctgtgtctctcccgagcttggtctgcggatgtccggtcagcacagccttatggccgggctgctgccctctgagctcaggcgtggtgacaatgcggatccccttgctgcagaacccgca

SEQ ID NO: 30848 - DNA, 1488 bp, Bovine  19866880631718
cacccaatgaagcatcattatttgttatgaatgaggattgaacaagtgtccagagcagtgttgtttgtggtaaactgattaggctttgatggctgcctgcaaaatacaaatggactaattaagctgttttgatttaagaatttcataaaacaggtgattatccagtcttgttttatccaccagcccgtttccattaggaggtcagctgagtttgaattgttcttttgaatgaggaatattgttgatggaaatgtccttgagagtgaaaattatttaattcacaattctgtacaatctcccagtgaaagtctcccccacatgttaggttcgtcactcgcgctcctgcccagcgggcttggccgcggtgtgcagcgaccacagcacctcctgtgctccccgagggggtttgatcatgtgcccgtgccttctgggagcatttggtgtccgtgaccagggctgcctgcgagcacagcgcatggcctgtgtgccctcacttgcgctgtctctctcgccgagaaagacgtccgtcctctctccatgccccgagacaccaccgtttctttcttaaatgactcaaatgccattcctctgtgaagccttgcctccttccaggcagctctgttctgtgaccgagtgccaagtgcagcactggaggcgtaaggatgagtctcttgtaatccttgcttgcagggagctgagacatcgaaggaggctgacagttcccatacaaggtagtgcgtgcacacacacgcacacacacacacgcgcacgcacgcacatgcagagcttcggtcagtgccaggtacaggcaaccaaaacaataaatgaagagtgcgtaaacccacatcttattagcctgacgagaaagccctttcctacgtgtgcacgagcatgccttctgagacatgtatctccctggttctgctacttggtccatgtgatccatgcctccttcctcttcctacaatcctttaaagctttgaagatggcgtctcagcttccctggaattccctccctcctttgtgtccgctcttgctgttatcacatgggttcagctgctcacgattctgtcctttctctgcatgggctcccattggtctgtgtccgttgcatctgtgtattgaaagaacaaagaactttttcattttatacttgcctcctttaatgcacttggactgtccatttacttaccccgtgaccttagcaaagacatactcttctctggattttcatctgcagatttaagcagttggaaaggatgcctccgcattgccttctagctcttccctctgctcacacttaccccatggccacaccctgtccccagctcagtggactgctgatggcagttctcccatggaacgcgggagatagcagatgggtggtctattgccaagagccaggtttaccattaacaaaacttaggttgaataagaagaaaaaggtctttcctaagctactgcttttctctgaatgacgcctacatt

SEQ ID NO: 30849 - DNA, 1382 bp, Bovine  19866880644857
cgggagtcccaggtgttacaaatcagtccgcaaggcacttggaagtgagccccttagccagcttcccccgggtggctcaggcggtgaagcacctgcctgcacaacgagggagagacgtgggtttgatccctgggtcaggaagataccctggagaaggagatggcagcccactccagtactcttgcctggaaaatcccatggatggaggagtctggtaggctacagtccatggggtcgcaaagagccggacatgactcagcgacttcacatcagccagcttcccatgtgccaggctgtgagctaatcccaggtcacgaggcacatcagagaggtccacaactgcctacagtccagtcctgcaggcggtaaaaaaaaagctaaactgaaaacatctcatgcctaacagcagtggtcctcaaagtgtgctccccaccgccagcagcagcagcagctgagaatctgttagaaactccctccaggtgctgaccaggacctgctgagtcagaacctaaggggggctcggcactgcgtcccaataagccgccaggtgattcggaagcagccgcggtgtgggatccagtgctgaaggccctgctggggtcaaacgtagttcctgatttattaggaactaataagagagcgtgcagcaatgggaaaaaaaaaaacttggcgcatcgatagttcaggactttggcagccgctggtgatgttctaagtcatgccctgcccgcctcagtgcggaaaaccatcggacacagtctgtgtgcgagcgtctcctacagacggccgggggtcctcttccctcctcgacctccccgcacgtctcacaagctgaccggccgtctcctctgacagaagatacactccaggacatcgtcctgctccgttagagccccagctttccgaacctggcactgaactgttcctcgccaggggcctgttggatggagacagggaatgaagtgtgacgggggctcagagcaacaggggtctccctggtggacgagggccttcaccatctcatggacttcgaggcacgctcttctggcccctctccatgacatctgtttagaattccacaagcagaggcctctccacttctgctccgtttcttactaagttttgaaattgttgagcagattaaaggattctttttgacacttttatggttaaactttgtagagtttaaactgcctcccttaactgttcctgggaaagattagaaataatttggaactggattggatttgccattctgtaagctcttcttatctaccaggctaatagcagacactttcctccctacaacagcccaggaggaaggcttattatctgcgttttacagatgaaaagtgagggtcagataggcgaaagctcatatt

SEQ ID NO: 30850 - DNA, 903 bp, Bovine  19866880816336
catcttagggagagtttccatcctggatccagcaggacggaaatgcagccgcgcgtgggaaagggcgagtggaaaggtgaggcggtcaccccgaagattccccactgcagtcagctcagtggacagcttccccgccctcaccctatgtttttagagccatttttccaaggttttctcttttcccaaatagcagttgctaccatggtgtatgtgatcatcttcaccaggtcctcttacctccaagccacaggaagtcattcaccgagcgcagcagctccaccgacatgtggtaatgaaccagggagtcctgcagcatcccggcctgcaggcacaagtcccccacgtgcttccgcatgcggccctggcaccgcttcttgtaatgtctgaaaggtgaggtgaacggaaatgtatcactgccaacgcccggattcggcccccaaagcacgctggctaggcactattcaactctctcactaaaaaaagcgctaagaaggcaactttaggctctacggttgaaagccagccaccatcattgtcagtaatataagccaagttattttctaagtgcaagagagttcatgtatttcctgtggataatattagagggggcttttccttttcaaattttccaatcacaacattagcacaagaaagtttgtttcggccttttaaaaaaatcaattatcttccacgttcttaacttcaaacctttattattttatagagagagctgtgctgcatattacaagccaactgtttggcttttgcaaacaagacctttatcttcacgagttcagagcaagctttaatgctgctttgagtggtgggacccagaacacttgctaacagctctttaaatattggcaagggatgtgctactaaataatgcaacagcttctaact

SEQ ID NO: 30851 - DNA, 1348 bp, Bovine  19866880964388
cgctcacaccccacggtggcgcagaggttggccgaggcccctgggcgctgcccgcaggcctttcctgctgcgggggtcagggtggccaaccctacctgtgcttgcggctgggaacgaggaccagccagccatgctgtggtcctggaagcccctgtcccggcctgggggtgtcactgtgcacaggcctggtggctgggcctgttggtgtgcagggtcccctgtgaaggcccagggctgcccttggagcagctccctggctcccacgccctcacacgtccagggccctagctctggggtcgcctcagacccaggctgtgtgctcagccgtccccagccctttctttccttctgaatcctatcgccgctcttcggtgctcctgtgacgcttgacagattctctgtgaataaagggaaaaaattgcagcataaatcatccggagagtagcattttctaatttggatgggaggcaaaacaactccggatgggttttttcctccttcgttttcagcagggtttctctgtcgggccctcgtcgtctgccttggagctgtaagtcacagtcctgtttccagggggaggcaggtttgatttcctcatcctcgtgttcgcgtttcccctcctcccccacttcctgggacttgtcatccttaatgactccgtgacaagaggcgacggtcggagcctcagtcttatcagcgtgggtggacaagcgacagagatcacagcgccttccgtgggtggcctggcccgagtccgttggaggcggttctggtttcgccgccaacgggaccatccgagttcactgccccaccgggacgagcaggctcgggccccgaggctcaggctgggctctgtgcagcctcgtggaagctggggctcaggcgcgtttagtctgtgcagagaggagggtgtgcttgttcccttccggctgtgccgggctgaaggcggggtccgggggccccgccccctgagccgcgggtgtgagccagaccgtcggagggggggccgacctttccggggctccaggtgggaacagtgtttgggagctgcagttgtgactgtcagcccagccattcccccccggtgcccctcactctcctggtctgtgaagtggggtgtgttggaggcaaagctgtccggtgtgactggcggccagtacctggcagttatgactgaaatcctcgccttcaggtcagaaggccgagcccttcaagtcgcagtagcctcccgtcaccccttgcttgaaattgtagacgtggagttggagtcgcctcctggctcttgccctcacccccacggggtgtgcatggtgaggggcaagaccgcgggctcgcttgccgcgagggg

SEQ ID NO: 30852 - DNA, 756 bp, Bovine  19866880986183
ttgtatttttaagacaaagtctacttggtcatgactttttattccttttatacccagcaggatttgctttggtaatgttttatctgggtttattttattctttttttctgcactgtgctaaaatccttgccaccactgaaacttcgcggcccaaaacacaactaactgtttagtacttttttttatgttgatctttattttaactcatagtggtaattctgcttttctcctttcaattgtttttttcttttctgttcttaccgaagctcttttcctgacaaggatgaatcaaagcaggacctgaccaagcctggaattccacaccaactccctgtctgcaagtccatctttcctggctctcctttgctcaacctttacctaaattcagtactgattcccttaaatgggacaagtctataaaaggccctggtatccaattaacaaactgctaaatgctcaatacactagttgaattttcaaaaccaactttcttcaaaaaaaaatcatttggaaatgttacatatttaaggaatttatgaggatacacttagcaaattcttcaccagctactcaattcttctacgtcctagacttcctaaatcccttctctgcatcgcaccacgctgaccatgcagggcagctgcgtgggccacaacacaggtatgccgttcaccgcagcaggcacctatctgcgcactcctcccagggcgggcttccaaggggtttggtgcaggactaaactctacactcagcctc

SEQ ID NO: 30853 - DNA, 815 bp, Bovine  19866881161956
tctgatgagaaaataaaaaataaagggttaattaaaccaaagaaaaaggaggagaaagtgatttttttttgctctatttttttgagcaaaaataaaattcttaacccaatacttgacagtccaataagtccaatcttctgacagaaataaaggggcagcgaccacaagagacaaaaagaatccagaagctttattcaatttgtttaaataatcactggtggctgctccacataagggtctgtggataaaaaggaaattaagctaccatctcctaggagatttcattttccaagagaataaaaccttatcaaatttcaagaaagtcgatgggtgggcaggcaggactagagaattggtacattttattacttaacaaatatttttccagcaattactaggtaccaagcaaaatgccagggtctgtccccaaggagtgcacagtccgtctgtataacagatatttaagcaaataattacaaatcaatatttttatttaaaagtaaagctttttgagacaagctttgtggttttccacacctcacccccatgcctttcactaggagggaggaggggaggatgcaggtaatagaggaagtttgcttgtcacccagaaggggctccagacacaagctcacagactctgtgacacctcggagctcgggagtgcttcctgctggaaaacccgtggtagctcggaaggcaggcatcgctgttcccattttgcaaacgagaaaactgagcccaaatgaagtgaagtgaagccgctcagtcgtgtccaactctgcgacccaatgggactgtagcctaccaggctc

SEQ ID NO: 30854 - DNA, 1259 bp, Bovine  19866881407852
ccagcccaacacgtgtgttcaccgctttctcggagagcctgcagctgggaaggtctatctcttctccatcctcaacctggaagcaacttccttgcgtgttagccgtcttcagacaagtcatcccacctagaggtggtggaggcggttccacagaggcgtactggccaagccctgtgggcggcgagcagaggaggaaggctgcccaactcggcacagaccccaccagtccccaggagctccgatggtaggaggtacacatttatatcctctgccataagtcatcaagaagaggcagggcccctgggggaggccttggggataagttcaactcagggcaggggtggctttgcaaggccacatggtgggtaggactgagccaaacctccatttccaacttgatcagtaatgtaggtgctattttcatcctgaccgatttctacccttgaatgtgcttaaacccagaccccaccccagagaccctcaggaggccactgtccatattttccaccacatccacaatttctggtctgtctgcaaactggctgatttgggcatatggaccacaggcccgccgtgaagtctccaggtgtgatcatcacttttgacattccttccctgacctgccctaagctcagcagcccttggtgccctcagacagcaacctcgcagtcctcagcaggtactgctgctaactcatccacgggcccgcagaacgcatccccctttggagcaagggctgtgcttcactcctgctcgtgtcccgttgccaggcccagcacagcggcggaaggatgcccccgtgactgcacgtggagtaacctgaacgctaccccaagtcgtgtacccagcaagccagtcaactctgggtgtccaaaatatgcctggcattgggtttcaaaggatgaaaaagattaaaaaaaacctttccaaaagaagatattttgaacaccagcagctgacactgcagaaaacacatgggactttggggccccgcaccctgaagtagaaatctgttatcatagtgtcattaatttgactactcccattgacaaaaatctgagttaagcttgatcaagaagatgacattaatgtagtcgttcgtggcacttcacagtaagatcttcaatccagcacaggctgcgatcacaacgggaccatccatcaccgatataatcctttcataattgcttctaagctctgggtcattacatttaagactaaagaccaaggaggaagaaggcggtaagcgtcggattagg

SEQ ID NO: 30855 - DNA, 2249 bp, Bovine  19866881559235
atttgtggggggtgtgtgtgtgtgtgtgtagttctccctgtaatatcttaaaaacagtcattgttatggaagaacatagaaaggtcatagaagattacctataaatctgacagttaaaaactgctgtaattcacttagattgttaataggggcctataaattttagattcatagcaggaagcacttagtagcttgacataaaagctattcttgttatttttatggagactttcttttttattgaagtatagttgacttacaatgttagaccagtttcaggtgtacaacatagtgatttgatatttttatagattataccccacataaagttgcaaaatattggctatcttccctgtgctatacattgtagcttatttctttatatctagtagtgtgtaccttttaatcccttccccctttcatggcccacacctcacacctctaacctctggaagtaaccattagtctgttaactgtatccatgagtctgttttgttttcctttttttagattacacacgtgcatgaaaaagacaatgtgctctttgatactagtcttggcaatattttttgatctttcacatcaggcaagggaaacaaaagcaaaataagcaaatacgacctgagcaaacttaaaaccttttgtgcaggaaggaaaccatcaagaacatgaaaaaggcagcttactaaatagaagaagatatttgcaaatgatattctttttattaacttactgcactatctggttcaaagtttgcccagcaggagattaatactttacccaaatacacctgagaacaagcaaaccatgtttataagcagaaaatgatgtcccctgtcctctctgttcatgctgctttattaattcttttctccaagaggttggatgacttatttctagggtcagacttgaacatcatggcatctaaatgttttcaatacagacctcacagtatcgccagttccctaaagtagcatgatcttaaaggtatttctggcgctaggcaacctgatcgatctgggctctggagaggctctcttcatactttatttccagcactgaagctaaattgaacagatggggtgtgatcttgactggcaaaaacctaactgatgaagaaagctaaaggctgagacactgagcaactattgtcatgtttaagcttagctgggtccttttgagtttgttttacagcttagcaggttacattgttagcactgttttttgcaataaatccatggaaaacctaacagttacttgttttgtttcttattgtgtatatataaatgaatactaacaagtttttttcagctccttaacataagcttcaacatgcacagaatgctgtaaatctgataaagtgtgaggtgaatgatattttataaagctattttctatggtgtcagttgtgttttgcttcatagtatatcagcaaaaaataaaataaaattcctcatatttacaggaaaaaatggtatgtctgataaggggttagtatctggaatatataaagaacacacaaaattcattatcaataaaacaagcaatctgattaaaaaatgagctgctgctgctgctgctaagtcgcttcagtcatgtccaactctgtgtgaccccatagacggcagcccaccagcctcctctgtccctgggattctccaggcaaaaacactggagtgggttgccatttccttctccaatgcatacaagtgaaaagggaaagtgaaatcgttcagtcttgtccgactctttgtgaccccatggattggagccttccaggctcctccatccatgggagtttccaggcaagagtactggagtggggtgccattgccttctccaaaaaaatgagcagaggacctaaataggtatttttcctaagacatagatggtcacaaggcatatgaagagacactcagcatcactaagcatcagggaaatgcaaatcaaaccataattagacgtatctcccacttttcagaatccctggcattcaaaagacgtaagtgacaagtgtcagagaggacgtggagaaaagggaacccaagtacaatgttagtgggaatgtaagttggtcagtcagagtggaaaacaataaggaaatgccacaaaaataaatgaaatggaactgccatgtgatccagcaattctactttgtccggcacacactcttatcagatcagatcagatcagtcgctcagttgtgtccgaccctttgcgaccccatgaatcgcagcacgccaggccta

SEQ ID NO: 30856 - DNA, 847 bp, Bovine  19866881734025
gaattcttacagctattcccaagagaatttgtattaacaaccgatttattggggagaaaaggttgcaggggatgatgctagggtgaacctttccttttgataattcctaaaactaatgttctgacttgaagccatcatctttgtgatttctgtggtgtggcctaactctttaatgaagaaataatgacttttccccgatcttccagggttgtgcggtgcttgaggactgctgtgaagagggctcagacattcaggctgtaatttgaatttcttgtttttaaaagaacaagcatgtgtcattatttggcctgggactactgctctctctttatcatcttgtagaaaaggcattctatttccaaattggcagtactctggtttgtttttttctgaatcttatcctaaaataacatgccaattgagctatttctgaggctttcttcagagaattgatgttcatttattcgtgtttctaagtaggaatggaataatacatgtaaacaaggtatgaaagatgtgttagaccagagcaaaaacgtgagtgcagcgcttatgagcactgttttgagagcactgctgttgatcagtcatcagtattgatttttgcccgaggttgggggcaggggcttggcagggcctggtctctgccgctgtgtccagtgctccttgaggcgattggtttcggacagagaaagaaggctgagtgctgaagaactgatgctttcgaactgtggtgctagaagaagtctcttgagaggcccttggactgcaaggagatccaaccagtccatcctaaaggatatcagtcctggggtgttcattggaaggactgacgctgaagctgaaa

SEQ ID NO: 30857 - DNA, 1857 bp, Bovine  19866880179280
tttggaaggcatgatgctaaagctgaaactccagtagtttggccacctcatgcgaagagttgactcattggaaaagactctgatgctggaggggtagggggcaggaggagaaggggacgacagaggatgagatggctggatggcatcactgactcgatggacatgagtctgagtgaactccgggagctggtgatagacagggaggcctggcgtgctgcgattcatggggtcgcaaagagtcagacgcgactgagcgactgaactgaacatgacaaacatatttgtaacgatgaaagaacaaaaatgtctgtatttgaaaactcactattatctctttacattataaactctaattctaaagttcttatcctataaattatcattcataaattccaccttagagttaacacgttgagatttgggtctgtggaccaagctaagggataggacagggaattctggataaccctttcttgctcccacccctatcccagccttagcccactcttaaagacatcagtctgcagcctcctttgtaccaaagtttcttctgaactgagctttctgtcccggctttgggatccacggatactcctgcgagttgattttcttctgattagactggatcttgaatcttgggaggacgtgtacaagtcctcaattttacttagggattcaccaggggtattttctaattcaagttcatttccttttgtctaaaataaacaagaaatatgcataagttggttaggcggagttaaccaatgaaatctaattgctcaacagcagatatcaaggaaaatggtaatttaagtccctttgggaaaggatgaagtggaactgccatttttttggtgtgattatatttgaaaattgaaaccattaaataaggatccccataaactatgctgaaacaatctggcatccattccaagtatcttatctagtcacctcctgtgtgtgagtgattttggctcaatcagatttgctttggaccagtgacatcacacaaataacggtgcaagtcatactgtgagacacaatgttttcagtagacatgtcaaaaaaaagtgataggtaaagttagttttaattatatattttatctaaactttaatgtatctaagatattagattaacatgtaatcagtgtaaaaactttttgagatagcttgcatttttctttggactaagtctttggactctggtatgcattttcgacttacaaacacttcgattcagattacccaccactaatgtgctcaacagccacgtgtggctagcagctgctagagtggatactgctgcggcagctggttagccactcagtcgggtcctactctttttgcaatcccatagaacgtaacctgccaggctcctctggctgtgcaattttcccagcaagaatactggagtgggttgccatttccttctccaggggatcttcctgacctagggattgaactcatgtctcttgcttggcaagcagattctttaccactgggcctctaagaagcccttgctagagtggatagctcacttttaagcctttttaactttacctttctctatccttcttcatttctctcctttcaagagggaaaaaaaaatctaaaacctggtgtgatcctcactccctctgcttcctacccaaaaattttttccctcttctcaagataatcaatagtaacatttatttatagcaccaaatacagaaaaatcagctcatgcctgagatacttgaggaaactgctagactatacctgcattgtgacaagtttgaagtaaatgcctctcttccccatgagctcattgtgattgccttcctccacaatgactccatcatcaagaccagcg

SEQ ID NO: 30858 - DNA, 879 bp, Bovine  19866880361644
taggagtctgaacccattgctgtgtcttggctttgcctggtccgtatttacgtgtgagacggacagtaacctgacctagttacctagtagcgtagtaagttctcacaatggtccggctgtggagacttgctcctcctcggcacgcatcgtcatagatgtccggatcacggagtttccacctggggaggtagttcatgttgcattccttgccagtccttcccgttcagctccctcttccagtcttggggaaacctagagaactatttggacgtttggtctctgtctctgctaccttctgaagagatgctgtattcagtagttacagtgctggctctggagcgtaggacgcctggctctgaaactccacctttgtcactttttagttaagacgattgggggattattttcataccttaatctcctcatctttggaacagttagatagcggtagaacctacttcatagaatgattgtgagaattaaatggattcctcacttaagactcacagaagagggattagtcataaaaaaagtgctcaataattgttaatatttgtaataattatcaacaagaagctcatgcttccatgctcctcacaaatgaacctacataacttgcaatgatatggctccttatctcctttcatcttttcagaactctgtgatactaactcagtttttatagttgttgaaaggcagactgcaagtcactcagtacctgttatgaatgtgaagccgtccttctcaggtgcgtttccttagtaactatggactgctagccatgcccttcagggaaggcaagggcctcaaactatggcccgtgggccgtatctggcctattgcctctttttatgccatctgtgagcttagaatgatttt

SEQ ID NO: 30859 - DNA, 1923 bp, Bovine  19866880364120
tgcatgcacatctgcgtgcatatttttgggggaaaggattcacagcaatcatcagagacttaaggtcctgaaaaatctatgtcactaaatcctggagtgcacaaaaggcctcttcaaggtttccatgacttgagtgcacatcaggctgtaagtctctgtgcggtttagtcgaaatcaatgtacacttgaccaaaggtggtttgggagctcacagttatgagccagtttctcctcaatcaagttcaaggatgtgaaagtgtgtgacaccctagtccactcactttctcactctgctaagaaacttgttttggtttttttttggtgatgccatgcagtttaggagattttttttagtttcctgaccaaggattaaatctgggccctcagcacagagagtgtggagtcctaaccactagatggccagggaattcctagaacttaatttaggtttcctttcttgatcagccaaatgtcttgcttcctatttgactgagaagacaagttctacaagtcctcatgtccaagtataccaacctttgagcactaacattcaaatactctgtcttttcacccgttattgttggtgaactattcatgcctgtacttgaaataagtatttccccttaagcataagtttccttcctttctcaaggacagcactcaaacgaatctctctgtctctcccaaagcatcactttctcttctatcttggataatttctatcagcatacaaacaagctgttaatctcccatcctaaacacacacacagcttctcttgtccccatttttccatttccatgtttccaaaaagcccaacctgtgacgatgcccaaaattaaatttctggtatttactgccaaaactgatttccctctatcttcctcatctcaattgttagtaactgcatccagcttatgcagtttctcagactaaaaactttagaatcatcttggattcctgtctcttgtacccataatcaatatgtcagggaactgcgtaactgattcccgcttaatattaaaataccagattaggttccaataccttttcctgaaactgcctgggatatttctgacttcatagagctctctcttttcccatctatctctaccagcactttcactgtatgttctaatgattgtgaatatcatcctctcaaattcattatagatatgaactatagctcagacccctccatctctcacagcactaaaaacactaatgcatacttagtgaagactccacaaacttcactgttagtcaatgatttttcatcaagctttcaaaaaaatcagttccacaaacaacacttactttcattagtcatgtttgaaaaagttatgtttccgaaatttccagcacctgcaaagctatccgtcatgtctccaaacaccagcattatgagggggaatccagttccatggatgatggcagccaaagtccccagcacgatatacaacctatcgagccaatctgaatagcgaaactaaaaaaggagaaaatacagacaataggaacaattagcacgatgtcatggatggttaactctactttccaaatgtatccaaaatctaaatagttagctctcagactaccattgcaaccaccttggcctaataacgtaagagaagcaggcatttgcttctttttttttttttttgagttttgactttcttctttatattggacttagtctatccactttataaaaaattaaactatagctgatttacaatatattagcttcaggtgtacaacagttactcaataatttaatggattatactctaaagttattataaaataatggctatgttccttatgctgtacaatacatccttgtagcttatttattttacccagtcggtttatacctcttaatctatacccctatcttgctcctcctatcttccctttcccca

SEQ ID NO: 30860 - DNA, 1058 bp, Bovine  19866880404262
gttctggtacggtttcccagtataaggctggataagagtgttaaacatgctagcagtcactccgaactgcagttcaaaggctcagtagacctgccccctgagatatctgtttaatccttcaatcctgacacctggcagatgtgatgcactgagtagattaagtactttgctctttgcactacagtgaagaaagacaggtgtaatctttgcctgcagacttttccagacaagtagtagatctttcttcccctacaagtatgaataaatggaggcttctctggtggctcagatggtaaagagtctgcctgcaatgaggcagacctgagttcaatcccagggttgggaaaatcccctggaaaaggaaatggcaacacactccaggatccttgcctggggatggactctgtttgaggcctgagcaaaacaaagatataaaaacaggatttagaaggtgattgttctgtggtgttttgatactcaataccagttttttacagaataaatattaacccatctctgctgggcagcatcttgctgtgtagggcctactcccaaggcttcttaagagagctggtcagctggagtttcggattctttggtctcccaggtcaaccttttgtattttggtaaatgctagttatataaatacattctcccctatattgaaggggtttagaatacacttgtcatgttaatctctcctgcttttaatttgaaaataagaaaataaagtttctgtatcactggggtaacttctattaatataaccccttatgattatatagaggaagtgacacatagattcaagggattagatctaatagacagtgcctgaagaactatggatggaggttcctagcattgtacaggaggcggtgacaaaaaccatccccaagaaaaagaaatgcaacaaggcaaaatggtcgtctgaggaggccttaaagaagagaagctacaggcaaaggagaaagggaaagatacattcatctgaatgcagagttccaaagaacaccaaggagagataagaaagccttattaagtaacatgcaaagaaacag

SEQ ID NO: 30861 - DNA, 881 bp, Bovine  19866880412449
ctattttttaaaataaagttttactggaacatagccatactcatttactttactgtctgtggctgctttcattgtacagaggcaaagctgagtagctgcaatagacatcttgtggttcacaaagcgtaaaacaattctctgtattttttgccaactcctctttttgactatactcttaagaagagagccttaaaagtaatctaaggtaagcacttttggtggtggaagtaatcagttcttaaccatatttatatcctgaaattataatccttctaagaacagaaaactttggatttatttttagtttaatagtctgatagtcttaaaacttaggttgataaattaccttttctttttaggcatgtccctttcgtactccacaaagtcaaaaactaacttagatataatgtcatcaacaacttgatagtgattactctgtgcaaagtttctgtgttgctcactcagaagatgctaaaacaaaaaagtatataataattatattttaaaagcaatagatacttttttgttcaggttttctaatattttcttgcacttaaaattaagtttctaataactactccaaagaaatatcctttatcagaacttaaaataagtagaataaaagttatctctcagaaaccactaaaactactttggttttcagtcttccattttccaatgagaagaatcaagtactaatgaatttgtggttttaagggaactgaaaatgagggagttacatcagaaaatgaaataaagctgaagaaaaacagaaacactgagcatttagagtatgctatgagcatttagagtatgctaatatttttggaaagacttctctttactacattattttatccttatataattaccaccaagta

SEQ ID NO: 30862 - DNA, 3154 bp, Bovine  19866880423823
tggagggagagagacattaaaggagcttggaacaggctctgggagtctgggccagactcttaaattgtcaaggtgactcacagcatatatgtcagcttgaactttattgactttgactttcaggacccattttttaaaaggtgaggtagtcatggaaaagaaccaggctgtggtacctctaccaatttgaaaaaaaaaaaaaactcacaactctatatgtaaggcttcttgccactggtgtgtgaaatattttacgtgacacacaaaaccctaaagaaaagaagttgttttgagcacatacatgtacccagcagcgtgtttcgattgggattgaaatagtatctccgtgttgttgtgaaagcccacttttacatgtgtctcatagttacctttctaaaaaagtccatgttttgatcgaattttttgctgcttcttcttctttcttggaaaataatcaaatgttactactaacatgtagtatttgaccaaaggtattactcctgaaccattaggtctaaagttctgggttttctcatgtttattttctcccctctggcttcatttagtgagttccagattctccagggtagcaagttcagtagaggtcaatggattctcatgtcactagtttgtttactttttgtctccacttgacctagattaaaaagtcaagccttttttggcaggagaaattatttgaaaaggtattgcaatgtttctaggatggttaaaatgaataggaaaattctttctgtaattatagagagactaagtccaaaatggttcatttgtttaaccacagtttccttggcttcaacggcaacttgaaaacatgtctgctgtggctatgtttcttatcactgcatgaacaagtcaatgcaaatgaccgacatttaattatgtgttggtagtatagacttgtctaatgtttggggcatgatgtagcataatatatcaaattataaaacaatatagatatacatatcatgtgtgtgcttactcagtcatgtccgactctttgagacctcatggaccatagcccactgtgcccctctgtccatggggattctctaggcaagaatactggagtgggttgctatgacttcctccaggggatcttcccaactcagagattgaacccaggtctctcccattgcaggtggattctttaccagctgagctaccagggaagcctatattatagctaaagacaattctggttgtgatttgtagcagagaataaaaaatagtaaaatgttgaacatgtttattttactcttttgttcccaaaactgttgttgtcctttgactcagaattgtgaacaaatgaaaagtgtcccttgacataagatgcaaaactcatgaagaccattaaaaaattgtttcatgttttcatttataaaatattggagacacgatatacttaaaacaacaattagccttaggaatggatatcatagcagaagcatctttcgtgtgtgtggtctagtcaaaattcctattttaatctgaggaatgtaaatacaattatgaggggcttcccaggtggcatgagtggtgaagaaccagtgccagagacttaagagatgtagttcagctgttgggttgggaagattccctggaggagggcacggcagcccactccactattcttgcctggagaatctcatggactgtggagcctggtggggtacagtccacatggttgcaaagaatcggacaggactgaagcaagttagcatgcacgtaaatacaattattcgtcttttaacacaggtcagggttatctcagtcttagctgtattgacattttgtgctggagaattccttgttctgcattgtagaatgtttagtagcatccttagcattcagccagtagatgttggtgaagtgaagtgttagttgctcagtcgtgtccgactctttgtgatcccatggactgcagcccatcagtttcctctgtccatgggattctccaggcaagaaaactggagtgggttgccatttccttctccaggggaattttcctaacccagggattaaacccaggtttcctgcattgtaggcagatcctttactgtctgagacaccagggaagctgctagacattggtagcacctccaaatctcccccttccccaaccaatgacaaccaaaaatatctccagacatagtcaagtgtcctgggtgtgggggaaggggcaaattaccttagtggagaatctgtacactaacgactcctgggtttcatggtgacgttccatattataatttattttttatttttttttcatattataatttaaacacaaaatttacctatggaaaatatttgaaagatctataatctttgctaagaagattaaaaaagggaactatatcatatatctggcacacagtggctagaaaaaaatgtctttgtgtgaactttccagtgctatgatttagtgagacatttagaggaggagagacttcaaggcttttctgttttcaagcccatagaatccaatggcatgttttgaaaattacagctaaagttactgaagtataagttgtgtaattctcatattgtcttcatttcaaaaaggaaaatagcgtttagatttagagagaaagaagttgtcagcagctttgggaaatctcttggtaagtctaactataccaaagaccatggaaacaaaatcaggccttttctcagtgatgttgctgtggagaatcatattttcatcctttgtccacatgattttctcagttatagtatgcaagtatagggttgagagtaccactatggttaatatttttctgtcaacaactgttcctatatactcttctgtttttccttttatgtttttgttaaacttatttatatttctctagagttaaataaaaatggattcacaatacatttggctttaggatttacgacaattggccttaccatttgacttttatgcatacatacaagtgtgtatggatgagttcttggaggaaccccaagttggcctacctttatatgtccatttataagtctctccttcaacatgtcttccacctacagcatgtatgttgtccttaggaaaagatgttttcaacattttttagtttaaatttagtcagatccagattttgcatcaaaatgcattgtaggaatcgga

SEQ ID NO: 30863 - DNA, 1003 bp, Bovine  19866880436564
ctttttagggagagcaagcatgcttacatttaagtacatattcttttactgacagttatatattattgtagcaaaatcagaagaccctgatttaaaaagaccactgactgtagtttataaaaaaatgtaatgtgcccataatcagtggagttttctaatttttgacagttcaatcttcagtctatatatgttatttgaaaatataatagtacatttcgtattttagccttgtagttagaagtacctctgttagtaatagctatagactaacataaatctgtcatctaaagcccttagtttaaataaagaaaccactgcagattggttgctaaaaaactaattatttcaattgttttgggagaaaatgttacatatctcatggcaccctaatttactgatgattagtttatgctatctaatagaatgacacaaaaggaaactaatcaagttgtacaacttgatcaagtaacaagaacataactaaatataaaacttttatgttgatgttctatggggataaatatccacgtggattgctagtaagtaaaactagctgtgacatgcggtatagctaaaatgattctgtcagtagcatttcactaccgtccaatgaattatcaggagagcaatgtgacgcagctctgtgttacctatttgaattatagtttagatgaaactctatttttaatattaagttctttggtgaaattctgatccaattaaagatctttctcatatgtgttttcacatttaggtctcagttgcatctgtcaagagacatgaagattgttttatgattccctgactaagagttttatcatgtaggttcattagcccctgtctaggctggttagttcatttgattaaagctggggctcatgacagaaaggtcaggggttcagtcgtgtctaagttaatttacctttacctctgtttacatacaaaattctgagcaacttcttatagatctgtcgttcacctcaattcaccatcaggaaaacaa

SEQ ID NO: 30864 - DNA, 2646 bp, Bovine  19866880442736
atttccttctccaacataggaacacagagcaaagaccttctaagcctgctctgggtgtgggagcttctgaaggggatgacacttgtccctggaatgaaaaggatgactgagagtttagcagacagaggtgttgggggtgtgggtacagcagggcggggagggcactccaagacaaggacacggcacagctaacccacagacacatgacaccgcaccacagcaagctagaacattttaaaaatactaagccaagtacttacagagtccctccccaaaaggaaagcctttatttagaattcaaagtgaaaagtgagtggtaatcttggaacactgaaacatatccattatgaggaaataatgccattgcaggagttttcatgactggccaggaatactgagaaagaggtgcagaaccatgggcatttgttggactgacttccagtgttgctgagagaggacccccttccttctggtctacactccatctagtgtaatcgggtgtatcaagcggtcatgacatgaacaacgtctcactttactcagctctgtctatccacagggcagcgttctgatattgatttggcttctcagatatgtttccgtattaaaaaaaacaaattgccaatggaagcttttaagtacctcctctcgagatctctttctcaatgaaaatggatgatttgtcgttttggtctttaggcaacaatgtcttggaagttgagtatgaatgaaccaggccagcatgaacagatagactctcgttgagtgagctgacaaaaacttctgcatcttttgatgccaccaggaagcaggtctccggggaagccagccttgacacacttcctcactgcaacaccaagtttccagtgaccgtgggatgaatggatgcttggcaggatgtacattccaatgtattttccctgagaggaagtgcattttctggaacattatccgagaggataattggaaaaaaaaccaaactctttatggataggaaagataacacccaactcacgatgctttttgtgagctcttgttgtttagtcaccaagttgtatccaactcttttgtgaccccatggactgtagcccaccaggcttccgctgtctatgagatttcgcaggcaagaatactggagtgggtagccatttccttctctaagggatcttcccaacccagggatcgaacccatgtctcctacattgcaggcagattgttactgtttgagccaccaggaaagcccaaagaatacttgaatgggtagcctatcccttctccagaggaacacccttatacaaacagggttaatttaaatgactaaaacaaaatttttaatataatccatggaaataattttcgaaaggttactcaataacactttgctataatattaataataatctaggactcctcattgcccaagattgttctggacaatcctttcaaggatgtttgcatagtggaaagcctttgaagacagagagatgtctccctctagagcaaagagcaagcatgtttacttcctatgataaaagattcaggtttttcaagttcagaatttctctagtaacacaacacactgtgtgcgcaggtgtcacctggcccttttcctctgtcaccctctagggatcgaggctcaagatacaagtataagaaaatgttgatgttctggctacttctattgccacgagtaacaaagttctttgtctctgacccagggtctcttgtcttctgccagcatagatgaaactgcaacagcctaacttgttgatttgtaaggaggataaaatctcagaccctcacagttgctgaaacttggatttccattttcccctgaaaattaggaggtttgttaacaaggcgcctccgatcccacattcccgttttcccataggatacaaattagctgcaaacgaataagacacacattgtccatcttattatagctggcctgtctctcatttatgccactggttggtatctttggacatttatgtttgccattccattccagggtacaagtgtttgagctgtatccaaattatcagctcattccaacatctaaagctaaatgatccttaaaaaatctctgcactgctttaatactcattgataagcacttgcagattaagcatcaaacaaaaaacattttaaaaaaataaaaggagacaaatctagctaacagaaaacagaataattttatttaaaagatgtatgtaccaatggctgattcatgttgatgtatggcagaaatcaacacaatattgtaaagcaattatccttcagttaaaaataaagtgtttaaaaaaacatgcatggttcctgctgaagaggaaagatacataagaatattgttgcagcaaacattcttaaatattgtagcaaaagtttctgcaagaaaggagaaaagagagaactagaaagccactggatattttaataaataaaagtgataaagcaaagagcttcttattggaaaatggtgaacaccacagaaaatagggaccatagagctctcgagttaaaaaaaaaaattacagacccagtgagtttaaaatatatttttattgttgtgcaggaatctttccttatactgttttcccttggggtaatgttagctgttgaaaacaaaacatgaaaacaggg

SEQ ID NO: 30865 - DNA, 1869 bp, Bovine  19866880504869
tgaattaaggttaaaagggctatatttattctgaatgccttgtttccttgttcagaataagatgctatattttaaaaaatcctgttaactgatctcattatatcatgactaaagccagccaagaaggaaactaataatacaaagccattgcaaataatgtgattcttaactgcattttaaacaagctcactttgaacccctctaatttccctgcagatgatattctatatttaccaacgcatacatcagtctgatccaggctcagccttcaccttagagtgtcttatgcagcaaattcttttaagaaaaaaacctacattgtatcctcctaaaaaacgaacaatgatgttgctcccctccaaacttggaatctttattataatagtgcaaaaattttaacattacaattggattaagacagaaagacttaacaatagtagaaaaatgtctacttacgtggtcatttccttctccagcttcttgccatactctgttccgtctatagtactagttcacctcaaaacaaacataccctgttatgtctctttattttccattaaaaatatgcatataaatagaacttcctccacagtccagtattaataatctgccttccaatgcaggggacgtgggttcaatccctggtcaaggaagtaagatcccatatgctgtgcatgacaactaagccctcacgctctggagcaggcatgccacaactggagaagaccatgtgccccaacaggaaaagcccacgcaccccccaaaaaatcccacatgctgcaactaagacctgacacagacaaatgaggaaatttcaaaaagataagcatataaaaatgaatcaaacttgtctcacttaccaacttacacaaaaataggtcgaactaatttaattgtaattatctataagcatcagggcatctgtgcaaatcctttactactggctgtatgcaaccacacacacactaagttcagtgaagcttatttgcaagaagaaagctgcattgattaaggagtctgtcaggagagatactagtgtccttggattaaaatgttttatgaaataccactccaagatgacatggagaaaaatattttctgtgggctttgtcctgataaatatcagtgcagacttgaccctaaaccacttagtatttcaaactgaacaccccatttcttcagtttttattttaaaaacgtaagatacaaagaagaatgtaataaacaccagtgagctcattatgcagtattagcaaatgttaacattttagggcaaggtacattaaaactctaacacctcccctccacacacacacacacacgcgcgcgcgcgtgcatgcgctagccactgttcatattctggtgtgaattttttttcagattttattttctatatgcaagtatacacagacatgctcatttcaaaagacagaatcacagttcacattcagtggccaattttccatgtcagtacatgtgtatatggggcctccccggtggctcagttagtaaagaagatgtctgcaatatgggagacctgcgtttgatccctgagttgggaagatcccctggagaagggaatggctacccactccagtattctggtctggagaatttcatggaaagaggagactggcaggctatagaccgtggggggtcacaaagagtcagacacgactgagtgactttcacatgtgtgtatatgtgtatctttgttttttcaaagtctcatctatttcagttgcttccagtcttactgttacatgcaatgccgcattaaacatacctgtccacatatattatatatggtgaatatttttgtaggatacattatcataatcaagaggccggatcaatgcggggagcacg

SEQ ID NO: 30866 - DNA, 2252 bp, Bovine  19866880542818
attatttttacagatgatcaaaataaaaatacaaggagcaggatgaacaagacacaattttgtcttcaccttttaggatgaaacaatctgatttgtttaatgacagcactgggctctaaactcacagtggtgaaaagcaattgaataaattactggattctgtttgcaggactatagtcaaaaaatgtacacagaaaaaaattctcttcagttatctgagggaatggagagaaaagataagaggaaaacctcttttgaaaagacagtatgggtgtgcatcttctctatctgatcagaagaaaagtctgtggtgtgtaagggaaattccgaccaaaaaatattatgaaacaatgcatatctgaatcttaaaagagctcattacaaggaaaaaattatattaactatatgaggtgatggatcctggctaaacttattgtggtaatcatttttcaatatatacatacatgaaatcattatactgtattcctaaaactaacactatgttctgtatcaattacatctcaactgaaaaaatcgattatgaaaaaatgtttttcataatctcaacccatgcaaataaagctatgctttgtccctttctctgtatttttacttcttaatctagacactggccagctccttcccaattgactacaactttgtctaataatgattccttcccattattggattcattcttgctcccataactgtcttctccatttgaccgtatataattctatcagtttcataatacactggtctatctttaatatataggaaactactctgtttttcatcctttcctacaatccacctattctttcatccacctgaatacctgttgttcattctgtctccctgatacacattcaacagagtggcatttatgtatgagtttttttacaggctgttttctgctatttaaacacgttcgaaatgacatttttataaaaaccgcaaaatatggatcaaggaattgttattttgcctatctaataaaaacatataactactcttctcaaagtccacataagctctaatgtccagcaattaaccaagctgcttgataaaatactgaatttcctattactattcaagcgacaattagatgcctattggaggaatactgtaggatgggcacagctcttggactaaagtaggaagctagattcaaggtcccttataagtaaaattctgttcttacttgtgaggcatatactgaaatacaaaactgtcctctccatttgttagtaggttcatgaaagtgttatatgtgttatacatatgcacgtatacacacagcctgttgacccttgaacaacatgagtctgcactgtgagggtctacttatacagattgttttcaatagtaaatgccacagtgttacacgatctgcagttggctgaacccaaggataaggaactgcaaaaacagaggaattatggacactgagggccaactgtaaattataggcagattttcagctacaccaacggtgggcaaccttaacctcctcattcttcaagggtcaactgtacttgttttctgcctagacttcatcaggtataactaagaaatgaggaaaatgtttccgcatgaggacaaaggcatcagttttcaaaaactggcaaaaagagaatattattttcttaaaaaaatgaatgcagtgacatttaaaaacctaacataacattttcaggataagctgaacacatacctttggggaatgggttgttttgggcttggagtcgaattttaacaacatcaaagggtgtcactatgaagatacataaaatttcaattaacaagtgatatctgtaatttgtatagatgtttgtccaaagaaaatacacatgatacctatataatggttaaaactatttatcataaagtggttttaagtattaacattctaattttttgcatttgaattttgtttaaagaggaacaatgagaaaaagttgttacttctttcacaggtactaaactctcattttggagaaggcaatggcaccccactccagtactcctccctggaaaatcccatggatggagaagcctggtaggctacagtccatggggtcactaagagtcggacacgactgagcgacttcactttcacttttcactttcctgcattggagaaggaaatggcaacccactccggtgttcttgcctggagaatcccagggacggaggagcctagtgggctgccgtctatggggtcgcagagtgaacacgactaagcg

SEQ ID NO: 30867 - DNA, 2547 bp, Bovine  19866880576812
taaaaaataggtggcacactagatagatttggcccctcatctagaccatctccttggactcaaaaaatagaactttttgttattcttaaggagttttaagaaattcttctacttctgttaagtcttctttatacttttactagatatttctgctctgcttgctgataaaagttgtgtcagtacctttaataaatattaagtgaatacagtgctgttcaatatacagtaactgtacattgacaaactaagcctcattaagtttataccaataaatctaaaatttttaaaaatgctttcatgtggatataccctagaattggtaataatgcagtaggttgtttactccttatatctgtttctagaccaatcataaatgcataaagactactaaacatcgtatttctgcaacattcagaatgactgctcatgattgatttaatagaatatttggggaggaagcatatcttcaactattaaaacgtatataggctatggtaagaatgtggaatttcctaaaaacattctgcagcaaaattctacactagtacttatacatcaactggttattccataatcagttatcttattacctgcacaatttttatctctacaggcaagtcacctaaacatctctggactttcaaaggagagagtggtgttggactagtgtttttatattttatatcctccatttgttcaagaggagtcttaagtgaaagtatcaaaataagtagaaaaggaacccttctggttttgaaggggcagttggacttctgtatttttctttgttatctatgacatgtataacaaaacataattagtgagctgttgtaaccacatggctcagtggtaaagaatctacctgccaatgcaggagacatgggttcaagccctggattgggaagattccctggaggaggaaatggcaacccactccagtattcttgcctaggaaatcccataaacagaggagcctggcaggctacagtccatggggtcacaaagaggaggatattgagcacacatacacaatacaaaatagcatctcaagaatattaagaggctctatgaagaagagagtttcaggtcaaatatgtgtatgaaacttaaggactactaatttaataaatcaaaacatggaagaaaatttttaagataataaaaaaattaggagcagacccaaatcccttcaccatcatctttccttggtttatatggtcaaagcagttttaaataccaagttcaagatactgcttgcctgtggtagaaagtggaagaatgtggataaggagtggcacactagagttttcagctatatctgtaaagtttcattacttcaaaaacatctaaagcaaatttggctaaaggttaagagttctatatttttgtaatgttttcttaattaaatttcataaataggtttaaaagatactcaaagagttttgatagcaattattttaatttttttcttttttttttcctttgaagaataaaatacagtgttggatccctttctcctattattgcaaatattgtgaaaaggtctggaactaaagagctgaaattgctgcataattctcagaaagactccagggaaaatgtacatatgatggagcagggtttcctatataaagaacctgttcgggaacctgaacaaaagtttgtgtcttcttcagaacataccctccgccgttctagtgaactgagagaacttgatgataaaacatctcataaatgttccatgttaaatccagctgaaaataacataaaacaaaattttacacctctgcctccatgtaaaagtaaacaagaatacattcttgatgtttctgaacacaaattaattttaaatgaaagtgacttagaagtaaaggtagatcactgtccatgtaggccacagacatctatacaagtttctaatttcaatacagatgatagcgcatctcaatggaaacaaaagttagatactgtgctttttccagcaaagcatctgaaagaaaagaacctttattcggtatttcatcgtgattgtgacctgttagcaataaacagttcacaggagcacctgacaatttgggcagaaattccatccgaaagccctcctgaggaacccaacacgtgtgacatcaagagtacggatagtttgccttctggtaaaatctgtcggaaagtgaaaataccattaggaagaaataaaaaggaaaacctggaaccaaatgtagagttagataaaaaaagaactgaatttcttactacacaagaaaacagagtttgtagctcaccagtaaaatctctactggatttatttcagactagtgaagagaaatcagaatttttgggtttcacaagctatactgaaaagaataatatatgtgatgttttagatattttggaagaggaaaattcaaatctgttaacaatgtttttctcttccccttcaacttctacatttactggcttttaggtttaaaataaatgcctttcagaagcaatggtagatcatattcttgacatttttataaatatgtataaaaattcttagtttgg

SEQ ID NO: 30868 - DNA, 1568 bp, Bovine  19866880596680
ctgggagggattgggggcaggaggagatggggacgacagaggatgagatggctggatggcatcaccgactcaatgcatatgagtttgggtgaactctgggagttggtgatggacagggaggcctggcgagctgcgattcatggggtcgcaaagactcggacatgactgagtgactgaactgaacctaactgaatctgagggaaaataaaaagttatacaagtaaaagaaaaggtataattatggtgtacatttactaagtcctaacaatgcatgatttgttgttaatttaactagttatcaacaaaatgtataatggaaggaaaggggaaagagatgaattctcaaattccataaaaggcagtcaattgataatactgaaaataggaaaattaaaaatagtgatacaaactcattatttaaaaatatgtacataaataaagaaagaatcagttaagagtagaaagtgattcctccagggaaggatataagaggagtaggggcaatggatcccttcactgcattgtaaaaaccaatttgtctgtttaactcataaaactatatgcatgcataattttgataaaaacaaataaacaagaatggaaatttttgtaatagcattgacatggtactatatgaatagatgatgaatatacattttcagtccctatcctgtttatttaattgtttttatcctgtttctttcttactcctgcctaatgtatgggttgctgtattgaatagttgttgccatagtttagccattctcaaatatacagttgacccttgagcaacactggtttgaactacaagggtctatttatgtgcatgttgttttcagtaaatacagatttttttttttttttaataaatatatgctacaacactacataatcccccagtggttgaatctgtggatgtggaacttggattttcaactgcatggagggtggtacccctaccccccatgttgttcaaaggtcaactgtagtttgtaaatagaacaatcttttggggaaatgtaaccaaaactaaaaaattctcatcattgtttgaaatgtatttaaaatcttgaaagtacttatttatcaaatcaaatgttattaataatggcttacttgacttgtacatggcatagtagccaaaggaaaatgataaagccatttcaggcccttgttataataattatgtttaaatcctaaggaatataaatatctctgcaaataattagatcaaaagattcaattgctttctccatttggagattgaaaatgtttatgctacttttaaaattaggtaataaagagaaaatagagaaagtgatattgcctactttaaaatttttaaatgtagtctcaagataaatgtaaattaatggaatcctgctttctttttgctctcaatttatttttagtggtgggcacgttaagcttgatgaagatgttgaccttggttatgtggaagacgggacaccctgtggtcccaaaatgatgtgtttagaacacaggtgtcttcctgtggcttccttcaactttagtacttgcttaagcaataaagaaggcactgtttg

SEQ ID NO: 30869 - DNA, 2391 bp, Bovine  19866880608317
tctctggaaagaaaagaaggggagatgggctaggtcttacagtgggaaaatcccaatgccccaggagtcctctggtatctgcaccctctatcccacagatgactggggcagggtggagtcggctagtctcctggatgtctgagccctgctgtcccatgtgactcctgagggctcccagatagagaggctgccactccatcatggggaattggaatctgttccagtcatccatgattactgtctttgattcctcaggagtgcagcagacaaagagctaactaagctgccctgggtgagaaccccgcaatttaacatggaatataagtctttatcaaccaaacaggtcttctgagccagaagccaggcaggcctccagcctgcgttttctgctctcgggcttttacttgggcttgttgtccagtcctttgactcactggacccctttcactgctgtgatcccttaagaattgcatcgcagactgtctgttattgctgccggacacaacagcaccatcacccggtccttatctccagccctgctctggccccctgccagtctggtgcatcctcgctctcacaggtcatcagcaccagtctccagctcacctgactctgtattttccattgtttttcccagataccatagtcattattggcaagactgggaactacagtcttttataatgtataccacctgaccatctgtagccatgtctcctccctttagaagcttatatttacacagacaaaatatcacacaaaataaggaccttacactggttgtggaaatggagtgataagaacaataacatttctagaatttctagggaaaaggttggagtccaaaatatgatttctaagtattcctccccaggggtattgtgctttatagtgatactcctttcttctccttattttattctttatgttagttcaatgacctcattatatattccagaaaaatacatggaaaaaaaacattcaaaatgcacttggacaagaattaaaagggaacatacgcaaataattatttttcaaaaaccaattgatcaaattgctaagttatggttgatttctcttcccttaaaaatgcctgcttttaatttcaagatatataggaatatcaaatcattgtcatatgcctgaaactgatagagtgttttgtcacaattatatctgaatacataaataaaatttgggaaaaagcttctctaaaattaaaactgtataaaggaaaaaatgctcactttttaaaacaaatgttattagtgtgatgatcattaatctggagaataaagttcctgaaagaattttatatcaaaatttcagctgtattcactgatcttcattgttttttttctccccccaggtgttgctggtaccaatattataataggcataattgctggcaccattttagtgctggccctcatattaggaattactgcatggggctataagtaagtgaaatggctcagtatattactgtcaaactgtactttaaaatatttatctaaatgattctaaaaatttttgtatcattggataaataaacctgcagtgaaaatcagtctggttcagtattcaatccatgatgatccttggcatgattagaggtaacagtaatttatcattttttagattttgagattaactcccatctattctaaaaatattgaatattattttaaaaccattacatgaaacaaaatcaatctaaatcgtgtctcatacaaaggctgtgttggttggctgtttagtgatgcagattctcttgacttaaacccattcctccacatctaggcaggatagtgtatgagacagcatagcgtttagtaacaagggtgatatcaacaagatcaagagcatgatcagctccttagtgcttcctgctatgagcagggatcctgccaagagccaaacctctccccaaccaatgtgaagaagacattgttatttgttaaataagtgagtgttttgtgggaaggaaaaactcttcagagatgtaatgtgttaaaattaaaattcaactataagttacaacttttagaaacctaattcttaagcttcaaagttcagcttacaattctttgtttctatgtgcaagatttaaaaagttacacattatataacttttgaatattggatccccttagcatttagctggagaaggcaatggcaacccactccagtactcttgcctggaaaagcccatgggcagaggagcctggtaggctgcagtccatggggtcgctaagagtcggacacgactgagcgacttcacttttacttttcactttcatacattggagaaggaaatggcaacccactccagtactcttgcctggagaatcccagggacgggggtgcctggtgggctgccatctatgg

SEQ ID NO: 30870 - DNA, 756 bp, Bovine  19866880611600
tcagattaatgctttcattcatggtccactctcaaacgacctttagtaatttaagaaaattattgttacattttccatacatttttataatatagaaaggaaatacaggattccataattgatcagaattttcggatttgttctaatgtgtaccaaatcttgtgcatcttaacacgctgctgaatgcagactgaaacacgacatctgaggacagtgacttctcctcctttcttggagctcttggtataaacttgatctgctaatgtgacttcaggtttctacacagttcatttcccgctagttatagagatagtctgttagtgtttgcatgaggtgtgtcttgatcttcagcagtgttcattgttcacgcaccctcccctaaacagaatgctgagctacatgctactatttccatgtgtatttcgttgccttgatgtacgatacttgttgcatgtatattaaacattttgtaccatgaaaaaaaaaaagagatacaatctctataaattattccctggtggctcagatggtaaagtatccgcctgcaatgcagaagaccgggtttgattcctgggtcaggaacatcccctggagaagtgaatggcaacccactccagtattcttgcctggagaatcccatgcatagaggagcgtggcaggctacagtccatggggtcacaaagagtcagacacagctgagcaactagcactttcaccttcttaaatgatttgtaatttcctgagaattctagtaaa

SEQ ID NO: 30871 - DNA, 3279 bp, Bovine  19866880645903
tggacattatgtagggagggttggatggaatgagttttgtccatggttcttgttacaataaagcagtcagagaagagagaattctgtactctggatgcattgtgctttagaaatgaaaaaggaaggttctccataataggcatttccaccggagagcaatcacaatgcccagttggttctcatgcttttgatagttcttaactgtatctaactcttctgatgagttcctgtctcaagctcacaggttagtattaactcggcctgcaaggaggcagattcctcttgttgagagagttattttgatctgtacactttatcattaaaacattttctgaaagcctatcttgcagcattttccaaatcatgttccatggaatcctggtatccagtgagatgtaaaaaggttttgcacagataaaagcaatctgtagtcaaagtattcagtgatattctgcaagctttacctcttatcataaagatttagaattcaattaacatataaaaggctcagagaaaacctacatgaaagaaatctgcctaactttgataaacccagtattttccaaactttgcaaatataatcttggttttattcatctagtatcaatgggtattacatgatccacatttttaaaaaggctgctgtatacagacgacataatttactcagatatttgattccacacatcacttaataaataaagaaggaattcacttccatttaggacaaaaaccataccattttcagaagcatgaaaactctttttaattggggaaacttttttgcatacttaattcataatttcaggtgctctttgaataaactagagaactgaagttggaagacagtggcccagcttaaatcccattgtgtgaacacagctgtcattaagtaaatcatcaactttctttaaggtaagacacccagataatagatgcaagaaagtcaggagcagaggagtcacatacaattgggttgcataatactctgtgctcagagcaagactgtgaggggctgacccatgaagcctaggggcaagtcaagccaatgaacatatcaatcaggctgtcaggagccaggaaaattcaatggctagaaagcaagttaacacattagatcaaatttccagaatcctggcggagaacaaatactagaacattagacacagggaggggaaaagacagacagaagcaagggttcaggaactagacaagcaaactgaagaggaggcacgaagtactaacaaaaattggaagactggatttacatgtatacaccattgatactatggataaaataaatgggcttccctggtggcttagatcatggcatctggtcccatcacttcatggcaaatagatggggaaacagtggaaacagtgacaaattttatttggggggactccaaaatcactgcagatggtgactgcagccatgaaattaaaagacatttgctctttggaagaaaagttatcactaacctagacagcttattaaaaagcagagacattactttgccaacaaaggtccatcctcaaagctatggtttttccagtggtcatgtatggatataagagttggactataaagaaagctgagcaccaaagaataaatgcttttgaactgtggtgttggagaagactcttgagagtcccttggacagcaaggagatacaaccagtccatcctaaaggaaatcagtcctgaatattctttggaaggactgatgctgaagctgaaactccaatactttggccacctgatgtgaagaactgactcatttgaaaagaccctgatgctgggaaagatagaagtcgggagagaaggggacaacagaggatgagatggttggatggcatcactgtctcgatggggatgagtttgagtgagctccaggatttggagatggacggggaagcctggtgtgctgcagcccacagggtagcaaagagtcagacacaactaagtgactgaactgaactgaggacgacacagaagcattttaagcactgcgtgtcttttcattttcactgtgcagaaagcaccttattcaaaggatgaacctatgaacccagatttacactagacttcactgattctgaacgcttaagcagttatcatttagagaaagaacaaaatcaaaccatcttgataattgaaagcttcaaagttttctgatataaataacacactaaaaaacacactcttctttttacaaaaactattttgagtagttttaattaattcagttccgtaatgaaaacaattggctgtcattcttcaaccactcttcgttgtggagatcagatatcctgttgtcacttgagtaattctttccccccatttctttctgcttctctggatccaattttgatgtggatcatatctcttttttaaaaatatttttttctgactctggtcccaccctaattcctctcctaaagcttgtggctcagattgtaacagacaacgaagcttaatagaggtcacagaaaatcccagttctcactttgcaatgcaccttgcatttaaagtacagaatcacacaaacttcctaattaaaatttatcatgtgaatacatattcttcaaaggcaaaggggtgaaatggctttgaaacaggcctctggcagtggttttgtagaggtctttagttaactagtaacacatggccatggatatgaataccagacgattttagagaaacagcagatgtggctttactcctccttctgcagaaaggatcttggaaatcacagtgcctggatggggaggcctagggttttccctgaagtacacggctgatggctactgggcagtgtccagaagggctctccttttgatgcccgaaaggtctcttctcacaggccgtgatcttgtctgcagatactccttcaaggacatgttagcttttgtgataggttatctccgtcatacaaattaatacagagtttctaattaatgtcttcctcattaccagttttcctagcccagtgagctcatctctggctacatattacaatgacttggggatttataaaaactgccaatacctgggtcccaaaccgcaaactagcagtttcccagtttggtccctggagcaacagcacccacaggatcctcattcagacctactgaatcagaacttctggtggggtgggactcagaaaactgttttaacaagctctctgggtattctgctgtgtgttcaagtctgagaaccactagtgtctttttcccaggacattagtttcttctcctgatcttaatatagtccgga

SEQ ID NO: 30872 - DNA, 3920 bp, Bovine  19866880698975
atctaagcttttcctaggctgtttttgtttttcttgtttgccttgtgtgtttgtgtgtgtgtgtgtgtgtgtgtgtgtgtgtgtgtgtgtgttttaatttttggagtagccgcagggaagtaaatttaacagattttaaattcactctgttgggcgtttggactggtgaaccatccacaagattagtggaggagaggttattatgcttcagatgaccttgatttcctggacacatctgattgggctagaaatcgaaactttagcatttgattgtatgtgtgtgctcattcatgtcctactctttgcaactctttgtagccttccaggctcctctgtccatggaattttccaagcaagaatactggagtgggttgccatttcctcctccaggggaatcttcctgacccggggattgaacctgtgtctcctgcattggcagggggattctttaccactgcatcacgtgggaagccaagcatttgattggccagatacaaagaccaacagtcaatggggtgacctggaaagagaattctatctaaaagtatttctttaaattggatactgactaaacaaaccaatgagatcttctctcacagaggtctaacactcacagtgaaaagtagcttagaaagacagtagcatcaaagataaatggtaatcataaaattacggtatctgatgagggaacaacggaagttgacaagtcattgtatgcagggaaaatatatcagagttaaaggcatataaaacatgttttataaattactagttttctttaaaatgccaactttggaaacacgttatattaaatcataaaaaaggagaaagaatttatgttttgaaacaatccttcattatactggggctaaacagatgagtagataatagaaaaaaatctttcactaattttctggttctgaaaaataggagtcaatccaaaaccagcagatgatcatgatccatctgcacaaaaacctaacaaatgaagtgaagagctcaatatggttgaatcattatcaaatatttccatgacacttcaagaaaagcataaacatcaggggggctctcctccatttagactattatcattcaaatcttgaggctctcaaccagcattatctgtaattttccaaataacagtggaaattaatttttgtgttgcaatttttttcaggaattatttgccataaatcaataattatttcaacttagaactaaaatagttttctttttcctttaatatgcctggaaatatttcttagtccagaatagaggccttaatatttaaaggctcctataatttatataaatctattgttaaattattaaaacaaataaataaatttaatagatttttgcttttaaataagtattgttatacacctgtttataaaataataaataccttattgcagaaatcctaagtattcaggagtacatgacaaagagtaaaagtatccccttcctacacactgtccaggctgcaattgccacctaaaaggtaaatacttttaccttttttgtgtgccacagattttgtgtaccacatcaggaatcatctatgcatatttaaggaattgtacatatacataaataaacatatgttctttcagtgtacatatagtttacccacactgttctgccacttgattttttttttcttaaggtaaccttgacatcaacctcattctttcaatgatggcagaatattccatcacaggcgtgaatgataattcatttaaacaaacctgtacaactggatggttaggttactgcaacaaacatcttttcatatattttttggtgcacttctgtcagtgtgtatgtagactagactaccagatgtggcctggaaggtcaaagaatatgtgcatttaaaattttagtggatattttaaaggagaaatataactgtattccattatacatatctgttttaaaaattgatttgcattttaaaataataaaatgcagtttattaaaaattatatatttcaatagagactaacacttaagccaacttactcaaatcttaccaataataagggttctccatatcttcaatgactttcttgaggaaacagatgctttatggaagtaggtcttatagaaataataaccaaagacagatgttgtaagaaaagaaaaaagccagcacatcccaagagacttcagttctttattcaactgccagtcatggttttattccttactatctcttttgttccagtaatccattgtccttgaaactttcctcatagtacttgatttaataacacactcataatagtacagatgtttatttttagataattagatagttgtagctaaaaaattatctacctctataaaaatgaactacatattagttcacatgtcatattggtttttatttcctgggggaaaaaaagcttattgcaaatttaattctagggaagtcaaaaataatcatttatttgaaaaattcaaagacaaactacatttttattaagcagacagaaagatctcaaaagaaaagtagaatttactataaataggataagatgataatgcatgaaagttactcagcctgggttataaaactatgaaaactcagtaaggaaaaccaattctagtacagccacaaggccatggtcatttgctctcaatccagatcctcataggaaattatacctttatcagctccaagatggactacagtcaccttttccaaaaagtcttctcagattccctcctcctcataaaatgaaactttcttgtgcttcatccagcctggcatttcacatgatgtcctctgcatataagttaaataagcaaggtgacaatatgcagccctgaggtatgaagctgcatgaagcacaaactggaatcaagagtgccaggagaaacatcaataatctcagatacgcagatgatgttacccttatggcagaaagggagaaagaactaaagagcctgtttatgaaagtgaaagaggaaagtgaaaatgctggcttaaaactcaatattcaaaaaacaaagataatgatatctgtcccatcacttcatggcaaatagatgaggaaacaatgaaacagtgacagactttattttcttgggctccaaaatcaccgcagatggtgagtgcagtcatgaaattaaaagaagcttgctccttggaagaaaagctatgaccaacctagacagcatattaaaaagtagagacattacttttctgacaaagctccatctagtcaaagctatgatttttccagtggtcatgtatgaatgtgagagttggactataaagaaagctgagcaccaaagaattgatgcctttgaactgtagtgttggagaagactcttgagagtcccttggactgcaaggagatcaaaccagccactgtttccccatctatttgccatgaagtgatgggactggatgccatgatcttagttttctgaacgttgagttttaagccaacttttttattctcctctctcactttcatcaagaggctctttagttctttgtcactttctgccacacgggtggtgtcatctgcgtatctgaggttattgatatttctcccagcaatcttgattccagcttgtgcttcctctagcccagcatttctcatgatgtactctgcatataagttaaataagtggggtgacaatatacggccttgacgtactccatttcctatttggaaccagtctgctgtgctatgcccagttttaactgttgcttcctgacctgcatacagatttctcaagaggcaggtcttggtggtctggtatgcccagaccatccccaggcagaagatagcagaaagattgagatggttcgaatcatcatctgaagaatgaaagtatcagccatatcctgggccttctgcttggtaataaatgtactatttcatgatgactgatga

SEQ ID NO: 30873 - DNA, 740 bp, Bovine  19866880724305
ctgaatggaaaaacagatatttaaagcaaaattcaattcccctggacttcttaaccgtggtgttgcatgtttagagaagaataattagtgcagtgaagaaagtatttttcttccaccatgggctgaagtttgtgaacagagaaagaaatcatgcctgactttgagaaatgggacaccatttaatctcaggtccgcattgaatcactgctggtctctgcctctcctttttttggaggtgggggggctgaatcaccattagctttgtggtttcacaataagaagcttctttgctgtgggcaacatgcatgacctaatgtcttgcaaaatccaggggaagtacatgcagtttccttctctggttcaagggctaagtagagtgaaagagaaaatactaagatggtggccgctgataagggctttattagatctgtctgaaaaagagggccaaggaagcaaaaggaatgagatttttattctggtttttggaagtgcaggtgattataaatattgccatggtaaattctgtagttacgtgtactttttgatatttttttttaaccaacctggacatgtagtgtggagaattattttgtaaaacaataaaaatttcacaatagattagaaataatcatggactggatatatgcaaacttatacagttgtcataaaatcattcctccacaaaggaataggtgtaaaaaagattgagttaaaaatgagggatatccacttgggatttt

SEQ ID NO: 30874 - DNA, 811 bp, Bovine  19866880730859
ccctgggttgggaagatcccctggaggagggcatggcaacccactccaggattcttgtctggagaatccccatggacagaggagcctggtgggctgcagtccatggggttgcagagttggacatgactgagcgaccaagtacagtacagaacacaggtctgcatggataatgacaaggcggaggttagtgacagatagtatttgccacttacattattcaacagggtttttttggccacatggcttggtttccaaccaggagttgaacctgtgcccccttcagtggaatcatggagtcctaaccctgattaggacttttcctagccaggatattcccttcaacagctttttaagtgtgtctattcatagagccatcaaagtatctataatccttaaagcctgtgttaagtttctaccaaggagaatcctgatatggatcaccaggttttttgtgggttttttttggtatccaagtgggtataaaccatttacataagaatactccacgtataaagctttcactctgatgtaaaagcccttctaaaaaaggggagacaacagttgtagtctgatgaaaaggttttagtatcttacaatgaaaaatacatcatgtgccttaaacaactggcacacctgaatttacataaaagaggcttaacaagaaaataaggcttgactgacagtggctcaaggaagttctaaatggtgtttaacagactggatcttatgataatatcatctcaaagcatttattatcaaaacaaaaacttcagttatacataaagtaataaacctttacaagagctgttaa

SEQ ID NO: 30875 - DNA, 1842 bp, Bovine  19866880904433
tttttagttttgccaattcactgtctgggtgacatggctacatttatctcattgctgcttcccctatcaatgccaaagcatcatggaatagatcaaagactagaagtacttctccctgaataactatgccatacctccccctgaggaaagtgaaaaggaggaggaaagaccgattaggcacttcattgtcattcccctgaagagtagagctccatgatggtagaagtcttgtgtcttttttttaactgaagtgtagctgatttactacgttgtgccgctgtctactgtacagcaaagtaattcagttatacacatatatacattcttttcatgtattcttttccattatggtttatgagaggatattgaatattgttttacaccatgctgttggtgcctagcacaaagcacagtgcaagatcttcggtactcaatttctgcctgttgaatggacttggagaaaaccccattcacagcattatttgactttttggttttgttttttgccgtttttaatttttggctgtaccgcgtagcctgtgggatcccagtttcctgaccagggattaaactcgtgtcccctgaagtggaagggcagagtcataaccactgaactgccagggaagtccctatttttcattttaaagtatatccaaacaaaaatgtattttaccagaacaaaggtctttcttgagttttcttttcttaaaatttgtattgagcactgtgtggccaggcatccgctaaatgctggcaatgggaagaggaaggagcacaaagtccctcaagttgtctgcatgtgtttccaggggtgacaattattagtataactttagtatacacaacagatattttgtttgtgttttttaaaaacaaaactcagcttttacgtataaaatgatcactatcctcttcaaagtaaatacccaagaaaactataaaacaatttcaatggtgccaagaaataaggttgttagaactttggcggggatttgtcctcagattctactgacatatgctttgaacgtcctccagtgttagcaagtattgccttatgttcataaatttaagtattaggaataggtcacttgatattagacaatgtatttattcttactgcaacagaaatgtctcatttttaaaattagtgaatgtagaacagttagcttagtatctggatatctaagctttgaacatttacttctgttttctcattattagtagtaggctagtggctgacttccttgagagaagtttcagctaaaaatgaaatatggctagaacgtaacaagcccaattttcttgtgggcttagcaaatttgttctgaagattattcctagagggaaatcccttcaatattcaatgtttatttacttgaatcactcctagtatatatccatttaatcatttttttactttatagccaaaccttttgccctcagacatcaggagtgaggaattcctaacacaataacaatgttaccttaaatggtttttgaacttgcatagttcataaaaaaaaataacacttccttttggtttttaattgctttatgattcatagactttgaacttgcccgatcttaaatgaactctttcctcagaacaaggtcaaatcagttcaccaagctgacgtttgctcacttatcttttcaaaaaggttttgtattatttcaaaaaaaaaatctacttaaaatatgcttccgtgtggaaaaaacattgtgctaatagactgacgcgtagtcgttagatctgattttatgattataactcaggttaggaaatgcttcactttatattggaatacattcatgcatccagtcaacaatattaattgcaca

SEQ ID NO: 30876 - DNA, 2154 bp, Bovine  19866880943892
tcccctacctgcctcgctggactctgagtcgcctcagcaacagttctgtgactggtgtacagggttcctcgtgtattcatctcaccagctcaaggaagagccagtctctgactcgtgtacttgtcaggacatgatggggctgagcacttggcctctgtgggatgtccatcccacgtattaagatgaaaacaaatgggacggcttgaaaagactcaggctgacagatactggtcgccctgcttttcatggtgtcattttcaaccataaagttacaatctcacaagtcagattttggtgcagtgtgaaggaagatggttttctttctctgtgaagtggttgttctctgcatgctttttgagcccaaggcatcctgtttagctcttttaaccaaggtctcccagtgtggttccaggtgagctggctgtagttccccactgtctgtctaacaggccaccctacaaagaaggctggctgaagaagcctcctttcttcagagagacctgggctgaatatatgagctcacctcctgggctctccaaaaccacatcagcaaatgtgtctccagacaccttgagacagttggaaatgtcgccgtgtgaaacaacagactgccatacagtgtagtttccatcagaggaataagacagtatttgtcctcagttctgcggtagtgggtttggtgctgacttgaagcacccattacttcaagaaggagtatgagcggaggaagagttggatggatcaatgaatgagtgacaggccttgggccctagggaaggcacgataccgccccattgaagtctggccttcgggaagcctgcctgagctccacatgctaaggccctcttgaccccaagtactataactaggtgtaaaatgggtcagactgtgaatgatttcgtcagtggtactgaaacccttaaatattttctttgccagatcttcaccagaaatgtggatgatgaaaccaaacgacagaacagtaacttgttttcactgttgtttctaatccttggaattatttcttttattacatttttccttcaggtaagtgtccacattttcattttctttttccatttggagaaatgtatcattacccaactggcgggatttattaaacatctgtgtgatttgctgtttagtagagtcattcctctagtcactgggctcttagcagtcagtttccttgacttaaatcaaagatgttttcttcctctggcttcctcttacaccccaagggaaggaacccttgcttccttccttctccccaccttctcccctgactggaaatgttcatgaagtcagagggaacggagtgtttgatctaacacaatgattggaagtaaaagcaggggtcttagaaatggaagctaaggggagctgtggacgcatgtttggatatataagtactgccatccagttctgatactcaagtatcttccagtgttctaaaagcaagaacaaacctcagagccccataagccagtcatgctgattttaaaaatatctgaagagtttgtcattcttttcctgaagaaggaagctttctaatgatggaagaatgtcagtcttcaaacaaaaactgtagtaagcatattcaaagtatgcttttacagattgcagatcatttggttgaaatgaaattgccaggagtttaagcactctagatgctccacatcgtaaggcagtatgggcttttggtgttaggtgtagggtcaggtatgagttgcaccagttcctaattctgtgtccttgggcaagtaaataactgaaactgtgtaagcctcggttccctcatctgttagaatggggagaatggcagctgactcttgatgatgaaaagaggtaaggtcctacttgtgtgtgagatgattataaacataatcacttattaaattaatgagtggttgcagctgctgctaagttgcttcagtcatgtctgactctgtgtgaccccatagatggcagcccatcaggctcctctgtccctgggattctccaggcaagaatactggagtgggttgccatttccttctccaatgcatgcctgcatgctaagtcacttcagttatgtctgactctgtgcgaccctatggacagcagccctccaggctcctctgtccatgggattctctaggcaagaatactgaa

SEQ ID NO: 30877 - DNA, 1665 bp, Bovine  19866880955791
ctgaaaagtggtaaatgatgtttgtgtcctaatgagatagccttgttagaagttaactttcaactaaaacataatcgaatgatagtaactttctggaaaacaaagtgttaatatgtgctgtactccttaaaaagtagtttattttctttgatcttgttaactcacttttaagaatgtctaagacaataatttaatatggacataaatgtgcaaggatgttttcacagcattctttttagtaagaattgaaaacttagttcagtaaaagctttgttcagtggtcctttaaagaactcattgttaatatatatatttaataaccttggaaaaggctcttgatatttgttaaagtaaaaaataaggctgtaaagccaaacatagaacctcaacccagttttgttaaacaggtatatttttagaaaataacagcatgtaaggtattatgtaaaatacaccaatacgtaatttttcattaccttctttatcttttcaatattttccaaatattctttagttgtctcaaatgacaattatgcagagaaaaatataaacattatatatttttaataatagcaattataatgatactataataatttatatataataattatgaactgaaaatgtgaccatcatagaagaaagagcacttcaatagaggtaaaatactgagttctcaggttactttcgctcctgtaaagctgtgtggctttaggtaagggccttcatctgttgacgcttgagaatctctttctgcagagaggagtttaaattagctcatgttctttccagatctaaaactcaatttgataacgtacttagtatctctttccatagcaaagaaactcagaggtcataataaatattatttaatatataatattaatctctctagtggaattccaactcgttgccactgctggcttttgtacctttagtgacggagtgttctctgttacagattgccactgaagcgatagaaaacttccggactgttgtttctttgacttgggagggagaggtttgaatatatgtatgcccagagtttgcaggtaccatacaggtaatagccactgatgagtaggaggggagtatggggactttttcaatcatcaggtttgttttcaggaaaattactttgaccagaaggtagggagtaagtggagagacttctagaagggaaccaattgggaagcagttgtaattctcctacttttgcattccagtcccgtataatgaaaaagacatcttttgggggtgttagttctagaaggacttgtaggtcttcatagaaccgttcagcttctggtcccatcacttcatggcaaatagatggggaaacagtggaaacactggctgactttatttttctgggctccaaaatcactgtggatggtgattgcagccatgaaattaaaagacacttgctccttggaaagaaagttatgaccaacctagatagcatattaaaaagcagagaccttactttgccaacaaaggtctgtctagtcaaggctatggtttttccagtggtcatgtttggatgtgagagttggactataaagaaggctgagtgcagaagaattgatgcttttgaactgtggtgttggagaagactcttgagagtcccttggactgcaggagatccagccagtcctttctaaa

SEQ ID NO: 30878 - DNA, 743 bp, Bovine  19866881130676
gctcaaaaaaactaaaaaaaaaaaaaaaaaaaaaacctaaaaaaaaagaagaagaaggaaaaggagcactagattggaattcccacgaaaatttttaaagagctctccatgcaggtctaacaagtaatcaattaccatggaattcctctctagttgaacttgctctataatgcaaataccaattcttgctactatttgttgtgaaaaactttacaactgatgcaaacatgtcccattgttgtggacatgcacctgtttagggatgtgttatccaagaacaaagattatgttatgcagatctcagcaccaaggaacacaaggtgaagccacacataccatcaaaaaaaaaaaaaaatggttcttcttaaataagttcattttataaaattttatattggagtatagttgataaaaaattctgtgttagttcaggtctacagcagagtgattcagttatacacatcttaggaggcacactctgaattagccttactgagtttccagttctgatgtcactgaaagccctcgattctgtgattcctggtggccaaggacccttctctccagtggctgctgctccaacaagctggggtggggaggggtgctgtgcaaacattggcatcagctctgattttctcatctccattcaggaagttaggcagcctcattacctatttatgctctgctatattctgataaatcagtctctccatcatcttggccattaactgcccattactagg

SEQ ID NO: 30879 - DNA, 699 bp, Bovine  19866881146614
gacgggaagtgtcctgtaaacatgacatagacggggacgggaagtgtcctgtaaacatgacagacggggacgggaagtgtcctgtaaccatgacagacggggacgggaagtgttctgtaaccatgacatagatgggaagatgcttgtccacagcaggggtgtgttttggttgctcaattctcttcacctttgggatccagccctttacaaatcacaaccacaggctcccaggcactgcaactggtgagagacttacgtctggcagcatctcgatgaaggggtggatgttggcctccttggccgcgcgctcaatctcctcctgggacacgacccggctgttgtctccgtaggcgatgttctcgccgatgctgcagtcaaacagaatgggctcctgggacacgatgcccatgtgtgcacgcagccactggacattcagctgctttatttccttgccatcgattaactgaaaacaagagatcatggatcagcctcagaaccagaacatttttgaatttagcaaaattaatgttgttatttcctacattaagactgcaagttgttatgagactgttgttgttgctttattttggactgtcgaggttaactgaatcaggttataactgcatgctttggggaactgtcatgtttcttgcattttaactctagcttctgatatatgcatctcgaaggcagaataat

SEQ ID NO: 30880 - DNA, 1240 bp, Bovine  19866881208716
cacttcccaacatgagtcatagttaataaacttcattaatatatgaatgttatcatattttatttatctcaaattttaaaaattaaaaatttggtttaatcttttttcctagaatcttgatggttacttctacatgtgttctcacaacatgttttcatacttagctgaggacttgcttttgctttttatatgttttaatagactcttggtttttctagacagagcttttcatttctgtatttcactctttggtacctaattctttttagtttcttcccccattggggtgtactattttgctgctgttgctgctgctaagttcttcagtcgtgtctgactctgtgcgaccccatagactgcagcccaccaggctccccatcctactttgctacttccccagaattaagctatagcacagaaccaacctgtccatttttcatgtcctccattctgaagcaactgctgtttctgaaacttttcaattgcatcaatattccatttctcaaatatttatctacaacacagttatatgtcaagtcaatttcaccactgccaagatgtggtcattttgcaactgatttagacctaaatggtgtcattcgttttgtagaagcatggggctatgacagtttcttacaacaaaaatagcactgcttactggcaagaaaatcatagattgtgaaattgcactttccttttcttgactctaataatgctttcttttaaaattaaaaataaactatgagatctaactatttatttccttaatgaaatatatccttcttgatttcaggaattggtgagcaaattttgcttcaaaataaacaatctagttttcagaatatgtgcttccataatcacatatcaccaagcttgttctaatgcttgactttgttaaaaggtgtagtatcacccatgtcttggtttccaaatacctcttcccactaaaaagaaccatgagtccttggagaaatggttgaatcccaagactgctatcaaaaatgtatctggaacatcatcttatgccagagaaaaagtactcaaaaaattatgatatttacagaatttagagtcagctttgatgagactctggtcaaatctaggataattttaacatcaaaatagatacaacagaaacctgcacacagatgtttatagcagctttattcataactattaaaacattggaggaaaaaaaaaacaactggaagcaatcaagatgtttttcagtaagtaaata

SEQ ID NO: 30881 - DNA, 1459 bp, Bovine  19866881240596
attcctaattgtctgagccaccagggaagccctgtaatagttgttacctgctgtcatttagggaggctggatgaggggtacacaggactctgcaatttttgcaacttgctgtgggtctatgattatttaacaacaaaaggttaaagatagaatcatatggtgaaacttaaagatctgctgctcttcaagtgctaattatgtgggctaaaacgaaaaatgagttacctaagaagtggtgtgactggagaagacaggccctagggatgaagggacagcatttcaggtggagaaatttcagcctcggctctcatttcagtagagcctttcagcgcctacttaaaagtatttgaagtacacacagaaagatgttgtggttggagctggctgagctaggcagagagtggcatgaaggcaggaagcgctggcctgcttcctctggaagccctactgacaaaatgcagtttgggagttgtaagctgaggatcagatcttgagctatgattgcctttccctctcagaacctagccagcgtgccataggaagcagcctgagatatgtgggctggccacatgacttgactcagcacagcccacagccagtatcaagtggcagccacgtgagggggtaccacagacttcaacccattcaagcctttagatgaccagctccagctagcacctaactgcatcttcatgagatgagacccagcgctatgcccagtcaatccacagaaccatgagtcataaaaatccagtattttaagccagttgataactagagcaagtaatagccctctgagttggaaagcctataaaggactttcacttaccttaactcttgaaaacttcaaaagtatcctgtaggctgtaacacaccccagtcagcatcttgcacgttggaagtcctcactaagaacatctgttaagtgaaaacaacaaaagatctgttgatcttaggaaagagatcagatgagattttcaggagccatctgtaactgtagtcctttgtcccacttggaacttacaacaccaaggtgaaagacctctgctcttggcttcgggaggaatcaggagagcaaagagaaaagcgggaatgctcactgatgtgtgcaagaggcaaagatacatgatgaaatgttttcaccaggactctttcaaaagagccagtttgggtcataaggaaaagtgacctttgaattggaaatggaacatttttgctttctgtgctaggcagctcaatttaaatgttttccctcttattgattgtcggttgttctgtggagaaccatcaaagttctccagccagaaaacctgggtttctctcctggctggctgtttgttacatatgtcattctttgggcaagttactgattgtctctaagtctttatttcctcattggaccttatggaatttcaatagctacctcactggattacttgaacactggatattataatat

SEQ ID NO: 30882 - DNA, 1077 bp, Bovine  19866881398427
tttccatacaaatggtgaaatttttttgttttagttttgtgaaaaatgccattggtaatttgatagagattgcattgaatctgtagattgcttctggtaggattgtcattttcacagtgtccatttctcccaatccaggaacatgatatatctccccaattgtttacatcatctttgatttcttttgtcagtctgctatgattttctgtttacgtgagctattgtttcctgactgcttttcctttgtgtctgcattccctcatttccctaaattcaaaactgcttgagtctcttctttgaaacccagggaaggcctaggagattaaagcctttctcttgaagcgatagcacactgtcatgttgatttcagcgttagtaaccaagaagtagaggtaatttcagtgtccatgtgtccatggatgaatggacaaagaatatgtgatatataaagactctgcatctatatacaaacatatacaatggatgataatgcagccttaaaaatgaaggaaatcctaccattcatgacaacatggatgacattatgctaagtgaaataaactagatgcagaaagacaaaaactgtatgatcccacttatatgtggactctaaagaagtcaattcacagaaatggaataaaatgattgttatcagagcctggagaggcagggatttagggagataaagttcaggagtacaaagtttctattatacaagatgaataaattctggagatctaatgcatgacaaagtgactgcagttaacattattgtatacttgaaattttctaagagggtagatcttaagtgttctcatcacaaaacaaagaagttaaccatgttaggcgttggatgtgctaattagcatgagtgtgattattatttcacattgtatatcaaatcatcaagttgtttactttaaatgtatacaattttaaattatcaattatacttcagtaaagctgaggaggataagactgaattgtgtgggtgtggccaaattcctaaataattcctactgagaatctaaagagaaattagttatctaccaattcagaggtagatactacaggaaa

SEQ ID NO: 30883 - DNA, 1792 bp, Bovine  19866881423542
caagataattagtaagtgattagaaataggaagaaaatcccaataaatgtccaatcccatctattctaggcatacaattattagaaattaatacaattaatttttatttttaaaaattaatgtttattttgcatgcctctgtacctaagagttagtgttgattttagattgattttgggtttcaggtttgcagtaatgagctgaagtgtgtgtgtaacagacactgggtaggtgaagactgcagcacttacttcccttacaatgatgatgcaaaagctggcattacactgtctggcaatggtaggtacttactttggtcccattatgttgtctttatgcacaaggaagagaaaactgcccttcctaagcttcgtttggattatttttatataattcaaatataagttaaatccacataataatgaattacaatgtacaactggggccctcattatgaaaccaattatttccattatctcgtaatatgaaatattgaatataacttagtctattgatttagccatatcttgttctatatcaggctgatattttccaagtattatacttatttggagctgacaacaaatcctagcatcttttttaaaaaatatgatttagtttttatttattggctatgatgggtctttgttgctgtgcatgggctttctctacttgtggtgagcgggggtcactctccagttgcagagtgtgggcttctcgtggtggtggcttctcttgttgcggagcccaaggtctagaacatagactcaatagttgttgtggacaggcttagttgctccctggcttatagaatcttcctggaccagggattaaacctgtgtctcctgcattgacaggcagattcattaccactgggccaccagggaagccctagtatttcttttaaatgaataaagtaatcaaaattgttaagtgtatgattttatattttatacttcttatatactgggactaagtaaatgaggaaaaatttgaattgattttaaaaatattttgttagctttaatattctctcttaaagaaccacatctatattaaactccagtttctgtagcctctactgtaggtaattctagaagtagtaaccttggccaaggtgcctggaaggggtttgacatggataagaagcagcaggtgtagttctaaaagcaagagttgcccaaatggagaagtagaaattaaatgcagatagtggaaagaagacataccttgaagatgaatgtcccttttaaaactatttttatcatttcattattgagtattcttctgcataaaataatgttcaagtcctgaagtccattcagctccaaagaatgagaaaattattatttttattctaatcatccatacaggttaaatgtattagtcaatgtgactttcataataaaactcacagagtgattaggattttggcatcttcagtcttagcaatggttgtggggctggttcctgcacttaatgtagaaagaagcctcttcaggtctgtggatttaactggcttgtcaaaagtcatactattacttagaagtaaccagaactagcatttgagttgattgttgttcagacgctcagtcgtgtctgactctatgacccatagactgcagcacaccaggcttccctgtccttcattatctcccagagtttgctcaaactcatgtccattgagtcagtgatgccatccaaccatctcattctctgtcccccctttctcctcctgccctccttcccagcatcagggtctattgatccctgttaattttctggagctctc

SEQ ID NO: 30884 - DNA, 1056 bp, Bovine  19866881498876
aaccacagacctcagacgtacatgcataaggggctagaaaaaacctctttttaaaaaactgtcttcacaccaatggacttaagtatgtacaaacacagagcccatttataatgctgacaaaactgttctgccaacaaaataaataaaatctacaaaaacactgacatcagtaatggtaactgaatgggacttacgcgttagtcactgaacttgaagctctacttgtgaacatggaactgtctaccgggaaacacagctctccgagagccgagcatgccttttgcatgaaggcagagaaggagatgggagagctccatctttcccttcccctaataacagcacagagtctgggtggggacaactcagtgaggtcacaactgcctattcccactgattgtgaacagaagatttaacaccaagatattttagaagatttaacgtcatcgtcagtgtcagggtcatcatgtgacagaaacagccttctactggaggagttgtggagtgttttttgagggtggagacagtttaatagcctggattcataggcttcacacctacctttgcccagatagcagctgacaggccaagaacaggactgatggccagaatcacaagggtgagcttccaaccttctgtaaatcctattataaaaccggtgaagaatgttgccattgcctgaaagaacattccgattttgtcaccaattccttcattaattttggagatgtcactgaaagaacagtgttagaaataaacatcaggattatgaacaccagaacttttttcctgaagctagttgagtgtttgtttgtttgtctcagtgtggggtaaatcagtttacatctaggattttgctcaggaacatccccagcaagtatcatgtcaccgccctaatgctcactcccacaagatgtcttgggtctggcaagtccaacccctcattcactaccagtcatgcgggacctcttcatgccctgtcagggttctgggaacgaaaagacgcatgaggcacgatcaagactcagaaggactttagtttcagaattactttcagat

SEQ ID NO: 30885 - DNA, 1220 bp, Bovine  19866881539156
tttaacattcaacataaaataggattttctttataaaaccacttacacttttaaatacaaaaatactaaaaatattgtgagtttgaagtctcagtctgtatctgttacaaaaataactaaggtcctaagaagttatgtcaactgtgattgcagttaaagcagcatttatcaaatattcaagaaaaaactaattataatgcattataatttattataatacatatccatttgctttttaaaaattgttaagtgcttaagtgtctccccaatggaacataactgccacatatacaggcaccactctgacttgaagaccttacaatacctagtattatgccttgtaagcagaaggcacttaatgcatgatggccggactgaataattggtggagagggtatgacacaaatcctcagctcaaagccaaagtataaggggcctaggagtcggcctacggcctggcaggggaatggggcattttagccctgggcccaggccctgagtctagttcggatctgttataaataccgtctgactgaaaatcctgacaagaggccctacaccaaacagtgctctctcactcactggacttggtcctggctctgtcagtcccaagccagcaatccccataaacacggcttgtttttaagcagcaggggatcattatacttatgagccagggtttaaaccctgccccatctccccaggtatatctgaggcattcttctgaagtatcaccgtattagtgcttttaaaatgtaaagttacaaagtcacaggcaaaatgtgcgtgattgttaaagaccctttgaactgatctgctttgagtgacatgtgtaggaccccttctcccccttcccctgagaaacattcacatccacgtgctgtcagggcctgggaggtgcccagtgtgggagacctaagtcactatccgctagtaacagtgcagctggaacgagtctatcagccaagccccagcacagaaaccaagcagcagcaagtgggccgcggggctgacttttgatctgtggaaacaaagggttcagagggcacctcttggcaggaataaacacgagcatcacgggtctcccggggagagaaggaaagaaggagaggagagggatgtgggggcacggaatattgcttccatctcctccgcctgcagctgctgaggcggagggctgacgggagcccgcctggagacgccatcggcgcgcggggacc

SEQ ID NO: 30886 - DNA, 1691 bp, Bovine  19866881680642
aaatagaagtgaatttttgctttctattcaccttttactttgaccgtagctaaaatctgaagtcaagacccttcacaacaatttcttctacctcaagaaccttcttgtctggtggtcttcttgtctgtctctagttctctgtcccaaagaaacctccttcccagcaagtgtgtcttctgttgcgttgttctaaaatactggcaatggtcaatcctgtgctttggtctcccacgtctggtccactccgtgcattgtctaaagctggagctttgtcctccagtgagtcagtgctgggaagtggagatttcatgcagttgctcaggacatggcattaatgagcttttgaagttagcattctgggtcttctttagccttgaacctgttacacccattttgtcaggagtttaggaccatatccctatgctcagtctttcacctcacacctgccaaatcacttacacataaggtttcacataaaactaaaatctatcttgtaaaatgactcacagtacacatcttagataatactgagtaacatgggtttcttcatatatgagcaagtgcactaccttttcttcctgcctgtagtacaagaaatggaacatacaaaattgtgaaaccaggagctgaattttattacttacaccatttggtaacttgagaaggactgttagtcctgaatactagttagaaaggcctttgatttgccaacccatcctttctctatcgtgtattcaaacccttatttcaatgaagggaaaaacagcttttgtatgagctttcataacagagtggaggaatgcaaatcttataattaagaacttagtcttcattattagcctgaaaatcatacaataaaataaatctggcagacatagccaaatgttcttactcagtttatttggaaatatattcatctgttgtgggctgctgttgcggctgacagttttggtttccttcatctctatttagggtttctggcaagtggttctgctaaagacagtaagaacctgaacagggcaactgttgcaaatgtagaaaagaggtgggccatgtcaccacctagagttttcttcatgaatcgtccccttcattttcatgagtgctgattctactgatcatcaggcttttcaactgggtgatggccacagagccacaattaaggaaacatacacatacatccctttatcttgtcagataaacttgtattcttacttgtcatctggtctcctcacatcacattcagtgtcattcttccagaatggggcagtagtcatgctattcatggtcctagactcctttctctttttttggtgtcaaaaaagagaggtgggaatctgaatctgtctgcatttatctagcttaatgacatgaatttggatgatatctctctttcattccctcagactctctttttaagtaggcagtttatttccaccccttaaaaatagccctggcttcccttttggcccagctggtaaagaatccgcctggaatgtgggagacctgggtttgatccctgggttgggaggatccctagagaagggaaaggctagccactccagtattctggcctagagaattccatggactgtatggtccatggggttgcaaagagtcagacatgagtgactttcacgaaaaatagccctagaggcttacacttaaagatagcagaacctatttctgtt

SEQ ID NO: 30887 - DNA, 1336 bp, Bovine  19866881696518
aattcagtgttcaagataaactttcatgtgtgttttatatatatgttgatagtatagcattaacataattttatatgaaagtatttagctagaagcacagtggtagctttaagaaagcacaaaatattgcaatgaaaatgtatttatatttttatggatatatatgttgcaaacttaaggtaaatcaacacaggataaaataaacacaaacagcttaaatacaaaccctatatagtttatttcaggtgaaacattaaatagttttctactatattagaaaatacattaattcctaccaacactagagatttgtcacttaaatatatattactccattttagggaaaaaatgcttcacattttcataaaatacagatagactgcaataaagtgctttttcttagagtatacagatcctgagaaaaacaaaaatatttaaaaatattgtttgtcttgaaatcatattctttttcattcttacattcataaactaaacttcttaggcattagcctccagtgaccaaaagctctttcttcaaggaaactgccttggtagttcttgatctagcacacttgtgtgagatgtgtaaagtcaagggacatcttgaacatactctgtctcagtgatgttagaacaagcgaacagacgtgacctagagaacttcacaaacggtaatacctgatggcaagacagctgaaaccagaggcctttcttgtgctgaaacagccttctcactgcctgaatgcaatgtgcttttccactgcacacccaagtttgaagtgaacattgaatacggtcagtgaacgctctctctcacagaaacagtagataatacggggtctttagacatcaaaaatagcagcatcaatatcacacaagttatatttttggttcatgaatgtaagatagccatacctcggatcagagaaatcttaatacacatgaggccttaaaatagtaacagggcggggtagcaggggaaacacccaaatacatatgaattaaagaaaataactgataggcaatatttggtaaatgatgtgaataataatatttaaagactgctttccgttatctactttgttgaaacacttaagtatctacgtccatgatttaaacgtgtataaaagacttgggaattcttttagactctgtacatcattcagcacacaactgcaaaaatgtctgacgactctgacactcccaacaggatgaagttacacagaaatctgtaccaaactctgagattattgctttcagtgtagaataatttttctcttctttacaagaatgctcaatggttagacttcggaatatctttttcaattctcaaaaa

SEQ ID NO: 30888 - DNA, 1282 bp, Bovine  19866881798262
taaaaaggataagaaatggaatagaagaacactttaagaaaaaaaaagtctaatgaatatcctaagaagaaagcacattgtatctaaaaattatagaatgccatgagaagggaacagcagaaaacatgaaaaaaagtttggaaattaaaaataagatttcttgagttcagaaatttagtataaggatttggagaataaattaaatgaacactcctagaaagcagggcaaaaggacaaagaactaataagtgagttaaaagataagggagaatctgtctttaagtgtctgctaataattttagccacgaattatacattgcatacaggataccgggtattaatagtattctaaacactttacctttcatttaatcttctcagctggataccctttttgttcccacatttttagatgatgaaacaaagacccagagagattaaatactttacccaagcacacttagtttataagtagtagaactagagtttgacacgagacagtcccttacgctgtaggcctaacctagacattatgctgcttttctgtactatgctaatgctaaaatgttaataactgtttttgaaaaataatcactgagaggcagatttttaattaataattctataattaagtctgttttgaagcctgaaggcatttagagtgtttatcactgttgcagagcttagaaattataatattttaactcaggtttatgttaaattataaacatacttcattgaactttcagttcagttcagttgctcagtcgtgtccgactctttgcgaccctgtgaattgaagcatgccaggcctccctgtccatcaccaactcccggagttccctcaaactcatgtccatcgagttggtgatgccatccaagccatctcatcccatccagccatctcattgaactttagagaactttaaataatggagaacatatgttaaatttttaattcagttaaaaccgttttatttaccatttattcagtgatactttgaaataatttcattacaatatagctaagaataacatttaatctactcagcatttatcttcaagatacatattagaattttgcacttgttatttccagggttatcttgaagaactcttacaacttcgagagaaccagctgtctgaatctgtcgctcagaataaaatactactacagaggattgaagattctgacctggctcataaactggagaaggaacaattagaatatataattgtggagcttcaagatcagctgtaagtgagtcctttggaaaagttt

SEQ ID NO: 30889 - DNA, 636 bp, Bovine  19866881976575
tggtaatttataatagcatcgtttctttaacatttagtttctatgcctttgcaaatgtcaacctggactataatgaagaacattgttgctaagaatggattttctggattatttacaggtaaaaatatttcctttaccaaactgttgactaaaatgtttactttttccttttaaattaattgcctttcagcagaaaatttttgaaaatattcctcatttactatttcctcctaaatatctttgctgtaagtttaaaaattttaaataccagttgcttttgaagtaatttggaatcaaagtgaggagtgaacagttgggcttgttctttgacaccagttatgggacagtgttttatatgttacctcacttaatttgataactgtcagaatgaaaccaaataaattacattttaaaatgtacggtaagatttggtctgaacttttctcttccctttctaggactgattcctcgtttaattaaaattgctcctgcttgtgctgttatgatcagtacatatgaatttgggaagtcttttttccagaaacaaaatgctcaaagacagcgatactagacatgctgtttcaacctgaaataacagccatgaccaaataataagaggagactcttaggcaagag

SEQ ID NO: 30890 - DNA, 1443 bp, Bovine  19866880127245
atagaaagatgactgggataaatctgaatcttcagaatataagcaaaaatggtattttgtacattcagttcagttcagtccagtcgctcagtcatgtccgactctttgtgaccccatgaatcgcagcacgccaggcctcactgtccatcaccaactcccggagttcactcagactcacgtccattggagtcagtgatgccatccagccatctcatcctctgtcatccccttctcctcctgctcccaatccctcccagcatcagagtcttttccaatgagtcagctcttcgcatgaggtggccaaagtactggagtttcagctttagaaacttccaaagaaatccttccaaagaaatcccagggctgatctccttcagaatggactggttggatctccttgcagtccaagggactctcaagagtcttctccaacaccacagttcaaaagcatcaattcttcggcactcagccttcttcaccgtccaactctcacatccatacatgaccacaggaaaaaccatagccttgactagatggacctttgttgtacattactgttgtttatttttgttcagtccctaagtcgtatccaactttttgcgacccttggactgcagcatgccaggctcccatcactatctcccggagtttgcttaactatatgtctgttgaattggtgatgctatccaaccatcattactatgaggagtacttaattgaacctttgattaccttggccccaaatattcagatgacttttttcttaactaaacttatgacaccatcctaaaagtgaataaactgtatatgcagaagtaaattgacgggcatagcttttgctttgttaggtacccattcattgtgttatatctttaaacatggtctacattataacatcccctgaaaacatttccataactataaaatatatttttcaaagttcaaagtcctaactgtgggacatcaaaatactttccatatattatggcctacgttttgttccttaggaaagaaaaatgccataaaatgactttgacactttgtttacaaaataactactattaataattgattattattccttataaatatttcagttaaaatgtataattatataagtgaggagtctgagataatattaggataaaaattgatgtaatcgcatcctgcaaaggttagtggtgagcattctgataagttaatgtatgtgaaagccctttaaactgtaaaatattatataaatatcaaaacttttttttgtttgttttcataaactctggattatcaaacccttttctccatgtatcttctttacatttcattttcatttaaaacagcaaaaataagtagaaatagttactaaaaacctattgtcattttgtgatataaatttacttgaaatttaaatactttagagttcaaggcaagactccaagactgaaa

SEQ ID NO: 30891 - DNA, 4082 bp, Bovine  19866880412843
cttacgggaaaagggcggtatcaattactggttttgcaaatgtttaaaactacatatgggctattagttgggagaatcctaattttaaaacattgaaaaccttaaaatcttagtttctgaggaaacttcatctaagatggcatcaactcatctcctagtttttccttcagttgtgtatctttggcacctaccacagtgcttaataggtagtgagcattcaaagcacgtttgctgaaccgagttgtcaacgacaaggttgaaactgtcagcggaggcaaccaaaatacatctcctatgatgacaccaaccaagggcattcaccttgatgcaaacgataacaacagaccacaactgctcctcaacttacacacgaattttctatctccggagctcctggatgcacagacttgcaaaatgaaagtttcctctaagcttctttcaaagtataaagttctgaatctattaacaaaccaggacaaaggctacttgctcaccactttctaaacttcagagaagggcatccctggtggctcagtggtaaagaagctgtctaccaatgccaaggacactggttcgatccctggctcaggaagatcccacatgccaccgggcaactaagcccatgtgccacaattatttagcctgtgctctagagcccgggagccacaactactgagcccatgtgctgcaactactgaaccccaagaatcctagagccagtgctctgcaacaagagaagcctgcactctgaaactagaaagtagcctccactatacaaaacaagagaaaaacccgcacagcaacgaagatccagcacagccaaaaataaaatttttttttaaaattttaacttcagagaaaacaatagctttcagcactataatgtacttccagagaacaattttaagcccatccataaattccaaagcagcccttagggagaatgatatactcaggaacacatggagataaaaacaggccgtggaaagatcagacctggtaaccagccctaaccacttactaaccatggaccaaggacacatttctcagcctctttgtttctcagcagcattaaggcaattataaaagctcccctatctaaaaggtaagatttacacgaagaactaataaaataatgtataagaaccaacttaaatatcatagaaatgaacaacactagtctagcagatctggctttcatcctggctctgccacttaccattggcctaaccttgagtgagctaagaacactctctgaacctcagtttcctgaataacaggagtaaaccacaacaaaaggcatctgccatctccaatcgcccccaccacccaacatgaaaaattctccaaaacttggataagtccaaaaggaaaacaaagcagaaacaaagcaacccacataaaacccaagaaacccatatccacaatttagaaaaccaacaaagccaaccctaagaaatggcacccagctatgtaaactcctttaagtgcccgaagtgtttaaagagtctgtcacagaatgctccagcacaaagcaaaacacactgttacagctgctctgttcacactttttaaaaggtgtcggtaataaagggccaaacatgcgactctctgaatgtgcatgtatgctcctctcccatctatctgtctgcctccagttctgctgtctcatgacctggcctcacttactcagcatcacccaccccagcacagcacctctgaggctcaactgcaaataaagttaaaagctatgcataatcagtctttagatagcaaaattgaaaatgtctctctttgaaggatcacaaagctttctgtctgaaacctctgacctttctagagaaatcagagtcactgtagtttaaaaatgtaggtggtaaaagtacaaaggattacatttatccattgtgcatgtttgccatcttttctgagatgaggggcaaataccttcagaacaattagttcttcaatgctaacatttcaggctgcaataccctcattctccaagaactgtacacatcctgggcccaatgagatggcccttttctgtttgtttctattcctattttacagaaaatctaaaatacacgatttcagaatccctttttttaaaaaataagacttttgtctgtacagtaaataagcagaaaaaataataataaaaattcatttgaatcttcttaaaaaccacagtcatccttgattgggttggaagggtaagggacttttaaaagtacatgtaaaagaaaagagaattcttgataaaagtccttgtcacatattaagaggccatacaataaaagtattgcaatgactatctttccctgacaggaacagacaacaatagttgtgctgttgaccagcatcaagttacaaagacttcattctcagaagttacttgaaactactttcccaaagagaacctccaccatttaaaaggaggggagaaaagccaactaaagaaatcaatcagaaacgttagtaactcggtaatttttatacacaaggcatccatgcaaaaatcctgccacagtcctacagagatgcagaaagcttctgccaaattcttatcccaaatccttgcttcatcttaagtgtccgtaacccacttatctttaactttcaattacttaacgctaaaaatgtactctcaggtatacactgttttccatcaacaacacttttaatgtttaatatttatgaattatactcaacataaaagatgtttactattttcattcttaatctgctattatatctgagcccatacagctctgctgaaggtttacatgcagatgcacagtatcttaattactcattctacagtaagctctttaagcatctccattcctcattcatttggaatgtttaaaaatgccacaagaagggcttgatgtcatctcaacactgaaatccatctgtctatggccctcttttgactttactccttttgcagccaaaattttcacaaaagttgatgagaatttgtcaacctaaggacttgtgatgtcagctcctgtgaaaggcaatggaatatttgaaagtgacaatgatgggatcccatacatacaatattcactttatgtaggagcttaaacttaaatcactaatctcttcaaaattaaaacacacagaattctaaatgtttctaataggggaagaggaaaaaggtagggatataacacagaagagacagttatgagtttcccatattaagtaataggtcccaaattttgaaaattaaatgaattattgatgttgtagcaccacagttcctatttatccactgacaaatacctttccctaccaaaaattaccaatcggataaagctatatgactcaccacagatacatcttccccaacagcatgaacatgttgttgcactagccaatcacaggctggcaaaattacaaaaggaaataaaatcagccaaaccatagcaacaaagacaacagcctgacaatggcagatgctacacagaaataccaacaaaactgctaaatattattcatttttaaaatatgttttattgctactttcatttcatcttgcttttataacccatagagcatttcaaaaatagtcattaaaatatatacatgaatatatatgctctgaaaacagtttttgtttggaaactcacaggctattggtcccaccagaaactctcaccagagacatcaaaggtaggcagtatggaacctgatggagaggacagtggggtgtgagccctatttttttttattacaatcctcttttgtttccaattgaatcacttttaacacacacctcaggtttccctttctgggatgacatactccacaccctaacttttaaatttattagcacttttaaaaaattaaacttaaaaagaaagtcacatttctattttattctatgtaaggttcaattcaacacgcttatttttttaaataaatattagaaggattcatatatacaatgaacagatatagtataaattataattatcaccttttttctatttacaattataaaattcatgttgagtgaggctctaaacttttacacttaagtcattaagaactaaacctgctgaagt

SEQ ID NO: 30892 - DNA, 1213 bp, Bovine  19866880421914
gacccataagaaaatggaggatgggggtggtggggttgctatttgattagagtcaattcttaaatttccacagcaagaaaatattgaatgtgctataatggttgctggattttcttaagaactgaaatcattacactctggctgcaatccaagttcttccctttttttaggttacaatttgaaacggtgcagaacatgctatagggttgtagtcattcatgtaatgtcattgaatcgagcttctggaaatagacaaaggactttgtgtcccgaaatgttcttctggcagaaaattgatagcagtctgagatatgctattactgggtttggttctgcctccaaatttgtgctgactaaagtgatttcatgagggagagagagagaaaaggagagagcaagagagaaaatggctaaatgaacttgcaactgtgtggggcagctaaatacttaaaacaaatgctgcatggaagaaaagcacacatttcccagcaaagatgcgcgaggtttttcaggggtcactaaaattacgtgaacctctttgcttgctttgcttaagttgttgttgcccaaatggagatgatgaacaggcaaatgcctgacacgaaagccctgggcaattcccccaagccttcccctcccatccctgccctctgcagcgttttcccgttcagtgtcacccctcgtctggagctctcaccagactcatcaggacgacaagcaactccagcttccccaatcagggatgcagcctgaatgcaaatcaagctttggcctggatgctcctgccaggacacatggtgttgggcacaaacccatgcctggctcgttctttgcccctaagtcctttccaagattcaccatcttcatcactattgtccctttcaaaagaaaaagttagagttgttttgtgcatgatgtgaaagacatgtcaataaacctcctttccacataaatagcacatcaaaatattaccaaataatgctgctgactttgccagcaggcagaggattccatctggagataatatcttccaactgagaggcatccaaggtgccctttcctaggcaacgggcaagttgaccgctctgtggctgaatcccatcctctctgaacacacaggctctcagcaattccctcctctttggtcaggtccagaccacctgctcctggatctggagtcacctgctcccctccaaaagaactcacgaatcct

SEQ ID NO: 30893 - DNA, 2296 bp, Bovine  19866880465867
ctagtttaaccccaaaaaaattaaaaaatcttctcacattttcactgccatgtttctttatttatttatctttaatttattgtggtgtcaaagctcatgtctggtcttggaaaaattctggcacaaacttggctttttataataccagactattaaaactacaaaacctcaattaaaaagctgccaggagagtttggtgctcagtaccaaaaatgatataaagcctgccatcaggaaggaaagaaaaggagttactcttgcaagaaacccaagtcttagtcatataactaaaatcctagatataagggcaatcagatagagtctatattttaagaatatcatccaactcatgttcctggattctgatttcacacatattctgattccaaactttatacctaaaggtcataaagcattttatttgtttgtttcagtagatgcctcaaatcagatccaatcaattacatcctaacatgtgtaaataagaaaatttgcaacaaatcctgagacagattagctaccactctgccctatttgtgactgaataaacgcaaatcattcctgtgacataaccataagaataggatagagtgtgtgtgtctgttttacaagactgggagccatgaactcgggactttaaattacaattctgacagcagcgctacttaggaaaatgacttagcctccaggaataatcccatattccatcctatgcctcacccaattctaggcgcacagaaataataactacccagcaaacgaaggaattcaccaacctcgtggcgctggggtgaagattcatcagtccaaagtaccgtgaagatggaactattctgactgcagacatgtggggtgattaagacagtggctttggagtcacctgactggtgcccattttctactcaggaaatcggagaatagtaactcacacagagggtactgtgaggcttaaataactgatacagaagcttacaacactgcctgcctgccaccaagaagcactcaataaatgctgtcattatcaaaactcaatagccttataatcagacatagccagatatgacattttcccttatccgaaaactgcagatgtgaacgagagtttccccaattcctgatgtgatccaaaccaaatcaatccatcagcacgtatttaatgagggcctatgacccaacattcccagcactcctgttggccggctctccttacatggaagacaaggaagtcttttctaacacaggcaaacagatcctgtataataaaacattcatagttaacttaccgatttagaaacacagtatttatttgaaaacagaaaaagcacctgtggcttattcttgagccacatacagaaccttttctccatacctatactctaggttctgaggccatgtgctacctagacagaaagcagaaagaaatgcagaactccagttgttgcccaaagatcaggcccaacctcacacctcaccttcaggactcctgctctgtctgccttgactatccagtcctcctcctcttcaccctgcctgccctttacgtgccttctcctggccacagaagaccacccatctctttgaccccctcaccttgcctacacccgctttgaattgatcacagataatctgttggttgatgatgagcctgaatgactgactagccatgatgccctcaaatttatgaaggcatctaaccagccattcttcacgcgtatcatgtgtcatcttcacaaagagcctgttacgtaggtattactatccttgtttcacagatgaggtaacatttactgtacttaaataatttatctacagagggaatcagatatacagggctttgaatatcaactcaagtaccagttatatgaatttcagcaatttatttaatttagaaaaaatacaaattaggtatggactggtaggtagcaacagttcaatggtaaaataatgactataacctgccccaacttttaatgaaggaaatgttcaggtacaccgaatgactgattaccaactttgagagaagagatttccatccaccataaaagccttataagattaattataaaattcctctaaataacaacagcagcacagagttaaataatttggctgaaatcaaacagtgccaagtggcatggccaggattcgaacctacattattaaattagtctgttttaagatcaagactgaatgcataattcatatggggaaaacaaatttttcaagctcaagtaaaaaaagaaacaaaagaaatctctagtatcttgttccgagttcccagtatacatcttgctct

SEQ ID NO: 30894 - DNA, 1002 bp, Bovine  19866880505677
tcagagcctttaagtgctacaattcacttgtattgtcactaaaaatttttaaagtggaggggatggggggaatgtgcctccccttccataaagagtaccagcaccttgagttcaatcaactaaagtcagagaacagtctccatttgtaaaatggtaatattaatacccaccacctgcttcccagggctggtatacgggtttgtgttcatttctgagaggggcttgagatccttgagtgaaaggtgtgatgcacagtattataattctcaccacagggtaacatatggagagggaaagaaagtgtatagatacgtatgtttctgtttaaactctgtgtgcaatgctgacttttatcttattttgcctttaagctaaactgcatgggtcacatttagagcatatgttgttatcatttgcctttttttagctcaagaaaattgagtgaataacgggtattgttttcctatttgccatggttagaatggttgcacgtttcaaaatctctgactcgacacacagaacagcagattctcttattatgatgcccagggtgaggggtttcattgtgtgtttctcccagtctaccatccatgaatattatagatcccattttgagtattatgaaattggccaagtattactttacaagtgaaaaaatcttttcagcctccttgatgaaaagaacggacaattaaaccatctccctgttggttacccacatgcctctcactcacagcgccttaattggtctaatatgcctttccctttttgctcttttcctataatgagctctcatgttagtgatcttgtattttaaacccttacggaggacccagcagtgtgttaggacagaacctacacttctgcagaaagcctctttttcaatttgattttaattagaaaccaggtggtacaaacccaaaagtttggtggtgttcctcggatgtaagatgtgaaaggtttttaagtaacactgtattagtcatgaggcagcaaggagta

SEQ ID NO: 30895 - DNA, 1353 bp, Bovine  19866880526905
ccctcttaaatatatcacatttccatttgcttggctttttatttcaagtgtatgggttagatgccatcttgctattgtaatactttgagcctggaataaatttagtatcttggaatttttttccacactcccttttacttaataattttagagaacataatatacagtgtttgataaaagatttggaataaaaggaattgagagagtaaataaatcttccaaggttacagagcaaatcctgtatctattcaaaggccttatactatgtaggcaaactaaaagtcatgtgtgcctgtgaatgcgcgcacgtgcacacacatacacacacacacacacacacactcatagagcaaaggtaaacactgcattagcaacttaggtgttattttctataaactctctgtctttcctatttagggaagaatacctcttctttccctttctcctctcttttaggaaaatgaaacagtccagtagctatttttttaaaacagcaacaacaacaaagtctgcttcttccaagcttatcaagaccaaacacctttgtagcgcaccatcactgacgtcggcacagcttgatgataagtgtccagccgttaaaaaggcagtgacactaatttttgctctgctcagaccatcaaagtaccaaagtaaagaaatttactacagcactcaatgaagaacaccatttttcagttaagttcaaaatgttactaataggtatccttgtcacttagacagcaacggcagtggggatactcttaggcaagagtgcaggttaggctacagtcttaaacaaccagaaatcctacagtggctagcatacagggaaaatgcaaaatgctatgaccactggctgccaagctgggtttctgggctatccccatagtgtaggtcttggctgtcatttgcccagaagccctacagcttcttagaggtcacctcaagttttaccctatactcacatttacagaccttcttcctaccccatcaaagtaaaaggaagttttaagacgctgctatggatcagagctgtgaacccgtctaatcccacctacattttagatccttcagggagacaagtgtgaacttattcattcactcagcctctctggggtcagggaagcctttgggaactcaatgaaagctacagttgacagggtctagaagttgtagtcagtcagctaccactcatgaagatctctagggcaccccttggggtaggatgaggaggccaacatggtatccgctggtactcagtaaagttctgattgtctgacccataccaactgtcaccataccttccaagaaacacagtaaatgcccaaagagtacgtggctgaggtagtgggg

SEQ ID NO: 30896 - DNA, 1095 bp, Bovine  19866880553774
tgaaagtgaagttgctcagttgtgtccaactctttgtgaccctgtggactgtgtccgtgggattttccaggcaacagtactggagtgggttgccatttccttctccaggggatcttcccctacccagggattgaacctgggggtatccctcattgtaggcagacgctttaccatctgagctaccagggaagtctcagctgcataggcatgtgaataattgcttttcttttgtgatggaatcaatgagctttttcttctgtataattgtctttgaaaaaggcagagaaaaagttaaagggggagagagagagctagagagaaaaagagagagagagagaaccccaaacccatcaagcccatattgcacattggctgccagcaatgtttcttttaaaataaaataaaaatgttcagttgtagattttttcccttttggagagatgcaggaattgcaaagacagtgccagacagcactagcatatgcttatttttctagctcaatgtgggcagcctttcttaaacattttgtataaatatatttattctcccactgagaccttgcctgccaggttcaggaacaactgagtaagcagatgcattataaattgaggaaagaaaagaaaggattgccatggaaatgctgatggcccctttattctagctgagtacattgccctggtataataaattactggttgatgcattgatgataaatctatagtggttttcatattcaaagtaaaagatatttcactctgtctttgctggagatgtagtcagaaggcaaggaaatgttgacatccggtgggcaggattaaaaaaaacacacacacacacagaccctttggtgtacaacccacatttgcaagctgtctgcgtttcttgtattggcctcagctttgacaaatgtaaaaaagtcactaatattttgacactctgcctgcccaagtctgataccagctggctgtgaagccacatactcattgttctgctggattttaaagactgggtcccagccaaaggactggactggatccattcattcattttcaagatgaagttgcagcttaactgtaagaccatttctcaactcaa

SEQ ID NO: 30897 - DNA, 1205 bp, Bovine  19866880577408
cctatgtaattctttcactaatgcacccaggtagcaagacactcttaaatgtcttgtattatttaatcttctctaagtattatctcatttaatcctcccagcagccctgtgaagcagtatgattagccccattttacagaggaggaaacagccaaagagaggttagatggcatgcccaagatggcacagctatccagtcccaggatcgcatatgtttttgctgttagaacatgatagctaccctgctcagtcactttggcattctttggtgctctgtgattgcttccatcatgtatgaaaaccctgaaaggattctgcgaagagactgtttcaccttgttagcccctggtgccttattggtaaatgtcagctgtaacagtatccacctaccttgtagggtgattatgagaattaaatgaggtaattcaggtaaagggcctagcatattgcttagcatatggtaagcattgaacaaatgcttgccataactagtattgttgtttgtttagccgtgttgaaatgagctttgtgatcccctgggatgggtctgagccctccttctcctggtagccctcacggggaggatagacccccaaagagaaaaagttggcagcagctgaaatggcccgccacccaggttgttagcatcgtccctcagctgcctctccaactgccatgactgctttcctaatttaaaaattactcttcccattttatatttcggctcagaaatcgatgcatctgtgaggcagtttgttttcccgggaaagtgtaaggagcccctggtggtggtatggagacgcgctcggtttagactcaatattgccacccactccctctgcagtgtcagagaacactggggaagatctgttcctcccccttgcacactggggactgcaggccgtcccatcctccagggctctgcttttctgcgggtgtggggaagcattgattccttgcaccttgcctcctcctctttgtgcctctcacgtttccctatcttccagacttcagcactggattgacgcccgtgtttctcatagccagggttccgtgcccactaaaatccagggcaaggctcttcagagcccgatttcccatttcctcttagtgggtttctgcgagagtcgatggtgatccatttgtgcctggacgaaggcggtccttcaagggggaggctctgctgcctctgactgcagttttag

SEQ ID NO: 30898 - DNA, 2037 bp, Bovine  19866880624983
tgataaaacattttttgaggcatgagacaaatttaaagcagaagtgtacaatggattcctatgtcaggaatcttgaaaattagtactttttagaagtctgtttcttggtaggcataacataataaaagagagcctcactaacgaatctttgcagtgcagaaaattatgggatgaaaagaaaggagaccttttaaaaatggactttagattcatatgaaatgacctttgtagcatcacgttgtcaccagccttcccctctcctcttgatcagcaagtagtaccacttagagctttattagaacatccctttgccaacttggaatggctccaggcaaatctgtcttccaaggacacagtttgaagtacttaaagtaaattgcaatggactggatggatgggggccacgggagtggatagccaaatcaagcagcattgcttgagataaagtccccctccaagaggcacttggtatccaaatggagaccagaacatattcatttttaaggactcccctcgagcagaaagatgatttttacacctttaaaaggaaccaaaaatcctaaatttcttcactttaaaagagtttaaaaaaaaaaaaaaaaagactcagggcataattttgcaaagtattttggggggattcacaggagttaaaaacaaaaacaattccactgacaaatctgggaactgctaaaagttctcagactcttgaataatgtatatcatgactcttcaagagagacaatcgtatgcatttatattttaaatatatttcacaataaaaacccaaaaccctatttccatggagtgtaagatgcaaatattgaaacacgtattttggctaatataaaacagtataaacagtaaaatgtttgctgtttagttgctaagtcgtgtctgactcggttgcgatcccaccaactgtagcccgccaggcttctctgtccatgggatttcccaggccaagaatattagaatgggttgccatttccttcaccaggggatcttcccaacacagagatcaaaccgagtctgttacattgcaggcagattcttcactgctgagctcccgggagctgttagatttaagtaaaactgtttacaattaaattgaatagctgaatccaagacaataaattaacaaaaatattttttaaaacaaactgaaattctttaataattatcctatgttaagcacattgtctgaccttattgttctattcctcagtaaataaaatataattctattagtggtaaaaaaaaaaaaaaaaaatctctcttcatctccacaaaagttctacctcaagcatttctcttcatattaggcaagagtcatctggtaatttgtaagtggagaggccggttttcaaacagggtgatttctgattatgggctttaaattatttataacaaaatttaattttcctggaaggttcctctgatgaaggtttagatgatatcctcagaaaacctcaaggtaaatgttaagaaagtttagcagccttgattcccttgagtatggccaaagttgtctgataaaagaatgctaatctgaacaaacagaaatacagaggatggagtaggggataataactattattttaaagaaaattactgagaaatgagaaatccatactttcagaccaaaaaaaaaattagaccaaacaattctggaattacatggaatctaagaaaaagtcaaaaagtgattacagaaacttttttttttcaaaatataatttgatatgtttatcttaagttaaattttagggagcttctaagtaaataacaatctcattttatattttcaattctcgcctctcaaacttgaaaaaaatgtaaatctgtacaggtagactgtcaaaattcaaattatgcttctctgcagaagtacaaggaaaggctcttcagctcatagttgcatggagcacccttcatgaaagctactttagaaaagtgatacaagaatctgcttgggttacagtaaattttcctgggaaacatttgttctgctttatttttgcttttggactctgc

SEQ ID NO: 30899 - DNA, 1841 bp, Bovine  19866880626525
tggctttggatggtcagcttttggggaccagtttggtaattaggtaagagggctttgtgaagaaaaaccatttgaaaccagtacctactcatggaatttattttgtgtgttccatcctgttctaagtgctagcagaagtatgaagaaatgcaggagtaattcttttgagatttacattctaaacttcaatgtagaaactttttgctctctcccactccctaggtccatgtcttagttctatcataataaagtggtggggttaatgttcggagaacacagactccacctcatacattaagctgacatgtttctcttctgaaattactatcttcatcctagaatttcagttacaaatttcatcatcttctggtatggttagataaaagagtgaatgttgaatacttgagattttataatagatagcatagtactttggagacatttgttttattctctgatgtgtaattgtgcttctgtgtcatggaaacacatattggttggggtgtgttgggcatgtatctggagatcttagctacttctttttggtacctttccccaacagcaacagtgagcaatccagggctctttttagtaatgaaaggacagagtggggatccagtctatatgtcactttgaaactcattcatattcttcatatcacctatggtgaatcacagcctgacctccctaagttgcagtctcagagcttctgaatgtgggctgcaggcccacaggtgtgagggctatttgagaaactgaactgctgctcctgttcatgaagatgaattttcagccaaagccattggtgagggtcaaataaacccatgttatgtgtgattggcatcagatggactaatctgatgggatagttgctcagaaagttgattatactagaagcttatggtagaaattaaacattttcaaataatttagatgctataaaacatagcagtatagcatggactccttagtgtctggaggcaacagagctgactggatttaagcaagaagagcatagacacatggttatttaaataaccttagagatgccttgaagaagcctagagatcatggcaacatctgaaatagttgaaagaaagggttatatcgatattaaatgtattagggccaagaacattgtctcataataccctgtataatcctcataattaatgcctcacagaggtgaacagaggctcctaattacaccttctaagaggcataaaggagatttagacttagtctagactggccccaaagcacaaggttttcctactctatccagtcaatcccaggcccttcagccttctccaatctggccttgatttacgtgtccaactttctcttccagcgcaaatgatgggctctttttcttgccaccatcacctcaatctttattgtctgtttcctgcgttgtgagaacacagaaatcacctccgaccagtttacttgcagggtcacccaggaccagaagttctgagactccaacagccaattctaattttacctaccctttagttgttgacacggatggaggagcctggtaggctgcagtccatggggtcgctaagagtcgggcacgactgagtgacttcactttcacttttcactttcatgcattggagaaggaaatggcaacccactccagtgttcttgcctggagaatcccagggataggggagcctagtgggctgctgtctatggggtcgcacagagtcggacacgactgaagcaacttagcagcagcagcaccagttgtacactcacctggctgcaccatttgaatttttaatgagacctcccctttttgaattttattctcttaatcagcttgcaaattc

SEQ ID NO: 30900 - DNA, 1169 bp, Bovine  19866880646452
gggatgcttggggagtagcatcatggccctgtggctcccaccgcagggttgaagatttgcaatttcattacaggaagccttcatttctggaaaatatgagtaaaaatacgagtaactaagtcacttcagtctattttccatatttagatatttccgggcacctgcgtgccgcgtccacagcccccactatatctctcagaaggtgctgtcttctcctgccttttgctaagtgacaggatttaccgtggccccttgcattaggtttaaatcaggctctgtgatggcggcattttgctaagcaagagctctggtgcaggggctcagtaatgaatgggtctttccacaagcctggtgcatttaataactgctaggttatccccaagtgatttccatgggagtggaccccaaattgcctatcagtccaaatgaagtatgccacaatttcccctgcattccagttactctcttatttcagcaccacctgctcctagtatattccaccagggctgactatgccagcatcgtcattaagggctttgtctttctgtgatgtgtaactcatcattgcattggcctgtccctgctcagtggctaaaagaagtatttggcagtgtgtcagcaaacctctggtctgaggggcaaaaaataagctgcccctttcatatcagaagagactttgaacctattggtataagtgtaccacattattatgttgtgtgtgtaaattattcttggcatcagggtaagttttacccaggcatggtatgtggaaacaccagggattttggtgtcagaaaggactgggctcaaatcctagttttatgatttactaagctggtgactttaggcaagttaattgtgttaattaaatgcttcacgtttccccaacagtaacatgggtgtggttcctgcctcatgggattgccgtgagtagtaacagagcacatgggaagcctgaagactggcctgctacttggtgctttcctgctgcatgtcacttgcctcccgctgtcttatgcgtgtggtctcgtgagttttctcatctgcaaaatggggatatgctgaacacagctggaggtggagaacaccagctctgtagccagggaaacttgggtctgaggcctggttctacctcttaccagtcacatgatcttgggaaattacttaat

SEQ ID NO: 30901 - DNA, 1956 bp, Bovine  19866880655722
acatctttctgtaagccttgaagataattataattcctggctttgcatatcatctatgtgtcaaatactctaccttaacctttctctgaactacagtcacttttttttttatcactctctatttgatatatctaggtgatatctcaaacttcatctgccccaatatgaaatgttgatttttccactaaagtcctcttcatcacagttaatggcaccacctattcatttgtttaagcctaaattctgaaggagatcagccctgggatttctctggaaggaatgatgctaaagctgaaactccagtactttggccacctcatgcgaagagttgactcattggaaaagactctgatgctgggagggattgggggcaggaggagaaggggacaacagaggatgagatggctggatggcatcactgactcaatggatgtgagtctgagtgaactctgggaattggtgatggacagggaggcctggcgtgctgcgattcatggggtcgcaaagagtcagagacgactgagctactgaactgaaatgaactgaaattctaaaatagttccatgattttttttcaccaatctctcattggtaagtccaaaataaatcatttttcttttcaatttgaatttttaactcctctcgttcataatttttttctctccatggcaattatagtgatatttctaaaattatgtcaagctgcttccctgcctaacaccctccaatgatgttctgctacatcaaaaaaaaaaaaaagaaaaaacaatgcaaacttattcctgtgtcctaaaaattgtacatgttctggctgttgccagaatccatctttatcacttttcctctctgttctcgtgacagcctcatgagtcttctttcttttccttgaacactaacttcattcatttctcagtactttgtatttgctatttcttaagcttcgacactttttcatgtctagctccttcttatcaggtaagatacagctcagagaagccattcctaactaccttatctaaagaaaccaagttaaagcactggatcacttttattgaatcatcttattctatttttcacataactcatctatgtgaaattttcatatttgttgattatccataatcctgccaaagaatacataatcctcaggaataaaccaaaatgcctagaatgatgtgtaatgcacagtggttgtgtacttattaaagtactgtttttctatttaattttttttaagctaacttctccctattctttcaaatacttagtacacgatgacaacaatgtgagttcattaactataatctattccatgttcacaaacaatctattctagttaccttgccctatatttgctctgagcagaagctggtcttcacctttctttgaaagcgtcctatgcgtttttacaatatttgtgtacatagtaagtattgaataaatgttgatgaatggactatagaatgggcttttggctccatacatcaagactttcttgaaggacagataattacttctactttatatctgacattttaatataactggctgtggtcattatcctttggaattgcattctagtcaattcttacaaaaaaaagaaaataaggcacaattactttgtgagcaatccacaattggatttgcatttaaaaattgccgagtgagcactcctgcctgatgcccaaatgaaattaatctcttgtaactcaaggtcttctctatttggagatgcaggggtaggagggttaaggaagactgaaggattcctgaatggtaaaagtcgtctctctcattatttatgtttatggggtgcttgcattgatctctcactgaactacccaaggggaatataaaggtggttaagatactgtccctattcctgagaagctctccatctctaggttacatggtcacatccctgtccagcctgcacatgacttcttggaaacatcc

SEQ ID NO: 30902 - DNA, 873 bp, Bovine  19866880692289
ggcaagacaggagtaagtgagtccaggactacacttagaaattcactgaccaactaaagaccacattggaatctcatttttttaaaagagaaaagggttatcttgcctgtgatagctgttcagtgaaatcatcattaagaagtactactatccaagtagtttcctaaacattcttaattcagaaatcgccaatgaggacactttgacagtttttgttttgagctacatttctatgcccacctgctacaaatcttgtacctgaagcactttgtgcggaaactcattaaatgctctcacaaagacagcacactaccactgccttccctttgtttaatggcacaggccctctccctcataaattcattctaattaaattatgcttctcaaggtgctccctctcacgcaatccttatgtaattgtacgtaatattttctccacaattgatgttacattaaataggcttttactacctgctatcctcctaatggcccttactcctttctttctttctttctttctttttcagctcaaaagagacaggaatttgacaagaaaaactctattataaaagtttgcctcaagctttcatcaagcttttcataattttcttaatgacacgtaatatacacagaggctaaacaaatgtatctctctgaacaccagggagaatattacattttaaagttcaacgaaagaaagaaaacaggtcggctcatgggtcgtttgccatatttatctcaaggcatgatgctataggtgagaggatgtgttgattaaaatgagtacaaggaattttacaaaaattatcaacagtcattacctttttcataggtatagtaaaaagatattgattctttaagctatcagaagtg

SEQ ID NO: 30903 - DNA, 762 bp, Bovine  19866880692729
atgcattctgcatacagttactcttaaaaaattaagcatgctgataaaacaaaaaacaaatatcatagtctcctgtatgagcttctgaagcatgagtttttttaaacaaaatgccactagtcggtcatatatcgcgtgtaaaatttgttctacaccaagaatgcagtaaaatgcaacttcatgagcaacagagaaaaacaaaggcatatatattctcagtgacagacgcttcccaaatttatcttaaattagcttttattaataaccggttcaagtgaagattcctttaacttgagacagctccgcagacctaggcgtttacgacatgaaatgaatactgccttggggatgtgctttttttacctgctaaattcctctataaaatttatacaaatttcttgtccaaatcaagtgttaggtattgcttcctaaccctaggttttcagtagcacactatagctacaattttctcaaaagctaccactaaatttcatttaaaatccactgaaagcacctacacacaaaataagaacatacctcctaagcaaatttacctttaattttctttataaagttaaaaacttataaaagtgtgaagtacagaatttaaaatacacttttcaagtcagaaggagaaagacaagtatcatgtggtaccacttaaatgtggaatctaaaatacgataccaacaaactattcacagaacagagacagactcacagacgtacaaaacaaacttagttaccaacgggggagtgggg

SEQ ID NO: 30904 - DNA, 1298 bp, Bovine  19866880740301
ttctatgatgtaatctgcatataagtaaataagcagggtgacaatatacagcgttgacatactccttttcctatttggaaccagtctgttgttccatgtccagttctaactgttgcttccttacctgcatacagatttctcaagaggcaggtcaggtggtctggtattcccatctctttcagaattttccacagtttattgttacccacacagtcaaaggctttggcatagtcaataaagcagaaatagatatttttctggaactctcttgctttttctatgatccagcggatgctggcaatttgatctctggttcctctgccttttctaaaaccagcttgaacattaggaagttcacagttcatgtattgctgaagcctggcttggagaattttgagcattactttactcgcgtgtaagatgagtgcaattgtgcggtagtttgagcattctctggcattgcctttctttgggattggaatgaaatgtacaattggaatgtacaactgtgtacagctgtgcaaagcagtgagagtccaatgaaccaagtagttgcggtgcttacggtgccaaatctgacactggtagacatcagcaccaaggagtaagggggctgtcagagagaaagagaagggtgccaggagaagagcaaatggctccctgttaggggggcctccccccaaattcaatagttatcttcttcacagagtcttaactccctctcacactttcagccattcttctgaacctttagtaaaggctagaaagaacctagtccttcctctaaccattgatcttctcactcatttgtcatttacacagcatacacaccgaacatctcctttccccaacacacaatgcagagcctgaggacccagagatgagttcaatgtgataccagccatcaggatgctcacaatccagtggggacgcatgaaaaaccctgcaatgaatgtgctgagagctgggatggatgcatgcgcgtgaggatggagggagcatgggtggtccttcatggctcctcaaaggactctgcatccctccttcctccgctctcccacctccctgaagctcaccttatgctgaatcaccttatgatgcacccccttgtgctgaatcaacaagatcaggtacaggcatccccagtgaggaaacaatgagggcaccagaaggtcaccacaaataggaagcagctatgctgctttgtgatttaaagtactaaatggtacacttatttccattaactgcaatagagtggtgttctcatgggtgaaaatagtgggattttcataacatca

SEQ ID NO: 30905 - DNA, 1022 bp, Bovine  19866880785585
taattttatgttggtaaaaagtgatttcaaaatatttgttacaaaaagtgactttgagtatgaaagagttgagacccacaggcttagaggcataaggttacaaaatgtttcagctggaaggaatctgggggattatctacttcattgacagataaggaaatttaggctgaaataaattatatatccgacttaaggttacccagcaattattggcaatgccaggccttgaacctatgctaaaatccaggactctagaaaggaactaattctttcttctttgccttcctctcttccttccttccttccttcctgccttctctccaaggaacaaaactgagctcttactgtgtgccaggcaatagggtgggtcctgatgactcagagatgactaaggcactagctctctcttaagaagaccacagacaggctagaatacagggaagaaccaaatatcatgaaacatgcctcagcatagacctgtgttcaaaacattacaaggagcaaataactgagtcttcctcagggtcttgagcaaaggacggactatgaatcttcaggtagaagagaggttttgctctgttgagagaaagtaactttcattccaggtccttggtcagcatggacaaagacacatggacaaagacacaagggcccaaacgagagcatctgtgatcaggaattgagtgtccacagcccttaatgtcaaggagtgcttcccagaagcatggggttggtcattattctgacaaatatatgcaagcagagaacaagcacagagcagggctggcctcagaggactcaggactccctgagatcacaggggaaaaggaaacgaagggtgacatctctgagctgctctgtaggtgataagggcctgataagcctttggagttctgcaggcactggctggagtgcaaactaagaaaagagctcgttgattgctgaagtgattaagtggatcaccttattgattctcacctagcctggaacagacctcaataaccaacatcatttgctttaat

SEQ ID NO: 30906 - DNA, 1272 bp, Bovine  19866880824893
tcaaaaacatttctgaatagagtcaggataaatacaacccaactacatatccatgttctttattctgtgctgtatgataaacaactgttggtggtacaggccttcacagaacagaaacctaaatttttgtacagtttcacactcatgatttcattgaatcctcacaaaacttcaatatgtaagcagggctgatgatacttaaacatttttcagagaaggaagccagagggagaggttgaactgtctaaggccacagtgagcagagactagaaaaccagatccattcacagctcttcacacgaatttgcagttctaaacagctgctctcaccccaccctcgtttatttttcctgaaaattatcactgaactgtctgaacacgtttaggtaaatcttttaggtacccgcctggattttatagtcgtccattcgatttagataattaactgttttctttctcctatcagattcaaaagcagtatttcttcactttcccaggcctcttttcaactttgatatcagagatagttattcactcctttcccattcctgcaaaatatcctttgcatgatgtaatgaaactggcactgaactggggattaattctttaccagctgtaagaccatgagcttcactcggctagtttcagttttatcatctgtaaagcgtggtggctggagacttctgagttccccttcccctttccttctgtgaattgggtactttgctaccttcactctagttatgacacagatttcctctctctggttagcccagcagctcagttgtgcgacaccatctttggtattgaggaatttctgcagtttatcacggtgtgtatctatgctgctcaattgcaggtgtgcccaactgctcagtcatgtccaactcttttgcaaccccataggctgtagcccgccaggctcctctgtccataggatttcctaggcaagaatactggagtgggttgccattttccccctccaggggatcttcccaacccagggattgaacttgtgtctcctgccttggcagggagactctgtaccactgagccacctgggaataagaaggatgggtctagggtggaggaaacgaagagctgttattcagtgggtgttaagtttcagctatgcaagatgaataagtcctagagatctgtacaatacagtgcatatagttaaaacactgtactgtgcctttcaagatttaagaggttagacctcaagataaatgtttataccacaaacaaaagtgggggggcacaaggaaa

SEQ ID NO: 30907 - DNA, 3406 bp, Bovine  19866880857631
tatatacattaaatacgtgcagttctttgtatatcaattatatctcaataaagcttttctatttttttaacaatggatccacgtgtttgcctttgattacgattagagcccactagtacttaaaaaaaattgaagcctgaacttgttcctaagtcagaaatcatagctggagctttggagaggaatgctaaatgaattgaactgttttcaaccactcaccgatgaatgaccttgagtaaccactacagtttcctgagccttagtttcctcaattgtgtggttagaatgacaatggctgacctgcctagaaggaaaggtaaaggtgagaatgtgtgtggaagatctgtgaaaagcaaactcaacgtcctactattttattacttaaaatttccatccagtgataatgccatgtcttgcaacagccatactcctgaccttgtgttttatcagactgaaaggttggaatgcccaccatttgttcatctattcattcacatgtgaatttgcccaacattcattgaggatctactatggcactttgcttataggaatccaggaaggaatgaagtcatcgcgcttccaagggagctcatggtctagcagacaaatggacaaataaataattgatatacaaactgatgggtcttccctggtggctcagacagtaaacaatctgcctgcaatttgggagacctgggttcaatccctgggtctggaagattccccagagaagggaatggctaaccactccaatactgttgcctggagaattccatggttagatgaatctggcgagctacagtccttggagcgcaaagagtcagatatgactgagtgactaacactttcatacaaatttatatacaatgtgaagagagagctgtcctaaaaatgagtataagacactagagatcatgctggagggacggatggattctgccaggggagttaggaagtagtatttggttcttgaaaaaatgagtggaactcattttttaagggatttctggacagaaaaaaatcacacagacaaaggaagagaggaatgaacatgtatgctatgttcagaaaatgatgagaagagatgagttatttagtgtgtatgggatgagcaggtcacagaattgaggcaagaggagagtctggaaaaggaggctgataataaaagcaaatgtaatctgtaccaagttgggggaaaaccataacatctttatagagaaaattatccaaagatctcatgagattattttgtaatcttgattattagttgtagtaaatgctaggctgctatatcagagacctcagaaccagaagtttaaattcgatctaggctgcaggagcaacttcgctccctgagatcacttagggaccaaggtccttccatcttgccactctcttgtctctgagggtgcagacctgctctttgtcattgaagtctggtctctgacatggcctcatggaagcccttagagaggccaaaaatttacaacaaatttcttttaagcaagtaacatggaacttgcactcagctatcctgcttccatcctattgagaagaacttaatcatgtgtcatgcctatcggaaatggaggctggaaaatatagactctaattgttcatctatgtatccaaaagtagagaacagatttaggtggggacagtagactgccacaacttgcttatttggaagcctcttcaaattctatatttaaatttgcttctagtatttatattgccgtgttatgtattatcctttatattgccatgttagacctctaaatgccagtgttcattacttaccctaaaaagttctttggatgatctaggatttacccaagcaaatcaagaaaatgtgaagtatacctttgtgttcaacattcaatttagtacagacatttaaagttattattagaaaaatatagtgattctgaattatgtttctattctgtaaggctctgatgttctagtctccatatcaatgccctgcaagaggattaggtttttatttgggtcaacaaagcaaaattcctggaagagcatactattttcgaggcataaagccagcctatgtggaaacatgaggctctcaaatgggttgacaactcaaaaccaccctatttaatgtacagctgtttttcaatggggctgaagttactagaacacaaattcagggagtggaaagagctaatagagagtaaacagtcaatctatgtgagctactgttatggttgctgttattatttttaaattatttaatattgtaggtttaaggatatagaagtagcaatttgtggggtgaggaaggtaagaagagcttctttcattaacagatattaaacgtcatgtagatatttggactttgggaagaatgtggaaacactgcactcttatgttgtccctattgatcaaagtccctgaaatgaatgtgaatgatgtgtctctcccttgcttccacacctctctcctactctctcctcttccctcctttgttctcttgctcattcatttcttctgtgctatagttcaagacttcatcttctctcgccttgtcctaactggtctctttgcctccactgctacccgtgatctttctaacttgcacatcttatcttgactatcttttggttaaatacctttgaggcctctccagtccctcaagcaaaactcataagggtctctaccgtcttgcctcagtctgctttaccaactacatctctagttactagctagtgcaatgagccacaatcgaaccccacccgattctctggcccattgcatacgctgatatcaccgtgctttcctagacaagagtactctgcccctcaattgttcacctgacaaatgcatacttttagcctaacactaatgtcacttttttttttctttttatctgtacacccaaggaagatcaatcatctgtattcctgctgccctttatgtatatctaagttcgagatagcacttactatgttgttatttacctttatgtcttgtctctgccattggactgaaagcttcttggaggcagggataatatcttattctctgtttccttagctcttaacacattcagtgtacctagaatacgggtgtatgtgtgtgtgcacagtgcatgctcagtcactcagtcatgtttgactctttgcaaccctatgaactgtagcccatcaggctcctctgtccatgggatttcccaggcaaaaatactggagtaggtttccatttcctcctccaggaaatcttcctgtcccagggatcgaacttgtgtctcctgcatctcctgcattggcaggcagactctttaccactgagcaaaccggaaagctcacctagaacactataaatattaaacagtaatagtattattatagctacctttattgatcacatatattgtagtaattta

SEQ ID NO: 30908 - DNA, 4007 bp, Bovine  19866880902468
tctgctggaagaaaacacacataatgtaacaagtgatgttaaatattatgaagaaaaacaaagctagataaagaaaaacggggctttctaggtgacactagaggtaaagaaccccctgccagtgcaggagacaagcgatatggttccatccctgggtcgggaagatcacctggaggaaagcatggcaatccactcctgtatttttgtctggagaatcccatggacagaggagcctggggggctacagagttggacaggactgaagtgacttagcacgcatgcacacacaagggctcaacagtggagtatagggcactattttacagaaggtagtcagggaaggcctttttgacctgttgacttttgagctaagacttgatgatagtaaagatgaggactatgcagatatttgggacttctcttctagaaagagggaacagaaatggaaagacccagaggcatgtgggaggaacagtcagggttagggtggctttgtggtgcatcagtgaaagaagagcagttggcagcagggctagcaggaagccaaattatggtgaactttgttggccaaggaaagacacagcaaatctttgatgaactataatatgcttgacaaaggaacgcacataccaaatccattcatctacttgctgtggtggctactgccctgagcccttgcgctgtgttagatacttaatgttgagtggtgaacaaagcaaaaaggcctaattcatagcattgtcaaaggagactgtcgtctgccatggcagtatcttttagtatcctgaaaggttttcccttatgcatatgttactgaaaaaagagtcacttgcataggatatttggcttcacatacactctcatgcaaacaattctttttttttttttttaatttaatggagatctaaatctgtggggctgcagtttaacccttatctcaggactctgtttagattgtaaatcctcaggtctcaagtccatgaccacgaagcttgatattttttcctcccaattgttgctagatttagcaaataaaaacacaagataccaagttaaatttgctttgcagaaccacaacaaataattattttagtattacatgggctctatttattacaaaaaaggacttgtttatctaaaccaagtcacgtattttatctggccaccagtcctagttctctgcacactcccatggaggtttcacgggcagcagtaagagcagtactggaaaaggttcaattagtctgtgatgatttcagtgatcacaaagggtcaaaccactggaatttaacctgctggaaatgagacctgagaagagtatcgcaaagttctaatgactcaactgcttaaattccattcattctgcatctgccggtagcccagtcgttgtcttggaacaataagccacttgtgtggcatagtcagtaggtacaatactgtagttgagagccattcaacccatccaggtcagtgtgtaagtttaattagtggaactgtaattgagtaaggcatagggacatcgtgtgagtcacttcttcaaaggaagtatatcttgtcgcaagtcctagttattggcagactgtttgcctcatgaaagatggtgaaagtagaaaatcagtcaaatcacacagcactggaaaagtccacattcaaaagtaacgtagagaaaagacctttaggttgacttgaaaatagacggtgctattttctttatgctctacaggaatctaaatatatattatgttctcatttagggctgtttcactagctgtgacaaaacatgtttgaatgtgttataagaacatgatgtggtctttgtaccctccaacttaaagaaaggataatgtccacagattcaaggaaagcacttttggaaatgagagctaaactgtgttgagctttggagccaggtaataatgaatattacaaatttaacaaaaataatgaatttgctggcaacagtcatgctattgataatagctcccatttgttgtgggtttaccatgtgctggtgtggtagtttaggtctcccaagaagaatatgcccttacagaattagatgtgcagggattttgggggctaaaatctgtgagctataaagggagggagccaggttggctgcagaggcttcagactgcaaatactgatctgatacctgtgagaggagagaggaaaggaagaaggattggagaggaagaatcttagatgtgagggagcttctaagaaaagttttgtacaggccagtggaaagtctttgagccagtcactagttataaagttttttttgtcttcccataggaaccagtctgcattagtatcctcttctttaatcatttactgggagcctggaggaagctctctggaacaaacatggtagtaaatccagaggggagcgattggagttgtcaggcagtggtgcttcttgtcacatgtgatacgagggccaccacagcaaggcactgtgccaagagttctagattcatgatcttatttcactctaatacaacccttggagatcggtattattagtgtacccattttacagatgaggaaactgagacacaaaagaatttagctggctttcccacagttaagaaggcagaaagagtactcacaggacagagttttcacacttacatgtcagaagctaattgcttaaccatgaccttgcattatagaaagaacagtattcaaactctggtcctataacttattgatgacataaatttgggcaaactcttggacttgtgttttctcatttataaggtgggatgccatcacctcgtcaggaagtgtattttagttgctgttttgttttgagcttaagcggtgttcgttcctttccttccccgtgttgttcgctcctttaggatgggcatctcatactgttaggtatctgcctcagccttgctcaggcacccacaggcttaattaatcctgggaactaaaaggactgtttctgtgcagattatgtatatggatatatctctgtggatgtgtgtatgtataaattgcccagaacttgtagtgattcataggagatacacaataaagggtagtctacctttctttcatccacctctttgcttcatggaaacgaactctgtgctagatggcaatctgaaatgtgtcattttcttgtttttaattttgggggcaaaattacattcttttgggaaaattatgttcttatttttcgtatgaacatttttactctttttcctacaatctcagcactattcttatatggatcaacagtgaatatttttaaacagtggactaaattttcatttgatttttgtgctgaaggtggagtgtataaaagtagttgtaaggtgtttataccagatgccattgtatttgttggacggcgtaaaacaattatgactgccaataaatttgaaagtatttcacttggaaaagatgtaggaatgtagtttattgaaaacataaaaataaggagtttatttccactccccatttttgtgcagtacaatagaaatttgtacatcatccctttgattttagatttctgaattatttaaaagaatcggttaattctccatttcaagtgagtaagacaaagttcattaggatatctgattcctagcatgtcccccattcacagatcatgttaactccttggagaggtttatcttttaaaattgcaaatgctgtccaaactgaaagcttttcaatttaatgccttcttacagtttgggactataagtaagatctttaatacagagaagggatgagtcaccttgtcagagcatcagtcagttctaaaggtacgcagtgctcaggacatgcatgtgcagtgagttctagtagatttgcaaattgctctcatgaaagatatataagtaaaattcaacaggcgccaacagtgctcctgaccagtggttacctactggtggttcttgaatggagtcaaagaaaaaaaatcttaaaagaaatggtgcatttttccctagataataagatgcataggctgacagtttttg

SEQ ID NO: 30909 - DNA, 1462 bp, Bovine  19866880905378
tcatcataatatttgcttgcctcattgttggggaagaaatgtatattatgagattatatataatttcaaaagaaactagtacacatgtagcacatttatagctggtaagtagatacttgtacttaatgcctttgaattttaacaactttgtctctgctcactttgtctgtgaatttgctaactttggtattgttttaaatacacgtgtttaatacacatttgaaggagaaaatctgcatgtctagaggcttggtagggtatactcacatctcaaagggagcctgatctttagagatagcatatttggataatcaaggccaaggaaaagggatttcccccttcacttttattttttggttcatatagatcaaaccatgtttctttggcctatatcaggtggtgtaaacttggccataggtttggtttgggccccgtagtattcgtaattatgagaggacaggactgaattaacttaattgtagagttttacccagtgtcttcaccaacctcctaataaagtaatatgaaattcagtaagttatgccaagtgggacagtgcttcactcacataagcttcctaaacgtgatatattcttatggcgcttctccagagtgtagaagaaacacatttatctaggtgattagtattctttctgtctgccagatttaaggattgtttggaaatattgttagaatggaaatcaacatttgttgctacacagggttgggcattccaggcagactccggtcgtttttaacggtgttgctctcatgtccacttacgtcacatctgccgtgacagtgacaggtttcagtaacacagctgccatcagagtgataagcttgtgagcgaagcctttgggaaagtaataaagtcatttctggtcccatctcaaaggacattattgaaaatgtctttaaaagtgatcaagataacacccatgaggctgtgtaacgtttgggtgtttaaagttacgaacaatctgcagttgagtccatttcaagctgaaaggtggctcttgcacaaactcccttttaaacaccatagctggttcaaagttttaggaaaatataaacatcagaaattaatagtcaatttcaatagtcagtagtcaatagaaagttctagggcagaagatacttctaagtttgtagctgccccgatcagatttaaaacttgaacatggcagtgctttgcattttgtaatatcttatgagggcctcgtgatttattttgttaatagtatctattagctgtagtacaggtccagttttaaaaatctcgaataaatttacgataactatattaacaaattgcaaggtctcacattgacctccaggacattaggaaatcaaatttaaaacgttgcattgtctgttactcaatgcagtgcactgaggacagcgtgtgacttgtgtactgggaatgatgcaatcgctaaatattctagtgtgagttaag

SEQ ID NO: 30910 - DNA, 784 bp, Bovine  19866880968297
tccttttctgttggcctaaagctggagaaacgcaaagtcttcacaaatgaatgctcccacatttcccactccacactgctactttcatttgaacgtctacagctgtttcaaaagtacttactgtaaatagcaaagtataagcagatttcagagtctgactctttcacaacagaggatatcattttttttcctgcatttttacgcctggattgaaacaaaactcccaagaaaaaaacatggaaaattcgagtgcctggtacagaacccagcacatagcaagttctcaataaatggcatttcttgttgtagggaatatctggcatcttattaaaagaaaaacagtctgctcatacaggaaaaaaaaaatcaagagaattctggaaataaggccttctggcttcaaattcactaacttaaggtaggcctttgttcttcagggactttggggaaactcattttatagttttgtgaagaatttacacaaaagaaaaattaaaatttcctacagagtaaaactataatgagacttactatcacaaatgtcagagaacctcaacttatttaattttttgatgttcacactaatcaaactcttctactgattgcaaacttctagaattcaacggactacagttcaagagatcacccttatatttcttaagcaaatggagaacattaacatgttatttctccttaaagtgacaatccctaatatcctttctgggttttgccaattttaatcttggcaggaagtggaaatctgcgcactcagcaacactgcaat

SEQ ID NO: 30911 - DNA, 1921 bp, Bovine  19866881025385
gccccccaggtactccaccctcagcttccaccttcggcctccttccctgcttcctgtgtacagcctcctcgctctctgcagctctcccttgagagactttgtcatcgccctagagcctagagtgctgtgttttccttcttctttcttctgagatgtttacttttctttcacacccaatggaagctcatttacttggtaaaaccttcctttcctaactatctcccaccacaagccagtgtggaagttgcctcatcttttttgcaccacatctcctctggactgggaagtgtttaccaaggtatttatggcagggaaccggcatctctctcctttctcatttgatcttcatcccaggccttcataacatctagaaagtggcaagaattcaagctatgtttgttgagtaaatgaccaaatgaatgaattaggaaattgaagcagagaatagattttgtccagctcccaaagctggtcatcccctcatccttcctgttaaagttctttatctgcacttctctttttcaatgacatttatcatttttaaatgtctgtctatggacagttatctatgtacaagttttatcatggctcccacacagcaggttccctgaggcagttatcttagatcaaaatcaactacatgtctccacaaacagccagtctagtatatcccacatgttgttttcttaatattctttcaatgaataattcttaaattgtccttatattactttgctcagaataaaaactcaacatgtttattgaattaaattgaatttaaccctctgttacacgtatgcctaatatctagaaaggcctaaaaatggattgaattataaagttcatgagggcagagatgatgttctgtcttatttaatgttgttcctactagaagggtgaacaaatggcaggcactaaataaatatctattgattaaatggtgaacatctcctattttacccttaggaagaaagcaaacccaagtagccaagagtaattctaggaccactttgtgtgaagaccctcagaatggatggcattttttctctgaatataattaaccaacccaaagtcaggaatggcagttgtcttaagccccttactcccttccttagcttgatgaataagcttccttttgatttagaccacagttaggtatgtacctttttaaaaaaattatttatttattttcagctgtgctggatctgtgttgctgtgcacaggctttctctattactctccagttgcagtgcacaggcttctcattgcaatggcttctctgttgtgatgcacgagctctagagagcaggctcagtagttgtgttacatgacttagttgtcctgtggcatgtgagatcttcctggaccagggatccaacccttgtccccgcattggcaggtggattcttaaccactgggtagggaagtccaggtatgtatgtttttaatcctgatgctctgacatggtgcttgggtttccaaaatcactggctcagcagcccaccatgttgtctttcctgctgaagcactttccttaatagatgcagtctggggtgcttaaatgcgaatgtgctcccctatcggtgaggggcagtattttagctgccacgatggagtgggcagtattctgtcagatgagttacgtacaactgtttagggttcccttgatttttttttctcctgacagttcaccttgtgcccaacattctgtttcctggagtcagacctgcagagccttatacgccactgaccgtctccgctcctgagaacatgagccaggggcgctgcctgtcacattcctcatcatccttcagatgaatttcccctgattactagaatgggaacttaaacctgaggatggtatacagcccttcctcgtctttccaccaacgtgccgtgaggaaaaccagcatccccaggt

SEQ ID NO: 30912 - DNA, 1531 bp, Bovine  19866881071208
ttatgtattttatttgaaatagtttagaaaaggttcttggagtaagagacagacgtgcaactattaatcctgttatttctgtgaggcagaaattgtgttattttccatgaaaacatttgcaggttttaggtgttatgatccttttagttttcttttaatttcatttcctctgtctccaatctttcagaagcgtgtcatagcttatccttatctccagtagatttctgggtgtgcctggaaatccccccagctcagatcctaaaggttatttaaatcacagtgttggatgctctccacatatacagattttgttgtagaaataagattatgaagatttcatgacaattgataccttgcatttacatgatggatcaaaggactatggaagggccagtgggagactgtggggtcagagctttttactaaaagatttctgggtttcctcatatatcagccaagtttgacaaatacatttatgatattaaggcatcaataattatacaaggttgtggaattaactcacactgatatatgtgaggtcttaaccaatacagagaccaactataaggctttttaaaaagtgatgtttttgtggaggtacaagaattgacttatatttatataatttttcatagcagctaatctctgcctatgtagaagtttgtctactgtgtgtgcatgtctactgtagatatatattgagagagatagttggaaagattatagtgttggacacagaagtactgaagtaaattgtgcttttactttaaagatcaaataaaaataaaagagcattatttacaacataaactaaatacatagctgggtgagcctttaaaaaaatatatctttttgagatccctttaagagacagttttagttttgcacactggagctatgtagagattatgggccctaacatcttccatggctatgattcttgaagataatgagtgaaaatttctcttgttatacttctttaaaatggcattttatttgtggtaccctgagactagtgcctgcctctaggatggaggtgacttatctcttttctaggggttgaaaaattaagccctggctatagcggttttgggtgttttctttaagcccatagctctgatcacagttttttgaaagcttaattatgaatggttgtggagtatttttttttaacccacttaccagcttttttttttttgcagcgtgactagcttcctttgcttatggaaggccccacatttatttagaaaacaaagtccgccttatcctaattttgctggtgacaagatgtggctacaaaaaaaaacaaagaacaaacctgttgctcgtatcagacctgtttgggggaagcctaaattaataaaatggcagtttgttaaacttagctcggactctgtttaaggagatctattatttacaaaattgagttgattcctccctaaagggggggaaaaaaaagtaattttagtggctcttgaaagcttttagataaatactcccaagtcatttttcccaagcttaaaaagcaaca

SEQ ID NO: 30913 - DNA, 931 bp, Bovine  19866881077657
cccaccagactcctctatccatggaattctccaggcaagaatactggagtgggtaaccattcccttctctgggggatcttcctgacccaaggatagaatccaggtctcctgcattgtaggcagattctttactatctgagccaccagggaagccctcctatcctcataggctgctttaaagcttgacaaatctaactggatttgaaagcatttcaaaactgaaaggtagcacagaggtgtgcagcataatagacgacaatttcatcataatgtcagtcccattcattctctgcataagtggcagagaatttgtggctggtgaggacagtgttaaatttacagagcaacccaaggagagactcgcttgccataaggggagacccacgactgatggtaggcacttaacagcatgttccaattacagcatttaaatctaattgcatactctgttaatctctgtcagtgcggcatcatttaatatcatctcggcagcctctaatattgtgagcaatgtgagctgagctgagactattgaaaaagttcagtcccaggtcttcatatcccctttaattctctctgtcaattatgcctccgccaagagttcaaataaaggtcttgggatccggggttggagctacctttttgaagcaaagcctcttataaatatacagattatatcaggagcctccaactccttgccctggttgtgtttgacgggttagttgcagtgactagtccctagggtataacttactataggcttctttcaaacaaatattgtaaatacaatctgttccatgaattatagctctggaaataacgtgatatcacttgcacgtatattttctcccctccccaatccccctggctcaagtaaggtcgatgtgaaaactcctcctgactcttacttagctcaatttttttttgcaca

SEQ ID NO: 30914 - DNA, 912 bp, Bovine  19866881129367
atggagaccctgcttgaattaacccaatcatgtcttctacacctacagtgcaccttggaacaactgggcttttttataggctattagaagctgttaggggaacttccctggtggtccagtggttaagactgtgtgcttccaatgcagggggcacaggtttaatccttgattggggaactaggatctcacatgccatgtggtgtgccctgcccccataaaaaaaaaaaaaaagaagaagaagctgttaggattgaagacaggtgagaataaagactggacaggcagcccccaatacccacggcagtggagcagaagtaataatgttactgtaatggaaatctttagatttgatctgggaaaaactctggatactttcaagggcatgtcgtattcttcagaggtatttatgaagtgttcatatgcgaggggaaaaaagcggtgtaccgccagccacctcaggcgtgcgttcacggccaaggtccacaaggataactgtgtgaatgtctccttgcttaataccacttggggaatacatttccccactacattccaggctgggccactgtcctacttaagaatgtacttactggtggttattttttaataggagggtggcggtgcaaagataatccagtctggaagccaaaaataaaaggaagccataagtttcgatatttggagttgaggtttggggtagagggaaattaaatggttctgtgaggaaaagagttgccttccaatgaagatgctggctcccttcctcgtattcctatttgtttaggcttcccacaaagcacacactttaactccctgctacccctggaaaagcaagctacctcaagagtaaacattctgcagttaaagtgcccgtggaaataaggttatattttaacagtagccaaaagaatgcag

SEQ ID NO: 30915 - DNA, 636 bp, Bovine  19866881152291
ctattcgttgaccctacaatcccacttccagaaaattatactatggatatgttttcctatgtgaaaattgacatgagcagtattattcttcatggcaaagaattggaagtcacctaaatattcattaacagaaggctggttaaatggaattgttcagctgaagcttttaaagaactgatatgcaaagatctccaagttacatttttgagtgaaaatcaagatgtagaacagtgtgtatagcatggagtgggacgggggagcctggtgggctgctgtctatggggtcacacagagtcggacacgactgaagtgacttagcagcagcaatggaaaaaaacaataaatattcatatttgctcctattttaattgaaatatatctgaaaggacacagatgacttaatgacagttatacatttttctgttcttgtttggctttttcatttgaagagaggtcaactgggtaactgtaggatttgaacaggagaaagattttttatttgtcacatttttttttactatttgaattttgaatcatgtataatataaaaatataaaattaatatttataaaattaaaaatataaaaattattttaagaaaccaaatgcctacaagatagattaatgaacaagtca

SEQ ID NO: 30916 - DNA, 1835 bp, Bovine  19866881168405
caataagtagctatctcccaccattgaacaagtaggaattttttgcaaagcactacgaaaattacaaagataaaaaaccaggatccccacatccagtgacttagagtgtagtaaaccattagaaagggaaagagttacccagatttgaggacagacctggatttgaatcagagttacattacaaatttgttggatgacactgagaaagttactcaacctttctgaccctgatgtgcctcaaatacaaaatggaaattgtagtgcgacagccctcattatgttgtctgagggactcaaggagataagacatagaaagcattcagtgcagagctaggcacataaggagtcaggaatagatgttacttttcattatgatgttatagtgaatatgttttacagcttgctttgtggatttagcatttcataatgagaatcttcctgctgctgaatacctctcctaaacatcatttagatgatgatttaatgtcttattatatggacatatcataatttacctcactattcccttgtttatttatctattgggtaatattttttaattatatttgtttaattttaatagatggatgatggctttgcatatactggtttaatttctgtcatatatcaacatgaattatccataggtgtgcatatgtcccctccctcttgaacctctcttccacctcccaccctttcccacccctctaggttgttacagagccccagtttaagctccctgagtcatacagaaaatttctattggctatctattttacattgggtaatattattgtcttcccaatatatatgatgtttttatacattaaggctattaggtttttcttcatatttgttgcatcatctaaattctttaattttttcagacaagctttactgggcccctgctacagcatggggaagcaagaacaagtaccaggttaacttgctcactcatggggcagagttggtggtagggaaagaggggaacatgagcttggtgcaatgcctgccctttacttttgcttcagattttttgacctacaagtattggtcaattttatgtagttaaacctatctaaattttccttcatgattcctcctattaattttaagcttaaaatatccttcctacaaagagatcagagggctattcatcaatgttttttagtctaaagatacatttttcaatataaagtgattcacaaactaaatagattctaaaatttaatgttagtggtcttttctattcatgagcaacctcaatatcccatgacttgaagtaacttgtagctgctaataaggatttttttcataatgtagtttgggggattaaatcagattgtcacatcctgggagtctttggtgagttagtctgcagagatttataggccctgagaagtcacccagatctccacgcatgctctcatcagtgtcaaagctctgctccctattttcactgaaattcagcaggatttgaagaaaagactttggagtgaggctgacccaagttcagagtgcagccctgctctgaacattatagtcacccaagtgtgtaccaggtacatcctctgagcctccatttcctcacttagaaaatggaagaaaatgatggaaccaactttagagactgactgtgaagcctgaataaggtaatacacggggacatccctggtagtccagtggttaagattccatgcttccaaggcagggagctcaggtttgatcccttgtaggtgaactaggatccctcatataaagttgtctggcacaaaaaaaaatttttttaagtaaaataatgcatgcatgtaaatctcttagaacaacacatgcag

SEQ ID NO: 30917 - DNA, 786 bp, Bovine  19866881189156
ttgttttgaaatcttgctatcaatagtgagagggaaagacaggaaaattcacatggaggaatatgtatgtaataccttgggtccagattctcctcaattcaagaagtaaaagaaaacctcaaaggtgtaagaatgtgagtgaatgcttccttttttctgtttcttagaatgagtgcgtggatagaagcagttgcttcttttttcactttttattacagtgagattctgcttttaagtgcatttgctttgggcacagagaaacacctagagttttcctgtaacagagatgttttacaaaagaagaccacactggaattgttcagtcaaggtgtgtctcaggtgaaatgttaatccattcagcacttctttgtgttttggaaatctctttagtgtgctgggctggtggccacattttctggtaatgtaggcttggtatcagactttagcaagtcaaattttaataagtatgagaccgtggggctgaagtagggagaagatctaaaagtggaagggctcaacctccttccacttagatctgccattatctttgactatatgactgaaagcttcatacgtttcaagagcttttcagtactttaaccaactctgtagtagaggctttcccccttgtcaaaatgcccagagaggaagcatcttactgcctttcagtgtatggggagtaatgaaagggggaattcagttcagttcagttcagtcgctcagtcgtgtccgactctttgcgaccccatgaaccacagcacgccaggcctccctgtctatcaccaa

SEQ ID NO: 30918 - DNA, 1742 bp, Bovine  19866881193792
ctgttgcttctagaatgctttctacacccacgtcttaccattattgatttacaagttcagttcaattgctcagttgtacccaactctttgtgaccccatgaacaccagacttccctgtccatcattgatttatgaggttacccacaaaatgatgttggccccaaatcacctagtttgtggagggtctttactagtaccgtcccatccccactcacacgcatgcagtgcccgctttctggcctgggagtcctggatgagttgttgcatagcatcagggttacctgttctgccacgtccaggtatgcacagccacgcactggctgtccagcacactgaagaatgcaaaactctcaggatatgaggatataagaagagtcaccctgtgccaaagtttgggacccactctgttctggcatgtctttcgcagggtcatccatttttgatccatcttgcttcctctactacacctaacacagtaccgtgcatgtagaaggggttcagaaagccttgggttgattactggagagtagattactcattttaacctaaagcagtgtctttagggaaatgcagtgtctttagggattcatgccatcccatggtatggcatgaatatggaaggatataggccttctacaataaccataccacaatcaacaccagaaaatgtgatttcttaaaaaccgtaatgaaatccagttacctggatgagtgtgccgaatgatcaagtaaatcagccaataatctctagagaaccatttccaggacccaaatatggtcatgtttcctttttgtgttttccccagcacaaggaagttggcgattgagtcacctgtttgtgatagcgaaacttttatgaacctttagcagatccatttataggcatcttttaaagactccagattttcctgggccttttgtggtgataactgatgcatctgaagtagaactgggagctattctttgtcaagagatagaaaatataggcagtcttgtcttccttataaatgtaagttgttgttgttattattattattatgtcagcggtaaactgctcccgggagaactgagatacagcatcgcagagagagagtgcgcctggccgtgaaaatgggcagtaggagtatgatgatattatcttgtggtaatgaatttacctttatgacagatcattatccccttctgtagctgaatcggatgaaggacaagtctagcagaataacctggtggtgcttgggatttattggctttaaatttttaaactggaaaaatgcagttacagccaggttatctctatatgaatgttgcagagggggacagagatgaaagaagtcacattttctttctggtaatggtagaaagcaggtggtcgtgacagtctttaacaaaacaatgaatgcagttcctcatatgctttgtcattttagtgcttgagtcgggatgaaatgaatggtaaaaaatccataggacatcatcatcttcattgataataaaaacaacttaaggtttcactgagtattacgctataggaaagagcaaagatttatattttacatgatgagatgagatttccctcctaggtgtgtgtcattcgagttcgtgatttcaaggcttcatgtaaacatgggactgtcttatgttagtgactgtgggagatggtagattatagttatgcacagaggtgagctggggtatgatgaggtaggcgtctccatggggagaggatgggttggaatcatgta

SEQ ID NO: 30919 - DNA, 1242 bp, Bovine  19866881328575
ctaagttatgtccaactctttgtggattatgggggaacataatcccagcccataagaacctcttaaacaaattatttacgcataaacccttttcctagctctgctttggcaagggaacatagggctatgttatgaagctactctttctttctttgccccctcttatctccatgtacatatctatgtattatttacccatctatcaatcagtcaatgaatctatcatatatctatctatccacataatatctaactggttgttttatttttgtttttgttgctattggggtggtggtagaaaggcatgtgagtgtgaaattacacccaaatacaaaatctggtcatctcttcaagaaattctgttcagaaaattataacagtatctgagaagaaatagacttctttcatgcctgacgtttaagcagccttaattgtctagtgcttttgacaatgctctgctgataacgagttacacatgctttgtaagccccataaaaggctatacaaaccccttttgaactttctcatggctaagtagttatgccttgattgatggaagagtaagcacaccttgattgcttacataattttgaattaattatattacttccagattcgtttgttattaaggagggtgcttatcaactgattctaattaatgtataacaactttgtgatataatagaggctttaaacatttaagatattacagtccccaaggttcaattcattcattcattcaacaatattaatcgaagtttcaatatgtagaaagtactttgggagttggtgtgataaggcagagaatgtgttaacacttggtgcctgcatcctaaggtggaaatgacaatcatagagtgaaacggaaatgtagggagcagttgtcctagctttctgttgtcatcttcacttgtttcagtccaactgggaaaataaaacaagtttgagggaactggctacacatgtgatagaaaagatggggagccagcaggcacagaaggcaagacacagatctgcagcagcaagaggcccctaaccctaccagcttagagcggccaagacacgggagggtttctggagccttgggctgggtttcactgggagaatttgatgatgactggtctacaagatgggatctgtatctgtggaagtgatgtggctcttgagcatacagaagggatgtgggatgctctggcttcccctcttctcttgcctcttcagtcccctcagaacctctcgtgg

SEQ ID NO: 30920 - DNA, 1123 bp, Bovine  19866881412404
aaattcaatttcgtcaccctataaaatgagtgaaataattcttttcctggagaggctttataagaattagttgaaattcagttagattaaacatacagaatgcttggcacagtacctggcacgtaataggtgctcaaaaataggtgcccacatttaaaagaaacttctgcttagctaagggtagcttcaagtgacttatcccataaatatgtgaaaactggattatgaatgtaaatattcaacacagtcttatggatcaagatcactgtaagggtccttcatgctagaggacagaggctcatagattttggaaagaacggtgactcaaacgtagcaagtgaattatttgaagcctggagtaaccaaatggagggacactttggaaagtcgaaaaacttactaaggtgctaagtgtcttgtataccttgttatgtcatttaatattgaagacagctctgcaaggtagttatcattgacctaattttatggacaaggaaacagagattcagaaagactaagtgagttgtgtgtcaccatggtggaactcagggttgactcagctcagagcgcgtgcttcattggatggaaaactagtgccgacatgtgtatcacttttgaaatcagatttgtcataaaacttactgcaacacattctctttttttcatccttctcaatgcacttactttgtgttgtgtttaaccctcagttccatggctttgggactgtggttctcggtcttggctgcccttttagcatgcctgggatgggatctggcgtgagtattttctaaagctgccctggtggttccccgtgtgcacacagggtgctcagatatatctaccttcgtcgtgggtatttgggttgtccccagttttaagcctaagtgtcagcagtgttttgtcagagtcaactatgatccccctgctggtttaggggaagatatatggaaggcctgacatctattctagttgtgatagatgttgcttatgcattaattagcatgtaaaaattaaatgttcttactctattagctggttttctctttttttttttccagttgaagaaggcgaattaaatgcaatgaagattatggccaaaaaaaaaaaaagattttgattatgg

SEQ ID NO: 30921 - DNA, 3118 bp, Bovine  19866881420510
ttggccgctgatcgggctctgcgcctgtgagcagaactgtctcaccctttgcagagacgatcaggctggggggagtccagaagagccggagcttggtgtgtgtgtgtgtgtgtgtgtgtgtttaagctgcattgaagccctctctccctgttctctttacttgtgatgtttcactaggtgggagacaaaggggctttgtgtgttcttcaaagtactctgtgctgactgtgatacacatccaggaaaaacccagcccaaagccgtgacattgcccctggttcaaaccccaaatgcaacttacagtggttagaaatgacaaaggataggtggcaggacccagaggaaaaacagtgaaacccaaaggaccttaaacagatctgagggcaacgatttgatttttcaggtgagatctttaagaaaatcttaatcatagtcttcctatctgcacatacaggaaagtcagtagagtgtatatttcattgtctgcccggcaaaggtaaggtcccctttaaattttctttgaagattactgttgtttttaatctttaggatgtgtgtaggggagaggcacagagaggcagcgtgtcagatgtttttctttctttttttaaggctcacctgctcttaagagcgaattgcattttgtcagtggcagaagaatgccttggcgttcgggctagtgtttggggtgtaattgaattgctgggtgctttaaacattgcagggttttaagccgagaaataatttaatgatgtggcctttaggattgttaattagcactgtctgtatgaacatgtaacaataacaccacctaccgtaaaagcaatgttctacacttcagaacactcatttctttcgggcttcctgcagagaagcagtcattaactctttttttgacaaacacttttagacatgctctgcagggccataaattcacccctcaggcctatctctgcatttatccacggggcaagctggcaaacgggggaagcttggagaaggatgagcccagccctccaccatggcaccgactgaggaggaggttgtggtgttttctgtgctgaattcctgagacactgtcactccagaacccagggagagattcaggtgagaatgtggggaaattggaacccctgtgctctgttagtaggaatgaaaaatggtgcagtcgctatggaaaactgtatagaggctccttgaagaattaaaaaaaaaaaagaaatgggacctaccatatgatccaggaatcctgcttctgggtatttatccaaaaagattgaaatcaggatttgaaagagagagtaacactcccatgctcactgcagccttattcccagcagccaagatacagaagcaacctgagtgtcccctgacagacagatgcctaataaagatgtggcttatatccacaatggaatactattcagctttaaaaaagaaggaaattctgccatatgtgacaacattgaggaaacctgggggcattacgctaaaatgacctaaggcactcacagaaagataaatattacgggattccacttacacgaggtatctaaaactgtcacattcctagaatcaaagagcggcatggtggttgccagggactgggggaaggggagaaaacaaatttactaatcagagggtatgaagcttcggttaagtaagataagtaagttctagagatctgctgtacaacattgtaccataatcaataatactgcgtttttacacttaaaagtttgttaagagggtagaccctcaagttgtgctcttgcctcaagtagaaaaaatgtcaggaaatcaggtcatgggaggagaggttgttggcttgccccctgcccactctgctggaggaaaccttcagtggctgatccctctagcagagttcaggggggttggaagcgccacgagtctggaaggagtccacgtatgcagtgaagagtgggaggccgatgacgatgggtggaggagtaagggcttcccatgctttcttccatccacctggtaatgacccagtgctttttccatcttctcctcttaagtcacaagtgtctttctcttctgaagacctgtctcttcttcagcaagacactcggcagcacttgggcatctaaacactagattgtgccttgtcttctgttcagccagactgtcccatgaccttgtgtccaggcctggccatctcctgtgagaactccatcttggaaacctcaagttctggtagcttctctgcccaccatctccttttctctcaggtctctcactccttcactctcacagactcatctggctgctagtccagagatagccactacctggcttggctgttgccactctttctgtgcccttagagaacattcctgactgatggtgccatcctgtcccgtggagcacagaggtaactttggaatccaggattctatcatttggagttgacatctcagatgaaatctatttgatattcagctccaacagcttgaccctttttctttcagtctatgaggccagaccctgtggtcggtcatctgagctttacagagcatccctggttcccttgcacacgcccttgctgtgtctgtccagtgaagagctccctccactcttacactcagactgctcagtgctgttggagtgttctgggttcctatgtggatttatgccacaaagcacttatgcttcatctttcaccttcagagctgccgtttctttttttcccctcttttttcttttctttcttttttttgatgtgaaccatttttaaagtctttactgactttgttacagtattgcttgtgctttctgttttgattttttggctatgaggcatgtgggatcttacctccccaatcagtgatcgaacctatactacctgcattgcaaggcaaagtcttaaccactggattgtcagccaagtccctagagctgcctttttctttttctcctttttggctgtgctgtgtctttgttgctgcccgaggactgtctctagttgcagcaagcaggcctcgtgttttggtggcttcttttgttggggagtgtgggctctaggcatgcttcagtagttgtggctggcatgtggcatggggcctcttctaggaccaggaatctaacctgtgtc

SEQ ID NO: 30922 - DNA, 1211 bp, Bovine  19866881452392
gggaaggagaagtatctgtttaaatattgtattctacagtaactcaaaaattatctttaaatgacaaaaagtaaggtgtcaggtaaacatctctatttttttcctttcttaaaattatgctaaacttacgtttaatgttaagaccttgaattataagaagcactctaatttttctattccttaaagtactattgatctctaaaggagatatttaataagtgaaattatagcatctagggaaaaaaattcttcttttctgattttgtaaggtagtcgatgctgcctcgcaatacactcctggcctttcttgtactggtcattttctttatttctcctgtgtagctgcttgaacacctcccagcgggtgaggagtgtttgttcaggtggcacagagtagagagatcttgactggtagagagtaacttaatatcagccactataatgcctatcagtgaaattctagctcatttaattattacttaattctctgattattttttgtatctgagagaagaagattgtcttcgctctggggaagtatggatggctagatgttgctcttgcagtttcttaattcactatacctggtaaggtgttttgagccagaacacctttttaaagaatggggtatctatgtacctacaaaaatggtgaaattctgactggacctgtgatgaaatagggaatcctcacgttcagttcatctttcagtactggatgccactcatgtttggtcagatttctaaaaaatttgttttggagatcattcataggatctcaggtctataaccaggtattgaatgtttatcattggaaggaagctttgtattcatttatcatttcctttctgccaaaccacaaaaatcccaccttgttgatcttttctcatatatgtgatatatgatgtgtgtggtggtgtgagagagagagagaggctgcgtagctctttacagcaagcctgtatcgtcatcctttcttaacctctttctaggaatagagatttctttgaaaccaagcataatcgagaaatgaaatagattgttaaaagactgaatgatgcattttaagtcgaacagacatgtggattatctgctgtttcgatctgtccatcccggaagttccctccatgatcactgtaccctcaatttttgtatgggaattggagattagatgtaaaatacaaattattcacactagtcaagtaaaaagaa

SEQ ID NO: 30923 - DNA, 1673 bp, Bovine  19866881471565
tatgagatcatccccagtgggaagtatagactgatatagttgccgtgtttttacatttttgcatgaagtggcaaaatattaaaattaagaagtatatcttaagccttagagcagccattagaaagataatgcagagagttataactaagaaaccaggaaataactagaattctaaaataatcatcaaagaatccaaaagaaaagaacagaggaacaaaatatcagaggaaataaatgaaaaacaaacaacaaagcttaatgtaattattaaagtatcttggaatcactgggcattgtcctctagctattaaagcattcatacttccgtttacatgcagcggacaaaccaatactgttttgtaaaatcactcattcaataaatatttactgagttaattctatgtgcagtgcattaatgttatgtgcctggtacacagtgataaaaaagattttgtcttttttataaaagtaataggaaatcaggaaaggtatttgagcagggaagtaacatgataagatttgcatttgtaaagctctctgtgtgaggaagtgggtggaggaggtgggcagtggggaatgcaagaggaagaggacagggggctgttgcttgattcaggggagaggtagagatggcttggaaatggctaacaaggctaaacttggagaaactcctctgaaattaaaagatctaaaaatatgttagaaaaaaatgtatagggcatggtgatgaattgtttataaggagtgaagagaagggtgatttcatagagcatttctagttttcttttgtggaaagccactagaggagggtgccatttgctgaagttaggggacaatggtaaaagtgaagaccgggagttcattcagggatattttaagtttgagtaacactaaagcagccaactggagatttcaattagggaatttatgttgtattcaatgcagtatccagtactcaatacagtgtacatttcaaaataaaaattcaacacatatttgttaattgaccagcttggaataagaaaaaaaatattaataataataatttattaagcattgactcttccaagcattctgagaggcattttgtctgagacatctcatttaacagttcaactttggtgattccaactttaccgattagggaacactcaagaagcttaagtaagaaaacaatgaaattgtagaatcaaaattaaaactcagatctgcctggtcacaagtcacttgccaagtctttgttcttactcataacctcctgatcacccaccacaatgtaacatttattttatggaaaataactcagcttcttcctctgtatcttagaaaaactctccctctcttttcccaataatcatgtattttctcactcaggcatggatactttggaatgaaatttgatgatttctactttgcctctaccagagattaagaaaagagagtctgctgccttctctacctgcactttgctggagaaaaattaaaatagaaaaatggaaatactcccagtgctccaagatcacggatgcactcatttcatgtgtattcttcaaaaatttcaaggaagctgaaatctaatttaatctattacatgattgttctaaatgacttaaccacatcaaagcatccgtggactcacactctgggaagggacattgtaaaatggttttcaa

SEQ ID NO: 30924 - DNA, 715 bp, Bovine  19866881544146
ttattaattaacctcgtatgttggattgagagctcctgaacatttacagatttgtcaaacaggagagtggtgtagagggaaccatgtctgcaaaactggtcctgtctgctctgtctggaggaaggcttgcattttcacttgtgtgtctcttaagtgccagccacagacagcactgtactgatatttaagaacagcagagccaatcttgtctcttcccagatatgacctcgaacaagttttctaacctctcaaaggcccagtttctttgtttgcaaaatgaatgtaataatagtgcctgtctatgaggtgcttggcatctgtcaggtacccaggaaaacagaataaaatcgaaccaatgcagaaccaatgagtagacagaccagggaatcatagttctgtttgtttatgacacaaagacctatagtaggtaatattgaatgacctgcatttcactgtgggaagtggtatgttttcattggaggtgtataagaaaaagctatttgcatgggtggaaatgtacaccatgtaaggtttcttttattcttactatccagggatgctatgactgtcacttttttagggccagagagaaggcaaaagggggagtggtagtcaaggagtcttagattctggttgtaacttagtcactgactaattttacatttgtctaaacttgagacaccctagaagttctctctattcttttatgtttaaa

SEQ ID NO: 30925 - DNA, 1327 bp, Bovine  19866881591990
catagtttgagtggactgccattgaattgtgtaatggcaaacaagaggcaaggtcacagccactgttcatgctagggctgcagtctattttttattataatctttctggttcttcctttaatgctcaagcccaaatggtttctttcaaaagaagaacttgcgtaagaatacaatcttatttttaaaaataatttccatgccctgatcaaaggtgaaccaatacgccacttgttcagaaaagaaagtttcatatctactccactttaatgaagacctaaaacccagcaaatctttaaaatggcgcccccgaaggacgaggacattcggaatctcttatcctatactaatttcttcatgagcctttctttgcaagaacatgttgtaattttcaagtttgggcttgtccctgtcaaagagattcatttcctcgttgtacctgggaggcgagttaattctgttgtagtagctccatcgtggcaggttagactgttaccaaaagagttcctactaaattgctggccagaaaaccaagggtgtggatgtgggttccccagagatgcacaaaggacctagaggcttcaaaaagaattttacgaatgaactgcaagttggatcttagcaacgattcccgtgtgagaatacagaagagtgcgcatttctaaagcagcaaacagccacttagggtgccacctcatgccaggctgagcagacgccttcctccattcactcctgctctccattgacaaacacctcgggaattctgtagccacccagcagcctggctttgtggcagagccaggatggttcagctgctggattttaatcgattctgcagcagtgcaatgggaaccccaaatcagtctgggtaactgagagtggttttcacacccaaagattctaaggctggccacagtgtactgagaaccctggcttttcaaaattccagggccatgaagtcatccccagccacgaagtttacttaacccttgcagccggctcgggtgtacaaaccacggctagaaaattagaacccgtcaggccagagtcacaatggcctgtgtgtatttgcggttttcctcttttcccagtgaagtatttaaggtttcagagtcactccaccaacttcaagacagtcagcactttagaaggaaatgggcagaaggagtgggtttttttttttaaggaggattttctgggttcataccaggcagaatatctgacagcctcaaagcactcactctgaggaaaacatcggtgccaaataaagaagagagggtgctgacagagagcaccatctaagcggcatcattcagctgccagggagtgg

SEQ ID NO: 30926 - DNA, 1356 bp, Bovine  19866881723054
aacactataaaaagccaaggcttaggaaatgtaactaaactaattttgtggaagattctaaaatattctttaagtatggctctaaatgattttgtttccaatacttcctggcagaaaaatattacccctgcatttcaatgcagaggaaataagcaggctacatttggccaaattcatttatttaagttatttcctaaaatgagtgtaatttggaaatcactggtattattttctcccagtacaggttaatgccttatccgtggcctctggaagggacacttcttgcaaagagagttattagttttttatttagaatgtactgtatgggtgatttgtgggtgtaacaaacctgaataatttaaagtagtctttatttgctgagaactgcagtttttattttttaagtagattttaaatctttaaactttcagagattaagagagatcagccaggggatttatttgtagcaggaatttctttttcttatgcttgcgtctttcccagcacccattcttctctcctgcctccatctagaattatgtaatgtcagcaataaaggagatagtagatggccatcttttagagcggtaggtttcagacttcttttatggccaaatcctttatgcaaagaaaaattttagcccctctagcaataaaacagggaaaaccagagctgctctggtggggcttgggagtgggaatcatccttctcagctgaccagtccatcttcatgccaagactcacagaactcctgggaacacaccttgaaaaccaagaccactcatttcacagtaagagaacagaggccagagggtagggaatgacttatccaaggtcattcagcaaggacaaggcagaatcagaattaaaacagtgtctcccattccctggtagctcagatggtaaagaatctgcctgcaatgcaggagacccaggttccacccctgagtgggaaagatcccctggagaagcaaatggcaatccactccagtatccttgtctagagaatcccatggacagactatggggtcgcaaagagtcagacacgactcagcaactaacacctgcttgcttgctcctgacccaacttatgtgcatcccatcagatccagctgcctcctgcactaggctttgctgttcgctcgtagatctgtcaaccatctttcaaattcccatctcttggtgggagtgataagaagcaactcagcacaggagcacagcacagaatcacactcgtgcatgttagcagcggtcgtaacggtggtcccaggccacatcctcctgatgtgcacttagcagccgccctctgcctccagcaaggcttggtggctcgtcatttctaagcagggcacgtt

SEQ ID NO: 30927 - DNA, 1468 bp, Bovine  19866880217681
ggtggtgtcatctgcatatctgaggttattgatatttctcccggcaatcttgattccagcttgtgcttcttccagcccagcgtttctcatgatgtactctgtataaaagttaaataagcagagtgacaatatacagccttgacgtactccttttcctatttggaaccagtctgttgttccatgtccagttctaactgttgcttcctgacctgcatataggtttctcaagaggcaggtcaggtggtctggtattcccatctctttcagaattttccacagtttcttgtgatccacagagtcaaaggctttggcatagtcaataaagcagaaatagatgtttttctggaactctcttgctttttccatgatccagcggatgttggcaacttgatctctggttcctctgccttttctaaaaccagcttgaacatctggaagttcatggttcatgtattgctgaaacctggcttggagaattttgagcattactttactatttacacgtattaaatacatatttgtatatttataagtgaatatatttatattccctcaactatagcatttaacacattgtcctgtaatcagagttttaggtgattactgggcctctataaggccctggagaataggaaccatttcctatttatctttctatctgtggggtctagtctagtgattggaatttcattaatgataaacttgtttttaaatgaaagaaaaagtgactgttttacactatacacattacaggcactgctggggccttaatttttaatttataaaaagggctgttatacttcaccagttttgttttaatagttttaaagagtcactgtgaatattaaaataacccaacatattctatggaatttgctgattagcctagaatatgaaccattctgcttttctctgtgacctatttctttctagccattgtattatactaaagagtgtaaaaccataagtctggaggaaatttgagtggttatataatataatgccttatcattaggcagcttgtaacctaaaccagattagacaccattctctcctcaaacactgcctgaaaagacaattctaccgctttacttggcaccacatcctgagattttgtgtcactgagaaaatgtttctgaatacggaatctggatcttctaatttggaatttaagcattatgtgtgctaagtcacttcagttgtgtctgactctttgtgaccctatggactgtggcccaccatgctctgtgggattctccaggcaagaatagtggagtgggttgccacattctcctccaggggatcttcccaacccaggaatcaaacctgcatctcttatgtttcctgcattggaaggcaggttctttaccgcgagtgccacctgggaagcccttaaacactagaggttaagcactgcaggttaggtcaaatgttctacagaagtgtagaaactctgtagagacttttt

SEQ ID NO: 30928 - DNA, 1017 bp, Bovine  19866880276509
gggtgaaaaaaattgaaatacacatacacattagcattttagaattaatatctcttattataataatttggaggaggggactccaaaatcactgtagatggtaacagcagccatgaaattgaaagacgcttgctccttggaagaaaagttatgaccaacccagacagcatattaaaaagtagagacattactttaccaacaaaggtccatatagtcaaagctatggtttttccagtagtcttgtatggatgtgagagttggacaataaataaagctgaatgccaaagaattgatgtttttgaactgtgatgttggagaagactcttgagagtcccttggactgcagggggatccaaccagtcaatcctaaaggaaatcaatcatgaatattcattggaaggactgatgctgaagctgaaactctaatactttggccacctgatgtgaagagctgactccttggaaaagaccttgatgctgggaaaaattgaaggcaggaggagaaggggatgacagaggatgagatggttggatggcatcaccaactctctggacatgagtttgagcaagctctgggagtggtgatggacagggaagcctggtgtgctgcagcccatgggactgcaaagagtcagatgcaactcatctgaactgaatgaactgaactgcactgatatgttgaaaaggttggaagttcaaaaggtgaactaggaataccaataagaaatatccttagccttattttttcatactttttgctgccttattatctaagtctagtaagttaattaaagtatagagaatattttatataagaatgttaatagttttggatcttcaatatttattgaaattatcttgtttcatcgtaggtcagacatatttccaactttttggatcaaaaccttgtccaacaagactttcttcagcgaagaataagaactctcaggtagctgaacacagccccagtacaggtattctatgactctgtcataaatacgatttacagatttttag

SEQ ID NO: 30929 - DNA, 1295 bp, Bovine  19866880359326
tggactgtagcctgccaggctcctctgtccacggggattctccaggtaagaatactggagtgggttgccatgccctcctccagggccatcttactgaccccagggattgaacccacatctcttaagactcctgcattggcaggcataaaagcccctttatttatattagttcttcagaaaaagtgctttaaattcttctaagaattttataaagtgagaaaaacaccccttttccacctcctcaaaaagaaatgcttctaaatataattattttcatgcattttgaagtcacaatagcaatatttgtagattcaaagtcattctcttttataaatgaaatggaggctatcttcaattccagttgcaaattgctgaggaatttaactttgtttcattaatattccctcttaaaagaatttctaattcacagcagaggactaagctaaggtcagcaattacgatggcagagtagcagaaactattaatgacaagcaatattgcagctaccctaatgcccagtgacagcagttcatgtcaggctgttaaacagatctaaagcacatagtttgcagcaagtagctttctaaaatcatctacttgagcattctatttcacagtgtaaagtgctcacaaggaagatatgcacagccctggcaaacggagaaaacttttcctggccaataaatagacaaataaataaaaccctcaactgaattgctgaagaggatatgtgggtataaaatcaagacaagaagagttagatagaatcatggtatctgtgtccacagagacagtctttacatcttttcaggaatagtcaaatgcattctcaacttaatactattcactatgattagtactggaggatctgtttagtacaaaagactgccacgtttcagttcagttcagttcagttcagtcgctcagtcctgtctgactcttgggaccccatgaattgcagcacgccaggcctccctgtgcatcaccaactcctggagttcattcaaactcacatccatcaagtcggtgatgccatctagccatctcatcctctgtcatccccttctcctcctgcccccagtccctcccagcgtcagagtcttttccaatgagtcaactcttcgcatgaggtggccaaagtactggagtttcagctttagcatcattccttccaaagaacacccaggactgatctcctttagaatggactggttggatatccttgcagtccaagggactctcaagagtcttctccaacatcacagttcaaaaccatcaattcttcagcactcagc

SEQ ID NO: 30930 - DNA, 1611 bp, Bovine  19866880452409
tgtgaatctctttgcatttatactcttaaagtttgctgaacttcttgaatatgtagatttgtgtattttaccaaacttgggaaatttttgtccgttatttctacaagtattctctctgcctctttctctactctccatctgaggttgccattatgtgtgtgttggtatgcatgattgtgtgccaaggttctcttagtctctgtacatttatcttcactgatcctttcttctgcctactcagatctgcaattgaaatcctttaatgagcttttcattttgttcccctttggtttctttttgtaatttttatctttctttatattttctatttgtatagatatgttatttctgatttcctttaggcttttgatttattatgaaagttgaataagtccaattgctctgcttcctcagggacagtttctgttaatggatcatagttccttattttttgcattcttcatagatttttagttgaaaactggacatttttaatatttgaatgtgctaactctggaaatcagatttctccccaccccccactcctgggtttatttttattgctttctgtatgctgggactgtttgtttagtgatgttttgatgtaatttttaaagtctgttttctttgtcatatgtggtctctaatgtctccattcctttagcttgtattcagttagtgtctttacagatagagattaacctgaatgccagaaagcaaaataagggggaaaaataggaaacagagcaatcgaggaaagaaagaaaaagaagaaacaaagaaaaaaagggaaaaaatgggaaaatatatctctaaacctcttgtaattcttgtagattggcttttgctggggcactcattcaacagtttgccaggctactatttatctctgcattaaccttagtttgcttgtgctcatcctacagttcagacataggtgaaggcataatgtctgattaggtcttttctgaacatatacttttatactttttcaaccagtttacgtgagtgctatacatgccctattttcacaaaagtataactctccaactttttcttcctggctttggatgctatattgtatgcctcaatcgttatgttttgtgccagaaaacagtgcatttttgtttaccttacaatattatcaaatgattcttgtcacttttctaagtaagttcccagatgggcaaaacaaagtcaggtgccgtatattacttccctgcgtagtccccagaatggcagaacacacagaaccctttgtgagttcttctctgacttctctggagcataggaccagggtagtacactaggtgagccagctgccgtctttaagactgttgttaccctagggagggagggagggcaagggcaaatgagaacatcacaaatatatcctcccgttttaaaattttctttgctctgattcagtgttcacttggttgttgcaacctcagactggtccccagagttctgaccaagttgattctgacagttttgtttgatttcttgatgtttctgtgagggcacgggctccgagagctgcatactctgtctgccgtgtcactagccgtttccttttggggccttagttaccatgtgatgtgatatgca

SEQ ID NO: 30931 - DNA, 741 bp, Bovine  19866880616447
tgatagcattaggaggtggtgcatttggggtgattagttcttagaatggaggcctcatgaaagggcttagtgcccttataaaagagatcccagaaaactctcatccctcctacatgtgagggcacaagaaaaacacaatctatgagccaggaagggggtcctcacaagaactcaaccacactaacaccctgacttgcagcctcttgaagagttagaaataaactactgttgttaataggccacccagtctattgtacattgttatagcagcctgaactcacaaagacagattttatttcatgatgtctgttcttaccaaacaaaaataatctttagatgggaggcaggacaaggtgcaaacaacttagcatttacctttagatcaccaaagaatgactccagagatattcatttgacacaccaaaaaagtggtaactatatgaggtaatacatatgttaattatcttgattatgatcgtttcacaatgtatacatatatcaaaatatcatattgtatgccttaaatacatacaatttttgtcaatcattactcaataaaactagggaaaaaaatatcatctgtgaagtgagatcaacacccttcccccggcaaaaattaaatcagccttcaaaacttttctggtcattttaaatactaacagtcttcccctatagcagatgttcttcaaagcctgagtgtcacttcggccttcccaccatgtgagctctcagactagaggt

SEQ ID NO: 30932 - DNA, 1262 bp, Bovine  19866880622819
tgtttaaaaaaaaaaacagcaaaacaaagaatatgccacaatctgtgtggcttacaaaaccaaaaatatttattttctggtgttttacagaaaatgtttgctaactttcgacctaaataataggcatataataaaatacatttagaagaaaatgaattttaaaagtgtatataaatacaggaaaagtagccacatgtttactctcctttcagattagcttcaaacttttttttttttactgttgtgctcagaaattacagataaagaaccacaatttaaaaagtagccaaatacattacaaatgtatacatttgttaatgacacaagaagtgaaaaagaataaagacagtctacaattgtaataaagtgatcttaaactacaacataaaatcacagaattttagagcaaaatggaacctgaaaaatcatctagtctagtcttcacaggtcagagatgagaaaaccgaggcctgtatctggcaagtggcttgcgcaagttcacacagagaattttccgtaaaattgtaactataacccaggtctactgttaggtcaatagagataggtcaaaattgcatcaagtataacaggtgaaggtgataggtcaatacctgtatagatcaatacctaatatatgtatttcccattttaatatacattgaagttgaaaaaataggacacctctcacacatctacagaaataaatccttttattatataacattccttttcttttttaagatgcatacagtacttgtagcccaagaattctgagaaaagctagagaagacctggcactatacttgagaattatacaactgggcagcaaaataacacctttataaatgtcaggacatacagaaataaaatttagtgtttgcacacaaaaatagggaagttacattcaacacgttttcttaaacgtgcatttaatgtttaaatgttttctaaaactttggtcatcatgctttattataacttgtaaaatttcacaattatgtagatgattaaacccaactggtaagcaaatatttcacttaacacagcagcaaaagcaagctaatactgcacaatcatattagcagactgatttcagaaatacatgtttttcacaaatagcacataaaacatagtttgtgataacatagttcaatgacttttcttccacttcattaaacaaggctgagtaatgagacatagcaaaacatgattacataacaaaaagtatatttttaattaaaagtctaattgtacatataggg

SEQ ID NO: 30933 - DNA, 3205 bp, Bovine  19866880647019
tttggttgtgatgtgcaggcttctattgtgggcgtggcttctcttgttgcggaccacaggctctaggccactcaggcttctgtagctgctgcatgtgggatcagtagttgtgtttcctgggctctagagcacgggatcaatagttgtggaacatgggtttagttgcttcacggcatatgggatcctcctgaatcaaagattgaacctgtgtctcctgccttggcaggcagattctttacccccagggaagctcggtcactatctttaaatacaagttttcaatatctatcaacattttgattttaaagtgtcatttatggtttaggataattatgtgaaaaaacttttaagtcaaatagaaactcatcacttcagattagcaaaaaacacagaaacaagaagcataaattctcataagaatatgtctgagcccatgatcacattgaatccctctgcacagtccacaaaaacctcaaacaaacttaaatacatatcccaagtactctgttctcagagttgtcaggagatatgattcaaagtacataaggcaggttcctagatattgtatatctctcaaattcactgtcaatgagcaatgtgaaatatctgagtcttgaatgtctgtacagatctccttcttatcctcaaacttctagtcaactcagctacttgaagaaaaatgatgaaaatggtgttatgctgccatagacacattactagtagaattcaaccaagccatcaaagaaaattttcttttagctacaaaatccagaatgaaaacgtgtatgttagtttttcttttagggaaaaatattagttcttaagtcaccttttgtaattaaaaccaaatgtcttagaatatataccaaaagtgcctatttagaatttgtattaaaatgtaacttaggctgatggagctttaatttttaactctatctctttaagactactatatgcgtgggtctggtatattctaacaacagctacgtgactgacattggttcgctgttatgatggcatcatatatgacacttttggagtctatcatcttaggatgggtatattttataattttggaggaaagaacatatcttccttgaagacacattttccccccacattttccaccctccctgccccacatttctctttctctaactgttatgttcctaaagttcttctgaaattttcccttgcttgcttatgatgtgctgatacagggtgatatgacttcatcaaattcttaattaccagatgtgatgtgtcaagtgagacttaagattggttatgcgatcagtaatgactatatacacacatatgcacacacacataattttaaaaataagaaaattatctccaattctgtttgaactgattttgagtatcaagtttcaaatgagatattgttgtgtgttatatagcaaactgtatattagaatctatattgccaaattttaagccccattcttagaaaagctgatattagcttactgactgaagatttttcttctgggtagacatgtgatgattattttttttaaaatctataaatctttttagttgtttccaatttgaaattgtatataccattattggagaaggaaatggcaacccactccagtattcttgccttagagaatcctgtggacagaggagcctggtgggctgctgtccatggagttgcacagagttggacacgactgaagtgacttagcagtagcagcataccattattactttattttcatgacaaagtatttttatcttttttgttctgctgtggtggatttccaggtggcactagtggtaaaggacttccctgtagctcaaagggtaaagaatctgcctgcaatgcaggagaccagggttcgatcccttggtcaggaagatcctctggagaagggaatggaaatccactccagtgttcttacctggagaatcccatgaacagaggagcctggcaggctataatccatggggttgcagagtcggacacgactgagcaactaacacacaagtggtagttatatacctgcctgccaagttatacacctgcctgccaatgcaggaaacctaagagatgtgggtttgatccctgggttgggaagatcccctgcaggaggacatgacaacccactgtagtattcttgcctagagaatcccatggacagaagaacctgatgggctacagtccatagggttgcacagagtaggacatgactgaagcaacttagcacacacgtggtggatttcactgtaataaggttaattatttctctgatttaaagctattgatgaactcacattccctatttcacttttctgaacaatcaaactttgaggaaatccagcacagatttatagagaatatttttattgtatggatttgtcctggagttttgagcagcaaagcggggttgtttttttttttaatcagcagttttatattatatcatattatttcacatctgatatgcaaatagatgtcagctcttctgtattttaaattatttttgccgttagaacttgttctgtagcctcactgactccacggcgatgcatgatgaagacagtatacacgatatgggtaggctgtactgaagccttttcatttaagacatacggtttgagctcaagtggccactgtggagctgctgtgataaaaagtcccctctgatatcacagcaggtgattgatttcctgggcgactcaggagccatgagaaccaaatctttgtctctgctttgattttaccacagctagatctcacatcctcattaatcctttatcctgacgaataaatcagttccattccccagtcccaaactatcttccaaaacatgatgaccctcatgtttttgataggccatagaatctacagctactggcctgactgaaggaaactgcccctacaagcatgctctttcctacctttaagcctgtaaatacttcatttacaaaatcagacccatatcgtgaatgctttatgaagccttaaagcacttaactttgcttcctcattcctaaatgcaaaccaaatccactcttcagaccagtcttacagtatattggacatgtgattaaagataaggacaaaattaaaaagttttatagataatgtttgggtaaaattatgtgtctgtaagggagaaaatgttgggtaggagagagaaaactaaagccttatggatatgaagtgcatcta

SEQ ID NO: 30934 - DNA, 1597 bp, Bovine  19866880647563
ctttgttcatagtgatgcttcctaaggcttaagtatcaccccagctaaacatttttcagtgagtctctaccatctacatcccctaagacctacaaagggcattcaaactgcttagcacagaatacaaatgccttcatgacctgatgttaagtgcctctccagccatatcccacctcctcacttttgtactttatattctcatagtacttaactggaaggcagtgtaggtatgttacatacattatgtcattcatttttcaaaacaataactcagttactgttttacctgacagggaataacaatgtgtatccactaccaatcttttgactactatcttagtctcaagtctccatccataccctactttggatcaaggaggttctcatcatctacatctgacactaatggtcttgttaaagttaaaaaaaaaaaaaaaagaaaccagcagagacactgatttcaacagatgaaggaaagtatttctatcaccatctgttgggataataggtataaagcttttcataataataatgccatcagtaacttccatcattaaaaagtattccccaaaatgctctacaacaatattttacactataaaatatttttaacaagattacctggcaataagcataatttccaagggctttatgagcttcatcgataactagacactttatttcagcagctgggcaagctcctctagaaagatcatttaccatgacttgaggcgtaaggaaaagaaccctcttactgctccagatttccttcctggtgaaagcctgagtagatcctgtaaaaaaaaaaaaaagtgacatcacacattctacacttcagactgttacctgtaacatgtaaacagcctagcctattttcagaatgcattcctgcattggtgatctgcttccaaggtgctaatttgacaaatatgagaaagcaacattttaaagctttgttgtggtccagatgtcaatgccggcttatactgaaaatcacacctagactgcctttagagaatccttgtaaaatgacataatacttaaagagaagaaaattcttcacctgggaaatccttctgaacaagaaaggcagaaaacctcacttccacttaccaatgaggtatacacacataaccacttcaaaatgctttgacaagttacagaaattctctgaagattgaataaagcaaccctattagagctggacttgctacaaggagatgatgtttcaagacagaagtaaaataagcatactgtgatctggggtctattccacatgggtctggaattcctttggcgctagttccatcagaacacgtgctttcccctgggtgcccagctcttaatttcaagttagtccactgtttctaagatacctgtcatttcggccatgtgggactgcgggatacccatcacccggtagcaagcctcgatctgctgtgtcaccaggggtttcgtgggggccatgaaaaccaccttgccagaagggaaccagcggtagaaattgtacatgaccacagcggcaataaaggtctttcccaacccggtgggcagacagaccagcgtgttgcagaacagggcggtccggcgatgtgca

SEQ ID NO: 30935 - DNA, 1698 bp, Bovine  19866880748869
tttgggtgtgttttgatggtaaaaggaaatgattcccttgaaagacaaaataggttgaaacttcatgatcagactttcattcacaaaaaattacagaaagaatggagactacttacagagaaactggaccttaaaaccagatagaaacctgggagcaagaatctacttatattcttgactcttctgtgtaggtactgtggaagaaatgctggtaactccttaaacaagtatgtttcttttctattattgattattttctggaattttctttcaagcctgacttaaaaatactataatatggtgtgctgcaattcgtggggtcgcaaaaaatcggacatgactgagtgactgaactgaattgaactgaacatatgttatcttataaagcagatcctgtttgattaaaggataacttgatattgatgatgatcgtaattattttgttctaccacagacccttttcctcctataaatctatatgagaaattatatgaaggaaatttctcacaaaagatataaaatgaacaattcacttgaaaccaggaatttgcctgaagtcagaagcagcactgaagtttcataggtctccactagatggcaagcattctctttcaatttctcaatggtaccaagatcaaaaattgctgctttttcaaacctagtctgcatgagacagtgggacttgtatcaaaaaattacagagaacctgattcatagatacagtcaaatttagaatcaagttgttcaaactgaaatggaaaatatattgtgatgtttaaatgttttaattggagaatatatattcattcatttgacgcacacacacacacacaagcctggacagtttgatccagagcccattctcctaactattatttgtttttttttttaactgaagtatagttgatttataggattttggatatgtagcaaagtgattcagccatgtatatatatatgtctaatatatatactctttttcagattcttttctaatataggttattacaagatatttaatagagttccctgtgctgttcagtaggttcttgttgtttatctgttttgtatatagtaaagtaaagaaagtggtcgctcagttgtgtctgactttttgcgaccccatggactgtagcctaccaggttcctctgtccgtgggattttccaggcaagaatactggagtgggttgccatttccttctccagatcttcctgacccagggattgaacccaggtctcccacactgttagcagatgctttaccgtctgagccaccagggaagtccttgtatatagttgtgttcatctgttagtcccaaagtaatttggtgcttccctccctccctccctttccctcattcccttttggtaaccataagtttgttttctatttctgtgagtctatttctattttgtaaatatgttcatttgtattattttttgagattctacatataagtgatataatatttgtctttgacttacttcactgagtatgataatctctgggtccatctaagttgctgcaaatggcattatttcattcttttttttttggctgagtaagtaatattccattatatatatatatatatatagatatttatttatttatgtatgtatatgtatacaccacatttttctttattcattcacctatcaacttactaatatccctcccttttgtcattctgcct

SEQ ID NO: 30936 - DNA, 906 bp, Bovine  19866880830013
aattttaaaacatagattgtagtctatgtaccaatctcatttgtgattaaaatataatgtcacctttgttagcttactttaaaatttttttcatgtttggcattaaaacttctcagcccccagtcttttactttatacaacataaagtaaaactctaaactgtatttttttttagttaagcatcttgtttctttatttttttttcctcctctaaacactacagtacccggcaaaagagcttaaatttgagtggattattgcaaaaatcgactctttcttaataacatactctctcattctaaatgacataggaaaacctatatagtctaagttatttccctatggttttttcatttgcaggctgtgctttcaagcatgaacacaactaagtagaaaaaaagaaaagaaaaagtggcttcagttactaaaccctctaagccagtacaaaaagacgcagctaaagatgctcttttccatcaaaacaactatcttaaatgcatttcattgtggtacttccaagtttggatggtattttaatggaagtaaatggaagctaaagccagtttgagcagtactgtattacaggctgcagccatgactcagagtaatttgatctaaccaggttcaatacattacatcatgaacttcagatttttctctgcagtaaaaccatttggaatcctgatttccagccaacactgactttgcctgttacaattcctaaattagagtagtatggaccaaaacatgccaatgtccaaaatctcatacatattcagaaaaaagttggccaggtgaccttgctcagtaaggaggcaaagagtaagaacccaaggagaaaaaatgtatgatatttctagagatatataaatatatagagagagagattcctaaaacaagaaattt

SEQ ID NO: 30937 - DNA, 1789 bp, Bovine  19866880862049
aaaaaaatgctatctaatggttttaatttaatttatatccttcacttactactgaagttttaaaacatttcaaacgttcattggctctatgtactttccttttgaattacctacacatccccctttgttcattgggtttttgttttgtttgaagaagttcttcttatattctgaatgctaatccactataaactctatgatgccaatagtttttatctgttttgctcactagattcctatatccaaaaatgatacgtggaacataaattgtactcaataaatgtttattggaaatatgaataagaaagtgaatgaataaacatttcccagtgtactgcctgtctggactttatagggtccaatttaaacaaaagttttaaattgtgttaatcatatttatcaatgacttttactaagtattttaaatttcatgtcttataaccatttcaatgaaagtttataaacagattcttgaatattcccctctaattctacactccttttaccgactctattcattttactcaatttaatccactttctttatttatgatatctgtaatctgaataaaaatggtaagtgtattaatacaaatattaagaaattgattaaaagtaacatcatgggaggcatctttacagaaaatcacatttcagacatactgaaattttgttttactactgatggacttaaaatttgattctttttattaaggaagttattatcttcctgaagcacattcaaacatggaatggtacacaaggttcccaagagaaggaaatagcaacccactccagtattcttgcctggaaaattccatggattgaggagcccagcggactacagtccatgggggttgtaaagtcagccatgactgagcaactgagcatggcacacacaaggttatgtttctgtgatggtgacctttgatagtcacatcagtctccaaaaaaggctctatgaagtgtgtttcggaagacagcacactttccatttgtattcaatctgttatttaaaattaaactacatcgtatattgggccctcaatgaaatattgtaaataagatagagaatgtcaacaccactatttctttgcatgcatgctaagcaaaactcacagaagaaaaaccctaggacatgatgtcaagcaaagccttcagaaacatagtagcagtatacacttggaaaataaaaagtaagatgtgcacaccaaagttaccttggtagctaaaacagaaagtctgctatgagtgttccttatcacagcaatagtacctggaaaggatggatggtcacatctgtctttctgaccatgttcccagtcctgagtagtagcactggcaacacataatatgaaaactatcaatacatgctgacagtgtttgtacttcagctggtgagaagccctatcagctgaggaaggaaaaacaaaaaacagggaccagtatcttagactgaggtgagatgtattacaaaccatggaagaaaggagatggaaatataaaatgatccaaataaggcagaagagggaactgatcatttaaggaatcaaggcaatacattcatgttcatttaaataagagcaaaagcatctgttaaactatttatcactggttttgcatactagcgtgggttgttgcagattatattactcatgtacagtcatccactgaaaagttcagcacatgactaagaaactttctcttggtgagtaattatttgtacagtgcttaccttttatgagcaaaaattattaacactaatcaatataacctgcttaattctgag

SEQ ID NO: 30938 - DNA, 1717 bp, Bovine  19866880915952
aactatcttgcagtgttgtgttattttgaagtgtaatgaagatgtaacattccaaatcgaagaaaatatagagacagaaatctgaattttaaagtgtttgcttttataatatttatattgtttttcttatctatatccaatattcaaatttttggaaaagaattcttagcacttttttttttctgatcagtctttttgtggtactatatttttcctggcaaaaatgatttagctgaaagactcaagagactttattaaaaaaacattcagcaagcagacatgctgacctgtagtttattttatttataacaattaaaagaagacattttaaatagatatgctactttatcatttctactcacagttttctatttttattattttgtatcttaaaagcactggcaagaaatccattttccaaaactgttttcagttatttgagaacattaaatgattttcttaaaggcacttccctgttttctcatttatcttagctcgtagctaggaagtttttagatgaagaagcagaactttcccaagaagatgcagaatatgtttcatcagatgagaatgatgagtcagaaggtgaacaagactcctcactccttgactttttaaatgatgagactcaactgtcacaggctataaatggtaaatcatacaataatacttctttttcttttcattttcaatgcttttactatggttatacttaaatattgtagtaattttccaaagaaccttgactttaaagggaattcaatttgatgtgtaaaatacttggatattttcattcaaattctgtaatattttctttatgtgagagttgcttgtttataggcttctactaattttaaaaactactacttttaaaaaacagtctctagagacctggctggctgtcagttgttcatttaaacaagtatttaatgcctggtatgtacctagcactctgtaaggttcttgagaaagctgtatctgtgaacaaaatggacaaagccccctgtgcttatgaaacatacattagaatgggagaagagaaacaatatacacaataactaaattatttagtgtaagacaaatttatagaaaaacaaaaacaaattgagtaagatgaagatttggagtgtcaggggttggggtattaaactgtaaatttgagtaaggtaattagtggtttacctcactgaggtgacatttgtccaaactctaggagatgggaattcaaccatgtagtctgttaaaactagctgagacacaaagctaaatttattaaattcgtcaagtacaggagactacttttagaaaacagtctccccaaatagtgcttgagcaggtcttctatagatggttcagattggctgcaatggaaatgggaaagattgtagtgggctcttctggattcttacctttcacaaatcttgccattcttctgctcctgcagggtctcacatgacttaagatggcaaagtttcccaaggcccacaactttaaagaaggctttaaatacaaaggtctcagtagtgtgttgctgatacagatatgatttgcagcataaggcttctttcccaggtttatagcagaatctggtgggagaatgttgatgcaaagatgaccagtgtaaaggccctgaagcaggagtgtgcctggcgtgttcaagggaacatcattatgactagaactgaaagggaagaaggggggtagtaggaagtgaaat

SEQ ID NO: 30939 - DNA, 1353 bp, Bovine  19866880937786
tatgatagttctgaagccaattgtaaaaatgccaaaaagtgggtagtgacccagctcctgaaaatccctgccccttcttcaaaataactggtgaatattgctcccactcattagccatgaaattgttgtttaatagctatgtcagactctttttcaaccccatggactgtagcccactaggctcctctgtccatgggacttccccaggcaaactagagtgggctgccatttccttctccaggagatcttcccaacccagggatcaaacctacatctttcccttttaaaaatgaatactgtctcatagtatatatgtaccacattttatttatccattcacccactgacggacactccacttgcttccacctcttggtgattgtgaataatgctgttatgaacatgaatgcacaaatatctcttcaagaccctgatttcaattttttgggtttacacccgtaagtgaaattatgggatcatattaggtaagattttttaatgatgatgacaatgttcttgaattatagtggtaatggctatacatctctttaaatatacaaaaaccactgaactgtatgtgattcatgttgaggtttgacagaaaacagcaaaattctgcaaagcaactatccttcaatacaaaataaattagtttttaaaaagagattatatttctctttgaaagaaagaaatacagatgcttatgcatttgctgtttaatgataattcaaatgaggtactttagccactaaattcaacaaacaaaaactgctgtagttttataaatagtagataaaaaaagaaatgggggaagtggagatggaagaacaagacataaaagatggagaaaaagacattaaaaaaatttaatagaagaaagaaaaataaaaatggacataagctcacacataaatttaggttaaaatgtaaacatccaaatccttttaatcctgaccgattctcgtttccccattataccacccaccatagctccctcagccctctttctgatctctgatctccctctcacataagcatgtgaatatgaattaaagtgctcatgtcatgatctccaactcacttaacttgtaaggatcaaagtaaattaccatttattaagcagaacagttagctggaaagaaacttgatttaggagtcagaaagcttgggttcaattcaattcatctattttccaatctcatatgctgtcaagctgaagtactgagaacagtgcctgtggttgaaaactctgaatttctcatcatattagtagtaattgatttaaagatctaataaaaggcattgagaattcaaaatagcatctaggctcatgtcaagatgtgccaactacaa

SEQ ID NO: 30940 - DNA, 2174 bp, Bovine  19866880960487
atgagaatctattctcttaaccttcaggggcttggggagctgaagaaagagaaaggagatcagtctggtgtgatagtgaaatagtatagaaataagaacagtacagtatctatttcacaatcagttcaaagggacattctgaccctgtatagagaatgggatgcattatcagtcacctggttttcctgtatcttgtgacactccttcaactgaccctccacagaactacaagggtagtctttcaaaaccattaacttaatgatttcattttcctgttaatgagatatcaaaaacttcctatagcttcaaagtgatacaacctctttgcttccctattctccccatcagtcccatgctctggggctccattagatcactagtagttaccagaatatatcctagtgtttcatgtcaccatggtctcacatgtactgtcccctcttcttgggttaccctcctctttcctcacacaaccaatatgctaatacttatctattctttaaaattattcagattttgccctccaaggaaagtcttctttggccccttgaataatttatatacccattgtatgtgttcccaaagcattcaacatttgcctctatcacactcaccaactgttgtaaggtctttgaggaagtattagtcatctttcctttatccctgtactgcctggcacataataaatacacaataaatttttctgtatggtaatataactgttttcatagatgtatattttcctagttccaaacaaattggtttacaaatatgttttgtgagctcaatctgctcagaagttttatagactctattctgggatattgaaagtcacctcatacaccacacataaataatcaactgtcaaacagaatacagtaaagtacactaactccaaaactgaataaaatgtaagctgttgttcagttgctcagtcatgatcaccgactctgtgcaatcccatcagttcaattcagttgctcagtcatgttcggctatttgcgaccccagggactgcagcacaccagggttccctgactatcatcaactcctgaagtttgctcaaactcatgtccattgagtcggtgatgccatgcaaccatctcatcctctgtcatcccctttttctcccaccttcaatctttcccagcatcagagtcttttccaatgagtcagctcttcacgtcaggtggccaaaatattggcgtttcagctttgacatcattccttccaatgaacacccaggactaatgtcctttaggatggacaggttggatctccttgcagtccaagggactctcaagagtcttctccaacaccacagttcagaagcatcaattcttcagtgctcagctttcttcacagtccaactctcacatccaaacatgaccactggaaaaaccatagccttgactagacagacctttgttggcaaagtaatgtctctgcttttgaatatgctacctagggttggtcataagtttccttccaaggagtaagcgtctttgaatttcatggctgcaatcaccatctgtagtgattttggagcccagaaaaataaagtctgacactgtttccactgttttcccatctatttctcatgaagctaacatcatacttcagcagtgaaaagctgaaagcatttcctgaaagatatagaataggacaaggatccctaatccaaccacttttcttcaacatactattgggaagtcatagacacagccattagacaagagatgaaaggaatccaaatcagaaagggagatgtaaaactgtcactgattgcaggtgacatactatttcatagaaaatcccaaggacattaccaaaaaactacaagaactcaataaatttagtaaagatgcaggataaaaaaaatacatacataaatctggtgtttctacacactaacaatggagtatcagagagagaaattcagaaagcacaccccacttataattgtatgaaaaagatacaaaacctgtagtcagaaaaccagattttgaagaaaaactaaagatgattcaaacagatggaaagatgttatactcttgcaatggaagaatcaatactgttaaatgaccacactactaaaggcaatttacagcttcaatacaaccacagtaaaaagatcaatggcattttcctcagaaccaaataattctaaaatt

SEQ ID NO: 30941 - DNA, 899 bp, Bovine  19866880965687
tattcattcatattcatttcttcaacctcatattttctagtcactagcagttaagaattaaagaggtttttaaatgatgagatttgaatctgagtttgacaaaaatgaatcattagtaggctttctgagggacatagtcatttcagttgtggaaacaggaagaatggagtgtcatttgttgttaaagaaaattctctttgtaatgtggtatatattttgggtgagaaattgacatctctatttaaatgaatgagggccctcacctggaaatgtcattcatactaacagagagacataatgcataattatctgttacagtttttgatgtggtttttgtgtagattaaggtgttcattcaaagaacatccccacttacaaggttcatataatacaatgtgtaagaaacttggtgccccagagttttaaaaatcattaatcgtagtgaattaagacatttattcaagacttagacactgacaaaagatggtccctaaagatttctacctagaaaacctttagaaaatgatgatttttgctttctacttgactgcctcagtaagccaattcatttttgtaggagcagctcaaggtcagtgatatgactatggcagctttaagtgatgttctcccttacacttgtaagctaaacttccattgttataactgatgatcagagtggtactgtcaagaagccctgagattgtctcggaggagaataagtaaaagaccaatagtaatatacatttcattttcaaatgaaaacatttaattgatatgtatatttcaaaatgcaatgacttttttttttacaattaataatgggtattactgtatcatgagaatatgcagaagaattaggctagatcatggtatattactctaggaaaaaatcaaagaaa

SEQ ID NO: 30942 - DNA, 856 bp, Bovine  19866881071562
atcttgcatgccttcaagtgatcttcaactgttttttcttttaattaccaaggaaaaaaggatacttggcatcaggctgtcctttctttccataagcccattctggttcaatctccagtcgagccttttctcctttactcatagtcaagagtgcttcatcccactaaaagcgagaacatcaaattaaaactaatgatacttcacagaaaaatacatgcaaaaccagaagaaaggcaagattacatacaaagtattctgttacaagacttcattatgtcctaaggtaatgtccttgagtgagcccctaaatctgtgtccttcattgtcaaattaagaaaaatttaaggacatattaaacagttttttagtataaatacttgaagtcttgaaaatgacaatgtcattttgtacaaatttggatcttaggccaaattatcaaaaataaatcaacataatggaaggatacagaatgtattaacttatatagactctgttaaaatgtaacagttatataagctcagatgatacagatttgtcacatactggaagttaagaatttagttgaatagaacaaacttacagtaagcacattagttataggaacagaaaaatagctcaacttgatatatcaacttggtataatcaggtagtagtaaaagtgatttttcaactaaacctttagtttcaagatgttgtacaatccattttgggctctggataagattgagtagtattttaggtcttaacgcagtacaaagaataacacattgagggttctcgtaactgcacttaaataggcatttttgttattaatgttctgaatacaaagaatttagaacaataagcagaccctaac

SEQ ID NO: 30943 - DNA, 1316 bp, Bovine  19866881139549
ctgtatctatagtcaaattagttcattcttttgctaagccctcctatgctgtttctgataatttgtctagtggttctgtaactgagaaagtgaaagtgttagtccctcagtcctgcagccaccccatggactataaccctccaggttcctctatacaaggaatttcccaagcaaaaattgtggtctcggttgctattgccttttccaagggatcttcccaacccaggaatcgaacctaggtctcctacattgcaggcagattctttaccgggtgggccaccagggaagaccactgaaaaagctgtgataaagtctcagtgacaacctctattagagtctactatgattatagttcaagtatttctcccttaggtctatctatttttgctttatatatgtatgttcacgtttgcgtccgtgctgagtcgtgtccgactctttgtgaccccatagactatagcccaccaggctcctctgtccatggaattttccagacaagaatacaggagtgggttgccatttccttctccaggggattttctagacccagggattgaaccctcatctcttgatgtctcctgcatttgcaggcatattctttaccatgctacctgggaagccctaatttctttaaatgttattaacgtccattgtaaattacagaagattggccaattaataccctgaacactaaaattagtatttaacacactaactcaattttccttaaatacatacttaaatcaaaagtttgaacaactttagcttacaaagaaaacaaagctttcattttttgacttaagaacttgaaatacccagaagcagaagcaaaccgaaatcaagtaaagtcctaaaatggtacaaacccctaaaagccaagcaggtttgccaacaaagctccgcctccgtgcaaaccctgcccacttccggctgccccacccactttctaaccctggaacacctcccctttctgcgaggtcccgccccctgcacctgatcctggtacccattgggtgaatccggatgctgtgtacacaccctccacacgcacgtttggcagggccctcttcgcgcctgcgcagcagcggcgtccggcagctggagactaggtcccggggttggggggaggggggaggaggtcaggccgaatcttcctccgtaataagaagctacgcgtcccgcggtcctggctccgtgggtccggtcggatcgggcctgggcgctggagctgctctggctcccgccgcggcgggtgcgatggaggccgtaccggagcccagcgctcacgccgggggaggccgaaacagccggcagtg

SEQ ID NO: 30944 - DNA, 1093 bp, Bovine  19866881260181
ttttcctatgatccagcagttagaaaaaccagccaaacacaaatattataaaaacaaacttactttatttgaacaacctaactggagagaaagggtgagtaatgtactatataaacagagggaaaaaatttttcatgtccaatttaaaacataatggcagaatatgctaaaagatgtttatttccaaagaagctgtccaaaaggaaaacagtgtttattatgacatgacatagtaacttgacttcttacagtagtagatctgtaacctgaacgttgtctaactcagtcttttaaatactgagaccaaatttttgctatgtctgcttaaaaatacaacaaaatgttttctcattctacttaataaaaatacttaaaagcaataaatgaaatttacataggtttcacggatgtgccaatcacaagctttaagaaaaacaatcaggagaaagcttgtcaaatggtttaaacaacatgtaattaaaacattagatctgacttgtataccaagtggtgacaaatgctaaccctaagttttcatgaactcagaagctacaatctatattctgttctcccccatctctccctttaacaatactaacattttcttaaatgatttaaaaaaaaaaagaaaacctgtatggaacacgattttcctcaacagactaagatgcttatgagacataaaacgtgaaacctttgaaaaacagtgtgcagtttctataaagaaaatatatacacttcagatgaagacacaaatacactgcctgcttcttgataaacatcctggacatgttctcttatttatactattcagaatcagaattcgaaaaataataatcgttctcttcttcatctaaagactccatagcctttgtgaaaagttttccaataccagagttttctgctaattctgtaacgagaagtttaataaaaaagattaatatgtttctaaaagcaatttcaaggaaattgaaaataactataggaaaaaattgatacgtctgcccacttgagaacaattaattttaatactgtgttaataaatagactaccctatagtagaacagagctacaaaagaaaaagtatattacc

SEQ ID NO: 30945 - DNA, 1265 bp, Bovine  19866881401052
aatgctcaaactaccgcacaattgcactcatctcacatgctagcaaagtaatgctcaaaatccttcaagttaggcttcaacagtacatgaattgagaatttccagatgttccagctggatttagtaaaggcagaggaaccagagatgaaattgccaacatcccttgggttatagaaaaagcaagagagttccagaaaaacatctgctttattgactactccaaagcctttgactgtggattacagaaaactgtggaaaattcttagaaatgggaatgccataccaccttacctaccttctgagaaatctgtaatcaggtcaggaagcaacagttagaactggacatgaaacaacagactggtttcttattgggaaaggagtacttcaaggctgtatattgtcaccctgcttatttaacttgcatgcagagcacatcatgagaaatactgggctggaagaagcacaagctggaatcaagattgccaggagaaatataaataacctcagatatgcagatgacaccacccttatggcagaaagcaaagaagaactaaagagccttttgatgaaagtgaaagatgaaagtgaaagtgaaaaagttggcttaaaactcaacattcagaaaactaagatcatggcatctgtcccatcaattcacggcaaatagatggagaaacaatggaaactcggagagactttattttggggggctccaaaatcactgcagatggtgattgcaaccatgaaattaagaaacttgctcctaagcaattttagtagatttcatgccgactctgtgtgcaaagcctcgaaccgacgtccctcagtctacctgcccactagggagtacccgtctgaacagatcatcgtgacagagaaaacaaacattcttttgcgctacctacatcagcaatgggacaaaaagaatgccgccaagaagagagaccaggagcaagtggagctagcgggcgagagctcggcgccgccccgcaaggtcgcgcggaccgacagcccggacatgcacgaggacacttaagactcacgcccccctcaggcgcctcccatcttgtctgctccttgcccacctgccttgtgtaaagcgaaccccgccccacccctttcgccggcccgcccataccccttccacaccacttccaacctcataggagccaatgtatttattttccttgagtttttatttatgctgtaaaacgcaccaagcgatggttacaggggacgccagacccagtagtgtgatgttggta

SEQ ID NO: 30946 - DNA, 1597 bp, Bovine  19866881427188
ctttcttgcagactgatacttttataaaatacaataaaagtgttatgacaacagtctctaaaaggttgttctcactttctgtatttatcttgtaagcatactcttctgttcaaataatataagggtaaccttcagggaagcactctccttatacttcttagaaataaaacctgtaaagcctacattataggtgaaaaatcacaaaattagttgatgtctctagaatgaatatgcaacaatttgtggtttgttactatttatattatttgttatatttgtacttccattcctactttgaactattggcttagataagaagttttgtgggtttttctccccctagattttatgacggtaatagtgaaattatttgagaatgctgaaaattcaaatttcaaataattatatattatatataactattatatatagttaattatatgttactgagtcattcaaatttcagtatgatagttcaacatattccattattagtcatgtagtcaccctcagttaaacctcagtacagtagtttttgagtattatgagttaaatgaaatcacaccaaatgttaaattccacttactttgaggtgccattttttcatttcctgtatatttcattcgttcccagggattctgttccttcctttcagaatctttaatgtcaaaaagttctttttcctcttttctcttttgtctcatcttgtcataagtagattttgaaatagaaactttaatctgcatgaaaaagttgaaatatctctaattatttagaaagtctgacacttaactatcttcatcttaggcaactgtaagctatacaaaatgaattatacatttcttagtccttatttcagtaattctaaaattgaatagaattacatagtaccaactgcgaactaaatttgtgcctaaagatactagtttgttactccttgacgatatcctggaaaattgtcaaatatatacatgcacacatatatatgtatataaagtacatgtagaatataaagtacattagatactttacaccagaataacaatatatttggtggaaaaggagaataatctatcatttacatgattaaggttcaagaatttcaatatcattgagatttaaaaaattataatcaaagcacttttatcaccccaaatctgatatacacaaaataatgatgtatcataagcttgaatttatcctaataattaagaaataaccttacatctttttcattctcagaatcaacatatgatggaatactctgctgaactgctcttccataaatgcctgatggtggttcagtatttttaactgaaaacgaaaccccattttccacagaagttatcactgattgactgcaggttgctggtgctggaattggatttccaaatacccctgaaagcaaccaaccatcaaacactgtcattatttatgtgatgttattctggacaacaaaattttaagacaaggttttaaaagaagtaaacaatataattaataagaaaaacatgttaaataatcacgaaatacaaaaacacctatcaaatgataatataataacaagaaatttcatgatgtcaaatagaactgcata

SEQ ID NO: 30947 - DNA, 1013 bp, Bovine  19866881466662
tgatgcctgaatgtgaaactgaagaaagtgaaaatgaactttatatgaaacaaaagaaagctaaatgttctgctaaagaaaaccttaagaaacctgatgttggtaatgaacttccgaataccgagaaaatggggtctagtaagacaaacaggcattccttggaatgtttgcctggttttactcaggatgagtgggataagaaagaattacagaaacttcattggtaagtagttagatttgactttgaaatctagagtggccacaaaacagtttataacataaaaacaagaggctgatttatgacttctaatcattaaaatggaaaatgtcatccaaagacacttgaagagaaattgaaatttatgtagggtggagggagaacacagataatatctaactaggtggccatctgcagcccacatatgaagaaagtgaaagtgaccttcttttcttttcattcccatttaatatttcaagacagtcccctccttccctccccaaaaactatttgaggggacagatatgttaattaatttgatagtggtaatcacatcacaatgtatacgtgtatcaaatgatcacatgtacattttaaacatatataattttatctgtcaatcatacctcaataaagtaggggtaaactatttcaacagacaaatgcaactctctcatttagcttcacattttcaggaatattttataattaactttactattataaaaccttaaatttgaacccaaatttgtaggttatttcatagtcttttccccctcattgataaatgaaaaattggtctcaaaaattgggtgatttgtccagggtttcttaattagtgctgcttgataaaccaggtatggtaagaattggatttggctacatagacttgaaaagcagtttcagtagtgtggtagttggtattggaagccaggtcacagttgagcaatggacagtaaagataacctagaggacagcaaaagatatgggcaatgttggggaacagcagaaggca

SEQ ID NO: 30948 - DNA, 1056 bp, Bovine  19866881513894
tccgggtaagtaatgatctgttctaactgtgaaataactataaatactactgatggattgtgaatatttagacttctgatggtaatttgaagtgatttgcagcactgaattcctatactcagtatctcaataatgtgtcaatccatgagcaagaattcttaatattctaggccatctttatggttattatcattaaaatgccaagtttagtggatcctaagactgtgttgtgtggcatcctaaaacctgatcaagcatttttgcagctaccttggtgttttacaattttcatcttgatactacatataattagtgatcaaatatttcaagattgggtgaaaaggggaacaatgaaaggagaagcagccatccttggcaaatgtgggtcaccattctggaagcaggaacaggagttgtgttgtccagtggaaaactgtgagcttctttaatggcactgtactgccatctagaggcgcaccaacaggactatgacatgcagcatggttaaaattgttaaaactgaaaatctgaaacgaatgcaagtacgttaaggtataagagaaaatatgtcaacttctagagtagtcatcttttcaaaaaactcctgcctcaacaggaaataggctttggaatcaaaaataaaagtaagggtgtttcaaataaaagataggcattttcccagaaatctgaaatgtaagtaaattaactatggaactttcagcagtacaaagataaagatataaatgggtaaaaataaattagggggagggtacaacaagatgaaaagttttctgggaaggcaagttctatgaatgatgtgaataacaaaagatggtccagaattttgcacaggccatgaaggttgctcagttttaataacaagtagctatcttagtcaaattatgaatcattttcatcttaaaacactatttgtaaaaattatattcaacagaatttcatttaacataaaacaatataaaatataaccaggactcctgatcagcccaaaataaaaatcagtatttaaatactgatatttcttgtatttaaatactg

SEQ ID NO: 30949 - DNA, 1115 bp, Bovine  19866881650941
acctactgcagataaaacttgtcctgaaagaatgttgcgcatttcttgaaagcccacttgatcctggtaattgtattggaatttctcgttttgcagagacgtatggttgccatgacctttatttggcagccactaaatacatatgccagaattttgaagctgtttgccagactgaagagttttttgagctcactcatgctgatttggatgaaatcgtttccaatgactgtttgaatgtagctactgaagagactgttttttatgcacttgagtcttggatcaagtatgatgtccaagaacgccagaagtacttagctcagctacttaacagtgtgcgattaccgttgctcagtgttaagtttctcactagattatatgaagcaaatcatcttattcgtgatgatcgcacttgtaaacgtcttttgaatgaagctctgaagtaccactttatgcccgaacacagactgtctcatcagacagtcttgatgacacgacctcgctgtgctcccaaagtactttgtgcagtaggaggaaaatctggactgtttgcctgtttagataggtaaatataaggttttaaaggatggatgtgacgtgggcttgatccctgggttgggaagatcccctggagggggaaatggcaacccactccagtattcttgtctagaaaatcccatggacggaggagcctggcgggctgtggtccgtggcgttgcaaagagtcggacacgactaaagcgacttagcacaacacacattaatagattgtatactcttaaaatttgctgattttttaatatttttaaaatagttttattttcctgtttactttctttgcttttttgattttttctcttcttcttaaaacacttatctgtctgttttaatcagattgttgtccattctctgtaacactctcaattaacccctcttccctcccagtgcaaaaattttatccgtcctacttactcgtgaacttttctaccattttatgcccttttttttccctttgtgaaatcatttacatctttgagtcagactaggtcagagaggatttattattgctagctatatcagacaatgctaaagaagagagctcaaaatctgtgatgaag

SEQ ID NO: 30950 - DNA, 999 bp, Bovine  19866881678072
tgccaatacttggaagcaaccaaggtgtctttcagtaggtgaatgggtaactattaaactatgctacatcaagactgcagaatattattcagtgctaaaagaaatgggctgtcgagctcttaaaagacatagagaaaatgtcttatcaggtaaaagaagccaacctgacaatgctatacactgcaagagtccaattatatgatattctggaaaaggtaaaactataaagacagtaaaaatatcaatggttgctaggggttttggggagggaagatgaataggcaaagcactcaggacctttagggcagtgaaattactctatataacactataatggtagataggtatcattatacacctgtcccaacccacagaatatacaacactgagaatgaaccctaaggtgaattatggactttgggggataatgcgtcaatgtaagttcacctattaaaacaaacacaccactacggtgggggacatggacgatgggggaaggtatgctcgtgctggtgaagggtgtaaatgggaaacctctgtacgttccttaattttgctgtgaacctaaaactgtacttaaatcttttaaaaagtaaatcaagcaggaaaaataggagatctagctactttataagttcatacctctcccagactaaataattacgtcctacgatatttaaaagaacctgtgaatgagacccctgaatcattgccagtgcccacaagactaaagactattttaaaaaataagacagtaatatctactaacatcttggaaaggataatgttaattttagataacactataaaacaaattattaacgagttgatttgtgaatattgagaagatgatgtagtgatttctaacactaggatggacgaactaacaagaagatgtgtcacagatgaatcttggggtttctttttatgtatttgaaagacttgcagatcagaaaaatacatatatttaaagacagatttgagaacaaaaccagaagt

SEQ ID NO: 30951 - DNA, 1562 bp, Bovine  19866880425497
aatgccaagtaaaaaaataataggtgaggtcttaagaagtatgaaaacatctgtgttccccttagtcaaaggggaaaaaataaatagtcatttagtaaaaattaggtgacatttttgctatacataaaagttctgttttttgttttttcctttcataatcaaaaccagttattgaagttctctggtgggttttggagtttttctgcttggtgatattcagaaagagtctaaaaaaatgttatcaaaaaatattttagacatttacctgtctaaagacaagcagattgaacagaagatttctcaaggcctttatagttttattatcttataattctataatttcatggtgatccaaaccactttatactgtcagtattctccatttatgtcaacatgaatcaactcctgtatttcatttcattcataagagaagagcttgaaaagcactttcagatagcaatttgtacatgatctgatatattttcatggtttttttaagcatgaaagatttaaaagaactatatccaaggctacattattcataaagggaaggtatgaagcagcacatcataaaagaaattaaaaggaaagctatagaatgctagtcaaatcctctacagcttatcgtattgtcagatcaaacagaaggccacactttgaggacagtgccagaggactatggaattcttctaggaggcactaaagacatttcttttctgcaataatgaatgagatcatttgacacagccagaaaatttgttctaatttcatttagtgcttaacaaagtatgtattgttagtttgctatagatttgttagtttgctaatgatttggatttttccttatgattctcatcgaaaacaaattgacaaacacaaaagaacatttattaacatttactagaatactaacctccatgtgtgttcatttccctatctgtacagtagggaataataatagaacctgcttcatgtggcttttgagagaattgagtttatctgcttaaggactcataataagttctcacttgtgttaaaaatatattattactgcaacaactatcttaactgataactgtttaataaatgaattcattttatgttttaatattgtagtgtttgatgtacatatacatatacaaattatatatagacatgacatgacatgacattgaagtcactcagtcgtgttcgactctttgcgaccccatggactgtagcctaccaggctcctccatccatggaattttccaggcaagagtactggagtggattgctatttcctcctccaggagatcttcctgacccagagatcgaacctgggtctcccacattataggcagacgctttaccatctgagccaccagggaagtccaagaatactggagtgggttgccattcccttctccaggagatcttcccgactcagggattgaacccgggtctcccacactgtaggcagatgctttattgtctgagccaccagggaagttcttcaaggctatggaaagggttcaatacccataattttccacaaatcttcagtagatcaaattttccca

SEQ ID NO: 30952 - DNA, 3311 bp, Bovine  19866880630540
ctcagggatcgaacctgagtctcctgcgttgcaggcagattctttactgtttgagctacaggggagacctaacttttcagcagttttggaaatgggtaacccctctgttcagagaaggcgatggcacccccacttcccaagtattcttgcctggaaactcccatggatggaggagcctggtgggctgccgtctctggggtcacacagagtcggacacgactgagtgacttcactttcacttttcactttcatgcattggagaaggaaatggcaccccactccagtgttcttgcctggagaatcccagggacggggaggctggtgggctgccgtctctggggtcacacagagttggacacgactgaagcaacttagcagcagcagcagcaacccctctgttagaggctggataggagaggaaaacaagaaaatcccaacaggttgcagacatattcaaacaggttcatgacagatttttgttgttgttactctgcaattatgttgttattatttatagatttattaactcttctcacgtgctataataaatatatatcatatctgtttaaaagccatggttccaaaggaagggctagggtggggggttatcttctttcctctgcattccacagagctgctgaatggtttctagcttggtgtaagtttgccttggtattttgtgactggtgttgcgtgagtaatgaaaataatgtatcagaaccctgcattagaaagtaggcagctgacaatatgcttgtgcttttggctacaaaatataagcaggctgctgtactttatgaaaacttcaaccttcacccgcctctgtgtgcagtgacaaggctacactgagacagtccagatgttacagatgcatggatcccactgagctgatcttgatcctggaggaaatcccagaatattctggccggagaaaggtgaaagaaagcacttagagttacatcatatacaacgttaagtccagaagcaataatgaatagtttgctttgtttatttgtctgagaattttaagacaacacccatggtgaaatcccaccgggcatatgtataatgaaaaatatacaaaatgataaaagctaaaagtcatttttaattagcgtatcaataatgaaaagcgcaactgaacagatgtcccttgctttgggcccagaagttcatgaactacaagctctgtcaggtgaaggaaaaacaaaacaaaacaaaagcaacagttcgctttaggatcttagtaggagcactcttgctcattttaccctttgtaactttatgtggatactgatatctctccaaaaatatcaagggccattctcataatggagatttacagatcatatttgaattatatcactgaggagttacattatattacatcatctcaatacatttgtatggaagtcacagaacgaagtatacctggggtatgttacttacatcaagcctttgctgtactcatacccccaatctgttttccacaagtaatttttatgaaacattggctgcatatgttctgcattatcattatttacaagaaatatacacatatttggtcattcaggtgatcaaaatgtgtttctaatacacatttggtattcatccacagcttctaattggcccttcaacgcaactcacaaaacccttggaatttcctgagcaataagagcaatgagatcatcttttgctaagacatttgatatcttgtcttcaattcctgaaaattctgcagagccatgagatgggtgaaatggctgtcttcttattttatcacaaatgtctttccactgctaccagcttcacgttaatgaagagggcttttggaagcacctagagaaagcatgtagaagggactgtttgccaagggagccaagaatagaatactgaaactttcaattccaccctctgatttcctgggaggggagaagagtagaggatgaattaatctccaatggccaatgagttatacaattaatgcctatgtaatgaaacctccataaacgccccaaagtagagggtttggagagcttccagcttggagaaccagaccttctaggttctgggccaaacttcacaaggatagaaattcttttgttcagaacctcaatctatgtatctttatatctggctatttttatcctttaatatcctttataataaatcacttccctggcagctcagacagtaaagaacctgcaattcaggagattcgagtttgatccctgggttggaaagatcccctggagaaacaaatggcaacccactcgaatattcttgcctagagaatctcatggagagaggagcctggcaggctttagtccatggggtcacaaagagtcaaacacgaatgactgataataaatcagcaatctaatgagtaaatgcatttcctgaagagctgttctagccaattaactgaactccaggagggggtcatgggaatttctaatataagccagccagtcagaagcacagggcttgcaactagtctctgaagtgaagggccatcttgtgggactgaaacctttattggcggactctgatgccatctaggagtggatggcatcagaactgagttacatttatttgaatttttggacaccgctgatatctgaactttacttgttgttgaggggacgccttcacaggcgtgtgtgcacacacacacatacacttgcctatgctttgaaattaggtccaggaacccctaaagaacttcctacttaaggaatcattgagacctcaggagaagatctgggtatataaagctcaagtcactcgcaaaacaacatcacattccttctcagacttctctcccataaatattcaacatatcctctccatttcaactttgcatttttcttacacctcatgtggtacttaaaatacagataatctcaccacttcttagtatttacatccagaaaagcctattcatttttcaaggtttagataaaatgatatacttttcatgtagactcattccatctatatttctctatattctgctgcctgcaaaattagctgttgtttttctcatctcactgtttgtcctaaaaatagacgtagccctactgcaatggctaaagaagtcaggggttgattagattaattacatatgaaatctgggagtagactacccaattaacagatgtattcaaggaaacatgctcttgatatcttcttgctacaacatcttttctccaacttgtgttccaatccagaataatgaggaaggccaaaaatattctgctagtgagatattgtctgtttctttagaagtcaagttatctacagaaaaa

SEQ ID NO: 30953 - DNA, 1691 bp, Bovine  19866881062382
accacgcagttactctctctgaagcaggtcgcctcgcttggcactattggggagatagcacacgttcttccctctcacagagcatataaaatgatttcacttgtgacattttagagaagctcttcagacacccctctgcgctttcagtttccaccaaccatgtggaaactattctctatatattttctggattcatgatgaatattttcccattaaaactccactataaacacaatagttgaaagttgaaaaaaaaaatagatgctagtaacttttattttattcttactaatttactttgttaggagtacactttttagagggccaagtcttaagaaaagtcagagttaggctttgttgagttttattgctgttatattagatttggtaatatactgtattaactgtgtgttcaatttaagctattaagttttaattgtcaaaaacagataaaatggaaaactaaaattttctttctccaaaattagggaattcaaatatggtctaaaatgtattcatttgtcttatgcttttgttctctctctctgtctcttcaatgtaatataatatgcataaaacaccattttaactctttagagacatacagttcggtggcctcaactacattcacattgttttgtaactatcgccactgttcatctccaaaaggttttcatcatcccaaactgaaattctgcatccacaaaacagaaacaccccactctactcacccccgagctccaaataactgctaccctaccttctgcctttgtaaattaagatggaatttggctattctaggtacctcctgtaggtggaatcatatttgcacttttatgtctagctcatttcacttagcataatgtcttcaagtttcacccctgtagaatataacagatcctcgttctctcttacaggacttttctttatctggataccatgagcatgtttagcaacgaagctcagaaaggaactggaaataaggagcttagtggacagtaagttaaagcatatcttttgtcatgagagaggaaaaaagagatagaaagagagaggaaaaaaaaaagagagagagaaatttgggagagctaaaagcataaaatgcagaagctgatattacagaacttgaatttttcccattgcactggaaaattaatttcaatacttttcagcacctcttcatttcaggtttacattagacacagggctttttaaatttatcgcttggtttgaaaatgggcaaaaggtttgtaacacagcctccctagctaaactccttttctcaaattttataaaaaccaggtttttctattaaaaatatagtcatgggaatcttggaagaagatgttattgttataaaatgatgcaacaagcagtaaggacaaagactgccaagctaaacacaaagcgtaaagtccatctgcgtatccccacactcttgcacatgtatcccagtgtgaattgtctgtgagtttctgatgacagaacttgacccattaaacactcattctgagaaagactcagctttctccacaaactgcatttatatttcccagatgattacatcttttatcaaaagcagcagttgagaaatgggcaagctcaacatcagaaacatagtccagctttgacactttgacaaccagtttcacttgcaaagataagggaaaggcaaggagagcaaggcagtt

SEQ ID NO: 30954 - DNA, 1143 bp, Bovine  19866880366147
ataaaaaggggggtaaaggtagaaatggaagaaagagaaagagagaggtgtttacatgacttactataggtaacaaagcaattcattgtgtgcagaatattgaaaaaaaattctctggttatatacagaaatataatttgtgtcattggatttgtaaagattgctcatgaaccaatttcaatatatctttaagtttcaaatgcttactctaacccagcatataattttatttctaaggtcttaaagaaacagggatctatgaaatataaaacactaaattaatttgtgtgatttttttgttctggtgcaattttcacaaatacattaagatatatgcaagtttgtttgtgcccaaatactggctttttctcagaggttatccactttttctgtcctgatgacacttccactgaattttaaggtcagtgtaacagcagattccttttttgccctgattctttatttcagagcagttatacttgtctatttaataatgctgcatttgaaggaaaactattattaacctttttgttaattgtattttttttggtagaacccccagtagagatttcttaataccccactgggaaatgaataggtaatcccattatcagagccctgtttaatggaggtttccagtattccttctgtttgcctttcagcagctaatagtaccttaagtagctaattgtaccttaaggtaacaattctaggccataaaaaatgtcaatatttggccattatgaccttttaaaatttattttcttttctttgaggtggtgaatgaaggggtcaagtagtggacttggattcaaatttcaattttttctacacatcaaaattaatgaggcctgtgtccttgtactagttttcttttgaaatcattattgctacccaatcattccatggtcactggcaataataatagatttacctttttaaaagaaaatctgtttcttctattttaaaattagtgtcaagtttcactaggtgtttttagacactgtcagttttattttgtgcagattatttcctacaaagactaactattccccacaccaatctttttttcttattttctaagtcatttgttaggactcattattttttcctctgtagcagtacgcagggaaataatttagg

SEQ ID NO: 30955 - DNA, 1603 bp, Bovine  19866880435896
cttctgtcgtccccttctcctcctgcccccatccctccagcatcagagtcttttccatgagtaactcttcgcatgaggtgcccaaaatactggagtttcagctttagcatcattccttccaaagaaatccaggggctgatctccttcagaatggactggttggatctccttgcagtccaagggactctcaagagtcttctccaacaccacagttcaaaagcatcagttctttggtgctcagctttcttcacagtccaactctcacacccacacatgaccattggaaaaaccatagccctgactagacggacctttgttggcaaagtaatgtctctgcctttcaatatgccatccaggctggtcataacttttcttccaaggagtaagcgtcttttattttattttatttttaaactttacaatattgtgttggttctgccatatatcgaaatgaatccgccacaggcatacacgtgttccccatcctgaccctcctccctcctccctccccataccatccctctgggtcgtcccagtgcaccagccccaagcatccagtatcctgcatcgaacctggactggcgactcatttcatatacgatattatacatatttcaatgccattctcccaaatcatctcttttattttcatggctgtagtcaccatctgcagtgattttggagccccaaaaaataaagtctgacactgtttccccatctatttcccatgaagtgatgggacccacatgaagtgatgggaccagttgagttagtggctcacagtaaacaccacataagagttaaaaattattaacatgcctagtaacataagtagtataaagacaaatatgttcatctactgtgttcactgacagattaccaggcacagaacagtgcctggaaaataataggcaataaatacatgatgaatgaagggacatgaaagataaagggaggaaggaaggcttcttttatttgataagaataataattcacatataataatatgacaggaatattactaataatgattattatgtgtacttaggtgcatttgaatgtcttttatctaattcatttcattttcaaataaattaagacaagcatagatttcgtaacttttggatagaaatccctatgattcactctctcgtgtatattggagtcaattttgaccaactgttgacttaattttaagctatatatattatcacctaactctaagtccacatttctctttaacttatatggagatcaacttattttaaaggagaaccatgctctatccagacagttaagggattaaaaaaataacagtgtgttccctggacagcagaatgtgaaaggtgtaaaacatttcatattttccttaaggatttgtaaatgctttgaaaaatgtcatgaaacgattgtctttgttggaaaggccattttcattattgatgagcgttgcagtagaatgttatcagactagtcagcctgcttttatagcactgtcaaaagagattagttatcaaattacagtgaaccttaagaagccaactgtgggcttccagtttgaggagacacagtaagaatttctgattcttttctcaaaaaaaat

SEQ ID NO: 30956 - DNA, 3112 bp, Bovine  19866880445115
tccaaggaaataaaactgtaatggttttgcaagagggtaagcccctcatccctgagatgttctacccagaagttgaaatggccactagcactcattcaagcacaagaggagaagccattaggtgaacttttaaaggttccttctacccttaacccatgagactatcagcatttcactttcaagagagatttttagtgttattgttcccaatatttgattgcagtagccaaatttcttttaaattagttttcttgctctaatagcccaaagcaaaggtgtatatttagaattaagaaaggcctttcatggtattatcaataggtttttctaaataccagcctatctttgcagacaacccaaagaatggaacagttgatcattcatcagctgtgacctctggagtagtttctttacttggagaaaaattgaagttccaccccatcacacttatacttgcttgagttcacaactgcaatacgcccctctagagagaggttcattgttggtgtcatgagcatcgatcgattgtatctaagctgctctcacagtgattataccttccctcattccccttaagtttcacagcccagagcatgcccagggctcactgcaggcagactcattctgatcagtgcaacaccagcatacagcatacattcacagagccaaaggcagtcagggtcccagggtattccaatcatagacagaatttcagctttattaggtaactgtcaaatttgccttggtgtctcttacaattttaaatcagaagaaaatataaatgcagagaaaccatgataagttaatttaccaatctgttgtaataaacatgtgcactatgatcatacattatggaaatcagatggagagcccagagagtgataatagcgcaagatatgtgcacatagtgagatcataaaaatcataaatgttatatatcaggaagagtttttctttttaaacatcctggtcaagattcctgctcaacatatttgcagagcaacctacccttctatttaaaaaaattaatcattcaaagggtaaaattatgcaaagaaagtttgaaacccaaaaggtaatatatacaatgaaagcagagaaaggcggtattacagtgtggaagatgatacccatgtacattgattgcctctactgaaacccagacatggacttcattgtcttaatttctctaatttctttgtttctgtatacaggtcctactgtgtgttcattccaatatatctttctttactcatgagctgcaaaagagaaaattctacatctaaagcttcttcttgtataagcctcagcttagagtgggagagaagagtagagaatgtttctttataatctgatggaaaaatccttaggtaaagaaatgcattgtttagcaaataataggcttaaaaggctattttatatatgaatagatagtttccttggcaagactagaatagattgtgaatgaggggaaaaaaaactctccaaaataagaaaaggaaaaaaaatgagttttcactagctacaaaaagaaggtgacaacagtcataagaatctggaaaagcagaggggatgtgaggagtaggggagaaagcttagaaaaagagcaggagactgggacagcaggaggagaaacagacagtgggaagtttctggagctggtttggccacattcaaggatggagaaggttaaagatcagggtcaattatctctctgttatgctctgatgaaacacagccttcttccagaaccactcttcatcttcaaagtctattaacacaattgccttttgtgaatttcaagatgaaaattgtggcataggaactatattgcccatttggatcaactcagaatagacagaaggaaatggaaaagattataaatgaaaaagatcaatggaaaattcatcagacttaacaaacccagaataagtgattagaagattctgagagccattggaaatattgattagcataccatacatgaagttgagatgggtaaggaactgaatccagagaattactgaaataggctggaagactagagacacagtggcgatcgaattcaggatcaagcacactaaaactggctgggtatgactcttggtgatgttaaagtagaatgcctgcttcaactctgtctcttagagatgctttaagatctgacatgggattggagaggggattagagcaagctgaaggggagagactcagtcccaaccaaaaccagtccaattctgcatgatttgcaaacaaagattctatatagtatttcaattctaataagggtccatatattaacatataagtataaataaatatttttaaagttttgatactactgctgaaaattcctaaacattagctgaatcaaactagaaagtatttacaacttgtgatataatttacaattctccaaaaagcagcaaaatgaaggggaaaagaagaaaggagaatgagaacaggagatggctggtggccaatcagtaaaaatcaagttttgttttattaatttttaattcaattttaattccatcttcttgccctaatctcagaagttaaaatttccatctcataacctatggcaatctctgtagcatctggataagtgaagttctattattcttcccatagtcctatgaatactatgcaatactgctaccaacaccagatggctgctcacctcttcttcatgaacacatctagactgctgctctcagcctcacttaaatagctatgacaacatgactgagtgctagccaacaaaatatgtgtggaagtaaacttcacacttctagggctggcccattaaagtcatccgtgttcttttccctactacttgctgggtgttaatacccaaggcagcctaaaagcttcaagatgaagatggcagagcttctatcagcctgagtgtgtgaatgactgtgtggatcaaagcacttcaacaaactggtactaactctacatttctgaaccattaaaacacttcaggattcatttgttttatttatgtgtatgtgtgtgtgtatatatatatatatatgatgctgacttgttatgttaataatgctacctaactagtataagtatgatctctgatctactccatttt

SEQ ID NO: 30957 - DNA, 2196 bp, Bovine  19866880476822
tttgttcccagttgattccctatcaaaatatggattttgtcacattaacttttatttccagattgttttaccaatgacctcctgtttccacagtgtgcaagactctgtggggtaaactgtcaaaatgttttgtatggaataacactcaaaattcctgttaactgtaatgggaccaatgtgaggactcccgtcaccattgtgaggtcacactgccctgaactgctccaaattattatagaaaaatgtttaagttaatgtcatgatcaaaaatgtagtaattttatttcacatttttctccaagtaattactctttttttaaactgatattgtaaaaattagaaaacaataaagcagaaaactcttttagagaagcaagattttatttgtttgggcttccgtgttgaatggacaggcaggaggtgatacgatcagtggtgaataacacattatgttccctggagctacctgtgtggcatagtacaatcttttgtgatgtttcacatggttttttgctaaattccacttcagaattatcccctgcctggatgcattaagggcgcgaggcttttcatttacaaaaccctggcgatcaacatttgcagtctgctggtaagtagaaaagtctgctagaatgaagtgtttctgttatctgattttcaagggaagctttttggactgagatctgcattgattgatatctccattgtattatgttcctgtgccaatgaaaagactgcagaagcagtactgagcatcagagcatgattgtgacccttttccctctgagtctaccagccaaaggaaagtgaaagtaattcaccttaaatagaatagatgacttgagtcacgtcctgataggcaggcaggtaggttcttggtcttcttcaagaaatcaactgcccagacaatgactgaatagtggccttattttactgcaactatcataacttttttttttcctacaaagtgtcagtaagggtgttttggagttgatctaatgcctttcaaccagtttcaaagcttcccaagtagcacagtattaaagaatccacctgccaatacaggagacacatgagatgcaggttcaatcccaggtcagggagatcccctggagaaggaaatggcagcccactccagtattcttggaaaattccatggacagaggagtgtggcagactacaattcatggggcctcagaattagaccaactgagtacacaccatatttcaaccagcattatgtttaattagaaaataattatatcaataaattagaaaacacaaagaatttctcataattaaatgtaaaatattccaattataaaaaatattgaagaaaaagaatgtctaccccattaagaatcatattttataatttaatcatgagagtgactatagtggattgagtacttgttgtattcagtatagttcagtgactcagtcatgtctgacacattgtgacccaatggactgcagcacgccaggcttccctgtccatcaccaactcctagagcctactcaaactcatgtccatcatgtcagcgatgccatccaaccatctcatcctctgtcatcccttcccctcctgccttcaatctttcccaacatcagggtcttttcaaatgaatcagttcttcccatcaggtggccaaagtattggagtttcagcttcagcatcagtccttccaatgaatattcaggactgatttctttcaggattgactgctttgatctccttgaagtctaagggactctcaagagtcttctccaacaccacagttcaaaagcatcaattcttcagtgctcagcattctttatagtccaactctcacatccatacatgactactggaaaaacaatagccttgactagatggacctttgttggcaaagtatggtctctgctttttaatatgctgtctaggttggtcatagcttttcttccaaggtgaaagtgtcttttaattttatggctgcaatcaccatctgcactgatctgggagccaaaaaaaataaagtctgtcactgtttccattgtttccccatctttttgccatgaagtgatgggagtggatgccatgatcttagatttctgaatgttgagttttaagccaactttttcactctcctctttcactttcatcaagaggctctttagttcttcactttctcccataagggtggtgtcatctgcata

SEQ ID NO: 30958 - DNA, 2606 bp, Bovine  19866880538947
gaaaaacctttcctttatgttccctttctgctaccactctaccgctctgctttccttaatggtaaaattcattggaaaaattgcctagacttgctgtgtccattttcctcctctcattctttctaataaatctacttgaatcactattttctcccccacccctccactgaaactcttcttgttatggctgtccctgacctctagcttgctaaagccaatgtcaggtcatctgtgttcatcacattcattcaacgtctcagcagcatggcaacactctacctggtttaagggaccctagatatccaagttttccttttatttcactgcttatttctgagcttttcttaccgacttttccattttccaatttttttggccttcctttttcgactacctattccctctagatgacttcatccaatgtcttgtcatttaatacaattataggctgatgacttataaatttataaatctacctctaatttctcccctaagtttcaggcttgtatattcaactgttcatttgactccactttgatgtctaagagatatcccaaatgggacatgttaagaggtgaactcttgattttttgctagcctccttgcttgttcccaattgttgtcattttgattaatgtttctacatgtctccaattgctcaggcctagtaactactcctccctcatatctaatcacttaaaaagccatgttggcacttgctcactttaaaaatctgtctcagcccagctacttctttctatctgcactgctaccatccttgttcaaaagtcactgtcatttctattttgaatttttggactctcccatcttatttctctgcttttaatcttgcctggctgccatccattctctatagagcaatcagagggatccttttaaaatgttaacaggatcatgtcatgcccttgcttaatatcctccagcactatgggtgtgatttaagcaaatgatatggaactctagttaatgggcccaagattctggtctacatgcaaagtttggtgaaggagtgcatttatattttaacttataattatgttcagtatatataccataattctttattaatctgctcctaacaattttttagctatcaaatatggattaatttgatgaaggggatttctagtttatagttatatttttaacttgatagggaaaagagcattcccttatctaatcatttgatcaatctccttgaaaatagctatctaatatttcattgtaatatttcaatcatgtatcataattgaaccctctcatattgtttctacatgttattataaaagaataaagatgttgtgaatgcctctgtgcataaagggggaaaagactgtatatatcttgaagcccttcaatacatatttctggggctttgtttagaaatcttttagaaaaggattggtccagggtcgaagggttggcatgagaatagaaactggagcctactatacagagtgaagtaagccagaaagaaaaacaccaatacagtatactaatacatatatatggaatttagaaagatggtaatgataaccctgtatgcgagacaacaaaagagacacagatgtatagaacagtcttttggcctctgtgggagagggagagggggggatgatttggaagaatggcactgaaacatgtataatatcatataaggaacgaatcatcagtccaggttcgatgcaggatacaggaagcttggggctggtgcactgggatggcccagagggatggtatggggagggaggtgggagggggttcaggatggggaacacatgtacacccgtggcagattcatgttgatgtatggcaaaaccaatacaatattgtaaagtaaaaaaaaaaaaaaaaaagaaaattgatatcatcctctgacctagatttttcttaactgtttccctgaattctctctacttttgtaccagtgctctttggagagaagattatatgtgataagcagtgtttcaatattctatagaatccagggagaaaaaggggttctgcctggtagcctcattacattggtgatgtgaagtaactgttgaagcatggaatcaagaagcagggtgggtgtaagcactgcatgtgtagtgggagtaccaccagcctagttgaggatgagcatttagagttcagggatccacatgtcaccttgttgaggagaacgtgagaaccaaattgacaagttgggtgctagtgaggctaaatttatctttgcaataggagcttttctgggtagtggaggggagagaagagaggaaagctagacttgaaagggacaggagagagacaatggggaagctgctatgtttgggaaagtgaaaggagaaatggagaaagatgatgatacatttttccatatatcatgaatttttctaggaggttgttcaattcagttcagttcagtcactcagtcacgtctgactctttgcggccccatggactgcagcacaccaggcctccctgtccatcaccaactccaggtgtttactcagactcatgtccattgagtcggtgatgccatctaaccatctcatcctctgtcatccctttctcctcctgcctccaatctttcccagcat

SEQ ID NO: 30959 - DNA, 1313 bp, Bovine  19866880584231
aataataaagtagggtaagtataggcgtatgctataccaaaagtaatgtgaatatagtttcattctctctccaaatatcctactgtataaatgcaatccattttccatcttaaaaaagcacttatttactatggccctaacttttgcagtctatggcacaaaacagccaaactagcatgaatttttttcctttctttaattccatgaatagaagattcattcttaccacagatcatagcgacctcagcatacagtacttttttcttttcttattaagttgagaactttaaccttttcaattaaaggaagcactttggagaatttaatccatttgtgtttaaaataattattgataggcagtcagcttctatatttgtgcactttggggccattattaagtgaaataagggctccttgaagaagcactgtaataccacagtcaatctgataactgagatatctattaagtgcctaacaggcaggatatgctagaaaaaggaatcatccagatcctgagcaagacagcacaaaatttgctcatactgctcagcatgacacacaattaaaaacttatgaattgtttactcctggaattttccttttcatatgttcagatcacagatgattgctattaacagtaaccaaagaaaacaaaactgcagatgaaagcggattgcttgtacagagttttccatgtatatgtccttcttttgaaactctcacactaagcgatcattttatatcaattacagctctagttgaaaccgtttcctcttgcctttggtggcataatgatctgcttgatgacaagtacagagtgaagtggcacctagcacagtgcgttatacagtgtcggcaccgatggcttgctgatctgcagaacaagtctctccaactctgacaaggcattcacatattccttaagtcttccttctcgtcacttaaatcattaagtggaatttaatcaacaaaccatatagggctctgaaggatttgccatgtgtgcaacaatagcattatgtgctggttagatatttgtgaggcagtctgataagcatttactgtttattcacagtaatatcaacttacactgacattcctttcatccttactatttcactttactatctttattcctgaaagttttctgacaacatattccaaagtaaaggttttgcatgtgtatagaaatgtagagattttatttaaaatatgatcactaaggtagatattttcctcttcttctttgagtaatcatatggaaacaactaagagaataagaaatagaaacacattgtctgcctttgatttaa

SEQ ID NO: 30960 - DNA, 640 bp, Bovine  19866880603176
ttttcagtgtgacctcagcaagggggacgtaaaggacagacctttgaaacagagtcacaagcctctgaggtccacagacgtgtcccagaggcacgtggaccacgccagagctgccgcctcccctggggcagggcagtcggcgccgggcacgaggaaggaggtggtgcccaagtgcaacggctccctgatcagagtgaactataaccagtctgcagtcaaagtgcctacgacaccggccagcccagtgaagaactggggaggattccggattccaaagaagggggaacggcagcagcagggagaggccccagaggcggcctgccaccagcactcagactactcctacctgggcctaggccgagttccagccaaggagagggcaaaaagcaaactgaaagctgacaacgagaatgacgggtatgtccctgacgtagagatgagtgactcggagagcgaggcctccgagaagaagtgcatccacgccagcagctctatcagcaggaggacagacatcatcaggagaagcattctggcctcttgatgaaacgggcacgatggtgcaggaggcgagagctctgacacaggggaacgagcggaaacccatcactcctgagctacacaaatacatttacttgcaatt

SEQ ID NO: 30961 - DNA, 1142 bp, Bovine  19866880644932
tggggtgaggctggtagtcagggaaacaaatatgaaaataagaacgtcttttattgtaagactataaaatcatcccaacttcaaaattttgagtcaaaagatagtggaatgcaaaacaagtcagcttccccatgcagctcagctctgcctcttgccttgacatgtgtcaggaagcacaacagcagaaggagccaagcccaagttactcctaatagctgagcaagaaggcagatgaacttcaaattttttccttaccacttattctaggctgcaggttgaggaaaatgtatcagctctgtaggcagagaacgtaatgcagccttgcttgactttcctactccaagaacactgggtgaacataaggacttgtttctgatatactagtagagaaatgaaggatggcaaagtcaaatctagaggtaaatagttaagattttaataggttaactgtaagcatatggtctaggaaaaagtgaaaaaacatctaatggcaagtattcttctcttttttgggaaatttgaaaaactgtatgtaaccaatttgggaaggaaactaaagaaaaaatggtttctaacacactagtttttatttctctgtgcttctagaatatatagaaattcatgctttgaaaaagcactccataatgacaatgatgaggacaatatagtacattttgatttgattattgtgaggatgaaacaataccatcccaattatcttttaatcactagaagtacctgatgtaaccaggtatctttaatataaaacatatgagtgttttctctgtataatgccagtacctacatataatgtgacactggaggtggcatggcaattagggtataattgctgtaattactgatggaattactcatattcctctatgctactttttctaattattttggtttaatgaaaatgtgtatttttgcaatgaacaggatgtggccatcatttggctgcctgcctgggatgatggacagtggctgtcccttgaatgaacatagagcagagaggtcaccacttgtttgcaggaagaagaggtttctggaacacaacaggcaatttaaatgcatgtcatgaacatcctgcaaaaactcacagatgggtttcatggaagaaatataacagtaggggggga

SEQ ID NO: 30962 - DNA, 1421 bp, Bovine  19866880648269
ggaagggaaaagggggagagacacaaacattcagtctctagcaatgagcatgtaccattgtatcagatcaccaagtaatttaataaaagcattaccacaataatttagcatgtgaaaatctgtatgggagcatcaccatgtggaagaaacaggttctctcttcagaagcacatcactacacggagtcactgcacatcctcaaatggaatgaaaattttcatctccactgcatattaaggctatgacgccataaaagctataattttaaaaactggagcaggcgagactagaaaagcagggttgtactgccatctgctggcaggactccaggatgactgtaagaatattccatttgcaggttagtaagtacaggtcgggggaagtattgatacttaccattaactattttaatagacaacatatatttaaaactcatctccaataaactgagttttatgaaactcatatgcactgtattataattagataaggaaatgttaatggtatcttcttagtttttaaatagtaaccccagaattaaatgtatttttgtattcctactcttgagttttttaatatacaccttgttatttccagcataatttaataagataaactatagggagaaggcagaattttccatcagatttcaattaactaaaacaagatattgttggcgcttgaatgaagtagactatattacattccatttattgaccaacaaaatatttaaatgcgttttctttgtcctggtttgagaacagattttattgcaccgaatccaaacattgtgtgcgcttccctaactttccctgaggccttcctttaactataaaaccatttatgaccaaaaaaattaagcaaaccagttgttccattacttgctggttttcattatatcctgaaatatccattcagcatttttatctgctaatgtaacacaaactcatctgctcaatgagatttattacttgttttttttcccacatgttcacaagatattcttgtacattttgcaatgggcctttattatctagtaatgatggcttgcaagttaaattagtttttaatggcatagttaaattctaatttatgttttggagctttgtttaattcatttaggtataatgtaatcattttcttgctatttcttacattatataaaagaacaaaagaacaggggctcatcatcacattcagttgttttttgactttattaaatcttgtcactaattgcatttcccccaagaaactttcaaaacaattgcagtccgatcttttgggcaaaactatctggttgctcagcattctgcataagaagttgaatcaaactattactgtaactcaggggttggttagatattgcactttctcatactcattataaccccactatgctgtgtaatgtactgggcaattat

SEQ ID NO: 30963 - DNA, 1464 bp, Bovine  19866880698773
tcactgtttggtgccaacgacattttacatcagcgccccgacctgcaagaggaacacgccacagcagagcgtttatgctgggctttgtaaagacgccaaatggccttcctctgggttttcccattcaggttgactcagcaaacagatgttacagaaacataagcctgagcctttccagctgcagacatttcagacaggaattctttaataaaatcagtctattctgtgaagatatgaaaaatcatcaaacttccttggcctctcctccttcaaattaatgttctggaaaaaagaggtcaatggcaacaacaacaacaaaaaaacatcattttatcatctctgtttaaaagagaagcagagatcccaatcgcctgcctcctgtaagcatcaatgaaggacctgctcagtaaagggtgtagtctctaccctcagaacatcaggtacctcagaagaaaacaaatttccatttttcttggttagcacagcttgtttcctgaaagtattcacatgggcagtctatacacacatacatatacccactccaatgtcttttttatttgctttactttgtggcttttaaaaaatttctcctccatgtcctctgaatacaattctcaggccaaaggcttttgtcatgttttagttttaagcagattccattcacatacaaaaaatctgcactattttcaaggtccacagccaaatcccaccagctgtctcctgcctcaccctctgaatatttttgttacattttggattcttgaacaccagtggaagtgataacgaagaaaagcacaactgcttggcgtgtaaaatgcaaactttttaaaaaccaccagccactggataccttaccgagaggaatatctatcagccaaaatacaaactgattttgtcaaatgaggtcacttctttcaaagccgcaactggtggtctgaccgagcttgtgcggtgtatgtctgtgctgagatgctgtgttttctgcatcaagagagaagacaccccaaaccaacacctctgccctcaggacgtgacctggggactgaggaggagcggggaggacggaggaggggggggtggagccatggccctgagggggcaccccctacaggaggagccagcagggccccaggcaggacttggagaccttggtggaatagcgtctcaggcctcttaagtcaagactagatgccaaaaacgtgaggcccagaaattaacttctcaagcagtcttttacacaacacagaaaaccaccaggccatctatattttctccttaattcttcctacattatgaccttccacacttgcctgcacatggacacagaaaatacaggcacaatttttacatacaggctctccccacaaccccacctccccacacacaagagcattaaaaaaaatcagaaatccaggctgtgtagaaccctaggagcagcactcaggggtgccccctacccagctg

SEQ ID NO: 30964 - DNA, 1001 bp, Bovine  19866880717912
tttcaaatgcttgctttttcagaaagggcaaatggatacatctccctctggaagtactaaatgtttctagcatttccagccagtatcttccatttcccatggaataacactctccctcttttggtccctatctgtcccaagactacatatcagcatttgcagccagtgtattccatttccacagattaacactctttttttgctccctgtctgtcccatggctacatatcagccctggcaacaaaacagtcccccctcaagattatgtgatactgcgagttgggagtgaggaaagtttatttccatgtgctacctccaaaacaatcatttcccaaatactttgcttatggcagttcaaacaaagttcactcttagcaggatactataataaaaatctccaaaagcaaaggcttatgcaatgcattgttattttattagcatcctatttagacggctgttacattgcattactttaatacaggaatgtagtcactttcattccaaaagaaacccacgataacactcaataacagacacctgaaaggggaactgacaaaagctcgaatgcctcttcctctgcctccttcttgggcagacttcccggactgtactgccaatctgtgcatgcacgcccatgcgcatctcctatcactttgtctgatcgcctcgtgctccaaatgcttccttaattctttggaaagcatcaaggcacagagaaaaatatgagggattttgaataagttaagtgtgcactgaaatctcaatttccagttttggaacacttgtgtttgtatcatttgatttcttgcatcttttcttcttcttgtgtaaatggggataacaactatcccacccagctaaagattagataaggtaatatgttgagtatctacaatatctgctgcatgatgggcacccaccggtcaaggttcgttccttcctcttgccttctctcagtgcacctgacccaccttcatgctcacctactctttgaagaactc

SEQ ID NO: 30965 - DNA, 822 bp, Bovine  19866880729321
ccagcatatttctatgtaaccttttggttatacagtctataataacagtagtatagtaataaatacccaagtttcaaattgtagtacagttttttaaaatcctatattgcatggggagtgagagaagaagatggaaatgattaataaaaagtttaaatgataagtggactttgtatagcaatggccatgagaaaaatatctcaaaaatatgaaaattggccagtgcccaaaaactgtcatttatcatacaatgagaaagcagagtaagagggcatagtaatttcattctaatgcttctctaacccaaagccattttccattaagaaaagtttttaggtattcataatattcattctctctgaaattaacaaactctttagtccttaaaaccttaagattttctctagtgaatcacttttggggttgtgatccagcaaaaacccagagtaaacattttttctaaagtatttttatgcaggcataccacagtggaaaacagatcaagctggtgcactaagcataaccccataggagctggaagctttactggttttctggaacaattcacacaatcttctgcactgcttgaaacattcagttacactgaatggctatcattcagtgttatttctgctttatagatctgttaataactgaatattttatatttaaatattcagtgttttttttgggtactatcttcatgtattcagtattgctgaagcacatgttgcacactaatgaatatttacagaagtctccagatttgggattagaaatagaaaatcagatgaacatgggtgacaaggataagtagaatta

SEQ ID NO: 30966 - DNA, 1177 bp, Bovine  19866880736686
ttcttgcctggagaatgccagggatgggggaacttggtgggctgccgtctatggggtcgcacacagtcggacacgactgaagtgacttagcagtggcagcagcagagaggacagagaaaaacagcaaagtgttttcaagacctggtgagagcagaccagcactaagttttaaagggaagattttcagaaggaaagctttgacactcaatatggcacaatcaaggtatgctaggaagcagggtgcttggatcgaacatgaaaaagctcatttttgacagctgttagtaaatacttttcacctgaatggtagaatgcatcaattgatgacatatacagaaaaatccttatggggagagtcaaatgcataaaatgagccatttgaatttttaaatgtattgctctgtgtctattttgtaacattattaataaaagacctaattggttcaagacttgggattgtattgttgaatcatgctaaaaacaaaaccatttctaaggagagcaaatgactccttccccagagacacagaatcaccaccggagcagtcagcctgtgcactactggtataacagcatccatccaactgccaatgcccagtacggatgctactgcaagtatgtctagcacagaccatacttataacatagtttttcactggaataagcataaattttaatcttcaacttcaaaaaatataaatttattgtggctgccatgtaattctgtattatgacctaaggtgagatttgtcagtgaaaatacttcagtgaccacttttatattgcaaaaacaactttaacatggggatttccctagtggtccagtggctcagactccctgctcccaatgcatggggcttgggtttgacccctggtcagggatcagatctcacatggcacaaccaagacccagcacagccaaacaaattaaaaaaaacacaaaacttcagcttgatttcatatatattcctcagtactatgtctccaaagaggaaggagatacaattcataaatataaaatctcatacaaaatttaatgcattctagaattagtaatttttttacaattaaaaatgaaataagtatgtgtttatttcacatacataaatctcatgcattatatagcatgatttactttgaatttcagctaaactatttcaaatcctaaaagacgatg

SEQ ID NO: 30967 - DNA, 1295 bp, Bovine  19866880785105
aagatcggttctccactatgatttctgtggactttgtggactttgtcatctacttattttaaaatattttttattatatttaaaaatataaaaatcccttgtacaacataggtggtatgccatagtggttaaaagcaggtagaatgagtaggtttgaaccctggctctcacaccgttgagactctgggcaacttgcttaatccctctctttttctgttttgtcatttgtaaaatggggacagagtacctgcctcacagggcttttatgtgtgtgtatgaaatgagttaatacatgtaaagtactttgccaagacgtaagtgacaaaaatctgctactgttgtttttcctgctaccaatccttgaggacaaatttgtcaagcaccaaagattgattatagtaactgattatgttaggaagaaaacaactaattttctctaaaactcttattactacatcaaagaacagaggtatgaatctaaaatgaactctctctccccttagaattccagaaccatttcttcagaataggatcaaatatattgttttactttcctaatacattgtcagatagtcatgactgatttatccccaccactcaagctttcaattatcaatatacaatgtatttttatgcttatgtttcctcaccccaaatcacccaacagatcatcagaaaaatctgttaagccctaaggataatactcctcagacttctgattttaaagctttctaaatttcctgtttcaagtcatggatattagtgctaaagaagttactgatataaagttactttaaagaataatcgggtcctgagaatgcgctattgagcagcaaagtgatagaacattttttttctgccagccttaatatatttatgtatctagaagttcaattcataatcatttaataaagtgaacacttatagtcttaaatattaaaaaagaaacaggctattaaaagttaaaaccctattggtatttagctatgttaaaaaaaaaaaaaatcccaggaatattgtaatgagtctaggtttaggagcaggcattgtgcaagttaatgtaagtaatgaacctttcatgtgaaatgatgtagtgtcacaactcatttgcatcccacttaaagtgtaattaagtttctctgacagcatggcttatggctgaaagaacagacctggctgctaaattaatccagagtccctcagttaataacactcagcaaagaaaactttatacactctttcatttaaagttcctaaactcccatttgcagaagcaaggcagcctacagagaaat

SEQ ID NO: 30968 - DNA, 1388 bp, Bovine  19866880863221
taaaagcctttttctgggtggtattatgaacggagctgtcatgtggagtctggaatgtaggtgtaaatttcagggagtgaggattatgttgtaaagagaaagggaagtataaattggagctgtaggttggtgaaagaaagggaatgcaaggcaatcgaaaaggacgcatggggcacctattacaactattaccaaggggcttccttcagtcacggccttccaagtaatggtttctgaagtaatattttcaaggatcagatgtaaactctgctcagcaggtgtgctgtgtttgagcaacctcccttttttgtcacctggcagagcctgtgattaacctggctcacacgagaaaaaaatgtcctaggtttaaattatatgtacctccatcactggggaccctgcggcagtggatgtaaatggagcatccgtgtgcccagaggatgaggaatttggcaccggatgaaacagacccaagggatacacacagcaaaggagtgcgtgctaaagagctgatacagactgctgactggctaagtgtgttcacggagctgggagcccacaggtctccagaagacagttaataatcatcgtgacaggctgtcaagcttccatttttcccttttctgttttgcatattgaccctgaactgggtggcatgttcattttctatgccttgccacatagcatcagggctgggccagccctgcctggtgtctgccacttactaatgagctaccacttttgacggctgtggcagaacctcatgcttgtgtttataaatgccatgcacagagactcgctggtaggcaaggctgccgagggtgccacactgatgctgtgcagagcatttcaggtgagcagagagaatctcattagcaaagtctcccctgttcttcccgtccaactgccagaaagccaatgaggccagcagctcggaacacaggcacgggagtggacattttctgcccagacttagagtgctggcctgacctccccactggccacccccaattcagtaatgaagacaattcttgaatttagaaaattcctcattggctccggttgaattccccaaaagcaaagccccaaataaatcacttgtgaaagtgatttattagaaagtgatttcagaaaaaaacaggtagagggattgaggaagtgggaccacaaggagaggagactgtggtagatagaatgatgcctcccctgaaagatgcccacctcctaataatagaacttaggaatatgttgccttctttggtaaaaagggaagtaaaattacagatgaaattaagattacaaaacatttggtcacaaaatagggagattatcctagattatacacagatgggctcaatctaatcacaggaggacttaaatgagaaaaa

SEQ ID NO: 30969 - DNA, 733 bp, Bovine  19866880863759
ctcatcactccaaagaaagacgaagaggacaatctagccaagcgggagcaggatgtcttgtttaggaggctgcagctgttcacgcacctgcggcaggacctggagagggtaatgaccgacactgacaccttgtagtggcctagagaagacgacggcagagacggccgctggcccggagcaagggacggtagccgttcatttactctcaggccctgtacacactgcagcatgaggtggtgttggttccgtattttatggctgggaagctcgatgtacacacacgcaagatgaccgcagaatggggagcttctctggtttaattttaaatagttaactgttcttctgggagatcacatgggtgcctctttcccctcctccattctagagctagagggaacagccccagggaaatggccaagggatgggcttagaattgtttacagactgaggagccagaacggatttcatggtgtggggatggggcaggcgggcagaggagggagatcttttgttcagcctgagggggcacccccgccttgctgcctctcggcccagccctgttcctcggcttccctcgcggggccttcgcccttgcagtcactggagcagagcaggtgtgggtgccagcgtgtgtgcatcaccgccacgcccgtgcatgcctggttgcccgtggttctcccgcagcgaggtgctacgtcgccactgaggctgtccgtgttgtgtgtctgtgtgg

SEQ ID NO: 30970 - DNA, 1067 bp, Bovine  19866880880471
aaatttatcgaccaaaataaatgaatatgtgtgaccaagaagcatatattttttattctagtattcaaacgttctccagtgtgaaacttttgaagtgagatacctattttgttaaacccactttgtatatacagaaaaacttaaatgcaaaaacaaaacaagacaaccacccatacactacggcttgaggtacccttatgctcaactgctgatataattatgatgtagttcccttcctaaaatagcttgatgtttaccaaattctcaactgtcttctttctattgaatttatgaaattcccatttgatgccagcactaacaaagaacaaaatttggactgatgagttttgttttaatcagatttccacaaaggaatattatattacctgtagtaacaaagagatgtaatttggccaaaaatgctatgactcctgaaaggcaaaactacattattctaaactggaagaaataaacttctaaaagttaataaagaccaaataacacttttaacaggcgtgttttattgagccatataaacttgtcttgtcagattttaaaaaagaaaggtctctataggaaaatcaccaatgattttcatgtgacaaataataggaaaccaagcattaaaggtagggtgaggctgtatcaaattagaaaattttatttttagattttctactgatatctataagggtaaagagttatagagagttaaacgcaattatgctaagccaatggaatcaatataaatacacagtctggataagcaggatgcaaactccttactgtatcattgcttcaattacagggcttaaaatttttgcccagctcttgtcagataagtacctctattctctatcttgcttatgtagacacagtcctaaaagaaagccaataattaatgtaggcttctacagccattttttatccctctaataagtacttttgaagttctattttttcagatccaatactactagtgagttataatttttttaagatttaactgtagaggggcaaaaaagtcataaaatcaaaacgatgtcattctctttgcaggggaatag

SEQ ID NO: 30971 - DNA, 1661 bp, Bovine  19866880896479
tatacttgctttacaaaaagtcatactaagttcacaaccaccccaaaaactcaccacctgatgtggccctgcccatcagagggacataatctagctccacccaccagaactaaagggtaggttttaaacattaatgcaatccttaccttgttattttcagagctctgttaaacaaacaagtgcctactgtgtacaaggcacggtgttgtttcatgaagaacaataagaattttttgatttagtgtaagagagataaaaccaccatataaataattatcatataaggtagaaagtgataagtgccatatgagagataaaaataaaatgctaagggagttcagagaaaagagaattcacacatttatgtgtgactgacctatttttactaacactatgataatcttagctatgtggctcatctcaaccttctgtaggggacagtctttataaagacatcctatttataatacagacttcgtccaaccaccgagtgcctgcaggctgacagtgtaatggcatcaaaactggagagtttcagtgggtttaagctctagatcagtggaggtatcagaaatggaggcttaacattaattcagcttgggggctgtaattgttaggtgtaagccagtgtgcagttttaatcactggcaatgggcaaagggaaatattgagaaaatcagaaagtataattaatgtattcatggttatctttttttttctggatacagttgctaatgctctacccatggaggaagcaagtttaaagtgtgaagagacgtctttcccttcattttaagagaccttctgtccaccctctctttgcagacaccaccaaaatagagctactgtataccatcataagccctgggtgtgtagctcatggtggtcagcctatgctttcccagacatgtgaagactcagctccattagttgctgagctcagatttaccaggtctgctaaatggatgtcccaatgtaccagctgaagagatcagaataagtttttctgctctgagtccagcttttggctcactgaactgtgatcatttcttttaaatcctgctgaagttacctggcttttaaactaaatttcaaaaaaaaaaaataaactaaatttcatatctttccatctttaagcagatcatgctatattatcagcagaaacaataattactttccaccccctggaaataatagtgatcagagccaatgtcttgtacttaaatctgagctctcatcaaacatttctaaaaggcaaacatagcaaatgcaacacagtggaaaaactccagatttagagttggaatccccattcagttgcttagtaattgtgttactagggtagatcagtgaatttctttgagtctttgtttaatcatctgcaaaacggattgttctaggattaagtatgaaatataaatataaggcttacaatgcttcataaggtagagtattatttattgaagatcaacagctctttggttgttgagaaatgcttttggtttcccctcaaattgtatatactggggcatttagtatagccattcaatctatacatcaaagtaaagacttcattcttccagacatgcagttggagacatgtctatagaggggagaggagtgcgatgttatccaccttttcaaggctataggcttgcaag

SEQ ID NO: 30972 - DNA, 1150 bp, Bovine  19866880953626
agatattaataacatgctaagcttattacctctgacttatcttggtagagataaccaggagacgtttgagctacaaaaatttaataagctcttatctttagagattatggaagccacaaaagtgtacataagatgaaataggtcaaatttcaacaatttagaggctttcacatcatccataaacttaataaacactgtttctacattgagagcacacatgtagtatgtaagtcctcaataaataaaaatagactgctaagttacaaattctgtatacaaaaacagttatctatgcctgctaatgagatcattccttaatggctaaagtttttttttaataaatactctgataatgcctctctaatgaaaagatactatgaacccttacacaaatgcttttgagtcaatctttacactacatacttttacaaagataatactgttgttcccaaaagacacacaaatgaagtcctttccttcaaagacttcacaaggcagatataaaatctgagcacgcatggcctgaaaagtaattattttcatgactcagctgaatatacattataaacaaatatatatgacaaaaaaatcacctacagaaaaaaatagcataaaatctcagttaaaaggaataaatgctcagtatatccacaagaaaagaacagtaaaaatatctgctggaatgaatgagagaagtattcctggagaaggcaagcttaaaccagatttagaaaattacaaattttctacaaaacagaataaagatcaaatgcaaaaaggaaggaacggaaagttcttcatgagcaacagcaaaatgactatcgtatctaactggagggttgggaaagaccaggtgaatgaacgctctttgaaactaggctgacaagttttgtctgctatgatgggtatcactagaaactcttgaaaagaaaaatgataaaagatttaattataagttcacatgattctcatttttttttgtatcattaacatcaaacaacaaattgaaactagtaaattttcagtataagtatacacttacacaaagctagtgtttaaatagcttctaatgtagttatttttggcacagatacacacatacagggcatctcaaaacctaaatttttggtagtatcaatatgcccatcat

SEQ ID NO: 30973 - DNA, 1605 bp, Bovine  19866880963536
cttttctcattgtatgtaaggcctcctcagagaatgattttgccttcttgcatttctttttcattgggatggttttggtcatcacctctgaacctctgtccttagttatttaggcactctgcctaccagatctaatccttgaatctaatatttcaggttcctgtgtgatattgttcttacagcatcaggctttactttcaccaccagacgtatccaaaactgagcatcattttgctttggcccagcctcttcattctttctgaagatattagtaactgacctctgttcttctgcagtagcatattggacaccatgcgaactgggggggctcatcttccagtgtcatgtccttctgcctttccatactgttcatgggattcttggggcaagaatactggactggtttgccattccctcctctagtggcttatgttctgtcagagctcttcactatcatccatttggggagccctgcatggaatggcttattgagttattcaagccacttcaccatgacaaggccgagaaccatgaaggggtgagtcagcagagttaccccttaattacttgaatactttctcttggttagctctatgctgttaaaacatgtattagtatatggatgcctgttcctcacctcagagatactgatttattggtctggtgtgggtccagatagtggccttttcaggggaagttttccatataatattggcacatgcccaggtgtgagaactagcaggttagatgtccccaaatcagactcctttcattctatgcaataacgtcttaagaaatatcatcgaactaaatattaatgtcatgaacaactttctaatctttggaaggtggttcaattcatacattaaataatttatcatttcatgtttatatttttgaagagtcagtagtagataaaagtgtagactttaagtcacacctgtatgtatccaaaactcagttctacacaattagtagctgtgtgattgggatcagttgcttgttctttatatggtttcttttctcacctgaaaaggaagtttccttccttgcaatagagtttgggtgatgattaaatgaacaatttaagtaaaatgcttagtgaactgcctgacataatacaagagctattaacatttttacagtatgtcttcaagattgatgggacagatatcattagcatgctttagtaattaaataattataggtaagttaaatatcttactctgggtaatttgactgatcaatttatttgagtctctccagtgtggaaatcctgactgctctggaccctatgagaacataaaatatgtatgcaatatccagcactgttagcaagtcaggcacaaaggggaaccataagaagtattttagtagcagagactgcatattaaccaccagatctatttttcccatgttccgtttttgagtatatggaataccttctaagtctccactgtgattattgtagtcaggtacttattgcttgcaactggaatgtgagtagaaatgacatgggtcacttctgggtctggacctaggaggagtgttgggtataccttcccatgtcctacccgatggaacctacatgtagcagagtctcag

SEQ ID NO: 30974 - DNA, 1970 bp, Bovine  19866880987238
aatgagagggagaagaaaaagaatggaagcaagaagatctagttgggatgccatttctatgatttgagtaagcagtttcagtaatttaagaactgcatagctgtaaagttcaatataaatgttaatttaaaactattatctcaatacgattgaattcaataacctttaaggcagtagatattgaggcaggattttttgttacttagcttcaagtaattcaggtaaaactgatgtataatttgaacataatgaccaaattcactaatgagctgattgcaggctttatgttctaaccttaaaatatgaagtacagtcgcaactgaaggaaaaagaccaaaacaatgttggacctgctgggaggcactgcagattgtagttcacagaaataaagagttttgtttctttttactcaaatatgtaaaaagccgtactcattagtcaaaattgggatctaattgaaatctacacatgacagtttaacattgctattgagatgaagttcatggtcaaaaaagagatttcttacaatggaaagggatatgggttacaatatttcttttcaaatcagttgcagcatgtatttaagtaaatcaattttgtatcagaatccccaaagaaattgggatgtgtttaaatctatgggacatggtgtggtgcaggatagcttgtccttttctacctgccaccattttatgagcatgcttatgatgccagaaaaaccatgtggtcctgcaactcaagccaaagaaaagacacagactctgtaaacataataaggcagaggaaatacatgaagaggaagtcagtcttgacaaagtaatttgcagtctgcaattcctaggacttcagctggatgtgagaacctttttttctgtctgagaatgttgtgttgatagcagccatccctgtctgccttcttcttcccttaccccaaggtctagatgttaattggcatctagaccttacatataaacatgaagaaagggaagccattgtatgcacagactgggaaactcatgtgccagctttgcaagcttatttgttattacagcattgtttgctgatttttaaatgaatgttactaagttttgctggtagtagatccatttgagtgtgataggtagtcatcttaaagtttttaatcctcaataaaataattggaaaaccttccatagcaactgactcttaaacctgtctgttggtcagaatggatgacggcaaagagcctcaaaacagaaaccaattgttttctccttataacattattctaagaaggaaaatcactcattctagaagttacttattattggaggaagtaaagaaatctgtcaccaaggtatgccactcatgtttcagatgactttgttggtgaagataatatatcaatgcaaatgtattacagtgtatcacaggcaataattgactgaagttgtgtcttcttgatgggttttcttgaatgaattaagctcacatgtcatattttgtcttgatattctctatcattttggattataagaaccatgtgacagtgaaatctactctttatatcctccatgggtatccaagtcatcattccatcatcactctcaaaaccaaggggtggcatttctgagacagtatgaactaaaaccatagcccatttatgagacacagtagtagctaataattgttgttcagtcattaagccatgtccaactcttttgccaccccatggactgtagccctccaggctcctcaaacatggggttcttcaagcaagaatactggagtgggttgccattttctccttcaggacccacatttcctgcattggcaggcagattctttacagatgggccaccaggaaagcctagtagctaatacagtgacccattaataaaaccaaaattagttaatactcattgactgactaacaatccaggcattgctgtaggattggggaacttggcagtgtgaatagaataaagtcc

SEQ ID NO: 30975 - DNA, 1551 bp, Bovine  19866881060948
taagtctgtgctagtagtagaatgatttagcattaggttcccgatgctccaacgggccaatcttgagaaaaaatactttcattctcttttgaaatttttatctcataatgccatcaatttaaatatgtgtatcaatttattttggtatatatttatatttgaggcacaattttgagagcctgagaagtttggggagaagtccctttctactcagtaaaaataaaaactaattttttatacctcttttatgtttataagcactttgtgtatatattatcttatttcatcctcctaacaagtccatgaaattattgtataaaaaacgactaacattatagcctatagaaggggaaataccctgaaaggatagtataatgaatgaaaattattttctgggttgaatattgcttttttggcattagttttggggcaaatttagggtttagggggaatttttgtatcttgtggaaatatgttacaaactctgaacattagcacatgcattcattgggcacattggggtgtgccaatgtatctttcatagacatatttcttatagtttagatggataaagctgttggtaaacaggttctgttatgcagctgatccactaaaattttcttttctcatgcctactaaaatcaggattaagatatcaattttctttctataataattaggacagctggtatattagaattatgggtatttgcctcttcttgtgtcttgtgcttaatgggatggaggctacttatcagactaggacaaggactggtcccttcatttattcaacatgggtccatttacagaaggcagtgaacttggcagctctgctggaagagctgttttctgggcagatgacagccaagggcctgattacattttagactaatttacagtgaagggaactgccttttccattcctttggtctaatctaaagacaatggacagaaaaaatgtatagaccttaattaagaattgctcattttcctggtctgggtggtgtagaccattttatttataaagtaaatttgatgatgtctatggcaaaccaagcttgtatttttcaaataccaagcttgtatttaccaagcttgtagttttcaaatttatgagccatcagtcttttcttcttcaaaaagttcaaagtcttctggtaaatttaattggtctcccttttgagtattctgtgcacagtgggatcactgcctcccatttgtctgttacctattatatactgtatgtgctgaaatgacatcttctacctagttttccctggtttgtttttcgagtcaaggcctcttttctatcaaggaatctttaattggctgactcattctgttgatattttccttatgattgttaattttttatccttaatattttcaagaaaactgagtccattgttagacatttttttcagtattaaaaaactattagtattgtactactctccggagaaggcaatggcaccccactccagtactcttgcctggaaagtcccagggacagaggagcctggtgggctgcagtccatggggttgcgaaga

SEQ ID NO: 30976 - DNA, 826 bp, Bovine  19866881077541
cgtatcctgtccttagtggattactgcagtgcctgtgtttaaataaccgttatttaacttaataatgccccaaagcacaagaatagtgatgttggcaattcagatatgccaaagagaagccttaaagtgcttcctttaatgaaatggggaaaattctctgtttaataaagaaaaaaagcttctactgaggttgctaagaccaatggtaaaaacaaatctgcctgaaattgtgaagaaggaaaaagaaattcatgctgattttgctgttgcaccaaatgcaaaagttacagccacgatttgtgataagtgtttagttaagatgaaaaaggcattaaatttgtacaataagagaaagaccacattcacaaaacttctattattgttaaaattgtttttattaatttttgccattaatttctcattgtgcccaatttaagctttgatttatgtgttgtatagagaaaaacatggtatacgtcggtttcagtaggatccacggttttaggcatccactgggagtcttgggacatgtctcctgcagataaggggggactgctgtatatgtacctctgccaggtaatagttttattttagctgagataacagatttttctcagatgtcttatgtcccaatttgaataatattgtgtcttttattataaagatgctatggaaatctggaattcatcgatcactagttttgattcatagtgactcttggaaactatcctttgtgagaaatggccctgagcagatgtgcttagtcataagaattgccagacagtttcttatgcgttggcagcctagtttttctgagagtagaaaa

SEQ ID NO: 30977 - DNA, 2876 bp, Bovine  19866881112357
cagggaggtctaggactgggtgatcttatcaaaacaaggaaaaaactcttacgacatggggcctagaatcgagacttaaatctcagaaaatcctaaaatcccagcagtagctataaagttttaacacactcaagccttttaagtcaaagaaatcccagagcacacctgaacttagctttgagaggaaagaaactgcacctcacaggggtgtaatataaattcacatacatgagattttgcccttctattaaatcaaaccaagaaacatgtattacaacagtcccgagagatgtcaggaagtatgaattggtaagggacttaatctatatctatacacatgagtttttttaattagaactttgtctttcacactagcaatttattttaaaaaataacttaatctccgttaggtatagaaatatgtgtggcaagtcaaacattcaagctgagagctctctaattaacttccctttttggtttgtctaccaatctatggaagaatcagcctatttgaatgacagtcatagatgaggaggaagaaaaacacaccacccagaaatatggaccagtatatttcctgatttctcagaagcaacagttcaaggcatttttggaggaaactcatctgaaactgtgttgcaattaattttatttcctctttagttacagatcagctgtacagatgagggaaagtctatatgtgaccgtgtgccaggagctgaaacatagttatggaaagggcaaaagctctctctgttctcaaagagctaatattaggacattctggtttcatattttaaacatttgacacaatgattttaagtacccatggcatcattttttattttccaatgtgctaatatattcccatattgtgatgaaggatgtactcttaatcattggagatattaagactggagaatcacttttgatgtattaattcatgcattgtttcactcaacagatatatattgagtagttactatgtgctggtcaatgtgctagatgctaacaataaaatgattaacaaaacagtccttgccctcagcaactacaaggggtgacaattaataatgcatatacagtgcatgcatgcatgctcagtcacttcagtcatgtccgactctttgcaaccctttggactatagtccagcagtctcctcagtccacaggattctccaggcaagaatactggagtgggttgccatgccctcctccaggggatcgtcccgacccaaggattgaacccgtgtcccctgcatctcctgcattgcaggcagattctttactgcacagggaaaccctgaatatacagcaaaaggtatttattaagctcctaatatgtgccagaagtgaagaagtgaagtgaagtctctcagtagcatccgactctttgcgaccccacggactgtagcccaccaggctcctccgtccatggaattttccaagcaagagtactggagtggattgccatttcttctccaggggatcttcccgacccagggatcgcacctaggtctcctaaattgcaggcagacgctttaccgtctaagccaaatgtgccaggcattatgctaaatcaggagatacagcagtgagtgaacataagttagaatactgttcaaacagagttcacatctgagtggagagacagaaaaataaacaaggaataaagttgatgagataaagagcaattcaggaggttaagtagggaatggaaggcactgaaaatgtttaaacaaggattaaagtgatccaatgtatattttaggaaggttgactgatacacacagaaaaaaaagaaggcagctaggacgtggcaaacctgctattcttctattgcctgagcctggacaaaaaatgtcagtggagaggagcagccaatagtatagtgattccctgtgaacagaagagaaactgggacgagcacaagatcctatagattacaacagtaccaacgataacaacacagtaacagtaacaccagttttatggtgtttgctgtgtacctgtcaatttgattggtacatgttagaaattcttagagaagatattagtatatctatttttacatacaatgaaactgaggcctaaaagttaatcaactgcaagatcacatagctagtaggtggtggaggaagaatttgaactcaagttcctgactctaactcagaatgtttaactcttaaaggaacaattacactagcaagaatgtttattgttcagtggtctgaatcaagtcttacattatgtgcaattatatagctaattattataaaactttaataattaatgtagtatatgctatataattatcatttaccaacataagttacataagtacagtatttagttagccaaagtgttcactccaattttcctttgcttgtctcttctcctcttcaatgttaagagttccccaaggctctgtcctaagcccacttatcttcttttccttctctgtctccctagctgacctttatcattttcagatattcaaagattattttttgccagagaccggcaatcaataaaacagactagaagtcatatatccaaatatgtcttctgggtatcttactcggtgtctcacaaagcatatgaaaaatagcatgtccagaagctaacccaatacaaaatccgcttgaattcctgtcaccacatctcagtaaatgatccttccatcacccagttttttatgctataagcctggaaactgttattgattccttcctcttccttatttgcagtacacagtccatcaccaagtttggtccagtctccttataaatatatttatgatccatccatttgtcatttttctgcatcccctcttccatcaccattatcaattagttgtatcattgcaataacct

SEQ ID NO: 30978 - DNA, 1261 bp, Bovine  19866881122587
tattcttttctacaaaataggcatttattacaaagtataactaatccctgggcttgagttaatccaaattactaaaaataaattgcaagccacttttcaaatgcagaaggatgaagaaggtaaggtttgtgtttcagattcagcagcttcttcctttccttttccaattaaattcttgttgtttagttgctaagtcgtgtccaactcttttgcaaccccattgactgtagcccgaacaagtgatcaaaaggagatctgccaggaaaaaggcctaggagtgtgtggacatgtgcactgcctgagttctaagtgatcaggatgtgagcagaacacacgtaccctgggccctctaatcttcacagtctgcccaagtgttgacaggaaaatcctctgccaggaagaatccgtctcctctcaagacaagacggtcccggaattggtactagcaagatgctgttgcggtgagggatgggagaagcaccgtattgacatttctcttggctgtatgaaagcagtaaatctggctgtgaagacaagtaaacttgaattgtggggaaaatgttctccagctaaaagtcccaggggctcagcaaacgttttcatattaataatagttcacagatggagtctttcaacttagaaattttaagatgtcatcgagtacataatctaataaagaatgctaggacattaaaagtaatataaataaaggaaatgtaatccatgtaagggtcatttggataattatttcatctcttgcatccagaattttgaaatgaaatatagtctttcctcacttcttctgcaataagtcatttataaaaagtaagtggcttacaaataaatgactatatctatgactactctcccaaaatcaataatacatttattgataattctgcatttaaaggttcatttcaccttagtattgacattctgtctcctctgccatttcattagatttaaaatttttcattcttggtaatgaactgtaagaaagttgctatgttagaaagtagccccatttcaagttgggcaatgcaactcaatatatcattttctattaattaccgtaatcggtaaagtttcttgtttgtgtgctcagcaaaattagagttaggagtctggctttaccttgaaaggcaagaactcttggctctccttaaatacatcactgaggtgctctgtaaaatggtggttgttgtggcttaggtgctaagtcatgtcctactcttctgaccccaaggactagagtctgcaa

SEQ ID NO: 30979 - DNA, 1104 bp, Bovine  19866881124365
tattaccaactttaactataatgactcaattaatccaggcatggtttcccaaagcaaactgaaaatgcaattatcagaccaataagatgctaaagtcagtaacttataacctcaggcagactattttataaagtgatataatcaatattgtattcaagatagtatgtggtggtgataatttgctacagaaaatacagaaattccattaccttttaaaatatctcaaaatcgactgatgtgttatcagttgcactttgagtaactactttgcagcatatgtacaataaaaaagcttacattcatataccttcaatgttgggtacgaaaaatcatggctaataaatgcttggactttagtaatagtctatagagatataagttgccttatcaacatagaaacaattttacatatcccttctgttagggaaatatctttacataattcttgttcataaatccactcacaagcatcacagttattctctgattaagcttcccttcaaaataatctgttgactctaaaaccaagtcattgctacatctgtccatcatagctctttttaaattgaaggaaacagaataccaacatacctttgatagagaaaatcatgctgtcttctaggcatccatttcagttatttattttggactatgactagtattctccatgaactcttacaatcctctaactcagaattactgatgcttaaaagaagtgaaatgcataaagctataaatctgactcaataagacttgagactatgatcaggaactactttaagccaaaggaaaaatctatgatcagcgaacagtgcactaagctttcttttctttttgtttttcaatatgaaagcactcttaaatccaaccacagaataagaataactactaattggttttctgctcaaagagacctatcattggttggcaactaaagtagcaagaatagtattttctcccactcacagctttagaactgagaagaaaatctgatgtactgaatatagataaggaaatcttttagattgaataaacttgctaaaggaatattcttattttcctttaaattgattggtataatgatgatcattgtcctcaaagaaa

SEQ ID NO: 30980 - DNA, 1128 bp, Bovine  19866881154591
agaaccgaggactttttacaggagaaacaattatcacaaaatgtccagaattgaaaacagaagaaaataagttttcctaactgtcatggcttgctttgatatggaattaggataaataaaaaagcactagaacaaagaaaaacagtgaactcgggtaattatgtcttttttgaggctttcaatataggggcacaacttttttctctagagttaatgtttctattctcttcctattaagcttaaaatagttctcctgaattgacaatatatttttacagactatggaatctcaagatttttcagattttgagcttctccttattccttttacttctaaaaattttgcttcctattatgtgtttctttagtctgacttacaaaataaattatatttatgctaaaacttgagtagcaagaattggcatttgaataataatttcacctaaagacatttcagacattatttttgtcagcatctgaaatcttttaagtcattttttttttcttctctttctgcttctatgtcctccttgaggttgttgtaatttgtctgagaatgtttccatccccaatctgaacctgcttctttttaagcttatctctcattatcctatgaagacatttgagtgggacaaggtgtcatgacatggttactaaggcctaactaactttctacaattggtggttattttttttaaattcttaattatattgcaaatggttatatcttactccattatatcttttaaagtaaatactggaaaagagcagttgctcttttctcttaatcccttagtcttatggttctcgccacatcattgagtctgctacttctatttttacactttacatttagcactcaacctggtgttgcctgttttccttgctgatgctcagcaccatgaaacagacaaagagcagcaagacggcagtaatagcatacgtgcgcatgtacacacacagacacactcacacacaccaggaactcttgaaaggaggcaatgttaacaataaagctgaaaaagtcacgcagatggaaaacaaaatttgcagcatctggtccatctgctggacagccagtaatatccagattttctgaatacttctattgatggatacttgacctat

SEQ ID NO: 30981 - DNA, 787 bp, Bovine  19866881204997
atgtcatttcaatttgaccatgttttcataatcatttaaatctcactgacattggcgtatgatctgtttcataaaattttaacaattttcttccatgaaaaacattacaatgaataacttttcatgcctgggttttttcagtgagtacttttctatcacttttgaacattaatcaaaagataatataaagatgactttgtttcacttagagtcaaggaatagttttaaagtcatttgatactgcattcaaagagccatatctcctagtaaattattctccactcctttaaaggttcctttgtcataagtcaagtaggagcatcaaaactgactatgatcagttcaactacaaaacagtgttttaattggtctttccacttcttttctcaaacttcatatcacaaactctccttctcaattgctgccaaaattgtaattatgccaagcttctgcttataatacattagtatttttgtacttcctatgcagtaggtacaaactccttagggtggcactacagagtgtcattatgagatctaatgtattcataccctctcatatacttcatcctggtcaccctaggtaaatatttttatcagctattgtgttggacttctgtagttttcatcacttctttatatctgagccatggctctgcctcaaatacctgtcccactcttctttgccaatcaaaaacttccctatcttttacaattcagtaaaggctccatcacctccacaaaatctttctatttccctagacataactggctactggttcctttgg

SEQ ID NO: 30982 - DNA, 1733 bp, Bovine  19866881228924
agattagtggatgcctggaaataagaagacaggaaggggagatgattggtgacaggaatgtgggtgtgactataaaagggaaccatcagagagccttgtggtgacacaaatgctctgtatcttgactgtttcaatgtcaatatcccaattataatattatactatagttttgcaagatgttacctttgggaggaaatacataaaggtaaaaaggagctcttagcgttcttccttacaagtggatgggaattcataattatctaaaaattttattataagtttgacttttataaaaacaaaactcatagcattaatgtcctatacaatatcactttcagttcagttcagtcgctcagtcgtgtccgactctttgcgaccccatgaatcacagcacaccaggcctccctgtccatcaccaactctcggagttcactcaaactcatgtccactgagtcggtgatgccatccagccatctcatcctctgtcgtccccttctcttcctgcccccaatccctcccagcatcagagtctttttcaatgagtcaactgttcacatgaggtggccaaagtactggagtttcagctttagcctcagttcttccaatgaacacccaggactgatttcctttagaatggactggttggatctccttgcagtctaagggactctcaagagtcttctccaacaccacagttcaaaagcatcaattctttaaacaatatcactttaaaatgcactcaattttcatgagtgtaaaaatatcagtgtttgcaaattttatagatttagtctctttttcagcatatcctttattaatgaatattcaaatctggcaccactatttctgtttatttgaactcactcattcaattactatatattacttcacattctcatcccttccaataacatagactcattttatcatgcaggatttttattcctcattttcatttttaaaaatgaaattatattaaaatatgcttcttgaatatattttcttaaatgtcttatccagtataaactacaaaataataacaatgacaatcaatgggttagttactaacattattttgtccatgaattgtagaataaggaatgtagaacatattaaatgtacctgaagcattagttcaatatagaaagaaaatttaaaaactttgaacaaatgacctttttgaatgtttaatgggatactcatgaacacttcaagtgacttttgatagcctgtcaaacagctaaagtaattaatttccttatgagacaatcatattggtcataaaaatctgaaatatgtatttaagacatcatagacatatactaattcaagcctattatgtaagaacaacaaaaataatggttatactagtatcagttatatttcaccatgaaacatataattttgtctaaaaagaagtttgcctatgattttcaaaggaagagccacatgaactttggcaaacattattttgcaaatgccactcttaagaacagtaccacctagcagtaacctgacatttataactattctaaataatgcaacaaaagcattttcaaggttcatgtgtatcttttcatatgcagacttttgcagttctcttcaataatttagcttgtttggacacatcttactgaatcatgttttttgaactgaaaatatacattatcttgtgagtcaagcatttgcaaaaagttatactcttgattctcttctttacctgaccctttttt

SEQ ID NO: 30983 - DNA, 1485 bp, Bovine  19866881236154
ttttgaatctgaatacatgtgtgtttcttaataaatactaagaatggggctggtccaagaagaaaagatggacagttttcaagagtttcacattaaatatttagagagtcttcttactcagggacacctgctaagccatgataagaataatgcactctgggctgttcagaattgtttgaccctctgaaacattaaagccattttattctcaaagggttctcttataaaagggtaaaagtaacgtcattgttcttgtagagtaaccaaaaaggaactcttacatcagctttctaaaaaacagtctagctaatctcaaagtacaaaatgcaaggcctttacagccatgatcttactagagtataaggttaaccacacataataataggtcactgggagagctaatagtacctaaaggctcttctgtccagagattgatctacccagcctactatagtactaactcacagaatcccaaagttggaaggtacctcgaagagcatcctacccaaaaaattcattttataaatgaagagaaacaaaatgactcatcttaaatcactttaacaaaagtgaattgacagcttagggactaaaactcagaccttttaattgccagaaaattcgctcttcacattattttggctgtttccctttccttctggtggtgacagacttacctttaagatccctactggataagaaaacaaactcaacaatgcagcatctccctaaaatcactttaggagcacatcagcataagcatatttgtcattagcgatcactagtgtgcatttaggaggaagagactcgtgccttagccctgctcaggtagccttcccacctctgcaaatcacttcctcacttctgacagaaaccctgtccaacactctcccacctctggatttctataacaacattcatacacaatcttcatcttcctactcgacaccatagaacttcatttttggttgtttgacttttgcatgtttctatatgttctctgccaattagtttgtgcatttcttgatggctggcttgtgtaccttatctcattagtgtcctccatagaatcccatgtatatttttaaaacaaatggatatgtttaatacgctgtctctttccaaacagaatttagagccataataaatatgtggtgagtttaaccaaatgtgaattcaggagaatgcatttctgagagggaaagagatgatcaagagcagcagagaagtgctacatgacaaggtggaccatgaaggcccccagccttgacctactgcacagccaagataggcctgctgtcatatccacaaacagacaagtttcccctgaagtcccttcatgttttatttcacattaagtgacaccataaaatctccaatcgtgacatttcagaaaccagttgttccaagatattaaaagcagacccatcacaactcatcggacggtttggatacacaaggtataaggtttcaagggcagctctc

SEQ ID NO: 30984 - DNA, 1055 bp, Bovine  19866881248371
tctacctgtttggcagttttctttgctctagatgtcaaaaagtaaatttatgcctacctgttatctaaattgtaagaaaagttaatatttagaaatgaaatatttatttatacaccattactatttttaaagacatttcagtactcctcagcaagggttatcttgcagtctttgtccttttgtagactaagcagagtcccaaacaattgatttaaatgagattttggatacaattttcttttactttgatttcttactaatttacttagatttcttgctaatgtagctgtttacagttatagtttttcagaagttactatatatctttgttacccttcaaataacatgtcaaaaactttttgagaaatatgattaattatcataaactataatgtgaagtaagaaaatttccccatatgcatcagaaagctaaggcaaataggttataacttatatggaaggttagtcaagaacttggatctgctagaattcttaagctacatcgttagcttaaatttgtcagatagtatcagtttattttcataaatgatgacttagcacaaaatacattgaatagattatcttttgttagaaaattattcaataaccattgtgtataaaattaattctaaaagtcagttttagcatacattaggacagttaataatcaacaatcttggttttgcttcaggcaagcaactcctatgacagttaacctctaggaaagcaatttgaatatgtttgaatttgtaagaccttttattgctcttaagatattcgtatggttgcataataacaataaaaataagcagagaacttttaaatggaaaagaatacttgtttgtcttagactcatttcttgaaggaaatccttccggaaaactcttaatagaccatctgtgccaaatgtttagatacagtcttttacaaagatagtaaatttgcttcatgtagctatttgaaatcctttgattcttactgacagggataatcccaattatgttctcctattagaatttttcttgtggggatatgttgtgcttcttttttaaaat

SEQ ID NO: 30985 - DNA, 1175 bp, Bovine  19866881250884
tcagtgctatcacaaagcaagcacggctgtagagtatagaatcccagcacacacaagaaattttgacaagcactagaaaacattcttggtaaaaaagaaaatatttgtctaagttctcacacagaagagcaacatttccatatcttatttacttcttctcaagaggatagatgatttttacactgagtgagaaaagggaatactaaacccagtcatcatgacactcatctgcttctcaccaatcaatacttgtttgaaatttccccacaatcacactgcatgtgaattaggcaatgccaaaattgctgcaccctggcagaattgtcactctctgatgactgtgatccaagctccaatgtttgcatgtatcccttcacctagtggccagccgttgctcacaggacacagtggagctggcaactgtctgcacactgtatcggcacaaacggtcgacaacactggctacacacctatctgtcttatgcaaggcaaaatgcttcaattacgatgacattataaaaggaaccactgataactgggagagttatcaagggtatccatccacaccaaaataaacatcatattgttaattgtggttgacatgtaatttgcaaaaacactttaagctatttgtattactaacagccatctgaggtcttactttatctccttaaatctgcagcagttttctgaatgaattcttatgaacacatttaagaaaacaattagaagtgcaaataaagaattccctaaaggcccacttatcttgcttgtatgatcagagccctggtaaacaagccctttgaatagctcaggcactttcccccgtctcttccttaccatgatgataagccagtctagtaaagaagaagtgtaactgacatgtgaattatctcctttgagagacattatgtaacattaaaaattaatctctttaccttttggtgttccccaaactttttctctccatttaggctgcaagagttctcttctaagctagaagtaacaaaattttcaagaagacactatgatccttttcctctacaagtaaactatgtttaaggattcatcaccattcaggtcctccttacattattataaagtacttgaagtatatgtctacatggtatttatgtatattcaaaaaagtattgttaggttctcaaaacgcaaga

SEQ ID NO: 30986 - DNA, 1883 bp, Bovine  19866881263639
tgatgctaagctgaaactccgtactttggcccctcatgtgaagagttacctcattggaaaagactctgatgctgggagggattggggacaggaggaaaaggggatgacggaggatgagatggctggatggcatcactgactcgatggacgtgagtttcagtgaactctgggagttggtgatggacagggaggcctggcgtgctgtaattcatggggtcgcaaagaatcagacacaaatgagtgactgaattgaaactgaagtgaacaaattagaataaaataacgcctagcacaaaggacttagtttctaataccactctccaataaaccactagggcttcctgttgctccagagctggcgcaataaatatataagatgaccatggaatttcttgtactgccaaaatttcaggaagtgctcaacaacaacaacaaaaaacatcatgttagagatgtcaagtggacgtggaaggcaactgaaagaggttgcaatttccaaatataaaacaattagagcaacaaacaaagtaggattggattataacttaatgtgtaataaaatattcatgagcttatactgatactaataaataattgagggactttcctgcggtccaggggttaagacttggccttccaatgcagggggtgcaggttttgatccctggttggggagctaagatctcatatacctcaaacaaaaacaaaacataaaacagatgcaatattgtaacaaattcaataggcactttttaaaaaattgactaaatataaggaagaatatagacaaatatctcatctggaaaaatcccaaattatttatgtagataatccaccttctaagaggtgaaaaacaagtcactccttgagtgtacaccgcagagactttctttccatcctcattgtaagtcggtgttcaaggtcacaaaagtcaacagtgacgagttatgcagatagcatgcaccctttttgtgatgtgatgaaaatcacacataagctctgcggtctttctcccaaaaatgcctatccctagtttaatcatgagaaaacatcagaaaaatggtgttttttgtttttttgatgagagacattctgcaaaataattggaccataatgtcaaagctatttaaaaaaaaaaaaaagggaaagaaaagaaagtctgaaaaactgtcacagccaagaggagcctcaagagacatgatgattaaatgtaatgtgggattctgaaactaaaaatgaatattagataaaactgaaggaaatctgaataaagtataaactttaattaatactaacatatcaatattggcacattaattgtgaggagtgtgccatattaatctaagatcataataataagggaaaatgatgcaaagtgtacgggaattctttgtacaatcttcacaacttttctataaatgtaaaactattctaaaatcaaaagtttatttaaaagaaaaggcattattcatgaattttagtcataaaatatcattttttgttaaaacttcacaaacaatattaccatatgtcagtattgcaactaatggtgaactctatgtactttggaagatatttgtcatgccacaccacacatatactggcttaaaggtttcctgaaagaatccttccagagcatcataacctgtcttttgaagctttcagaacataaatcttatgttattaactgcttggctcagatcataaattattttaagcaaaaagaagagacaaaactgcacttgaaacttacaagcaattgctgcaactctgcagttactcctaaatacttttgctacctctagaaggctaataaggtaatgcgtggaataccacagttcttccttctctttattctatttagactgaaggcaatgactttg

SEQ ID NO: 30987 - DNA, 1367 bp, Bovine  19866881313995
ctagaaatgtaaaaagcaatttttaaaattaaaagtacagtgaacagatttaatagaagattagaaatagtgtaagagaaaattagtgaattggaagacatagttgaagatatacagaatgagataccaagagaaaaagagaggttaagagcatagaatatagagtgagaaagtatagcttatttctactcaaagttctagaaagagagaacacgccaaaagggggaaatgaaatatttcaagaaataatggatgtaaatttcccagaattggtaagagataccaaccttaaatcatgaaagcctagtgaatctatcctagaagggtatataaaaatctgtatctaaattcatgatcctaaaattacagaatccaaggaatattttaatttgatataaaatgttctgataaattagccgtaaatgataaaacattgaaaccttttatttatagagatttccctgtattaacatagtgattgatgataactaattttctagtcaaaattgagtcaaactttggctctactcatttgtttatttaccattttattttatattgtatctaatttttaagcacatgaccatctggtaatatacccaggatcttggacacctagggtaaaaagaggtcaccctttacagggtcatttattaaagggtaaataaataaatgtcatttattctagtacttactttaaaaaaataagaaaatagaagtactgcttttctgtattatagagctacttaacagtttcagactcgtctcaaataagaaatcattctcaatgactaatttctcctcccactccccttctctagtctgttgaagggaaagaccatagtttaaataataatactgaaaatactcacataacaggtaaaatgctctttgctgaaacagtgttggtaaaactgaagtaaaattggagtcttttaaaatagaaatttcaagggcacagtgggaagaaatattgctttttggcttaaagtcacaaattacattttaatcaaccactaaataatattatatataggaattgctgttaagattcacaagaactcctttccccaagattgccgagagcagaaaaaagatacattctctctcaagggggagaatacttttaagagatgcacctttgttccatgtggaacattctatttctaaattaaacctacattttaaattaaacaatagtatgtccaaagcagtagcataccataataactcctgtcttctcattgtatctggcctgaatattaatggaaataccaacaattttattttcttagcctcccatccccataagcgctatgtaagcttaataatgtttccaaatttggcttctttttatagctgcagtt

SEQ ID NO: 30988 - DNA, 1078 bp, Bovine  19866881388919
ctcataaaactgtcaaagtaatctgaatccatagatgttgacagggaaataaagatgaaaatcattgttccaaaaattggggattatagatctcttacataaatatacatgttcaatttaatagtgataatcctccaatatagatgagcagcattatctgccttgataatattttttaatatcaagggcaggattttaccttccacatcaaaaacactttgaaaaattattacttggggaccctatgcacactgtaaaagtaatgatataacaggattttttcttattgatatgaaagtggaattagaatctatgcatttacaggttaaaaataatctcttaaagcttattttcaatcaaaattcatagcaaaatccgaccactttatttttcttaagggaattcatcactatggttatttctccactaagcctgtcctgttaaaactttataaaatgtaagaacaatttattaactaaagaatgtttactaaagttgttttaggaaatcttgatgtttaaagtgcagctttcataggcaaggattgttggctatttcattttataacataacaagaaaaaatataaagaaaagtaatgagcaaatattatcaagtattttgctgttcagtcacttagtagtgtctgactctttgcaacaccatggactgcagtacaccaagcttccttgtccttcaccatctcctggagctcgcaaaaactcatgcccattgagtcggtgatgccatctaaccatctatcctctgttgtccgtttcccctcctgccttcaacctttctcagcatcagggtcttttctaatgagtcagctctttgcaacaggtggccaaagtattagagttttaacttcagcatcaatccttctactgaatattcagggttgatttcttttaggatggactggttggatctccttgcagtccaagggactctcaaatgtcttttccagcaccatagttgaaaagcatcaattcttcagtgctctgttttccttacagtccaactctcacatccatacatgactactggaaaaaaaatcattgctttgactacacagac

SEQ ID NO: 30989 - DNA, 845 bp, Bovine  19866881598062
attatagtaagcctctcctctcctttcctctctttccccctctctccctcgctgccttccctctctctttcccttttcttctctccctgtagtctcaagtctgtgcatcacatagtctttccaagatagctggacttgcaccataggttgggctcataacgtgaggattctgaaagacaggaaatggaaactaccattctcttaaggttctggtttagaatttgtcacagcatcactcctgccatattttactgataagggactcacagaacataccaagatgcaagtggaggggacctataaccctcctctcaatggaaagagtatcaaagaatgtatgaccatctttatcatgctgcataagtccatataaaaatgtaatatcccaggccatttactttataattattggttcaataattataatattataataaattacattattccatcctacaataaatggttgaaagaggcctatctatatgtaaaaacaagttagttcattgttatgtgcttactaattcacctaactcacacaatgcatgcatgaacttctaaaaactgctctcttgtttttttaaaaaagaaaatacctaaagcacttgtgtgagatgaaaagttgacacctctacaactctttgtttggatttgaagctgcataggtaaaaataaggaacattttcttttgtcagatgaaagctgctgaatataaattatgttgattaataatagacatgccatttctaaccttccagtctttgcagtcggaaaaacaaattctgctagtcataaacatcctctcaactgtacatatgctccaccttaaccttgtatcccctcca

SEQ ID NO: 30990 - DNA, 1308 bp, Bovine  19866881609914
atttaaaaaaaaaacaacattcacagtgtaggggtcccagaaggagaagagagaaacgacctgagaaaatatttgaagaattgatagctgaaaacttccctaacataggaaaggaaatggccatcaacaaagttcaggaagcacagagtcccaggcatgataaacccaaggaggaacacagtgagacacatagcaatcaaaagttcacaaatggataaatagacaataatagccattgtttgccatatcaatgacttgagaaaattgtaaggttatagtatatattaaaagaaagtgagaaattattaatgaagcaatataaaaacaatctctattacagaaaaagtattcactgataagtaaaataaaaaccagagtcaaccaagtgaacactgctaataaaatttagaattcaagacttgtttgtttctgtaattctattatatgcattgaaaaaactgacctcataccatctatgtgacaaaaatttggttccaatacattttgcagcggaggaattagctaatgggatataaaatgaatagacacactgttgcctggaaaaaaattttttcttttaatttttttggactgtttctaattgtacaaaccatcatatcagtgcccaaagagaaaaataatagttaataagaaattattctttctaacataacttggaccttggagcagtggagattattagatgacatttggaactttttcctgcctttagattctactgaggaaaagtctgaggaccagaaaaccttagttttaatctaggttccatttagtcattgtgcaacactgaacttcgccctctttagttttcatctttactaaaacgaacattgttacaccagatacctctctacagatatactcttcctgttacacaactttcactaaataaattcaaagatgtggaaattacagtaattatccaagtgatttgattagtatcatctgcctatttaggtgacctggatgaatataattcttttttcctaaatagaattttcaaatgtgcgtgttagtcatgtaattcttgaaattatcctttcagctacttctggatagatagcatcagacacaaagcagttcagccattcaagaggctatgcttctgccctgcctgcaatagttaaaaatgttttcttttataaatgtctgaattaattatacttcttatggtatctacagtcctatctttatacacacccccatttgcttacttttgccattgaaatcatgaagaagtgaataccttctacattaactataatatacctaacccatgtaggttct

SEQ ID NO: 30991 - DNA, 609 bp, Bovine  19866881665557
tttgttaaaaaatgtaaggctgtaaattttgccaaaactgtatatttttaagttatttaaatatataataaaagatatagtgaacattaaaagtatgacaaatacgatatttctcttaattcttttcagcaatatgtgagcaatatatagttgaaaaccagtaaattaaaatatttaaagaggagtcaaaagattacaatttaataactaatgaaataaatgtgttttttttttaagataatatttgggcagctggaagttctttgataaattaatagtgcaattatgaggaactagatgacagaaaaacctgttggctcatttactatccaggaagtttactaaaaaggtgtccaactaaatcttaatattactgatatgttgaaattttagagaaaagtaacttcctgatagaactaggctgttttgtttaattaaatcattgaaaattgtgagaggtttgaaattgcttcaaaatgcattgaggattggacaccatgatagcagttgaaatggcagttgaaaaaatgtaaggtaattgcccattgtcagaaaatgtctgattctgactggaaatagagtccctggaaaatatgcactaacccatgc

SEQ ID NO: 30992 - DNA, 1605 bp, Bovine  19866881730993
caaaagctcagggtcagtgaagcagcagattctaatggggatatcagaactagaaggggagaccctgaccagagaatacaggctcctttcctttgctccttcaattaatttcaattaccagattgttggttttgactgtggacgtttgaatgatacagacagaaaccatttctaatgatgagacatcatagtttgaatcaacccttctgccatataatttacctgaagtctccaactctactctgacccacaggtggtgaaagagcacgcacgaccgtgtccatccctgtgcagttggaaacagatacagaatccaagctaggaaacattgcccatcgggtgaatgcaggtcttctcctgggtttctaatgttccaggctgaaatagggatgcggaacaaagtgcaggcgcccagcagtacttccagcaaagctactgttgtctcccaccaggcagcagtattggtaggactgtaattattattatttgcttttttaaaaaagatcagttcagaaatcctgaataataatttacctcacaagaattcactcattatgtagttattctattccttctgctctttcaaaaccttatttttgtagctaggcatgaaataatctcccagagcttcaggagcaggtcttttttattcatgtgattgcaaacagaaactccttattcaagaaggaaaaggttattaaactgagcgaaggtctttcaatattaaaataaaaaaggaactgtgactgcaatcttaactgcgaggcgcgatgtgagaggtgcgggcaatgcacagctccgagtcggcctgtccaaaccggcacgtggccagcagtcaatttaaaagtcaatttgctaataatctcattcgcaatgcgttcagttattttttttaaatatctgcttattgtttgggggtgtccaggcttgtttcctaaatgaaattcaaaataagttattagaaccttgagctgctatattcagagatgctcattcgggaaccatcttgatactcaggtaatgatttccaaatgtctctgaggtcagaacacagacttcctacctgtttatgtggccgatttgtactgactcttgagcttcagttcacttaacattgatttgggataggagttcatgctgattatatggtgaaagaaagtcctgtaatttttgccgttttatcaccttatcatcttctgctctgccacaaactgggcaattttcttttataaagtgtattcaactacatcacaatccagaaattttagggcttctctacaatagccctctcccaatgcataaattgtctccaaagcatcccaatttccttcaagactgcaagacagaatttaccagccagcattctgagcacaccacggacttcataggaaattaagcagaaaagtcatatgaagccatcttattgtgtgttatcaagaaacaaaatgaactatcatttcctttttccccccaatgatttgcaattccttgatgaaagtcgaataataccaaaaggtttccaaggcaacccctgtagaaagtgaccttttgctttccccatttcattcgtcctacgtgttaattgactttgaaaaagcaggatat

SEQ ID NO: 30993 - DNA, 728 bp, Bovine  19866881808523
ttacttacttaatctaattctttccattctcctgccttcattgtttcccaatctttaaattttatactatgtggagaaaaagaaagattgcaaaattaagtgagaaaagaaataaagaaaattgagaggtttgctagaaagtaattggtaagttggttaacaagttgaagaaaaagtagaaaggggatagtgaagaagggaaggaaggaatggagggagggagggaaaaaaaggcaatttcaagaaaaataaaggggttttgatcttaacagggtaatggaattttttaacatttcatgactactcccctgaaaaatgcgtataaatacaaaaatgtgcaaacaatttcgagttaatggattgatctccaaagcccattgaacccttgcattggtattgattgtagaactatgtctctgaatgaagaataaaactgaaagatgattttgaaggacattttggctgtcgcctttggcacaaagcaacttgatacacagagactgggatatacaatgcacagggggataatatagacaggaagcatttaaaagggcaggttatataataggccaccaaaatgcgtgaaggacactctagaagtctgaccctgaatagcatggcagtagcacataccgatttctcataaaaccactgagctcttccttaaagagctcaccccagcctattttccttccactgcggggggcttgagtcatcacactgctgta

SEQ ID NO: 30994 - DNA, 762 bp, Bovine  19866881867354
tcttggtcatgaggatcttttttgtacagttcttttgtgtattcttgccacctcttcttaatatcttttgcttctattaggtccatactatttctgtcctttatcgagcccaaacgtactgtactttttttttaaaggcctcttactgatcatttctgtaccttactccacttattttagccctctttcttggaaaaaggaagaatagaagacaaaaaggacagaagttattaaatgtagtaaaagtaacaaacagaaatagctgtaataaatttgtaagtatcaaagaaaaattccatggacagatgaagtggacaaggaaaatattattcaagattattgcaataggggtcaatactatcacatatgagagagacattgaactcaatttccctgaaacaaagggtgggaggatttttaaattgatgaactaataaaaaaagtactgaaggacttgagagaggttggtcagtgtgaccaggctatctctgttttcttatcttcctttattgaaggtaggttcttaccctcccacagagattgggggagggtgcttatctttcttgatgatgacatttcaaagtattggcttccaggtccttgaaaaagacatttctgagttgtaaaactggcaggaggctgagaagatttacatttcaaagggatatagaaagaatttacaatagcaagtcttctaaagtaaatgctcgagaaaagcagaggtcaagggcgaaagtctagaagaagccgtatcaagttagt

SEQ ID NO: 30995 - DNA, 1174 bp, Bovine  19866882021400
aaaaggaagagagcagtatattgctccactttattctggttctctctggtccccagactctcctggatgagtttgcttatgaaaacttgtatctgccctggtgaatctgctattgtagcaactgaacacaagcctcaggcactttgtttttaaccaaactgaggaaatgccactgtgattccaactgtaatcactggaatatggaacaaaatgaactgcagctgattcaagatgagccataagaaaaagcaatttatgcaaagcaagagccctgctgtggctttgtgtgatgcatgttcatacatatggtggaaaaggctatctctattcccatctaaagaaaatggaatgagattctgaaatcagggtctatcagccacatacctgtacaacacacaccagcaaatcagcttcagaaaccagattccttcataaagaataagcgttgtttaaaaatatccatatgcattgattaaaaagaagagaggttttaatctaatatatttatacccttttatatctgagaacagcctagcaaatcacctattcatttagtaaatgcataacatttggaaagatccttcttcaatttaattaaaatttttatgccattctctctcattgaacacaaacacacacacagagtcacagtaacctctaagcttaaatatatatgttgggaatggcatagaaagggtatactcaaaagatcataagtattgctagcctagatcttcatgaaagtcttgacattgtttacaagaagcatagttaagagcatgtgtctatagcatggaagagtactggtagtgagcagaaaacatacccatttattatcaattattgaaaagctatggcagcattgagatcctctctgtgacctttccatagtctgtatggttcatggattcttctaaggtttcagttgaagtttagcaacttggccaagtacctatatcctccaatgaatgtggcatgaagtggtgacaatacagaaaacatttaattctatgaagtgaaaactttctttcatgatttgatctcttaaaaaatcatataagactactgttttcctctttaaagtgcttcattgttctcacagttctctttaaataaactccaacctctttactattaatataacttacttccagtagtcacgtatggatgtgag

SEQ ID NO: 30996 - DNA, 2043 bp, Bovine  19866880113667
cctggcttggagaatttgagaattactttactagcatgtgagatgagtgcaattgtgcagtagtttgagcattctttggtattgcctttctttgggattggaatgaaaactgaccttttcccagtcctgtggccactgctgagttttccaaatttgctggcatattgagggcagcactttcacagcatcatctttcaggatttggaatagctcaactggaattctatcacctccactagctttgttcatagtgatgctttctaaggcccacttgacttcacattccaggatgtctggctctaggtcagtgatgacaccatcgtgattatctgggtcgtgaagatcttttttgtacagttcttctgtgtattcttgccatctcatcttaatattttctgcttctgttaggtccataccatttctgtcctttattgagcccatctttgcatgaaatgttcctttggtatctctgattttcttgaagaaatctctagtctttcccattctgttgttttcctctatttctttgcattgatcactgaagaaggctttcttatctcttcttgctattctttggaactctgcattcagatgtttatatctttccttttctcctttgcttttcacttctattcttttcacagctatttgtaaggcctccccagacagccattttgcttttttgcacatcttttccattgggatggtcttgatgggattatataaatatcatttaagataatcaaattagctaactttaggtatcctttcacttggagaaaatttctaatctactgtcagaaatgcttgttctttgaattataatcatggttctttgccacaagaatatcactatcttaactagcctatgttttgaataatacgattgggagaagccagcagatacctttatagaggtcaaatctgtgacatgaaatttttagcatcatgatgcatctaacacaactctatcagtgataaatgcattttctagaaacagttcgtgctattgacttcaacttcttacatgctgatggtgaagcacacatgtcagtttgatttaaaatatttttgtctgagtccttgctggtattttcctcatctgaaaaaaataatgtataaggtgattgtgaagaagtataaaataaacaaaaggagctcttctccaaaaaattttacattttgaacttttttttttttggtcacaccacagcctgtgggatcctatttccgaaccaaggatcaaacctgcatagactgggctgccaggtaagtcccacattttgaacgtttttaagaatcttcccaacttttagttactgaattcataagctttttttcttaataaatttgaaaaggaacatttactcacacagacagcatcacaagaatataaatacccaatgcccatatcttcatatattacatataaaatgtattattttataatacatataaaataatatgttattacatataaaatgacagcatcctccaagtataggtcagcctgcctcatgcctctctttcaaaagtttttttttttcaaaagttttgacttgggattcaactttaagaattatgagaggcaacatacttcataaattccagctaagtaaattataattacagcccagattccaattaggaaatttcagcattgctaagctgaggaatgaagcttaaagatacaattaatatgagcttatattaaaggctttagtggaattaataaactctataacagtagattattactagtcttgaacacagacaacaggctcttattgtcaataaccagccaaatagccttctttctatttgcttcttttgaatagtggtattttatcaaataaaaccctgtaaccaatgtaattaggaaggccttggataattttaatggaaaatttttaaatagcacttggaatcccacaaatgaaagtttccatttgactctcaaagtatgagagggcttcccgcatagctcagtttgtaaagaatctgcctacaatgcaggatacctgggtttgattcctgggttgg

SEQ ID NO: 30997 - DNA, 1295 bp, Bovine  19866880467237
ctgggccttggttttcttatatacaaaatagagagtgggccagatggtatctgattcttgctcttaaatctatgagtttggggtgtaaatatgctatggaattaaaagaagaaaattaaaaaaaaactttttcatttttcccttgaaaattcaatggccataatttttatattgagtgtacaagatttcaagttagcaggcaattgcctggaacatttaagacactgttttagctatcaaacttacatgatgagattttcctggaataaagtctacctaaacaaatttccaaagcactctatgggattctaatctgtgtctataaattattatacagacctaagtgtttaagagtccaagttatttttacaagttgaattgacattcaaaagtatgccatgcttgcaagccagtagctcaatgaacaactgcatacacatgatgtttttaactccttttattcactattcagaccaccaaaacacttacattctaaatgtgatgtttgacattgtaatccaatttagaaatgtttaactagtagaaataataactgccctggtaaaggcataaatgttaaatgagcttcctcataaaatcatgttccagggttgacatgatcctgtggcatgcagagagttatcataaaatgacaagcaagactaactaggtgtgagagattgttccaaaaaaatttccaacctcaatcattctagctaattgaagaacaaaaatagggtaacttctcttctgtgtttaaaattacagctttattgtttgaaagcttaagcaaaacccatgatctgtgtctggtgcaatcatttcagagtcactggaggggaacaggaaagggtgaatacgataccaggtacttttctggcttctcaaatatgggataaaatgataatcaggtaaaacaaacctagaatagactaaaactggcctctcctccaagggaatttccagttcgtgtagtcctaagtgataaacaaaaacagcttggtctgggaagataatttttgccaagaatttgagttttgtagctgctaagttgctgctaagtcgcttcagttgtgtccaactctgtgcgatcccatagacggcagcccagcgggctcccctgtccctgggatcctccaggcaagaataccggagtgtgttgccatcattgaggttatcactttaattgatgatgtttaaaagtatggcattgaaatatgtatatcatgtatgaaacgagtcgccagtccaggttcgatgcacgatactggatgcttggggctggtgcactggga

SEQ ID NO: 30998 - DNA, 1351 bp, Bovine  19866880490725
acttaataaagcttaaattccttatccttttatagcctctaactacacaatcccataaaagatttgtgcaaacacacacattattttggaatcatgccttgaacaccattgtacaaattaaagactgaaagggcttctcttggttcttacaccctacccaagtaagagtggggaatttctttaaaatatttcagccaattcacatatctatatatctaaaatatcaccaaatttaaactgattcctaatattcattatattgtgctatgaaatttctgttattaatttttttaaaaaatagcttaatgttcctattacaattttctttggagtgtagccttctggtaaaatcctaggttataacacctgcagtttgtattcctagttaggcaactgacaacccctagaatgtacaccaaaactaaacacacatacacacacactgctatgtgacattctttatgggttcctcccaatttcctagatcttcaaatgctggagtgttttagactgcactttagtactcaaactattccttcctaactgttcttattacttttagttattaatccagtctctttgctttaattattaactcttgggtaaatgaaattgccagtatggcacagttttgactgaaaaaaaaaaaattgacaattactgtggttcaacctgatattctgactaaccccaaaatttatattttctacccaaattctccatgagttccaccttcatgtacccaactgctaagtttcatattcatttaaaggtttgattggctgtagtgtcaaatatgttgacaaaataagggcaaaaaggactggaaaagggaacttttgattgacttccaggttattcataaggaagtagcaataggagagttgagagagagtaatcagattacaaagttttttgtatacatatcaggttcagttcagttcagtcgctcagtcatgtccaaccctttgcaaccccatgaaccacagcacaccaggcctccctgttcatcgccaactcctggagttcacccaagctcatgtccattgagtcggtgatgccatccaaccatctcatcctctgtcgtccccttctcctcctgccctcaaactttcccagcatcagggtcttttcaaatgagtcagcttttcgcatcaggtggccaaagtattggagtttcagcttcagcatcagtccttcaatgaatattcaggactgatctcctggttcaaaagcatcaattctttggcgctcagctctgtttatagtccaactctcacatccatacatgaccactggaaaaaccatagccttgacaagatggacctttgttgacaaagtaatgtgtctg

SEQ ID NO: 30999 - DNA, 1034 bp, Bovine  19866880574104
actggctcgtgctacctgctgctcaacacagattaactcactaccagccatatgggctagcgacttcataaattcctctccttttgcttttggctcttagggaagttaatggatggtttaccggtggagagaaaaacaaccttgtggtgtgcaggctgggcaataatcacctgcgcccgacacaactggcacctccatctgccttcgggcagctatttgtgtgaaggcaatagattactgcctttggtgctactcctgtgtgtcagccgctgccatttgcctcaattacaaagtcagatggttaaacgctgaattcatatttatattatttacaatgattattcattgcatccattgttaaggagggtctcaaactgtttctacagttagaaataaataaataattttgatcaactttagcaagcatattcaaacaccgatgcttatttttaaatgtagtaaataaaatgctctaacaaataattcagtgaagttgaaagatcatagtgtttaagtttctgacttgggtttattgtgacttagttccctttctgtgccttaagtccctctgaaatatttaaatttttgaaagtatgttgtaaactgtaccaaagcataatttaaaaatacatgcatttaatcataaaatactgttgttaaatatagaacttctggaattcaaaagcagaaactatcaaggaattttcattttaaacatcagaagtattaagtatttttcattagcatgagatcaataatatgatcataatgttaacaaatccagatgtttagcattgcatcattcttcagcttatcttgatccctgttccttccaaatagcctttaactgattttatagacagaataatgaaatcaaatgactggctttagaattaataaccaatttaaaatgttttattttataaaaagtttttttttttttttactctagaggcataattttctcaaccttttgataatgtaataactacacaccaagacatttaatatttagtcattttttgtgaaggaga

SEQ ID NO: 31000 - DNA, 969 bp, Bovine  19866880648640
aacctgtaatggaaaagacacactactactggtaggtgtctttttcagggtttacctgatgcaaagagctgactcattggaaaaaccttgatgctgggaaagattgaaggcaaaagcagaaggggatggcagagaatgagatggttagacagcatcactgactgaatggatacaatttgagcaaactctgggagacagtggatgacagaggagtcacaaagagtaggctacgacttaagtgagtgaacaacagcatgcacatacatatatgtatgtgtgtgactgaatcacttttctgtacacctggggcactataaatcaactatacttcaataaaaaataaatgaattaatatttttaaaagatgtaggtctattaagaattttttacttaatcttataaaaatagaagatactgggggttttaagcaggagggaaggttttgagattgttttattttttcaaaaggtatttctgttgttaaacagaaaattattttatagaaaaaggtactttaataaattcttggaatcatgagagaaaggaggacaaggtagagactgtatggttagagaagagggaaaataagagacgaatgaaaatccagtgtgcaacagtcaccccacactgatattccataacagcaataaaacagtttaagtctgcaatgccagagctgctcttatcactggtatgaaaattcacacataagaagacaaggaatgttccctgattttaacttatgcttacaaaggatgtcttaagattgagtctgtaatgagttgcctatttctcagtggaaggggagagcccagtttcacaccttcccatttcatttctaaaagtccttctgtaccatcacagtccctattattatactccaattaaccggtgaagttgctcagtcatgttcgactctttgtgatcccatgtactgtaggccaccaggctcctccatccatggaattt

SEQ ID NO: 31001 - DNA, 1113 bp, Bovine  19866880724997
cgaccccatggactgtagcctaccaggctcctccatccatgggattttccaagcaagggtactggagtgggttctatttccttctccaggggatcttcccaacccagggatcgaactcaggtttcccgcattgcagggcaaggagccttaccatgtgagtcaccttaaattagaacacttagtccacttataagcattaattctattgatatagttgttctaaaatctgtcattttcctatttgctttctatttatttctcctctctcttatcttgttttcaccttctgcttctttggggtagaatacatatttatctggttccatttttttctctgttaggtgaaaattactttttattattatttttgtaaatactttaggaatacgatatccttgacttagtctaaattaattggcacttataccttaaaaaactaagggacttaatacttttaactccttttactgctacatttcatctataagcagttgataagtattttaattttatttctctctatatatctagcctaagacattattgtttgatatagtcaatctttatttagactcaccttgatattgactacttttattgctctttattctttcttatatctatgattttccatctgaaattatttcccttccacttaaaaaatactccttgtaattaattttgtctgttggataatattctcataatttttagttatatgaagataagtttatttcacattaattttttaagatgcttgtttttatcattttgtttttctgggtacagcaatctaaagttttatttattttattttagtactataagagtatatgttattgtttttattttattttattacttctgctgaggattcagctctcagtccaattattgctcttttgaaaatatttgtgtgtgtgtgtgtttttagcttcttttatgctctgttattgtttcaggtttttaggaatatcagttaaatgtaattaggtcagaattacttgggtcacttggatcaattacttggatctcttggatcaaacataccctcttaacttttgtgtcatttatcatggtagaattctcctctattatgtccttcacatattg

SEQ ID NO: 31002 - DNA, 2623 bp, Bovine  19866880724998
tatttacaaaaataataatgaaaagtaattttcacctaacagagaaaaaaatggaaccagataaatatgtattctaccccaaagaagcagaaggtgaaaacaagataagagagaggagaaataaatagaaagcaaataggaaaatgacagattttagaacaactatatcaatagaattaatgcttataagtggactaagtgttctaatttaaggtgactcacatggtaaagctcttgcctgcaatgcgggaaacctgagttcgatccctgggttgggaagatcccctggagaaggaaatagaacccactccagtacccttgcttggaaaatcccatggatggaggagcctggtaggctacagtccatggggtcgaaaaaagttggacacgactgagagacttcatttttttttttataagactcagaaaataataatatacaacctacaaaaagcattttttacttttttgttttttttttacaacagagctccaaagagctaatcttttcaaattaatcaattaatttatttatttgtttttggctgcatcatgcagaatggcaggatcttagttcccccaccagggatcaaacccacacctctgcagtgaaagtacagagcccccaaccactggaccaccagggaagtcccacaaagcatttttaaaaatatataggtcctgcaatgttgaacttaaaaatttggaaaaagatatagaatacaaacactaactgaaagaaagcttttaagttatatcagtatcagacaaagcaaactttagtacaaaacaatcattattaaaaataaagtcagacacatcaaatggtaaaaagttacccactaggattataaagatataagatatacatttgcacacaatgttattgtctcaaaatttgtgagacaaaaaataacatatgtatggaagagaaatagacaaatacatgataaggggatattttaatgcaagttattcactagctgatagaataaatataaaagagaaaaccagtaaatatagaaaaaaatttaacaatgtggttagcaaacttgatccaactgaaatatttgcaacacctgtagaaataccttctttcaaaaattcttggaatatccatgcttagtcactcagtcatgtctgatactctttgtgaccccatggactgtagcccaccaggttcctctgtccgtggggattctccaggcaagaatactggagtgggatgccatgccctcctccaaggaatcttcccaacccagggatggaacccaggtctcccacattgcaggcagattctttaccaactgaggcaccagggaagcactgaaatatccatagaaaatgattaaacaaagtaatttagagcacacactcttggcatttcctactaaagttgaagtaacatgtcctactttatgacaaaggaattccactcagtattacaatgttttaaaaatcatacagagaagcatcaaaaagatacatgcaaaattactcatagcagcagtattcctaatggtcaagaactgtggagaatccaacagcaaaaggatggctattaactgagaacacatttatatattagaatagagatccaaccagtccattctgaaggagatcagccctgggatttctttggaaggaatgatgctaaagctgaaactccagtactttggccatctcatgcgaagagttgactcattggaaaagactctgatgctgggagggactgggggcaggaggagaagtggacaacagaggatgagatggctggatggcatcactgactcgatggacgtgagtctgagtgaactccgggagttggtgatggacagggaggcctggcgtgctgcgattcatggggtcgcaaagagtcggacacgactgagcgactgatctgatctgatctgatatggtaatgaaaataaacaaactacagccaaaagcaacaacatatttaaatattaccaacctaatatttatcaaaagaactcagtcagggataatgtatattaatactatatgcttccatttgtacaaaactcaaaaactaaagaatagtattagaaattggcattatcatcagttttttcagaggcaggcacgaaatagtgaatgaaggtagaatgggtgctggtaatattccatttcttgaactgggtgatgattacacagatgctctctttgtgataattcaactccacaaataaattttttctacattcttttcatatatgtgttatatattaggtttatatataggaatgtataattatatataagggaaaatatatatgcataatcagaatatggagtatgctatgacacgactttcattaattgaaataagcatactatcaacctctatggcaactgacaaattttttcagcacttgaccttgacaaataaaggtgtctcaatctcttcctcttaaaaatagtctattttgcgtagttagattagaaatagtaccagctgttgtctcttctttggcccagatccctcccctgacacaataatcaagcatctcctctaaattaatattgaacaaatatttaaaggctatgatatttaaccagtgctaaaacagtagacttcataatacatctacatgactta

SEQ ID NO: 31003 - DNA, 1078 bp, Bovine  19866880732263
ttctgaatgttgagctctaagaccactttttaactctcctctttattatgcagtgtataatatggtaaaaatagaccctgttctggctaattagtgccaggagcaatatcagtatcctcagatatgcagatgaactgacctgaaagacctgtcccaccagatcgtctggagcacagagtgccttactctaccctgagctccctcaggttgtgttgaaggtcagcagctgccacagtgcagggtttagtctttacaggggcagatggtgcatgccctatttgttcagtcgtctgcaacaatcttggcatgtttcagcttgtagttgactatatatatatatgtataatggaatactgttcagctatgaaaatgaggaaatccttctgtgcaacaggctctgtgactgaactgaactggctaatcaaagtatacaaactgattgtcgtcttcagggatgttgatcacaattagtttcaaataccagggttcttttttttttgttttttaatgtaagctttttttctttccaatggccaactagattccagttaaattatactttttttgtattttctgtaccataggctacccaggtggacatgagagcagctcaggttgctcaggatgaggtgcgtgcatgttaatttgtttagccattatcctttggaaatatcccaataattttctacttacagctttgcaatttttgtttaggaaattgctagacttctaatggctgaagaaaagaaagcttacaagaaagccagggagcgggagaaatcatctttggacaaaagaaagcatgaccctgagtggaaggtagagtctgtttgtttttaaagagaaatacaggtaaaactataatggggagtcctcttccaaggtaagctcaaagatatatttagggcatataaattacctgtctctcgtgtgaatctgacttatacacaatggagtattactcagcaattaaaaagaatacatttgaatcagttctaatgagggggatgaaactggagcctattatacagagtgaagtaagccagaaggaaaaacaccaatacagtatactaacgca

SEQ ID NO: 31004 - DNA, 1951 bp, Bovine  19866880780140
atgaagatgaaaagtgaaagtgaagtcgctcagtcgtgtccaaccctcagcgaccccatggaactgcagccttccaggctcctcagtccatgggattttccaggcaagagtattctagtgaagtagataatctgtaaataaaggtatagtgcgttgtcagtaacaatgatatggtcaaaaacaaagcactgcaaggaaactattgtgctgctttaagacaattggcacaaatatttttaaaaattatctgaagacttaacaaaagagcagaccagaggaatctagggaagagctttcctgacaaaggcaacagcacatgcaagggtttttatactattttactataggacctttacatactacatcaattcatttaaatgataaaattgtcaaaacagctggggcccagagcatctttaattctagtcagaatcttaatgttttggttatggaagaaaccattgcttttttttctagttttttgtttgttttagctcttctttttctgtgttcttgttttattgttgttatgaaagtgagataactattaagaccaatagcattgtattactaacaagagctttgaaaataacagatgcttcctttttggcatcttgctcacttatggttagttgccatcatcttgaacagtataacaaccctgaagtaaaagtgagggtagaatgaaatgataaagcataaaagaattgaatttaatatgaagagagaattggtattggctcagaatgctggttatttgaaagacctaaatgaggaagtgttttcttaaaggagaggtgaaaccagttaacagaagtcaagcctttagctgcatatcaggataagcctcctgcctgcctccagactccagtaagcctcatcttttgtattgattttaaaagcgtcaatgctgaatagggtttcattaattatgatgatgattattgcacagttaaaataatagagaaactgaattttggttctttggtggaaaaatatgcagggttgaaacaaaaaaaaatcatcatggcattaggataagctggatacaaaatcatttcagagattgatgacatgtcatggtagccttgaattatctgccttattcctttaaatttctattttgatcatccacacaagcaagtgacatattaaggtctattagccccagttattttgtcctccaagtaactttggatactgcagaaacaacttttaaaatgaatggatttctttctgcattatgagaatttgaccttttatgttttttataagcaatgcttagttattctagaagtggcttgatatgctattatattggccataaaatatttctttgtgtaatgtcccttttgccctttctttcagcattagcatatattttatactttcagttcaacatctaaagatcatttccatggaaagacattcctagatcatttgtgaaattgaaatactatacaaactcattgataagaaaaacatttaaaagcttgaaacatctttttactgatcttacctaggtttgagatatagacacaaatgacagaggagatagaaagggaaaggtattagaagcagagagaaaatcttgctgaagacttattgattccagatgagagtgagaagagaggcatggttctcgctggcacagttcagctgcagggcagtaaaaaagccaggggcccaaatgggcaaagaacagcacaggcagttgtgaaccttctttctctgtctcaccaacttaataatagccatggtgccacctgaccttgaaaagtaattttaaatgtttataagaaaaagagcaactactcctacctccactgtagttacacaaacagctacttctggaagcaggagtagaccttgaaagctacagaacttgaaagctagctaccatatgctataagaggcaagaaaatcattttcctaactagaacaaggaaca

SEQ ID NO: 31005 - DNA, 1284 bp, Bovine  19866880928709
gtattcccatctctttcagaatttcccacagtttattgtgatattaaagggatatagtttcaattggagttcttatcattttaagaacattgttgtgatgaatacgccagagaatcttcagagttaatagaatctttgagactaaaataaatcccccaatctatttgttttagtgttataaatattacaagcattcttcattttagatcaactgaaactttcaggtgatgatgaccataccagtttcagtgatgagacaatatgcccttggtgttatggcatgaaaggattgttgctcatctattttctaaattgaagttaagatgtgaacatcaaaaggaaaaccaaacaaggagtctggatagaatagtaatatagttcagacattggacttttcttctgagggtacattcatgtctctgcaattttattatcctatatatagaatcactgtggatgtaggtgaataatttaaggagtaatagacaagaaatggctgtaattttcagcattataacaatcttttttttttctttctcctttttcccttcctttcattccactttagaagtcatttgagagtagaaaggaagatgaaccaaccactagctaagtgactacaaatgaaagttaagatagactacttgggaaaaaaagtattttgttaataagttgggaaattggttttatctaaagtagaaaaattttataataggaaactcagacaagcctaattttttagcatcaacctctctgagataaagagtgcacacagggatgaaaccaagtacataagaggtataattaaaaaatttctaaatctcttatgtagaactgtgaacacctgagtttttgttcctattctcttaaagttgtgttatgtgaccttggggaaagtccgtttctctctctatctttaattgctaagtcgtgtttgactcttgcgactccatggactcctgccaggctcctctatccatgggattctccaggcaagaatactggagtgggttgccatttccttctccagggaatcttcctgacctaggaatcgaacccaggtctcctgcattgaatgcagattctttaccgactgagttttgagggaagcccaatcaactgtactccaatcaaaatcaaaatcaaatatactccaataaaaatgttaaaaagaagaaaataattaaaggaaagccagcagcatataaacagcatacacttaaataaaagatgaatgcttaacatacaatgttttttattcactataagctaaaggtccatttc

SEQ ID NO: 31006 - DNA, 892 bp, Bovine  19866880997311
tggataaatttattaaaatctttttcatgagaccaagaaaatagtctatataaacatatagaactgacaccatggaaacagattcatgatgaaaggttttatacttagatgtcttaatggttttccattatggttgacatttgctgaagacaaatggaaacaacttgctttaatgcgaagcgttctgggatcctcccaagcaggcacaatctttctgtctctctttttttacaatatgtcattgtctgctgctgctaagctgctaagtcacttcagtcgtgtctgactctgtgcgacccggtagacggcagcccaccaggctcctccattcatgggattctccaggcaagaacactggagtgggtttccatttccttctccaatgcatgaaactgaaaagtgaaaatgaagtcgctcagtcgtgtccgactcttagcgaccccatggactgcagcctaccaggtcctctgcccatgggattttccaggcaagagaactgtctactctgtattataattatgtctctttactccaaagaatgtattaatatttttccatcattttaaattaccatctataatttgaagtgaaagtgaagtgaaagtgaagttgctcagtcgtgtccagctctttgtgaccccatggactgtaggctaccaggctcctctgtccatgggattttccaggcaagagtactggagtgggtttccattttcttcttcaataatttgaagcatatggaaggtattcaataaatgtttgtggaatatacaaataacgtttgtgtatgtggtttctttttattcctcaaaggtcaaaattcccagagaaacaagttgaaaatgattgcattttttttcattaaacttacttccagaaagagaaacttgca

SEQ ID NO: 31007 - DNA, 1355 bp, Bovine  19866881000649
tagatagatagataatttttcttcatgagacaaagttcaataaatcataattatttaataaggttgtgctcaaagatccatgaataaaataattaagagaaatatgttattggaagttttgttgcttaacaaactcaaatcttgaaaaagtgtcttaaaacttttaataactgaactagctaaacattatttttaatttttaattaagtaatctttaatgcagtaatagttaacttcaaatgttcgtcattttgagtgatttttacttcactctgttttatgtaaataatgaaagtaatttttcttccaatgatttaacctacttttgttgttatttcatactagactttaaatatagtaaaaaataaatatgagattttagtgccccagtactgctcagagaggactggataaagctggaaattattatgggacagactgggaacaaggatggctttgctcacagccttgatttccactgtcaactctgcaaaatgaaattccacaactttattttcaagttcattaccattttcacaattataattagatttaaggctaaagtgtatgctttagtgagaggtatatagttctgcttcacattgacaggtaagtgaattctaatatcttgcagactagtgagtgagagtttattgcagataatgaacaagattcacaaatgctgaaacaaaggctcaatgtgaagagtaagaaagaacatttggggacttccctcgtgttccagtggttaagaagccacacttccagtgtgaagggcacaggtttgatccttggtcggggaactaagatcctacatgctgggtggcatagacaagaaaatttttttgaaaaacagaattttttaatatactaaaaaatataaaggaagaaggctaagcacattttatttcttttttaatataaatttatttattttaattggaggttaattacaatattgtattggttttgccatacatcaacatgaatccgccacaggtatacacgtgttccccatcctgaaccccactccctcctctctccccgtaccatccctctgggccgtctcactgcatcagccccaagcatccagtatcatgcatctattcaagaaaatagctcatggtgataattataagtaagatatattaagaatggactttacagcttcattttttttttacatcgacggaccctgaaaaataatatggatcttgaatattaaaaaagttacttttgttcctttacaatcataatagcatagaccttgaaggctttttctagtcttaacttgcagatggtaagatacatcctattcagaaaacagggcacaacttaatgttagggtagacccg

SEQ ID NO: 31008 - DNA, 892 bp, Bovine  19866881098516
ttttaattgtgtactttcagaggttttgtctgtatgtgtgtatgtttgtttgtgtacagtaagcatgtttgccagtgtttaagacagtgaatgatgttctctctcttttttttttaataagtctgaacttttttggtcacgctgatctcccataaaatgagtgacaacttaaattgatgttgtggttaaaatacttgcccattaagaggacataatgagccttcctttctagtaacccagttggaaacattggcctcatcagtattacattctcataaactgaaactgattaacaattatgtgattgggcaaaaccagagcctgcccaatatcatccagcatttagattctctttgaatccagttccacatttgtatagtggcaagatggatatggacatatttgataattgtaagatttgtttcatgtctgaaagtgtgatgactccatacaaagaaggaaaaaggcaaactataactaaaatttcactatgaatatccacatatcaaaaaaatgaaagcagttatcctgtttttccaaatcaggaataaaatgtaaaatactgttgcccaaaatagaaattggttaatatcctattaggccaacattaaataggcacaaaattattaatatattgaatgctagtacctatatattgattttcaaggatagttgtggcacattggtgtctggtctggttagaataattttcttgatgttcagttcttactggatttatttcatttgaactcaaaggaataaaccaaaactttaaaacaaaattggccagtttttcctgtgtttatacatttttgtaaattttgtgacaaaggtttgtaacaaaaccataggtctcagtgggtgcatgaggtttaagtggtttcatctcaaa

SEQ ID NO: 31009 - DNA, 1047 bp, Bovine  19866881221287
ttcttgcctggaaaattccatgaacagaggagtctggaagactacagtccatggggttgcaaaagattcagacacagtgactaaataacaacaacaattagaataacttgcagagagaaggagttgcctggatatttaagattctcaacccgtatttcaataataaaaatagagcatagaaaagtctataggaagtaacaacatttcttctttacctctgataaagttgaatgtcaaactaaaaattaaaaagaaaaaagccaataaagaagtaatgtcttaaaactctggagaagcattagaatgggaaaataattttttattgtctttgtcattgtttttcaaaaatgggtgtcttcatttttaaaatgtattattttaggatctacgggtttcctgctaatgctaagttatctttttttatatatacttaaatctggcttaccattgaaaccattcatttattctgtttccataaaacccctaataactatttaaattttttctgttcttggctcttttcaaaatcataaatacaggtttgaaaactaaatttgatttctgtgcaaataattctcctccctgtgtccatccccactaattgctaaggaactgtgactatgtccatcagttttatttatgataggcttattcctctcatcttattccccaggaaatggaaagcttgctatggatcagatgatactgaatcattgtaactaccttctctccaacttaaaccaaagaaaatatgtgaaaataagagtgaaaagaaatttgcttttaagtcaagaaaattaaatgtaattttcaagtgcctctattatgcttgcttgtttgtcatatcaaacagctaaatatcccattttttaggatatttatagctaatgtaaaagcaactcatgaacaaattaagctaataatatgctaattcttatgttgttttgtttattaactattatatggtcaattttttccacaaatataggtgaatttcttaggtataaagtcactgttaaaatttatatataccagacagaacaagat

SEQ ID NO: 31010 - DNA, 1534 bp, Bovine  19866881262060
ctctttctacacttggtcaagccctggcatcacatttgcctgtggtttctctgcagttattctaggacttcttaaaactgtaagtaatctagaccctgactgacttcctgagagtccccagccttatccacaggccagaaacttacagatgttaaattttggcacctgtctaattagttaagcccatcatgctataactaattttcttctgtgcagtattctcatcaccatcatattcaagcttcttttcctttgattcaaacactcactacacttttaatctttcagacattacaactgtattctcagggccatgtgttttaggtaaccaattctgctacttcttgccctttactgaaaatatactctcttctaagaacactatttccatggcatctgtcttaaacatatggtgctcatttcttcacacccctttgtaaccaggctaagggagtggtacctgcattttcctataagcatagtggtatttccagggcattgctatttaactcatttaaaaactctgttcctttcaggcatttgaccttcaagtattgttttcttcctgttcttattatcactaccttgtcaaagccatgtttgaccaagtcagtgggtcattgttcagcctagattccaacgctaatcatttcaaccagttcttgacccaaatcctcatctttgtgtccttctgtgtgcttttacctataacatatttactccaggttcatccatatgtcatcttcatacctgctatattctaaactggattgagacctttacaggcactaaagttaaaatacttctgctttccttcatacttcaccaaatgcaattcaaaataaacaatttaaatcataaaataaatgcaaagcatccagaaattctggctttttcatcaaaactgtttccatgattttttctcaaagcatttgccaagtatccacgttggataattcagtactgattatataaaaattcctggataatgtagagaaaagcacaccatcttcaaagtggtgcttattacaattcctgttgctgcataacaaattataacagttcagtttcctaataccactattttattatattcataaattctgtagaccaggcattcagacagggcatagcaagaatggcttatctctaaaacttcaacaggaaagaggtaacagaagaggaattatttgactgttgggtaatggaatcatatggattccatttgatttgtctggcttttgacttggacctcagtttggactgttagtcaaagcacatatacatgatctttcatgtagtctgggattcctcacaatatataagcctccatgaaattggacttcttctgtagtagaagaccaagacttcaaaagtaagtaccctagccaacaaagcaaaatctaatcattgttctggcttagagacttggacgtcactgagaaccatatgtcaaattctactaattacaagtgagtcatcagcttattcagattcggggaaaggggcataggccccatcttttgatggaagg

SEQ ID NO: 31011 - DNA, 965 bp, Bovine  19866881271095
gttggtgtttgcctccaaccattcaggaatacaagcacacagacttatacaatactttggtttaaaaattattcataatatcaatgttaaacctgacgttaaaggaatcaaatgggatgcgaggtgtaaaaaatgaagcactgaaacacaagcttgcatagatgaatagatggagatgtataagtggcactgaagggaggcctgagtaccggagagtcatcaccacctcagccgcccaagacacaggaacatctccagcaccacgcttctcactttctccaaagaggtcatgagcaggaatgtgtgctgtacgaaggtgaattgaaatagtctgtttccataagcctcgtccagaaggatgcacacatacccgccagcacccaatcagtcacctttaaggcatccacaatgtctctcagtttcattaatctctagacaggcgtgtgatttgaggtggcctcctctttttctgaactgaggccagtaactctattccattaaggttctgtgagaaaactatgtcaaagctgcctttcccctagggcgtggctacaaaccttaagtgcttgggatataacactccacttgtttaaacatccacattccaaatgtcaaagggctttttaccaaagcatccaaaaccttttgggcactgtgcagttattaatctctctctctcaagagcgtacttttccaaaatttgagacaaatgacagcacacctcaaatttcctgagcaacttgattcatatgaaaaactcctgtactttataattcagtacctttcaagatacaactgtgttgggatggattcttcttaaggacaaccacatttacagagaattctcacttcggaatatcatttttataccctatcatctcataatacttcatgaacaaatactaccttgctttcaagaggcaggtggaaaatacagctattgctgggaaaggcattggctttca

SEQ ID NO: 31012 - DNA, 850 bp, Bovine  19866881277100
catcggtgcaggatgaggatggagctagacgacctccaatcgtccttcctgtcagggactgcagcggtgcagccagctggaggctctgccacttaagccctgcgcctcgctggctgagtgccagaacggctccctggcttcctcctcccgcgggaagggcttccctgggcgacccaggaggctgccggctggagcgggggcggctctcccgcgcagctccggagaggcgagaggcggcgaggcgagagctgtctacccaccatcaataatgcggtcttttgtcagcaataaattccctccaaaattaatgaaacagcccttttaaattctcatgccactacctcatctagcaggagcttggctaggcctcctgctctctaaataaatagaaaagccgtataaattgtctggaggcgatatctagctagctgggcacaatctaatcttctcaaccgcctacagaaacaaggagaaggatggaaacccaggatcgatgcttgctctccattgcagaaggcacagcactccatcacccacccggagcagggcagggctctgctgacatctgtcgccctggtcactcactctgcagtagtctgcatgtgacctagtcccagaggataccattaaggaatattaaggcagagggataaccccttccttttacacgtgaagacgccaaagcccagaggaaaaaaacaaagcaccacaatctaccctctagtgccttagtgttctaaatcccagcttctcagattttaaggagcatgcagtagtcgcgggtgggtcgaggttgggttgtgcatttctgtaaagcccccaagtgctgcttctgctactacgaggtcct

SEQ ID NO: 31013 - DNA, 962 bp, Bovine  19866881306438
ctaagtgaatctcactttttctggccttggacaagtgccttattcgcacataatttaatttctttatcataagcagtttgtttctctagaaagtcattggacttgaggttcaagaacctggcgttctagctagattatagccaggaagtcactttatatctgtgaaaatataccaataaataggggataatattttcttagggtgttaggaattttaaaaacccagtgtattggaacgttaaaatgggattctttctgtcacagttttggctgtggcccagaaaaactgagggggaaaaaaggatggtatttcctcttgcattccaaagtagggtgctagagttatgcagtatttgtaaagaaggtggctataaactatttttccaaaaaaaaaaaaaaagattgatactgaagaggtaaataagaatttctctggagcaagttactggagaacagggacatttccctcttttttcatatggagaaagggcttcaagaaaaccttgtttctcagtcagtctctatgctttggcagaggagcctgggggctgcagttcatgggtacgcaaaacagttggacatgcccgagcaactaaacaacaacaaataccctttaaagcagggtagacctcctagaacagactgaaatctaaagggcaggaagctgtgagaattggctcaattccagagtgaagagatggttacataagcaacagctttactttcagtgaccagagtcaaggatgtgggttttctgtggaacagatgtagagcaagcatgtgggtagagttggcctaggttaattataaaaggaaacttcccctgcttttggccaggggttatgggtgatgtggtctcagcaggacgctggtgatggtgctgtcaaatgaagaaaccaagcgaataggatgaaggtgaggagcaaaactgatctgctgaaagagaagcattgctggaggca

SEQ ID NO: 31014 - DNA, 4054 bp, Bovine  19866881363403
ttggtttataaatccccctttgtatctcttggcttataaactcagtttttcaaacatttctgtacttgattagtacattgatgttaaataatttaaatgatgttaaaaaacaatgcctagatctactttgccctaaaaagaaaacttattctcacaaacttgcatattaaatactaatatgcaaacaaagattaaagtcctaattatcattaaatcattttcataaatataaataaacatgtagcaatccctctattattaagaagacacattctggtgatatacatcttgttgcttataactaaactacccagttatcatcatgaaccaggagagaaaatgatatagcagaaagggtatcaggcatgaaatcaggacatgtaatccaaatcctggtctgtcagtcattatctcatttccatcaaaataatttatttctctgcagcttgtacatttagataataacattaagggtgttgtgaagattaaattagatgcctgtactaattctaaattgtattagacacataatatgtgcaagtgagaagagcttatattacagttctgaaaattaactctttgctgagccctatgtttagttttatttactcatcatgttccataaagtaagtactattactattccaatatcttgaaaagtagtacagtataaggggtaaaataccaggtggacaggtctggttttgtggctcatatcctaggtcatctatctattagctgtggcaacttgcttaaattctgaaatcctccttcataaaatgaggataataataatttcaaccacatcgcattgtcctgaggataaatgaattggtatacattaagcacctagaattgtgctcaataataattacttacttacttgtacaagtaagtggaaagcttatattaattaactcacaatgccccacagctagtaagtgatacaagtagaattcaattccagaaagcttaaatcattagcttatattttaaatgtatttaattgtacatattatatgttttaaacagtaaatattttttggacacacaatctaggcactcccaataaggcttacagagagggtgcatcctatctcccaaacatattaagacagctcagaactgttttgacaatttcagactacagagagaaaactctgctttttgcttttctcaagataatactcagaccaatgatgaagaggcccagaagcatcacattaaccttgaccctcttaatttgtcatgctgttttgcctcctcatcaaatactgtcaatcacaatgaaaaatcagtattttacctcaactatctcattcacagaatggcaattaaaataatttttccctgtatggaatcattggtcagtgaagtggcaaagttactgaatgtccataactacaggaggacttactgaaaataaccaatgacactgcctttcgagcagcaccatcttcaaaactcaggttgaaatttttttatttctagagatatactaagaacggttactcttcagggatgttaaaaaatcaccacattatatttgagtaggaactaattgctattaaaagttaaataagtcctagaaatcgggaccacaaccctgcagtttcttgatatattgagaacattatgacactgagattaaaataattaaattcagttggtttccacatatatcccatcacctttgcaactctgggttatcacccattttaatatttctgaatttaaccaaaactcatgtatgacataaaagtcatataggaagttcatttttcctataaattttacatatgtttcagaccataaaaactccagagagttattaaactatgcaaagggagttgaattaatgttttctgaatcattgctatgtgaaatccaaattaatatgttatgtcctttacttaatagattttatagagcatcaaggggttccctagttggtaaagaatctgcctgcaatgcaggaaacccaggttcaatccctggttagggaagatccccatcactgtccttattattaaaacctaaagatagtaacatcataaaaatatgttgagaaaagagtttaatatcatacatttttctctttccctttcttcaatcattgtgggttcacctgctcaaccattgtttctattctttactgcctgccactatcaccaagatttctcagacattttttgacttcctcatgtaaagtttcatgtctttatattttaagaataataaaggctatgaaaatacgtttttaatttccatttaacttttcaaaattatttttgctgtgttatttcttattgtcacaatattcctgtgaattaaatagatgtaatatgtgaatctttaatagataatatgaataattaaataattttcacataatcacgcaatgaaatcatttgagattcaagagtataaagtctccttcaacctaaatcatttttgtaaatgaatgagaacacagggctttgagaagaatctgatctgcccaaaattttacacacttttgggcaaagcaagctccaggtctcagcctctggacttgtaagccaacattttcttcatagcccataagatctgtgtgctaaattgttattgttgacttcactgattatccatctcttaaacaaacagaaatagtatctcagactttatgaaaatctttgtttcacttctgtgagagctgatatacactctttgggggcagttttatttgtgggttttcaccttctgggtttcactgtaagtcttcacactaataacgaaactggtactaacatggaagtttttcttggtttgaggtcaagtctagatacagctgctgtgtgttacttagtttccagaataaatgttcgtctcttcctgatacacactttggaaaggatcctaatctgctttttacacaatgtccttctcaaattggtaatatataggaccaaagttctgagtttttaataggtttaagttctaagcaactcaaattcagagtggtaaggcactgtagcttctctagctgcagttagcaaagttctaggtctctgctgttgaaacaggatgccaacttaatgaaatgtggtaaatatgatcattaattgtgctaccccttgctgccacagtgccttaagacttttaataatgtaaaacacatgttgttgcaatatactgacaatttttattttagaacaatattgacacactatcattctgacaaagcaacatacctctcaaataacagaaatattatgtttaaatgccagcatatatttggatcctttaaaaagagcaaaatatacaacaattatcgacatgttaacaataaacagaaagtagtaatcaaattttctttatctttcccttgtaatggcaacatcctttgacctaagattggaaactcaaaagaaatagaggtaggagaagaaaggaggtgtgggttcagcataagcacctacctgttacatttaaaatacactttttaataaatttttatctgaaattatcattttacattattgtctctgcaataaaagacatggcacttaaataaaagctataatgaaacctcatgtaattaaagttttagctcttctcaagttgatggatttccccttatgcagaggtctcattagctataacattttcaactttcatttttgcagacacagcttccttgggtgaaatgtcacagaaacatggaagatattttggtgaagttcttcacacttcttaatgattaaacttctaaggaaacttctgtcatcctttccagagcttgaacttctgtttatcacatcacagtattgttataacttcaattaaattgtgcagataatttcaatgcatggatatttttaaaatatatattttagttattcatgagtggttactataccctaaacattactttctaacaaacacaatacagtgataatgctttctgtgtgcctttaccatttacatatatgaaattgagggaatagtaactaaagactgacggatttatttcagtagaatttaggtacaatccatttgatcatcactgggg

SEQ ID NO: 31015 - DNA, 854 bp, Bovine  19866881429751
tttattaaagaagatgccgaaaattttgacaggagttattttcatagtctctctttcagaggcacattgatccatcctttctctgtgtcctgccctctaactttcacatcaattcttttgcaagatgtttgatgacaatcaactgctctgcatgagctgcaataaattctcaaatataacagtaagcagaattggaagtatcactcttccagataaatatgaaatgtcagtgcttaaaagtcttgatagggtacataaaatctcttgggagacagtgaccccagaaggaaatctgcttgattatcatgtaatgtaccatacaaggttacagcaagatattttgtataaccatatcagtaaaatactggctaccacacagagacacagattaaacatttttcaattggtattaatatcaactctttggcctgaacttttattcatgaagaaaacatgtgaaaaagtcttaaagtttataagagatttcatttgatgtgagaaatctcacattttattctccttttcacacaaaaagcctaataatcatagactactgtagcagacagatgatggtctgttgtatgttaatttttcaagtttgataacaaaaatcattcagacgtcttgaggctgagtcaccacaaaattcaaatggtttttatgcattataaattcacgacttaagaccaaacacatttaacacattgaagaacctgtacctactagaagcagatggtgaagcagtgacttaaaccacctatacaagctgattctccaactgcaggcaggtgtgcctagagtccaatgagtataagttgtagtcaaaattctagaggttcatctcaaaaggcttc

SEQ ID NO: 31016 - DNA, 715 bp, Bovine  19866881580135
tgagaacatgggagtcctgactaaaagagataatccaccagcagaattcttaggctgaatgggtgagcacatgggacaagatatcatcaaaggaagaaaacgagaaaataacaaaaacaaacaaaaaacaccttatgttattactagggaaactcctgtgttatgtgtggattgaataggacacttaacatatagtctgttatgtctgagaaatactctgtacataatgagctcaaactatcttaggaaacacatgcactagtgagggtcttagatgtaaggtattctactctactgctttgaaaacatgaaataaaagcaggaagagggaggaattaaaaatacttttatcatctccaaaaatcttagcggcttctatgattttgagaaataaaaacaaagaaaacgacagaaccagctgtaacagatggtactaattagtatcttagaattcattaggaactatgtcaaagttgactggctatttgcaaaaatatttctgataagttgtctaaactactttcataaatgtaatggaatattccaccacattttaccaaagttgaaaatttcaaaagaaaagacatagtgatatagacagtatttagttactattttccagtaatgacatttcctcatcaaagctaatgataaagcacctttctatttcctattagagactttataacagagggataaaggatggagggaaaag

SEQ ID NO: 31017 - DNA, 958 bp, Bovine  19866880430212
cccactccagtattgttgagtggagaattccatggacagaggagcctgacaggctacagtccatggggtcgcaaagaatgcaaacacaactgagcgactttcagttttcattgctgattagcaatgttgtgatagtttcagttggacagcaaacaaactcagtcatacatgtacatgtatccattctcccatcaaacccacctcccttccagacacaggggttttctcttactttcagccaaaaccttcttaaatgatgcaacttggcttcattcaccaaggtgatttgggttcacgagtcattggtagaagggatcaacacattttctttgtcagggcccagataataaataatctaggctttgtgagctgaatgtgctcacttgcagctattcatccccggtgttacttcaggagggcagccagagaccagtgtgaacacgggcctgccagtgctccaataaaactttacttacgggcactaaaattgggatttcatagaatgatcatgtcagaaacattctttcttaaaatgcgttttgtacaaccaattgaaaatgtaagagtattcctagttcaggggccgtccaaacctgtgagccattgtatgctgacctctgataaagaccaggcttttctaagagttgtttcatgcaggtgagaacttttctgggtattcttcggggctccttacaatctgacaaagatacccagtttattcattgatccaaaatgtaaacatgcctcttactatgcctccaagacagttggaaatgaatgcaaaaaaaaaaaaaaaaatcagattcaaacattgggaaagatttcaagttgcttaatgttaagcatttacagcagaatttatacggcatttgatgttcatatagcatatggtttggggatgttttgctgtatctattcaaaaagagaagcatctatttatcacagatggggtattatt

SEQ ID NO: 31018 - DNA, 1422 bp, Bovine  19866880500429
ctctggcttggaaaatcccatgggcggaggagcctggtaggctgcagtccatggggtcgcaaagagtcagacacgactaagcgacttcactttcacttttcactttcatgcattggagaaggaaatggcaacccagtccagtgttcttgcctagagaatcccagggctgggggagcctggtgggctgccgtctatggggtcgcagagtcggacacgactaaagcgacttcagcagcagcagcagcagcagggatgagacctggcacgctgcggtccatggggtcaaaaagagtcggacaggacttgttgactgaacaacaaataatgataatattgcagtactttgtggggttattttttacattggttatttttttccaatgtaagcctttaacacatacatgttttgccttcctgtttggcatctacacattttatttttttaatatttatttatttggctgcataggtccttggcatgcaggttcagatatgtcaggatctttgttccccaaccagggatcaaatccacgtccattgcattgcaaggcatattcttaaccactggaccacctgggaagtctcagcatttactcattttaaagaaggagcctcaaacagtgagagtgttgtcagtttctcttgatataagtgcaaagactagacctttggagcttagggttttttgtattttgaatatttatttatttggctgtgccgggtctgagttttggtaggcaggatattttagctgcagcagacaggatctagtcccctgaccagggatggaacttggccctggtacattgggagcgcagagtctcagccactagagcaccagggaagtccttggacttaagtttttttcatctgtaaaataaggatggtgtggtcaccctggtatgatggtgagaggtgactacatggcctgaaattgttaaacctgccacattcaaagagaaaattcatacttcacacattttttaaaaattgataatgtgccctcctccaaaaagagaaaaacaaaaaatgagattttctccaacagtgtgagctaatgcccaagacacaactctcattgttttattctagtaaaagcatcatatccataaaaagaaagtcataactcaattctatattcttcaaagaattaacttcaatggctcctaattggtttaaatgttaatgtttgcataatgcataatttctttattaaaaggccacagcagaaacacacattatcccatttccaaagaagcctcaggaaaaatctttcccatagcctcagatgatttaaaattgatctcctatagcttgtcctacttttatattcttaacagcagacaaaatagttcctttcaattttaagtcaaactgttttgaggacacggggttgagttatgttgctattttcagagtaca

SEQ ID NO: 31019 - DNA, 1344 bp, Bovine  19866880544562
cccattttatttatgtagttttattttgtggctttggtactatttgtataagctgtttcttttttttttttttttcagcacaagaggtcatgacaaatgaactgaatcatttgacactgagatcatttctactgcgcaggtgcagaaaccctgtctcagggcctcaaacacaacctcactgtttccagtgaagacaaaaccatgtttccagtgccacctcctgtttaaggtgtgagttttaaattttttaatttccgcttaaaatcatcactaagctggaattccatgataagaacaaagccagccttctgttccatggggatcctgggggtggggtgcttgtcttaaagttcctctgtttattttgagaataagagaatcccttattgcctcaaaggaccgctcatctacccccacgtgccaaagtgggcagtgttatatccctatttctacagcattggagtccacagagacagtgaggaaatgcggtggaaagccaacattataattaaggggccggagggaccaattgagcaagaaagatgaaaagagtcaacacttgagttggggggaaaaaatgaacttcagggaggcatggaagctgctctggatgtttccgatggctctgcgaccccgtagggagaagagctgtttaagacagtatcaagagtattatgaaactaagccaaatggaattaggtataagctgtatttaagcatgaagtacatcaagggatgtctcagaatataaaccactggctctctgtttaggttgattataaatggacaccacggtacactccaggagcttttcctattccctgatgtcgtcaaatccactgttgtcctaatgctttttattttttacattagtctcagtcatttaagaaacatttatgtgtaatttctattagattttggggatgattcttcttctccatggctttgataactatacatataataatggctatgattatttttttaagatttttcttgatgcggaccatttctaaagtctttattgaatttgttacaatattgcttctgttttatgttttggctttttggccctgcagcatgtgggatctcagttccctgaccagggactgaagccacaacccctgcactggaaggctaagtcttaatggctggaccaccagggaagtccctggctatgatttattgaccttttactcattcgactattaccatgtgtaatgggctgaatggtggcctccaaaagactggtccccttagaaactatgggtgtgatcttattgggaaacagagtcttttcagatttaattgagttaaagatcttgggatgaggtcattctggat

SEQ ID NO: 31020 - DNA, 2838 bp, Bovine  19866880633436
acatgtccttctctgcatctgtgtctcttattcctgccctgcaaagtaggtcagtctgtaccatttttgcatgtttggtaatggtcacaccctccccatgctccaaagaagcaacacttcctttttatgcaacttacatacaaaaaagaaaaaaaatcaatccctaggaccatatttttgttagtctgtgtggcttccttgttcatgaccatcaaatctttgttcattgtcaccttctcagaaatcatcttacatagcaccctatcatgtctatacatcccctgctgctgctgctgctgctgctaagtcgcttagaaggactgaaattgaaaacactgacaaacatgtggagccatgggaacgttccttcactgctggtgggagtgcaaaatggtgcatccactttggaagttagttgggcagtttcttgtaaacttttcgtattatccagcagtcttgctccttggtctttacccaaatgaattgaaaaggtctgtccacacagaaacttgcacacaaatgtttataacagctttattgagaattgcccaaacctggcagcaactaagatgtccttcagtaggtgaatggataaacaaactgtgatacgtccacacaatggaatattattccttgataaaaagaaatgagctagcaagccttgaaaagacatggaggaattttaaatgcatattgctaagtgaaagaaggcaatctaaaaaaaggctacctactgtatgattccaactctgtgacattctggaagaggcaaaaccatagagatagcaaaaagatcagtggttgtcggggactgtgagggagatgaggatgaatagataaagcacagagggcttttagggcagcaaaactattttgcatggtacacgacattgtggatatacagtactcatttgacaaaatctatagaactatgcagcacaagtgaaccctaatgtaaactatggacttttaattaataataatgaatccatgggaattcctaggtggccctagtaggaaagaacccacctgagaatgcaggagacataatagacatgggttcacttcctgggttgggaagatcccctggagaagggcatggcaacccactccagtccacttgcctggagaatcccacggatagaggaacctagtgggctgtagtccatagggttgcacagagtcgtacacaactgaagtgacatagcatgcaattaatccatattggtttatcaattgtaacaacatatactaatggaaaatgcaaataatggaaaagggaggataaatatataggacctctctttctgcctaatttttctgtaaacctaaggctactcttggagtaggaaatggcttcccactccagtatccttgtctgcaaaattccctggacagaggagcctggtgggctacagtccatggggtcccaaagagtcagacatgactgagcatgcatgcaatgcaatgcaaaaaaaaaaaaaaggtggctctaagaaattaaatctgttaaaaaattgcagctacacccataaccttagtcaattctcccttatttttccatggcacttaacaatttagctgttatgaaacgtgcttatttactgtgtatcttctttattgcttatcttccccaaacccttaggatgggagcctcctggagcaggagtcagtctgttttgctcactgatgcatcttgtgtgcccagcacagtgcctcatgcctggcgggtctccagtaaacatggctcagtaaatggacagaaggaatggctgggaaagttttccaaagcaggccttctcagcatgtccctcctacccctgcctgagcctttgactgtctttgactatagctttctgatcagtcaaggattacacttagatactgttctttgtggggtttttttgttgttgtttgttttgctttttgttgttgtttttttttgaaaatgcaattattttaataaatttctgttctttatactgtgacagttattcatagtaattagatttcttcttgttattctttaataatttacatttgtatgggcatatcgttgatttacagtgttgtgttagtttcaggtggattgcaaagtgagtcagttatccatgtacgtacattcactcgttttatagattcttttcccatatacatcattaaagagaactcagtagagttccttggctatacagtaggtttttattagttatttattttgtatataatagtgtttatatatcaagccaattatcccaatttatccctcccctcttatagcctgttctttcttatttcccctcttaagatatacgcataggtgtgtgtgtgtgtgtgtgtgtgtatttttccctgcacagaagatgaaatccatcccaaggtcttaagatttattaactgttgcctgagtcattccacatgatgtcaggggaggaggcaagctgtgtctctacttagaaataccctgcacagaggtctttgggtaattccctcgattttgtaaagatgttggttggcttaagtgattagcatgagatccttaaggaggacttaacttaagcatttaaggatcttctgtgtctctcggagtgcccctcctgggttgtctggatttgcacatctggaaggcaaatttcaaaagggtttccagcctctctgcttattttctgagccccattggagtgtgtgtgtgtgtgtctggcttgggggaggtttcctccttcaaagcactggaggtcagcctccccctgcaggcatgtggtctgcgttcagggagacctgccaggcccctccaagggcctccagctctcagaggcaaaggggatcaagttacagaag

SEQ ID NO: 31021 - DNA, 1315 bp, Bovine  19866880649237
ccaagcccatttaaccctcacaaaacctggcaaacattaagtgcaggttcaccgctctttgtgcaatgaagaggctcccacaaagcctgtgtgtgcgtggacagcaaatggacatctgcacagctgccatggctacagaaatgccctatttcctatagataaaaatttctgagcagaacttagcaagtggaagtctgataggtcacgtgaccatgcctgaaccaatagccaaagcccaggggaatggcctgcactgattggcccagaatgatcatgtgattctactggaggtggattcagagtcctaaagggatagattgccagtgaaaatctgcgggtagtttccagaatctaggggaagacctcaggctggaaaaaaataataccacagtatcatgctggatatttgtaaatatttctgtgttttcaggaggatttgtcaagtaaaacatcatttctgggaggatccgttagaaactaaaccacaggacagtttctgctcttcaagtagcaaacattttaaataaatttattctgtaatatattttcttcagaagaaaaccacagaagcatggaacgacatcaagatattttggggggagacacaggaaaatgagtgcatgcatgaaacgcacacacacgagtctgaacaaaggtctctagaacatcagattgcctgtcatgtgttattcggggggagggggcagtgttctctgatgcctcactgtccatcagctcgtgtgtgtatctttcttttccccacccctgtttctgaaatgcctactgtgattaagaatttgcaagagattttcccaaagctgcctgcgtgggtgcatctttcagaatgttaagtaccccacttttgacatatgcccttggactgagtttttaaagatccctgacagttattgacagccagtaattagtctgtagaagcccgacttctgccaagagcctgacttaccacctctgagtcatcttctccatcagcctttccctccacgtcatcacttacaggaaggcaagctctcctgttctcaattccatgctgtgctcacccctggcccactttgaggatggctgcgtactgtcctcctgaatggaccttgagaatatcaacatgggagaaggaggctcaggccgttggcactatggagtgtgttagaaaagaattcaagccctgtattcagaactcatgagaattcaggtgagtgaagtgtggttatttttcaggtaccctaggcaaagtgcagttgcttaatttagagtccaaaccaggatagatcggagaaggaaatcgttcactttcaacaga

SEQ ID NO: 31022 - DNA, 2707 bp, Bovine  19866880724613
ataaggaaaccaaagtgtataaaggttgagtgggatattcacaatctgacaggtagtaagttgtgaagctataacacagacccaggcagttggacttcagaatccatactctaaatcactataatatggtgtttcactacatataaagtaaattaagataattgtgtctggttaagttctgtgctttttagagagaaaaactaaggcaaagaaacgttgaataatttcatcaagatcatagtttctacttgacttggtgtcattaacaaaagcataacaatatattctcttacttcctatattaaataagcaatcaacagccctctctggctacttctcttcttgtctgtttattttcagaggaaacctccttcaaagtttttcccatattctgcatatctaattcttacctcatgctactctacttagtcatctgtctcaaaacgcccctgagggcctagcagtgtctctgtcattattgatttctcagcagcatttgagagttgacctttctttttgaaacatattttttagcttttattaaatcataatcacctcattttcctcctatgtgatagtctttcttcctcagatcttgttctctcataggtgatgtgtgtggaacctaatctccactcttgaaacaaacattctcgtgttcaatcctgggtatcctttattcacaattttctctgttcccatggctttaaatactagttacagtcagtcttcattattcatgagttctgtatttctaaattcacctacttgctaaaatttatttccaaccttcaaatcaataattaagtgttttctcagtcattagcagacgtgcatatgaacagagcagtgaaaaatttgagtccctgaagtgcatgtacccggctgaggtgcaatgaggttagcatcttccagttttacttctcatacttgtaaataattgtcctttttgcagtgtatttagtgccttttattttttgcattttttatgctttttattgatgattttgcttttcaaagtggctctcaaatatagaactgacttgctacctaatatttacaatcacaagaaggctatgatggtccttgtaggaaaaaatgtgtttgctaactttcattcaagcatgagttacaatcctgttggccctgagttcaatgttaatgaatcaacaatatgtatcaaatatggtgtctttaaacagaaacatatttaaaacccgattaagtattgactggttgataaaaaacgttatgaccagaggctccaggaatctaaccccatgtttctccttgggccaatgatagagtctttgttaattccatgttcccagaaacttgacagaacataactactatgaatgagaactgactgtatatgcctatgttccccaaatctttgttaaacaaatgagtgaatcacacaattagttcaagaggtagggcaaggtcattcagagcatggtaataagtttcaattttccagagtgaagccattggaatagtttaggcaaagtataggaagcagggagagatggggaaaagtataaagataaaatttctgttttctgaagttcactatgtggagaatgaattagaagatggagaagtgaaatggggagaccaagaatgagcaattgcagtatttaggtgaactatgattgtggtttaccctagcttagtggcagtagaagcaagcaacaagagacattttaaatgcagaatgtatgagatgagcggctagactggatgtgggtgtgaggaagagggaggagttcaggatgatacttaatttcggctgtcattactgtgtacacggtaggaacatttaccaagaataggaagactcaaccacgtgaaatctactttaatatctcttgtatctcattagagatctgtttattacttcatttacttgatgattatagagtacctactacgcaccaggtatcatgctagttgtagagttttttggtaacggatgatttgcattaaatccccaactttggggatttttgaactctacatgtaatatattttctcatttgcggtcatttatttgtacgtccatcctgggttaactggaaaaaaggtaataatttttactttgtgttatttgtattcaatttagttaggcattccaaatgtacctgaacctcttatgtcacatggcttcattatcatgctggattgtaattacttactgatccatttcttcaactatatcctatcctctcacagggggagtacctggtctgtcttatttggtgctatagccccagcaccaggcatagcactcggcacgtaggggttctccattactatactaagggtgagataagatacagaggactgtagccataactaatgataatctataatggcaaattttctttcctaggctgggtttttttcctcctttagaaattactcatgcatgttcccaacagtttatatgaagactccaaaagcatactttagactgaaagacaatgttattattcagtaagaacatggagaatttcatttgtcttactcccacatatagcagttaagaacaaatgaaatattttctttaatagtttctgtgctttatatgtgccatttattgcttaaccaaaaagaaaccacaataaataaagaagtattattttcatggtttctggatatataagtctgtttgcctttatatcattatctcataacttca

SEQ ID NO: 31023 - DNA, 1844 bp, Bovine  19866880830707
tacttttgctttattgactatgccaagcctttgagtgtgtggatcacaataaactgtggaaaattctgaaagaggtgggaataccagacgatctgacctgcctcttgagaaatctgtatgtaggtcaggaagcaacagttagaactggacatggaacaacagactggttccaaatcgggaaaggcatacatcaaggctgtatattgtaaccctgcttatttaacgtatatgcaggaggagaaggggacgacagaggatgagatggctggatggcatcactgactcaatggacgtgagtctgagtgaactccgggagttggtgatggacagggaggcctggcgtgctgcgattcatggggtcgcagggtcagacacgactgagcgactgaactgaactgaacagagtacattatgagaaatgctggaatggatgaagcacaagctggaattaagattgccaggagagacatcaataacctcatatatgcagatgacaccacggttatggcaaaacgaagaactaaagagcctcttgatgaaggtgaaagaggagagtgataaagctggcttaaaactcaacattcagaatgctaagattatggcatctggtcccattacttcatggcaaataggtggggaaacagtgtcagactttatttttgggggctccaaaatcactgcagatggtgactgcagccatgaaattaaaagacgcttactccttggaaggaaagttgtgaccaacctagatagcatattaaaaagcagacacattactttgccagcaaaggtccatctagtcaaagctatggtttttctagtagtcatgtatggatgtgagagttggactataaagaaagctgagtgctgaagaaatgatgcttttgaactgtggtgttggagaagactcttgagggccccatggacttcaaggagatccaaccagtccatcctaaaggaaatcagtcctgaatattcattggaaggactgatgttgaagctgaaattctttggccacctgatgtgaagaattcacatttgaaaagaccctgatgctgggaaagattgaaggcgagaggagtagggaacagaggatgagatggttagatggcatcaccgactcgatggacaggagtttgagtaaactccaggagctggagatggacagggaggcctgacatgctgcagtccatagggttgcaaagagttggacacaactgagcaactgaactgaactgagaagttgccaagcaaaggtggttaccagaagggaaccagcagggtgggaagtgatgataaaccccatctccacctttcaggcccggggtgcgcaaattcgcatcacacacagagcagcaagagcttatcagctgcagctgcactttttctttagaaacttcttccaagtcttaccttaaaatgatttgctaaatgattttgctaaaacatacttgccaccatggccctgagaaggccaaggtatgcttaagtgacaaagattaaagacacattagcatataaaagcccctcctttgtcctaaggcagggatgcctcccacctcgactgtccacaaggactgcctcatgaaatgtgacttcacttgaaattgggttttgctgcatctgaattttgctcaagactggaggtttcactgaagctacaaattgttctttccacttcatggttcaagaaaataggaggattcttgttgactggtgcagaggctggtttcatctctgacttgggtggtgagatgagctgctgagatgagaggaaggcacaggttttaaagggcccaatcttgttaattacgtgttttctttactgaggtcgatgggtgttc

SEQ ID NO: 31024 - DNA, 910 bp, Bovine  19866880997004
ttctattttctatccttgaacagcagaagaagaaaggagaagatagttaatgaaaagaggggaagtatttattttctgattatcctaagtaggagaaggaaaatgctaaaaagctaaaaagttgcctttgatttctcccaggccctgtttgctttctaatacctagaaaattgatcctcttcatcctttttaatttgtgtgtgtctccacccacaaccctctgcaggaaagagggctgcatattttgtgaggttgattaatcaatgtattatttttttccctctttccagcagttcagggctacccatttttcatcagacctattgttacttggcagaaaataaatacaccatcaaaaatgtattgccgtaccaactaaaagatgaaggagagtgaacatttcactttgggtttgtgcaaacaatattgatttatgcaaaagaaattcccaggagagtctttataatcacacaagtttattcttgattggtggggtgagcgggaaactttgagccataaatcattaatttattcatttattccttgagttaataaatatttatgaagcacctactaagtgcaatccctgagtacaaagcagaacagaccaaaaaaggttctaatggagcttacattttgtgggttggcaggtaattatcagacagtaaaacagagtaacttaaaatacagtgaaaagtgcacagacaaaaatgaaacaaaaattaagctttcttaagtaagctttaacaagttttagatccagaaatgatttgaaaaagaaagggaagacaaaagaacagaagaacaagcaattttcacaagtgtacttgaggcagtattcccaagtgtggttttgtgcatggctgtagtccgtgggttattatctttaaatggtgataattgcgtattt

SEQ ID NO: 31025 - DNA, 1417 bp, Bovine  19866881048752
ctcctgtattcttgcctggagactccccatggacagaggaagcctggcgggctacaatccatggggtagcaaagagtcggacatgactgaatgactaagcactgcacacattaattaatttaactttttggcttcattgggtcttagttgcagcacatgagctcttctttgcagctcatgggcttcccattagttgtggctagtgggttccagagagcacgggctctgtagttgcaacacacaggctctctagttgtggtacatggacttagttgctccacagtatgtgggaactttctggaccagggatggacccctagtttcctgcactggaaggtggattcttaaccactggaccaccagggaagtccccttgaattttagtgattttgatcatctttgcatgtttattgactattcatatttttctttttgcaagttgcctgtacattctttttaccctaacagtcttccaagggagagaccagtgtcatcctagggttgtatactggttaatgctattgagacataaaattgtgtgactactggtcttcgataaagcactaagaagaactaggataccccttataattaatatttggtaagtattcactatgtttgaggcactatatgtccctacttaatcccaatagcagcccagtgtgagagaaattcttcttcttttataggaacttctctgaaactcagagaagtaaaagtacttgtttaggatcacagaattagggacagcagagatgaaattaaaactagagcactgctgttaaccaacttacatgccctcggttttttagctaacaccaagaaacaggctaaagaggactaaagagtctgataattccacagaattatgaatttaggaagctgaaaattttctaattggttgcctaaaacagcccaagattaatttttagtgtatcacgcaacagtctgaatactttaccgaagataagaggttaaaacttgagttttgaatcatagttttatcacactcaagctgtgcgaccttgagcaaatctcttatcctctctgaggctgcttacttatgggtcaaatgagaataatatttcaatttaccaattctatgatatttgtgtagatttttaaaaaaaatcatgacatgagtacttaacacataatctaactagcattatcggtcctccgtgagattgaacataattattactaataataggcatatttacagagcctgcagggctgtgtgcagaaggtcacgtttgactcttgagtaaagacaggatgtaggttagaaggaaatgatccaaaccctcagatgtcacaaaaaaagaatgtgtcatttctaatccatttcagccccggcactaaaatgtcataaaacgtgaaagctcatttttattctttgcctccactaacctca

SEQ ID NO: 31026 - DNA, 943 bp, Bovine  19866881112174
cttctgttctgctcttctagcatggtgtatgagtaattgggataagacatgacactttccagcttcccttgcagctaggtatgaccacgtatgtacattctgttcatggattgggaatggaagtgacatgtgcaacttctggattctgcctttaaatagaagaggcaggccccctaccttcccttggtccctccccaggggccagaattttccatggtgaagagccatcttggattgtgtccaccacagtgacaacttagttggagcaacaagttggcaggagtctgggcccctgatgcctctgcagactggacctgcctcacaaactgaaacatttaaacaaaaaaaataaatcactttctttctttctaaatccatgatctggggtggggggaggctctatcggttgacccttttatccaaagctacacaaacctacatggtaatccacatggttactagagagtagcttccttttgttcaccccagtgcagaaatgagagggtaacatccttggccaaagagccagtgaggtattaaggtgacttgcttttatccttaacttaagcctcagtgcttcctcccaaggtggaaaattaaaagcatgatggatgaggtgtctttgccatttagctggcctagtttacacaccgctggtgagaaaagactgcacttgagatggaacacgtaaggaataataaggaccacttatgaagaattaatgtgatgtggaaaatggaaagaaaaaagttattaggttacccaggagaggcgtggagagcagcctacagaacaagctgtcactatgtcttagaggagagaaggtagggagaaggctagaggactaatttaaggttattagaataatctctctttgctaagtgactgcctctttgccagactctttttcctcctgaacaaaaatatcaagtgtattgaccaa

SEQ ID NO: 31027 - DNA, 1330 bp, Bovine  19866881136859
atattttatatatatatatatatatatattcagctatatattttacatataaacactaagtgcttctggaatattttaaggtacactgacctttcctggaatgcaacgtctgtgtccatcatggcctgcctgttcttgatttgctgagaaactgacccagagttgttcactctttctagaagccacatcaccccacgtgctgttaactgtggtgactgtccaaacaacacgcagatcattcctgtctcattcgtggtgagtctacacagagatgctatctgcctgaagagctgctttttagagtggccatgcctgagcatctctagaccaaaatagacaattatttgattataaattgttccctttttattaatagcctggtgggctacagtccacggggtcgcaaagtcagacatgactgagcgacttcacttactcacttaggactattttggaaaatattaattttggtattaatttagatattaattttggaaaataaaatttatgttggtgggctatattatctatgagtttaatttcagaataccaaagggacatcttaaaatgttagatatagtggatgtcagatctcacctagttaagaacctgtgggacttccctgaaggcacggtgattgggaatctgcctgccaatgcagggacacaggttcgatccctggtccgggaagattccacatgctgcagagcagttaagcctgtgtaccacaactactgagcccatgtaccctagagcccatgctctgcaacaagagaagccaccacaatgagcagcccaagcatcgcaactagagagcagcccccactcgccacaactacagaaaaacccaggaagcaacaaacactcagcatagccaaaaataaagaaatgaaattatttaaaaaatgattctaatctccagcattggatctacctgtaccattgtcttgtggagctgaggcataatattgtggctgagctctgcccaaactccagatttgtgagcaaaataaatgctgttttaagcccgaaacttgggagatggtttgtcacacagaaataagtaactggactacctcctttccaaacactgcatgcactgggaaagaggaaattccctgttatgatgaagctggagagcaaaaaacaacatatggcttctctgtgggatgtggactggcttcatctcttcacacacccgtcacttgtaagagcttacttcaggggctcggggagtttggcaaaacctcagtgaccggaagaaatcaggaccaagaacctgcccaagaaaatccttctgaagcatctagggggtgctattctatttaat

SEQ ID NO: 31028 - DNA, 1681 bp, Bovine  19866881190997
tggagaaagcagcgtgtgcacctccaccaggggttctgaacctgggcacattgggcacttggaacttgttaactcgtgttgggggacactgttctgtgccttgggaggctcttttagctgctccctagatgccagccctacccccatagttgagacaaccaaagatgtctccagacatcagcacgtggtccctgcaggacatagccacccctgattgacaatgactagcctgtgcagatgtgcttttctcctgaccccttggctgtgctactccttggtttgggggtctgtcggggggccctcttccctcatcagatctgaacagcaaattccacgattcctgggtctgtgggaagatccccgcccactccaatcaccaatcctcatcctacccctctaggaccccttgtctgtgggtgccactggatatgaaataaaagaagaaaaatgaaaaggcagggcgctcagctgagtggagcatgggcgcatttggaaaggccgagtcattaatctctcggttctctctctcttgccctcttcatctccgcagagccaaggtgaagaagggggtgaacatcctgagcacgcggaccagcgagcctcggcagtgggacgtcaagcaggagatggggaacggaggcaaacacgccaccaccgctgtggtgtgccagcgactggcgccaggcgcgcgcaacaggtaagagggaggggctccctctcgattggtgacccaggcttccaagacccgttctccacctaagagccctgccttagactcacgttaaccactgcttagtcgagctgtcacaccttggttcgacaatctggagacacttaacatcaccagcaggaccttttggcatctccggtaggaaggacagggccctgattcccagggtctctcctcttcgggttttgaaacagagattagcttgcaaggtctagtctgctttgttcaggctcattcattctcctcatatacactcatgtcctggaggctgtggcatctccggttgcccttgcttatcagaggctgctttcttacaacgtgttcgccctttgtgcaaagtgtgtgattctgtgatttatactaagaaatacatatttggtctttgtgcctgttcctggcacagagctttgaaaacccttggactttacaaggatgagaacatcaaagtgactcttgtttatgtcaataaggtgacttttggaaagcctcctagttcaccttaagatgcaggctggttgccaggggaaccaaggctgtgattagaagcctggagtattcagccccacctcctggcctcctgggtggagaggggaactgaagactgagttcagtagccagtggccaatatgagttaatcaatggtgctcatggaatgaagcctctttaaaaacaaaacaaaagactgagtttggagagcttccggggtggtgatcaggtggagacccagggacagtagcacctggagagggcctgggaacttgcccatacctcgctctgtgcgtgtctttcatctggctattcctgagttatagcctttcataataaccagtattttagtaagcgaagtgtttctctgagttctgtgagccactctagctaattaaaggaacccaaggagggggtcatgggatccttcgatctataatagatcggtcagaagcataggtaaca

SEQ ID NO: 31029 - DNA, 1841 bp, Bovine  19866881200032
acccctacattatatcctgccccttccctctgcccactgggcatcactaacttcttccctgtatctatgactctgcttctgctgctgctgctgctaagtcgcttcagtcatgtctgactctgtgcgaccccatggacagcagcccactaggctcctctgtccctgggattctccaggcaagaacaatggggtgggttgccagttccttctccaatgcatgaaagtgaaaagtgaaagtgaagtcgctcagtcgtgctcgactcttagggaccccatggactgcagcctaccaggctcctccatccatgggattttccaggcaagagtactggagtggggtgccatcgccctctccgggtatagtcactagtttgttgtattttttagattccacctacaggtgatatcgtacatacgatatttgtctttctctgtcttatttcactcagctaaaggttttaaatcatgcaatcagaatgcttttgaatcaggtgagatttcttccccctctctgaggttttaattcagattttaactcttggggttgtaagaaataaacagttcacacttctgatatttagggaccctggagcagtgacgtgacaccaaagcagctgcaaatctggacttttatatatatatatatatatatatatatatatatatatatatatatatataatatacatatatatatgaaatatataaatatatatatatatatatgaaactgaatcactttgctgtacaccctgaaggtcctgcagcattgtaaatcaactatattttaattaaaaatcaaatttaaaaaatagaataaataaaaagagggactcaaaaaaggaaggaaaactcttttactgcaatgactactcactccattagctggcctctcttctctaaaatgtgcccggatagaaagggaccatatgtcacagggccacttatgcatgtgctaaattgtttgcaacagacaaagctgtgatctggggaaactcgaaaactaagatgacttttaaatggttgaaagaatgtggaacaaaggagtcaggacttggtcagaaggactctgcttttttctctgttcacagaactggagtcaattttatgtttaaatgtttcccacaacagtcaaatcgttctcaaatgtttcactgaagcagggctgcctggcaacccagatgtgttgtggggcagggaggggagctggggagggggccccaggcaggaaacattatttcttcacttcttcccaagcagaaagaaaattgttccttttctctcttccagcagaatacatttaaaatgacaagctggagaaaatgaaaacaaacctttccttgggagaccctcaacagggaaatgcatttttgacacaagtgtgggaaaatgagtttccagaattttctgaattagctccaaattggcagtcaaggcaaacaccattgtgttggacggtctcctcctcttcaggatgagtctggggactgtccagtcattctcgagggttctacttgaccctgcagatggaagctccgttggaaatggaggcctgacaattatccagggcaagccaggcatcgggaaattgcctttgagggcttttggtattctcagacataaaagggatcaggagaaagaaaaacacactccccaaaaattcaattacaacagcgcatacacagactgtgctcagaaatgaggggcatggatttgaacctgtaggtctgactcccctagtagagaagggtttatcttccatgtggggaaggcacacattcctattcatagcatcaccatccccccacggggaactctctaatggagctgccaaggggcac

SEQ ID NO: 31030 - DNA, 1586 bp, Bovine  19866881245879
tgtatgaggctggacacttttccttgttgcctggaactccaatgtggctcagggtagtgctgtctcctgctcttaagtggccacatggacgtcgtgcaatatgctcatccagtcctgagcatcaccacacaaaccaggctttctatggtgcccacgagcctgccctttcatggtcctctcttcatcctctgaacactctcttccacctcaagtctgccaccttctttgttctctactgtaaagaataatgaaaataaagatcatataacaacacttggcacttccctgggggctcagatggtaaagaattggcctgcaatgcaggagacccaggttcaatccctgggtcgggaggatcccctggagaagggaatggctacaacacgacacttgtggccaggagttttctaagtgctttattttcacaagtgccctatatcattggctccccgttttgacagatgaggaaactggggtgcagagagtttaaggagcttacccatggctgcacagctgatttctcctggaattggaaaaccaaatgtctttttccagaaacctctttctttccaagaatttgggatgtatcttgaactttcttctcttttagtcagttgctattttgtaatcattcgaccacactcctgtaaaaccatcacactcccttccagctacattgctcccgttagtttatctccgctcatttttaccttaattatttcagtgcctcctaactgctacagggagatttctaaaatataaatctgttctgcagagagaaaaccaataaaacctcatccatttggcagcctttgttaaagctccagctccacaacacggctcccctgggccctcctgatctggattcttattttccagctgatcccaatcactggaagcttgcttgctatgcctctgtgtctctgaattctgcctctctgctcaccccttctgcctacgactccttctacactctaccagtttctctctcttcccttggcccactccgccctattctttggggaggaattcaaatacaataccaacagcagcagaagtgaaacacgagaagaccacagcctgatggcatcacagcagccagtttctgtagccatggaagttctccatagcaggactcaactgaccaccattcttactgcttacaacaaagaaagtcctaacaaagttagcacttttcttgttggtttatggttctattgtccttttaaactgagaattttgtccacagacttgtgtaattgccttcctaaacccctcatttagcacgggaggtggtaggcaatataggcttagctcgctgaatgaaaaaacaccacagtaatcatctactcttggtttttataaaatcagccttgtcctttcagggtaattaggatcctgtgaatttaagcggacaaagcagtaaatctaatctaggtgtttttgaggagcaaccctcttggaaagcaggatggcattcttgctcccttctgacctaaattccactggtaacagaaaataaaaattcagtcactggaaaatacttgagatcctctacttgggctcgcttctcaggcagccaagaa

SEQ ID NO: 31031 - DNA, 1499 bp, Bovine  19866881266384
tcttttcctgtgaagacccccgacagatctgcaaatgggtgacaccacccacagagcccccgacacttgtggaggagggcttggcagcctctgcctaagctgaaatgctgtcttcttttgcatagaaaacacaagcccatcgaattctcctctgttctcctgagtgctccctgttctgtcccacttaaccagtcacggagcattttagaaggctctgtcaatcggaggttggaataatagcactgccattacctcaagcattgttgaaacatgaaggataaaatgtgtctcattattcaggttctcagaagtgatggtattgagccagaatggtcccattaactctcaaggccttacttttgatgctctccacctttaaataataatttcttctcaaggaagggaagaaaagttgaaggctatcattgacctcaaaacagcagagtttctcacatctgaagaagcatttatctgcagatgaggcttttggagtttctctgatgagagtctgatgtactgtttttagagtcaagaaaattctcccacttttgattcgaaacaatgaagaatttaaaatgcaggcaaggaacagaagtttctggtcttgttgggaatagcccggatgacaccttttggggcccgcttcctgctaagttctgcagtaattctgcagtctacttttgcttccagtagaccacttatatatgcattagtagatgtatctacaaagtaaggaattgagttagactgtatatcttatgattctgaacttcagttttcagatcttcttatattggcataagtcttagtttggtacattaaagctacaacaataatagcaatagctaacatttatttcctgggctccaaaatcactgtggatggtgactgcagccatgaaattaagggatgcttgctccttggaaggaaagctatgataaacctagacagtgtgttaaaaaccagagatatctgtttgccaacaaaggtccgtgtagtcaaagttatggtttttccagcagtcatgtacagatgtgacagttgaaccataaagaaggttgagagccaaagaattgatgcttttgaacagtggttgctggagaagacgcttgagcagctcttggactgcaagatcaagccagtcaatcctaaaggagatcaaccctgaatattcactgtaaggactgatgctgaagctgaagctccaatactttggccacctgatgcgaaaatacgactcattggaaaagaccctgatgctgccaaatagtgaagattaaaaggagaagggggcggtcaaggatgagatggttagatagcatcaccaactcaatggatgggaatttgagcaaactctgggacatagtggagaatagaggaacctggtgtgctacagtccttggggttgcaaagagtcagacatgactgagcaactgacaacaacaagagcatttattggttgattacattacttactctattctctttggtcccctcat

SEQ ID NO: 31032 - DNA, 1065 bp, Bovine  19866881361388
aaaagtgagcatcagaactaaaggaagagtgtgattccttatgtagtgatattttttaaagaattatatatacttagacaagcactgggtaactatggagagtgtgcacacacacacacatgcatagagagagacacacaatttaatgactatctgtggagacaagaacagaaaggctataagataaaggaaaattctaaactcagtttcccctcccccgctttatgctcctgtgtactgtttaacttatttttattatggacattatcgtgttttttattgcatataaacattgatttgtttcactgttcccagcttcaataataacaatagcagcatttatgttacaaaacattttttcttatgtgtcaggcattatacttgtaaagacttcatgttgtttcatgacattgccacagaaaaggtaaacgttagttccattttacagattgggaagtggaagctgagggagattaataagtatcgaaacacacgctactactcactcaagtctcaaacccaatgcctgcttaaccactgtgctttcaacactttccattccaagcagattgcaggctgaaatctcacacacacatttttataactcattaactcaaatctctagtgttttccaggttgtactaaggaaaattgggctatcagtttaggataatttctaggaagaaagtttttattggcgcttaagtgccttagacttatttcctattttaacaccttccatctcaataatcaaaaaatggaatttgtattcatttctccaagttgctgaaattactttttaaaatagtgatgtgtgtttcacagcagataatttctgcacctgtaatattcccactccatcaccaatcttttgactaaattgcctgatgacaatttgcatatcattcgatcattacttgcaaatttcactggtaaagttcagcttggagcggtgacattttcctcagataagtggttcagtgaagccaaattgcatttattgatctaaaattaagtaaatatttgataaaatccaccatgtatcccattgaggaagaaaaaaga

SEQ ID NO: 31033 - DNA, 1060 bp, Bovine  19866881468378
tgaacatctgtcatctcatatagatacaacattaaagaaatagaacatatatatatatatatatatatatacacatatatatatttccttttgatgagaactgttagtgtttactctcttaactttcatttataacattcagtagtgttaatttatcatgctataccttacatcctaatgtttaattatcttataactggaaggtttttgactatatttattcaattctccctcaatccctggcagaataattctacttaactctggtttcacatgggcataaccttggaagctttattagggaaaaaatgatatccaggcgcaccagagaccatctgaagagaagtgaggaaggtgtttttgaaaagcactggtgttttggaaaagctcaccaagttattctgacatgcagctggggttgaagacattatatagaagagcagagattgtgagtatacattctttcagaatgaggatgatatggaccccaaaaccagagagaagcggtagagtgagaatcagactaccttctcaactcagctagaaccacacttgcttagaagacaccagggcagcgggatgctacagaggggaacggggaccagaacaaagctgctccaagacatgtcacatctggtcagtctcctccctgtgtctttagcaaataaatgaggaattgatcagaggttgtaggaacactcgcagaggtctctgagccactgtggaccacatcacattcacttgtgtatctcaagtaccaaagcacatgcctggcataagaggggagcttgctaagtgcttgacggatggatgaatggacagacaggttgggtggtgagtggagcatgctcctattttctattgaaaaataaaactttcctttatcccctctagtccttttagtcttggctgttcatgctgccacagagaccctcagctcatcaattacagacattaactgtaaattatacttttgcatagttaattcagcctcttcattatgtatttagtggtgctcagcaggcataaaattcaatagcaagctttggagcggatccaa

SEQ ID NO: 31034 - DNA, 1337 bp, Bovine  19866881526802
ccttcattttgtcatgtgaaaactaagatctttgtactgtcggccatttctgaagcagcagaattgctgggacaagcttgctaaaaatacatatgaaagaaaaaagtgaaagtgttagtccctcagtcgtgtccaactctttgcaaccacatggactttagcctgccaggttcctctgaccatggaaattcccaggcaagaatactgcagtgagtagccattcccttctccaggagatcttcctgactcagggcttgaactctggtctcctgcactgcaggtagattctgaatgaccagggaagccgtgtcaagtccccggtgctatgcctgaaaagcatttgctttatccttgtattctagttataattgtgagggagtaagccaagggattgaaaggttttgccaccaaacaaagtcaacttaaagctcttttcctttgctctcttccagaagcagcagtttattcaatgaggttgtgcagatgaactttgaaatcgccagcttcagcagcctctcagggagccagcccatcacctggcaagtggaatacccacggagggggaccacggacatcgcagtgtcagagatcttcatcagccagaaggacctggttggcatcgtgcccttggccatggtaagacttttgcgagcatggatgcacctgcattcagctatctgattgcaccttgatgtccttcttagcttccccaggatgttggctgcaattgttttatgggatgtttgcattcaaagttttccatcttcctacccgcttggaagtcgctacttttcattaatccagcctttctcaacttcaggctaattttatactggctttatgacatttgctattttatgacatttgctattcccctgtgccagatatatagtatttacttactttttcttctcgaactctacagcagttctttttatttctgttccccttttataaggaagctttaagccactacattattaggatgagtgtggtttgctgctggtgtaaaccaccccccaaatcttaggttcctcatgcaacctaggttggtcttgcttataccacatggcttagatgatgggctctgttccaggcagtccctctgggatctaggctgatggatatgtcatcatcttgcagctaaaacggcagaaacaacatggccttcttggaggcaaagatagaggaacagtctgagtcacatgcaagctcttttaagcaatggccaacggattacaaatgacactttcacacacatccttgggcagaaggagtccccatggccccatcagatttcaagaggtctgggaaacataggtgcagaggaaaagtta

SEQ ID NO: 31035 - DNA, 1087 bp, Bovine  19866881536339
tttgaacttgtgctcacaagtcaggggcaaaggggcctataatgaccaatattgcctcttgagagaaaagacactcattagtgtgaaatgttgcataagcatgttagcatgcgtgtctgcctgcccctttagctgaggcccagcaatctgagcttttctttctctctgccatcagaatataccagctgccgccaccagggggcactgttgactctataaccatttggaggctgccctgccggtgggttagggagcagagctgtttcaaacataaattaagggcattggcgttccaaggttccaagtatttgaaacaacacaattttggcagttttccatttgaggctcaatctttgtaaaaggccctcagagagttttaaggggagtccagaacattgtagtgggtctagctattggatacaaagttcctttagttacctggatggtctcaacctgagaaaggtggttgaacacagtgaatcatatgtaaaagttatgagtatctctccttcccagaaactggctggatctgtaatgaatcttaagccatgacatagcttgagctgctgatcgcaggcggccaggagaggctctaaaacgcagattaataaataacaccatataagtgctatgttgcatcccgaagtcatgcctgagtttgaattgaattacttcctatggaaaaatgcaaagtttaggtcctgatgagtcatgactatcagacggagaaaacaaaaccaaaaagccttagaggtgaagagggtgacaccagtatcatggctgaagccgccgcaggtcaatgtcaatgaccttggagttagagtcatctgtttcttctctctggttattatggggactgcccgggagtaacaatcgctcttcctgtttgggggccatactatcttcctgtcttgttcttccttccacaaagactctgccatcctgtctttctttctttttttctttcccatcttcactgttaatctttcaccatccctgtgatcaaacactacttcctcaaaggtatcaatcagaaattattcaacaatatttcttgagttcagggtatgtcctggctctgtcctgg

SEQ ID NO: 31036 - DNA, 1102 bp, Bovine  19866881703476
ctctgagtgtgtgggaccctgggaggtctgtccatctcagctctgctggcaaagctcctggggcaagtttcccttcctctgccttccttggtttccatattttccctcttttacaaacagaccccaacaaacagctttgagaatgtggagttgattttggagacacgccttctctattccagggaagggagaacaggtctttagaaatgacctgaactaaaggtgtgaaatctgtgaaggaagctgggctttacattcaagaaaaatgcagctttagaaagccagggaaaccctcttggtggttctgcatgttagagacatggagcaaccacagtgcaaattagaatgaaaccctccaatgagccactgatacagaagcaaaagagattgtctctgtctgattactgttaacagtttctagtttgcttgttttatattaaatattttaatgttacagcaacttggtttaatttttgttccatttttaaaatttttttaccacaggtgcagtattggcttcatcgtaactcttgttccatgacatactttcttctttgcatcatgtgtgactcactgtatttatataataattgaattggttatgttttaatagtgtactaagcgcctgtgaacccatcacccaaaacaaaagctggcaccttggcatacttccacttaaactgaattttttgagtagctatcaccgataagtgttttaaaatgtagttgcataaatattctgaaggcttgattttatttttctgtttgctcaaaaaaactaaacttttccccagacacgtcttgaaatcccaggtaggagttcttaagtgctcaaaaccaaatgtttcatgattgtcttctgggtaaattatttcttctctattcaatctgtaccaagagcaataacgtactcatttttttttctaagcaaaactgtctcctttctcaactgatttctttgaggaacaaagccaggaggaaacccagggtgccatgtggttatataataaaaagaagtaagaacagacactcagcaaactcaactgcttgcaaatttatcttttcaagccagagatgttcattaaggttctagggttccaga

SEQ ID NO: 31037 - DNA, 3694 bp, Bovine  19866880017586
tgaaagtggagagtgaaaaagttggcttaaagctcaacattcagaaaacgaagatcatggcatctggtcccatcacttcatgggaaatagatggggaaaccgtggaaacagtgtcagactttattttttggggctccaaaatcactgcagatggtgactgcagccatgaaattaaaagacgctcactccttggaagaaaagttatgaccaacctagatagcatattgaaaagcagagacattactttgccaacaaaggtccgtctagtcaaggctatggtttttccagtggtcatgtatggatatgagagttggactgtgaagaaagctgagcgctgaagaattgatgcttttgagctgtggtgttggagaagactcttgagagtcccttggactgcaaggagatccaaccagtccattctgaaggagatcagccctgggatttctttggaaggactgatgctaaaactgaaactccagtactttggccacctcatgcaaagatctgactcattggaaaagactctgatgctgggagggattgggggcaggaggagaaggggacgacagaggatgagatggctggatggcatcactgactcgatggacatgagtttgagtgaactccaggagttggtgatggacagagaggcctggcatgctgggattcatggggtcacaaagagtcggacacgactgagtgactgaactgaatatgttattattatcactcctattaaactctaagttctcagaaggcaagatcagtgtctgtttatatttgtagccacattactagtgcctggcaaagtactttaaacatagtatgaactcagtaagtgtgttctgagaatgaaagacacatgcacaccagtctgattagttcatcactgtgcgtttaccaagtgcctacaacacattcaggtactgtgttatatgctagggacatacagttggggaggcacttgacataatcttcacagtagctgtatgcagtaggtatactgtttttatttttatcattattttatcttaattccttgggatcttaattccttgaccagggattgaatgcatacccactgcagtagaagcacaaagttttaaccactggaccacagagaagtccctaaagtaggtattttttaaaataaaagaaattttacagatgagaaagccaaggcacagagatgtcaagtaatcttctagggtcacacagagccaggatttgagttcagttggacctggagaccccaaaccctgtgctccacgctcttcccactgagcacaccaccccacataatctagtccaaagtcgtctcaccctagatctaaccatcaagggcgatcacactatgagatcctttgcagaaactgttttctgcctcaggaagtttgctcttttgcctcaagggctgaaggctgttcctaaatgtatctgctctatcaccttcttatctcctccttattctgcctttacgctctggtcctcctccatgtaccagaacctcctaaacttgtggccgctagtggccaaacaactgtcttctaggaacaggttttcctagaaggacttttctggcccgagagtcgtctccctgctgcttcgccatgctttggctaggactgacattccagaagctgactttatcaacttcctcctcctcttccaggaagtcttcccagcctgactatacttgactcgcccattatgcactctatttgctcttctacactgatctgaactcatgagcgacaccctgtgagcatcttttatctgcttcctctgtgtgcctgtgtctaccccatttgttggatgccctcaagggagcagcgtataaggaacagctggtttcaaggcccgtgttcaggcagggcctctctttggctgctggagtggggagagatatattccctactgaatagttacagcctgaccctctcatcctaatgaagaagtgtgtcagctgctgctactctcctgctacatttcagccctgaaaccagatccccatcctcttccaaacagggggaaagggctagtcctctggacatcaacctaactaagccaggatcccccagtcctcagcctccctccagtgctcacttgttacaatgcaaattttctgcctatgaaaatttggaaattctgctacttcagttttgcagaaacagactcttcttgtctagatcttccgggccaagggcagggctaggatgcaagagaggagctcagaacagcctcgacaaaagataatttcacaatttattcttcatgtttccttttccagcagctttaacccacagcgtcttcaggacatatgtttcttaaaggggatttaatggcataaatgaatgtagaacttgactagtattacgtgagtgccgttcttgggcacacactaagttaaggcaaagccaagcaacacaccagtccctcctggatgggaggggaagattctgtctgagatgaacacacactttaagctcatcacacatactaactataagcctttcctgcgccatcacagaccttcctaacccagccacgacccagctgcattgaattcaaacccccaaatccttagaggagccaaaaggctgagcctgagctaacagcttcattttctccttcactcccattgggaaaacagaggaactgcaatttggctttgttacctaagccctgggctgaggcgtcagggagtgaacaagactctgatagctctgcctgtcactctacttggtctcctttctgggcaaactggcactggggagggggcggaacaccatgggtggaggagggtgcagagctctcccatctgagtgtcattctgggccccaggccaggcatttggctttctctccaagagaggcaaaggctgaagctgctcagacaaagggccaaatgaaagctaatggggagttgggtgactttagcctctccccttcctcctcccggagactggggctcaagtccttggcaggagagggtgcaaatcaagacctggagctcagctctgttcagattcctgttgcctcttttattctcctggcatccacaggctgtcttcctcccctcaccacctcccacctagggtgctgtaaaaaatgcaaatcagtgggattttaaaattcaagcccatgccaggaacacccacaaaccctctattaaggcagatcctgaggtgggtggtgtggtcccagattccaagcaaaaaagagaggattctgctagattcttttcttgacttgagtcttggacttcagacatcctcttggtgatcttgacctttctctctggtactggacaaatgaatgggaaaagtcagaactgtgtatgtgtgggctgggaccagccattccaaactgacatggaaagcatgagaaaatgaacatgagaagggacatgatggagactcttctgtccctcatctaagaagcaatcctctgggtaaagttcccatccgagtgtcagcacaaaaagggcttcaggaggaagtcccagagaaatggagtgggacagacagagtgcctgggccacttgaccatgaagaatcaaaagggacccctcctacccaagctggcccctgatacaactgccaagctccctcctcagtgtggagagtgggagaggctgtcctggactctggagagtacgagctgacactttctggatccaggtctgttgtcgt

SEQ ID NO: 31038 - DNA, 1565 bp, Bovine  19866880357915
cccagtattaaatttccccatatcctttcaacttacacattccacccagcacatgcaacttggaaagggcagttgggtccaggcctatttctttggcaagctctgaatctttgagaaaaattctagatatgcatatacagttcttgactctatgaaatattggataaatcctggaaactagggttttcagagtaccttcccaccttggaagtcctcattgggttcaactgccatccaatgtctccctttgtctcatctaagagtcatctaatatctgttccccccacatctgggaggccaagatatggaatatagagaattagaaagttccctctttagtgtgctgagccctgactttgggctttttggggagggagatcctagaaagaaacagcaaagtttccctttgtccctctttggttgtccagcctgacttctcctccctccccactatttctaacactttttgccaagggtccagggttggccccactgcccttcctttcagcctgttggtgaggcacaagcatcattccacattccagctggggtaccctaagccatgactctattttaacaataagcctttcagaatctgaattccctgagaatcgcagggtggctaagacggggcggcactggtaaaatccctggctagagcaacatatgcactgcctctttcattcactgtctcctgtttcaagtggagtggagggagcagagggacccacaagttccatccgtctagccccagggttgggacagaagttgacattcttctctgctgtcttgtagcaatctattataaattcagccctacttttgaagagtgatgcccatcagaactgagaaactatagacatagcccttaggcctcagtaactaagaaatgggccatggggatggggatagaggggttgtgtgagaagtccaggggaatggcctcctctgtgccactgcacgacagagctggcctccgacccttggggtcttccttctgagggttggtagagacctcattgctactcttttgatctaaggggacagactttgacttctgaagcttggcccaaggtgaggatgtgggcacagagttcacactcggtaagttctgaccttagaaaagggtcaggggtcggggatgagaaaggaggtggcactgggctgggactcacagtggttttttccaggcagtgcagcaggtgatggtgctggctctcgatgagtgaggttgtcttgcccatgttctcctcttctggggtgccctaggaagaaaagatgagagactgagcgtaaagctggtggctctccttctctccatctccttcatttctccacagaagggaggagggaccagaaaaatctggatgaaccaaattttagggtcaccctagaacatgttagcctttggctaggggcacctaagctaaagctggcttagggatacaatgataaccctaaggaagaggtatgtggagagggctgctactgggggaaagtctggggctttggggcagaagtgctggtgcccctgggaggagaaaccaagttcatcctcccttcca

SEQ ID NO: 31039 - DNA, 841 bp, Bovine  19866880364914
cggcaggctggagtgaccctggaggtgtatgtttggggagcaacccttgccctggctcatgggccctgtgctctctcccctgcagatgtccatgaaggaagtgggtgatggcttgcaggatcagatgaactgtatgatgggggcgctgcaagaactgaagctcctgcaggtacagacggccctggagcagctggagatctctgggagggggtcctgccccaggttctcccgaaagcccccggacacagctcgagccccctcagtgggagggcagcagaggtcctgtcagacctggggcctgctccccctccaaccaagcttctcttggcagcaccagcagcggcaagtttccatcgcataggagtgtgtgtgggagggagctggccaccccgcccaggacaccgctgccagagccccagccctctgcccagcaggggccagagctggcagaacctgatgactggacctccacgttgatgtcccggggccggaatcgacagcctctggtgttaggcgacaacgtttttgcggacttggtgggcaactggctggacttgccagaactggagaagggtggcgagaagggtgagacaggggaggcgggagagcccaaaggagggaggggccagcctcgggagctgggccgcaggttcgccctgacagcaaacatcttcaggaagttcttacgtagcgtgaggcctgaccgcgaccggctgctgaaggagaaaccaggctgggtgacacccacggcctctgagccccgagctggacgctcccagaaggtcaagaagcggagccactccaagggctcggacattgccccttcccaggtgcctcggag

SEQ ID NO: 31040 - DNA, 1358 bp, Bovine  19866880366432
catttacactggaatcttcctatctccagcaatacagaactgaaaaccctgatatctggtggaggctggaactttgggacccaggggtaagactttgtattcaaggcagaatcactcccagattactcagtctcatccagacgtcaagtgctctaaaattctctgacacaggttgtctctagatttcaggtatcagtttaggtatcccttaactttctcatcagagttctctttgaagtttttccttccttgatcatagctcttaccaggctgtattttaactgactgtctacttatctataccttcctccaaaaaagctcctccagggcagaaactattttattcatcactataccccagcactgctactgctaagtcacttcagtcatgtccgactctgtgtaaccccatagacagcagcccaccagactcccctgtccctgggattctccaggcaagaacacttgagtgggttgccatttcctcctccaaagcatgaaagtgaaaagtgaaagtgaagtcgctcagttgtgtccgactcttggcgaccccatggactgcagcctaccaggcccctccatccatgggattttccaggcaaaagtactggagtaggatgccaccaaatgtcaaatgaacgccttgtaacttcagtccagtaaagcttgatctttcctctgtctcataggaaatgtatgaggcttttgggcacgaagtcacccagagcaacaagcccaggttgctgatttctgcggctatgtcagctggcaaaggtacccttgagactgtctatcagatccccgaaattcaaagtaagtaacctccaggcctgtgggcccaagttcagagctaattaaccctgagacctcccccatagattggctaatgctcagataccctggagagagaaggctctgtcccaaaagaataagatgatctcaaagcctgagagagacatgggaagccagtcaaaattcttaatgacaaaaggctacttggaaaagttagttgagtttcaaacttctataagacctgaaggtctgagtgcaatgagttattggttatagattgtgcgtcttctatatatcaacttttcaaataaaggtgagacagaatggagtaaagaatactaaagcataatccttcatgacatgattacaaaccatattcagttgggactaggacctttaggggaagtaggatggagagtattattttccttgggtcatttttcttctcttgtatcctaccccccacttcccaaggtacatggaccccatcaatgtgatgacctataaccttagggtctcctgggaggttccacaggagaggacagcccctgtttttaggaccctac

SEQ ID NO: 31041 - DNA, 489 bp, Bovine  19866880374532
gctggtctgtctggccctcccgtgcagatgtgtgcaggggttgagaacacgtggcagacacaatgaggcgaggggcactgtcagagaagagaaaaagtggggagaaataatacaagccccagaattctgctcatgaataagaaatgccaggtctctcagcaccacgtcccaccccctcagcttttggtccttggatcccagcaatcgccatgatcagttatgggacagagaacagcagtattgcatcttgagggccaagattatgttatgttcatttctggcatccttagcatctttataggcatgcagtccacctgtggctaagtgaatgactttttattacattgtctgggttgagctcaactgggagcctctttattgctttcattgtcctttaccctccgagttacagatttgttcccaattcctacaggaaactcaagctgaggttcagaaaaatgctagctggggtttgcggagcattctgtt

SEQ ID NO: 31042 - DNA, 3308 bp, Bovine  19866880391353
tggtctgaggaaccggactctgcctggcacacagcccatgaatgtttggtaaggggagctgtatgctaggtgccagtggtccattcgttcctcttgtcctagggcttcaactgcctcatggctagttttataagcagacaaataagacacaagtgaaggggacttccctggtggcccagtggctaagactccaagctcccaatgcagggggcctgggtttgatccctggtcagggaactaggtcccatatgctgcaactacgaccaggtgcaaccaaatagatagatagatacattaaatgcattttaaaaggacactagtgagcagataagggaataagataatttcagatagtaagacacgtcatgaagaaaataaggtgattgagtaaagggccactttaagctgagtggtcctaggagccttgctgaggaggcggcttctgagtgaaggacacccactgacagagccactctcagtgctgttaagaaaacatcctttctttgaaaaaacaacaacaacaacagtgaatcaactttttatttcactgaccagaacttccgattctctctgatgctgcatttaaaatcttgagagtccgcccaaatagcatccaggcttcctgtatccagaggcaggggccgaggggcaaagcgtgtcagggcccaggcagcggcctacattcctgagcacgtctgtgtcatttttaactgaaatgcccttaagctctccatcctgaaacttttctcagtggcatctgtggcagaaatacactcatctcttttgagggtatacacagctccatgggagtaaggggtggccattacacaggtgccagccaaacttcttattcagccagaaactaggcttctggctcagtttcatagcagggagatgagcacaactgtggtgagcgtcctggctcttctacaaggtgagctgggctgaatgtgagcgctgcccatgatagagctgaatttgactctataaaaaaagaaatatttataaagttgctcctatctctatgagtagtctatgagctgcttccaagaacccaggggtgcccacatctcataccccatccagacatggccagttcctcatgcatagctacatgtgaagcaaagaaaccatctgttgagacttccctggtgctccggtggttgagattctgtgcttccaacacgaggtgcacaggttcaattcctgggcagggggctgagatcccacatgctgtgcagtgtggccagaacaaacaagcaaaaaaagtctggcttaaaaaaaaaatcttttttatttaaaaaaacaaaacaaaacaccttttgctgactttggggggtgggaattgggcctgggagagatgcggaatggactttttattccccctgggaaaaaaaaaaaacctatgtgtatacccatacacatacatatccatgttcaaggatgtttttcttccaggactacaggaccccagaatccagccctcctccagtctgagagatgatgcctattaactgcacagatctggcatgtgaacatactgtataggacttccctggtggctcagtggtaaagaatccgcctgccagtgcaagggatacaggttcaatccctggtccaggaagatcccacatgtggcagggtaactaaacccatgaaccacaactactgagcctgtgctctagagcctgggagcctcaacaacgagcccacgtgccacaactgctggagcctgtgtgccaaaagcctgtgctctgaagcagaagaaatcattgcaatgagaagcctgtgcactgaaactggtgcgcagctcacagcacctggagaaggcccgcacacagcaatgaaggcccagcacagccatgaacaaataaatcataaaacaaaaacgaaacccacatactatatgaggctcttgtgttgtctcacaagctgagaggataggggcaaagggagtggatactcataggggatttgcttttctgtctaaaatccagtctacctggcaacactcttaggagaggctctgtgggcaggatatggtgggtgacctggtggtcccagccccctgcagtaagaagggagtgactgagcagggaccaaatagcatcgctcacaaagtctctgtgggctcagcttctaaacaccttggaaaggcctgggtgagcaggcttcactgacagaggccaggaagggggccctgtgtggggagaacactagcccagtgacgccctgggagtgtgcagctgtgttggggacacggcttgcactcttggtgtccacaagggaaacaatcgcttctcatcaccagagacaaagacttctgtctgctgaggatgccaagccagggaggtaggaaggtgggcagaggcaccgcagccgatctgtgatgctggcttgggacagggggatcccacagtaaaagtctgctgtcctcactgcgtgaacatggactccctcactagattaatgggaaatacaaaagttaccaagtatcatgactactttgagctttctttttgtaatagctcaaaactgacctttggccaaaattaaaccacagtgagcacatcataaatctcaactattactgggttggcttctaacactgcttgaagcaaggcttcaaatgctattcagaatgatgtgagttaccaataaatgaaaaatagttaaaagaaaagaaacatggagtccttgtggggagaggcagcaatacaggtgacccgtccagagtgagcttggtctggattcagaaccatctgctgagcaaggtcccggatcttgatgcagaagtctttgtttcctctgacagcttttgtgccacagcccgggaccctgtagacacaacgtgatctgctcgtacttgtagaacttgctgccaacgagtgtctcattttcagccagtgcccacaggtcaacagcacctgggctggaagccactaggatacctctggctctgatggtatcaagtgaggtcagcctctctggcctctgtctggattccagtggagtagaaaccttccttgggggcagcacaaaggtccataaatggccagagggagccagcccagcagctggctgctcaagctggaaactcaagctgcaaactggagcaggaacacccgatctgaccagtacctcacagcctccaatggatgctccatacaggtggacacattaaggggaagattccagtcccaggccgccaggggcacaaggctgggtaaagtttccttcagcaactccatatttccaacctagcccccaacggaggactgccagaaattcagctccgccagacccca

SEQ ID NO: 31043 - DNA, 4880 bp, Bovine  19866880412972
ctccttagaacctaaaaaaactataaacaccttgaaccaaatccatatgtaaaataaatatgacactgcatgttttattttttataatcatctgtattttttcttacatacttgtatatatagctcagcatttcaagtgaccctgaagtttaatagaagctatttttatggaagttaaaattttactttttatcaaatcagactactgttttggaaaggggagtttccttccctggcaaaagccttgagaatgtgaaccaaacaacagtgtgaaaaaattctctcactcttgtcaatacctccaaagaaggggcccaagaccctgtgtcagaaaaataacaaatgctaaattaccaactctgaaaaagttgcatttatgtggatccaaaggagaaaagaaagggatgtgtgtgagagaggtgagaaaggttaatattgactaatttcaagtcataaaaatacttttaacatgataataaaaatctttaaatcatcagattaaatggagtaaatgtttttagattgaggtatctaggcttatcttaatattttaagttgatttccagtgaactctcactattttcttcagaggatcctgtcccctaaagaattaggcctctcagcataacttagcaggtttcaccctccagtgcctcgttcaccagctaacacttaccatggggtggccttgaagggtacagcaggctatagttttctgaggcactagcagtatctcactctttgttatccagacacatgaagtcttgccatcaggctaagtaggggactaccctggtagtctggtgatgaagaatccaccttgcaatacagggcacacaggttcaatccctggtaggggaactaagatccatgtgagtacctcacatgttatcctgtgagtaacatgctgtgcgaaactaagcctgtgtgccgcaacactgagcctgcatactctggagcccatgagccacaactagagaggccaagttccacaactactgaagcctacattctctggagcccacacgctgcaactacggggcccacgtgccacaattagagcgtccatgcactgcaaagaaagctcctgcatgacacaatgaagaccctctgtgccacaacgaggacccaacacagccagataagtaaataaataagaagactaagtaggcatagaaggaccttcccaatacaagaagctagactacacttaatgcccattctgaagaaactatacttgagttattaaggtttgtgttggaagtaaaaggcctgtcttccaggcatgtcttggggcttcccaggtggctcagtggtaaagaatccacctgccaacataggagatgcaggttcgatccctggatggggaaggtacccttgggagaaggaaatggcaacccattccagtattcttgcctggaacattccatggacagaggatcccagtgggctacagtccatgagaccgcaaagagtgggagtgcaactgagcaaatgaacacacaccaggcaatgtctagatgagtactttgaacgtgtctctcatgacttttgaccttggcacacctagagcaacttgtgaggctttagggtatgattcaaactggaagacgggggcagatccaaactactagcctccctgggaagtccttttcacattgcagttcagggccgtggagccagtagatgagtctactctgatttctgctgcatccccagtgcttgccactctgcctgaggcacgtttggaattcagtatgatgatgaccgacagactaaatagatgatgtaataggaaagggggaagggggattattggttctttgagttttacatgaacatgaggaaggcaatcaaatcaacaacccactccagtactctttcctggaaaatcccatgaacagaggagcctggctggctagagtccacagagtcacagagtcagactcaactcagcacagcacagagaaatgcagtcaaatcaggaccttcccactccatgctgggaaactcggacactttgaagcactcctgaaatatttactctgtctttaagtgtcctctgggtcccaaaagccccaaaacaaggcccagcaagccattcaaagccttggcatgtatagaaaaataaatagtctcctatcaccagggctagtggtgtggtggtttagttgccaagtcgtgtctaactcttgcaaccccatggactgtagcctgccaggctccactttccatgggatttcccagacaagaatactagagtgggttgccatttccttctccagaggagaggctctcccaactcagggactgaacccataactcctgcatcacaagcagattcttcactgatgagccaccagggaagcccccgggctagtggtagaaaacataacacttgtggctgggaattagagggcgaggacccacaagtataatatttcagtcaagtgaagccaccctgctgaacattcactaggaactagcccttctacatgaatacacaacaaaccagcacaaggagaaagagccttgtaaactagtctttacactgtcatgtagtacttatgaggcccttgcccctccctgtgtcccatgctggcagacaggagggtcagagcaatgcagaaagacaagagcacctctgggctctgcattgctctgtcctggaggatttgtggtcaggaggcgcatgtgaagggagtcgcagcttttcagtcatagtacaggcttaggtaggccagacggttccgatgctttctaaagtctttgtctgtgggcagctgcaatgaaagaatattatctaggtcaatattcaaatgagaacccactgcctctggtcttcctggctctgtgaaataggcatgtatgttatacctgttgtggcctagctgaacctcaaccccatagtaacctagcctcactgagtctctcagcattgctctgtgcatctactctttgtcgtcttactctggaaatgtcatactaggaattattttctacttgggaagttgtcaagtatagctggtaggacttccctggtagtagagtgggtaagaatccacctgccaatacaggggacatgggttccatccctagtccagtaagattctacatgacatgagcatctaagcgcgtgcaccacaaccactgagctcacatcctagagcccgcaagtcacaactactgagcccacgtgctgcaactacggtagcctgtgtgtctagagcttgtgctgtgcaacaagagaagccattgcattaagaagcctgagcactgcaaggaagagtagccccagcctgctgcaactgaagaaagcctgcccatgcgcagcaacgaaaacctagcacaatgaaaaataaataaataattaattattttaaaattatagctggtgaacttcttgaaaagaaaaattatatatttaattcttgaatgttacccataggctctagcataatgatgttaatacatttggtgtttaatacatacttggagaattaatcccaggttccactggataataaagggcacctctggaattatgatagctgatatggactgagcatttattatgctacaagtatggcactaaatacttttctacaatatctcaatctttacaactttatcagatagagtctattattatatgcattttaacactaagcacactgatgcttagaaaagtaagattattagacaaaatcacacagcaagcaaatatggaactagaatttgaacccaggcagtctgttcctaaaatccatattcttggcagaatgatccacagcccttgatgatctaacactaagtggtgtgatgggaagagcagtggcttaggagtcatcagatctaggctctatttgagcaacttcaacaagccacttaatccatctgagcctcagtttcctcctcagtcgcagaggataattattttggactaaccacagaagattatttgaagactaaataagaaaatgtgacttctgttccatcatactcacctttaaaaatctagtgaaattgggtaactctccaaaaaaaattcccatatgtatatacacaaaattgtgcaagtaattttaggggaacaaggacttaactgaagcttattcacagacttctggttaagaatcactgatacacacggaagtattaggtaaagaactccagagaagtccaatcctattacctcagttctcagggttcttttctgtagacatggaacctgagcccagtctggagatccaaatttcattggccatctgactctcttgggtggctttatctctaggttgtatgtggtagggctagaaaaaatacagaacgtcatgtgtaatgagttagcaatcatatataaccttccacccctgatctagagtcctaaccctttgggaaaaggcagtcaactgattcacataggattcttttgcctgctaaagtatttctgattaagtttcagtgttcaaggtatctagtcttgacaaagtaaaaactcaaccccagtttaaaatatttctggaagttcagtctccttagctgagagatcaaaagatcccagaaatggtggatgataaagttaacacagtgatgcataagtattgctcatgatgtaaaattgaggaggaaagaaaaatgctaatttaaagtatcaacgacctgaggtcagtaaagtagaaccatgtacaattccttgacaatgggattatttaattatagcctttgttcataacattcttttggtatagactctttgctgtggaaataacatgtagagtgtacataggaatcaagattcaatatctctattccttactacaaccttgaaaaagttacactcactctctgatctttgaaattctcaccagtaaaaaaaa

SEQ ID NO: 31044 - DNA, 1194 bp, Bovine  19866880423736
gaggggtgttccccgaagaccgcgtgcgtgagctagtccggtccgcataacctggcccagagagcggcgcccccgtcaggatcaggtccagccgggtgctcatgctttgcgggcggccccaagaatcctggaactgcagtttcgcaatgcccgcggtctgcagtcaccgggatgggtgactgacttggaggctgtgtctcctttccccgctcccatccccagaaccggggatcgtcccacaatcctcttgtaagaggagccaggcttggcctctgcctgtcaggacagggccctgggcagctgccttgccacacggcccgcccttgccttccacgaccctgcacacatcacctgtagtccagtggcctaagcaggaagctgctctcagggcctctgagaaaggagagcaaggaggagggctgagaggaagtcacaaagatcagcttaaaaataactctcctctccatgtcagacgtgcgcgtggagccaagttctgacagcggtggctcgaggcggggtctgaaagccccaaagtgaaccagcagacacccatctgggagcacacgctgtgtccttatcagccttagcaagcccctgccgaaaccctgtcttctcagaaacttccgcccaaccagcagctgtttcctcccctatatttaaacaaccaggttagtgaactggagagagcactgctgcccgccccaggaagaacacagtttcccatggaacacatagggcacaggatgaccctgagggcctgtggcctgtgctgggctcctgcctggcttctgctgggtgagtggggcccagagttccagggaaggcctccagccccatggtcccggcagtgaggcaggagacctggggggagggtgtgcccagatggttttctgggtgtgagcagtgtgtgataccttccaacactgaatggggtgaaggggacccccaaaaaagccagagatccatgaaacaatgcctatgtcacagccccagccccgagcaccagggagtgcaactcctcaacgagtcttgggatatagtcaggcctcttggctattttggggggcttcccaggtggcgctagtagtaaagaacctgcctgccaatgcaagatatgtaagagacctgacctgggttcaagccctgggtcaggaagatcctctggagaagggaatggcaattcactccagtatt

SEQ ID NO: 31045 - DNA, 1771 bp, Bovine  19866880435135
aggattccaatcttatatcacttgaagattgataaaaattagaatttgtaagcataatcgtttctcaaaatctcccatcatacatcccccttcagagatgttgctctgcaacatttttccccaacagattccagatctctatcttctcctccaccttccacaattaccaccattttcacttccacattctctgtcagctctttcgactaaatattttcctctatcttcctacttctctagacaaattctctctctcctttcacttctctaattctctatagcagaaaatatgataattggtcagtcaagatcttatttagcatggtggagacaaagaggtgctagtgaaatatgaaggaatagtctcatattagtaaatcgagtccacgtcccacagcgatagtcaaggcagaacagagcttaacctgtggggcagtttctgttgggtgttattttctagaatccagaagcaaatagaattctctagctctggctttaccagaactatccgatgttgtcccagcaggtttgtgcttgctgatgaatttcaggtgactcatgatagcttgcatctggttgtatctaggtattgagaaattcccagaaattacatctctaactcaagatctttgttctatgtggttgatcccagaggccagagcatgaataaaggagaaactgaggcagggacagtggctgacaggccaggggatgaggatggaggtgaactggggctaacgtgcagctcccttccctttgacacaaagactctttcatcagagaaatgcaacagaaaagaaataaggtagacacaactcagttcaataaaatcaatgcattatgtgttatgtagcctgccagactcctctgtccataacactctccaggcgagaatacctggagttcctatcccttctccaggggatcttcccaacccaggaatcaaaccagggtcttctgcattgcaggcagattctttaccagctgagctaccagggaagcccctagaaaaatacatacctacatccaccatcaacaacttacatatatctgggattgataatactttacatcttcctttccagatatgtcctaaattacattggttgaagtagttttgaggtcccagagcaataacggtttttaatttcctggaggcagcatttctgcatgagaagaaccgctccagatgatcactgataatgagataatgcaaattcagctagtgagcttacttcaaacagaaaaagtgccccaaaagtaaaatgtcctatcaaggggagtggccaagatggcagagtaggaagaccctcagctcacctcatcctatggacacaccaaaattacagttatttacagagtaactattgatgagaatgacctgaaaactagttgaaaagatttcccacatttaacaatataaagaaggaatcacaatgagatgggtaggaaaaacagagatgtggtatagtctagactcacacacccaggtaagtggcccacaaacaggaagatcatcacaaatgcagaaattctcccccaaaagtgaggtattcaagctccacattgagctccccagcctggggatcctgtaactaggatgacaagaatgtctgactttaaaggtgagtgggacttgcctacaggagaaccaaagggctgtaggaagcagagactctactcctaaaagacacatgcaaaatctcacccattctgagacccagtgcagaggcaataatttgaagggattccagtctgactcacttgctga

SEQ ID NO: 31046 - DNA, 1055 bp, Bovine  19866880441580
aagggatatagagggatgtggagggattttgtggcatcctcagagctgaagcaaagacttgccggactttgtaggctttgacaggattgcccccgcaggggcagcaggcagggagtccctgactgtgagtagtgggtgtgctaggttgtctttttctggctttactgggtgaggtccttatgaatcctgggtaagcatgagacacaagattttaaaggcattgaattattcacagaatttggagagctttgctcttgaaggccaatggggtcacaatgtcagagttatcgtttcttttgatgattgattttttcccacctggttatgggttgaagtgaaagtcagttagtcgtgtccaactctttgtgaccccatggactgtagcctgctacgtccatgggattctccaggcaagaatacaggagtgggttgccattctcttctccagaggatctttccaacccagggtttgaacctggatctcctacgttgcaggcagactctgtaccgactgagctgccagggaagctggttatggagtatggctccttaatacacctaaaggcacaggattccctaggtcaagtgtcagcatggggaggggatgctaacagactgtcagtggaggccatcaggatagggtggagtgcaacacaggatgactataatgtggttgtttggccaaggtgactaaacatctatggcatgaacagcctggccaaggctgccagagtgaggagaagtagcatgagaacagagttcagagagagagagaccagccccgacattcgataccagcagttcccatggggttggggggtgggggcatagacagacgtggcacatggacactcacaggataccaacactagttccatgtcccaccaccccctccaagcccctggggaggtcaaaaaagggaatcagaaaggcacaagaaaactggaagcctgagctggtcctgggtgtgacagcagaggtggagtaagccccagaagaatcaacagcgcatgcagagaaccagaccagggggtaaaaagaggagactccacaga

SEQ ID NO: 31047 - DNA, 714 bp, Bovine  19866880453218
tattccaggctccttgatttcataagcacaatgacctatgacttccatggtagctgggacacatgtacaggcacaatagtctcctgtatgtaggaaccaaggattgatgtgacatgggttattccaactgtgtaagaaagagaagactcaaatatgcagaaggaagatggggaagggatttggagccttggttgtgggaaaacaggctttctctttgggggacaattagctagactttgttaataatgtgggacaaacaatggtgaagaataaggtctgtgttgcttctgcagggatatgctgtgaagtactggagagacaacggcatcccttcagagaaactcatcatggggttccccacctatgggaggaccttccggctcagcacttctgacacctcagtctgtgccccagtctctggaacagggtcatctggtccttacacacatgatgctggcttctgggcttactatgaggtaaccaccatggctaattcaggctaaaatgccctggggaaaattcagccctccaagtcatcttgctattcttatattcttgagattttataccctggctttcacaggtctgtggaaaggaaggttgatggctgtggaatacttttcacttaaaaaaactatctgaattgtcttttggggttttgaagtgtaggtaccatctttcccacagcccaaagctatactaatttcattgctg

SEQ ID NO: 31048 - DNA, 787 bp, Bovine  19866880458534
ctggttctgggcatggggctcccctgccagagatatgctgttcccatctgtaaatggcttcagtgcctggaaaagtggccacagacgagtgcttagcagcaaacagatcactccccactgagtcggtgattcaccagggcagaggaccagcctccaggcacagggaggcagtagccgtgggaggtgccgggaaggggcatgggactctggcccacacttaggacagatttatttcttctcctgtccatagcctgtcgggctattctgctagttcttcaacttattttatttttttcccccgaaggctggagagagtttccagcccagctatacagggcatttccccagagaggcttagaaaccctcagaccaattagttggaaacctgtgactagggtcttttttactctcccttctcagcaagcagacctctctcctctgggaatgggcctccctacggcaggtgcaggagaagagggagggtgggttgagaggaagggaacggggggagcaatgagggaaagagtttctggaaggggagagcaggaggaggggagcaaacagagaagaaaggcaagcacacacagagaagaaaacagaaaggagtggggttcgtgctgttccagtgatctgtgccttggggccttaatgtcacattgcgatgcaagcagaaaatcagtaacaagcatttctgggccttgtctcggtcatccagcactatgggagaggcacaagtgtgaaatgctgccttcaccccggaggggcttacggttatgcgaaagggtcg

SEQ ID NO: 31049 - DNA, 528 bp, Bovine  19866880489266
aaaaaaaaaaaagaaagaaaatgatttctgaattctcttccttccaaaacccagtcctccagctgagtagaaaggaaacgaatattgacttctaatttaattcctacaaccctggacgggaggaatccttttcgcttctctaaatgagggatcggggataagggaggtttgacttgtcaggttcccaggctctatggaagcatctgagcaggctctaccccggctctgctagaggtcacattctccaggtctcctcttcgcccttgggtgcgggttggggggcggggcgggggtgacgtagccgggaagagaggttttgtagccggcggctctgcaccgggcagaatcgagggctcccacgaggggagtccagggttggggaggggcggggcagggcggtgggcggcccggggcagaggcagggtctcccgtgagggcgccgcggccccggcgctgcaggcaccctgcggttgccccaccagcttcctggctggaaggacacgtggccccggggccccacagcggttt

SEQ ID NO: 31050 - DNA, 1031 bp, Bovine  19866880507114
tcttgcctggagaatccctggcagaggaacctggtaggctgcagtccatggggtcgctaagggttggacacgacggagcgacttcactttcacttttcactttcatgcattggagaaggaaatggcaacccactccagtgttcttgcctggagaatcccaggggcagggaagcctcatgggctgccatctatggggtcgcacagagttggacatgactgaagcgacttagcagcagcagcagcagcatgctggccttttcatcatgaagcacagggaagccagcaactccatggggtggcaaaagagttgcacatgacttggccactggacaacaacaacaaagctggccttacttcaagtaaggagagaaaggtccagcggtcacgcgcagggctgcctctgagtccagggtacaagaagaagaggtccagaccatcaaagccatgtgtcctcaggagggggatcactgaactgacaaacctttcccggttggaaaatgtggacagcatcatggtgaacctgcagggggaccagggccgaggccaggagtgctttctgcataaccgtgctccccccaaccactcccctgcaaggctctttggttcatatgtgactgaggaaaggaaggtggaactttaaaactctcaaaccttcttaagtcccttcccagccctggacttcaggctccagggaggatttgcaaaccacacctgcccctgccagatggaagcaacactcagcctggggtggagacagtggctcagaacagctctgcctttgaaatgttcacccctggccaggcactgactctttgtctaaacagataaggggagggaacatgagaaaaaggccagcatttccagaaagatctctgagctaatgggcctcataacatggcacaagagggccaggctctgaccaggggttctagagtctttgctattctgtttattagctgtttgttctccattttttctagtattttctcttccataggaagacattatggaaaatctttagaatagtaaag

SEQ ID NO: 31051 - DNA, 1773 bp, Bovine  19866880528949
tatttactttttaaaagggaagctctcctttcctgtgtacatacttgtctaggcagtattaacattttcccccagggctgtcagcaaacatctgcagccattgtcattaactgtccagcactcacataacacagccctaatggtttaacttagattcctgtcattttgggttgggcagtgataggctttacttatacataccagtactgtacatgtattaccaagttagagtgaattaacactgtaaatagcaaatccataattaggtccagcatgtcattaagatgactttaattacacgtttaagatcctgttgttacataattgagcttagctcttttttttttcccctacccttttcccccacagtacagccaagttcacagtttatcattgctaggggattttaattaggatacttctgtatcttaattagaaattaggatacccattagtcttgaaattaattggattctcttttagggttgtcttttttgtgtttgctttttttttaaaaaaaaaaggaaaataagctggaggtaagcatataccataacacatgaagatactgatttcatttttcataagcattttccttggaacatttcagcagttacctttcccagataagaggtgtagttattgtgctggctgtggaaggaatctgctgaaattatcagtctaggtgcacatccccctaatctgttaggagctgtaggtaggttttaggcagatttacttgagaatgttttgtggtgtagtggaaggagtgtttgtcttagttgactctctgctaccaacttttttaccttgtactagtcatttaacccagagaaggcactggcaccccactccagtactcttgcctagaaaatcccatggacggaggagcctggtagactgcagtccatggggtcgctagagtcggacacgactgagcgacttgactttcacttcactttcatgcattggagaaggaaatggcaacccactccagtgttcttgcctggagaatcccagggacgggaagcctggtgggctgccgtctatggggtcgcacagagtcggccacaactaaagcgacgtagcagcagcagcagcagtcatttaacctctcaaagtccaatagtctcaccagtaaaaggagacagttagaccaaaagatttttagggtcccttccagctctaagatttaactggtacatgactaataagataattttctagagaaaaggaatatctttttatgagtatagagagcctttatacatttacatacatgactactatgaattggtttaatgtctgacttctagaatactaaatccatacatttatatagctgttcaagttagacataaattaggctagcagcattaacatgtagagaagtgtttgggaaacctgttgctttggatgattctgacttaaagaatataactttgggtaattaaaagtaatctttaaaagtagtgtaaatattgcagtaataattgctaaccttttaaacctaacctaaccttaaaaagggcttccttggtggctcaggccataaagactccctgaagtgtgggagacctgggtttgatccctgggttgagaagttcccctggagaagggaatggcaacccattttagtattcttgccttgagaattcgatggacataggaggctagcaggctacagttcctggggtcacaaagagttggacatcatgactaagctactaacacgatcactaacctaaaaaaaggtttaaaggtaagagccct

SEQ ID NO: 31052 - DNA, 6616 bp, Bovine  19866880586304
ccgctaacacacacacactgttgctgcttagccgagtctgtaattccatggtgcttggtgcagttttgttctgcccactctaggaacataatgtgctgggaatgagactatgctgctgctaagtcgcttcagtcatgtccaactctgtgcaaccccatagacggcagcccaccaggctcccccgtccctgggattctccaggcaagaacactggagtgggttgccatttccttctccaatgcatgaaagtaaaaagtgaaagtgaagtcgctaagtcatgtccgactctttgcgaccccatggactgcagcccaccaggctccttcgtccatggaattttccaggcaagagtactggagtgggctgccattgccttctctggaatgagactatggtagacaggaaaagtctggttgaaattgccaggctttgcatgatcccacttctgccaccaagtagtgctgaagtcctgggcaagtagcttcactatgccttagtttttctcacctatgaaataagtgggtggaatgaaatgacctttcagctcccagtgctataatattgataggataattctaagtacaaaaagggtatgtacacacgtgaacttagcttatgctaagttttcattttaaagcaagatgttgctcaagtccccaaagaaagagggcatctgcagagggcaagtgctggtgttgggctcctgtcctccataactatgggacaagatctgttccatcttttattcttataaataagattggaacacagccatgctcattcatttacctattgtctatggctacttttgtgctacgacagcagagttgagtagcttgaacagaggatgtatgacccacaaagcctaaaatatttatttattttctgtttccttacacaataagtttgccagtttctgctaaggcaagtcagtgagtggggaagagggaaaaaaggactctctcagtggagctcggaatataaacctggggagaccatgggcagaccctgcgtactccccactgtcctgcaaatcagcttatagcaagcaggtcacttgtatttttccacggcacatggataaggacccttgaatccttgggagctctgcccagtgacctggcagtctggtgagaggctgtccccaaaccaccccagcacacataaacacagagacacccatgtgtgtggacgtgcacacatacacacactcacacagctggcgtgggtaggttagggcagggagatactttcatcccaagcatgtgacaaggacagagtcctaatccaccttgtacagaggcatccaacccaaccaggctattctcatccctgccagggtcccacatcaatctgctccagaaacctccccagtccctggcagagccctaagcagagaccagggtaggaaagagcctggggcacaatctgcggtgcccaggagcagagtcggtcccaggaaagagtggggaaagctggtcaccagcaaatagagcagactggatgccccaagagctccacttagcaatgcgatgtgtgaacggagcaatgagctgccagagaactgggtagcaggaagtggctggagctggaggaggggcacagaggtatgtagtagaatcagcagtgatgaaaggaaaacacactgccttttagcctgcactctctgtgctcccccccagattgtccaggcttcggctgctcagtttgggatttgggggcattccccattcttctataccctctggagctggcaggcccctctgtctagctgtgccctaacagccagcactgcaaggcaacccttgatctccaccccagagcctccagcatccatctggcaggctgtggggggctttgatggtctcttcctcaccatgaagctgatctggtttttgagggcgatgagggggaaacaaaacctcccgattaattctcacatggcggccgcctgaggccatatgccgtgttctccagctctgccattatgcatcttgcttgtaattgctttagaatgacactcatcatgctctattttatcaaccaatgacagaccaatagaggagaagggaaacacacttacacactcgcacttacagaggaagccagactacataacagacagagcgattgtgccgaaatttaaaagctggactctgtccacttgtctaaatagactacattgcgttcactgtgactgcttccgagtatcaaaggtaggtgaggttgccagtggtggatgggctgacacaagcttctagaagcactttgccacgcttgccccactccctctaaacttttcacaaaaccctcagccttcttggctttaattactcaaggaatgaagatttctttcctggatcaaaaaactataaacagagagggagagagagacatttctctgtatttaaacactccaccgtgagcaccctaaggtgaacagccctccgtttctgccttcctgggtcttcctgtgactccctttgatctaggaggctcaccccatcccccacgttgccccctcagcagtcagggcctccctcattcctaaaggtcacaagggagggaagctcccaggggcctccatgaatgagctgcagacttgctaacttcactcactgccgcctgcttcctgggaccactggagtaggaatacatatagtctctccctgccctccactgtgaagctgggtaagcccaagaggccagcaactgtgacaaatgaactgcagcatcttcagtgccaacactgtcccagacagatgctctgtggcaggtatggagtagaacactgaacgccctgagggggcagaaatggttgggtgtgagggccccacagtcccagggtcccacagtcccagcaacatcccccttatctatgcatgcatgtgtgctgagttgtttcagttgtgcccaactcctggtgaccccgtgaactgcagcccgccaggctcctctctccatgagattctccaggagtcggttgccatttcctcctttaggaggtctttccaaattagggatcgaatcctcatctcttacatctcctgcattggcaggctccctcatccgccttggaccaacccttccattcccactgctgggaccggcagcctcttcccaagccggcttctcagtagatcctaaacaaattctctagcatcctgcagtccctagctaattagggtttgaaatctgggcccagagaatagagaaaatatccccaagctgaagatccattttgctgaagctgctgatcctcagggcacttgcgaaagctccactcaggaagccagagggggatagttcatggtcctaggttaccttccaaacagagaaacaggaacttcgatgaggtggggacatgataggagcaaaagaccagcccaggcgaggcacccctcccttccctccctacaggaccagtcagagcatggacctcagtcccctccccagcctagagagctttcaggtaaaaacactggaagatgcttgggaaaacctgggcacagaggtggggtgggggagaaatcccacgttgaccccccggctgagccagggggagaggcatccagcaccagcgctatagtcccgcgtgcaaaaccccttagctccaggggagacgcgggctctccaaccccttctcacaggaagacgggaatgagcttacatccctgaggaccgggagagaacagaacactctgtttccagagcactctcccatcagctctcatctctctatttcttaatgaggagcctgaggggagtccgggcctcggctgtggagcaggttagggagtaatagggggaaaccccattcaaactcatgcttcccactctagggaagcttccagctcatgccttgcctcccctcttcccaccagagcagtggggcatcagtctgggagtctgaggagggggccaggatagggcagcctggactctgtgcccttatcctggggaggagggaggtgccatggagggcgatgcttgctcagccctggggacctggacctggacctacagcccgacctactttgcagctcgctggcccacctgccaggggccagcagccaggatcttggctggccgcagaaggcctgtccacctgcactcagcacatgtgcagtgggtgtcctcagtcagccctccgacagcaaacactgacaccagggagcccactgtactccgagccgcccagtcacccccggcagactcagctggtgcgatgtttcctggtctttgttgaatgtgtccaatttcctgaccagctccctggtaaataatcatttcctcgttcactccaggcagctccaagctagagaagggcggaggctgccttgctggggatgctctttctttggtttcgttggtgtctgagagccagggttgacctctgctcagagcagggggcacaggctgcttggtaaagacccatcttgtcctcagcagcagccagcagtcactgagctccctccttgctgccacgttggatgctgtctctgcgtcttctctccccaacccttaaggctgaaactctgcattaaggcaaggagacgggatgagaatccagtgggatgctgatctagggaggtgggtattttaagggaagtcagagggagacattaaagacctctcagcatgaaggcaagggcataggccaggaaagaaattgatggggttccaggccgcctttggttgctgcttggccgacactggggctgtgatctcaccttcatggtgtctaaggcacaggggtccacagagccctcctcgcctgcgtgggtgtgcacacagagccgagcccttgggcagctccagccccacttctgttctccctgaagctcccgccctgagttttcctggcccgagctgctggcacaccatctggtactcctgggcgagccaagcgttatttaccagcgacagctctgttcatctggccgtccctgcccaggagcaagggcagaaagagaccctccaagtgccggtggtggttcacgctggccactcacacgtgctgggcactggcccaggcactgcataaacgtcattagttttcaacctcacaggaatcctcgtttgcctaaaggagaaactgaggctcacagggggacttctgtttggtcgtgccctaagaaagtggccgagcattcaacaaagaccgggaaacattgtgtcatctgagcctgaggagggagacaggactgctcagagctcaaagggcttgctggcattaggagcagctggcattaggaccccgacagcctcaggtgggtagaggtgagactaaggaggctagacgttcctagccagggggccatggcacacaggtgggcaagaatggattacaggtatgcaggcaggtgcagatctccgcagcctccagggcagccaggtgaggctgggagagcagagccgctggtgagcagctccgcctgcctccagcagcctggccagctccagaggagcaagatcaaaggcatggccaggtgaccccactgggaggcacagatctaaaggaaaagactctaaaatctggagtgagtaaggaggcacaaattaagagaggcttttctgagacagaactgatgttcatactgtcaaaattcttgctctgactaggaggtagacacaaaggtcgggtggagaacgggacagattcttgctcttgcaaagtcaggaaaaggaggggctctgatactccgggatggaccgggtgggcctacactgctgagagaggaggccctcgtgctgggtcctagagagggccacttccttcacctttctccccatcacccaaagagcatgggcctgagctctgccaaggagcataattacaggtgtcatggcaatttatctgattcatttcatgtgcccggtgactacatgtggtgagattttcatcacctcaagaacaggcacacacagtcagcacaacaggaatatttgttgaatgaataaaggaaatgggcaatagtggattcaaattagcatctgcagtggaaagcctgtgctccccacaaaccccaccccaacacattttttgtgtaaacaggactacaaatccaaggactgctgacttgctctggttcaggtttaattttaaacaattaacacaaagaaaaaaaagatatttaactcattttttacaatgtagtcacaacccccccacccattaaaataaaggtacccttataagttccattaaataacgctgccatactaatgagaggcattcatatttataggcataagggagttttatggatgctgcctgaaagatgacaagatgttttttctttgcatgtttgatgtattttataattttttaaagtaatgatctaacatcttcacttatatgaggtccccggagtacacaaattcagagagataagagccccatcaattctctgtggattctccaggtatagagttgcttttcaggggaaatctgtaggtgcttgggggcctcatctaagaaccagaagacccagccctggtccaggatgatgcttctggtgagaggaagggtcacctttcagcaggccaacctgagaacaaggacctggagattttctcctgcccacaatggcccagggttacactgggaaac

SEQ ID NO: 31053 - DNA, 959 bp, Bovine  19866880602891
tttaataagggtttcatagaaaaataaatgctaatattgaaggtcagcctaatttcttgaggtttttccacacctttaagacttagcagacctggaaaaccctcacagcagacctggtttctcattagagcatacaatttcttttttttttttttacccgcgcgctcggcgccccccccccccccaacttcggccgaggaggccgctgccgccgagccccgaggtgctggcttctccagagcatataatttctaacaaggaaagaatgtaagtgcctctctctcagccaggcaacagcaatgatgagacttctgggggcaaagggcgtgggaagatgttaggctgtcttgagttggaaaaggagcatctatacaccctgggcattcccctactgtcacttacttgcactcttcaggccaagagcatccttcaaggtatttatcagggggaacttgccctggttgcagaaagtgcctgtgaaatcatccaggtcaatggcccagaccatggcacctccaaagttgttctccttaagccactgagcctatttaagaatcgaggacaccaggagtcattttatttcttgagactctgggctgagctgaaagcacattggaggggctgaccttaccttgattctgaagctgttaacattgtcataaccaacccactcagtgcccttgtaggcatagggcacattctgagagtcatcccatgcctcagtggctccatctttcaggaaggcacagatctttaaaaagtcaagagattcaaatcctttaaatatgactcccatgaaaaataaaacatacaccttcctctttgatttttttttttttctgtcatgtctccaattggggttttccacaggtttctaattatggccttttatctacagtaaatagcaacaagttgtttttgaaatactcagatgttaaccttattcttagtgcttgatt

SEQ ID NO: 31054 - DNA, 3251 bp, Bovine  19866880623735
tggcgcgctcctgctcggggcttctagcctgagtggccgctgctgggctggctctctctggcttttcaaggacccttgtgccgcccccaacgaaggtttctgctctgctggagtccagacggaggccggagtggctgacctcacttgggtaggggaccgaggtatcctagtggcttctgattcaggtgagtcacttgctcctcagctgtacaggtggaatggaggcttggggtataggtcgggctgggctcaacttttaatgtcccatactcggtggaggaattccagatgagctgcttcagatcctaaaagatgatgtagttaaagtgctgcactcaatatgctggcaaatttggaaaactcagcagtggccacaggactgaaaaggtcaattttcattccagtcccaaagaagggcaatgccaaagaatgttcagattcacacgattgcactcatttcacatgctggcaaggtaatgctcaaaatccttcaagctaggcttcaacagtatgtgaactgagaacttccagacgttcaagctggatctagaaaagacagaggaaccagagatcaaattgtcaacatctgctggatcatagaaaaagctagagaatttcagaagaacatctactgcttcattgactatgctaatgcctttgactatgtggatcacagtaaactgtggaaaattctaaagagacgggaataccagaccattttacctgataaacctgtatacagatcaagaagcgacagttagaactggatgtggaaaattagaactggacaggttccaaattgggaaaggagtatgtcaaggctgtttattgttaccctgcttatttaacttatatgcagagtacatcatgggaaataccaggctggatgaagcacaaactggaatcaggattgccaggagagatatcaataacctcagatacacagatgacaccactcttatggcagaaagtgaagagtaactaaagagcctcttgatgaaggtgaaagaggagagtaaaaaagctggcttaaaattcaacattcagaaaacgaagatcatggcatccggtcccatcacttcatggcaaatagatggggaaacagtgaaaacagtggcagactttattttcttgggctccaaaatcactgtggatggtgcctgcagccatgaaattaaaagacgcttgctccttggaagaaaagctacaataaacctagacagagtattaaaaagcagagatatcactttgcccacaaaggtccaatatagtcaaaacgacgtttttttctagtcatgtgtggatgtgagggttgaaccgtaaagcaggctgagcaccaaagaattaatctttagtaactgcagtgctggagaagacttttgagagatcaaaccagttaatgcaaaaggaaatcaaccctgaatgttctttggaagtgctaatgctgaagctgaagctccagtacattggccaactgatgcaaagagccaactcattcgaaaagacccagatgctgggaaaaactgaaggcaggaggaaaaggggacaacagaagattagatggttggatggcatcacttactcatcaatggacatgagtttgaacaaactcaaggagttagtgaaggacagggaagcctggtatgctgtagcccttggggtcacagagagttcgatgtgacttagagactgaacggtagcaacaacatacttcgtgcttgggggagcttgaaggttttggtcccaaaggagaataactgtgtgggtaggatatacctgtcccaagattctaaattggtggacattttagcaaaattcataacaaaattaagacatgaatgaaactgtttttctctgtatccacccaagatcaagaatgatgttgatcttaaagatgatgctgaaaccaatctatgctctttccatctcttcccagtttcttacatgtctttattctgctttctttgttttgaatgtcagacttagtggacaaaccagtggagggtttcatgttttaaaaaaaaagaatagaggtgttggcaggtattgcatggaaggataaaggtgggacaattaatgtccaaataactgggactatttaatcatactaaactgtctgctatccatatcattatgggagatgtcatccttgtctttcgagaacttagcatccctagaagtgaaatgctgtcttgatgtaaccccagcttgtttccttcaccgtcttcccccaccctcaataggtgctgttgaattgtgggagctggatgagaatgagacgcttattgtcagcaagttctgcaagtatgagcatgatgacatcgtgtctacagtcagtgtcctgagctctggcacacatgctgtcagtggtagcaaagacttctggtgggtccccgctctcattgctcctgtttctgggccttctttgggtgtcttagatgtcacattagcctcattaagtaatgttttgggctcattataagaacccagtgactaattacggcatacctataaggtttcttggacttccctggtggctcagatggtaaagcatcttgtttacaatgcgggagacctgggttcaatccctgggtcgggaagatcctctggagaaggaaatgacaccccactccagtactcttgcctggaaaatcccatggacggaggagtgtggtgggctacagtccatggggtctcaaagagtcggacacgactgagcaacttcactttcactttcataaggtttcttacaaggttttcttagagattttgcagtccattgtaaaagtagactgtaccagaagtccagtagatgacaaagatgtaggaatatacatttgaatacatgtttttatatatatagtgtaggtcaaattaagtctctgtttcctttgcttcttagcatcaaggtttgggaccttgctcagcagatggttctgaattcataccgaggtgagtgcatcttctttcctttttagttcctgttgtagctattttgtttttattctctcctttgtgctctttgagctttccttggatgtcagtgacaccaattctttgctctcctgcctggtagttttcttccaaaactatggtcaagtcccagtgttgactctagctcttaatctccctatatctttttaattgacaggctcatcaccttcttgatcacctgaggctcaaactcccagtcctcttccactcctcctttttccatctatcagtggtccccaagttcttggaattttttt

SEQ ID NO: 31055 - DNA, 1683 bp, Bovine  19866880649400
ctgctcccggagagaaatactggcgggtcctccctgtgctgtgaaacacgcccatctgtcttttttgaactctgtttctaaatggatgatggtggacaaattcttcattctgagtctgccttttccccttgataacttgaacaagggcggaggaagcaatgtgggcatggcagctggcacagaactgggcccacagcctggcttaccaccccctgtgccagtgtgtgagcgctactggggagggtctgtgttgccccattaaggctactccagacccagcccagtgctccccttaagaggtgcttgatgaatattgaacagaaggaaaatcattccatacctaccaccctccgcaactgtgagatacaggcctgctgggaagcactgaggacacgctccccagacactggtctcttcagggctgactctcccagtctcacaggagcagctctactcacacccagctcccctgtcggtgctcctggcttctgaaacaggaagctcccaagggagatttgcaggaggcagtgccctctttttctctcttctccgtgcttgccagggtaaccttgcttaccctgttccaaggggtgtgtcatcactgggaatggtgcccacccacccagggaagcagaagcaagggaccttgttgggctcacagaagtcccacccatgactcttcggagtgcctcagatctaaaaatgctcagttccagacatgcagcctgctggtcactagcccctaagagccactcaggccccccacttgccacaggtgatgctctcccagtgccggtctcagattaccccaggcactaatcacagtttccatttctcatgtgtcgttcattctggaggaccatgcacatcactcgacgctgttcaccactatgaggggcccctccctcgcaggctgtgagggttgctgaatgttacagccaccttctgtcaaaacagctgcacggcacaggaggcacatgaggttcatcatttaacttgaattacatttattcatatttgttcttgaccctaaacaccaaacatcatcgactctttcattacccctggaatatttcttaatttcaaaggaacaaagaaataaatttcttttaggtcatgggtttagactcagagccaggctgtggagccagttccaatcactccagtctcccaagataacatctcgttctgtccctgtccctccaagatgagtcaatttgctctggccattcccaggggaaggctagaccttgctttaatgaccatgacttcagctggggcaacagaactctaggtcactgcaagatggcccagcccgtgttcccccctccccctactcccaccccgcgctgagtgcccatgactagggctttttgtgtgatttggcagttggcaccctctccctttcctgccaataatggtggctgttgtttctgagcaaatggaacaaatgaccaatgtgaactccatgcaatctatgaactgaaaacatctgcagggaggcgagggcagccactggctggggtgggacttggagaggcagaggaggggcgggggagggagattcaagaacccctgtaccacctgccctgggccgctccttcagtcccactgcaaacttgagagctgggtgttgccagtctctgcacatgagagacagaggtgagcagctcaaatcctgaa

SEQ ID NO: 31056 - DNA, 991 bp, Bovine  19866880652972
atgatgatttgttaaaattataaagcaatgaattttggcctgcaaatattctacattagaaatctccaccactggggatctgttccccatgacgattttactctgaatccaggataattacaaacacatggtattttttcttgcatgctttcttgggccaaccctgcatgacaacacgtacatttacaggatggaacttgaaattcccattctcacacagggatagttaagaagtgttatcaataacaaagaataaaagttatacaacattgattattataaattattcttgtttttaacctccccattcgcctcaatatgttcagattctttcccgcagaaaacatgagcttcctatgtaacatcgttacatcattaatgatgattagaatgagctgtggagaccttgattctgaagacatgtatatgcaggtgagacgcaatctgattgcaaacactgacacagtagcgaatcaaatcaaagaaagagaagacctggaaaatacaaaaaaaaagagagattattagattctcagcacctgctcaggccatccctaaagctggagaggcttctgactttctcttctcctgaaattcatcttcaattccatacaatttagtaactcaatttccccacagatctcctttataccaaggagcaacaaactcagtgaatattttatgttttgtggaccatactttgtcacactgttcaactctgcctctgaagcataaaagcaaccacagacaagacataaatgacaggccataactatgtttcaagaaaactttatttacaaaacctggccactggcccacacagtatagtctgccaactactgaaatacggaatttatgagccaggatgtaggcaggactaataagaatacaaaagaatgactaaagacaaagtcacaaggaactctcatgaagtcccatgttttctggtattctaaatcattacaattaaaaaaaatttttggccacaccc

SEQ ID NO: 31057 - DNA, 1360 bp, Bovine  19866880667472
cccagtactctcatttctttattgtctatcctacaaaagaatgttccatgatggcaggcactttagttcacctctgtatgcctagaacagtgcctaggatagggcaggcattcaataaatttggtgtatcaacaaatagagacaatgctataaaatcaagttaaaatcccccaacaaaattactccaaagacaagttaaagcaatcaaatcaattgttacactgaatcactcccacactctacttttgaaaacagctgacttgatttttctggtgtatgtggaaaaggtaagaagccactaaaattctagattaacataaaccagagcatccaaacatactatcaaacactgggcaaatgctcacctgttacaccagttttaggataaaggaactggaagaattcctcagggatcagcccaaagcgaacttttcctccatgttcaggaagaggtggtacaggggcaagacttggctgccctgtgtgaaagatcctcgttgcctgcaataccctataggtaggaattatacaaatttaaagcttattctttaaagagaacacaacatatgaacaattgtagaaagaatggatagggatgaggattaaggtagtttccccctgtcctgatggagagagaacaaaccaagaacaggaaggccagggtccaataattagctgtgacaaggggaaacaacttacttaaagctttatgtaatcttctacctaatactagaattcctctgttaaatctcatagataatctgtctagcaccttacacatctattaccagcactaaaatatgtaagaacacagactctgcagccaggctatttgggttcaaattctaatttacacttttgtaatctgtgatttctctaagtaaagtaaaacaaagaatatgaccttagaaggttgttatgaggattaactgagttaaaaaagtaaagtatattgaatggtgctcagcatatgttgttttatgtaaatggttagttattacatagctaccgtgttgtgagctccctgatggcaagaactttgaccattctgaatattctgtgacggggtgctaaacaaccactaagtgaaacaggcttttgcagtgttggatatctctatgttcatcctttgaactgctaacgtacatccttaaaacttctattgattagttctaattttattcatttattttgtaagataacacccatgtatctgggttaaataaacatctcagttccttcacaaacctgattgtccattacaagcagcaatctgattttgtttaaaaaaatgaagtatacagaactgaacatgatactctaagtacagcttgaccaatccattcattctacaaacaca

SEQ ID NO: 31058 - DNA, 968 bp, Bovine  19866880684508
ttgggttgtttagtcctgatgaagatgctatttttagcactcaggcaatttgggcttctctaatcagggagcagggaataggcctactgaggggccagcagatttagaattccagactgagcctgttaggactagaccagaaaagatgacattcttgggcagagattggctggaggagaatccgatattttctagccccacaaaggaaaagatgagaggaaaaggtgctgagattgagcaggaaggaacctggtgggatgaccagtgaggtagcaggctctctggtaggttccctaggaaagctgactctcgtttgctttcaaaaaggcaagtgcagtcatccaggaggttctggcaactgtgaggaaggtctgatgagagagagaaaggctcaggatgcggagacaggcagggtcaggcttcctgtaagaggagcctgggggcttccccagtggtgctagtggtaaagaacccacctgccaatgcaggagacctaacagacatgggttcagtccctgggttgggaagatcccctggaggagggcacagcaacccactccagtattcttgcctagagaatcccacagacagaggagcctggcaggctacagttggggtcagagagttggacatgactgaagggactgagcatacacacaggcagcgtggaggctggagcaccagacagggaatctggtccccaaaagattggacagagggacccaaaaaagcgcttagtcacagaggaagtaagtccaagccaggaagtagtcaccatgctgtgagagcctctgggttgagcagtgcccagccaggccaaatggcatcatcttgtgaattagaaaaagtccctcctcctgctccccacccccgcagatgcagcacacagatggcggcctctcagacaggaccggcacaggagaagacacgcccttgaggccaagctcctcgacagtaacctcggattc

SEQ ID NO: 31059 - DNA, 1673 bp, Bovine  19866880691277
tggcttttctgcagatggggaagtaccaggactcactccttcagtggctcatcatcccagtaatccccttgtctcctgctttctgcagaggagggcagtaggaaacggttaccttggaaatagggagactttattatatcaccataaagatgaatctctttgggcctcagttgctctgtctgtaggcagggagaatgatactctatgtttgaagacactaaatgctaaggagctccttatgactagagtctttgattctgccacccagtcaaaagagtttttacttaaatctcaaagtgaatctttcttttggaacctagagagctcccaacatacaggccacttcgtctctctgctgtctcccctggtgttggaattgaagaggcttctgtctagggtggacagaggaagatgtcatgaaaactgagaggttcattttacgaagagttaggcctctgtccagttcctcccccaccatccaagcattcacaccagacacacagtctctgctcagcacctccgggcctgcctgccaggagaggtcctctgcctggacagaaacagttccgcagtgatatctgaacacattccaacagcacatttatctctagggtcagcctttcctgttgatgctcaggaggcatggggggactggggaggaggattgggatactggtgctggcaagccacaaggggcggaggcttgaacgcaatggggacacagaccccacccttgggagggtgacgtcataatgaggtttgtagactgcgtgtggcccttcttcacattaggatgagctccctagctcttctgttgccagtggagatgagataggcacagcctcactcagcagtgcctcatccagagcaggctaggacttggtgggtggagacgtccaggtggggaccataggatctggagccagaagaatggcagtgtttccattgtttagtttaggatctgagctctgttgggacacaacaggttctacctatccctttgagttcagtcatcagtgccaggaccttcaggctctggcagtggggcagaggagacccccttccctgaaaggctgggcaaacacaggagttttttacacccttaggaactgtctccaggagctgcaactcgctccctcaagaaaagtacttatccccaccagcagggggcaaaactgagataccttctgagggttccaccccagctctggacggctttgagaaagtgccttcacatccaatctcaacacctttgatttattctttattttcaaatgaggtaatctcaccttccccccaggctgagttttggggggcaggagggaggaggctgaaccatttgattcctcttcaacaaaaatgaaatcatgtcccctatcccccaccccccagcctcagcccaggaatatttatctctgtttacacaaccatggcaacaggctttattctctactacttaggaggaaaaagaaaaagaaaagtggagggcagtgctttttcctactcctgtctcctgctctgctcaggtgacagatctatcatttcagaaatcaggtaagacagagatagccctgcactctggtgtaatgctgttcttctcagggacaggggagcaagaaggctgcaatgtaccaggatcataaaagcactccagagctttgacagtgattgtc

SEQ ID NO: 31060 - DNA, 1348 bp, Bovine  19866880696933
cctatccttccacgtggactcagtacctagaccccaaagtccggacttgggagcgtgaactctcaacccgagtccgcccggtccctcgatccctctccggagcccaaggatcccaactgcccggtggctcggcccaggatggggagcgtgcagtcggcaagtgcccaagaggtcgggcggatggagccccagagcatcccaagagagtggtatatggcccagactcccacactctcggcctgcgttcgcagagggttcagtacgctcgaacggtgtcaacccaagcggctccagctgtccccgcgtccagaattccgagatctcggcctggatgcccggaatcgcctggcgctccggaggcgaggcagctccgtgcctcagcagggaccgaaacgtagagcttgagcgaccacagttttgggtgtgaaacagagaccgagggaaaagcagagtgcggtgaaggggcgggcgtgcttgaagggggctgggaaagaacctctctgagtccgaacgaggcttctggcttttatgagaacccttagccctgttctagattaagaggtggggtgagtcatggtggcctgagccccagcgggctcctggctggctcggaagccctcattcacgcattcgttccactccccgcaaagcccccttcagcttgtctgtctgaaaggtgtacagttggcccttgaagagctgggcgtaggctctattagcatttgccaggagccccaggagcggtgtgggatttgcatagtgatttgcatacagtaataatgattaacaacagtgccactccctggcagacggggggaagaattcggggaaggccctggctctactcccacctccctcctcccatccctggataagagctaattttctcacaactgctgtgacccctgagagttctcaaactctgggtgagcaggtctggggaggggcagtttccttcagccttgtccaatttgggagagtttaaactcagtgctttttttcttagggcttcccaggtggcgctagtggtaaagacccctcctgccaatgtgagagacgtaagagattggggtttaattcctgggtcagaaagatccccggtattcagtcctggagaatcccatagacagaggagcctggtaggctacagtccagggttgggaagagtcggacaggattgaagcaacttagcacaaacacattttatttctgcccgggtttgaactcttgtgcattcccatctttgttttgcatcttgcaggtagcttaggggctgggtctgccccaaagctttggaggtttccaagaacagttagctgggagcatcttcctcctccagagagatata

SEQ ID NO: 31061 - DNA, 1882 bp, Bovine  19866880771119
catggcttgactgcagggagacggctgagttgactgtagagcccacagctttagcttttggattatttgtgcaaccacctgtttcccttactcccaggtaattgaattgcctgttttcactcatttatgtagcaagatacctacataaacgaaatcattttaatatcttctctttatttggttgtaattgcttggagagagaaaaaaaacacgtcctttcctcctgggagatgtgagtctttagtatgatggatacaacgagtggaggattttagagatacaattggtggtaataataatgaaatactaaataataattatatcggcaacaatactaatgatgataatgatgaagctgggaggactgctgtcttttgctggacacttacatgtgccaggcaccggactctgacctttgttggcactagctcatctaattagggcacaggagcagaactgcctctttgctgcacactgatgggcaaactttgcccatccaggtgtgcggaagaggtgtgtccagaaggcctggctgaagaaccagagagcacgtgcacgtcctcctggaaccccaacctcatcccaatccacagggagaacagcgagcctgcccttggcacagaacacccccaatccacttttcaaattacccagacacacacatgccccctatgtaattatcccaacaaatgtgctaaaggaaaataaactctgcaagactgccttacaaaaatagcaaaatgcacagcacaggcctgctctgtataattcatgcaggaaacatggaaacatcttatcctgataaattgtgctttctgtgaatttgctgattatacacacacacacacagacacacacatgcttgcacgcaagcacagactgcctctgcaaagcttgtatttgataagaagatgaggacagcccaagactgaagactggctgtgccctggggaagctgtcagttgagggcccagaacctgagtggctagatgggtgaccactttctggcagcctgggcatatcttccagttcaggcttttcaggtccacgactttagcaagtccttgttacatgcccatactgggggagcaaagggatcacagagaggagtaggagtctggtggaggaagcaggcccctgaacagatgaaaacaggaccagatatgcatgatcatggtgctgaactggaggatgaggtgggcttcttgaaggacggataagagtcttgaaggatgagggtggcgcccaggggaggagaatgggtgtggcattctaggtagagagaacagctggagcaaaggccctggacaccaggaagtggagggtggaccatgagcttggcatcatggagtcatgcaatgggacagacaggagctggagctggagtgctaaggggcaggcagaaaggaagagaaggccccagccatcatgccaggtgacctccccacttggccactgcataaggcctgctcggatgccccctactcaaggagatcccccctacgccacacctcgactaggttacagctctcgccaaaacccttggccctccttccctttccatcatagtgcttctagttccacctggagccatagaaattatcctgtgatatttgggtcactgtctccccaactagacactgtgggctttctcttcacccaatgccttgtgcagttgctggtacttatgagtcactcaataaatgcttattaaatgaatgaacgggtaatgaatggttattgcaacccatcgtgggatggctgggtgggggtgagattggggaccagctgggagactaatggaataactttgcctgaaagatgataagggtctgaagcagagagcagggagtgaacaagtcaacctggtggcaaggcagga

SEQ ID NO: 31062 - DNA, 1206 bp, Bovine  19866880772502
ttgccagtattttctgctcgttctgatgtcacatactgctatatgacttaatgccaaattcatatcttatggaaatgattactgtttaaaataaaaatacttaagctttcttatgttactgagacagatgaagggtccatttttttcccttttgtttgtgtctgaaatttggagattacaaatggtagttttttgtgcttttcactttcatatacagagaaagtattggccattttacatgttgaatttttgtaatagtggttatgagtatgcaatgaaggttcacacatgctctctccaatcctgtttgcattcaattttgagatgactgattaagaaagtagtttgtttcagagttaaaagatccagattagtattgaacctataaatttagtttatcacagtgttctgatccattaagcagttcagcagagaactgtgccctgctctcatttccacttgaaaataggccttttagaggtaaaaggtgcaaaggaagttgtgtatgatggttaaggtggagttgagatagtgtacttttgttaaatggtctaaaaaccatccttttattataatttttcagaagtacatgatatacacatggaggattaaatatgttctatgaaattattttcaattattagactaatagcttttttttaaagttctaatgacttatttaggctgtataaatttagattagataaatctggaaaagaagatttctttgcatatccagtttttccagggatagagatagtttcctatctccaccctatttatttagttcacattgatagagagtggttcaaagtgtggaatggtaaaattaaccaaatttaggattaaatgcataattctttgtttggtttcagaatatatttaaattaggctatatctcataaggataggaatgtactaaactacactaagtccattctaaaggagatcagccctgggtgttctttggaaggaatgatgctaaagctgaaactccagtactttggccacctcatgtgaagagttgactcactggaaaagactctgatgctgggagggattgggggcaggaggagaaggggacgacagaggatgagatggctggatggcatcactgactcgatggacactgtgtgtgttcactcacacagtctgagtgaactctgggagatggtgatggacagggaggcctggcgtgctgtgatt

SEQ ID NO: 31063 - DNA, 776 bp, Bovine  19866880831123
acaggccttcaagaatttcaacagatttggggtctggaagaagaaatgggaggcacatgtccaggcagagacaatttacgcaaatgagttagctgctttgtaaaaagttggtaggaaatatagcaagcagttcagttttgcttgagaaccagcactccattatgtaaaggggcagtgcagggtaaggctggaaaagggacattcaactggacaaatgtcagattaagcagttttacctaatttgacaggaaactactgataatttttaaaatagggtggagctgtgatctggccactgctttagggagatggttctggcaagaacaccaaatggattgaagggaaagcaactaagcggaagaccaaataggaaactacagcaaaagtctagatgagaggtaaccagtagctgaccgagggcagtggcaatggggacacagaggcaggggcggatggaaaagacactgggtaggaaaggtctataactctgtctaattcggtaccccccagccccatgtggctatctaaattgaatttatgtacactaaagttataaactttgttactggcgtgctgtagtcaatggggtcacaaagagtcagacatgactgagcgactgaacaagttataaaatccagttcctcagtcaatgctcgatagccacatgactactgtattagatatgcggataaagaacattctcatcacagcagaatgttttattggatggggggtggatcactgcactttggggggtcagtttgggtgcagggatg

SEQ ID NO: 31064 - DNA, 730 bp, Bovine  19866880832653
ttacaggatcacacgtaaacgagacgttaagcgttccaatataaccaaaacaaaggtaattactggcctaaagctaaaggcagattaacccagaagtgaaatgaggtgataaagcaaggaccaaaggagatattacatccctcacacttaccctggaccgaggagggctgcgttcttcagagagggggctacaaaattacaaagcgtaggttagcaaggtcacgatgaaatctggtttgtctcttcctcggccccaagtctcactgcgcttttcttcacgccctttcctcccacccgctccaagcaaccacagacgcctcgttttacgatcactctgctatccaggaccagggtgtgtacctctcacctgctgcggcggcggcagaaagtaccacccgggacagcattgtcaggtagcgttcacacagcaatcttcccgccccagtgaccccgacagaagaatctgtcagggacagaagcaagatggacgctcagaagtctcgcgagaagagaacttcgtgccctttccgtcaacttccggtcttttctccccctcgcgataagaagcagagagccggttgcgggagggtgctggcgggaaagccggctgggctcttagaagcagatctcgcgagatgtagggaggctgtagcttgtctagaggggcggaggcccgagaggaaccacgtggggactcctggagctgaatctcaggcgggcatccaatttg

SEQ ID NO: 31065 - DNA, 1898 bp, Bovine  19866880847404
ctcagattagacggtgacaattactccttcttccctggttatggcctcccccttcctttctctccctggggagaacaaggaggcagatcagtctcctgggacctaagaatagatgtgggaagatcaaaggagggaagcggactggcctcagagagcccctctcgtgccttacatggccttgtttaaggctgagcaacagcccgagggatggggggagcagagaatgtgagcagagctgcttggaaaggctcagggctgtctgaggacgcagctgagccatcctcgctgccatcaagggtggcctcggagataaaaccaagctcccttattgtcagggaactggatggagggcgggcgaagaggtaaggtactctctgcacgctccagaccacgagaatttctttccagtttctcagccgggattctggggtctccagagctgggaaacaacagtaaaaaaggtgaggcaccatccattgagtttttgtgactttgcccttggtgtgaaagcagcagtgacagaaggaggctgtgtggatgtggggtaccagtggtgtgtgggggtgtgttgtgtacctgagtgtctgtggctggggagtcaggcaggggggccctggtgcaaatagttcaggtttagggagtttggaattctggaacaaatctctcttgccacttaactcttgcctttccctccttctccaggaagcaggtgctcggcacctcttgctctcttgagcagctcattgaagagaaacaaaggtgcctcgaaggggacctctcttgggggtgatgaaaatcttttttcccttctgctcatttgtgtcacattcttccattgggccgggcgactgacaggtgcacccttccccaggcccctttcagagtcccctccctgctgtttgtgtctcacccagatatccagcagacaccgcctttacaggagctaaatatgattagtagaaacccttcctgacagctccaaagagaagccctcaaatgcatattctattgagtgcatctcatcgctgctgacagtcactttatcaattaaattccaccttcccagtcttcagagacgccaccaacctccctacctaataaatcatagaccccagttatcgttaaatgtcccatcagtctctaataaaccccttgccaacaggggcaggttatttattatgctgcctggacaaaaatgaattgggccccgttctcagaagagcaaacgtgatgcctttctccctaaagactgaggctgtggtattaaatggggcaattcatcaatgtgggccttgagcagaggggagtctggtcgagagagagagagagagaggatgcctggggtcctttactgaaagccagggaggcaggcccccgtggtgggaggtggctgtgaagagagtgggaacccgggcctttgctgcttctcccctgctcctcatacctgtctgaaaacactaaggatttggtcaccccacaggccaaggggcacatgtgaaaatagttattctccacatcaaaagttcgctacgtaggatccaacaaggtcatgaaacaaaaattctgtccagaaggccagatgctgttacttaataaacttgacataacttaaagttatggatggtactagtccactgagtagatgaactgaagaatacaggaggaagggttccctttgcctggaagagagaaccagaaaacacgtgctcagtcactgtttgtgggctaagcagcacataggtaagcactgactctcaaaaaggggcgtttaacacctaaaagaccctgttaggtgtgagaaacagtgtgtagagtgggccttgtagttactgcctcatgttagatcccaaactgagaggatgctcgatggtctgcaagtgacaatccaaactcctcag

SEQ ID NO: 31066 - DNA, 1943 bp, Bovine  19866880870888
atactttactatacttgattattctataggaaacacgtgaagcttttgaacaggaagccaagcaaaccaacaagcccaggctgctggtcaccgctgcagtagctgctggcatctctaatatccaggctggctatgagattccccagctatcccagtgagtgactcaccttatcctcaaaactcctgtaggcatcactcttgcaaggtagacttgtgctttgtcttactacccagggactttgtttagggtgttttggaggtggtatcttttgctcgcttaagtgtgggacatacctactattgttatttagtcactaagtcatgtccagctctcttgggaccctatggactgtagcccaccaggctcctaggtccatgggaattcccaggcaagaatactggagtgagttgccatttccatctctaggggatctttcctacccaggttcagaagccgtgtctcctgcattagcaggtggattcttaatcactgattctttaatgttgagctaccagggatgcccacataagtatgggaaacagccatgggaaatgctttacaaccctgtattctacctcaggtacctggacttcatccatgtcatgacctatgacttccatggctcctgggaaggctacacaggagagaacagccctctctacaaatacccaactgacactggcagcaatacttacctcaatgtggtgagtctccacacagatgcagatgcagaccagagatgatgtaaattacatgcagattcagggacaaaacaaacaaattttgcaaaagtctcatttggataaatcttctaagtgaccgattttatctcattaactataacctcaccaaaatatttttgaaaaagtacaaactaatctatgtcatgagcatcattaaattttgcctgttaggtcagtggactagcataactaagcgtggggtcttcagctgggtaggcctctaactcacctgctaccttttcaggaatacgccatgaactactggaagaaaaatggggccccggctgagaagctcatcattggattccctgcctacggacacaatttcatcctaagagacgcttccaacaatggtatcggtgcccccacttctggagctggtcctgccaggccctacaccagggaggctgggttctgggcctactatgaggtaggtaggctgggctgtacattggaactctgggaatgccatgtcctgggctgcacactagccttagggctagaacctgcaagaagcttgaatgttcattctgtccactatttacatactttaacacaaatattactccagatgcttcagatgtataagtaacctattcatttacctaatccagtatgaagatttatagcgtgcaatatcccttcaaactacaattgttgtttgttgtttagtcgctaagtcatgtctgactcttttgcaactccatggactgtagcctgcaaggctcctctgtccatgggattctctaggcaagaatactgaagtgggtcgccattcccttctctaggggatcttctcaggaatcaaacccatttctcctgcatctcctgcattggcaagcagattctttaccactgagccacctggaaaaaatcctcccaaacactttttcttttctttctttctttcttttttggggtgggaggagtggggtgacagtaatgcaaagcacataggatcttagctccccaaacagggatcagatccacatcccttcattggaaggtgaagttttaatcactggaccttcagggaagtccccacttttctttctaaggtccattgttagacatggcaaatgataacttgctgttttacacataaattcacagcatatcccaactcagaccagccagatttaagatgttctatgactgccatgttgaactcaacatttacacctcaaggttggctcttg

SEQ ID NO: 31067 - DNA, 1870 bp, Bovine  19866880881831
attccactccaagttggggcacatcctctgggcttctctggtggctcagatggtaaagaatcttcccgcaatgcaggagactcggctttgatccctgggtcagaaagatcccctgaagcagggaatagcaacccgctccagcgttcttgcctggagaatccaatggacagaggagcctgtgggctagtccatagggccgcaaagagtcagccacgactgacaactactatactgtccctcgcttcatgctgtgaaacacacagaccttgcacctgattcagtgtctagtcctgcttggtttaaagttatttaaacaacacacacaggttgtttgagccacccatgttcaggtgcttctcactctgagtaaactggcagggcatgacagggcagcgacatgccagaatctgagcactgagccccttctttttccaggtgctctgctggaagctggggcggggaccatggtgcctgactctaaggagcaagggctggctgtgctttcagaaggtggtgacgggagggagagagcctcctgagatgactcactaacccggcccatttccactgaatttcctttccgcgcccataccctgctaccggaccttcagtcctcatcctctccgcactttggaaagccagtggtgagatgcccagagccagagacaacccacacgctcaccctctccccagtcctctgtgatcatttaatggttggtttcattcaaataactcaaagtaatgtaagccacgctgcccacacagatgctaatagcaatgttgagattctcctgcgttcctctggggagctcatgttcttaaataatgggagtggagaagagaagggccatttactgaccaaagggataacagcgggaaagaagatggggatggggtggggcatggagaaaccctgggtggggtgtcagtagagatggggagtgggggaccagggacaggatggggactccatgcaccccagaacttgcccattcatgctgtgcaggctccccaagggcctaaagagcaactggttcatctgggaacctccactcttccccagggcttggatttgccagagccgcacttgagccatcccaagtccatgccaggacacatgtcccagggtcttcttgcctccaagtcccctaatgacttccctgatcataattatacttgccttccacaactgtttcctaacaggaccttttgggttctcaaaagccctcatccttctaaggtgtagaggaaataggcttgaattgaatacatgagaggaaggttgtgatcactgaccctctccaaaatggaatcactgcagcccaaagggtaaattcccatccctgaatgttcaggcagattcgttgccatctgctggggaggttgctgaagggagtccagctctgaagggtgatagcaaagtaggattcatggggcttacgtagctctctgcagatcccacggttaacatctatctttccctcatccagctaatctggcctatccaaggagctgaattcacaattccctggtctctccaaacatagtgctgtgtggctgagagctgctgacccgaatctgagccatgctggcttaccatcaggaaccctggagccctctgggggagtctctgagcagaacctcccaggtccctctgcagacttgcagttctgatggtcactttggccaaggactcttttcacttggacctctttagagatgaagaaatggaaatgggatggttcccagtgccccaccatctagaggctagttccccaggctgtgatcatccaggctactgggctaatgatcagatttcctctgaagagggagagactgacagcttgtgaaactgacttggaagtgagaa

SEQ ID NO: 31068 - DNA, 679 bp, Bovine  19866880895414
ccttggggcctagctgagtgtccccagcctcttcctaaatgactctgaactggactgactttcgggccagtgactcagcacagcacactcccttcagctgtgctccctcctggtgcagattcaagatgtgctcccagaacaggagatggtcccttcctgaagtgctcccgggaccaggaattgagccctgaaaagtaactccattcgctgcccaagttccctgccagctttcccccttccctgctgaaggagaagctgtgtgcttccaaggaaagccagcctccctccttttggactggatcctctaggaactgggaggccggaaccgtgagagcggaaagaaggtggatgagggctaaaacagacatgcctgtcaccaagtcttgccatcagaatcagccctgcagcactcatctggtatctgggagcagaggggaaagacggctacagtctattctccatgaaaatgaagcctgttttttccctccctgattagcatttttattgtgtccctcctatttgctctgcctgctcataattaaatactgcccatggtgtctcgtctatcttggtaatgttctcctggacaccgatgaatggattttttttttatagacttgctccactgattgaaaataagactcaggttctgtgtgtccgctgatgggataagtcagcc

SEQ ID NO: 31069 - DNA, 1922 bp, Bovine  19866880909733
tatggactctagttcgcttgcatcagattagtgaagagatgattattctaaggagtactcccacaagagccaggtgcttccaaagtccatcccataagaccattactggcacaggaatctggtgaccaaagcaatagaaaagtcaggtgattctcaggagtggaaaccatggcagcaaaactaagagagactcaaagaaggcatggtaagactctagtgatcccaatacctgtagtaaaatcaatgtagaaagtcatcttgaaaaattaatggagcagttccaaagttccagtagccaagagccaggagagtttccatttgtctatttctgagggaaaagaagcaaagagttgcatcagaacaaatggaaagaaagattgactgatcatttcaacatcagctgttggagggactgggaaaccaggagtctcacacagcctctcatgctgattttctttgttctcatccttatttcctaaattgtgagagtggttggagtaggtgacctcaagttgctatgtttcaatgtctctactgttctaattactccccttggagtgaagtccttgagtaaagacactgagtgcttcatcaatgccagctttggatggattctgagtggaagattgtttccatctagtccacaggaacgtggactttcctgaatttcccttggctatggagctatatttcaattgccaacctcttcctgtgaggcagcaatttcccttatgttagagtcgtcactgtgctggaaatattaaaaatccgtgtgcttcttgttggcctgtttggaatttctgcttgggggctgctgtggaaggttttgttcaacctattcttgaaggtaaaaagattttgattcacagtcctttcctcatttacgtgtctttcaggccaatgagaacttggtagagagtctcatcctttcttttgatggtgtgatctcatttcccacattccagcaaaggcatagatcagatgagtatgaaggcagaggtggggccaggcttgaagtgccccagacctggcaggtacttgggctatttggtgaagtagtaggtcagttggtgggcagaacctactacccagaggaatagagtgggaaactctcactgagaaagctccctggggagttgcagattgcttaagaaaccacagatttccaaataacttttctgtttaaatctgaagagggaaggggaggatctgaatgagatccttgtgtattgcagcaaacctgtaatttacaggcaactcagggctgacagtatctcttagaggtacctctgttcttccaggatataattaaaaaccttataaatcagttcagttcagttcagtcgctcagtcgtgtccgactctgtaaccacatgaactgcagcatgccaggcctccctgtccatcatcaactgctgtagtccacccaaacccacgtccattgagtcggtaatgccatccaaccatcttatcctgctgtcgtccccttctcttcctgccctcaatctttcccagcatcagggtcttttcaaatgagtcagctcttcgcatcaggtggccaaagtactgaagtttcagcttcaacatcagtctttccaatgaatacccaggactgatctccgttaggatggactggttggatctccttgcagtccaagggactctcaagagtcttctccaacaccacagttcaaaagcatcagttcttcagcactcagctttctttatagtccaactctcccatccatacatgactactggaaaaaccatagccttgactagacagatctttgttgacaaagtaatgtctttgctttttaatatgctgtctaggttggtcacagctttccttccaaggagtaagcgtcttttaatttcatggctgcactcatcatctgcagtgattttggagccccccaaaa

SEQ ID NO: 31070 - DNA, 1479 bp, Bovine  19866880943308
ccccatagaccgcagcccaccaggctccgccgtccctgggattctccaggcaagaacactggagtgggttgccatttccttctcccagtgtgtgaaagtgaaaagtgaaagtgaagatgctcagtcatgtccaactcttagcgaccccatggactgcagcctaccaggctcctccgtccatgggattttccaggcaagagtactggagtggggtgccattgccttctccgtcaaatgctcagaggcaggaccaaaatccagactgcagaaccaagagttgagagttgggaagagagaacatcagaggaagagccatgcctgacacgctcctggcccagaggaagttcaatctgtgttttttgaatgaattagtgaaacaatgaagaggaggattcagaataatttaaattcgtccctaaaaactatgggagcatctcccctaatgaagctgtgagtgtggtcagtgggttcacaggagtggacaggccaattttctgaagtgcagttagtcataatatgctctctttgtggtctcttttccaagaatcccagctcaaagctctatgaatgtgttgttgatttattgtccggcactacaattccttgtttcccattatctctcaccctcacttcctttagctcaccctaaaattttgctcccctatcacaaaaaaacaaacacccatccctctcaaaaaagaaaaacaggatgccccaacctcctcaaatttctgtccatgacatcatataataagagtcttcagtctagcattccccaaagtgtagaacattattctatagaatgataatggtaaaagaattgtggatgcgtgctaagttgcttctgactctttgtgaccacatagactgcagcccaccaggtcctctgtccatggaattctccagtcaagaatacgggagtgggttgccatttccttctccaaaaggtttgtaggtcagataaatctagaaaacattggatttcacaaaaccaaacaagtatcttcagtgaagggcttctcagactttaataaactcgtctgcattcctaaagaggaaacgccaaatttacttaacctcagagcccttttatgtggtgcttcctgcaggactggggttctgcactttggaaatctacagttttttccttttttcttgttttcttcagtgccctggttcccttatctgtaaagagggagttaataatattagtgacctcatagagtagctgtgaagattaaattaattcattcaggtaaagtgtttagagggcttcccttgtcgctcagctggtaaagaacctgcctgcaatgtgggagacctgggtttgatctgtgggttgggaagatcccctggagaaggaaaaggctacccactccagtattctggcctggagaattccatgaactacatagtccatgaggttgcaaagagtcataaatgactgatcgagcttcactttcacttcacttttcaaag

SEQ ID NO: 31071 - DNA, 913 bp, Bovine  19866880952590
cccctatgacagagtttgccctttttgctgcagtaaacacccagtcagaggtaggcaataaatctcaattcaattctccttttctatttccaacaaagtagacaatttgaagtcccttccacgtgtcctgactccaaaggcgatggctcatactgaacagatggggctgcagatttcttttattaagttcataaataaaatgatgctacaatagaatcaccatgacaactggcccacaagttgcggactgattctgatctcaggtgttctggaggccgctttaacctcgccaatgatcatttgcagataggtaagaacagaggcagtcaaggggttgtgctcggccactcctgagcaatgccacagtcagataacatttcaagatcttagttctcacgcaaccagctagtcaaaagtgaagaagagggccagatctcgattagggggccaggagatcacttctgctgtattccttagccaataaatctctgacccagtgttgaatgaactccaaggtatgactaacttctctcaggataccactgggaaagtatttgcagaaaagtttaaagcataatattccagtttacttctgaattagtattccatgctgttctacccaaagaaagggagagaggctacatcagaggttctcagagtctcttgactcaaagatttggaaactgccacccgtttgggggaagtgtatgggaaactgccaccagactgaatggacactgcttcttatcagtaagaaaccaaagtgtgataagttaagagacatattcattcacatcaggaaacaaattgagacgagggcatcagcagctgtgggtgcaagtgaagtggtgctgtcacgaatgccaggatacctacactcttagcttccacctgcacgtctacacctctctcc

SEQ ID NO: 31072 - DNA, 1106 bp, Bovine  19866880953481
ccactgctgtacccgatgtatccaatctggattaaacaacgtgccacaaaatgattatgactgtttaatacctgtattctcctgctctacattagaaaataagggtaatttgaacagagactttctccctcgccagaaagtcacagaatctcagaagggtgcttaagctctggtctcatcttcccttccccatcctccctcaatgtgagcaactcctttatgacatccgagatggttcttgcctgcttgtatactttagtcatggatgttcactaacagggaaagcatttgattgcatttgtcaacagctctattttgagactcagccctgcattactgaaagaaaaataggcttttatgtatccgtactggttctgctgagaatacactgaatatctaccatctaaaccaacgtctcaaactaaaaggaaaactcaaaattaaacgctatatagagtatagcaaaaagctcggatattagaggacagagcacatgttcaggttctatcatttatatgacttcacattagtgtttgtgtgtgtgcatgtggtcacaccccgcagcttacaggattcttagttccctgaccagggattgaacccttgttcctggcagtggaagcacggatgtctttaaccactggactgccagggaagctcccagtctcttctctcttggcttcagtttgtttcctcatcttaaaaatgaggggactgggttagatatcttgaagatctcttcttagtaattctggtttaggtagtgagaactggcattttcacatttcaccataatgtggcaagaacaatgggagttcttttgatttccccacaacagccatcgatgaaaattgtaaggttaaagcaaatataaggtttgctgtgtgtaaatgtaaagcaaatgtgtgatgccggaaggccctgagttggctgtgaaattcttttctatcactaatgttcatagctttatcatccactaggtgtcactacagatccacagttcaaacaatctggagcagaataatgaaatcaaatgcatggtgagcaatatgtgctttttcatgaaaaaagcacatgttaactggggtatacatgcttgttcacag

SEQ ID NO: 31073 - DNA, 1030 bp, Bovine  19866880954530
cttgttgtcagcaagttctgcaagtgtgagcacgatgacactgtgtctacagtcagtgacctgagttctagcacacagcagaaaagtccgcagtagaagacttctgcatcaaagttttgaattcattccgagctcactctgggcaggtcacctgcgctgctgcctctccccacaaggattcttccaggtggtgaggacaatggaattttactgcaggataccggctgtctcaagccagcaccacagaaggactgcagtgcctctggctaccttcctacctcgctggctgggcctcctcagcagaacgaagttgtcttcggtgctgagaatgggactgtctcccttgcagacaccaagagtgcgagctgtgccctcagctagctgcgcactcccagggtgtcactgggctggtgttctccccactcggttctccttcctagcttttgtcagtgagcactgctcactcgctatggactgaggcctttccagagtgtttagaagccaagtccacagagactttgtgagagatgctacttggtacccaatcacagtgggctgggaccatcaggtcatccaccatctcacacccacagaacctctcccagaccctggagtgttgctgagcagactggatttcagacaaaaagcaaatcccccagaagtagccactctctttgcccctgccctctcagttgtgaggagccacatacagtacgttagtttatcggatctgtgcagttaataggcagtgtctctcggcctgggggaggccagattctggagtcctgaactcatggaagaaaaccttccttaaatatggatatgtatgtgtctgagtgtgtgtgtggatacataatttttgttggttgggggaataaaaaatccttcctatagggacttcccgggtggtccagtggtgaggtctccatgcttccaatgccgggggcctggggttcgacccctggtcagggaactagattccacatgctgcaactaaagataaaagatcccatatgccgaaactaagacc

SEQ ID NO: 31074 - DNA, 901 bp, Bovine  19866881006983
cggcatcaggggggctgagcggggacaggagggcccaagggagctgctgatggatcccgagagtaatcataacaccagtcagtttatgtaaagtgcttactggtgtcaagctctaaatgcatcatctcatttaattctcaaaacaactctttgaggaaggttcaattactaagcctccttcaaagatgaagaaactgaaactctaagggagtatttcttatccaaggtcactcaactcaaggtggtaaagccaaaattttagctcaggcagtcacattccaggactcacggcataaagggctttgccatgtaaggatctcattagtggccaaaggacttctttagtgtctgtcttctgccagaggcagtcaaagcacagtgacaatgtttctaggacaggaaggagaacctcaccctctctggacagaagggactggttaatctgtttagttaacatctcttgcctcgagagaccccaggcaagatattcaaaaacaaatcaactccagtccctccccaacaggaaggaagctggtgagaaatccagatgaagggggcacaggaatttcgtggttcacaccgttcccttctccagtctcagccccctgtcccagagccaagccattacctgggacactcagtgagtggggcccgctcgttcccatctgggaagcaaaacaaggggatggctccgagcagccggtcctcctcctcttgttgaccccgaagcaagttctctcgctacaaagaataggaaaagagacaggtgggtgtggaggtaggagcaggtggagagggcttagggtctggcgagcttctttggaggctcctaagcagtctgagaagcttttccactggtgtgggacttaaagcttgcctctgtgcccatcactgcacacag

SEQ ID NO: 31075 - DNA, 1566 bp, Bovine  19866881037449
gacttctttgctaatgctatagaaatcccgtgtaggagcacaatgtcttaagcaataaaggaggaggagaaaaaataatccggagagaaatcagcttgcggttcatttaaaccttattgaaatttctactgtggaaacatttaaatatcatagttactgccgtgtgtcttcgctcctgctattcccgggtgtatgtttcgttgcacatttggttggtgagcagaacaataaagctgcttggaaattgctttcccactgctaggtaattacaacaggtttttattccaaatgtaaagaatgaactgttatttttttaataaagggagtgctcggttggtcccggccccctccgccctcctgcctccagctgtactggccctttgctcccacatcctccactgcatccttctctctctccctccttgctcctaagaggcagctggaagcagctccccagctgctggctcctctgtctccccgcccaggagcctcgcgtgtcactgtttagagaaagaaatggccccctccaggtgtctgtcaagaacattaaatatttagcctgactccatccagaccagcaaacatactcctgtctcccttccctacccgccgtgacacatctccccacctccatcccatctctctttttttaatcccaagcaagtgagccgggattaactcggcatttgtcagttctgtctgagcacaggcgtgagctcatcgactctcccaccagaccgagcagagaaagtgtcttttttgctttcagaggcaccgtgtggcctggcagccaagtgagcacccggccaaggctgtggcgtctccagttcctaccacctgcccacacgtagcttctctccttcgctctctcaagtgtattgcaggtcggcctccccagtcacctgacgcgtttctttctttcctaaccccctctgactctggctacttgtcctgggaaaacaaattctctttctgctgtcacctctgatgtcaccaggagggaggaatcgtgggggcagcctctatagctcacgtgacccagcggcagtccagggtggcctccgcagctggcagaggaggtcagctttgtggctccaagtgccccttcccctctctgggcctcagttaccctctctggaagatgagagacatggaggagatatctttgcatccctttgaactatgataccccaggacttgacactttgatcatatgcattttgatccactgtctgctgttttgccctatccatccccacgtgtcctgccctgagcctgaacctctttggctggaaccagacagaagccctgcactagcctcaagctgcctggctccaaggggcaaatgtctgttagatgaaggtttattctagtgagtggaaggtggtgaggctgtcactggtgccctggtggactgataggactggagacccactagcttcagagggaggcaggctggtgggtgggctcatcaggacgaacaaggtactgctttggagctgactctgacctttggggaagccacttagtctctccaagctttggtttctacatcattttaatggg

SEQ ID NO: 31076 - DNA, 4132 bp, Bovine  19866881042046
atcagtgtaagaagcatcccagtggatttcagagatattaaaaaactgggaggagggcaggagatgtgtgttttggaactgatgatttgagatataccctgtacatcccagtgatggggatctgaaacatagtaaatgttcaataaatattgtttggttgttgaaggattggagtaaaaggagtgaatagacagtagctaattgggaatgctgaaaaggcacctcactccatgcctcctttgagattgttttttatgtgctggcaaattactaccaaatatattattctttgtacttaaaatatgtttgcttgaaatctgtcattaaaagttatatattatatttaagaagctgaaaccttgttactgtgttaaatcaacaaaaactttaagatcaaagcaaatatgataatttataataatgtttctctgaatcactggctggaatcatgaatctcccaaccttcgcctgttgttgcttttcagttgctaagtcgtgtccaactctttgcgacccatggactgcggcatgccaagcttgcctgtccttcactatctcgcagagtttactcaaattcatgtccaatgagttggtgatgctatgacaccttctcatcctctgctgcccccttctccttttggcttcaatctttcccagcatcggggtcttctccaatgagtcagctcttcacatcaggtgaccaaagtactgaagcttcacctaggacttggaatctggttcacattcttattttctctccaccacctcttatgccataaaactgtgaaactctgattttcatgtggaagacttgtgtcacatgatcttacatgcccttgactcctcagtaccagtggccttgccttatcttctccagcattctcctcccagatctcttcttcttggtctgtgaatatcagccattctctaacattctacctatttaatctgccattcttctcttttaccctttccttattttctcccaaatcctcaggatttcagcaaatcatcttcatttccaccctaccagaaaatcaaaagccatcaggttggaactccctgagctccctccccagcacctaaaagctaaaaactctaattctatctgttcctcctctttcagaatgactctttctccagctcaaggctaatcccttcatctgatctctgcctcctcctcaggaaactcttactctattaatcatcccctctatctcccttactctaagcttccctttcacttggtctttcctgacagcatgtaaatattttcatctcttctctttaaaaacaatttttactcgtccacacactgctcctttctcctagtgctagccctttctcttcccttcaaagccaaatttgtacagtctacttattattgtctccactttcatctcctattcatttgaaaggctactgtaatctgaaatctggaaatcatccttcttataccaataaaattgttctttagggtcgccagtgactgccatgtggccaacagtatctgaccttacctctcattagtccttattagcacggaacctccctccttgacatttcttctcttttggttttcatgacaccattttctcctcctttttcatactttagtcttactctgctttattctttgatcagacagaaggaggctctgtcttcagccttttgctctcctggtctacttatgacatttcttgggtggtcttccatcaaatacactgcttcagcttccacataggaccctcagtcccaaatctgtgctaaatgcattcaactcaaacttctccccacattggtgataacagatttcagttaaacgcatcattttctcccataaacctgtttttcctcctgcctcagtgacaagcatcaccaaccagccccagagttgtcaagccagaagtgaggccatgcccttggactcgtccctccttcagctgcacatctgatcagttacttaggcttctagagtctgcctcctaccatctgttgatccatttccaaagcatctactttaatgacacctttgtcatctgtcacttgtttccctatagtagtctgctaattgcttcttcttcagtctgctagaataatcttcccaaaatacaaaacagatcatgttatttccctgcttaaattaattagatggttcctcagtagctttcaagataaaattaaaataccctggtacttccctggaagtctagtggttaagactccatgctttcactgaaggggcacaggttcgatccctggtcagggcactaagatcttgcatgctgtgaggtgtggcaaaccaaaataaaaacaaaactctaactcctaatcccttatggtgtgcctctgactcttattcaaccatgtactctactactttctttttctgatcacacttaacaatacacgcaggatgatttatacccccagcctcctcctcagtgctctcctagcctctcctctttggtccagctaactgctgcacatccttcttgagcatctcttcctcaactaagccttccttaactccctgattagctgctgctcctctattctacaagagatcctatgcacacctctatcacctctatttcattgctggtgtctatatatatatatgtcttgtcctagaatgtacactccaagaaagtaagaaccatgtattatttggcttaggctgttatatatattagtagaatgaatgaatgaacaaatcagctcatatctttgttcacttgaagactgagccttcaagtctaaaaataagtgaatgaaaagttgttttacggtatagaggttcctcaaaaaattaaaaatagtggccatatgatccaacaatctctctcctgggcacatacccaaacaaaactgtaattcagaaagatacatgcagccctatgttcacagtagcaccacacacaacagccaaaacatagagacaagctgtacatccactgacggatgaatggataaagaaggtgagatacgtatagacaatggaatactcttcagccataaaaaagaacaaaataattccatttgccgcagtatggatggacctagagaggatcatactaagtgaagtaagtcagaaagagaaagacaaataccatagattacttatatgtagaatctaaaatacgacacaaatggacttttatgaaacggaaacagactcacagacacagagaagagacttggggttgtgaaggggcaggggatactggagagggatggagtggaagtttggggtccgcagatgcaaactactgtatatggaatggataaataacaaggtccctctgtataccacagggaactatcttcagtattttataataaatcataatggaaaagaatatttttaaaagaaagtttatatgtatgtgtaacttaattactttgctgtgtagcagaaattaacaaattattacaaatcaactatatttcaattttaaaaactgttttacactctagacagagggaaaattgtaggtaaactaagtaatgataacagtgaaagaaatatgaaaaaaaaagcacttctttaaattagataactttgtttacttaatccttctctaaactgtattattctcttaaaagagtatgttaatatattattaatattttggtgtcttgctgatattctagtttttatgtggaaaaaagcttaattcattaggaatacatcttaagctgatctcccaaggaaaattcaagtgcagcctaagtacttgaaacacagatccaggttctacaatacacctaacatggtttgggttttctcaaccaggactctcacttggcatttaaatttctccaagactttatcccaaatcatctttcaccattcttctgtacttatcttataatattctagtcaaattgaacatccaaacactctctgaaatgtcctacatttctcccaatgctttatttcttctctttaggcctttatttcctccaccaagaatctctctgctccacttccaacaattaagtattaagtgtgacttcatacataaacatctctctgatttttttctgaagagattctcttcatatcattttgtacctcttactatacaagttttatttttttaacttgtatagcaaaaagactata

SEQ ID NO: 31077 - DNA, 1410 bp, Bovine  19866881059308
ctccccccaaattcccactgcatccaggggctccaataaagtcttgcctgaattccttgtctggcctttggtcaatttcacttgattggggaaggccaagaactctgatcagtatcagttattcccccaaggagtctttttgcaagacttgcacttactccagcaaagttaccattgctcaaaatatttttggatcttctttccttttgtggagggaatgaagaggatggaatctggaactctggtctcactggggtttgaatccacctcctctaccaagtagctggatgtggccttcagtggatcagtctgctttctcatctataaaatggggatgtcaatattacctacctgacaaatatacaaaacattaaaaatgtatttaatagtagaaactgttgactctcagacagatataaaatgaacacatgccaatgatttcatttaacttactatttaatgagagaatcaggaaaatgttaaaaccagttcaaataaggatttggctttattctctacagaacaaaattcaattgcattgccatggataggaatcacttgcatagcaatcgttaggaaatattcacattactgtcggttttctatgaattaacttctacctctacagagttgtaaaatagcctattcaaaaacacggacataccctacaaagatcaagccatcccactgaaaggatatccagtaatctcttttgttcactccaaaaatctaagtttttccttgcataggttgttgtaaagatttacagggttatctacttaaagcatatgagaggctgattcatagtaaataagtgataaacattggatattactatcattattgccttcatgtctatagtgtattactttgaaaatcttggtagctgtttttctgctgtggaagggagattcaatttttttttttaaagggcaaagttatttgaagtcaagtctgctaaatattaattaaagaacagcaattttgtttttgaagtaactgaagtttcttatttttttgacaagatgagtgttctttcaggtctccttgactagatacgtcaaaaaatcagttctcagaggattctgtgagatggcagagcaggaagcaccgggaatctgtctctccacccagacagcaatagcaacagcagaaatgctcaagggagctctctggggtgaaatgaaaggacaccagacagtaatttaaagtcccacgaagaaatacagatctcaataaaggcaaacacacgggcgatggtaaaagctagtatcattgtaacaatggtttgtaactgtactttttgttttctacatgatttaagagactatacatttttaaggaaaaaaaagtcacatcaattacaagtgtaaaactaataccactgtaactttagtttgtaactctaaa

SEQ ID NO: 31078 - DNA, 1009 bp, Bovine  19866881111031
tttaattttattttatattggagtatatacaatgttgtgttagtttcaggtatccagcaaaagtgattagttatacatttacaatatcccttctttttcagatttcttccccctctaggttattacagaatattgagtagagttccctgtgctatacaaaaggtccttgttggttatctatcttataaatagtagtgtgtatatgttaatcccaaactccgaattaatccctcctctctacctttctcctttggtaaccataagtccttatctttaaaacaggcataatgaaggtacatactgcctcttgtgctttcagccataatagagtgacagcgactggatttaccttcctatcttaaacagctagaaaatcatataaaatatacgaatcaaataatttcagacattgggcaacaggcagtacaggattctctgagagaaaagaaccaaacaggggtggggttagggctataatttccccacctcactgcctgaatgcaattcttaggttgcagtccagggaatgggaacccagacagaggccagtctctcagagtctaaggagactgaggcagctagagctttccaagcagaaagagctctagaaatatgaaaaggatcctcttaaatcttgggctaaatactgacttgcacatgcagggactcaaactccatgaggctagggaaagaatcatcacaaaaaaatcaggccaaacaatttccagctgaatggggctggatagtgtttgtgtttccacgagttagagtgaacagaccatttaataaatgcacaaggtgttggatagggtcctcagaaagtggtgagctctggactcatcctaagtgaagtacaagggaaagtcgctcattcgtgtccgactctttgtgaccccatggactatataaacagtccgtggaattctccagaccagaatactggagtgggttgcttttcccttctccaggggatcttcccagtccagggatgaaaccaggtctcctgcat

SEQ ID NO: 31079 - DNA, 781 bp, Bovine  19866881203942
cacctatgggcgattcccaggggcaggactgagggtgaacaagaagtcagggacccccaggtgtcgtgggacatggagtgggggacatttccatggggcaaggcctctgcaatgcccctggtgatggcctgtccactgtctcttcagaacgatgactactgcacgctggggattgaggccactttcctgtcctcctccagcagggagcccctgtggattctgggtgatgtcttcctcaaggagttttactgtctttgacatgacccacaactaggtgggctttgccctctccacctagaggagtgtgaggcagccatctccactctccctgaggactctgcggttgccctgatgcctctggggtgagggcaacgcttcaaacaatcctgattccttcagctcacaagaacctttcttcgtgaaactaataaactcaaaaatcttcaaacatctttgaggttccttccaataaacaacttagtatttaattctaatttgaaagttagcaacagctgttgggggatctgttaattgatggacgagaacatgcatgtagcatgggtgtcaaggacacggtggtttctgcaggagggtccctggttagaggttttcacgactcctagcactctcttctccatcactatttttctctccattcttaaaaaagaaagtgaaccagagcaattgatgactcaagaatttttaagtaaacagaaacctaagatagctttttaaacaggggctctgatggccaaatatgaccagaaaacagtttttgtgt

SEQ ID NO: 31080 - DNA, 2096 bp, Bovine  19866881218394
atgaggcctgcatgacttcctttttatgcaacatcttgagatgacagaggtgcccacaccggtctagcacagaggaaacatgaagttcttagcccctgaggatagagcagaaccggacgcctctgtcttcagtcctgtacagccggcagaagcctcaaaactgccttactttttctttttctaaattaaaaaaaaattttttattgaagtatagttgatctggggcccccctggtggctcagcagtaaagaatctgcatgcaattcaggagctgcaggttccatccctgggttgggaagatcgcctggaagagggcatggcaacccactccagtattcttgcctggagaatcccatggacagagaagcctggcaggctacagtccatggggttgcaaagagctggacacaactgagcaactaagtgaacacacacacacacatatatatatttttcagatcctttttcattataggttattacaagatactgaatataattccttgtaccatgcaataggtctttgttgtttagctgtttatatatagtagtgtgtatctgttagttccaaactcctaattttcttctccccctgtcctttcccctttggtaactgtagtgtttcctatgtctgtgggtttgtttctgtctcaaacctccttactttcctttcaagggtgccaaggtgaagcggggcagggagtgggagctaggggcagagaatctactaacagtaggcctcaggctcttccaccctccctgcaaaccacaggagaggcctcctgaagtctttcagaggggcataggtattctccctgctcttagagcagggaaaatccttctccaggcttgctgtgttagtctgctaggcctcctgtaacaaactcagactgtgtggctgcaacaacagacgtttgtttccttacggtggtggaggctggaagtccaagatcaagctgtcagcaggtttgcttcctcctgagatctctctccttggcctgcaggggaccaccttctcactgtgctcatagtcatccctctgttgtctgtgtcctgatctccttttctattaggacaccagtcagattggactggggcctattctaatgaccctactttaacttcattacctctttaaaggttctaagtccaaatacagtcacattctaaagtcccgagtggggcttccatggtggctcagtggtcaagaatccacccgtgaatgcaggagacatgggttcaatcccccatctgggaaggtcccaaacgctgtgaagcaatgaagcccgtgggccacagctattgagcctgtgctctagagcctgggagctgaaactactgaagcctgcgtgccctagagcccgtgctccacgacaagagaagccgccacagtgagaagcccgagtaccgcagctagagagtagtccccgctccctgcagctagagaaagtccacgtgccacagtgaagacccagcacagccaaaaataaataaataagattatttttaaaaagcactgggtggttaccacttcaacacataaattttaggggaacactgttcaacctctaatagctggttgccaaccccaaaacaggcaaaaatctgcctccaatgctttcattaattttcctccagggtacaggggcttgagatgtgtttaaaagaacgatggtgttttgtccgtgtgttttcacagatgccatggtcatggacgagaaggtcaaggaaagctttgtgctggacacagcttccgccatctgcaactacgacacccactataaggaccaccccaagtactggtgtcgaggctatttccggtactactgcaacatcatcgccttcacacccaacagcaccgaccgcgtggccctgagggacacaggaaaccaactcattgtcactgtgtcctgcctgaccaaggaggatacgggctggtactggtgtggcatccagcgtgactttgccagagatgacatggactttacagagctggttgtgaccgatgacagaagagccatcaccaacaatttctggtctgggcaaggtaaggaagctattgtgggtctagctgggggtgacccatggcggtgggt

SEQ ID NO: 31081 - DNA, 1240 bp, Bovine  19866881220318
tgaatactggggtgggttgcaatgccctcttccggggatcctgctgctccagggatcgaacccacgttttcggtatctccagcattggcaagtgggttctttaccacttgtgccacctgggaagccccgctaacaggagggggagctctaaatgcccaggcctgggaaggccatccaaggggtccaaagcagcactggaagtccttggattgtatcaggcttaacatatcagccttaagttgaggagccaacatgttctggactccttgcaaggtctgtgccatagatattactgcctgtgtccccttcttatgaggaggacacagggactggatggaaaaaaaaaatactactcatctgttcagtttttgctggtgaccatttgaaggagggtgggtagaggctgaaggtacagattataggtgcagggactgtttcttcttccctggtgattccttctgcttctgtgctgatgtttcccagggctctgtcctttgtcttctctgcttcttcatttgcccttttccctggagggttgatgggagtccctgatttcaagctcattcaggtgctgactgttccttcctgaactgtccctgaccactaattatgtaccacggatctctatccttgtacacaggcactcctctgtgtcatctcgccactccccttcaatcttctccaaaagatcatttcctctaaaacgccccgttcaattgtgtcatatcctgcacttcatttctggccttaccttcttccactcacacatgtttttctttccatcataaagccctgttctctcctacttgaccaaatcacatcttttcacactctgatgcctttgtacatgctgtcctgtcttccagaaatgccatatttcctattttctactgttttcctagcaaacttccactcagtcccagaccttcaatacccagcccaaaggtcacataaggcatattgattcatttcagatccacacctcaggaggaactaaccattccccacttgggctcccacagtccttcctgaatacctcggatatagttattaccttggttgtttgcataacagcctccttctctgactttaagctgtttaaggaaggaccacatcttagccatctctaaacatgctagctcaatgctcagcacattacaaatgctcaagaactttgcattaggaatttattttaactttctttctcatagctcccttgattttacataactgagaatat

SEQ ID NO: 31082 - DNA, 957 bp, Bovine  19866881369635
tgcctcttgggaaccgaatgtctctgggacctttggctcactctctaaaggctgttgccatggtttcatcctgctgattaccttagacattgacatttacacaaatttgcctttcctggcacaggttgttgaatggccctgggaggttggtaagatgttggttgcctggcgagggaagctggtctgcagcaagatgtttgaagctgatgtttcagcagctcacgaaggagaggccctgggggctatttaaaaagtggtggtgtgccatatggctgtcagcgagtgcctgactgagagctctgtgctcaggagaaggaaagaaaggtccctgtgtcatcgctggggtgtagggtttctcgtgctcattttgttcagggagcactgttgcactcaccccttgcttaggcaatgctcacaaatgcagagtttaccttaaactactttcctggggggaaaaaaaaaggaaaatgggaaaacaaatgtttatgagtaagaactagaagattgtacttgactccctacattttgctccagaatgcttcctgctgtcactaaaatcaatcctgccctcccaagatggagatctgcccccttgggagaagacagcatgttaaagaatgggcaagaagctgcaaaggcgattcccctcccacaaaagaacttccataagtgtcttaaaccaggcagtggttcagtctccaggtgatgattctgaaagaacaacacactcgaacgtgtgtgttctcagatgtttgttcaaacatctgagaaaaaaaaaagcctcgtgggctgcggctcctcctcactggttcatgctgatggagtggggagagcagcggggtgattaactccaagcaatggataactgaaaactcaggatgcttgacttcagatgtatggtataatatatggaaagcgtacatatcttactgtgtgtttgccttcttaattatgttt

SEQ ID NO: 31083 - DNA, 1038 bp, Bovine  19866881370245
aaggcatgtgtggataaatgaattcccctggagccggggcggcccttcccctgaaaaggggggcaagctctgggtaccctgaatggagcagagcagagaaggcagttggagtgccctggagcccggggggtccaagcagctgtcagaggtagaggtttgctgaggaggcaacaattgccacactgttcctcaatggaggattgccacatgtccccagccccctgcagtaagggatgggtatttacttttccctgctgcactgttggcaaaggaaccccccagagctcagccaggagaagggaggatgatgggcccgcatcagtccacaggaacactttgtctcgcatccacactacctgggtcagcaaaaccagcccaggcgcccagtgaggtgaggaatagtgccatcggctctcttctcctcctgggtgcccgcagagaccccgtggaggcccagggctgcgccagcagacagcctcccctctctgctgggggcgtggagccccgggcagagtggaacatctgtaaaatggggatactgataataatagaaactgcgcagggcggctgtgagacttacacggagtaatggatgtggaaagtgcttggtaaactgtaagacattatacagatgtgcatttacaatttgtaaatgaattgatgggagatggcacaggatgcttgcccaggaactacttggaggcagaggaagttaaagaagggggagtggccgcaaagcgccccgggaactgtgaccgacacagaaagacagtgtgtggaaggtacatgaataaacatgagacatcctccgactcctaactgcctaattgtgttccagttaacaaggtagacaggcagctgctggtttctcccaggcagggagggccacctcattcctgccctgcttagctgcccacccagagtaataggaaccagaccctgggcgggggggcctcccctccctcctctgccacagcctggccccctgccccttcatgcttgcctccatgcacagcagtccctcgggggcaggagcca

SEQ ID NO: 31084 - DNA, 715 bp, Bovine  19866881371975
accctgagagctgagacccgcccacccccccagctccatgcccacggcccattatatgcccgcgtagaatgattgctatctggtctgccaagtaactcttggcttttcagtaactaatactgcagtgtggagccaaaagagcggtggtgacacagtgtggggggaaacgcagcggctgattcgaggggcctcggctttttgcaaccatagttctagtttctcagtaggattcgttttgtccccatcattaccttcttccttgcctcccagcctggcaccaatggcttgatcagagaaccctcaaatgctgggcataaggtgccttactgactccccagggccaaacaaagcgagatgtcccccgggcaaggaggaccgcagctcatccatccccagtggccgcccagacccccaccgagggagcagagacagactggctgtatttttagctcccttgtgggcccctgagccctgccccactttctgaaaacagagggcttggggcccaacaccatctggacttagtagtggggacggtgccttctcctgccgctcatgagcagaagccagggggacacacagccctttcctcgtccacattttccaggccaggaaatccacgcagtgggggctccaatgggactggggtctcctggaaccacaggtcctgcgtccagggctctggcagggcctccaaaggctttgctatgggaac

SEQ ID NO: 31085 - DNA, 1403 bp, Bovine  19866881406362
cccagctctaccccttgcagccgacttaagaaagctgaggccagagccttgtttctgcatctagaaagatggagatgctgatgatcttttctgacttaaaatggaatctcccctcccttccctgcttcgtttcctccctactatatattatcttgtctaaacttgggtcccctgaaaacacagcctaagacctgggtaccacagcatgtgggcagcaactgcagagggcaggtgtgatcgagaaaggaagggagaagggacggtgatggaggtttgtgagctggttttcctggggtcaatttgggctcaatcccatggggatcctggagggactatttaggcacatccagagctgtcccgcaaggacatgtacagagcctggagctcttgaacctgtctccctgatgactgtgcctctgtgagtacagagagccttccccagatttcagagaaagcccctgatttacctttcccttattcatcttcctcccctgagcccacacagatgtaaactccccaggtgcagggatttgtccactgctgtgcctagaacagcgcctttcacatagtagacagtaaatacatgtgaatgaatgaaccgattaaaaagaataacgtacgcaacattctaagcctaggacccagcttggggtaagcatccaatcagcagccattgtttccatggtcaaattaaatgagcctgacttgtgccctttgtggtgcaggtgagcagagggcagaggcacttttctcccacacctttgagccccctgggcaggcgagccgacagatgctggggtcgtgaagagcagcgggccaatgccaggcaaagtgaactgatgattcctggcagcaggtctaggctctggtccggatagccccccatccacatgacccctgatgggctgactaatggggctctcgggtcccgccccagggaacacttgtccttgctaattgtgtgtcagaggaaatctgtttccaatgtcaaaggcagtttttaatctgctgtcagagctcaaagactgtattccagccacaagcagggaggtggtgtgcgctagaagtccccgctcccggagctggggctggggtccctcaggctggtccctgtggctcgaggccatcggagctagcctgcccctggctgcccgtcatctgctggggattaccatgccatttgttctaattcttgttgacatttcatttcacacgctattaaatgaacctctccagaagggatgggagagaagtttgctctagcgagagaggaaaataatgtgtactctggggtcaaacaaggtcctgatttgtttccatatagaaacctgagtggatctggagccatgacccagcccttgggaggtgggtcaagggtttgggcccaggggctcccaagtcat

SEQ ID NO: 31086 - DNA, 1249 bp, Bovine  19866881473410
tcccctgccggtgctgccacaagctggtgtgttatttcaccaactgggcattcagtcggcccggccctgcctcaatcctgccccgggatctggacccgtttctctgcacccacctggtatttgcctttgcctctatgagtaacaatcagattgttcctaaggatcccctggatgagaaaatcctctacccagagttcaacaagctcaaggagaggtgtgttcactgtgtctgtggggctgtattttacaggtaaagaggagtaagtcttttcttctgttagtcgtcacctttcctctgatccttgggtccctccttctgtcaagggctctctgtagtgtccctgctctgggagttccccgttgatcagcactttgagctcgtccttgcctccctgcccctgtggctgctgtgcccctgcctaggatatgctcctctctcttctctgccttgcaccccaactcacccttcaagcccagtgctcaggattctattttcaaatgcttcggagagagctgcatctcacaaaagcttcacaagtgctagtgtttcattatcatttgtcacctgcaaatgaaccccaagggaagggctggtgtctatggtctttgtacaccagtggctgggtcagcgcccagcagagagctggtgctcagtgttctctctccaggcttcctgggctgtcctctgtggggagtggtctgtcgctgtgtgcatggttgtagaagggcagagaaaatccatgtcactagagcacagcctccagagaggagagcagggagcttgtccatctgttcactgctgtgtttcaagcacctaaagcagtcagaggcacatattaattgctcagtaaatgtttgttgaccaaaaaagtgagtgaagagaaaatttaggctgccttttcttttcctgggaatgtcatgggagtgggggagtttggggggcttagacagcctgggatcctgggtgtgatgatctatatgtggactggttgctgtctcttttatccttcttccccatcttgggctccacttctttctcccttaggttactccacccgctgcctcctttccctccccctcctcccatctccactacttcccactgttccccaaatgactgaatgagaatccagctcaccgactctgtccctcctcacagtaacagagggctgaaaactctgctgtccactggggggtggaactttggcacctcgaggtgagtctgtgctattgggtcttctctctgggg

SEQ ID NO: 31087 - DNA, 904 bp, Bovine  19866881662156
gtattgctggttttgtgattttcctgctgcctgagtgttccgggtacaggtttctacatcggtgtatcctgctccatgtctcctcgggtaaagcccccagccccccgcaccacgtggccacagatgcttaatcaaaggacgcggatggggagaatgaaggccccgggccgctctggagtgtgcctgcttcagaaatacactgaaagaacgagaccacgcagtttctaaatcagtcatttgggctagtttagcatgaaaggctctgatgaactgggactgattcatccattctcggtgttctggggaggcacacggcagaggtccctgagaatgccgtgaacttccggcatgaataacgctgcccttctcccctctgtcgccaacagggcagccctctctgcaggtggcccggacacacagctgccggcctgagctgccaaggcagagggacaaggccacaagggtgggctgagtgtgtgtcccaagtctgcctcccacagccaagcccccatcccctccccctatgctgtgtgaggtcaccacggtgacttcctgtcttcggtatgtcagggctccatcagagccaattggcggcgggtgcggataagggtctgtaagcaggggtggctgtcagatgacctgtggccaccaagcacagcatcgattctcgcctgtgctggggcccacagaggatgagggaggctggaggaggagggagccctttctatatttagctcccactctggtacatcccggtggacagctttgaaagaggctgacttccagcccagcatgggaaggtttaacattcctcaattaggcacactctgtgtggggttgtgttttgagagggttttttaaaaaatagataaaaaggaaagcaagagggaagagaacaacaaag

SEQ ID NO: 31088 - DNA, 1160 bp, Bovine  19866881800137
ctctcccctccttcctgtctgcattccacaagtcctccatcatttgaggatgtgctgttattgttttgggtgagtgctgggtgttgagagccgcatatggaaatccaattgtgtcaagctcattatagccttatataatttgattgcaccacttagagccagacctttcttgtatctgggctctgtcttcattactttcttgagatgaaagattctcctgctctcctctgtggcacttcttttaatcttatcttaccctgggctctattaaggcaacagattgtcatatcaaatgcactatatcgtttaatcatttctcacacaggataaagaggtctgcaatgtattcacagaaccctacccagcacatgtaatttggtgaggacttttggcttgactttgagctcctgagggccagagtctgtggtttatgcacattttcatcttaagcacctagcacagagctttgcactgaatgtttgctcaagtgaggcttgtgatggcccaggaaggaagatgatcctacacagttggccagaaatccacgttaaaaaagccactgtgatgcactcagtccttgtgtgggctggttagcctccctctcttctatggccagaagtacagtgtaagagttaaaggaatgtggatatcatctaggctgttttaaagacaaagaaatggaaaaaaaaaaaaagataaagacaaggaaatggaggatgtgaggggaagggactttttcagggcaagacttcagctcagatcttccaaccttcaggccaatgctgcttccataacatccctcttcttccctacatttaagctccattcgggcaagttttaacctgatgaacaaagcccaaaacttgcattttcaacagctgtggagattccaggtttggaggagaggtcaggatggaggattctgccaccctggggacagttcctggtacaggctaataagcccaagaattctgggggcccctaggagcctttcacgatgaagcacttcctggctggctggctgccaggtgtccttggagcgtgagtatcgacatctctgccctgggagaggcagaggaaggagaaagggagagaacggaaaagccgaaagagaccatgggcaattgcactcttaagcattcatctcagagaaaagaaaa

SEQ ID NO: 31089 - DNA, 725 bp, Bovine  19866881930401
ggataaggaggaaaggggatctttctgaccttgcccggttttgttcccactagttctgaggacgttttgtaatatctctaccattcaccctttcatttccttgttcttgtcaccaataggaaatagtattagagccgcagtcataggactacttaacttctactttactttctttttttttcaagccagaagtttacaaaacttggtgtggagaagagtaattcccatgtcctttagtattctcagagtccctagtggggggtcagccaggctgaccacctcttaagactgtccttcatttgttgactacatgaataaaggaattagattaatgccaagaatttgcaaattccttcagaagctgccactagctgacaaaggggccaatgttgtatagggcatatgtgagcagatggtctggaggtggacctgagcaatggtttaaagtctccctgaaaatcttttgttgttcataaaaaggcaagagcacacggtttggtgaatacagatacattttaaatgcacaaagtcagcagttggcagactataacccttgggccaaatccggccctccacctgtttttgtaaataaagttttattggcacacagccacatccattagtttcatattgtcagtggctgctttccagctaccacagcagagctgagtagttgcaacagagaccatatggtccacaaagcccaaaacatttattatccacta

SEQ ID NO: 31090 - DNA, 2650 bp, Bovine  19866880187991
ctttgggatatggtgggaacacagtagattggaattccagaggatgagttctaaatctccaccttgttaccacaggagatagggcccaaggatggtcatcattaatttcttctctgcccatgctcacatccactcctcagactaagtggtaagagtctatttgccctctccctcgagctgaccagagtgactttgtttaatcaatatgatgcggaacttccaagactgcttcctcctgggatgagttgttctgggacagtccttcttagaacccaatgactaagttgtgaaacgcccaggccacataaagcggccaggtggaggcgctctggttaacagctccagctgcacttgtagccacagccagcatcactgccagccatgtgagagccatctccaatgtccagccaagccaaacttttagatgactcctggctgcaaatgcatgatgaatgacccgggtgaacacagtcaactcaaaggaccgtaagagataataacaatttggtgtttcagctcagttcagttcagttgctcagtcgtgtctgactctttgcaaccccatgaatcgcagcacgccaggcctccctgtccatcacctactcccggagttcactcagactcacgtccatcgagtcagtgatgccatccagccatctcatcctctgtcatccccttctcctcctgcccccaatacccccccagcatcagagtcttttccaatgagacaactcttcacatgaggtggccaaagtactggagtttcagctttagcatcattccctccaaagaaatcccagggctgatctccttcagaatggactggttggacctccttgcagtccaagggactctcaagagtcttctccaacaccacagttcaaaagcatcaattcttcagcgctcagccttcttcacagtccaactctcacatccatacatgaccactggaaaaaccatagctttgactatacagacctttgttgttggcaaagtaatgtctctgcttttcaatatgctatctaggttggtcataacttttttaagccactgcattttggagtggtgtattatgcaataatagacaaccagcacaattatcaactagcttttacctttggcaaatcagttcacatcttcgaatctcactctcctcctctgtaagataaggagatgagactagaaaaactcaaaggtcaccttgagctaaaagattttataactgtagttctcatcaacatagcctcaaggataatcaatggtatatccattttttaattaaagtaaccacgggaaagtgaggtcatttcagagtaagccaaatatcattctcctcatgaataatattttcaaggaggaccaggaaaaaaaatacactaatgaagaagaggatacgtaaaaaagaagagtgcaagttcacatttaaaaaaataaaatattactacttactcactattatatttaacacatttaataacataagtcttcttatcaattctgtgtttggctttgaaaacttggccaaatccacctgagccaattggtgttacttctgtgaaatcgttgaacaaccttgagagataaaatgctgctgttattctgagttcaatgtcctctgttcctccactccgacccttctgctttcccttaaaggcactagtgaaatggactctataacaaataggactctccccttctgagtaagaaggatccatttcacagaaactcttgaatcacaaaggataagtcttccctcttcccatcccaacataacagatcactcctggggagtcagtcaccgcctggctgcatgaaagaatggtaaagaatcttctattccaagtataaaactttagagaagagtgccagactgtgttccctgctactaccaagctgtcatacaagaaatgagcctgtttatgtttgcacctctctgggtttcccctctctcctgccccacattccatcattaagacctgccaattttctttccaaaacacatctgcgggtgtctgcccactttcccccattggcgcaagcttccaataagactcccaccaaaccctcttcacaagacacaccacctcctcaccttcctctgctccagtccacgagcctcacagcaatcagtgtgataaatactaagtctgatcacgactattggccaaacgcttcccaagcctgcccctgcattcagcaaaacccagaaaaccctgacataggctaccaggggccacctgtttgtccccgtcccctctccggcttgtctggtgaccccggctccttggccactgccctcctggcacatggctttctctcagttcctcgggtgctcacattacctgtagcactttcgccttcccatgtgctcctctttcacagagtaccaggggctccccaccgccctgtgctaactcatccctcaagcctccccacaactgtggcccagagaaagccctgcctcatccctcaccctaaattcaagggtccccaaccacaccatggcttttcctttagaccgctggtcacagtgtgtaattatcatccccacaaaaactccaaaaggacacgggctgcttctactgttcctgctataaatacgatgcccagcacagtgccagatatatattaggtacttattacatacttg

SEQ ID NO: 31091 - DNA, 1075 bp, Bovine  19866880419625
aggaagagcagcacaatggtgaaggaagggtggatggtccattacaccagcagggacaccctggtcagtaatcacaggcatcttattatggtagtgaaactctgttatgtgctttacttcgtgcgttttttaagtccaaatgagaatgagatatatattaagacatcatagtacaccagaaccatctttatatttaggatgttaggaatatttaaaaggtggactatttaatgtactatttttatagattggtagaacagtacagagtcaaagcaagtctgatggtacaccaccaaatgcacaatctctgaaagaaagaattggtattccctggtggcttacatggttaagaatctgtctgcaatgcaggagacccaggttcaatccgtgggtcaggaagatctcctggaaaagggaatggcaacccactccagtattcttgcctagagaatcccagggacagaggagcctggtgggttacagtccatggagtcgaaaagagtcgaacacaactaagcgactttcacttcacaaacttctgctctgcaaaagacagtattaaaagattgagatgacaagccacagacttggaagaaatatttacaaaaaagatatctgtaaaagactcttctccaaaatatacaaagaactcttaaaattcaacagtaagaaaacttaataatctgattaaacaatgtgctgaagaccttaacatgtacctcaccaaagaagatacctagatagcacataagcatatgaaatgatgcgccacatcttatgtcatagggcaaatgcaaattaaacagtgagatactgctgcccatctgttagaacagccaaaatcataaacactgagaacaccaaattctgacaagatgtagagcaacgagagctttctttgattgctggtaggaatgcaaaatggtattgctaacatttgaagacagtttagtagtttcatgcaaacctaaaatgcttttaccagatgatctagcagtcgtactcttttgctgtttacccaaaggaaataaaaacttacattcacatggaaacctgcatatggatatttataatg

SEQ ID NO: 31092 - DNA, 716 bp, Bovine  19866880442968
acgcttcttttctatacagtcacagctgcagtaggcagtgaggaagcaggaggcgtggggtagccacgtttctctaaagcgggtgattaaggatctacacagttatactttttgctgctttcttttttcttccgagccaatcaaccagttcctagcagagtcagcagatgatcaggacctgagtcgtttcttgatgtgagcactggagcttttctgccggccacatggcaggaaggaggagagggtgaggtcaccaggcgtttccagggctacacttccttgttgtcgctttcttctgttctgttgttggttgttcatagttttcgttgaagctctagcttaaaaagaaacttttttttaaaaaaaaaagactgtttggggatttttttttttccttcttatatactgaatctacaaaatagaaactacttcattttaattgtatattattcaagcaccttggttgaagctcaaaaaaaaaaaattatgcctctttaaactctagcaattataggaatatttatgtaactcttatgcttcagaaaaacaaaagtatttgtgtgcgtgtgtatataatatatatatgcatatatatttatacacatacaattttatgttttcctgttgaatgtatttttatgagattttaaccagaacaaaaacaaacaggcattccatcacaaatttttgactaacacaaaatctcattctacctg

SEQ ID NO: 31093 - DNA, 1270 bp, Bovine  19866880510015
ctttaactttattgtttatattttcaagagaatgaaacagtttccatcaccaaggattttggcaactcatctccattatgacaaattacctgggtccatcttcaagaacaaagccaaggtgagtgtccctccactggtatttcaatgtgaagttcttcatgtatagatattggctttctgaggtataggatgagtttgctactcatcacagaattttaatgaataaagtgtgcagtttggtgtttcttgttttttcttcagataaattggctatgctgctgctgctgctgctaagtcgcttggctacagttgcattcaaatgaaatgtattttcagccgggatataaaacatatacataaagtagcccaccaggctccactgtccatgggattttccaggcaggaatattggagtgggttgctatttccttctccaggggatcttcctaacccagggatcaaacccaggtcttctgtattgcagacagatcctttactgactgagccaccagggaagcccttaacctccattaggtatttgaattccaccaagtggctgtctggactactcacatctcccattataagggactcctctgtcccctctgccaggtgtggatggctctgtaaaacagtttttctttatactgagaatctcccaaattggaaatactgctttaatccataattttcccagtttaatgcagttcagtagaatcacaaacctcagtgattctttttccccccttaattattccatgagacacagagctaaagtaatatataaagcatttggatttggagcaagcagccttttgaacaaagctttactttcacaagaaagcagggccagagatgaacgacagttaaggtaagaagttgatactgagattttatccatacactccagcaggtgaaagcctgctggccttcaccatgctcacttatgtctttgcaaaattataaattgctatgagccagagagattcctgagtggtaaccagagccccaaatataagaccctcaagtgacaagaatctgctgtatttggattgggggcagagttttagatctcagcaaagacatagactagcacattcatctctattcagttgtaccctactaccgtcagttcatgtctttagattgatgaggcgttctggaatccagactccctctcactttcatgccatctacaaatttgataaatagagcttctatatcttaatctgaaatcctcattaaaatgttgatgatggtctagtcagga

SEQ ID NO: 31094 - DNA, 702 bp, Bovine  19866880547913
tgaacaagaacaacaacatcataagttgtgtcaacatttggaatatctgcataactcggtgaaccaatattttctaaatggccaatgtttgatataggaaatcatgccattcaaaggacaagctagatcatttgaatgtaacatggtgcaaaaagtccatttcagattccatatggcaactaatcggccttttaagagataattacttgctgagttttggtatagaatcaaagaaggcaattggttgttatctaaaaaagatattaaaattttactcccttttccacctaaatgtatatttaagacaagctttccttcgtatagttcccttaaaagagcacatcacaacagacaaatgcagaagcagatttgagaaccctggtgtcttctattgtcagacactaaagatattagccaaatggtaaaatgatgcccttcttcccactaattgggggaggagttggaaaaaaaatgtttttagaaaacaaatatttcatttatgttaatatgtaatggatttattattttaaatgattaataattaaatgattttttaaatttctaagttttaatttccagtatataaatattgacagctataactcacataaacaaaagctctctgatttcctcaataattttaagaatataaagtggtcctgagagcaaaaaattgagatcttttattacagggaatgagtg

SEQ ID NO: 31095 - DNA, 912 bp, Bovine  19866880622174
tgtgctgtaaattaggaagacttggcctcttgaacagaagagaaaagcaaggatgtgaatacagttagcagtgggagtgagacggcagcaggagccactatgaggcaccagtacattctgaacagtaggtaacacttgcagaaagatgacgccagatgctggtgttcagatggagagaggcgaggtctgtgtgtgagatggtcaggccatcagactgatccagtgatggggaggaggagaatttgtgagacagactgtagaagaagagtagacatgacttgagggaatagagttaaagagctgggtgaagaagatgcaaaggaaaaaggaaatgactgttccttgtgaatgagatgcaggcaagtgtcatggcactgatggtgtcaagggagtccaagacttggagggaagatcgttgttgtctaactctacaatcccttggactgtagcccagcagcctcctctgtgcatgggaattcccaggcaagaatactggactgggttgccatgcccttcttcaggagatcttcttgacccagggatcaaatcctcatccctgtgtctcctgcatgggcaagtggattctttaccactgcgccacctgggaagcctggagggaagataacaatttgtatttgtttagttttaggtggcatttggacttccaattgtaggaggcttaccaccagcaaggaataaatgacaaaggaaacacaaccaggatgagaattcaacaagacagatttcctaaggttttgagtctaaagggagaaaaagaggctagcggcatgctggcaatcaatgtgttaaggctgaaaaacacaggaaaagagtgaaaaattgttagagcacagagaacccccattgtttcttaagacaaaggttataaccatttactaccctgctattcta

SEQ ID NO: 31096 - DNA, 1122 bp, Bovine  19866880649433
ttaaattgtccttttctgcctataatgaaaatgtacgtatcggctctttaagcttgaatatagtcagctcatgggtagtaaagttacacattgtgagttcgtgtgaaactgtctatgagctggtccaaaccatccccttgttacttcatgtcctgcagctggggggaaatctgggccaggagataacatagataatggtagaattttccatcacagggaacaactgccagtgctaaaattaacacgtattgaacaacagtagcatattgagggcctactaagtagagggagagaaatacagtacatgcaatgtaagttacagcttttttgaaaacatttaagggcacatagtcttgaaaaaacaaaaatacactgaacctcttcaacctcattcatttttcttatgtttctagtacagtgcccagatttgtaccccacatcatgtttataagaaaacaacatatacttgaattctttagagaactgactttattgatgttaatggaatatcagatgggagtttggggtgggaggtgctgtcctgagcagttcaagcctaaatgaagattggctttctgctgagaaaaggctccacctgggagaccagtatgttgaatagccagcaggaatagccagtttataaaaatgttaaaaatgttcttctcttcctaccacacctcgacctgctctgccacagctctttttatagtaatgaagcttacattaattgtttgaaattcagttgctgccttagaaacgggggcaccatagttatttaaaaagaaaaagaaaaaaatctgttgagtagagctgtcatttactggaaaattaaaaagaaaaagggtagagaagagagggatgagttgatgagaaagaataggaatgtgtttgttaaaagtttatctttgcttagagaaatagaatcttaagttgatcaccatctatattccaagagaagttttactacagcttcagatctgtagtatcattttattaccttcctgtgttaaatacttagatttgttaaagcaatccttattttagattttaagtgtttatttctctaaacatcagccacttacaaatttaaaatcaatttaatttaaaaattaatttcattca

SEQ ID NO: 31097 - DNA, 1394 bp, Bovine  19866880656983
catggcccttccctcttctctgtcggagcccggctctctagccatctttctattcaacaagtccaagcactttcagtgtgctagacactcttgtaagcccctgacaaatattagcctactaaatcttcaaaacaacccctataaagcagatacagtgcttctaatttgattaattcatcgtattggagaagaaactggcccccagtcacactgatgggaagcagcagagccgggctccacgaccagccgccagccctcccgtgacactcccccgccccctgccccagcgataggaggcatctccaccgtgaacaaacacccaaaggcactaacgatgtggcacagaagctgaggccttgacctgcctggacatggtgacaagattagagggtctagacacagccaactcctgctctgattagtaataaacaattacagaatgcacagtccattctttccctgtgccaggagccctgcacacattattttaatcttcccaacagttctataaaataggaaatattattattccatccgatgcacggctcacagaagaagctataacataaagtccccaaataaaaataccacaaaaatcatttctgaaatatattaacacactaccccatcatcttgattcttttacagacttgtgagtagctgagtgagttgcttgctcctggtgtctccttagaggatggcaatttttacataacacatataatttagcctggggcatatttactttgctacactgggagcttggaaatcctgttacaagttgggcctttgcttgtggaaaacctcaagcaacttgaagcagtggctcccagcctggcaaagcttccttattcctggcttggggacacaagctttgggcagcggcctcgcagcccatcagtttgtgcttcatcccggtccagcacccacgtccgtgctgccccacagcctcctagacaaatacccagggtaagcgctctgtgtagcctgtgccctaattgctatgagaggagccaaactggggagggagacaggaagagaggactttttaaaacgtgaatagtttactcaaaagattttccgtaggaatgaagaagagtgaagattcatgtttgaatgcctatgtcttttttttttttttaataacagccttcttgagatactttttgcctaccgtacaattcactcatttaaaatattcagttcaatgattttcagtgtactcaaagcagtgtgaccatcaccacagtcagttctaaaacattttcttcacctcaaaaagaaaccccacattcactgacagtcactcaccacgtccccctaaagggctcccccactgaccctagataaccaccaatctactctcgtgaatgcctatcctaatgcttggctgt

SEQ ID NO: 31098 - DNA, 2033 bp, Bovine  19866880695877
tgagggtagagcagattgtaagtttccgcatctctgtaagacttccaatagtgttaatgtttgttaagaaaacttaactgcctgtatgggtatgaattttagaactgtcttaaagacagcttaacacttcagcgtagatcaaaccacctgggaatgtttgttaaacatacaaatctgtaggtttgagtcacagcaacctatgtctttaataaacaggccatgattctgaggtagaggctcaaaatcacatttttaagcagttttaatgaatagttaatagtcattgtattactacatatacctaggaattgtttcttctggttatttttactaagacattttttcttttcagattcttttagataaaacagatgacccatcattgaggcagcagttacttcaggggtataatatgttaatgaatcctatgaagatgggagaaagattcaactttcttgccttggtacctcatcagagacttcatggtagaaatcatcagacgaatgcacgtcagtcaaaaccctctccatcacctgtagctgggtttggtgaacttgcttggcagtgatatttcagtttggacttttcaccccccaagttggcctaagaaaccagaataaagggaacatattttatatatcacaggtaaaattaagtattaaaatattttctctcttcatagccaataaaaataaaccatacagtaccactggaagttgatcttttaaggttgtatttgattcttggtacaaatgtttgttctcaatttaatgaaacaaattattgagtatcctctaattaataaagctggttgttataaagtgtaaacatgaatactgattggtttaataacaactggaaacaactggccattcacagggggctgattaaatagaactagttgctccgtggcatgtgaaaatcttctggaccaggatcgaacccgtcccctgcatcggtaggcagattcttatccactgtaccaccagagaagtccgaaagtgaaagaaaaaggagttgttcagttgtgtctgacattgtgatcccatggactgtattcctccaggcttctctgtccatggaattctccaggcaggagtaccggagtgggtttgcctgttcccttctccagggaatcttcccaacccagggaatcgaacccaggtctcctgcgtggcaggcaaattctttactgtctgagccaccagggagaccccaataatgggcataggttatcctaattttgtatacttatgggtacaaagcacagtccagttaaggtgtaatgttactaataaatctttctgccttcaaactcttctgctaaattcaatttatgcttaaaatgatcagaagggagaagaggcagaatcctttaaggaaaatgctctcatcagaatcctggcttccatcaggaaacaaaacagtagttgggagttgctggagtggtttaatggctaatcttcagtagtctagtcgcagtaactaatgatagttatcatgagcaaatgtttcctgtgtggtacacagtcatgtggcaggtgacggtggggacacaccagcccagtattttagggtctttttatgtgtcagggtctgtgtgagaggagaaagtctatgggaaacaagcaagagagccaccacttgggctgagtagaagcaggagcctggattttccctctcaggcactggctagataattagagccagcagcaggaggcaaattaaagccttactgggaacttctaagtagataggtgtttgtgagctttggatacttctctgaagccctgaagcaagactgcagtgtgggaagaagcgttggcaagccttcccaccaagctggatgtatccttcagcagctcttggagtccttctaacctacaatgctgccacagacaatgagatcagtgagacttctgactttaaaaaaggaataggcacaatgagtaataacagttgaagttgaaattgtgtgaatagtgttcttattttgtatgtggttttgtatttcttttgctcttacttcacat

SEQ ID NO: 31099 - DNA, 1297 bp, Bovine  19866880719994
gactggacgggatagggtaagggataggggaagcagggagaaagagaaaaagaacggatgtgcacaaactgagggcagggaagaatgagccgtagatcttacgagagatccggaccacacaggatgggaacaatgatgaggcaaagaagattgtgtgagacttcaaatgacatcacctactttgctgaggaaagaacaaaatttggataatagagggactgaagatcttacttaattctaggcaaagctaatacttttgaatgaagttatctctttgaaagtaccagtttttcaggtaacaggttttcagggcagcataggatgcaccctacagtacttggtccaggctggagagcagtcctctcctctggtcacacttttcttctctgggttctcgctcttctccatcaggagttgctaactgaacagaagttttgggatctgtgagatgttcagtaactcagatgggactgttcctcaatcacagcttgatataggaggagctagcacaaaggaatagtacctaagtatcacgggttaacgggggtaggaaagactaaattgacatgatcgtgtttttaagtaagccgtgttttctgatggagggctttctcttcctgttgcattctcaattttctgaaaacaaaagcctgacctctctgtctgcttttgtgttgtgctaccactggcatgaaagctggatcgttctaggtttgttctttatagatgtgaatcaggaatgagatgcacataaagaacatgtcttaagtttcaattggagtgggttgctagggtactgccatgagagccagggatagaaccagcttcccaaacaccatctattttatcatcagacttcatgggagaattgtatgacccagagagcagagtgctcttgggcgggggcggggtgggggagtgatttttgcttttttcccctgaaaacccaggactgtaactgtgaccctgccctgcctcaagcttcccctccgccccactgccccgtcccggtgacccagttgcccgccccacctgccagcccacctctaggtaaagtgtaccagctgctgacaagctgcttgtgtccatgtgttgtggtcttggctttgtattgtaaggactgggtggagaagaagctggggttcagactaaggagtgactcgatagcttaagaaaatgaagaggggagggtaacacactcagaggtgttcacgtgcttgggaaggtgatagaaggcgattcagaatgctcttttccacccactctggaaatccacagccagttagtgatttctctt

SEQ ID NO: 31100 - DNA, 1731 bp, Bovine  19866880738845
tgctttttatttttaaaaatgcttatcagtcttgacatataaaaacaatggcagtaaatccacatcaccctttaaatgttccttttatctttaaaatggcatgactaaaaatctaaacacaagaatggaaagccaggctggaacatctattctagttttatcactaatcactacctcatgacttaaaaatagtgacacgttttatattatgatttcttcagctgtgaactgatcctaactatgtaacggacaaggggaaaaaaacataagcatggtacatgaataaacaggttacaggtccagatacatttctccaggggagtttcactttagtgttcactcaaacgatcaattttaattttgaaacaaaaaacatctcacattagcttgatactgctccagaatcacatgacctgggaattctggctcaggcacagaggcaaacttcttgataatgtcttcgagggcttggagaccagccatccgcagctggttactatgatcggttgcagccatgaatgccatgcgaattaggtcagagagatgaagtaccaagaggtcatctaaaaataaaaatagaaggcaaaaaggaaaacatttccaaaattaagtgtaataataaaaaaaaatacaaaatgaatttgctttaaaaagcatttataatcaacatgttataccaagtttaaaaataaaaaagatatactttcaagaaagtttccatatcataatctctgaagaattgtggtaaacctttatacaatatgataacatgaatgatattataggatgtatgatgacatttgaagcaaaataactgattaccataactttctccaatggagtctgtaattctttggtcaacaaagaaaggcaatgccaaagaatgttgaaactactgcacaattgcactcatctcacatgctagcaaagtaatggtcaaaattctcctagccaggcttcaacagtatgtgaaccgtgaacctccagatgttcaagttggttttagaaaaggcagaggaaccagagtcatattgccaacatctgctggatcatggaaaaagcaagagagttccagaaaaacatctatttctgctttattgactacgtcaaagcctttgactttgtagatcacaacaggcggtggaaaattcttcaagagatgagaataccagaccacctgacctgcctcctgagaaatctgtatgcaggtcaggaagcaacagttagaactggacatggaacaacagactggttccacattgggaaaggagtacgtcaaggctctatattgtcaccctgattatttaacttatatgcagagtacatcatgagaaacactgggctggatgaagcacaagctagaattaagactgccaggagaaatatcaataacctcagatatgcagatgacaccacccttatggcagaaagtgaagaataactaaagagcctcttgatgaaagtgaaagaggagagtgaaaaagttggcttaaagctcaacactcagaaaactaatcatggcatccggtcccatcacttcatagcaaatagatggagaaacagtggaaacagtgtcagactttattttggagggctccaaaaatcactgcagatggtgactgcagccatgaaataaaaagatgcttactactttgggagaaaagttatgaccaacctagacagcatattaaaaaagcaaagatgttactttgccaacaaatgtccatctag

SEQ ID NO: 31101 - DNA, 2616 bp, Bovine  19866880762925
ctgccacttccttggaagaagggaaggagagaagagacatgggagaagcatctttacgatctccactgctgtgacgggaatggaaaggggaggagaccctgtgaggttgagaattgttttcccacggcccatttagaagggatagacagggatcgctatttaccgaatacttctgtactagccactgttctaggtgcttttctgatgtttccttattgaatcttcacaaccaagttatgtaggtattaatcgcatttaacagatgaggagacaaagcctgaatggaaccttcagagtatttcctttataacagcccatatatcttttctctttttttctcacaaatagttaatgtgccttataggagacaatcatactcccaagctgagaagtatggttgaagtaattgaaataaatgagatctaaaatgttcacaggggccaactcctccagtccatacccctaaaggaaaagctaaatacaatcgtctttactttgtaacatcaaaagatcactgttatccaggtaatcctagaaacaaaacggtatctcaattttaggcagttgagacgtttctagtctaagttgtcgggacagttacttcaccaccctttttttcttccaaactgaggatcagggtgtgggctgccatgagtcatctcctagtaacatatagatcccagaaaaagaatcaaaacaaggacacttaaacagaccctatttcccagagggcgaaggtctgaaggtaatggacagtcagaaggctcacccactctgttttaggcttggctataaacagagtttgaaaagggagaggactgacctgggaatactctgtctgccctcctctgaagtcagggaggaagacaggaaggaaatacccactttcctgatcaaaatgactaatcctgttcatgtctgagagttttgagtaaccatgcaaatcttcaggctcaaacaaaattaaacacttctgatcatcagacaacctcagaactttctactggtatatattcacatctcctcttttgctgcttaggccaaccttgaaattgtgggtttcctgagtgtctgggtaagaaacagcataattgtttttcttaccttactacctttttatctttccacaataagatttcttcaagaaaggggaggtggaaatatgaaaacaaatgttaaagataatatgctgagtataagcaattcaaaataaatgcttgtgttaaaaggttaacacataattttgatgattagtttccattgcctagggttctcaagtcttctccaattttggttatatttaagtcagtaagatgcagttccagtttgggatctacaggatgtagactgagacagagctaggcattcaggatgtattagggagtgcccatgggacaaacccctgtgggagggagagggcggaactccactgggtggaggcaagagtcagcaggggagtggccctgtcttccacagcttcacccagagtgaagatttgtcccaccgtgacccagaatggctgaagctttataacctcacctcgtcttcttcctacaagaaacagttctctgcagccaaaggagctgacagctagaggctgtctgccagaaacacgccagcaactggagcagagtctttcgataaagggaatgtgaacagtacatctctgtattcactactcatgcatccttatgatgtacctgtacccctaaaacatttgcatagtaagtgaaactgattttagtaaattattcttttacacaggtcagattttttgataagcaatgaatccagtacaactctatttatgtctcttccttctttatttttatcttttcttgatatgcagatgataccaccctaatgtcagaaagtgaagaaaaactaaagagcctcttgatgacagtgaaagaggaaagtgaaaaagctagtttaaaactcaacattcaaaaaatgaatatcatgacatccagtcccatcagttcagctcaggtcatcagttcagtcattcagtcatgtccaactctttgcaactccatggactgcagcacgccaggcctctgttcatcaccaactcccagagtttactcaaactcatgtcaactgaatcagtgatgccatccaaccatctcatcctctgtcatccacttctcttcccgccttcaagctttcccagcatcagggtcttttccaaggagtcagatcttcccatcaggtggccaaagtattggagtttcagcttcagcatcagtccttccaatgaacacccaggactgatctcctttaggatggactggtttgatctcctttcagtccaagggactctcaagagtcttctccaacaccacagttcaaaagcatcagttcttcagctctcagcttgctttatagtccaactctcacatccatacatgactactggaaaaaccatggccttgactaaacagacctttgttgacaaagtgatgtctctgctttttaatatgctgtctaggttggtcataactttccttccaaggagtaagcatcttttaatttcatggctgcagtcatcatctgcagtgattttggagccccagaaaataaagtctgtcactgtttccactgtttccccat

SEQ ID NO: 31102 - DNA, 1826 bp, Bovine  19866880867857
ttttatgtgtctgaaaaaagaacgttgagtgatttatctaattactttgatgtataaggatgtttggggattttgtatttatgtgcttatcaacaacctcagaaaactctttcacagtagccttggttaactacgtcccacagcctcagttgctgcttgaccactcagctcaggtggagaaaaagctgtgtaggtccacggcgttccctccagggcacaagcagtgccctgtatttagacaaggtctatctgccctgtcctgaataagcccctcaggggcctgcctatgcctcagtgttatctcagggacctccaggctccatgaggtagactccagttagccctagaaatagcaggctcactgtaagttagatggggcattattctttctactttacagggagctgaaattgagttataataaacttgtaaattgacaactcggaaggcatccgcagagcctaaaatggatctgcattttttgttttttctgattaccaccccacagctctatccatgaagttttgcacctttaagaaacagtaacacctgcacactggcttgtatgcctcaggtcccctgccctgtgagccatgtcaggatgggtgaacataaattctacgtgatggctgcctttgcatgtccccctagagacacctcctgcagccccgagcttctgctgagcacagctggaaaagaactgctgatgaggagaacctggggggaaagaatgtctctgggtgcaggcagaaataacatgtagaatgccctcagtcttacttggaattcacgttttaatttagatcctgtgtatcctttgaacaaccccgctggctgctatgccaatggccagatccacgcccacggggaccgatggcgggaagacgactgcacattctgccagtgcatcaatggggagccccactgcgtggcgacggcctgtggacaaagctgcatgagccccgtcaaagtgcctggggagtgctgccctgtatgcgaaggtaaaccttgtggatcctagtgagcccctggtgaatgtcgtgtcagagcaacttccaccagtgtgtgcctgcttgcgttttgtttcctcaggtgtaatgtctgcttcctgctgttagttgcagatgattttatgatacagcccagactaatcatttgggggagatgctgcagatttacagtgagagcagtgtggtctttattttaccactgcagataatgcttaactgaatactttacactcgaagaatatatgcattcaaattcagttcaccacaagcctaattaacatctaaaggtcaaaacagggaaatgaaattggaaataagacccatactcaaagcatggtttgttcaatttataatgcttctataagcccaagagtcctggcagctagaagaaagacctggaaccatcaaaggcagttgtcactgcccagagtcctccctctgagtgtccattgtttaatatcgtgatggctgtggctttgcaattcctctcaggctttcacttatgtcttggttacctacattcatgacctcttttcctttttagtgaagagatgcctgagatatcctggactcgtctttccatctcaacccctaagccaggccattttcaccatcctgggaagattctttgcacatttattcaagtcagtcttaatccccggtccatatatgttaataaaagagactgaatatgtatgctgatagatctaatagagagtatccatcactaagaaacacgtttgcatagtgaaatgaaccaaagtgggtcagaaattaatccttgtagaagatggatccttctagaatttttaaaaa

SEQ ID NO: 31103 - DNA, 970 bp, Bovine  19866880953058
ctttcatcgtctacattaatagagttttcccctctaacttcatttgtaaatatttcacctttattatacctcttcccaggctgcaattatgttgacattttgctgatttatttgaatggttttctgactagttatggtcacatttgaaaagcaactgtggtaacagaatgacatatgacgacacagtaaaacagattagctgttgtaaacagctccttcggttctgacttggccagctttatctccagttttatgagcccagacaggctaccagtaattggtggactataaggagggctgatatatatggccatataaaccaagtgaagctttggaattttcacatttattagatgttcacatggcttaaccaagtcaagccaccaccaccaacccccaccacaccctggcaaaaaatcttaaggaacaaaatgcctgaattaggtctgaaaagacaacatcattagtcatctttgtctcccataatcaaataagcaggcttgtgtattgatatggaagagctccataaggtaagcaaatcattagtaaatcctcagaggagaagtaatgagacagataagaattagctttgtgttatcttatcacttctatatgaaggttaactcataaaagaaatataggaacatatctgccatagagaactaccctacctatagtgagatttttccccggaagacttttcttggtatgtgtctgtctgtgtatgcatgtgtgcacttgtatggatttgtaggaatctaggatgctggtaattggagaaggaaatggcagcccactccagtgttcttgcctggaaaatcccagggacgggggagcctggtgggctgccatctatggggtcacacagagtctgaccgactgaagcgacttagcagcagcagcaggatgctgttaggcagctgcttcccatgccaggcctttccaggcctgccgctcgcccggagcacac

SEQ ID NO: 31104 - DNA, 1947 bp, Bovine  19866881007774
tgatgtccctgcctggagatttggaaagagagaaacacaatctggtactagctaagtctagagcaagcatataattaatatgtagatacacttctgtgcagagtttattaacaaaaagcaattattagattatagctagggtagtaatacaaacacttgatactatcaacttaaaactgatagttgaaaggctttattacaaacaaattaggcagcaagagtaacctcaagcagaactgtccctttgctaatttccagcaacagctgtaatgtgttaaatttcccaattaaggtagttgaccactagctaagtaaaaggaaaatgttttttttccttcaaaatagaaataatcatacactgtatatgattggcaatttgatacttaattagctgggtcatattttggaaataatgtgataacaagtcaaatttttttttttttttgtcttttactagtttgagaaacggcagatcagctcacatgtttcctgttgggataaatgcagtatattaatctgcttcctgacccacctaattagcttcaccaattggctgttgtcatctggcactggactttaaaaattttttttatttattttttcattgaaggataattgctttacaatattgtgttggttactgccatacatccacatgaatcagccaagatatacatatgtccccttcccctcgcacttgaatctccctcccacctcccaccccatgccgctcctccaggttgtcacagagcacactggtctgagcgccctgagtcatgcagcaaatccccactgtatctgtttgacaaatggtcatttctatgtttccacgccgccctctccatccgtcccaccctctccctcccacagtgtgctcacaggtctgttttctgtctgcctctccactgccgctctgcaaatgggttcgtcagtaccctagattccatatatatgtattcatatactatatttgcttttctctttttcacttcactttgtataataggctctaggttcattcacctcattagaactgattcaagtgtcttcctttttatagctgagtgatattccttgtgtgtatgtaccacaactttgtccagtcatctgtcaatgtacctctaggttcctttgtctgtgagtcattccagatttctctttctcttgtcctgcacatcttttccatcaaccaagactgttggctctacattcataatttgtccagactctaaccgcttcatcctatatttaccattgccatctggtccaggccatgccccctttcacctggattaaagcaattagcctcctaactagggtgtttccttcttcctctgcaaactgaagtccacacagccgccatggtgatcctcttcaaagcaaatcaggtcacggcattcctcagatcaaaacttctgtggttctctatcttagaagaaaagcgaaaatccaggcaaatggctcaggaccccatgaaatttggctgcctttggccctctgacctctcttccctccattctccttctcacttactaagctctgggcacatctcacccttcagggtctctgcacttactgttaactctatctggatgctcttcccccagatcagaacagggtttactcccttatttctttcaggtctttgctaaatgttatcttctcctgagattttccctgatcactcaccttaaaattgcaatccctctcccacccaccatcaagtggtacaccctaccaagtggtgccagtggtaaagaattcaccagccaatgcaagacacacaagttcagtccgtgagttggaaaaatcccctggagaaggaaatggcgacccactccagaatccttggctggaaaactcccatggacagaggagcctggcaggccatagtccatggggtcccaagagtggacagactgagtaccaccaagcatcatcctttcc

SEQ ID NO: 31105 - DNA, 1042 bp, Bovine  19866881050464
aataccttattatcagaggaaatgtcagctgagccaggcgcattgtttctcaaatggacccgactgttgtaggatttaattggcgtgaatagttgaagcaggacaaaaatggtttttccttggggacccatgtactcagttaaaaggccaaaacagaaatgcttatgcagtgactttcttcctaaaaattcagaacacttcaaaaattcccacaaattgtattcacagcacaaccctgaaggttagtacacttatgatgcaaatatgtttttagggcagttcatgtgttcccataattccttttataggcatgcatattcattagaaacactgaaaatttattaagaaatcaccaaatgttttcaagggctgcaaaatgcaaaccatatgctgggagaagagagtatttagagagattctgagaacttaaagaatgatcagctcattaggtcttcctgcagtgtgtgtatttcagtttcaatgcttaagctctagatattttcacttgtttgtcttgaatggagaaatttgattttaaagtcttttcttgtagtggatatgcgtcttttcatcatttctgctgttttaaagtagatgctatgttatttggtatgtagatatttataactgtcatctcctcattgaacttggagtctttaatattataaagcagttctacccaacagaactttcttgtgatgatggaaatggtttgtgcactatataaattaatgaacgaactaaaattaaagattcatttctcggtcacattactatgtgttgctcatggctcctgaaatggacagcatggttatatagtatcttctttgtcttgattaatatttttggcttgaattctaccttgtctgatatcagagccttgactcctgctttctttctgtttgcttttgactggcacaactttgcagagccttttatttctagcctttctgaatcacttttgttttaggcaagtcttttatatacagcacagagctgaattctacttttatcctaggatagataactttatcggtataac

SEQ ID NO: 31106 - DNA, 1211 bp, Bovine  19866881068271
ttggctgttatccctgtttttctattttatattaaacatagaagaatctaaagtttcaaaagattaaataatttgcctaaagttagccgattagatacagaactggaaaattaaatccagaagtttatctcttcaaaacccatgtgttttctccacgagtgaggctctctctccctttaatcaaatagattaggacagtgctaaaagtgctataacagttactaaagaattttgtttcttgaagtcacagaaatacatgattgctgttaagtaagctttattgtgtcctggggttgagaattgtatattaccatagtgttgatatttctaggcgtgtttttatgacacattcagtcatactgtttactactgacttttagaatgataaaaaatcctcctttctctctgatttaggagcacgtctcttgatgtggagcctatctatacattcagagctcataagtaagtatgtgctttttctttgtgttaatcaacatcattgtaaatcagcctgattagtatattttattttctttcacgtatgtatttgtcatatgtgtttttttttgtatttggtagcgtttttttttttgtaaatgtaaaagaaagtggcagataatgtaatgttagcaacaagtatatcgctaccaaatagggatccttgctgaaattaggtattatttgcatgatatttaaatgatgtgtatatctgtctcttaaaatgaagttgaggcagttaaaattaactattagaaatcctgatctttttttccttaaagataacccggtaaaaatacctgagacatttaaaaaattgtggtcacatttcatgcttttcctttttccatttaagtttaagaaatgtacctgttcactcgatttagcacagaggttggcatacattaagggtcagattgtaaatgcttttcaggctgcatatttaatgttgcatattcttgcttttagtttagttttgtattacaacattttaaaaaggtaaaaactgtaagtgctttaggattgtacaaaaacagttcactggttggatttgatccgtaggccatagatcacactaaccactggtttagcagaggaagaaaaatgaatagtgctttgataattttttttatttgttgtacaaaatagaaaaagacaaagccacttgaaaaactaagcattcttatttctaactcattctaatatcaaataga

SEQ ID NO: 31107 - DNA, 760 bp, Bovine  19866881083969
aatacctgtgtgcccatgaatttagttattcgttctggaagtcgacttttctcactagataaaatcatttccagcatatctccatgtagcttttccatcactacaaaaactctttccggggtttcgaacatacattccaggtttacaatcccaggatggtgcaaattctgaagagttgcagaatattaggtgaccaacttgagtaaagttttactatgcaagtatctaacaatgtactgcagttaactgtatggaataatggcacaaaagatagctcagaaaaataaaagcaaacaaaaaggatcatggagtttgattttcaaagttctgtactgaagagaagatgcacgggaagggaaagaatgtctccccactttgattatataactgcccttgtccattactgcttttccttttttgtcatctttttaatcttctgatggtactctaactttatgctatccacaaataggcaccaactaccaaagttttagccaattacacagctttggttcttcagggctgtttgtaaaggtcttggctcaacaggtggctttgtcttgaaggtagtcatttaagtcctgatctcatattatatcttgatttggtcttccctctttcaggttcagcatctctaccaccatcaccccatttttcttaagcactattaggcgcacaggttggggcttccctgatagctcagttggtaaagaatccacctgcaatgtaggagagcccagttgattccgggttaggaaga

SEQ ID NO: 31108 - DNA, 1177 bp, Bovine  19866881104571
cccaaaatagcaggctgtctttacagcgcacccaagctggatggctcttacttggagcactcatgactttaggtcacagctataactgagtaggattttgtcttattctgtaactgtcagtagactgtaaagaaagtttaaaagtattcaacttcacatcctagactttgaatgaggctataaaaggataatgatgtttttctcatcatttgctatgagatttttcggtaatatctgtttatgtacacttagcgactgaactgaactgaatgagaaagcgaaagtcactctgttgtgtctgactttgcaaccccatatacagtcgtatattccatggaattccctaggacataatactggagctggggttggtatcctttctcttctccaggggatcttcccaacccagggatcgaacccaggtctcacacattgcagatggattctttaccaactgagccactttcacctttactatcagaatagccatggtctaactgattagcctattaaaagaaacgagatattccgtgcccaaagtgaaggctagtgacgtgattttagtaggatgataaagtcacacagtaaacaatatctcttgttggcgttacatccttgggatattcttttgcacttcactgtcctaattgttcagagaaggcgatggcaccccactctagaactcttgcctggaaaatcccatggatggaggagcctggtgggctgcagtccatggggtcgctaagagtcgggcacgactgagcggcttcactttcacttttcactttcctgcactggagaaggaaatggcaacccactccagtgttcttgcctggagaatcccagggacggggagcctggtaggctgccgtctatggggtcgcacagagtcggacacgactgaagcgacttagcagcagcagcagcagcagtcctaattgttatgacagatctaagatgcagataaagtttagcattatacatagaacagaagtacctgttatcattgtgataatatatggtatcaatatgttatcattgtaataaggtgtgtccacgttttacttcatattttcgacttctactataaaaagtatgtgtgtgtactaactacaaagttgctaactgcttgattcatctaccttttagaattaacctgatctcgttttctaaagaa

SEQ ID NO: 31109 - DNA, 1746 bp, Bovine  19866881320622
catagatgtacccttctccttttaaatgaatcgatagtatacagcaggccattgtatgaatatgccttaattaagtgaatgaatcacttgctgatgaatagtcaatttgttcccagttttttgtactataaatggcactgtggtaaatattctttttcatatatttatctaccaggagaaattctattttttttagatgtgaaattttaagatgaaaaggaaagactattttaaattttgatgcataatgctaaactgtactacgtgtttgttatggttacttggaagacaaccaataagagtagtagaaatttaagatattgagcccatgttaaaatcgatatccgttaacaacagaccaaacttgagcaaaccccgagaaatagtgaagaacagggaagcctggtatctgcatccatgggatcacaaagagtggaacatgacttagcgactgaacaacaatagcaaatctattattaagtcataatttttgttatgagagatacattaagactggggagagggaattccctggtgatccagtgtataggaccatgttcttaaagcaggggacccagctttgatccctggtcagagagctagatcccacactccacaacttcaagatccctcatgctacaactaaggccagtgcagccaaataaaaaaataaatattttttaaaaagactagtgagagacttcaaggtactgatcagctattttacaacatggagcagtaatgaaatagaaggtatactcttcacctttttataaagtggcaatcagaggacttacctcatagggctgttgtgttggtttagtgagctaatggctgtaaaattccttagattagtacctggcagctagtaggtactcagcaaagtattactgatatttttataaagagaatttgttctcataaaagagtcctctcttagctttcatgatcttatttaaataactccttttggcttctgctttcatcaagttggagaccattggtagtgaacaatttatttagtgtgaacaagagacagtttgtatttaaaaatgagtgatcacattttatgctacaagatgtgggaggcggggggtgattagtcaaggcaaatgttggggccagcagggtctgccatatgccaagggtcagtgcctgaaaggtgagtggtaccagcaccagctctggtgtcaggaagtgaaagcaggccaagagtctatgagcgagatgactcacaggtaacgggacacccagaatcgggagttagaggaagccaggagcctggctcccgacacaggaaggctcaggccaaggcaagctctgaagctgtgaaattcaaggtggccagctaggggcccagggagaccaaagtgcacctctgtgtcagagggacctggctaatagctgtttctgagctgctccagggcagaagccaatcacagaagagcttgtctagatcctgcaggtacaagtaggtgaatgaggccatggaaagtcaggtctgatatagggagaaagaagaaatacgctttctgtgctagttgctagttgcaaaaacaccatgatggaaccctcctacagcaaggcgttgggagagctatacacgcttttattagcgaccctgcatctgctgtcatcccttgggaaatgaaatgttgctgtgttcttttcttggcatttctaaagtaatcaaacatctaaaattcatacagctttgctgagatgcaagcagttatggcactaaag

SEQ ID NO: 31110 - DNA, 637 bp, Bovine  19866881434534
gaatagagctggctcactagtgtataaaccttctggctgccgtttcgttttctgaaaattaaagatttggacaaggagaacttttggacattttaagacttgttaattccaacattctattttggggaaaaagtggaaatttcaagctgacttttggggtaagacaatgatataaatctttaaaaacataaagtggagaagggtgtgggggtgggtctttaatttcctggattttcgtggactcaaagagtcaactcttgtcacagccacctacggggtataacccattataggtttctaagctgaatccacatagaatactcttcagacttgtgtggtagttgtacaaagctgaccatttataacctgctggggcttacttatgtgtcttaaacactcttaagacaaataaattgtcctagtggtctatatttggtgcctatttttttttttttgcatcccagtgtacagagctggactgagctggctgcttgttcttgatgcaaataaatataatggcccaattgtctcctcatgccagggggcggactttgagcacacccagagccctgtgggagcccacagaagggaggtggctatttggacatttagtctgtaatggagacaagttaacgat

SEQ ID NO: 31111 - DNA, 1583 bp, Bovine  19866881454650
tgtatcttctagtttccttggactctctcagtacctttatgatttgtgcttttcccctgcattcttgctgttgtcgtagatccttctgtcttaagaggccctctcctgggccacacggacgcagtctggggcttggcctacagtgcagcacaccagcgtttgttgtcctgttcagcagatggcactctccggttgtggaatacaacggaggttgctccagccctgagtgtgtttaatgataatcaaggtacatacctttttctcctttttcttacagagtcttttgtaaaatgtcttattctaaaagaaacaaatagatgattctacagactcttactgttctaaatttaatttgaaggtttttttttttttaagcactgaaaatatatttggttgagtttccaacttagtatgtataattttaaaaagcatactatttggtgaagtagcaggcatttgttttgaatttttaaaaattgaaataatttatatacaatcaaaaacagatattaaggatacattttcatgagtttgacaaatacatgaaacttttgcttctatcaagatagagaatgtttccttcagtgcccaaaagtttctctgtgttattcacagtcatctcctcccctcattcccaaccagaggtacccactgttgtggtttctttcattataaattagtttttgtctattctaaaatttcatataaatgaagtcatacaatgtatactctttttatatctgacattttactcttactgtaatgttcttgttgcttatccatgtggtaataaatgttaataatttaattttattgtttgtagttatttctttaaaccactgtgtttataatttacctcttgatgagcatttggcttgtttctagatttttcctattatgaacaaaactcctatgaacatttgtatttttttttttaatcacaggcaggtaaagaccctgtaaatagaattttgggtcttcagaagtagatttatgtatttaactgtttaactttatgtggcatcgccaaactttctttgaaagcggttgtgccatgttgtaccacttattgcgatgtgtgagaattccaggagccctacatccttaattacaaacatttgttgttgatagtgtaattaattttagccattttgatgggtgtgtgcaatagtatttcattgtctttttaagctgtatttctttggtggctattttgagcactttttttgtatgctcattgtccattaatgtatcttcttctggaagatacacgtttttgaactgctgggtttacttagattttgaaccagattttaaaaatcagattatgatcacgtatacatagaatttcacttttaatatttataaataagttccagattttaaccaagttttaccctattctaaatgataaataaaattgtcttctttattcatgagctgccataatttgtgcctaggttttgacgagttgcctgcatttgatatttgtatgactctaccaataaataacaatttgaaattttacttcttgaattccatatttttaggaattagaattcctagtaactcactaaagttag

SEQ ID NO: 31112 - DNA, 1540 bp, Bovine  19866881468252
gaagacttccggagtattcgtttgtcccttaaaacccaacagtgtttacacagaaatctattagccctccaactgagcttttggagaaatggagattttgcgatgggaaagtttcacgtaatatcctactttccaaagtatgattaacagcagtcctattttcaaatctgtattaagtccttctacatagtttgcttagcttttagttcagttttgaattatcatgagctcaatttaccccttcagtatgggaagacacggcacacacccccggcccaggtctcaggagttcttcccttacccagctcaaaactccatacacaggcattcagagaggctgttgaccctaaaaacccagtctcccacttttctagcacacggcagcatacagtctacctactgacccaggtccttgcttctctggcccgcgggttgtggtcggaggccgctggcggtggagcctgcagatggggagggctttggcaaggtggtgtgggcggcctcgatggcagtggtccccggcgcctgtgtcacagtgaccggctgtgctgctgtccctggaactggtgggctctgatctgctcttgctgtctcccctgtaagaaagtggaattgcactggggctcacagaatagctggtaggctgttcaggacagaaataagtagttcttgaacactagccatgagcaaagtcctatgctagctgctgtggaggcacgtacaatctgggtggaggaataagccgatgaatgaaccaaagatgaagtaatgataaaatatttaaaaggcagctcaaaacaatagcaacctaaacgaggctgaacacgattaatcatgaaattaatttgccgcacaccagaagcaatggttcatggatatatacgctgtttcagtgagtgttggcctagaggtagggggtgcttccagggctttcattgttttagagactgtgtcttagacgttttggttttggttcatggctaggcgactaactgctttaggtcccagtttcctcatctataaaatggggtaacagaactaatcagatggtaaagaccatctcgtttcttcttctaaacattactcctcatccacatgtgatgatttagattgcttccacgattttcgataatctgaatttattatgaattatttatgaatttataatttattatgaattatttatctgaattatttatgttgagggcatggggggcaagcggcccactgggccttggggttgtatagagaaccacgtgtctgcgtcagaaggaaacatcacatggtccccaaagtgaacagcacccgagtcctgggagggaacagcagccaccctcatggcctgctggaccccatggcaggtgtgccgttctacatctgtgcgtctgtattagtttcctggggatgctataactaattaccttaaactcggtggcctaaaacaacaggaatgtagtccctcagagttctggaggcagaaagctggaatcagcatcactgggctgacctccgtccagaagctcaaaggtagaatctgctt

SEQ ID NO: 31113 - DNA, 1210 bp, Bovine  19866881676811
ctggtttctgtcctcagagcacactgtcaaacagaagcatttaaacattattctttggtcagctcaccagaggttagcatctggcctctttaacagcactggttaaggaaaccctagatcagagtctgctgccttactccactcttttcctcactcattcattcatcatccattaactaactacttttcagcacctactttacaagccaggtgccattttaaggattcaaaaacatatggtaaaatcctagctcatgggggatgtagcctctttcaggttactggtcaacccagaggatgcagagcattctgtctcagaggccgcattcccgtggggtccacagtcaaggctttagagatactgctctgcaactttcaagctgtaggaacttggacaagtcatacaacttttgaattttggattctgcaatcacaagttgggatggcagaacctgccacagagggaagttgtgagtatcaaattggctgatgctcttaaagcactggtagtagctactctcattaagggctatacaataagacaatgcagagtgctagaggctgaggaagacaattctactgcccttctttttcattttttgtttgtttttaagacaatatggacatatctcccacatggacgcttaaactgcaaactttacatgttgttctgtgtatttccactctaggtttttacaagggccaaaaaaatagaaataatgtgattgatgaataagaggagaaacagagagccaacagaacaaaacataagaagaatgaggtggcttatctgtatacctgaattggctgttgacactaatttgctaagacttaatcatgacagtacttaagtgccaatttaaaaaccacttaggtacttgtgaattgaggtagctgtcaagttaacagcatagtctttaagggtccccaagttcacatccccagtcctccaggagtaaccaagcacattatgctgtcatttggaaggtatgtatctctaataacagcagcagtcacaacaaggctttttcctccctacaggacctaacacatcatatttgttgatgcagtaatttatttaggaagcatttaaacccacaatccttgtgtgggatctgtttcatcaaatttcagaccctgactatggaccttgggattgcagctaagaagggtgagagccaaccttgttacacaattgcgtgccgagaaa

SEQ ID NO: 31114 - DNA, 1136 bp, Bovine  19866881803709
catatgtgttactcctattatgaaatacattcctattaaaaatacctaataattttatttttagtaaagtaaagtagaaaatgaattgttacatttaaggagaggtcaataaacaattataaggcagagaattattctgagaaagacattgcatcagttagacatttagttgtaaattctaaattcttttgaaagaatttattaaacatacttactgtgttgttacctctactatttgttatcctttttgctgagaatttcacttttcttttacccaagatgaggatgatatggaaaaagagtcctgtcctgtattaggagaaggaggtgacagtggtggtctcattcctggaaaatctcttgtgtttgcaactctggagctgttgatgttcattttagtacgtcatatgccacatctcagtaccaagatgtcggactctccaagtcacatagccactaaaactcgactgtcggaagaaagtgctcgtttggtggcagccacagttaccatactctccgacttaccgtctctctgttcacctgctggtatggtgttgctcactatttgtaaatgtattatacagtattagacagagatgagcttgcctttgattttaagtgctatgatgatttattttcctattaagtcttaaaggaaaagtaggacttatttttaagggtttgtttgctttaggagcctataaagacttaagatttaaaaaaccaaaactctagatgcctttttcaggtacatttcaaagaaacttcagcaaagagacagacccacagcttgagagaagacattgaatgttagcaaatagacataaagtgaaattactaagcactttattttctgatctggttgctactcttgagccacactgacaaacatgtcagagaagagtgacaaccaactttaaggagcaactgttaattaaaaaattaaacctgaaaaatataatagctgtctgcagatacttgaagaactagtggatagaaaagtaggcacttgatacttccctggtggtctagtggctaaggccctggtctcagtacagggggtccgggtttgatttgcggtcagggaactagatccctcatgctgcaactgagagtttacatgctaaactaaaaga

SEQ ID NO: 31115 - DNA, 705 bp, Bovine  19866881904257
tcgtaatatctgaaagactgttaggcatgttctttcatcctttaactctaagtgtcctggaaactagttccataaatggagattaaaatatagcacagtgtgttttttggcttgtccaaataaggtcatatgcggggtaacaaatgcatagcagatgaccttgtgtcaacctcggtggccttgaacctaaattattcatgaatgaatatcatagtattttgatttttctctgggaatttaaaaaagctttaggtatttcaagtaactttagaatgttatggttcagagctgattctgaaacacttgactagaaacccctgtctctgattgtccagccttcagcagtcctcgctcttaagtatttccctgtagcaatggtcttggaaggggctggttcctctctgcttcctctgctattcacttcccatccctaaaagggcattattgccaggagtctcataattttcctactaagataatcatcgaatctaatagttcaaacttgggcctgctaattttcatctaatcaacggaggcaggaaaacatagtctggaatgccagctatgtgaatgaaaaatatttagtcattcttgaaatgataggaatgtttttccaacaagcttaaataaacacaatctctactgagactgtgttaaactttttttggaaaagagacaactcttaggccaaacagaagttaatgg

SEQ ID NO: 31116 - DNA, 939 bp, Bovine  19866881923028
ctgcaagtgcagaggtaagtgttagtgcatgcccttgccccagaaaccaagaaaaagacagcctgtcagtgaaacagttttgctggtcattgtccgctttgacagcaccatcactctctaggggaccatctcttgcaactccgtggactgtagcccccactgcccaccccacttggttttagaaaatcctgtgaatggaggagcctggcgggctacagtccatggggtctcaaagagttggacagactgagcacataagagaatgtagagtgaaaggaggaaaattcagttataagccttccagaaggtgagacatggatttgtaagggttttttcctcccatttttcaaaattgagggcatatttacatgaattcttttcatgatcctttcccatatcacgaactgtgctctgtaaacgggattttttggtgactgggtagcgctgcctgtgaagacactgcaggctgtttctcctgtgcagtagctgctgctttaccaggctgccttctgtctgtccagaggtctctgcctccgccgggccacccgtcctgtcaggcacgtgtctatccatggatggccatcatcataaaaatggggagagctggcatgatgggtgtcgggaatgctactgtcacagtggacgggagatgtgcgctctgatcacctgccccgtgcctgcctgtggcaaccccaccattcacccgggacggtgctgcccatcatgttcaggtaaaggctggctgacgtctcgttctctccctaagcaagcgacttctgcctcctagggcctcatcacatctctaactctggggggagcgcaggggacgacccctggaacacacttccaactctctggttttcatcagcagtagccacaagcatcaacagggcatgataaagattagccagaaaccactagactattctagagctctaa

SEQ ID NO: 31117 - DNA, 930 bp, Bovine  19866880634228
tttgtaccaagagtgaggtaacgtttgtggagataccttatacagtgataggtgcttaactgatactcagtaatatataaactgttatttcctttccatgttgtttttctctgttctcaatagcaggagaatagaagtagaaaaaagttgaatagagaaggtatgtaggtaagtcacttcagtcgtgtctgactcttcgagaccccgtggactgcagccttccaggctcctcgtccatgggatgctccaggcaaagagtactagagtgggatgccattgccttctccatatgtgtgtgtaattatacatgtggagagagagagacgggggtttggccataggaatatggtagaatatatataaaaaagaattgagaatgaaagggtggtcaatgaaattgttaaagggatattgatgaaatggtggctctaggctggtttggataagtaaggaaaagggctgataaattggaagagtttattctttcattaattattcatttattcaacaaattttgttcaaagtcctaaaaatacagtgatgagcaagaaagtcaggcaaaaccccttccctcatggagctcaatggacagaaaataaacaataaaaactaagttcagttagtaataagtgctatgaagaaaaaaagctgtgtaacagaatagagtgatgtggaagcaggacaatctttcagaaagattgttcacaaactgcctttctcttcataaagcttttcctcctgcactttgagaatgacgtacattcttgcatggaagcccagggaggcagctcccactgctccatctccagccagccttgttcctgcagccccgtgccaggacagcctcccaagtcttgtcaagtcttgctagttgtaaagcttccactaccgccgtcttccgatttgctctctgccccatctccagactgt

SEQ ID NO: 31118 - DNA, 4444 bp, Bovine  19866880649500
gctttgtgaaactgtactagataaaaatgaataagaatgccaataacaaactgattacttgccagaaggcgagtaaaataattttataatgaacaccatgcactatccaactttctttgatgaaacaattttgtcaaaatgaagacggatgagaaatcacattcctagtctacaggacagagaaataaaagagttcaagtttcatgaagtctgggctttgaagtactttgactataaaagataaaagaaggcaacacctaacatactaacttcttttctttagttccaaacattcctggtcttatggaccatgccaccccttcagaatagatgtaggaaggtggcacgtttgaatttggaaagagtcaaagtaacagcaactatatttctacaaaagagtatattgctaagttgtagggtttgttcagttccttccacaataaaaccagtatataaaaacatgttttaataagcagaattggataattatgtggacaggaccaaggaaaagcaatgggagttcaagattatgtaacagaatcttagtaataacatttactatgaatgatgttttgccttcctggatggaagtttcctagacagttagtatgtctttgtgtgtgtgcatgtgtgcttagttgctcagtcatgtctactctttgcagtcccacggactataacctgccaggttcctctgtccacagaatttcccaggcaagaatactggagcaggttgccatttcattctccaggggatcttcccaacccgaggatcgaacccaagtctcttgtgtctcctgcactggcaggtggattctttacttgtagtgctgcctgggaagcccatatatgtctttatttcttcagaatgatttttctaatctacaaagaaattctgttccgttacttcttttaaatgtggtttcatggcctaatcactttcaaaatcaagctagtactcaagattggactcaagaacttagcaggatctcaagggtgttgtgatggagaaatttttcctttgaattttctaactgatttcagtagaggcctccagtcaaaaaacctctgagcagtaaccaaaatcattgtggaataatattgagcaaggactagaaagttagaaaacaaaacgaaagacgcctacaatgaacaaatttgaaattacagctgtccctctctttctctggttctgatatgcatcaatttcagttaccatcatttagttaaattacacaagtcctcccaaaacacagtttaaatttccaccatcccaatataataactgagtaattgaataaagtgtaaacttcactgttatctcttcaatccacaagtcactatataaataagagatgtgcatcaccatcagtgaccactcatgtcatccttttcaaagactgttggtgactgctcactgcacatctgttattcaattcacacacagacagcaaaacatatgttgtgctacctcctgtctcccagtcataaaccatggtgacattttacaatggataatcaaaaaaggaaaccgggcaataaagatgaaggagcaaagaaacgagatgtgataatgctggaagcgaaattccaatagacagtaactggcattatagaatagctaactgtggaatgtaaatactattgccattcaagactctctagatatacagttagaagaactcagtaaaagtgaacttattggcatacatgaggacaatgaggtggctgtgacaaaaacaaagatgtcccagaagtgactggcaaaaaaaacttcatatgaaagcaactcttggagacagttcatggcaatatatgcataaaggatagttcaagacatgaaagtgctgggagctgattagagcttagaaaggagtatgacaattcaccaaggtgtagacaagatgcatgctctgtattcaaagttatataacaagaaaaggcaagcattttcaacctgctcttgataaaattcaccaattctcaatgttttatcatgtactaaatattaaatttactcttttttcacttcctaatacatttattattgacaataagaggttttaatgttttgacaaaaatttaaaggtcatggaacaacagtagttttggcatttattattagattgctttgcagagtttcagcttacatggtcatgtttatagtcctgcagttctgtgtaaagcagggattcactgaatataacaaaagttctaaaaaagaaaaaataagaacaagcaatcatatcacaaagaatttcaacatgttatccagttctcaacatggagttaaacattaatcctataaaaactggatatcctagtgagaagcacttgaaatcattcattacacagctaaatgatggaaaatacctgtcatattgacaacgagtaaggaagaacaatcctgaaaatcagtcaggaacataattgccagtgcggtgggaaactgagttggtacagttttcagaacaaaaacaaaatacctgaaacaaaatcctattagagattcgttatttcggccagcaaatccataatttgttagccaaagtaactcggttagcagaaggctcggtgtttgattctaggattctctgagcagttggtttaccataagattctgttcagacgtttgtaagttaaagctaaaggcaaaggtatttccctgtgagggacctttgtggtcgaaacatgggctagggctcaccatatttgggagtccttggcttggcttccagagtttagaggtctcaaagcttttttctcagtgagatcaatggcatcctgagacagagttcaaaatacagttctggtataaagaaactttctcctcaaagtgaaagtgtaatctgatgtctttactggatgtttagctgatgaaaagtgtaggttttattttgggtgaccaaaagaatgacacacagagccaaataaatcagagagaaattccctgtgtataaatgatataaatgaaagactataaatgataatcaggaaaagttaaaaggaactgaaaatctagaaagggagagacatgggtctgagttaccattaatactgtagaggctgtaagattctgcactctaaaaaatgcataaccaagcagcgagtgcaaaacaaaggggttttccttgggtggaatccccaggccagaaacagaatgtctcccacaaagagaaccgagagaaaagtggattttagattcatgtctatcatgaagatgtgacagaaggcacagagcatgtacacttacatatcacaacagaaacgggaatgctataaagccaggggcaatgaacatttcatttccacatctcgagcacacagcccagtgcctaagaatcagtatgtaccctgtcaaaagacatttatttaaaaaagtgggtccacattctattctatcaataacggcttcacttactcagtgtgtatacccagatacaggttcaccctttgtggggaaaaaaaagcacactcttaaaataatttcaagacaaggaagcagtataatgtagtggtaaacagcactgtatcaaatcccagtaccatcaagaaatggctgggtgactgtaggaaaattgcctagtccatctgtgcctctatttctcatctacaaaatgagaatgagaaccccagtatctatccctacagagttcccgaaagaagcagatgtgatttcagatgtagagtactttgcatagtgctgtcacacaaagcttaggggctattatcacaaacattttaaatgtgagtgcaggctgggtgaatcaagtatattggttcctcctaaacacacacacacacacaagcacgcacgcacacaaatgggcttccatggtgggtcagacagtaaagcattctcctgcaatacaggagacctgggtttgatccctgagttgggaagattcccctggggtcgcaaagagctggacatgaccaagcaactaacactacacacacacacatttacctgttctaagatgagtctaaataaacattgccacaatttttttttttaggtttatgatcacatttgttaaaatatgaccaacaaaagggaattccctggtagtccagtggttaagactctgtgctttgactgccgggggcaggggttcggtccctggttaggtaactaagatcccacaaggcatggtcaaaaaaaaaaaaaaatatgaccaacagaataagtataaaaaagaattaccctcactaacacaaaaatgaaaattaagatgattttttttcaatcattgaattgccaaagattttagaattataatgatgtcaagtttgtgaggtggaagatgggtgttctcacctgcagtaataattgataaaatggtgctagaaaacatgttggcaatatgtattaatatcatgagccttaaaataccttctctgccatttcaagtgttacatatctttagcacacttactttcg

SEQ ID NO: 31119 - DNA, 1801 bp, Bovine  19866880843688
ggactctgaaacattttatgagtaccattaattacatttatattttcttctttatgtgtaacagttaataaaatctatgtctaagaagtctgatagctctttcaatcagtataacattaaagttctacatcatatagcattgtgatatcattattttgccactctttttatttcttagcaatccatgaaataaagattcatcttacagtcaaatggagtcttaggtttattaaattagtatattttactaggcatgatatttttattagtgttcagtggatctcaaccaaaggtcattgtatccctggagctgccacagcaatttctaagtgctttgaacatagatcttttatctataaaaaggcagcatgggttaaattctacttcctgtgctttggctgctttagatcagatcagttccattggttatctcattctaatcagaaggtctgtcagacagatatacctctttgttagatgtataacttgtccatggagaacaatgaaataataatttaaaaaagacactgagataatattttctaagaagaggggtatgtccaatatggagtattttgcaatttcttattttataccaagtaatatttccctttgggtcttaattcactaagtcttctaacagctacccatcaactaggaatattgagctttataatttataattataagatctgactcaaagttcatttatttaaaaaaaaaaaaaagaaagaaagaaagccagggaattccctgacagtccagtggttaggactctgcactttcattgccaagggctcaggttcagtccctggtcagagaactaagatctcacaagacatgtgacccagtcaaaaaaataatgaaatttaattaaaaaaattttttttcttaaagccagattgcagttatcagcttccaagtaccacctccttatacacacaatccatacactgtcagatgtttaaaaactcaaaaaagttaaatccattttcaggctatataccaggagatccaaatatggtaaacaaaaagacgtccatcctgttcacaagagtgagaggaggagaattgggtaatgcagtaatgtttttagatgtgtacataagaagctctttataaaatatgttttttaaattacttgacattagcatgtataagctaaacagggtttggctcatagtattttcttccttcagaactggctttccaagagcatgataaagtgaagtataaacattacaggagatgtgaactgatttctaaacatttcactgatttttaaaaaaaataaacaacagatcattgttactttagagaggctaacatatcccccatcattacataatgaaaagtagattttaaatgtttttatatatttgatagagtccaaatgcttcagtaatggttctgacttagatattgtttaaacgtgaacttttttgttagattatataacctctgtaagtgctttccagaatgatactgtgatataatatagtagatataaatcaaccttgcatttttttaaaaaagatagtttaatggacagttttgctgtataggttcttttttttttatttttagagatgtatctgaggtttttaattttgtttgagtagtactgctgatggaaacgtgttctggagctcagatgatgaatagtgggtttttctgaaggtaggcactgacctagggacattgtgctttctctctccttgagaagcgagaagaaagaattgggatcttagaggaataggcagcacagagtactgtgaaaatctggaacctcgcagatttg

SEQ ID NO: 31120 - DNA, 2298 bp, Bovine  19866880870998
atttggtcctggtggcttcagtgtatggttgacttagatgtgaagtagcctacagagtgctgcctattctggaatgaatctctgaaaatatcacatagtagttgacctttttgttaacaatggaataattccctagctatcttcacttaaactactcccttcaagtatttcttaatcatattttcttttctttgctcaaatcataatgttgacaaactgaactatcttggggtttgtttggctcaggctttcattttttaacatgatatctggcatttgcctgtgtgcgtatgttcattcgcttcagtcctgtccgactctttgctgctctatggactgtagccctccaggcttctctgtccatgggattgcctaggcaaaaatactggagtgggttgccattcccttttctaggagattttcctgactcaggggttgaatccgtgtctcctgcattgcaggtggattctttacctctgagccactggagaagcctggcatttgcctgtagtattttataaatgaatcttgtttctaacataatttattttttccatatcagtgtttaggtaaaagaagtactttccttttagcaatatacagaaactaacttcctacagattggccaaaatcttttaagtgtacaatccttagaggtaatataatcctctcattttgcaggtgggaggacagttagacccagcaaagtcaagtgagttagttgcccaagactgataagagactctgccaaagatgatgcttttgtctggtttttgatttgtttcccaatcttatgcctattcatatgtataaacatattcatatatattatattacttgtctgaaagggattttgcatctgcaaattttggtatccgtgggggtcctggaaccttgcccctttccccccaccccctcatgatagcaggagacgactgtacttttattcccaattcccttctcacagtctagaatggggattctccagggcacaggctatcaagctgattcagcctttgatctcagtagcctagtgttctgtacaaaccgagagatatttgattatttatgcatttgcataaacactgtatcatttaggttgcttgtggtattaggaacagaaaacccagttcgtactggacttcagtgaatgaacaggagcttataggttcttgtaaaaaatcttaaaaaaaaaagtctcacagaaagtttaatttaaaggtaggctggtttttggttgatccacaagttcatgattccattcagagtaagctagtttgtaattcgcatacctccgctccctgtgggtattgtcctcctcctcaggcttgcttctcttctggcacagaaagagctctcctggaaccattacttcctcttttacactccaagagaaaggaatgaactatctaactaaactgaccttttaactaacaagtttacattaatcattatttttttaaattttaaacaattaggtagtatagcatcttaaacatgataccacaagtatctgaattccaaaagaaaagaaacaagcatcgtggaaactagtggttgtgttgtatctgattattgctaaagaatcctaaatttgttttggcaaaattgatgtctaagaaagtacttttcaaactttaatttagaaatcacctggagatctcattaaaatccaagttttgatttagttggtgtggagtgggacctataattctgcacttttaataagttcctaggttattctagtgctagtggtccattttgcatagccaaggtttaaaagaccacgctgtttctggcattttctaaaggtgttgagaactagctcagtttactactgcaaaccaccagcatctcttttctggacctgtgcagtagcctgattaccagtctccctcaagcctcttgttcctctgtaattcattctctaaatgaagctgtgttgatcattttcatatgtaaatcagtcgcatcattcccttgattaacctactggtaacccattgggttagaatagaatctaagctccttatcataactgcacagttactaaatgatgcaacccctgcctgcctccctctccagtctcttttcataccattcttctctttgttcactttgctttagttctttgtaacctcccttcatgctgcttgtaatgtggaccccgcattttctggcttcttctctttattcaggtctctgcttagatattaaccgtttctgagtgtaccttatgaatgactacagagaaataagttcttgagggattgtcataatgagacagtagatcaccaa

SEQ ID NO: 31121 - DNA, 2179 bp, Bovine  19866880941846
tgattagtctctatgcagatgaaacccaatgtctttctctaagttccaaatgccttctatacttcagcatctctttttgatatattgtatgccttgctagcacagtaaaatcatcatctttctctagatcaaagtttttccttctttttcctttaatagcaccacggtttcccccatgatttagaacagaagcctggaagtcttttctgacactttcttctcatttactctcagcattcagtcctctggatggcagatggtttgtaccttgtaaattcttgtgttatctaatcctttgttttaattcctactgtcacctctctaatgcaggccctcattactttttatgtgcaactgcctcctaacttttgctctctaccgagactccctgcacccttctttatccttcatacggcttccaacttttcatacagctctgatattgctcatttgttcagaaactgtcaaaaacttccctgtgaattgactgctaattcctcaaattgagagaaaatctttcataatgaatgtctccacacaatctttttagttttcattttcatcatacctttatgaatatatgtacacacacagtatactaataatcattctttagctatatttcattttttcctcatctttgtatgttgcttatgctttcagctttacatagaatgactccattcatatgcatactccaaataatctaatagcacaattaataacttataacatatgggcttaaattacctgctattgtgttgagaaacatcaagtactcaaagtttgaaatctccctgtgctgccatcgctgggtcatattagaagctttaaaaagttgacgtggactagctaatgagatacgcctgcaagaaaaagaatttgatgtggaatcaatttaaacttaagattagttatatcaataataaatcatgacttctgggctcattcgaattgatgtatttatattaatgaacactagaggcgtttcaatctacaattaatgcttaaacaaatgatttggatgagccacaggtctattatccatgttctattcattaaggtaagctgtcattacaaaatcattataatagctagctctataaattgattaataacagtatgattaataattcactgctttactggtataagagctattatagttactaaaaaatacatataaaagtgtatacacatctttatcagtttttatagtcatctcttaaagaaaacatatttgtacattattaatttaaacatcatgtttttcatacctattgtaacagaggaaagaggattcactcttcaggtgtctattcatcggttgagataaaggtaagagaaactatttttttatataccctaacaatataccaagttttctattttcttaatgtaatataaatacaaaaggacataactgaccaacactaagtagcagtgggaaataggtggcaggattaaatacatttggagcccagaatctcagagaagtatgctgtcctagttcttcctaccactaaggacaagatacctattttttttcaagcttaatttacaaaggtgtaatttacataccataaaatttatgcatgtaagtgtactattcaatgcgtttaaagtaaatgtctagagttgtgcgattatcactacaatgtattttggaacgttttaatcaccacaaaaagtcgccttgtgcctatctagaactaacgcttaattctaccccttgctctaggcaactatcaatctgcttccatctgtatgaacttgccttttctgaacatttcagacaaatggaatcagacatcatgttaccttttgcattaggcttctttcactaaccataatgtatttcagattcatcactgtggcagcatgtataagcagttcatttcttttgattgctaagtagtattccactgtatgaatacagaacacaccacattttaaaaattcattcaccaactgatggacatttaaattatttcactttttagcttttatgaaaaatgctactaggaacattcatgtatatgtctttgataaacatatggttgtatttctttggggtagattactaggagtgaaactgctgggctgtacgctgactttaactttatgagaaactgccaaatgggtttccattatacattccaacaaacaatgcatgatg

SEQ ID NO: 31122 - DNA, 876 bp, Bovine  19866880967465
aattgattggttaggtttgagagcagcatgggaagaatgttactatcccctagctgcaaaccgtatttaactccagtcttaatgaggactgtctgtctttaaaggctttgaaaaatctcagatgcttagcattccactggcatatttttatattttttgtgatgcaaaatgtatatataaacaagtatttaaagagtatcttaaaaatcttatgaaagggaaattaaataaattttaatttaatggttttgaatctcaaaaacagaagttataaaatgtattcccagggttttccattttgaattatttgcatttttttacccttaataccttcctcctgcttgtccttacctcttctgtcaggtctgcagtaactgcacttgtttattatcatatactattggttaggcagttgtcactcactggtatcaaaagaatgttaaagtcctgaactgactttgtactaaagtgatttttaaacttttgggaattcccatatatccatggtagttgtccttgtgtgttcctgtaaaagctctgttgtgacaaagagctgaagactgctttagctttttaaaatgtgtttaaaatttattcataaaagtaacgtgtgtatcaacctctggaagagattttgccaataatgtgatgaattacggattggccagtgtaacagggtgaggggaggcccgaaccgtgacactgtggccatttctgcacgcacgtttgtgacatgatgtgaacatactgcctgtcatttcagcacttttgctgaacattttgatgtggtgtcagatgtaaaggtttgagcatctgaatctaaccaacttcaccattttgaatgtgcgtaaaaaagtaatcaacattagaaagact

SEQ ID NO: 31123 - DNA, 1835 bp, Bovine  19866881067529
cggattgtgttttcctgtggtttttcaatattattgtatttaaaattaaagatcagatgtttttatcctggactgtgttgtctcttctcccttggccccagcccccagcatgacaaattacaggatttctttgcgcatgtgggtttataggcttttttttctccctctgttctcatagccagcaatacaggaatgcacaggaggcagatcactgacctcttagaccaaagcattcaagtccattcccagtgttttgtcatcacgtcggacaaccgctacatcctcctctgtggcttctgggataagagtttccgcgtctattctacagacacaggtaacctcataatttctttatcagtgaactcaagtttacaacaagtggcggtaagaggctgaaaaggctttctcatctcccctgtaaaagttacagaattctaaaaggtgtaaaatatagttttccccttcaagtaataatctactctataatccattaataagttaacttcagaatgtttttaaaggggcaggttttgataggtttgtcgcccaagcttcatacttacaagtgaatactttattttgaaagcataccttggtgtaaatgccatatgtacatgtccatgcataatcatatgacaagtgcacatacttacaggtgtatttccccactttaatattatttaaaggttatttttttttccctggaaattctaagtgtgtttcctgtgagtggctatcttgcctccacccagttccactgaatcttgctgaaaactacaccatggtgaagaaaggtagctgactccgtgttcatttgcatgcaactccctaagggacaaaccaaactcaaatcactactattataggatatccagtccaatgaatgggtgtatatttttgcatataggcaattatgaacattgaaaaatttaatagagtctctttaaagtattttagaaactggaagaggagggcataaacttatactgaatatgtagttgtatatttaaaataattaaaattagatagtaatgcattagaacttaaataccatggaggtagatagttcaactaaaacaaggatctacaaataattatattgattaaaggttctggggataggaaattttttaaattgaaatttctaattaattaactgttttacagcaaatcctttttcagtcatgttagtcatctctatacaatgtatgagtccatactcctactttagtaagtatagtatattaacgaattaattcttgggtattcagggactttgtcctagctacgttttgatgattgtattataacctaacaatgagagagtagggaaatatagttgaatatgtactgtgtatagaataaaccctagaagttagacatgatctcgtttaatttttatttcagggaatcaatgacctaatatttttataatttacttctttattctggaggtaggttcagaaagaagacatcattcaggtcttcctgattacttgggcttttctagatgtttaggtctatgatgttaattactattgaacctaaaactcctctggaattctttaaaaacgcattggagattgacaagttttcctaaaattatttattattataataaatcttctctggcttaatattcaggtttaaattttaaccttttctttcactattacggtaatgacaaccttagtgttatttgacctcaaactatgctcccttcttcacaaactttcagattaaaattgttgcatcctatcacaggggttttcttgaacattcttttaggttcatactggttttttatacattgaaaattatctttcaatttgcat

SEQ ID NO: 31124 - DNA, 1580 bp, Bovine  19866881103377
cagaccagcaattgctgagcggagctgctttgatgggtaggctgaggcgccgttcctgggccctcctgatccacagttctgttcccctttggacagtgccgtttgatcacttttcagcgtccacttacaagcgtgtgacgtttgttttcttaccgtcttctgccttcagggaatgtgttttctttctgttaggaaaataaatacccctggtgtgtgaagcatgatgtgtcatggggttggcgttctgacctctgaggaggagtggggacagtggcgaagcaggcctcgggcacatgaggccccgccgtcctgctgctgcaccgggaggctcggggcgtggtagcgtccccccaaccccgccaccgccggctgagcagaggtgacagggctccccggtgttcccgaggacaccctgccctccacggcccccatccctcagcctttgctctcattactcgtcagggaagagaccgtggtagggactgaccgccccagcctgccgcgtctcgggcggcggccaggagaccagagtcagggcctcatctgcctcccctgccctggccccacccgccccagccccgctctgccgcccaaaggggaggaggaggaggaggaggaggatggtcaacctggatgagacctgcatgaggctcccctgtgacatgcgaggcccctggggtcaggctgtggacactcttcatcgcacgtctcagtaagatacgtgtctgccactgccgacccaaggggacccccggcagacctacagacagttagcacgctggcgtcagcccgggatgagagtgccatcgcggcgctagaagccagtccacagaggggctgccagcccctgctactctgagagaatcctatctgtgagcaccagggcattcagacgtctcatttgcatcccctcgtctggcagctgtgtcgtaatttaaaccctgccagcagagatgtatgggtcgccatgtcagggagcacaggggtggccattaatgccatgagttacagccggtggtgcccggtcagagttaactgtgagagaccagtgataaattccgcctttccaggggttctggggacaggggagaggagagggctggtttctcatatttgaggtccttctaaatcacggtgctgacattttatttagagaacttgcagcatgcagtttgtatgtgggatgttttgcatctgagagcagcttgagacagggcctctcggctggtggcggagcatctgcgcacagcagagccggcgttcccacgcgggtgctgggctacgtcctccccagggtctgtacgccctgtagcctttcagactacaggggagtgcagcggatgggagtggacttgtttggaatcccacttggccacccgctcgaaacttgattttgccgggcctcggtttcctcgtctgtaaagtagaataacagctcccttcctagttgcccagcagggtgactacagaagtgcgatgagacggtgtttgggagactgtgggaatcttccaggcctgtgaggagaactgaactctgccagaatgaggccttggagtcgctctgcgtttatcacctcttc

SEQ ID NO: 31125 - DNA, 1414 bp, Bovine  19866881144711
cttggtgaccgcatggactggagcccgccaggctcctctgtccatggaatgttccaggcaagaatactggagtggctagccatttctgtctccaggggatcttcccagcccagggattgaacctatgtgtctttcctctcctgcattgtcaggcaaattcttttcactgcactatctgggaaaccccccctggtaaaaaaccctctccaaaggtacatgaagaggaccaacagtcaaagcttcagatgaagaaacctaggggtggagctgcagggtctagggtgcaagcatgccaagggtatgaggggcagtggagtctgagtccctggccgcagctgtgttcagagactgcagtgtactggctatacaccaagtctggtttgagtgggggagggcagctttccctgaaagtgccccgagggttaaagcctttgtaattgtttatagttaatatggaaaaaaaaattcacgcatattccaggagtcagactcctcagatcattctccgtgatctgacttctgcctgtttctatagtctcttcgttggccacttcttgccttagactctccaaaggttctggaaatgcttaacttgggcatatatccaattgtttcttacttatttggctttgctagtgccattccttcagaatgaatgcttttccttttcttcttctggttagcatctgttaactcttagtcccaatttacatgttatggccttccaggttgccttctattactttggaaaatgcctctccattgtgttctcaaaggactttttgtatatattaaaattgtctcttcatatatccatttcttccattggactgtgaggtccttgaggacaatgactctgtcaccaaatgactccttcttaagtctccagtgcctgtatagatccttgagcatcattggtgcttaataagtgtttgttgattaaatagatgaatgaatgagtgaaatacgagctggttagtttttcatctctcatcctttacaaccaggcgagaacctttcttctttacttcatttcctactgggaccaaccaaatgaaattacttaattttctgacctctatactttgcttatgttctcttaaaagcctacaatgccatcttcttcctagtatatcaactgaaacttgaccccttcttaaaggtcttcctcaaaaatctcttgctccttcaagtgtttcctaatccctttaaaacatgtgtgatcacttactcctttttctgaatttccaaagctctggatttttacttttcttactgcattaatcttatgccatgtaattctttgctgcttttatcccatttattagattgtaaaggccttgagattagagattctgtgttcctcatatgagtgtcccgtatagcacctcagtcagtgctttctaaatagtag

SEQ ID NO: 31126 - DNA, 1256 bp, Bovine  19866881321644
atggttggatggcatcactatctcaatggacatgaatttgtgtaagctctgggagttggtgatgaacagggaaagcctggagtgcggcagttcttggggtcacaaagagttttacacggctaagctactgaactgagaaattgaaaatgaagggaaagaactatactgtttgaagtagcttgtaaagagtcccacctgccaatgcaggaggtgcaagagacacagggttccctctcttgtttggtaagttcccctggaaaaggaaatggctacccatgccagtattcttggttgcgaatcccatggatagaggagcctggtgtgctacagtccatggggttgcaaagagtcggacatgactgagcacatacgcacacagactgaattttaaaacattttaacatagtaggagttactctgagatacagtcagtctgaggatttaaaataaagtgatactacgattatcctttaaatttattttgtaaaatgttttgtggagtcaaaatttccttttttttctaaagtttccttctgcttattttttatgtaatcaaattgtaggctatttataaatatctagttcactatgtattctgaaacctcttttagaaattttaattttccgctagattttatattttctgtgtttgggatatgtacctgtcatgtgttcagtattatgataacttttaacagctaattgggaaagcatgtttatgtgtaataatgaaataagtatttcagtaggatttttttcttgtaggattgtcattataatcgaaatgttttaaatgctcatttgaaagaacaatccagagatagaaaggatttatgtctttcatatacctttttaagaaagtatggctttttgagaataaggtcaagataggtctctgatcagtatcagaagaaagggggaatctattttcaaacttttttagaattcaattgtttttgcgagcacactatctgtggagtatcgatcgtcagggtcccgtagttagtcaaaggctatctcctctgactcaccccttcgtgtggtgtcatcctcctccatgtgatagattgttacaatctcaggcagtgtaattacacacgagccaagtgggtcatttatttctttaccttcaccatttaccaaaaatctcctttatctttgggagccagatctttcttttgcagtaaaagcaaaataatggcacataaaacattacatgtaagaactaagcaccataaaattattaagagaataac

SEQ ID NO: 31127 - DNA, 1498 bp, Bovine  19866881575948
atggtatgacattttgtaaatatattcctgccctgattataacttcttataaagaaaagacaaaaagaaaatattcttgtctctttcaaggaggctgtcaaaatataaaactaaactcagtgtgcatttgtaaaatatggattaatgtcactccaaagtttatgcatggttagatctgtcttctcatcagtcagaattttagactggtgatgaaacaacagggaaactggaagaaaaaaacaacttcaaaactgatttctactttttttcagctttaaaagattaaagcattatgttaaatgaggagtttctcaatagaagaaaataataaaatttcctcacattttcaaactaaaatagatttgatcttaacagattgacaatattatattgcaattattataaggaaataccatatataaaattgaattccttcaaaaggacattttttacattctctgtcttagaacttttctttctaaagataatgatcagaaaaatgatacagaagaaagactgttaattatattaattcagcttcagaaagagaattcctgtaaaacatggacaagattaccaaataaaattgtagtttcatatcaaaactttggggacattaaatggatataaatatgcataaataattcaattcatttaaaaaagataggctatattatccacttaagaatgaggataagacctgtttatgatttaatttaagctttgcacacaatgttttcttcgatttcacaagtttatttaaacatatagtagtatttgctaaggagaaggaaatggcaaccccctctagtactcttgcctggagaattccatagactgaggagcctggtgggctacagcccattggggtcaccaaagagtgggacacagctgagcgacttcactttcaccttggggagaagggaaatggcaccccactccagtactttttgcttggaaaatcccatggattggaggagcctggtaggctgcagtccatgggaattgctaagagtcggatacgactgaacgacttcactttcatgcattggagaaggaaatggcaacccaccccagtgttcttgcctggagaattccagggacaggggagcctggtgggctgccgtctatggggttgcacagagttggacataactgaagcaacttagcagcagcagcggtagtatttgctaaacgtatactatgggaaaacttccatataattctaatattttttgtcttaatatatgcattttattgatgtatagttgactaacaatgtttcaagtgcacaacaaggtgattcagttgcatatgtgcatatatgttatatatctactttttaaatagaaatctggcattctattcatactaagtggatgacaccttcaaagcagctctgaatgcagaactcaaaggcacgcctatggtgtctcctcataatgcagaaagagaaagagagagcgcgcatgtgtgtgtgtgacagtgtatgtgtgtg

SEQ ID NO: 31128 - DNA, 1792 bp, Bovine  19866881821989
tataggttgaaagagtggagatgatttcagaactgataaaattggaagtttatatttctaactcacaactgtgttttgctatggaatttttacttgggaatcttaaaaactgaagcctgctttaccaaagtgaactaggcactagagctctgaggagcttccttgttttcatcagctatcctgctgctcatccctcctttaccctgccacccccacttctgcttcttcctctgatctttaaaatcgctttgtagaacatttttctttgtatctctcattcatggattttctcagtaagttaaaaaatgggctaattcaaagaataaattttaaatattaaagggcaaaatctgacatgtattcagtacctgtgccttgtattagcatgtctagtggagtatacagtaacctccagcataaagaagaaccttggggatgctttcagttttactaattatttaattttgtaatcagttatttccttgaattaaaaagaaacctttgttaaagttgaaatgttgagatgaatacattagaaaggcagaaagaggaggaacctacttatatgtaatttttctttggtcataaaaatagtatgaaacagtttttaaaatttaaattgcctataagctacttctgaataattctgggatttggattctaaaaagatgatcatagttacagcatttatcactaaggcatttaaaaacttgaagtaatttataaatctggattgttcatttcaccatttgctggggaaaaggaaaattactatatccattttattctcttttactgttgctgatttaattgttaagtttgtattatttaaaacttgaagagaacaaatgattggaggctaagtattaactcattgtgttaactattcagaaaggatccataaatgtttcttttctaattcaggcttgggatttttttttaattatagcgtaagagagcaagtctcttaatttttaatgtgaaaaaactttttcttttaaaattaggatcagaattagttcttccatacaaaatctgttcttttttcaagtgtgaaataagatactacttttaatatgaaaatctacagaacaaacatatagttgtataaaattaatattttccttgttctaaatatctttgtggaaacttgaatggttaaatctacaaaatgttctacatttgtaaattttgcagactggagttaaaatggaagcttcttgcatttagttcctcaagttcacatctttatattataaactataaactgtgctctcacctgccttcatttaagaacaatccacagtcaattacaatgtaaagtcatatttttattactgttttcaacaagactgctgcttagggtgagggaagaggtgtgggagaaggaggggcacatttgacattggcactgagatacagttaacatcagcaaaactttgtttttaaaagaagaattttacatataattaaatactttttttttttttttttcacttggtgacaacattcaggcaacccaaaacaaagtggggagggtgggaaaggggagaaagagaagagtgggagagaaggaaaagggagaaacgactatattttgatttgaaaatgtaccttgggtttcattttgtggtggcaaagcccgattgcttcttttgtgtgaccttttaaattcacattgtttggaagaaaacgatcacttttgtgcaagaatgtgattttggtggggtggtgggtttgctctcctttttgtttgcttgtgaattaaggaagtcttctgccgggttcggtt

SEQ ID NO: 31129 - DNA, 883 bp, Bovine  19866882227896
tgacgttaaaagaatgaaatttagtcaacaacatactgaagtgcagactgagaggcagatagagaaatcactaaaggagttctgtgcttctaaactgcccttgaactgctgggcaaagagagattgtgcagccaaatagcacactgctcactgctacatttataccattactaaagaaaagtgagttagtatcatatcctgatataaccatcaagcacttgtgcatcttttggcaggagaatcattctgtctacgattgttattgtgtagttttaaatggagtagtcaaccagctgttatatattttatacactgaaggccatgtttcctttgaaattcatagttttaatctcaactgaagtctgtattgctgtgcgccaagatcaaaaggattaggcaaacttgtacaattacccttctttgcagagagatgatttttttctaatgtttaaaatagtcctatacgctgacattttatccaactattttctttagagctacagaacattaaaacatttaattaacatttcaaccttaggtcactcttaatctaaaatctaggaattcgcaatgtacagatatgttaaactagctatagtgcaacacacttagggagatggagctttttaaaaaaatccaataaggaatgctagagaacaattaaaattagaatatacccatctaatttatcatttgcttacactttgcatgccctggttcagaacgcagttcacaatacttatagtaatgaataggtatcaatataaaataaatttaacataagtatggcgatgcgaaactaagggtaagaagtacgtaaaaaccgtgccagaagttctgtagactcgtgagaggtatgccatgcattgacgttaagctttct

SEQ ID NO: 31130 - DNA, 4139 bp, Bovine  19866880418065
cattttaaaaaatcttgtttaaagaaatgaaatgatacaaatgaacttatttacaaaacagaaacagattcacagacttagagaatgaacttttggttaccagctgggaaagatgaggagaagggatagttagggagttcggatccacacgtacacactgctatatctaaaatggataaccaacaaggacctactgtatagcacagataactctcctcaatgttatgtggcaacctggattggaggggagtttgagggagaatggatacatgtaaatatatgactaagtccctttgctggtcacctgaaactactacaacattattaatcggctatggtctaatataaaataaaaagtttaaaaaaagaaaaaaactttttagtcatctatttctcaaaagtttattgtttcttttgtactgtaatatttagtccctaaagcccttttatgccaacttgaatatggaatagaatattcaaattaatgtttgtaattttaggaggtgtataataaactaacattttgctagtcaaaagtaccttgaaatgttacttctttccattcataaagataacacaagatcaatgcatcagggagattaattatattaaaacaacatgtatgagtgattgatacattcccatataatgagcaaacagaaacactccagttagtaggggagaaagctattcaagcagctctacatgattttaatttgtagatatatgtattatatggtggcactagtggtaaagaatctgcctgccagtgcaggagacacaagagacgggttccatctctgggaagattccctggagtaggaaatggcaacacactgcagttattcttgcctgggaaattccatggatagaggagcctggcagactacattctatgggatcacaggagtcagacacaactgagcaactgagcacacacatgtacatattatatgtgtagattttctctgatttacctttctaattcatgaagtgtattttcacttaggggatgcagcttacatgcgtgcaaaataatggcagggaggtaattcttgaaatgtaaaactaattttccacgagaaagctgccaaattgatactcacatgtaagcatttgagaattagaacattacactgtatttgctcagtaagatcactagcaaaagtttatcagaaaaaaagaaataacctttatcagaaataaggcaagaacaaataaataaaccttcacttgtatggttcggtctaacaaatagaacaaatatttttcaagggcacagaaagatgcaaacagaaaaagaacgttgtttgctgtaactttaggacgcattaatacacattcctttctcatcttagaaaaatgcatatgattcattgtagaacaaacatgtcatatttatgtaaatttgttacttaaatattttcaaactctgtagtcttcttttcttctaattgttcttttttcccatgtgatcagatcaagtttcagagtttttaatgtcatctgtggtgaccaggctgacctctctcctgaactctagactcgttatgcacttgacccttggtcatacttggctacccaataggtctctcaaattcaacacgtccaaagcagaattactcatttttcctctaaaactattcctcagccagtctctcccatttcagtaaatggtgccattctctgcctaacagtgcacccaagaccttggttttcactttttggtcccgcagtctccttaagtgatttgttacatctaatttatcagcaagtcctgataattttatctcaaaaatgtatcctgaaactattctcgtctctccatctctgctatcacccctttcaccatcatcttccacctgctttatcgaaagggctcctaaaaatgtataatgagatttgaaatagaagtgaaatatctttcccaaagtttaaattgctcaaattatatttaaacatctcagaagaaggatttaaattctaattccttctttctgatagagattctaggtgagattttacaggtgaggaaattgaagcttagaaaaatgaactaactcaagccacacagaagtcaaataatttgcccaggtcccacaactagcttgggcagaagttgtgacacaaatccactagtgactgactccaaaatccatgttctttccatgacacctggatgttgtgtctacttgtctgggttttgtgtatacttacatcatcactttagcctcttcaatgaaatcctcttcagacatgaagccttcgttgatggccttgatagctacctggacatgtgctcgccattggcctaaatagaccacccccaaactgaccacttccaatctgcttcacaaaagccaattcagatggatctatctcccacttttctggaaaagtaaaatatccatgttacaagtaaggaaaaatgttaaattttagagctagaaaagatctaggaattatctcgacctattttcttttatttttcagagaggtcgaaaacatttataaatgagtagtaaggacctgttaccatttttaatactatcattgtggcttaaaagtgtaattccagaattcaagtttaaatgcaataagttctaaaggaattttatatgttgagtcgtgccatataaacacattattttaaataaataaaagcaaacaaagatacaaatctcacttacttggagagaaattatggcttatcaaaacaggctttttctttcccgagagacccagaaggaaacacagttctgtgtctttctaaactaaacctgccaaaaccagatgtggtcctaaatacgtacatccccacactggttttgttctgataagtaaacttgtgaggtagataaaacctgggctcccccccacccccatcccagtttcttttactgttcctctgccactcccactccaaagggcttttttgccctttctcttttgcaaaaagcctaatcaattcatctaataaatattttcaatattaagattctaacctatatctaagtgtacgtttgaaatgagaattacattactgaatatgtctcatcctatagaagcaaatcagtggttggggggggggactatttttaaaataatgctttggaaaactcagaatcaaatcttaactttttagtatccccttttatatagcaatgccaccatctgctggaactttaagataatgcatttaaaagaattgaagggaattccctggctctccagtggttaggacttcatgctttcactgtccagtgcccaggttcaatttctggtcagggaactaagatctcacaagctgtgaagcacattctcctctactccccccaaaaaagaattataaggactaatggacccttgtatcgggctttgcaaggtactctcctttccaatagtaggtgtgtttttaaagtaacataggagaatatagtcatgaccttgggattggcatagatttattcaacagaatataaccatagaagaaaatattaataaattatacttcataaaatcttatttatcaaatatagcccattaagaaaatgaaaaagtaagccacagactggggaaagatatttcttaaaatacataaccaacctaagacttccttttcaaaataagaataaatcaactaggaaaaggcatataatcctattgttaagtgttaaataaaaacttgaatagagttttctctcacaaaagagaatacccaaagtggcaactgaacctatgaaaagttgatcagggaaattgcatatttaaaccaaaatgagatatgcacacatacactgctaagtcgcgtcagtcgtgtctgactctgtgtgaccccatagacggcaacccaccaggctcccccgtccctgggattctccaggcaagaacactggagtgggttgccatttccttctccaattcaggaaagtgaaaagtgaaagtgaagtcgctgagtcttgtctgactcttagcgaccccatggactgcagcctaccaggctcctccatccatgggattttccaggcaagagtactggagtggggtatgaacaaaaaccaagccagaacaaacaaaaccacaagaatacgaaacacggcaaggacaaagatgggaacagctaaactcacatatgtcat

SEQ ID NO: 31131 - DNA, 1782 bp, Bovine  19866880454967
cataattttaaaaatttctggctaaataaaaaaattttgaatacgtttgaaatatgtgtagattcatggtgacacagcacaaataactgattttgtgagttgtacctggtcttcaaagtcttctgtttatagtatttttatatacttattttttttttggcatgatcatttctcttcacttggcattgggcttttccttttttgctaaaatttgtcccttcgttaagagaggcatcagtctccaaatcctaggatgtatatttgtaactgagtcctgtattgcattgtgaaagtcttctacagtgttgtatgttcttggcatagtgtcacatgtttgttgatagactttctgaagttctatggaaaatgtgggttcaactctgcgccactgaggtcctcagcctcctctcctccagtgtagtgtgtttcaaaataagaaaccatcttgaagcaaatcattgtcatctctcagctcagtaaagctatcaatatcatctctagctgaaagaaatgctaacacatttcacttcgttgaaagcatattgtcaggccccgaattgtcaaccattcgtttatctttcattgcaaaactggcatacagtcagtcagttacatgtgaaaatgtctgcgacagagatgcttatagtgagaataccaggcacacggttctgtaattgaatgccgaggaatttgaggcttatcccctcattcgttttccaggtgtctatatgttctttcttgtttccctgttttctcagctgtgacatttattttacttattgactgacgaataatcataccttgaggaaaatggcatgtgcaaaacttctatttgaggacagacggaggtatttgtcagttattccagaaaaagagctgggagggagagagggaagacagaaagtgtggagttgggtctgagatggtggcaggtgatatgctctggaatgtaactctgtccctctctagttctttcaggaaagttcctaaccttctagaatgctagtgggagtggattagtatggaaatgacccagtcagtactcatacatcataatcggagctcagtcactggtaaaaggtttctctgcaatggtcttgatttttactttctgcctcctaaaacagtgttgtgtgattgacaaaacccgttcatccctgatcacgttcctgtttgttgctacctctttcatcaaaacctccaggggagaatcacatcttgggtctaggaaagagtatttactttcattctgagccaggaagggaaggattaagctgactgttaagctatcacagtataagtttgccagcatctgaagaaaagcaggattattctgtttctctaaccccaaagagtcagaatgtttggattctacggggtaccaatagatgttaactgtttcctatgctttgtgttcagcagtgattcctacagattcatattcattacctgacagtaatactgcaaacccaaattatgccaggtaaattgtatttttcttatgagtttaattttgaaatttttaatattttggtcatgtcttaaacacctcattattcttagtactgtgtttttcaacagaaggacagaagtaatttaagcaaaaattcagtccagttaatgtggttacaatgatagtaattggtattttgaaagttccatcattgttaagattcaaattgaggtgacaaacatatcctgaagagtaaagaaacatatggtcttatccttgtcgctcagtttggaagtttgatgggagtctgtttgactcattttctcttc

SEQ ID NO: 31132 - DNA, 3356 bp, Bovine  19866880480838
aaatgggcagaagacctaaacagacatttctccaaagacatacagatgacaaatgagcacatgaaaagatgctcaacatcactcattagagaaatgcaaatcaaaactacagtgaggtatcacctcacaccaatcagaatagccatcatcaaaaaatctacaaacaataatgatggaaaggtgtgaagaaaagtgaaccctcttgcactactagtgggaatacaaatttatacagccactacagagaacaatatggagattccttaaaaaactagggatacaactacagtgtgacccaacaatcccactactgggcatttaccttgagaaaaccataattgaaagagacacacgtatcccaatgttcattacagcatatttacaatagttagaacatggaagcaacctagatgtccactgacagatgaatggataaagaaagttgtggtacatatatacagtggaatattactcagccatataaaagaacacatttgggtcagtcctaatgaggtgaatgaacctagaacctgttatacagagtgaagtaagtcagaaagagaaaagcaaatattgtatattaacggatgtatatggaatctagaaagatggtactggtaaatttatttgcagggcagcagtggagatgcagacatagagaacagatttgtggacatgccggggatggagagggtgggacaaattgagagaatagcatggaaacatatacattaccatatgtacaatagatagcctggggaaatggctgggactcagggtgctcaaatcaagtgctctgtgacaatctagaggggatgagatgaggtgggtgaggaagggaggttcaacagtgagagaatatatgtataccgactgagcgacttcactttcacttttcactttcacgcattggagaaggaaatggcaacccactccagtgttcttgcctggagaatcccagggatgctgccgtctctggggtcgcacagagtcggacacgactgaagcgacttagcagcagcagcagcataacaaatatcaacacaatattgcaaagcaattattctccaattaaaaaaataaacaaacaaacctgaatctaaaccaagcctctaaatataacctcaagtttatgggaaagtttatgggcttccctcgtggcttagttggtaaagaatatgcctgcaatgcaggagacctgggttcaatccctgggttgggaagatcccctggagaagggaaaggccacccactccagtattctggcctagagaattccatggactgtatagtccttggggtcgcaatgagtcagacatgactgagcaactttcactttcacttatgggaaagaccattccatacttaccaaatgataaaactggacaagggtgaccttagcaagcctgctgaagatcgggaagatgtgaaacttaggaaactctcacactccgctggtagacatgcaaattgacctgtacaatttgaatttgacaattcttaaactgtggggaaagtcatcttcttgccactagatggtgcttattggcttttaaggagtttattgtattgtgttctattattttgttacattctctcattactctcccctgatcttcggaggaagggactagcctctagcactagagaagttgtgatccagacccaagcagccatatctgctttcgtcctgtctcgccatattggtactaaggacatatctctgaggcttgctgtttccccaagccatttattttattcatttctttagtaatatctttctcttaacactgtatcaaagatattttttctgaagaatgttttttgatattcagtagctccattctctagttttaacttttgttttagtttgagaccagagttatagaaaacggtacaaagaaattctatacagcctttacccaagacctggattccctacttattaacattttcaccattctccttttttctctttctctccctccctccccttctcattatctcacccgtacaaatacatgagacagcaatgatgtttaattttttaaaccatttaaaagtaagttggcagacatgatgccccattggccttgtaaagaagggcactgtttacaaaaccacagcatccctatcaacatcaggaccatttctcaaactctctttgtcttttataattttggtatttttgaggcccaggctcataatcttcagtttgggtttgttgtgtcctcatgatcggatacaagttataatttgaggggcaggaatatacagatgttctcagtgcatcatatcagtaggcaatgatgtcactggtaatactgtgtgtgtgtgctcagttgctcagccgtgtccaactctttgcgatcccatagactatatagcccaccaggctcctttgtccatgggattctccagcaagaatattggagtgggttatcatttcctcttccaggatctttcccacccagagatcgaacctgcatctcctgtgcctcccgcattgggaggcagattctttaccactgagccacctgagtagctggcattctaccataaagtaactgggcttccctgatggcacaggccctggagcctgtgctctgcaacaggagatgccactgcaaagagaagctgcacacaccacgactagagggtggccccagctcaccccaactggcgaaaagccctagcagcagtgaagacccagcacagccaagaataagtaaataaataaaaattattaaaagaaaaaagagagcgttcctttctcattgttatactacaccttgaaggataggctaagatgtgagaatcgaatgattaaaaagggagataagtggaaaagagagatcaggtagtcacttgaagaagtatgctcattttaaacttctttttacactagtatgtgaggtgatgtttagccatttttattttcctgggaacttttagccttttccaatgtatacatctacggaaacagaaaattttaagttctaagatattttggtgatgttggacattcagctttgtcacttagtaggaaggtgaaggaaattgaattgtgcagaatgagtacttttgagcaccctcccagtctctttttctctcacccttcacatctaatcaatcaacaaatgcagccattctgccttctctctgcctgtcaccacctcttcacccctattagcttctccagttcaagctgtcatccttcacttaaataaatacaagagcttccgaacagacctctttcaaatcatcctttgcatagagtaatctgcctaaagcacaaatgtagtcatctcatattcttgtttaaaaacccacaaggatcctcattgcctacagaa

SEQ ID NO: 31133 - DNA, 3098 bp, Bovine  19866880650056
gaaaatacagtttataccctgggtgccttgtttagtaggtaaggaagacttgcaggctaaacttttactcttatctgagagctaaaaaagtgcctgatcctggaatagcaccaattcatgatgttaaatggggagcctagaatgtaccctttattctgattaaagtcagccgagcatttccctcctttttgcttgtgtttctgctgttcggttccctttttacaaaagaaaattggggcttaagctggggtttacattgtagaagagagcagaataaggtttgttactatatagtacctacccattttagatacttttgaattgaaatataacccacagaaactgttggcagacatacaccatttgatttctcagataattgtcagtctgatgtttattcatgctatatttcttaacattacaaacaggctgaaactttgtggtaaacctatgatgtaatgtgtaatagccactgtgttctgatgtaaaattctgaaattgagagctttaactacattactactcttagagcattgacaagtattagattgagttagataatattgttgatttgtataggtaaaatattgccaaacattgaccttttcatatggcttaacatagtaagatgagaattttaacaacctttgatcactctgcttctttctgtaaggagttcatcctttctctaccctgacaagtaggctgtttgtttcttttttactatattccttaccatcctcatgtttggtaattcacaatcacctctggacccgtgattaaaaatattgtgaaaggatgtataaagtaggctgggtaaccttagagccattaaaaaaaacatatttttcttcagcagaatttttatgataaaaaagagttcttagatcttttggctaaaattggtagaccatgaaaccaagaaccattagtctggtatttagatttgtaacactagacagagaatacaacttcatggtggtttgggtttctcattggtgaaacggtgaacagtgtctacttcagaatattggtattcagataagcaacaaggatatactgtatagcacagggaactatattcatatcttgtaaaaacttacaatggaaaataatctgaaaaacataactgaattactttgctgtacaccttaaactaacacagtattgtaaatccactaatactttaataaaaaaagaatattgatgttcaaagactaatgcgttacttttcaagcttttaacaattagcagtcagagtaaaggaaagaatgttcttgtgttcactgttaaggagacacagagaaaagggtcttaagttatagctcttcgttttattttaaaaagatacttgtaacccagagttggttcatttgtgattcttttgtctgaatggctcagtcctttttggtgtggaaaaagggagaatcagctggaggagtctgaaattttgtttcatcttcattttttactttggagcatcaaacggattctttcattcagagtgattgtctccaggttttaaaaattaattaatgtatgtatgtatgtattcttattgaagtcctgttgatttacaatgttgtgttagtttcaggtgtatagcaaaatgatccaggtttacatatatatatgtatttttcagattcttttcccatgtaagttattataaaatattgagtatagttccctatgctatacagtaggtccttggtagttatctattttatttatagtagtgtatgtatgttaatcccaaactcccaatttatcccttccctacccctttcccctttggtaaccataggtttgtgttctatggtctctttcttttctttttaaaaaaaatctcttagatctgttattgaaacttgcagtgatcaaatgactttgacatgcatattacatttacatttcttatcatcagtcccctatcccaagggagaactcagtttcataaaagttgagggactttcccaaattcacaaagctgaagaagcctaacttgacctggtacccggatttggctggttccagagctcatacttttcctgccattccctgttcctctggtagaatgtgtgggtctgtttctgtttgattataaattcatttgttctctttagtttttggtattgagagattggtgtccttcttaatgatgccttgggagtcagttttatctgttgaaatttggaggttgtgtcgaattgcctttagccatctgcctaaatagaaggccgataatgacgcatcatatgcttttccctttagttctcttttcctttccactggagaggttgtgtgtgtagcggttaatagtgcaggctgtgtggtgagaatgcctgaattaaaatctggctcttattcttaccatatgactagggaatattaccttcagtaggtttgttgaattaaatgagttgttacatctgaagtgcttagtgtttagtgcttagtgcttagtgcttagtgctatgtgtttgctatgccaacacgtagcaaaatagtggaagcttgattatattttttattatttttctgtgtaaatagtaactctacatggatactccctgattctcttatagtctgcttattcctccggctttcattgatcttatcaaaaggtcattagattgacctttcaggacaatgaggttaatttcaggtgtatagcaaaatgattcagctatacacataactataagggaaatctactcagcctcctctcctcttttcatgtacttttcacagtatttggcagatatgtgtttcatagtttgcagctcatagccatctttttgttcactggaggtaggaattatcttcctctccgatttgagtattttattgcttgcatagaattttagggaaggagagtagagaacatattaatactctttccactgccatcttctaataactttttgatcccagaagcaaccacttttacttttaaaacaacatgttagtaacgtaaatctctaagtgatgtacttacgctgccacttcttgctttttcaattttaggtatgatgcactgacttcctcctagtactatggaggacatagttctctttcacaacataccttgagat

SEQ ID NO: 31134 - DNA, 1593 bp, Bovine  19866880693730
catgtagaatgaactcaaagagatccacactgaagcacatcatgctcaaactgtcaaaaggcaaagacaaaattaagtattttgaaagcatcaagagaaaagggactcagcacatacaaggagcccttaataagattatcagcggatttcttattggaaacttcagaggacagaaagaagtgagctgaggtaatcaaagtgctttaaaaaaaaataaaactgtcaaccaagaatactttatattttgtacttatattctcatttgaagaacaggcaaaactgttgttcttcaaaaataagaaagaaattaagacttttccaaataagcaaaatcttagggagctcattaccactagatttgccctgcaagaaacactacagggagtcatgtagtttgaaatgaaagaacaacttaaaactatgtgaagaaataaagatttcaatagggcttccctggtggctcaagggtaaagaatctgcctgccaatgccagagacacgggttcaatccctagtctggtaagttcccacatgctgtggagcaactaagcccacagtcacaattactgagactgtgctctagaacctgggaacaccaagtaccgagcgcatgagcagcaactactgaagctcctgtgccctggagcctgtgttccacaagagaagccaccacaatgagaagcccacccacagcagcaaagagtagccccagctagccacaactcaagaaaagcccacaaagcagcaaaagcacagtcaaaataaataaagaaaaattttttaaagttctcagaaaaggtaaataaatgagcaattataaaagctagtattattgtgacaaaggtgtgacactccgctttttgttttccacattatttaagagactagtatattttaaagaaactattagtttaaaagagagtgtaattgtaacttggatttgtaactccaaattctttttttacataatttgactaatgcagttaaaaaatatttttctaccttttgggcacacaatctacctagatatgactttaccatcaacaaccaaaagggatggggacagaaaccattaaaggaacagagtttttgtttgttgttgaagttgaactggtataaattcaaagtagagtgttaaaacttcagattaaatataatccctgtggaaactatgaagaaaatacctaaagaatatatacaaagtaaatgagaaaataacacatttcaatacaaaaaatcaactaaacacagaaaaaacaataatatggaaaactgcaaaaaaatgtaaagtatatggtaaataaacagcagttcagttcagttcagtctctcagtcgtgtccgactctttgctaccccatgaatcgcagcacgccaggcctccctgtccatcaccaactcctagagttcactcagactcatgtccatcgagtcagtgatgccatccagccatgtcaaccactgctgtccacttctcctcctgcccccaatccctcccagcatcagagtcttttccaatgagttaactcttcacatgaggtggccaaagtgctggagtttcagctttagcatcattccttccaaagaaatcccag

SEQ ID NO: 31135 - DNA, 2623 bp, Bovine  19866880795539
acagtttcagggataatgagccagccaatagaccaaataaataagtagaaatatgtgatttttttgtatagtgttaagagctatagataaaaaattatatggaaaaaggagacggggaatgtccatggtggggttattattttaaataggatgattcaagaaagcgtaacagagagggtgactttttagcaacagtcttgagatgaggaggcaagccatgttgctatcaaggagaagcactcctggcaaaaggcaggcagatgcaaaagccctgaggtgaggaggtgcctggaatgttcgagggacagtgtgtgttaacaggggaggagcaggagatgagtcaataagtggatgcgcacaagtgccagaaggaaaccactctgcttcagtccaagccgattcacctgcattttcagctttcccagacagcttatcacacaggaagtcaccaaacccaccactaccggcactaaaagaaggcacctataaaggactttcagctttttcttaagatcctcatttactgcgatagctttctcgttagttgtgagaaaaattaccccagattacttcaaaacattaaagtgctggagaaaaacaaacctggccaactggcacttaatactgacaaagtcccccaatttatcaatcatgctttaaggaaatagggatcatagctgaagagctccaagtaattactagtgaggatgctggaccaagtgttaaatggccaagaaagcaagagagtcactgggaagagaagaatggtggatgttttccgcttatctttcctgcatctattactcctccgctgccctccccagagctctcagtttctatttccaagtgcgagtgtgctcagttgtgtccagctctttttgtgaccctatgggttgtagcctgccaagttcctctgtccaggggattctccaggcaagaatactggagtgggttgccatgaccccgcctccaggggatcttcccgacccagagatcaaactcatgtctcttatgtttcctgcattggcaggcaggcgggttctttaccactaggtgccacctagaaagcccctcccattgttaaacttcatggtaatgactcccactttctgcagcaccctttcccctatgcagcttcccctttctgaagcactgaggatgacgaagatcaatttccagtcattcctgcaaatggtacgtgaaaaattaaggtttaatggtgattactggttgtttcattttgaatctaaaaccctggacttcagaaataatggaactttgatgtaacatttgaatatcttgcttttgccacctttttattcttatggaaaaagcaagtcatcttctagaaggtgccagaggtactctctatgataaaatgaggcttcctcaattattcaatttcacaggtaccaagggtgaaatctcagaactgagatgcaggttctgaattgccctggacaatggatctcactagaaacagaaacttcaccaggtcctgttcaaaggactttctcctgtaacagtgttcaatactggagcacaggaaactgctgaaataattaaatctgtgcaaaaatagtttattaaataacataaggaagattatgaaggacagttccagaatgcccactcatgtggcttgtaaaggtgcatttttcataaagatctgtacagctcaaaagcacaacatcctgcaggggaggctcctttattccaggatttggcagaatttattttcatcttctacacatgagccaccaaagtaaaaaacaaaagtcactcctcttcagtaaagcagtgtcctcagttaaggataaggttttcatgtaaccttagggctctcagggcgcttctcgtgaagagcagccactataaagacgactatggagcaattttttcattcttcatgcatgagacataaagaatattatagaatagtccaagtttagaagtcactctcaaacatatatgtagaaaagttattgtcagaatactctcaagctttaacaaattggaaaagcctgtaatctttgcactgtttcttagagtcagtggctctaaagggtgatattcaccatcagtgacttcacccagggtttcctttcatgacagtcctgcaggatgatcctctgggttggcagtccctttaggtcaccaggtttctgcaatctctgtaagaacctgtagcagctcagcaaacgtcgggcggcctttaggtttctggaaaagggaattggaggcagtcaacttagcttaagactcacacggagaccagccttggacccggatccagcctagctcaccacgaacagaagagacagatatcttggctgatacacagggcatgaatggcagttgagcgaggcaggggtgtgaaaatataagggaagagatcgctgcaaaaatggctagagctgcaaacactagccgcacgtggctatttaaattaactgaaattagatacatcttaaaattcagttctcagtcaccctaaccacttttcaattctttgatagccaggtatggcctgacctattggacaatgcagatagcatatttccatcaccacagagcgttccacagatctgcccccagagatctatttggatgacttgatatg

SEQ ID NO: 31136 - DNA, 1540 bp, Bovine  19866880799010
catttgtggcctgtagctttcccttctttggtgtccctgatgtctctctactggatcatcccctttggtacagaagcatcacatacattcccaaaaataaacctctgccttgacccacagtcacctccaaactaccgtatcacctgagtccctttacagcaaaagctcttgaaagacaggattggggttgctatccctgctcctcaactcatgtgctggcctcaaactgctccaggtgcgtttctgtctcatcaggccactaagatttcatgtgtcaaaatcaccaagaacagccttgttgccagaacccgtgatcacttcccagttctagtctctctcccctgctgccctaacagtgttaacacagctgaccattctctccttgaaatgcttcgcttctgttggttctctgtgacaccaaagtctccttgatttttctccaatcttagaggctgaaccttctcagtctcctttgctgacctctgttttcctcctttacttctgaacactggtgtgcaccagcactctaccctgggcttgttttgcttcttcatctatgaatcctcctcggaggcagcctcatccagttccacggcttgacataccacctgtgtggtaataaccctgacatctccatctttagccctgttgccaagaacctcagatttatatatccaactgcaatcctgatatctttatttaaatatttagcaagtatctcaaatgtaacatggctacaatggagtgctatatagtccccgaaaatttgctctttatctagtctttgatgtctgaataaatggcctcaccatctccccagctgctcagccaaaaatctaagagctatcattgattcattcctctctttcatacctcaactctaatccatcagcatgttcttttgtctgtggaagtggaagtgttagtcactcagtcgtgtccaactctttgcaaccccatggactgcagcatgccaagctcttctgttcatggaattctctaggcaagaatcctggagtggtagccattcccttctcccggggatcttcccaaaacaggcatcgaacccacatctcctgcattgcaagtggactccttcccactgagccaccaggctccaaaatattccaatatcctatgaatattcaagactccttcatacttttccctttagtgcaacagactgatcgcactaatggctcttattgtaatgcctccctgaatcttttcatacctctctgtatacctgctctttggcaatgcccctcatagtagctgtcgatgtactcaaataacctgccttgaccaatgtgacagtagtaaatggaacaccagctaaggcttaaaaatctgcctgcccatttctacttcctttcttgcttctttattatgaccatgagagaataagaatagagtcatgtaacaacaccacacagaggagagcagagttgtcccagccatatgagttgaggccatcctagacaatcagcaaccagctggccctcccaaacatatcaggaaaagcaggcaatatggcaga

SEQ ID NO: 31137 - DNA, 4068 bp, Bovine  19866880816554
catattttgctctaaatactagtttttcttttattattactttgagaaaaacacataaaagttttacagaacatgccaacttcagataggagcttcttacatgagaaataaccacatgtaaggaatctagcctagcatttttttaaaacaattacattttcttctgaggaatatactacataaaattgtaataactgataaaaattcctcattaataaaccaacttctatagtctaattatatagcttcatgttataatttaagaggccctttagagaatatatattttttaaaaagtacaaagttacatgatcaggaaaagtaccttttaataagtaaccacaacattgtgaaatattcctctaattacacatatggctcagtttcatcttaattttgccaaaaaagaaaaagatggcttgaaacagtaaatgaaataggtatgttaatacaaggaagcacaacaaacaactgacatgttgccttgccactatccacatcttatgaaatattttacaatttcagtcatgcttttactattaaatactgttatagtgccacttttaggatgttacttaaggtaaagcttaacattctatccttctaacaagagttcaaagagaatacagagatgaatgtgaatatatattgtgttctacagcatctgctttctaatattccaaatttaacaacttatctaaatctaatctgaggtatattaacaagtcaaacattttttaatccacagcattggctatgtaccatgcaaacactactaccacaattgcacacagtggaaagaggtaatatttatatttctgccatagggttagctcaactgccacttcatctctcttcctgttcttcttccgacgacccttcagtctgttttcaaaagcttccagttcagcctaaatcaaaacagtatcatttttattaaattcaatacacacactgacttgaatttttccactcagacaaaaataaattggggaaatgttttaatagtaatggtatataattaatatacagatttgatttttttaaaatactatctttccactactgaccttattcaacaaattcagagttgaggtaagaagaactggaactagagagtggtgaaagagactatttcagactgatggcctgcttttgatactaaatacagaaacatctgatttaaaatatagacattagttttatatagcaccattaatctgtagttaatggggctctataatacagagcttccagctagtgcaaacagacaacccattaggataaagatacctctaattctagttttacacaatgctggtaacaaatattaacgacttgtatggaagacattcaagtgagtgaatagaaaaagctgctagaaattgattcctctcaatcaaatacatttaaaaacagagtaaaaattcttcaggggaaaaatgtttcatactttaaaccaaaatgactcctttagaaagtagaattacataaaattcattctaaaaaataactttaaaaaaaggatacctagatgacactcattataaagtgcagatttttagtctattgtaaagaacttacttattaagctttaatgcatgacaatataatattatacactgcactgttattaactaaagcctggtacttattaacatatatgtaatattcatgaaaatctatatatgttcatttaaaagaaggaaatagaaacttcagttaacatattcataacttttctcataaactgcatctgaagacctaacatatattcaatacttaatttaacacaaagtgacattcttcaatgaaccaaaatatcaaaatattctcaagtagttgtgatatacagcaaaaggtcaaaatatattaaaagcagtcaaacttgagaagcactgacacagtaaaataactgatgcataaatgatgactcgcagttttcaaaagtggtttaaattatgttctatacactgtttaaaaggcagtaaatagagactatatttaagatttctctccataatggcttataaaaaggagaagaagggacactccggactattaataataatctccaggattccagtcaacccatgttttattgcattagctctgataatttattttttgatattaggcaaatcaactttacagaacataaaacacgagaggttattttatcccaccttgctacatgagttatttttaatgccctctctcaagacatggaaatttcagtttcttcattcataatggtggtagtttacatacaatgtatactacttgctaagcactgaagtatctcaaaatgcaaactgacaaaaaattgtatgtcactattagaaagttaagccactctttggaatatatgatcaataaatatagtatttgagcaaacaggaggtacaagaatatacttgttatctaggtaacacattttatcttgaatgcagataaaaatttaagaattcttaaaggcattcaagagtctaatggggaaataagaaggtgtattattaaaacaaatgcattggttagtaaacagcacttgtctgtcacagacaacctacaactcagtaacatgagtgaagacgtgcactccaggggatgccttaaaacggatgctgccatgtcctgaccccccgtcactcaaaccaaaagaggcattatctctggagaatggatgaaatcaacaaggaagtaattgggaatacacaaaatacacagaatatctgggcacatacaaggtcccatgcttccttcagaggttcaggatacctggactgaaacaaacggataatttttgttttacaaggaactatagtttcagtccagaattgagctgacctagtttatatgttatgtttatatgtttccacgtatcttgtatttgcataaaaactaacaattatgcaaaaagacctaagtttgggtgttttctgttacctgttgtcttcgtttttcctcttcaagggcagctttggcttctgcttcttttaactgtttatagacatttaaaactaaattaacattgcaatcaccaagttttatacagaattttaacatctttccttccaggctccactaacctataacaacttctgagagcttcatactgaaaattatttaaagaaccataaatgttatacactgagaagtgttactagggtactatctaacagggtgtgagcggaagtagagtgttatatcttattcagctgaacaactataagatactagatcataatacacagagttacatcactgtaaactgaaacacttttaaaactggacttttactcttaagttaccacattaagattatgatcaattattaaatattactgtttgcctagggatgaaattgaccattttcctaaaacgccctctctggaggggaatccttcgtttcaaacaaaaccaaaagtttatgcactgattgggttaatggagggaaatagtgacacttaaaagtaacccaaacagcaaagaatcctaaaattttatttttgtattactttaacataattttcaggaagcttaaactaacattaagatgagtaactatgttccagagtacatccactcactggtacagagtatgggaaaatctagtacatcccagacaataaagattatatctagcacacaccagcacatctgagagttttaaaaaggcctacacactaggcttttatcacaaaaacaaaaaaggatgagatttcaagttcttcataataagcatctaaatttaatgtacaaaataaataaggaaagggtcactaacacattaaaaatgacatttaacgtgacattacctcagatgctttctgcttcatttctttgcatgttgtgtcacattctatggaaatctgatttttcacgtactttgttgcactgcacttcctacaaataaaatttttaaaatttttacttcaaaagatgtccctcaaagttgtagtaactgcatgccataaaaaagcaaaatttatctagcagcttaagattatgcctattatttcatttttattcttcatttctctttatcgcttcctattactcttctga

SEQ ID NO: 31138 - DNA, 1412 bp, Bovine  19866880843336
ttgggatcctaggacttctgccttcagttctctacactaaatattctaacacaaatacttttcaaactgatcacatttctacacacagcaattttggggttttttgtgtgttcttaaggctgaacattttctaaaatgacatcatcaccatgcttattcaaataacaaacaaaaccctgtcacaacacctggggaaactatcttccaaacatcataatttctggctttcaagagtgagaatcaagcccagaacaagccctgaagataaaggcccgagccatcttacttacaggtggaaagaatcatgctgccttatgtggggagcatacaaacagccttctggtctccagagatgctcctgtcacaaaaacacatcttttaactgaaatcatagctcactgaagacgtttctcacggacaaagttaaccccacctattttcctgttctaaaaacctcagcgaagtgtgtgaatgacaacctgatggcctatataagagaaagctgaataatctccatccggatctgagggtagctgctgttcactcctccttcccgactgtgtgggtgaccccaccaaacaccatttcaagaagtcacaaggtttgggcaaaagggaccttaaaaagagcatgaatgcaaactgctatctctgaactgaggaggaaacggaggcacagatgggataaggggcacagttcatggtagaaacagaactagattgtcagttttaaagtaccgtgtctagaatgttctgtcctccggctcagtactaacactttttggcaccatcagaagaaaatttattccgtggggagaagggaaaaccaacccatccccaggtaactggggtgtggtaacattatcaatgataaaaatgcacttgggagtttcactttatcccattgaaaaataaacaaaaagtaagtaaactaaagggaacaagtgcactgaagacacagcaaattcacatggcccttcctagttcctgctttatagattaagatctctttacacactctgggtggattcttctatttttaattcttttgctgcagctatatatatataaagctatatatatatagctttaaaaaaacgttccagtgaatgatttaaagattttttaagatgttcccaaatgtagccaaagcttgctttcccatcaaaagtattcatcaactgttagggcaagggctatagcttctcctttttcatcaaagccccctagcactttcagtgcagctcctcaaggtcaaaagggaaacacgggatgtggctgggaggcgcagggaggagtcaaggcgaaggaaggaaggaaggaggaaagcgtgaagatgaccgtaaggtaggctacaccttgtgcacagccaactccctgaaggagctacagttaacagatgcatatgttgtt

SEQ ID NO: 31139 - DNA, 1465 bp, Bovine  19866880874325
agacttagcagcagcagcagcagcagcatatagttgtaaagaggatcagcttcagtgaccctctcaattggtcactgtcaacttacaatggctggccactccgcccctcatcttcaaggctctcatctcctttgcaaaatttctcgaatcaccactgccctgtatgttcgttagcaattcctgggccaaatgcgttgctgatgttacaagttgtttctgctgccttacaaccccttttgaacttgaataagaaaactgcttgaatttgctttttgtcaatcatcatttccatagtctaaaataaatataaaatacagcaagtaataagtaattagccaaaaaaaataaagtgagaaatgtgcattaaaatgatgtacaacataaccacatttatttagaatctattccaataccaaacggcaaagttcaacaatgtaaaaccacaattacttttgcaccaacctaataccttctaaggaaatgctttctcatctgatcaacttccaatgaagaactgaaaaattccaacactgttactaatatttctaatacagatgtatttgaaattcttgttttctgaatttttcaccgtaagagtcagctctaacatgaatggcacataaaaagaacaagaagaatacaaaacatagttaatatttatttcatcaaaaagagtatagtgtacctaataggaaatgtactacaaggtcagtctcaaatagtacctgcataaaaatttttaatattttttaaaaatattaatcaaatatggtagatcaaacgttttagtacaacagtcatgggtgatataagtaacaactaacaacctatgtaaagagcaaagagcgggatcagtaagtgatgaaactggcaagtacagaggtcaaaagtttgaggtgattaatactttttaagggagctataataattaatcataacaacagcagtaataagagtaactgaacgggtgaaatctagagaacagtaagctatacagtaacagtcgcagtcatagaaccacgcagaacattctttcctcaattatagcaatctatccttttcctatacccttgatggctctaaacacctccttggcacattcatatatggtctaatactattattaaagtacaatatcaaagctcattaaaactcctatttaactgtagcttttacaacccaagcaagcatttgttaagagaatcaaacttatgaccctatttaatcaagccacattaaaaaaattttacatatgtgctaaagaaaactggatgtatcctggcttatctgtatccctggtgcctagtacagcaccacctggtgctaagtagctccttgacaatatcctctctaatcagttgggaggtttcataaataagaaaacttgagctactgatgaataaattattttctgaggcagggcaataagttaaaaactatttcttaattacttcaattcatttct

SEQ ID NO: 31140 - DNA, 622 bp, Bovine  19866880901526
catctttatgttcagcagaaaaaggaacttttcctcaagaaagcctaggaaactggttcaagtgtgcctttgtagtaactactgtcaatagtatactttgaagaaagagcagttttgggccaaagatgctctctgctgtgctgtgtaaaggctgtgagctaccagagatcaactgtttctaacgtaaaaaggaagtgctaatatagtagtttgcagattcagtattggtttcatactgtaagacagagctaaaatagcctcacagggcaaaaatagtacagtcacgtgaagcatcaatagtcctttttaaaaaacagaattatcatacttgtgaattagaggttaatctctttttccagatgaaaagagtggatgttggtagatactggtcatttctattctatccttctgtaatgttagggaactgatatttgtcctgacccagggaagaatctcattcatgccattttattttctaagatacaatcaaatttgatatcagttctcagaagacctttcctggcatctagaaggtaggtgtgagagtctttcttttagtagaactagaaacttttcctttattttccctaaggactagtgtgttttaaaataacattaatag

SEQ ID NO: 31141 - DNA, 1925 bp, Bovine  19866881063019
ttctccttacctgctccaagtaacaaatcctttcttcttcttatctttggtttggttgtgtcttttgacacccaccaagaggcgaaaccaagttttgacgtaacaagccttttagataccaccatttgtttaaagaaaaagttatccaattctttaagagaatctcaaaaatactgaaatgttttacgtggtacaggaaaaccgatggaagttttaaggcttctggctgcagagggagatggctggcaagtatgtgaaactacaatttatgaggtcctttctctggaagtttaaggcttggaatttgagaaagttcagaggaattagcagggatatataaatctgcaaaagtgcttgagagataacaccgccttctctctggacatcacattaacgaaagtggtttcacttcatacagagtctcatttaatcctctgggcaagtctaggaggagggagatgctgacaatcttcatctcctctctgtttgttcagaaccaagcaacctgaggggactttcatttatccacgttttggcccttgctaggaaatttacccactctatgcagctagaatagtcacatatagaattaggagccagggaaatataggagggaagcattttcatcaattattatggggaataaaatacaaaagaaggagaagttagtgataaaacttaaagatttcagatggtaagttttttcttggctatccaagacagtattgagaacatgagggtgggaggaagacagaataaaaattaattctaaattcataggacttactttatatatgagacattatgcccacacaaaaacttccaagactgatatgccagccttaccagttggataaactgatcagtttgaacaactgcatgtaatttattcatcattttgcaagcaaacaccattcttggcattatggactcacttgagagtaatcctgcccaccagagccattccttgaggtaagaatgtccaccttgtcctaggaaaatgatgaaaatagaaattaagttctaaagtggaagaagagggtttggggaattaacttctataaaaggtaccggaatatggttggaaaaagcaagacttaaggcctactcagtatatctgatcttttagcttacttactcagtcatttctagagatctcctttacattgcctttgatttctacagaaaataagttttcttcatttgcaggaaaattagtcatgaggtttattattttcaactcaaaaaaaaatgcaaacctaaaaactgaaaaattatgttttatttggtggatttgctgagggcttaagtctgggaggcagcctctcagataattctgagggcctgctctgaatagaaaagggaggagccaggatatataggagttttgcaaaaaaaataaacaaacaggtagttggaacatcaacagattactgttaattttaaacaatgaatttagcacttctatttgtatgggaagatgtaggagtctggctcactggaatcattcctttggtatgcaccttaactgtttagggccaatatcgagtgctctccatctcaaatcccctcaggctgcactgactgctggtgggggcagtcactactgtcttgatgtcagcagtatcctttgtttactgatatggaaggtaaactatttatgccattcagaggtgtagatagagtattataagccctaaatgctttattttggccacagttaaagacagaaccccgtaaatattaaattagattagtacctaatgaagacattaaaggaaagatggttgacataagagcttttgaaattttggatagtcaatgagagaataaccagcattagccagctggactctacttattctctaccttttggcaccatgaaactgaatttgtgtcagctgtcattcagtcgctcagttgtg

SEQ ID NO: 31142 - DNA, 4053 bp, Bovine  19866881146800
caggtcatcaccctccaaaactgctgtcactcccacaatttaaaaaacatagaaagttgtaggaaacaggaaaaacctacacaattaggcaagaaagtgtgattggttcaagagacctgctgccctacctcacaggcataagccagttctaaagtcttttgcagttatttgcttttttcagttcagaatttagaagctctgaaggtaggctcttgacatttttataatggtcaggttctttcatttgcctttttttttttttaaagatcattataattgctttcaagtttgtctggcactctgaaatgttcctaggaataaatatggcttttgagtagaaccctagaatgaattaaagatgcttttgtcttttattcaagtcacagtaatttgagctggtattaacttaggtctcataattaggccaaatcaaatgataagagattttctaaaaacctagtcttgctttgaacatggtaatagtaaatactttgctacaaaataaacttaactgctaatgaaacttctaaaatattccccagccttgaaagcccacagcgtgtattcattcattccgtaaatgcatattgagggctgttgccacaaccctggttttgttatcgcttttgcacagttgatttccactgtatgtttcatgtgaaatgagtattcctctgctttatttaagaaaaaaaagatctgaaaacctctatcctggacaatccctcttgataaaggaatacacataagtcagattttgttagccaactcactgtaatttgtcatttgagcttaagaaagagtataagaattatatccttatcaaaggaggatcagcttggaataacagaaacgtaacttagataaatccgtaagtggggcaaagcagaaacttgcttgtttcctattgaccttttgaagttgacctaggttatgttttgataactgtgatcttgattttaaactcctctttagccaaaaattaccactggatttagctagaaccatgctacagtctaaaataattgttgaacctgtatgttgtcaactgaatgtgggtattttaagtcggttttgcattgtatccagtattaaatctatgtaaattttaaagatttcctgaagtttgtgttgccagagtgtatcatagaaatgttgttttaagtgtctgtctttttttccacgatatattctacataaaaaaataatgtgaatcacgtgttgacttcctgcacaaagcttcatccagagcttgaatcagtctttgggtttgagaatcaccgagcattttttccccacaagtgtagtgtatatttacacgtgtgtcttcgttctttctaattctgtgtgttttcctttttgctatccaggagctgcaggtaagttgcagcctggcgttctggattatttatttgttgtcatctgtgaacgtatttgtcttctttgtggtctcatttgtgtttgtgtattagagtagaaatggcctaggtagtcgatttagttggtcgcccctagatagaaagtcaagagaatcctattcagttaaaacaggtcatcgaccacatactttgatctctttaaacattataaatattgagtgatgttttaaaagtttcaaaaaactgaagggctgattgaatctctgcttatgacaatacactgagtatttttcatctgggtgtatgttctcccagtgtattaccttccctatatttataagcttgtgttcgaggtcttagaaatgacgccttgcttttccagggtgaaagtatggacaacttcaactggggagtccgcaggcgctcactggacagcatcgacaaaggggacacgccgtcgctccaggagtaccagtgctccagcagcacgcccagcctgaacctgacaaaccaggaggacacagacgagtcctcggaagaggaggcggcgctcacagcaagccagatactctcacgcacgcagatggtacacttagctttctgtacagtgacagctggtctcctctttgtcttcacttccaacttagtaattaccattgctcgatattcggattttcatttccttctgggtaaaatgcatgtgctgaaatgaaaacacaaggctgtagcagcaatggagtgttccatgattcatggtggaactaagcatttcatctgtgcaccccttgggctttccaggtggcacagtggtaaaagaatccacctgccaatgcaggagatgcaagagactcgggtttgacccctaggttgggagcaaggggagcactgaaggggcagtggcaacccacttcagtattctagcctggaacattccatggaagaggagcctggtgggctatagactatgggatcacagagtcacatgattgagcacagacagcacctctgagctgatgagacgtattttctgttgcttctctcctagtcacagtgagctacgctgggcacttttagaggccttcgccctgaatgatacgttttggtatcagtgcaaacaccagcactggttaattctccatctgcttttctttccttgtcagtgtggaaagagagagcacaactttgctccctttgcaagatcaagtcagttatatggaagttctgacttacattccaagggtgagtggcagagattcagagagagagagagagagagacgagaaaatgaaggctataagcatcatctgtgtgttccaaatactgagtgaggggaaggctgaacttgcagtggcagtaggttagaacttgaagatggcagaacaaggagagagcaggggtgtggattagccatcaaggcccatgcgatgaggaatcagctggtgaagaccaggtggcagccacattacagccctcttatatgagggccttttttcacacctctgtttaatttggcccatccgcatcacactcagtctgctggtaaagtgctggcagtgctattgaatggccaggctgagctggcctttagacaacatgtacagttgtcggtttgtggccggcttcttgtcacctgccctgttttggcatctcaccattatgccgatgtgtctttccctaactccctgtcacgtattaagtgataagctgttgctgacacagtagcagcagttaccacttgctgagtgtctgagacacaccaggccctggtcacagtgttctacatggattagtcactatacctctcccctcaagtacacgaggtaagcacagtgattgcagctctgtagactaagtgacttgtcccaggacacacagcctgtaagtgcatttgagcagggcagtctggatgccacctaaggcttgctcctccccaggactgtgtgcatttaaaggaacggtgagttgctggcagcagtgactcactgaatgaggctcagaccctcccggggccagaccggaggctcagagactagcatcgtgccaccaaaccactgtggaactatggtcattacctatctaccctctcctttaaaacaggactcctggcagcacctgcctcgggggaatttcatggggaagtcagtatagtaagtgctgaacaaaggttagcttccatgagagccttggagcagaactgtctcttcataaggccaaccctagtcatagcggtatgcatgcatgctaagtcacttcagtcatgtccgactctttgcgatcacatggactgtcgcccgcctggctcctctgtccatgggattctccaggcaagaatactggattgggttgccatgccccttcctccagggggtctttctgacccagggacagaacctgcatctcttatgtctcctgcattggcaggcgtgttccttgctagcagcacctgggaagcccagttatagtggtagtgagtttggaagagaatctgatgctacttcctcctcatagagggagaaaattagcttctgcttttatctactcaaaatcatgaacttgattttccttatgttaaatactgacccatgaaaaatgtatagccctgcttaaaagaagaaaaatggtagtgttttctttgttctaattgattactgctagttttcaaagaacataaacc

SEQ ID NO: 31143 - DNA, 1563 bp, Bovine  19866881351935
cttgcctggaaaatcccatggactgggaaagcctggtaggccacagtccgtggggtcacaaagagtcagacacgactgagtgacttcactttcattttcagacttattttgtttctgtattagcagttgagaaatttaaaagtatttgtttagtaattcatttaaagataataataacaaatcctagtatattttagcataaataacatgtgctatgctatgttcagttgcttcagtcatgtcttgactctttgtgaccttatggactatagcttgccaggttcccttgtccatggaattctccaggcaaggatgctggagtggttgccatgccctcttccaggggatctttcctacccagggactgaactcgcatctcctgcatctcctgcattgcaagtggattctttacccactgggaattctttacctgggaaaagtcatgttctttacctgggaaaggcatcaataacatacttattacaaaaaccaattctattttccagaacaaaacaaagtttaatgagaagaatggcattgttttacatttttgcaaatctctttaacatctggtttcatggaaggaatctggattatctgatctgttcagtactcaaatctgttgtaatatgtttttttttttaattgaagtgtgtgaataaaatctcacccaaaggtgtaattgaaaaagggagaggtatataatactctcctcacgtcactgtatatacttttctttgatcctattcaaaaacttgatatatgatagttttccaagggttaattgcaatatgggaattgaaaccacatcagtatacttttcatgctctgtaatattaaatcaatttatttaaatctgtaactttgactaggtcagcattcaagtctgattttgtaacattgtgaatttgatatgtgaaaaatatcggttctctgagttaggcaggaacttttaaatgttcacacattttattaaacaacagctaaaaaatcacttctgttagtatcaccaataggcttgtcaggcgagtgtatgctccttggttctgtctcgtcacaacaaagatttggagtgacggacattaaagccctcgacgtgtcacagctctcgggtcttggacagactgtgttatagctctcaggtctcgaatggaccgtgttatagctcttagacaaatcagtgttacagctccatgttacagctctattttatttagataatagcaggaaaatccatccttgaggcgtgagggcatgtcaacccaaagacacgaagaggagagctccgcagcgcacaggagagagacccccagccctttggctcctttttttgtatgttttttctcccccccccgcgggcctgccctatgtaaattgggctagccaggagtgttgtttgttctacctgaggtcctcactccggtcctcggaccttcctttgttctattttcgcaggcttttctcttccttgtcttttagccaccgccattctggactcctgtttcctattctaagtacctaacaggctcatcagaaatatttatgttttgggaaattgtcaaa

SEQ ID NO: 31144 - DNA, 1382 bp, Bovine  19866881388440
gtttgacaggtttatgaaaggcttgaaagataaatttgtcataggtaaaatactgcattatccataggatttatgtaactaagtaaatgaaagtgaaaaaacctggtgaggtgggagaaatgactcagttcctcactttgcactctccacatcttatttcctctcatttaaaattttgcatgaatattacagcttcaaatataatcataacattaattcagaggtctgatatattaaaggataagcttttattttataatactccatttttaccatattggaactttctggaacactctccttctaggacagtttaggagtggtcgtgttgttgttgcttagttgtggccgactctttgcaaccccttggactgcagcacgccaggcttccctgtccttcacatctcccagatcttgctcaaactaatgtctgttgagtcagtgacaccatccaaccatctcatcctctgtcattcccttctcctcctgctttcaatctttcccagcatcagggtcttttctaatgagtcaggtaagtctaatgagtcttttcatcaggtggtgaaagtattggagcttcagcttcagtatcagttcttccaattaatatttaggactgatttcctttaggattgactggtttgatctccttgcagtccaagggaccctcaagagtcttctccaacaccacagttcaaaagcatcaattcttcagtgctcagctttctttatagtccaactctcactcagctgggtttatttgcctaccttccaacccatcacaagtcaggtgactttgcggctgtgataggtcaaaccaggtcatgtgacccgcccgagaccagaaatgcctggcacaaaatcactggcagagggaggtctgatgaacaagcctgtagaaggatgaaggtttctgggtggctgaataacccactccatcccactcgattccagtgaagatacactcattagcaagaagtgaaaaaggaagacattgggatccttcagttgcactgtgtagaacactaattaaggcattgaattgcgctaacacagttctctctggaagacactttgttaaaatgaatacttaactgatgtcagaacaattttgattaaacgtgtttatccataaacgttctctggattccgaatgtgacatctaaacatccagtctctgtggcgtttcacttggaaaaatggagtcccacagtcaaggcaattgaaaccgattccagtctttattatttctaagaatattagatgaggtctcatttgtaactcccaagatctctctttaaaccctttctacagtttccctagtgttctgtgtattttataccctacctgcatctgcttgtgtgctcagttgtatccagttg

SEQ ID NO: 31145 - DNA, 754 bp, Bovine  19866882017355
ggataatgattcctcctgtgaatcttaaaagataattagggattttctaggtttgagccaagcatttatggggaaacaatttcctgcattaaggaatagagaactttttagatagagcaaggggatatgcaaaagctgagcagcaagtaactaaacacggctagcacacagggagctgacaagagcaaaggaaatggagccagactgtgaagcgtattcctgttaaagctttggagttatcttgtcatgatagagaacttctgaagggtcttaaatggggtagaatgttaaaatgaccactcagacaacagtgatgcttgaaaggggctaagtctagcagacagttagaaggctactgcaatagtccaagggaaaaaagatggactgagccaaggcaaaagcagtgagagcaaggggaacatttgagagagaactttcagaggcataattataagaacttaacaaaaagtatcagaggtcccttaaatgtttccagtttgagttatgggtaaagatatttaccgaggtgggatgactgtcatttgagttattcatcaaatatttccaactctctcccattctactaggacacatgctggtttacattctctgccctcattctctgtctcttgacatctttgacgctgatcaaagtgtacagacttccagttataagatgagtatattctgggggtttaatgtactgcattggatttagttaaggagtgccacattacatactttaaaaaagaac

SEQ ID NO: 31146 - DNA, 1361 bp, Bovine  19866882076682
ttatactgagcaagtgatatttaagctgaaaccggaagaagttagccagtcaagggaagggagggatggattctagacagaggacacagctaaagcacatgctctaaggtggaaaggagtcaggtgcctaaaaggaacacaaagactggtgacctggaaggtcagaagtgaggaagagaaagaagtgcagataatgcaggcagatgggcaagctgctggcccaaaggcctgttgaggacttttgagatttaaattggagataatgattagtttctgaaagattttaagcagaggaggaacaagactgtgtttttaaaagatcactgtggccaagatgtacacagactgcagagggcaagagcaggaaaaggagctattaggacgcagcagaaatccctacttgtctagtcataatatccatttctcagcaataacggaaccctaactcttagttgggtatactgatattaaaaatagaagactactttccggctccctttgcagctaacttgaccatgcggctaatttatagtcaatgagatacaggtggaagtcttacacagaacataaggaaaggctgttacaggaaatcaactcgggtgagagaagtaccttcttttctttcttccttcttacaacctgcagttcagaaaaaatggctggagcaccagcaaccaccgtgggccaaagtaaaagatataagctaggacgataaaagaaaaagacaggattcaaaatccctaggttggatctactgtaccagttcagggcagcttgcttccagtctttgtctttttccacactgaaagaaaaaaaaaatttctagtacatttaagctgctattagttagaggttttgtgtgatatatagcctaactcaatcctatatgatacagaggccactatatttacccaagaacaggcaggggtggtttggatcatggtggtggtagagataagaaaaagtggcaggactgaggttatatttagaagataggatcaacataatctgttgagagtccagacatgacagagggtgaagggtaaggtcagactgactttcaggttcctggcacaagcagttggagagaccatggtacaattactgaggcagagatggtgggcacaacctgagtttcttttcagacagtttgaatttaaggtggcgatgaaaattcttagatctcagaatagacatcaggctgggaaccacagtagagacattattcgcaaatacatgccaacccaaagccacagaaatgaatgatgtcccctcaggcaagtgtggagtgagaaaagagaccttaaagagcaaccttaaggaacactgactacttgaaggagacaagaacaagcagccag

SEQ ID NO: 31147 - DNA, 1918 bp, Bovine  19866880364784
ccaacctagacagcatattaaaaagcagagacattactttgccaacaaaggtccatctagtcaaagctgtggtttttccagtagtcatgtatggatgtgagagttggactataaggaaagctgagcgccaaagaattgatgcttttgaactgtggtgttggagaagactcttgagagtcccttagactccaaggagatccaactagtccatcctaaaggaaattggtcctgaatattgattggaaggacagatgttgaagctgaaactccaatcctttggccacctgatatgaagaactgactcattggaaaagaccctggtgctgggaaacattgaaggcagggaggagaaggggacaacagaggatgagattgttggatggcatcaccaacttgatggacatgagtttgagtaggctccaggagttggtgatgaacagggaagcctggcgtactgcgatccatagggtcacaaagagtcggacatgactgacgatggaacagacctgaacagcctctgcaagttctcctcctctctagcattgtgaaatagtttctcatcatcactggtgtttttttttatttttgttttttaattttagtctaaagactgcagaaacacgggtttccatacttagaatcttgatgccttagacttattttagtttttttttttttttcagattgaggcccaaataatctatattttttaaaataaagaaaaaagagttgatctttttgcatattacaatttgacatcgttgatatatttttctagtacttaagaccagaaattacttttatataattactatctgaataagtcctataaaacagaagtatctggaaaagtcctgtaaatcagaaatatgtagaataaatgtaaacattgtcttctattaatgattagttctttgcagataaagaatattattggtgtttgtttgtcttccctgatggctcagtggcaaacaatttgcctgcaacgcaggagactcaggagatacgaattcactccatgggtcgagaaaaccctttggagaagaaaatggcaacccacttcagtatacttgcctggagaattctgtggacagaggagtctggcaggctacagtccatggggtcacaaagaatctgatacaactgagctaatgaacacgtttgctttgagttattcagaatatgtttctaccactgtgaaattttgattgtcttccaaattgggactgcatgactttttagaccaagaattaattttcaaagttatgtaataatttcttattttaatagagaaatctaacaaaacattgaaatatgagttcttctgtacaattcagaattcccctagcaataatatagataatgcatcatcatagtatgttcaaaagctagtttggatatttacatacacttatataaacattcccccttaacttatataaactttttaatgctggttactttatactatttacaaattccaaaagaaatattacaaattattcattataacatgagcttaacatagtagaaagctattcatattttattttctgtcatgccaagaaagagtataaactgttatagagtataaattgctttaaaaaattctggtcttgtgcagtttgatcttgctgataaaaatttcagaagacattgagtgttctcagaagtggcagttttacatcaagtgcaaaaatacatgttaatcttggatgacagtttgtcttttttcatgttttcccatgtatcattaaacttgattttgaggatgagcagaatatcttactcaactgtttaaccatggaggaatttacagttgttagatactgagccatgaattttttctttaaagctgaaggtaggcttttgtagaacccatttagtaaatattaattttactattttaattggattt

SEQ ID NO: 31148 - DNA, 1812 bp, Bovine  19866880516533
ttgtggttgatgcaatgaggaggtacatttaattttatatgatgtgatatgctatttcgttgttccaagatttttcttaagatgtttggaaatagaatttttgtgtttgaagaaagtaagaattattttattatttaaccaaaattatgttttggtcctgttaattttaagttttactacactaaaatggcctgtgaaattgactaattcatcctttaaaatttttaagctgatcagaggaatcgttcaaaagttttaagcacttcttaatctgtgatgtcagtttttagcagaactagaaagtctatctttgatgtcattttgggtgtttttaaggtaataatttgagaagtgctacatttaaagaaacatgtcaataatattaccaagttctctgttgtgaacataatcatgaaaacatactgagatgaaagtataagagccatgatatactatttatagtaagcttttgacatacttcaattttcatggacttttcattcaaaacccaaagatttttttgttgtgttaaatcctccctaatcctgtcaaggacagtcaatctctaccttaacatccatatacttggctttataaaatatgtctcatagttctttaggaggcttcaaggtccttaaggatccatgtattactgctttgttcccaaagcttaacacagtaccctctaaaaaatgtttctagaactgaaaggaattttcacagggaatgatccagatgcatggaagtatagataccatagtttgccttgtacctttgcttttgatgaagatgtgtggaatggtcttgaatttcagcttttgtgatggataatagaatgattatcttagtgtcttgtgtcttcttcttgtctgcttttctttatagggtattcaagcccaaacggtagcgaacttctttcttgcctttgaagcacagctatcaataattccagttataaacaaggtaatttgttagcgcaacagtgctattattttactttctaagggtaaatttactgtatgagtatcacttgtactactttttatatgagaatcttcaggtatttattaaatggaattgactattgaacatcatggaggttaaggatgcaaaacccctgtgcagtcaaaaatctgcatgtaacttttgatttcacacagttaactactaatatcctcttattgactacaatcttaccaataacttaaacagtctgttaacacatactttgtatattatatgtattgtatatagtgttcttacaataagagaaaatgctaatcaaatcataaagaggagaaaatacatttacagtactctgtttatcaataccctgagtttacatcatcttttataaggtgaatcatctctcggtacttacatcagtattgtcttatgtgatgacaaaacaccatagatgttatatgtattactgacactaaacgtcaacaattaaaagataacgtgaaaaggaacttcatatttatttacaggtaaatgattgatgcattgataacaatgaagcagaaatattgctttatgctatgacattatgtgattgcttcatggtaacctagtgtatacactaaggaaagattcattaaagtttttatagcgtacaatattatagtcatattcataacagtattggaaacattgttacagtaaaaaatgtttatttgtaattataggctgatatgcagtttctctaattatgagagtcatactgtacggtaatgtaattctttgaaagcaaagttataaaacagaaagccaatacattattaatttttatgttaaatatcacttatg

SEQ ID NO: 31149 - DNA, 1887 bp, Bovine  19866880521978
ttaatttttttcatggatgaatagtcataaaacccaggagaaattataaaaggaaaattatagtttccttccccgctttatcatgatatccctttcttagatgtatcagtatcaatattttcctttttctagacaacaagccagtgaacagcctcagcctgcctttgtcccagcagagatgctcgcatcatcaggttactcaggacagttttttcagccagcatccaaccaggattattattcaccatcttcttacattgacagctttgaagaagagcctcctttactagaagataagttaaggaagtgctattaatgtgtgtacagcttgaatagtaatagcaatcatcagcacttaatgcatactatcagcatgctgcatatagcgttttatatgattgttccacatataaacgagagtctgccagacagatacatttaaaccaatgggagttcgtctcctgtttgtgtggggaaaatctgaagtagataggtgctaacactatgttggtcttgcagtttttaaatgtttcttcactgtttcttacatgtggactccctggccatctctagacaacagtgagcatcttcaggcaaagtaattatatcaaagtaaccactcttcccacctagttaatgaagctactttatagcagcatgttttactattttctgctatgcttgcctgggggcaacaggggtagtttctcaatatacttttttttgttatcatggagaagcgagtttttttttgttttttcctccttcctggctcatgtgagccccctcatctcatctaggtatgactaagtaaggaggaatatgactccagtaagtagcactgctggtggcaaggaaacctggggacccttgcagatggacgtttcctccaaagatttcagggatctcccatccattggttcttttttttttatttaaaaaatttttgagattcagccaatttatgtctgctacttttgttcctatggcatgtcaacatgatgctgctgctgctactgctgctaagtcacttcagtcgtgtccaactctgtgcgaccccatagacagcagcccactaggctcctctgtccctgggattctccaggcaagaatactggagtgggttgccatttccttctccacagtatgatgctacaaaactaaaattcaaggaggttttaaatttgggagccaaggagaaatattcacaggctaactgctctcttttctatgttgtccaatgaaaacagataggttaacgttcccagtattttacattaaaagatcattgtttggacacagccagctacctgatattaaaacattcttctctgtttgccttcaaaattaagaagaggataaagatgtaaactattcagaaaagtacggatagaattatataatcaatttgttggaacttcagaggccagttaaatttttgcatcttttatgcttaaccatgcattctaagttgcctctacctctgatacctaacccctgaaagttataagctattttcattaggcatttgccatgaccctgccaacatctctacttaaaaaataaaaaaacttatcaattgtctaattataaaagtaatctatattcaaaaatagaaatttggaaaatatagaaacatatgaataaaaatataaagtccctgaaaattttgtttctgagacatgactatcattaatgatttgataatatttattccagcctttattctattttctatgaatatatatatatatacatacacacttaaaaatgaaatactgcctctctttgaatatatatatttgtaaatacttaaaaattggatcatactatggatatgaagttttgggtttttttaaagttaccttatatcataagcatttttat

SEQ ID NO: 31150 - DNA, 1029 bp, Bovine  19866880524104
cattcatgaattcccaggatgtcatcttcaagttacaaaatgcctggtttttattttatcaagagtcacattggccactgttgtcaggtgtctttttgataccagagaatacttgtgaatagtgcctgacctagtgataaagttgaattccatgaattgtcatgaatccctgccttttattatacagagaaataagcaaagggttataagtatcatggaatattataagaaactttctagcaaagcaatgtttatgcttcagttgtctgttagtatttccttatcaagatacaatacgaatgaaaaacattttatattataaattaaaaacaaaactttggtttcttgtctcggtctttcatttagccagccttgagcaaataatataacctctagggattatctttctattcttaaaaatgggaagaataagctctgtttaccattgtttactgtggaaaccagttatttaactgggcttgtgaagcactctttttaccaaaaaggagataataaggatataatctgaaataatgtaaactttattcaaagataatgttactgctaatttccttctatgtagtctgctctttttaagggtgatctatgcatggtaataatataattctactaatatattttttacctacaaatgatatttggcaagaagtcaaagattttatgtaccacagagaatgtttattgcaattaagtaaaccagctgttgacttctgatcagtacttcaatgtttaagatgttttagcttttattttggctacagtctgccagtcaagtctcttcatataaggaaggaaaatgaacaactagtaagacatttgatgtgtcattctgatgaactttagaatgcttaatatcatcttggttgatttcatgtttcataaaagctttctcagttgcaggatcaattactctcaatttccacatcaatcagtccagatggttctcattatttgctaaggatagctgcaaattgaaattcttgaacccatgatgcatattgggttaat

SEQ ID NO: 31151 - DNA, 1083 bp, Bovine  19866880542852
tttctgtatttccttttgcattctggagtggtaggtgagacagaattttaacaaagaaaatagtaatggaatttagatactagatatggagaatttatatctatatatttgactttatatgctaatatattaaatcagtgatatgacaagaaataaaaaggaaacattctatcaaggaaaatccttcaatctcagaaccttgagtacctaacatggaaaaaaatggtatattacctgttggcaaacccagtgtaaaatatctgtcttgtccaggtctgaattgaatgatgcgattacagatgtatttggctgcccattcactagccaagtcatagttatcaagaattacaagcctcattatggtgacgcacagcttccaggacaagttcaaacctgagaaaatttcattgtatgagtactttaagtaactagcagatagtcaaacagaagcataatacagtgatggctttaaaaaggatattacttaagaaagacatgcatgtatacaaatacaatgtgtacttttaaaacagcagtaatagctgctctctactgaacagacttcaggtgctgggcagtgggctaggtcaattaagtacaaatatgaatccttacgacaagcttctaaggtaaacacaatgtccagtttcagaacacaatttgagttcacatagttgttaagtgacaaagtcaaaatttttatcaaggcaaatttactataaagacatcacactgcattgtctccacagggatactatataaagcaacataaaacaaatctaaaggcaaacaaagcagcactcatttattgattgcaagttaatgacagtagttattactcagcactttatgggttacttactaaaatccagaactctccctacgaatgatgtaataaccaaacctctcttctggtaaataatgtttttataaaagtaacacctgcactttaaaaaatttcaatcaatacagaaaggtacaaagaattaaaaaaaaaaaaaaaaagacccaaatcctgccacctcaaaataaagttcattactattaggtatacatgattccatacatctatataatgcacat

SEQ ID NO: 31152 - DNA, 2875 bp, Bovine  19866880568737
agagcacacccctgactccttgacagaaatctacccagaaagatagagaagatctagatccacttagcaataatactcaaagtggtccaatcctacctccattgtaatcaattcaacaacttttttaaaaatttcatttcactttttaagacgacaaactcaacctgtggatttatcttctcctgtctttctctctaaaatgaaaagaaaggaaaaaatattttcttcttgcacataatgaagatagaaatgagggaagctgccaatcaataagagatctaaacagaaaagcaggtggaacacagctaccactgactgatactcataaagcttgagagggtaatgcaaggaatactaccttccaccagggaagatagtctgtcttccatggaaaatttcagatgttccagtttcaatacaggcttggagtgagttgtagtttattagaagcacactttatttgaaagtctttttgcaacagtagactgtctccacccctctcttctatcccaaagtccccaaaacttggcaagcgggtgctttcaccccaagcaataaaattacattcttctctaaagaaattgaacaaatcgctttgacataatagagtcagtttgtatgagcattggtggggggcccctgagtatggtggaacacagcaaaaaagagctaagattttgtcttttctttgcttttcatacattgtcatccaccacataaagggcacccaggaagaaggttcagtgaatctacccaaagtccttttctatttttattagtctagagaagtcttctttttctgttttacttgtccagagatggtacctttttttatcccgtcttttcagagagcatgacttttctagtttcaacaatgatgcagtgcaggttaacaagttcaacaatgatgggattagcaagtagagacctcccacatgctggcatctaagggaccactaatacctccttctctgctcacacaaaagcaaggcatgcctttatttagctaaaagcattacccatttaccaagacctccgtatccaagagaggtagatgagcagaagccattctacctctacattgaatgtgccaattaagaagggtcagcactctgtgttcttggacaaaagctacttatttttgtatagcctgtgagcaaaaaatttaatactttttaatgcttgaataaagttaaaagaagattaatattatttgcctatgtatatggcatgaaattcaaatttcagtgtccataaatgttttttttttttggaacatagtcatgctcatttatctattattgatgacagctttggcaaaacagtggtagagttcagtagttgtgatagaaaacatagggtttataaatcccaagattttactctctggtgctttacagagaaaagtgttttcaatctctatcctaaagcatagttattgaaaaattgttctttttcttgctcattggagagaatgggttggagggttgacatattgttatagactctacactttctttcacctctttttttaacttgctttcttttgggctggtctatgcatagcatcttatatttcacattatctgtgaaatataagataacaatagtgctttcactattgttagaaagctgaaaatggaaccacataagcaagatccatgtccaccctcttggtggtgggaacagatgcaaagggcagattttgaaaaggtcaggctgaatttgggctatgtgtgaaagagaggggaagtcaagccaaatctttcaccctcatctttgggacctaaaatttcaagaggttctctgtaaacagccccagaggaccaatgtttaagaactggctgttgtctttttataaaaatcttcttttgctattttgaacctatgcaataatattttatgcatctcttttctctggaaacaaatttaaaccaaattttcaaccactgcctaacgccgtgttcctatagaatggccttttaatagctcttctccttgatacatgtgcctagatgttcttttataggtgcaagaaatcagctgtcaggttctgaagagaagacaggagctgaacctgaatggagaagagaactattagagaaatcctcagagctgacatgaggttagctaaaggacaacaggtacgccttcattttcagctcctgacatgctattgagctgcccttaaagaagtaccacaaatcacctgacgttctgagaggtaggcagaatttttgcagtggtataatgctttcattttatgccctagaaatacctgaaataatgtgaatttccatttgggaatttaaatgttctttcagtgttttgacataagtgcatgaaggagcccagaggtacttaaaacattgaaagtgaaacccaaagaaacagaatgaagaacaaacaaaggacatgtctgtggatttcttattacagaattccccaaccccatggctcctagactatttagaaatgaggccacctcagagggctttggggttggaaacagaagatttaagtgtgcaagtctaattggggatctggttatgcttatggtataattctaaagctaaaggaaaattaatattttattatctaaatttgtgcccaatatcaatcactgatataatgctgttctttaaaagagaagtaatcttatttatattcagacaaagcacatactggagaaacatgaagaaaatctacttagaatggttgacatttgtcttttggacattactaggaaggctgccagtctatttaccttcaaaaagacaaagataaaactctcgaaagcaaattggtccttgtaatgcattggatttattacctaagctccagtaaagaagataatatacatgctgtgcaagaa

SEQ ID NO: 31153 - DNA, 1581 bp, Bovine  19866880631036
agggaaatctttcccccttccctgggaagggaagccaacaatgtgagctagaggtatatttattgagatatatttaataccctgtactaccccatatgggaaaagaatgcaaaaaatagtggatatatgtacaacagattcactttgctgtacaactgaaactaacacaacattgtaagtcaactatcctagaataattttttttaaaaaagtgttattttcaaaatgaacaccatattaaaacagaaaaagcacttctatctatgcaattctcaataatgttatgaagaaaatatttgagattatatctaaacaaaaatattagtctttctaaaatgtttatctggcattgacaaagtctgtataataacctatccaatatagtgttagtaacctaaaacttggatcatccgagaaaaaaatgtgaattgtgtctatatggaaaaatgagcactggtagcaaatgatatatttctaattgggtttggagcttgggaggtgataaagaactatggaattacttgctctccccagcccaaagtggtagtgctctgtatttgccctaggaaagtgcccaacagaagtgtattcactgaatccttatgtatatttttgaattacaaatactaactgcccaggaagtaaaaaagaaaaaaaatattgattgagtgtatatgctatgaagttttctagcatcaatattctcaccagggtttcctgggagttctgcactacaaggagcccagctgagaaagaacagttgcttccctcctagaaggcagagtgcctgggagctgaagcaatttgtcaggattcaccaggcacttactcttcctaattcaaacaagtgaattttctgtagttggttatattacccatggcaatagttcatattgaagaatgtgaccacgaacgaagtaccaattttaaagataacttggtttaatttattttttaaatcattgaaataggaatagcacctgagccaaaaccgacctactttcctgaaactgtatgtagcttttaatagccagtttccccaatcttcctactaaaatgatcagaaagaggttaactgttgcactgatgcggcaagcttcagcgatgtttgtacatgtggggtcaattactaactcagacacttactgcagtgagaagaagatggcgcagctggagaggatgaccatggggagcaggcagtatcccagcacgctcgccacgcagccataggacactcctgaagagctcatcaagttcagtaaggcatgaatacctaggcagccaatggcactcatgccatacacataaccaaattggacttttcctgcctgaaacaatgggaagaaaaccgtttggatacacaatgaacatcaagaagaaaccagattgtcaacaaagcagagaatactttcgaatcattcagctcaatgttattcatgtctttggagtataagcatcaggagattgggagctctaaagaaaaactgattgtaatatagattcaggtcatgaaaaaaataccctctatacatgggatggcacaagcatgcttatatccccagactgatatttttattatag

SEQ ID NO: 31154 - DNA, 1477 bp, Bovine  19866880651817
attgaggcaaagcacaaagcaattagctgaatagaaccaaaaaaatatagctaatatcattgacataatggtcctgggcagaatcaacattatttttgaaatgtgaacccttctgcgaagatcattgacatagttgtcatagaaactgctgtcttgtcattactgctgtctccagacatctgttctaggttcaaacactcattgacatatgcattcatttggttagatggggtgtcttatcttaagcacctttatcatctatgaatatgttgactccttttaaataatgaaaaaccaataataaattagtaactacagatgtatcagcacttagagttttggttgcaatggctaataacatcactgagacttaattatggctagtattatatgaattttatagtcagttttgaattatatataataatataagccctggtatttaagaaatacaaatagttttttaaatctaaatgcaagaatttttgaaactgagtttatacagatatgtttgagttattctatttgttggaaaaaaagtcacaacacttcacataaggaaattacaccatgaagacctagttacagagaactggtaaagatatttaatttccccctaatttatttgcctacatttcctgtttcagtcattgctaggaaaagacagcattaaccttcaccttaacatattgagcagaataattcttaattttgcatcactgtatgtagcatttataataggaaatttagcatccatgtcctccaaatgctaaatgctagtgttaatagcagctcttggccctggtcatagtagcaaccaaatatgaatccacacatttccaaatgtccctgtgtacagtatggggttgagtgaaagaagtaataccactcatgaatggaaaccactgtaaatatctttgcaaagacgtcttttcttgttatgtcattttctcagcagattcttaccttgttacatttaaatttatctggtgtgctgctgctgctgctgttcagtcgcatcagtcatgtccaactctgtgcgaccccatagacagcagcccaccaggctctgccgtccctgggattctccaggcaagaacactggagtgggttgccatttccttctccaatgcatgaaagggaaaagtgaaagtgaagtcgctcagtcatgtccgaccctcagcgaacccatggactgcagccttccaggcccctccatccatgggattttccaggcaagagtactggagtggggtgtcattgccttctccgtatctggtgtgagtttcatactaattgaagtctggaaggttgaaattgcttcaagctgtcaacaatactacaagaatgtcaggaaaaaaacaaaaaagcaaaatttaaaagatttggtaccctaaaaagaaactgaaagggaaaaatgtaccaagttactaaacatttaattgtttagaatagaatagttaagggttgcctttcc

SEQ ID NO: 31155 - DNA, 2221 bp, Bovine  19866880739562
tggtaaatttaactgatttctctgacctccaaataaaatctttagttgattaattgggaccatttatttccccaaagacatgagtaactggaagatttccccaagaagctttaataattaaggagagtttacaagcatgccaattataagatgaaatttaaatttacttggaaattaatatttaatgtaggttattgttttagtaaatttgtctgagtgacttgtcatcaacccctattgtaaacacccatgtaaaaaagtgaaaaataatttgccagatgagtgaatagggtaatacattggagaactaaagtaacaacagttctgagctcctcagtagagtgtgactagagtttgactctaagcttctcagagagtcaaactcaatagactttagatgtaattagtattcaaatcttttattttgtcgtactgaaattctaaagccaaaactgctcttacttttggttacttacaaagaacctataccccattctagatctacgacttcataaccataaattgatacttgctaggtagtttaaacattccaaaacatttctatttgcatctttccaataaatacaaccattttgtactgggggcttccctgatgtctcagacggtaaagaatctgcctacaatatgggagacccaggtttgatgcctggtcaagaagatcctctggagaagggaaaactaaacagtctgaaacatttttgtttgcatatttccaatacaactattttgtattaggtggtagctaatatacattgtattttattaaatctttctttttctaaagtaaatgagatacagttcaaattagaaataaagctagaaatgtgctttttttctttaaggtttaatgcatgtgcacaataaacttgtggatccactctacagtatgaaagaaggaaattgaaggagattggatcaaaattctgcttgaatgaacagaacacttttatacatatatgaattttcagctatgcaatatgattaaaacttgggggatttttgaatattgtcatttttgaagtctaatatctatgttaaacattccatatttacaatgtgtccattttatactagggtttaggagaaataattggctctcacggttaatcagctacttgttacagaagccacactgtcaatgtaacaccacaaaaatgtctgcctatttacaaattgtaaatcattttaaaggtgacttctgtacatcaagtatcattcatatgactccagtggcattattagactttaactttttaataacaggacactccaagcctttcaggtatcatacaactatcattgcaagcctttacttccaaatgctatctttattttctctgcattacacacaagctttctgcacgtgattgccttggtcatctttctacagtagcatctggacatcaaaagtcctgttagatattgttggtacagaaaatttgaagagatggcagtgcctaaaactacagtttatgtccttttggaacgtatgtattaagtgcatgttttttgtgcaccgtcttctttagcacttttttttctctttttataaatgtgaccttagttttatttaatgacttgggttcgtgcacttaatatacgtattttggcaattatgagctttatacctagaaacacactgaaggaaattttttttaagaaaaattattaaacctcttaaacgattagctttattccttacctatatatactgtataaaaggatatgatgaaatataaaaggaattactgtaaactatttgattgcataacaatttgcatcattaaattacaaataaaagtatattgttttctataactcaaataaagcttgtaataaacaaatattaagttatctaaattttatttccagaagtaaaattgaacacatgcatctgaaatattctaacaattaatagtagctgtgagattgcatttattaatactttttatttgttgtcataattcaattagatttaagagacaatgcctctgcctatacagcttcttaattctgcttcttagacagtaaaaaatacttccttttcactcttcatattttgctttttataagcccacctagtagaagcatcacttatatatacctgcttaatcgcctatgtgattgaaatatagtcttaaaaatatttaaatagaaaattaaaaaataaaaaataggactgttaggataaaatatgctg

SEQ ID NO: 31156 - DNA, 2673 bp, Bovine  19866880850115
tgggccggtaagatccccttgaggagggcatggcaacccactccagtattcttgcctggagaatcccgtggacagaggagcctggtgggctacagttcatagggtcccaaagagtcagacatgactgaagtgacttagcacacatgcacatactatttgatgaggttatctcattgctttgttatgagtatcaaataggaaataagtgggactcaataaataattgttagctttttcttggtctaaccttaattaagcctaaaagatatgaaaatttgtagtcaactttagctcttcttcactcttacctctttcatcttcttcccctcttttttaccctcaaggacagctttgacaattggctctggctttccattctcaacaaagaaaaaaattaacaaagaagagatactgtgcagttcaaatctttgttgagagcaatgtaaaagaaagtttaataaagagcaataatactaaactctcaaaaactaaatatgaccagagggaacattaatgctgattaatggaatttttagaatgcctaatttttacataaagatcaaagtagttttgcttattcagcaaaattcatctaaattcttcccttaattagtggggctccttaaaaccaaaaagaataaatggtaattaaatgctaatcttgcacagtaaaaatgacttgaaattacatgcaaattggaaaacataatcagtaaaatatctttctatgtgaaattcctggtgcctttgtttgagtttattttatgttgtatttaggaagtatagtcaggactctgggcagatagcagcctgtcatttcagggagttggagttcactgctgttaaggcaatagtagcttggctgataaaaacctgaactgtacctgtatgaaaagaaaatagatataaggatgtttaggtgtagaattaataatttttgctggtcaaatgaacaaagtcttctctttggtaggtttttgtagatggactaagtctcaaactttttttaaaaaagattagtagtatgagagggacttgagcctagtaaaagtgacacaaattttgaatttaaaaatcttcacatgagatctctgcaaagtccatgttgatatagctgattttagaatttatataacttttccagaaaagtcttcattcagccaaaaacactgtctattgctatccatttcctgcttttctctgaggtgaggaagtaccaggtactgtcttttgagcttataattgagtgtcagttattctccatttattagtccttccaggtcagcaactgatacttctcatcctgctctgggtggcacgagtctgactgctgtggactatatcacataaactctctcactctctgttcaaccagtggagatcctagcaggagactggtggatgggagataatgaggtcacagtatgtattttcccaaccattccttgggccgtggcttggcagtgtctgtgttctacccagagatatagttcctaccagaccctctcccaccattacagctcttgtcagtctcggtgacagcaacatcactttgctccttccgattagagatggcaatgtgaaagggtgttagttgctcagtcgtgtccgactctttgtgaccccatggactgtagtttgccaggatcctctgtccatggaattctccaggcaagaatactggagtgggttgccatgctctccttcagtggattttcctgacccaaggatccaagtcaagtctcctgtattgcaggcagatatttacagtctgagccactagggaagacctagagatggcaaaggcttctggctatcggagttcctcaggcttctccttctcttgctggtgcctttaaccctccccacaattttgtaaataattcgttcattaagttgtcacagttatcacttttatgtgtcttgtaaggatcctgacaataaaatgattcatattcttgtagcattattgttttccttgaggtaaaaataaagggaataggttctgctttttattttttaattcattgttattattacttttttggcagagacatttattttcttctctacaaatatctctcttcctttctctccttcctccagtgagggcatctagacgaagtatagtcattttatgctctggcagtcctttctatatactctatgctggcattttagcttccttttataagtaatcatttatatgccttcctcttttccttaaaactttctctgccttatttatcattgtattctcatacatggatggttaggaaaactagtactcaataaatgcttagtaaatgaggaatttaggtgctgaagaagactcttgagacacgcctgggcaacttgctcaaggaaatcaaatcaatcaatcttaaaggaaatcaaccctgaatattcattggaaagactgatgctgaagctgaagctccaatacttgctcacctaatgcgaagagatgactcattggaaaagtccctgatgctgagaaaagaagtccctgatgcttttcttcctgccctgaattgagggaaagaagaaaagggattgacaagaggatgagatggttggatggcatcactaactcaatgtacctgagtttgagcaaactctgggagatagtgaaggacagggaagcctggtgtgctgcagtccacgggctca

SEQ ID NO: 31157 - DNA, 772 bp, Bovine  19866880864098
tgacttaataatgagggatttatgataaggaaacatttagggcaattagagagacagagatggaatagggttccaagaatggaaaccatagcacagctgaacattatacaaatggaacttgatccaaggaagcactaatcatttcagcagcagaagttcatgaattgtcagtagcttgatatcagtgctgtgttctttgtattgacttgtttagtctttccgctactctaccttctaactttgctcctcaaaacttcagcttgctttatgatcctttatgcctgcaaacctaaatacttcttagccctatctaatcctcctggcttcttcttatttttcttaacatgcttattgttttaattgatttttgaatatttgaatgtatcatagttaactgtgacttttatttttaaatagttttaataatttttttttttgaccagtgtttcttacatactttaactttaaatttttatttgtcagatctatctatcttttctccctagatttcacttttgctaatggatcacttcaagaaaattagagataccaagggaacatttcatgcaaagatgggtacagtaaaggacagaaatggtatggacctaacagaagcagaagatattaagaaggggtggcaagaatacacagaagaaccatgcaaaaagatcttcactatccagataactgtgatggggggtgatcactcacctagagccagacatcctggaatgcaaactcaagtggggccttggggaagcatcactacaaa

SEQ ID NO: 31158 - DNA, 927 bp, Bovine  19866880970711
cttttctttaattgtccttgccctttcctttctgaattctgtcaagtgaaagtgaaagtctctcagttgtgtctgactctttgtgaccccgtggactatataacctgcaaggctcctctgtccatggaattctccaggccagaatagtggaatgggtagctgtttccttctccaggggatcttcccaaccgagggactgaacccgggtctcctgcattgcaggtggattctttacgatctgagccaccagaaagctgaagagtactggagtgcctagcttatcccttttccagaggattttcttgacccaggaattgagctggggtcttctgcactgcaggcagattctttaccaactgagctaccagggaagcccaaattctgtcaacagttatttgatttttgccaacttatattctatttcatttttttaatttttatgttattgcctgtgttttgtgtgtgttttcactaatggttcattaaaaaattgaatacaaatcaacctcataaaacagtaacattatgtaaatgtgatgagtattatgcataaacaatattaaaaacaaataaattctatttcagtcaaagtactataatgggacccattgaaaagcagatgtaatcctatataattgaaactgccacacaaaagacaatattccaagttcttagcactcaaaatcatattatattttagtgttcaatatatagcctatgaggttcttattcagctttttgttctctgaagagtttctaattgtgtttcttattacaggcagcaaaacatccccgtaagttcaatcacattgataaaatctttcaagatcttaatacagattattgcatggaatctatcttcttaaggaaattttttacagaatcctcttcctgttttcatttgaactgattacatagagattgtgt

SEQ ID NO: 31159 - DNA, 1132 bp, Bovine  19866880998518
ataacttaattaaaatttgagaaggattaaaatacaccaataggtttataaatctgtgattgagatatctcaaatgggggcactgagatcaaatcctcgaggtgagtctagacagagctcatataaccctcagggtctgtttatgaaccctagtcagccaaggaagagtcaatcatgaagactcttcacatttttctccaggttaggtgttattaatattgataatgtggcaactctaacagttaaggctacaatttgcatttaattaaaaatataaatcgagataaagtttctctctatgaagtttgggaggagaatccattactagtaggaaagagaatacatacgactatcacccattctctctggtatttggcatggttttcctctatacccttataagaaagggagcattagaaataaaggcaagaaatcagcctccaaattctattactttacagcccaccctaatatgctccagttatcattattatttatttaatatgtagctggattctagagtttaggataaacgaatcttgtctgacttggtttaataactttcctaaacgagttcttccaacaatttgtaaaaatgagtatgtcaagttctttgagctcttgaatgtcttttcacaaagtcaaaactaggatttgttgagctccttactggaggagaaaataaaacaaaggcaaagttctataatctgcagccagcaaactgtgtgtcagcaagtcttttattgagtgaccatatatttactggctccataagccatgaaactccaatattttggccacctgatgtgaaaaacagactcatttgaaaagaccctgatgctgggaaatattgagggcaggaggaaaaggggatgacacaggatgagatggttggatggcatcaccgacgtgatggacatgagtttgagcaggctctgggagttggtgatggacaaggaagcctggtgtgctgcagtccatgaggtcgcaaagagtcagacactactgagcgattgaactgacctgaaataagccatgtaactagcactatgcccagaatactgtagtaaacaacacaggcacttatcctcagggaacttatagacagaaaagttgtatccagaactcctca

SEQ ID NO: 31160 - DNA, 627 bp, Bovine  19866881160659
atttatgtgagaaaccttatttacttatgtgtatatgtgtgtatgtatgtatttcttttgaaaggaattggtccagatggtcatattgctttcaatgagccaggatccagtttagtatcaaggacaagattaaagactctagcaatggacaccattttggcaaatgctaaatattttgacggagatttatcaaaagtgccaactatggctctaacagttggtgtggggacagtgatggatgctagagaagtaagaattaaatgttctttgatatttttcctttgatgtttgtagattttggagaaattatgttgtcaaataagtgatgttttgatttaatcatatttgcaatataaattgttgtttagctttcagtaattgctgtcaggctcattgccatatttagaattcaagtaaattaagtctttggagctggaaattaaaaattaggcactacctcttttgaggtactgcttcacttgcctcttcctgtttcacaatttgatgtcctaacatcacactttatataaaaggacttgttacaggaaagatgcagttctaattaacattaaactgcttttggagcctgaaagtaatttagtgtcatgtgcttcttgactgtagaag

SEQ ID NO: 31161 - DNA, 2197 bp, Bovine  19866881210773
tcatccagcctcagaactttatttcagcttcatgccaatgactccccaaattttccaggcaattaaggactgagtaatcaatgctatatccccctagatagagtgaaggatgccactgagaatactctctgggagtactgctgaagaggcagaagctttccatgggaatttctaaatgaaaagtaaatgtaaagcttctagggttcttttgccatcttgtaggaagaagtgactgagaatgaaatcaacacaggaaaaaatcatcgctaagaggtagctaaagatgaatttttgattaattcctatgagcacagaagcccaagcagcttactcctggccttttcagcaacttttttatttgtacaagttaaaatttacctttatttgtttaagccatttttaattggatctcaattctctgcaaataaatcaatgacacagaaaatacttaaactctaatatcaaatggtaaaaacccacatactttttaattctaaatattacttcagatagtaaaagaaggaaatggcaacccactccagtattcttgactgggaaatcccatgaacagaggagcctggtgagctacagtccatggagtcacaagagtcggacaggacttagtgactaaaccaacaaccaaccaaagcatatgcgaagaaaaacttgaaggtatcattctgtattatacctgtatcgagatagaattatgcatgtttttatttagtgacttcattcacatgtcttacctcttgtcctagtcctggagccctttctacaataagggtctattattttatagttggaaaggttttaaatcaaattttataaaatccagcttttccattattaccattatttccccaatactatttctgaaaaatgttctctgtgattgaatagagtttcacttgcaaattcaatccagcagatttagttttattggatgcaggcttttgaattcattttaagagaagaacaaatacctggctaagaacttcgtaaagattttttatttcctattttaatcattttttttaaaacatgtaattctcacctctaaaatttaaaattttttctttcttgggttgcctataggttatctttctactgcttgttttgagatgttttagtgcacatacttttctatttctcttggccttttagaagtgacatgaatgtactttttaaaaactgttgcttaaagtgcatggaaagcagtatcttgtgagtatccacatgaatagttgtgatgaaagtagatagtaactgttactttaagtactgctactactactgtctctgtttaaaaaaagaaagatttttaaggctttttgttttgaaaagtttgcagaagacccaaccatgatgtgagctgacttttgttttagctaatttctgaaatttgtcccaacttatcatattaaaatataatccaatattgaataaattttatatctaaatagagacttacgattcattgtaaataagttttatacactatgtaagtactggaaatagcaatatgtaagtagctaatacataaatgtacttggaaaaatgccatgtaacaatagaatttttcttctctctaattctgggagaagagttttatttagcttagaagttattttcttctctcagatatcaaagtggccttcagaagtacaaagagaaactgtctctgggaatttttaggcagctgcttaaaaatatttgcagaaatggaattagaaaagaacaacatttatggaaaatttgccaacatacaaatgtattaggattataggactatagttgagaaagttactacattaaaatcagcttggatcagttagagaagagacagaattctctgagatttgtatagaagttcttatttaaaaaggaaataattagcctgacatgaaccaatttgggaacagaacaaggttagtgggtggttttaaaaaaaagaaggtaaaaatagcagaagcagatctgggtcagatctgggacagagagatttccttgaggacacttactaagagttttagtgtcttagagtggagggttgatcatgcatataagaattggacactagtcttaactgcttttaaatgatttgctggtattgtttgggcttcccttgtggctcagatggtaaagaaactgcctgtaatgcaggagacccaggtttgatccctgggtcagggaa

SEQ ID NO: 31162 - DNA, 729 bp, Bovine  19866881226379
atacatcatctttattttaagaaacaaaagtgcaagatatcccacaaccacaaagaaaaatcccattagcagataaataacaggaagaaataaaaacaaaaactgattcatccgtttctctttcacatcaaacccaagtcctcaccacttaagtccttcaaactctaaatgactgactgactttgtcttaataggggcattaatattaattacaaattaatatttgtaattcccaatgagatacaaaagggagaaaacaatgactggatacccagcacagagtaatctgataaccttcaatcaggtcttcctttttcaaatatctgtaatatcacacagaagtaacaggttctggagttatatatacatgaggtgacactcttctctgctatgtcgacactagtacaatagtacagtattaaagaaaggccagctaaagggaaggcattcagtaaatgtccactgataattagtaatgaaaacaccctatgtagaaagagtatttcaaatataatgacctactccctagtgaaacaagaaggaaatgcatattactgtgctcctctaatttatcagagggcttgtttcaagaggctatttttttaagaagtccttaaatttaggaggaaatgatctcccatataaagttgtatcatccatatataattaactggtatataaatatcatacaaaaattttttttaaacagtagctgttatttaaacagga

SEQ ID NO: 31163 - DNA, 988 bp, Bovine  19866881365683
cccgggttgagggcccgagcggccagcccgctcctgaggtcattcagtgtgagtatagtagaagtagaatttgaacccaagtattgttcattggaaggactgacgctgaagctgaaactccaatactttggccacctcatgcgaagagttgactcaatggaaaagtccctgatgctgggagggattgtgggcaggaggagaaggggaccacagaggatgagatggctggatggcatcactgacttgatggacatgaatttgggtaaacttcaggagttggtgatggacagggaggcctggcgtgctgcgattgatggtgtcacagagtcagacacaactgagcgactgaactgaactgaactgaactgactttgacttcatcactcatatctatgccctgttccatactgtctctctttgaatggcctgaactaggtaatgaagaaaaattgttctgttttgcatgttaattgacagtacacagagagaagataaataagaagctacaaattattctaaaagacactatgtaaaaagagagtaacagacccctaaacttgttataacaaagagaggccaagaaatcatatttctacagcaaaagttgtagttataggattttccctgttactagtacagaaacattcaaagatgtgcaggggtacgatggccataaatcagcactgaataatcaaaccaagccgggaaaaaaatgccagcaagtcctaaacacatttgtctgcaaagccttaataaatgcagtttcataaatactatgcaatataaggtataaattatgctgcttttctcaaaaattagttcaagtgcaagctggaagaattccctgtgcttaggctgatataaaattcagtaaatacagaaactttgaagggaaagaaaataataataaagacttttaaaggttatgtgaatactgtaattatctgtgcataaatgagagcattttctctttctagcctaacaggaa

SEQ ID NO: 31164 - DNA, 1505 bp, Bovine  19866881423499
tgagcaacttatgaatgagtatcctgaaggagatgaaatgtcttttttactctgcccccaaattgttctcctatcatcctttctcaattcctagaaatactttgacgctttttgcaaggagttcagtgagaaagttacctgttacctggaggaatatcttataagcttttgtttcttattcacacaaaagtaagggttagtttatctgattaattcactgtcacagtaaatggtagataacagtgctgtaataggataggacatggatcaaacatgtttgatgaagatactgtgaagagggtaggtggaggatggagtcaccctagaggattctactgggacgagagaaggggtgagtcagatgtggcacccatttcatatttttccagatctgctttttttttttaatataaatttatttattttaattggaggttaattactttacagtactgtattgattttgccatacatcaacatgaagatctgctttgtttcttgcttatgctgaaaccgatttgcctaaattctacttacaactttgtttttctttgtgataaattattcctcaagaaccagagaaccacagcagactattttaccaggcctggcacccacatagccatactcaataagtgccttgagtcttgttaaataagtcatttgaatgtttggttcatttgtttcagtaggtgccagataaacacttttttttttggtgaggattaattgagatgttgtctgtacagttatcatggtgctggttctcaataaatagtagttattcttagtactgtaatactttttctattcaaatgccttcttatattgaatttcccatcaggcttctaaatgaacccccataattctgtatgtattaagaaggacatgaaagattgccctttttccttctggtttttggcttctctttgcttttttgttttattatagactcagaggaaattaaactctgtcatgatcatgataagcacatgagactcaaagaacaaaagtaaaggacagttcagccttgttcttctaagaccacaccaaaggtcaattattatagacagggggaacctccttcctttaaatactttagagttagtgccacaagttcttcagtgttcacagggtagctgtccaaaaaaaatattttagaaacacactaagcaaaaatacttcaataagatcaatctctattatttctaagtcttattctaaaggaaattttcacttttttaaaatcaaatagatatgtacttatgaaagtctagattttggatctcaaaaaattccatgtgagatagttaaaaatttctttggtaataaaattatcaagaaaaatgtccagtataaagattattgaaaatttcattttaattatacctagtatatgacaaattggttgtttagtttatgaagaattttatttgtaaatcaaagactttataattaagaaaatatattattgatagaagattatatttaaatatatactccgt

SEQ ID NO: 31165 - DNA, 775 bp, Bovine  19866881677062
atatatgggcaaagatacagtgaatgctctaccatagatgttgagagttttttaaaaaaaaaggtataagggaagtgtatatcatgatttgtctacatatgccacatattaatacatattgccacatagcaattacatatgccaatattaataaaattaaacacaatcaaactacatttctgccatctcatattctgaacttaaaattttagattacttgccctcaaacaactatcacttttaaattaagattgaatgcatgaaatagtcaaaaagattgaacttgggaagatgaaaataaataaataagaatctagtcaatatagtgataactagaacccattttaaggcagtggccagttcaaaatatctactgtgcaacatctaaataccactctaagtttctggtcctggccagaatataaattagaagtagtctcctccatagcctgtgttaataaatagggcagattagggcatacaatgagaagcctgcctgcattttcaaatatttcaatttcagttttcggagcaaactcagtcatttttaacctagctccaatatcatcttactcaaaatacagataaagtttgaattttaaattaacatataaatgactttgggttgatttagaaaaactaagctgaccctcaggtcctttaaccatcagtgaagactaaggaaataaatagcattgtaagttatggggacagtatcaccaaattttcattgattcattcaataagtattcatagggcagaagaatataaaact

SEQ ID NO: 31166 - DNA, 899 bp, Bovine  19866881905215
ctgaataatttcctacctctgcttctctactttctctgtgcaagtttttcccctgcctcctgttgaaagagcactcctgaccacttgggtttggtggtacccaatttgaattgatctttgctaaaatgaactaaaaaaatttaacatatctcagtttatcttttagttccatgctggcttatatgtttggttttgccaataaatgttttaagatgtttatttcacagaattttagactgttttctattggatcacaggaggattttgcaacactgaactggaattcctatgtgccatcagttggattaaaccaataagtgactctcagtttataccaagccccccattttccttctctatcttctaactgacactccttactcctttatgttttgttccaggcttctgtaggcatttgagtttgttatctgatttcttcatctgatactcattttggaatcttattgtttaacattttctgcaatttatatcagtcaaaataaatgtcgtatccttcatattttgcaaggaaggaagtatcaagtcaagataaatcctttgtagacttctcaaaaacttgtaaggactatccacatctttgtccctacatggtgcttagctgatcttcctctcaaacttctcacatggtggcaaggaaatgtgagaggccagatcttcaagactacatatgtatctgctgcttgtattcagctgaaaagagagagcacatgtcacatttcattcaatttcataacaccactgaggggtgaaagatcctccaatgaaaaccaatgttttatttttttgctttgaataaaaaaaaataaagaaaaaacaaaaagacacataaaaatcccaatcttcttatttttccctttaaaaaaattcctttcattatt

SEQ ID NO: 31167 - DNA, 3040 bp, Bovine  19866880466359
ttccctaaatgggcagaagatcctgtaagcccgagagaccctcctcttagcgtcttaaacatcttatcacagcctcaagctccagggttctgtgcttcaggacatagaggggccatccaccaaccaaaatggctgactttacgctgagtggggacctccagctctcaggaacaggaagcgtgttcagaggccccaccccaaagggtagggacttcctaacttcagagctttctgattggctgagctttaggtttctttgtaaacatctgaggaatacagagtgaaggaattcattcattcaccactgaagtcagcactctttgatatgtgtataaaacatgtgtatgtatctccaatgtctgactcaaaatcacacttgaaccttcaataccttggttttctcatctgcagaatgggggtaatagcaatacctacttcgtatggttgttgtgaagattaacagaaagcacttagaacaccatctggcacttaatacgtaccatctaagggttacacccaacccattcatgaatgactcatcccatgattccctcatcaagaggagtttctccaggcttctgtcctagactctcacttggcttaactaggttctcagtgcctcccagatccccttcgcaaggatccctcaaccccacactgagcactggcaccagagcaattatcagggttctggcaatcaggggccggtgaggggagcatgctaaaaatatacccattccccacaatcccataagccttcaatttacctgcttttataaaaagatgcttccttaggtgtcacccgtggaagatataattacagcttgggaatgttaattcctctgctcctgatacgtggatcactgctctgcagggctcctgccctccccagagccttgggtgggggcgggggagatgggcaggcggcctggagagaatcaggtaatgccaggcctggagagctgcagggatgtggccataaaccagagcaccttggcgggacctagggtgatggatgaggattgcagagggtgtcttctcatcctaggttatcctcaggaagcccctggggagcttgggcaggtgggggaggacaccctggacagagcccctgccagccttgtgaggaagagggaatcctgctccatcgccctccacccaaccctctcttcagccctttctcaacacaacagccagagggattgccataaaacctgagaactagtccctcgtctcactcagaatcatcacagtggcctctagctccgaccctccccttccccactgtattttccccccagcactcggcagcacccactcttgtacgtattggccttctttgttttgttgtagtgcagatccttcactgagatatacattccacgaggacaaggattgctgttttcttcactgttttgttcccaaggctcaggacagcaccaggcacacataggtgctcattgagagtttgtggatgaaggtgactcttcagaaaggatttccaagcaggaggaagcatgagggcaaagcacaaaggcacaggagggacccatgcatttggcaagcatgagtgtttctccacgtttggtgcacaagcacgaatgcttacggaaaagaggaagcaatgacagcaaagctggcatggcctctgtctgtctggagctggcaagtaggagagtggcaacatggggagatctgggtttctggggacttccctggtggtctggcagttaagaatctgccttccagtgcagagaactcgggttccatccctgtttggggaactaagatcccagatgctgcggggcaacgaagccttggggccataactactgagcccacacgctctgcagcccaagtgccacaactagagaccatgtgctgcaacaaagacccagcacaaccgaaaaaaaaaaaaaaaaaaaagatttgtgtttctggaagatcttgggggctggtggagagtggattacagctgagcaagactggaggcaagaagaccaggaaggaagctgcttagatttgcaggagggagaggatgaggtcctggcccaaagcagggtggtgtggtgggggttgaagtttctaagagatgcataggggtctggagtgaaaagcaaggtggcaggcttcctcccgcctctccaaagcaggtcttcctggtcccccaccctagccagactgtccccagctccgcccctgggagatccctcccttgccatctggcttcgatctaaattctgttcagcttgcaaagctcaacccgatggcttcctctggccccgagccctctgtgtcacaccgatgttctctgaatgaatgtctggtgctcctcattgaccacgcggatcactgcctgtccacaatgacatggacatatttcaagaaaactttccttgcgaatttcttgagggtagggattgtggcttttctactgagagcctgacagaattacacagtgatttagagcctgggacttttgcctctggctgtcttgggcttaaatcctgagtttcccacttagaagctaattgactttaggtaaagtaacttcccccatttgtaaaatgagaataaaaatattatcccctcacaggattgttctgaggacgaactgaattaaaacatgtaagagggatgagcacctttacacactcccacaacacctatacgtctcctgtgttgcacgtcacacccctacaaatatttagcggagtgcatcacgatggtgactgatgctctgtcctccccactggactgtaagcaccttgagggcgggagcgagcagagcccagcacaatctcttgacacatcattactgtcagataagttcatgctgaatgaatggatggttatagtattaaacatgtaacattgaattcgactgaaactaagatgccaaacaagagagatgcctagggacgtctcttgtggtccagtggctaagactccgtgctcccagtgtggggggccccggttcgatccttgattggggatctggatcccacacgccacaactaagatctgatgcagctaaaga

SEQ ID NO: 31168 - DNA, 2710 bp, Bovine  19866880469770
aactgggaacgtttccaggctccttcctacagaggggcagggtatgccctgcttcgagttcggcggggtcggggggtggagcaagaaccagaatctaggaaatagtaataataacagtgtctacctcagagtgttgtctggagggtggaatgagttagcatatggaaagccccggaaatgcagctggcacatggcaaaagttgcataagctttcagtaaagtcagaccagagaggaccctgaggttgccaaagctgtgcgtcctttctagccgctggacttgcattgtcagtcagttcagtcactcagtcatgtccaactctttgccaccccatggactgcagcacaccaggcttccctgtccatcaccatctcctggagcttcctcaaagtgatgtccattgagtcagtgatgtcatccaaccatctcatcctctgttgtctccttctgcttccaccttcaatctttcccagcatcagggtcttttccaatgagtcggttcttcacatcaggtcaccaaagtattggagcttcagcttcagcatcagtccttccaatgaatattcaggactgatttcctttagggttagtgatggttttggatttctccagtttctctgctcgcccatgctggtgattctgtgatgtgtgtgtatgcatgcgtgtgtgcaggcatgcatgcgcatgtgtgggaaggggatgtaaatgcaggtgtctttccgggccactccctgacgcacgcacacacattccctccctcatttctctgttgctggtttgctcccagctgtcccaccctccagagcccctgacttccttcctacccccgctccaagcccacaactcaccccagcctcctccctcgcctctcccagagcccatggccctcccactcaccataaatctgtaactctggagtgtgtatgtgttggggtggtagagagggtgctgtggtggaaaggcagcaaaccaaaccaaccccagctaatgaaaacggcgataaatctctgtccatcaggtttgttgtgagcacaaacattgccaaacaagggcccagatggcctgcgggccctcctccccgtggtctgtagagctttaaatggaaatggttgctttacacatctattcactacttggcaatgggggtggggaaatgacagtatccagggggtgggccacaaaataggatcgggccaggtgggagccctttatgccccacccctaagcaggcttcctcaggccagtccttaactcccctgccctgctcctggagagaacccgggatgagccctgtctgacatgtgccaactgggggaggagggggaaggaagaggctgcctccacagcctggactcaatctgttccaatccccagacacatcctggggcagccagacccagctcctctctgttgtttccaaagttcttcatcccttgcccagaactttccttcctttccatctggtcagtttgaagcctactctatctttcaagctcaagccaagccccacctcctccaggaagtctccctgcccccagtcctcctggacctgtcctggctcattcctaccgcctggcccactgggagcccaactcggtcattaccggaggtggaaaggcctaggtgcacagctgggctttcccgctgagcagagggacctggagcaggttaatatgtcagcctcagtttcttactctgtaaaataggtataatcacggcacagttgggcttcccaggaggcttggtgggaactaatccgcctgcaatgcagtagacgcggaagacgtggggtcaatccctgggttgggaagatcccctggagtagtgcatggcaacccactccggtattcttgcctggagaatcccaaggacagaggagcatgagggccatgatccatggagttgcagagtcagatacgactaaaacggcttagtatgcaggtacaccgtaattatttaaggaccacaaaggatgtttgggctaagggatgggaaaacctggactctccctactgttcggtttattattagtatttatgtatttattttgtggtctcattccccataattcttttttttaatttatttttaaattgcactgttcagtttttaagtcagtgtgcaaggctgggcaagacacatgacctctctgggccccgtctgctccttctgtaatatcaggacactgccaccttctctgtctatcctatcgtcctgctgggatgacatggaatggtctttggaggctgctcagaacagggaaggtgtgacttatgatgcttatgatgatgctgatgtcagggatggagttggggggaggttccccaagtcaagtcagaggcacccagtggcacataattcatacacgctgtatggtcaaaacacacgggcatgttcccctacccctaatggggtgcctcctgtctcttcctatcccgtgacaactccagatgtaaaggaccaagaaagaaaatgccagaaggctttgaattcctgatcccctgtgggaaaacccccaaagggacccaaggaggtccaaagggatgctctgtggttccttatttctaggtcaccaggtgggtttaccaatggctggtgaatgtagaaaccatttaggataaaagtacttcacttgagagtcttggaatccctaagacgcccatggataggctttgctgctgctgctgctgctaagtcgcttcagtcgtgt

SEQ ID NO: 31169 - DNA, 591 bp, Bovine  19866880584733
tgaaggaattatttagtccttacaacatcccaaaccgctaagcactacgttataccatttgagaactagggaaactgagtcacaaagacggctaactcaaggtcacggagctaaaaaaaaaaaaaaaaaaatgaaggaagcggaactgaaacccaaggcggcgggaccccaaagccagaaagcttaaccacttcgcccgccccgcctggtgcaaggtcaaagcgaaggtaattgcgacaggagaaagcaggttttcctacacagaagaaagtctttctcggctcctccgcgacccttccccccagtcggccgggaggggacccgggcgcattcccctggctgaggcttgcgcctcccctcttgtcgggccgcccccccggtcctgacccccttcccagcgagggctcggccgggtccggccgcagtgctttcggggtcgtctgtcggcgctggctagttaagaaaaataaacaacgttccaaatggaggcagattcctttcaacccaagccccgccgcctgccagagaaatgcaaacagcgggggacggcccgagtccgcccggggccccgcgcccgagctgcgggtggga

SEQ ID NO: 31170 - DNA, 2039 bp, Bovine  19866880590359
cccctctaccccatggagggatcatcgtgatctcatgcacagtctggtgaggcctacaaatgtgccttccctgaagtctcgggagcttgcagctgtctagacgtgaaggggaggtacagctggatgaaatgggggaaagaccaaaaagagaatctccccgggaggaaagtgggctcagttccccctccctgcaggccggagatacccagatacagcttttggtggaaagaggcaattagggtcccatcagggttggaaattccctggaggtccaatgattaagactctatgtttccactgcaggggggcaagggtttgattccgggactgggaactaagatctcacaagccacgtggtacagccagaaaaaaaaaaaaaaaatcccaccagggagaaggcatggagggctcaggaagcaacaggaaattgggaaccagttggccttttcaagcttattttccctctccctccaccgctcagactgaaaaccgaatgcccagctctgtggtttgggaagtgggatctagttttcctctcaaggaggcagcactggtcctttcagttcctgaactgaacaggtccctggtcaaagggatctggacctaaatcctggctcccccatctactgaatgaccttggctaaatcctgctctgagcctcagtttcttcctctgtaaaatgggaataaccctgtagtcagctcagaggtttgttgtgaagaatacacgagacagtgtacatggagtactcagcagtgtggcacccagcaggtcctggatggacgttaactcctgtgatggtgattcatctttcaccttcccaggcagctcctgatcatttgcccactgccaccagaaggacttgtgagccaacccctcttccatctacacccacccccactcctcctcaagcctaagaactcagtctcgctaatgaagctgaactctcctccccccactgcccattcagaagtcattagcaggatctccacaattaggaacaaatggtttataacggatggcacccagggagggctgcgcggatggaggggaatgaagctagtgcttggaaggcaacagggagctgctaggaaaagaaaaacaagtcctggggcagaagggtctctcctctacggaatgagaccacaccctcatttctgtctgggagaattcagggaaggaccagtgacctctgtgcggaggtcaggtgcagggatgtttaccagttctttctccaagctaaaggattccaggtctgtgttggggtcgcagccttgctgtgtgcgtgtgcatgtgtgtgtgaggacgtggtgctcaggaagacaagcttgaaggactgaactttgagaacagagcagcagaatcgcacagatcacagacctggtgagccggagggttaaagggttatctagtctggtgttttccaaattgctggcctggccatgatctaatggtgggtcatagagtatcaattgagaaggtcaaaaaaaaaaggaaaaaatacacacacacatgaaaatatcagagttaatacataagcataagcattgtttcatgaaactgtgctgctgctccaaacaaaaggtatttcttacgacagattccagcaaaaatatctgccaaacactgatgtagttcactttatcgataaggaaatggaaattcagagaggggcagtgaagtgcccagagtcatacagcagctgaagcagaacctgaatcccctgggcctgacgtgggctctgaacagggaagagcggccaggaggtgggcaggcaggatggaggacccccaggaattaaaactctggtttaattccaatggtggcgaagggcagccaaaataaacaaaactgaaacttttgtttgcatctagctaattttggcaaaattgggatctcaactgtctggatagtttcaactgagagctggctagatttagaggaaggggccctagaagggtgtttaggggggccagcccaccccaaacctgaaaagccctcccaggaaggtctatcacctgatcacctgtccccctgga

SEQ ID NO: 31171 - DNA, 1387 bp, Bovine  19866880633241
tgcaggatcttagttccccgaccagggagtgaatgtaagccacagcagtgaaagcaccagacccaccactggactgccaagtgaactcccaaggactgatcttcatcttgacggtgcaggttttttgtaaagggcaggcagcaggcagactttagtggaaagaagattaagtcggagccaagagatttgagaattaattcttgctgggcttgtcactaactttttgattctagtccaggcttcagatttatctgcaaaatgagtagattaaagtaaataaaatccaatgtcctttccagccctgccaagggctcagtatttaaataataaaaatatacaatatcacttggtttctctaggtcttttagccacctagggatccttaatccttaagtgtgtagagcacagcacaggtgttaaaaaagtgagatactcttcaactctggagtgttctgtcatggagtgccaggccagacttgaaatctttttctaagaataagtatgcagacatagtgtttgtgtacttccccttggtgataagtagtgagagccatgaattcccagttgcttttgcaaaggacttttttactgtgctttcttttgtaggatccaaatcaagccgatgaagaagctatgacacagatcatccgcgtgtcctaaccccaggccatgtgatggagctgatcaaggccatattcctcacagtttcccactgttccagggaaaatgatcaactcgccgatgggacactgacgatcacattctgcccttttctacaggacagaaaccacttagtttttaataagtggctcagtattataattgcaaggatgtctggcaaactgaagttgcaagccttgtctcaccctttcagtcaggacttatctcagactgttgctgacattgacatttcatggattgggatgatgcaagggactcatgccagcccagcagcacacacacagcacttgtgttgactggtgacgccagccagccatctgagcagaggagagcaaccttctcaacctaactgcaactggggaagctgcagcccattacttcccacagattctgaacagtacccatccctctaatgggggatctcaagctgactgatggaccttttctattcagagatggtttccaggcaaggaagctccatctcatgatatggaaacaataaattctgagataattcatctaatctgtggtaataataagaatctcttctacccagatgatagattggggatttttggactcccgccaagaaaaagctaactctggggatagattgataaaagattcaagcactaaaaacataaattgctggatctcttagctttcacaaggtgtggcctaccttgtctgtctggtgacaggtcat

SEQ ID NO: 31172 - DNA, 1961 bp, Bovine  19866880638987
tttgggggggcactggggtgggttggggtccgcgccgcagcctcacctgtactggggtggggagaggcgaggcgggctgctgctgccgttgctaggcagcggctccacgggggcacccgcgtcgtcgtggccgaggggcaggaggctgctggcggagccagggttcagcatgccggggctgttgaggaggggaaaactgctctcggccagggcagcctggagggtacagaagtggaggcccgtcagtgggctccacctggtcaggtgatgtcccttccccagcccttgggagatctgcgccctggcagatctccggtgctcctacctctgaccctgacctgcctctcagctttgcggagaacccgggcttgacgtattaccctccagggagacagaggaccccccccgcaacacagggacaagccagggcaggagactccattgcctatctatgccaacctccctgccctgtgccccatgtctctgccagagaggatgggggaggctctcttctgaggccagcgagctggagggaaggtgaccagtccactacctggtagctggcgttaagtgttccgtaactgaggcccgagatcatgttcttcaccaaggtagggctcctggaggagagagaaggcatgtctgcttcattcattggcttactcctcactcaggccttgaccctaactgagggcctgctctgtgccaggggaggtcccgttcactatcctggaggtcatagtcggccgtgcccatcttgttcagccctcctgctgacctgaagcagcaggaaccaagagccgccttcacaggagagctgcccgggctcctagggaccctggaacacgcccagagcctccgagctgatgagtgggacagagattcttccctgtctttctccatgccaggcagcccagtagcttttctcctcagtttagatttcctgctgtccgacaaggtctgagtgatagcctccacagacccctttctgtaaaatccactttcctgccatcctgaatttggggacatctagtatgctgtgtgctcagcctgtccccacatgctctacaccacaggcttttctatacaaaaaagtgctccaagagttgggtcaggaaaagcaatggcttaaagccatccttccacagtgactacccccagtttagagtgtctcagagaggttaagaaactggcccagtgtcacagagctggggagaaatagaggtataattagagcctaggtcttctgattccagggtgaaaatgggacataaagatttcaagtgttgggactggcacgtgagggcactcagaaggggtgtggttcatttttgaatcccaaccctgccccagcccccacttccggcctgaaggtaaagaggctcttgtctgggagaagaaatctttgaggggtacaggcacccacagatatatatctaacttgcttcacacctctctctgcctccccataggcctctggcccaagaagcacaggcaggcccacgtgagatgtctggggtggaaggtggcggtgctggaagggaagctgaaagagcaggctctgaccctctcccaggctcctcagtctccactcagagcgctacgtgggagagatcagagacccagctctgccagggatctgctgggcgactgccttccagccccttgctctctctgggcctcctctccctgtaacaaatgaagaagtggggcccaggatctcacaggtttggctcatcttgtgacaagaggggctctggggatggcagcccctttgtcaatggccacgctggtcgccacctgcccacaccctgatccccggttcctctcagctcctccctcggtcagaagcagaagactgaaatgtcctctccctgaatcacctgtcacttccagactccgggctctcctgggcccctgtggcctcatttctccccgccctcccccacggcaggaaggct

SEQ ID NO: 31173 - DNA, 857 bp, Bovine  19866880651922
ccagaaggccctgctggctcagagagagggcaggactgtggttggcaggaaatgacatcactcacagccaatcagagcagctgtcccagcctcgctgcatctttggcaagcactgggaattgggcatagagatacagaaggtcacgaagcagtctctcctgctgaacttagcactctcaaggaagagaaggctgggctctgtacagaccctacctgtcctgatcactggtggggaggggggtccctgtgacacttgtggaaacctggtgggccaggggaggtaggctgcttaactgtagcttctgctctggccagcagagggactcaagagtcagggatccgattcaggtcctgcgacactgggccctggtatccatcctttcccacagggcgcggacagttccttctttcccctcagccgctcccaccctgctgcacagaatgtaatactttcacccgtcagacagacagacagacagacgcacatgccctcatgctggctctagaaaaataaacagcttagtgtcccagctcacatttctgcaccccatttttctagggtccctcccttgcctctttctggtcccccaggaaaactctacagctgaaggtgttaaaatgactaactgaatgaagacaattatcttcctgccactgatggcggagctggggagagtatgagtgtctgtgtttgtgccccacagtacagcccaggatttcggtctacacacacgtccaggcctgcaatcacccatccccccaacccccatacccattctaggcttcagagtgtgcactttggcaaggaatctgacttcaaggtctcctggaatggacccaggcctccctaccaggtt

SEQ ID NO: 31174 - DNA, 1704 bp, Bovine  19866880656335
atcccctggaggaggaaatggtaacctattccgtattcttgcctggtaaatctcatagaaagaggagcctggtggactacagtccatgaggttgcaaagagtcagacataactgagcactcatgttgatcatcagtatgtgaattatatctcaataaagctgttatttaaaaaattaagggtattaaagaggcctcccattcctataatacccatcaccaatacttagaaaaatcctgtatgaaaaaataaaattttcaacagcaacaaaaccatccagtgcctaggaataaatctaatgaaaactgtataaggcctctacactgaaactataaaatattgttgagagaatttaaagacctaaataaatgaagtgatataacctgttcatgaagattaatgatatcagttctcaccaaacagatctgtagattcaatacaattccaataaaaatcccatcatcgtgtttatggaaattgaaccctggtggacctgactccatggcccaccaaaactggacacaacagaaaaaaatacaagggtcacagtgtcccccatacacagggttacaggcagacataactgaaagaccatcaagaccttcagtcatggacccaccaatcaggaccctagaaagcccaatttggaatagagtgataaaatatattctcagttaaaacagatccttactctgctttcagtagttataagagaaagaccataactggctaaatatatttttatttaaaacagaatggtggagaggactggggtttgtcaccctccacaggtgacatcactggggacagggcttccaggctgaggcagtggctcccttccagtgggatataggtgtgcaggggctcctctggccaggacttggagagcgggttaagaaatctctgaggccacatgcccatgggtaccagcctgcgtggtggtgtggcactgcaggaagctcttgacctgtccccagaggccagctgggacttggcgttcacctggggcttcagagaattctgggaggactgagacttgaatgcagtccccagaaaagacagcggcttccttccggatgacaagttggggagcgcctgagaggctgggcgggagatgggagagggccgagggtgcagcatggccttggtcctcaggctgcacccgcagaggcagggctcagagacgtgggccgcagaggggcagggccgaccccccaggctgcgctctgcctcccatccgaactccctggggtgctggcctttcctaaaagggggaaatgtcagatcagttgagaagagactcagagaaagatttttttttttttaatgcaaggacagtgcttccctgcctcagtacaatacttactcagcctctttctggggcaagttctcttcctgcaggatcgaggacttagagacagactctaccacaggggatctcttcattttctctgaaaagaggaggaattgagagctggcggggagcgggctgagggctcagaatagccatgagtcagaggaggtttcaatgaggtgtgaggatgaaggccccgcagaagcagcgtggggcctccaggctggaggattagaatacccccaaaccctctctccccacgcacacctctgggagggggagcagtcagattcactattgtacagtctagaactggaaaatagaaaggtctaactggggagagagggggat

SEQ ID NO: 31175 - DNA, 2087 bp, Bovine  19866880674125
tcctgtagtgtaagagggatgcgaagaatgggaatgaaacgtttgctagggtctttcatggcagtccagtggttaacactccacgcttcccactgcaggaagcaccttctactttagggggtacaggttcaatccctgattggggaattagatcctgcatgccttgtggcgcaaccaaaaaaagtttgctgcaaagaggcataaaaccctagaagtacctgttctttcagggcagaaggcaagcagggaaagggctctctgttgggatgcttctcaactttttcaggcttcttgaacttctgaccccagtagcatcaccttaagggattctcttatatttcaaaataaggcacatcatcatcattacttgttagtactttttctgatggagttgagagacagttttagcagcagtaggacactatagcttcatttagttgattttggttgatcataaagtaatgcagtgtcccccaacattcagccacatatgattctacttaagatttttaaatagccatgtagcacttgaactattatttattaatgtcttttaattctctttcttttccttaaaagtattttaacagacaactatatttctggggaagcattctggtagagttaagagcatggacatggagccagcttgcctggctttgactcttggccacaccacaccaagctttgtgaccttgtgcgagttattcaacccctgtgtacttttctttcctcattggtaacaaagagataattgtatatcttatggggctgatgtgaggattcaaagagttagttcattgaaaggtctttgggcaccacctggcacatagctggtccttggtgattgtttcctgccactctgtaaagggggagccagtttccctcaccatagaaggaaatcttggaaatgacctgtttgtttcattgttttggttaaattcatatacatgctgttgcctttcatgtccgaggattagaaacttgaggcttactttctctttggtcccaggatccttaaaactttctgccttgatggaaatgttctgtattagcactgctgccggccacttgtggctgtcaagccttgaaatgtgggttttgcagctgaggagttgaggttttaatttttttgttcgtttaagtgtaaatagtcgcatgtggcttgtggctactgtgctggacagcttgcatgcaaagtgttaaagagagtaataataattggaataataattccaagttgaggctttcttcttgatgtagtcaaaactgaaagaaacgcagaagaaatccctttctcattgtatgactctgtgttactgaacactctgtgtgccacctaaaatcttctcttgaacgttggcatacttgccacactccataaacagaggtgctctagatgggaagtccaaagcactggtatgtgtcctgagacctgctctggttcttagtggagttttcaagagactgtgggcctctgtttcctttttaaaatgagaaggttcgggttgatggtgtctgtgcacatactggccctgatgagctgattctgcaggcaagtgaatgactcattgatgattttcgtccttttccttccagtgtgtctcagatgcccgtggccgagggcaagagcgtccagcagactgtggagctcctcacccggaaattggagatgcttggagcagagaagcaaggaacattttgtgtggactgtgagacctatcacacagctgcctctaccctgggcagccaaggtcagtgagagatgggcctgtgggatggctggaacctggtttggagttaatagacattcatattcattggaatctttctgctcttctgctgagagtggtgctcttggctaggtggtatatgtgtttctgaattcattaattttttccttcatctcttagtctgggcctgtgttgtagtctttttgcacttttaaagcacttttcacttctcaaagtgttggtcactaatttcctcagaatcatctggatcgcttgttagaggggcaggttcctggcccagcttacagactcactggtaatcagtcatagtctacattatagtaagtttcacag

SEQ ID NO: 31176 - DNA, 571 bp, Bovine  19866880728197
ccccctcccccgaccccccctctatttaccgccatcatcagcacgcgcgagctgtcaccagggcgcgagacaaccgaacgcggccccgcccccttcccgcccattggcccacccgccggagccccgcccccgggccccgcattgcgccaacggcgcagcccagggccccgacccggcacagacatcctctcccggggttagcgcggcggccgccaagtttagggttagccaccgacgcgcggccgacttgagcctggcgtaaggggcggtggcgtagaggggcgttgtgaatcgcgggtcgaagtttggttgaagcacaggagggtaaataaggaggtttccagacaaagagactcttaaaggtacagagtcttacggccgtccctcctccttaaaggactagagattcacaagagcccatctccgccccctgctccgcagcccttcagcctgcggaactgtaaaggaatcttgcggtagcttccgcactccttttgaatggattgtctttaacatctcttcccactgccaagcgggaaagccttcctcattataccgtctaggtttttgc

SEQ ID NO: 31177 - DNA, 2595 bp, Bovine  19866880772426
tttaaaaataaaataaaatttaaaaaaaaaaaaaagaaagaggcatgttttgagaaacatgactcaggtccccccacaacccaccctctgtacagcagcttctacaacttggaggttctgtactcgagtcctcgtgggttacaccagcagtattggtgttgcagcctccagtccaagagcagacttggggctcgggcccaggaccccaggggctgcagtgatggggctggcaggtcctcttagcggggagatgaggcgacccgggcgctgttcctctctgcagtttcctgtggactgtaacaacatccagaacctgcccaccctcaccttcgtcatcaatggtgtgcagttccctctgccacccgcctcctacatcctcaatgtaagtcctggttcctgcaggctgaaccagtgggcagaaggtcagggatggaggtgggtgaggggttgggaaggaagctgtgaggagccagaaacactgggtccccttaactgtgccatctccttgaagcattgatttctcttcccctctcatggattttaaacccccttctctggaaccaggctgtgaaagagcagagcaatcatctattaataataattgttattaattaattaagggggagaggcactggctctctgttgagcacttacaagagtcagccaccaagtgaagcactttgtctacattttcctgatgactcgtcataacatttaatgagggagatatgaatttttattttacaagtaaaaacttggaggttccaagaggttaactcattggcctaaagctacatagtaagggtgaagctaaggtttgaacctaagttgatctggctccaaggctttactaccaggagttgaggagatcctgcagagggagggcccttgcaacctgccctcagccacagttggcctgtgaggcctcaagggtagaaactctggctcatccttttctgtatctgtgctgctggcctggggctctgggctgaacagtgcccggtccacctgtgagctgatgaatgagtgttgcccttgtgtgttgtgcagaatgacgacagctactgcatcctgggggtggagatcacctacgtaccctcccagaacggccagcccctgtggatccttggggacgtctttctcaggtcatactattccgtctatgacctgggcaacaacagggtgggctttgccacggccgtctagactcagtgcctggactcccgggcttccttctccctctggacactccaccctacagggggttctctctgcacttcctctctgcatttagcctcccttctctggactctggactctctctaataataaacagctcttctccacgttggccatcctgttgtttttagagggcggtcgcagcctgtgaggctcagggaacgggacaataagaatcagaggcaactttgtctctatcggaccatgttgtccctgagtttctaggaggttcgtcgtgggtcactgagtttctaagagaaatagggcatgaggtaggcttgggggtgggccatgtacccctcaaagtttggagtctcttcacagcttctctctggagagggaagacaggggtagtggcatgcaggcacggcatgcctttgtaaggggacaatccaaaatgctctgctgacctaatttaccaaactaccaccagagttaccccacacatatcactagcagtgtgactaggggtcccatgtgtcttaaatctaggcttcttcctccttatctgtgatcaagtttgccctaggagctttcagaagaaggctggaggacaatgagcattgtaacagatgtgggtcctttagggagacatcacgtgatgccaccagagcatcttgtgacgtgcatcacgggagggtgacatgaaaaggtcaggaagtttctctgttcagcaacatggtggtggtgtacctgcaagctccaggtaatgaggtctaggtggggagggcccccacctagataaatggagaactcatgatgggagaggaggtgggctcccttttatagtcatatttccttcaccatgctgatcaaccttgttccttatgctcaagacccaggtctggtaccccattccaaaccaggaggatgagggttgacacagaggggtttctatggcaacaacacaccatctgggaccctacctctttcctagactccaggaaagccagagcactgcacgcctctcactggggtcaaataggccacagggcatattgtgatgatctgtggttcgtgacattactttctgaaagagaaaacttgcaaaaggggtagaaaccaagtggatcaaagtttccaaattaaacgccaagtctcagcacaggcctgagccagcagggtgggactacaaatcccgacgtgcctagcagagccgtcgcccagcagggaggactacgtttcccagcgggctctgcagcaggcagacgggcggtagggcggggaggggcggagccgggaggggcggggccgcggggtagggtgctgccctctgccgggcacggcggggaagtgagtgccgagtgacagcaggagccccggcgccgggcgcggggctcggtgacagcggaggcg

SEQ ID NO: 31178 - DNA, 3415 bp, Bovine  19866880782109
cagtaagaaatggcatgtgtgatcataggcagaggtacgtaaaacagaagtggagaaaacttaacctggatttggttttcatagcaaggtaggggtactcagtgttcacatgtatttcctgtgaacattcagatgttctctgaaaccagaaatctctaaacaagcaatccaggcaatactctttatagtttactttctacccttcttttcacagattatctcatactttattctgaagatggctctatataagcccaagtgaggctattaaattttcaagtacagacacccactgcagcctagctggtttaacagggctgtgagagcagaagccccgtcctggcccccaacatccacttgcctcaccgggcaggtaccatacactccatggaaagcctaaggactccagggagcaggcttctccccccaacaccaaagacatctgccctcaccaaagtctttgaagtagctattgccatagctcaccagccacctgggatgccccagagcaagctcacctgaatcttttaaggtgcagccggaggacctgaggtagtctgtagatcattaactgctttctagcttcactcagaacaaggggttttggattggattttcgtcgtttgcctagatggtttgggaaggtataagacatgggtcatgaggagactcattctttccgagccgtgcagagacaatgacttgccacccaatacgcattctcctagtttctcagtacttcaacctcagtttcatctgggcagcaatgtgaccctctctgagactgcatttcccagcctcacatgcccacatggtatggccacgcaagttctggctgagatgaaagaaacgactgtgtggctctctggggatggccgcttcaagaaggctgatgcagttgtaaggtgcctcctttgtccttcccactttgaaaggaatctcagtttcctttcctgtgaaatgggggataatgcatgtatctcgggtttagggagagggtaagaggacacggggtttcccaggtggttcagtgctaaacgatctgcctgccaaggcaggagatgcaggttcgatccctgggttgggaagataccctgcaagaggacatggcaacccactccagtacttccgcctgggaaatcccatggacagaggagcctggtgggctacagtccatggggtcacaaagagtcagatacgacttagtgtttgagcatgcatgcatgcaagaggcacaggattcccaaaggacagtgtatttagagattttttcccccacatgacttgcttgtggcgtatacaaatatttagaaaataaacttcactgttttgtatttttatgccatacttgttttctgaaacgtgtttcttggtaacagcactgctagacatgcagaacaaggctggccattggctaaatatactccattcaaaacaaaaccaatgctcaggactccaattttgtttcttaagatactgaattgtgggtgaaatgcatttctaaattacagagaaatgaagttctcttaatttccatcagaagccttctctataaccatttactgatgactgctctgttatattaatttagtcaatgaatggacaggaatataaaattcatggtccactgtggtgtctgttaattgtctctgagctgttgatatcatggtctctgtctgaggagcctggcacctgattcgaagcttgtgaaaagtagcaaatcacaggcagatgacgtatcgtggagctttctctgacaataggttgtggagctgttacttctcatgatagactgcagcaactagatggcagcttttactagggctggcagtcatggtatgtgagggcatgagcagaaagagaattcaaagaggggcctggccttattttacattcctgttcaccagcagacttttgaaaattactgcagctctctgcctgggaatcctggcagtgactgctgctctcagcagagggagtatgtgagctaaatgaagacaatatagaatctggctttgtttctctcaaatgaaattcatgaagaaaaatcactgattctgttaagactgatcagttctgtctcccatttgattaagctggctacacaggtgaaagactgatagttttgaaactttcacaagcaacagatcagtgcatctcatcccttcactatagctttccttccttgctatttgaacctgtctacagaaatactgataaatgggcacatctgacaaccagaaaaacaatcctttcttgcaaaaataaataaaagtgtttcttgcctaatctatcaggtccgagaatgacagacttaaggctgttaacatctttctgttccctacaagtataaaacttcatgaatcactattttaaaaagaaaaaaaatacatactgttctaataagacaatttaaatcactgcctttatatatctctatgtaacaggatagataggtgagtttatgcttaatcaagtacaggattcacattttgttttaaaatggcaaaacagtatcagaagtgtgacttttgatttttgacttgattcttcagagaacaggtttcccacaattcactactttaaaaaaccatatgcaaaaatattaaagggctaccataaaattgttattcccaaaccaaaacttatagtctgaactataatatggttgcacattgttctcagatctctgcacaatccattcatcttagtatccaaatctctatatgccaaaacccccaaacatcagtttcaaagtatttgctctgcatttcctatgtacatgctgggttagcaaaagcattgctagtgtgtcaagacacggggttgggggatgcataaggtgctctcagaaccatatggaaaaaattccactttacagttaaagccatgatagagaaatacttcctctgacccttctgagatgtaaacctttcaggcatgtgaaaataatgatgaagctgccatggagcaatgtaccatatgacttcctctcttggtctcactgtacccttagcatcacttctgactgactttaattcagaataaaagcacacttttctgatacatagcccctcaaacaggctatgccacctgaatttagactaaataagaactgtcaaactctattcatgaatttaagcaggacccccataacccatgaagctaaattctcacattcttggagtccccatttcagggtccatactttcaaatgcctcccaagataacaactaacttcagtcacagcaggagtccaaggaggtccaactcctaggtttggttttatttttttaatatataatgtccatatgtttttctcaggaaaataggaaaaaaatctttaaaagatgctttagaaccactcaatattacagtgttattttgactaaaagggcaaattaaatactttaaa

SEQ ID NO: 31179 - DNA, 2716 bp, Bovine  19866880843346
ctggtggacagtggggctgatggaacagggagaggacctttctttgttgctcagtctgttttgtttctgctcccttgttctcttagggctgattcgtttctccacttctccaaagacagtaaaccctctctttgctcttcggttccttttctctgatccctgctcactcccagcccacgtatccatactctgttcttggtcttctgcttagctgccctggcctgttctccctgcctactcttgttcagcatccgcttcctctccctggcccagacccacgttccctgggattggggtcagctggacttgaacttgaggagagtgggatacgaacgtgctgcgatcacacagtgggaatgcgggcgctggtgcccaagccaggaggacaccctctctcctgacctagtccactaccctcttcagggaatgaccccctggtaatgtggctaaggcccattaggaggattgcatttgtcaacctgataaatggaaacagatttctctaacagaaaaattagagagtgataggccttcattttcttgctattaaatttagcctaaaagggtattgaaccaggtggggaccagactgaagaaaactactctcttctgtctccttgtaaacattcagccatctatctgtccatgatctccatccatcacttcatgcactctatccatccatgcatccatctgtccatcatatctatccacccattatatccatccatctgtcccttaatcctttatgtccatctgggcatccattacatctgtacatctaactatgcatctaccaaatatttcctgagcaccaaattagttgctttacatttaatccttacagaaactcttcaagatagacattatcttccttttgcacatgaggacaccaggctcctgtgaagtgaagttgctggaggtcacgcagccaataagcaacagatctggacttcagctctctctgcttcaaaactcatgctcatagtgtggggtcaaatggcctccctggatgtccccagtgcttctttctgaatgcaaaatatgacagccttgcttctgaaggcatggacaggcatgctcaggttctggaatgcccggagttcccggagttctatccgaggagcagccccgggggccagaagtcacgctggacttacaagtcctattggcatttggtaccggtaacaatgtcaccagccccacgcctgcagtggaggcttcctgatcatgtaacttgcaacccagcatgtccttgtttcttctcttcatcaggccaactctgcttctgagggcactcttgtgtgccataggtaggaaagttctaggtacatgcttggccactgcatccgaccccaccagtctctctgcagcaactgagctcttgcacgcctgcctctgcttctccctaggacacccaagcccacattttactctggcacttttaataatagctttctaagctgtagagttagctgcacaatttcaggtcaaaactccctcctcgggcccctttggttgagacagggctgtgagtgcagacagtttacttgggtgatgaccccaggaagtccccttagtgaattaggtggagtgaggcggggaagggaagggagccactgagatgtgtgttcagagcaggtgaccactgtgggctctggagaaactgctttaggttcccagcctcgggacccctcagctggtaaagaatccacctgcaatgcgggagacctgagttcgatccctgcgttgggaagatcccctggagaaggggaaggctctccactctggcctggagaatttcatggactgtatagtccatagggtcgcagagtcggacacaaccaagcgactttcacttcattcgggacaaggggctggtattggcggtttgttaccagttcccctctgtctttggctggggcaaggcggatgctacctctgttggctctggtgcagctgtgtgcaggtgctggctgatggaggtgctcaggtgggcaggtcaggactgggagtggccaggggctgtggccagggccctgacagcctctgccactctcactggacacaggcatggtggccgaccagtccctaggagtgtgcctcctgccaagccctcttgtcaccgctcacgtctctccaggcccacgaagctgccaccaccctctcctgctgcccctggggagacccttcccactgggaccagtcatgggcaccacattcgatgcattcagcagatgcttaaggagcacctgctccgtgccaggtgtcagtgtaagaggagaagctgccagggcccctctagacgctccgagcagagggaagggattgggcggcgtgcagggggtccttaccagaagccacacaaggtggccccttctggacctttctctctttctctgagcttgacatccgctcctagagggtgtgggtgacacactgggcggccacagagcctgagccactctgagtccccttccggcagagctctgcggaggctgtgattgtagcggtttttctgacttccttttcctttctctcgcgcccctgcctcttccccctcctgaggccgccagacccacggctgccacgtggctgccttttcgtcagtggggaactgagccttccagtgccctctcgctgagtctctatggggaacaggatgcaattcacagtgcaataagggtggggggtcagtttattcgtgggtgccctt

SEQ ID NO: 31180 - DNA, 1114 bp, Bovine  19866880902843
tccctttacctctctgagcttcaggaggaacgcacactgggaccctccatgtggaccttaatagtttcagtgctatccaggatcagggactaggatgaggtaactgggagactctgctggggtgcgaaatttgggaaggtgccaatataaaatacattgtaattcgatattaaaaagcaaatcagcaaattacagccctgccagccagctgcctatttttataaataaagttttattggaaccagggctgagattaaagtgaaacgagtgagatgggatcatgaaaattcaggtttagatcctgtcttcatttaaaatgttggcattttgttcactagagattttttgcattgatttcaatttttagatatattgcaggaaaatattgttttatgttaattacctaggtttttttttttttttttgctgctcccttgaagtttcacacccgagcctcactcactgtaagccttacacacctcacccttgtccttggcctattaccgtctcttcccgaaggacctgagtaaatgagtagaggctgaagatggttccaccacctccagccccccaccccacaacaccaagcgggctctgcagacaagtccagacctagctttcctggggcccaataattagttcagagtcaaatgcaaagtgctcacattggccttcaggctcccagagttaggctctacccaccttcactttcgtctcccctcattcatttctttccagccttgctgcttcccgagtttgttttttcagcttgtctcgtgtgtttgctcagggcctttgcacttgctctcccatctgcccagaatgtgcttcccctagctattcacttggcccccttccttgtcttctctacttaggtcatcttctcagagaggccatcccaaaccccttgctctctgtcccctcccaccactttatttttctacataaacctttcacctcttttcctatttatgtacttgtttgttgactagtagaatgtaagctccaggggtgaggggactttgctctgtctcctaggggactccctagaactgggtctgacacaggtagctcaatatgtattttccagtttcacagatgggaatacaagggg

SEQ ID NO: 31181 - DNA, 5239 bp, Bovine  19866880906721
ccccacgcccatcccaccggcctcagtcacagcccctctcgccttcctactgttccctttccaggacactgccccgagagcccaaggctcaatccttcacctccttcaagacggctcggatgtcacctttcctatgatgtgtaccctgagcaccctacgtaaaacggaaacctccaactttaccctggatctttccctactcagtgcccccgcctgcacccagagcacttttcatctttaacatacgatacagtgacggatttacgtgttacgcttcatggtcaagcccccactgccaacacacgggctgccaagaggcagcggttgtctttgtgctggtcactgatgtgtcccaagcacccagaacaatgtctggcacctacccaggtattaagtaaatacttgttgaattagtgaatggtatattgttcagaaaagagtaaagggtgaggcactgggattgcctgcagacggcagctggttcgaatgtacgagaaaataatcatctgatacaccaatttaaaatgaagagccccttcatgttcctagatagagaaactagaaccaagctcaacaaagtaactacctagcaacagtccgtgagagctttgtcctccacagataaaagaacacgttaaaacaccagttagtgaactccttgttaacaatgtctgtataaagacaggaaataacctaacatcccacaggggactggcttgtaaagtccacacaagagggtagaactatagggaggggcgaaacagctcccgcatacaaggatgtggaatgactgccaaagtagctccacaagggaagaaagcaaggggtaaaaactgcaatttgctgcgtatgttcaaaacaacaattaaaaagcatctctaaggccttccccggcagcccagtggttaagactccacacttccaatgcagggagtataggtttgctccctggtcggagaactgtaagatcccacgtgctgcacagcatggccaaaaaaataaattcaaacaaagtctctagaaggattcacaagagagtggtgatgctggctgctctgtaggagggaaagggagagtgaaagagggtcaccacacatctttttgtacattccggattttaaatgtttgattgttgccagtccaacaaaataacaagcccaattgatcgtccaaaaattgttgctggaatccttctcttgaagatttttatttctctgttctgtacagaagagcacatggccatacaacaggggtggggagggggtgggcaggggtgccttgggctgccgtatgccaagcacccaacatagatgagctgattttatctcaggttcctcacttccccttgaagtaggcattctcatttgtaaggaaacagactcagatgctgggtcaggcaaccaacatcacgtagtggaaagcagcccggtctggatttgcagccaggccagtctgactcccaaggctcaggtctttttactctttgctgtctggcttggcctccagggatcctgaagtcctcaggcagctcctggcatccagtccgcctcgctgcactcactgccatgacctcacctaagtcactccccagggtgttaagtaactcaactgcaagctcttgagcttacttacaaagggattgtgatgcttgtttagaagattcctccttctcataaggtgaacctcatcttagtccatgacccaatcaccagatcttagaccgacttaacagagtccaaaccagaagcgtaggataacaagctcctctgctttacgtaaagccacgggccgccagccctaattctgaaaggaataattcaatattaaagagatatgtgatcaggcaagggagactgtcaataaactagagtcagaactggcactctccacctgcatcccagggctgcgggctaccacctggggcctcacagctcagagaagcctcagtctggttacgaccactgagccatctcttgcttaaaagccagggccagccttaaaggacagatgaatatggcaacctcactcttagggtccaataagccttaaaggcattagagcttctggcaggtctgtgcctctacttggaactttctctcctgatgcataaataagagtggctcttaccctcttacttgcggaggacaatacatcataaccagaaaggaacacccccaagtttccacgcgcacactcccctcctcaacctttgtctctgtccacactttgtctcctatcctggctgggaaaagtccacaatcaggttaacccctcctttggggtactggattcctgccctaccaaagatcatcattccaaaatgattttcctctcctgaatcactttaccagatcactcccatcagcacaggcatcttgtcacacctctctgaccttaattctttccctttagttaccactccatttctctccttcccaccacagcaaaattccttgaaatcacagtctacatttaatggaattttctgtgatgatttaactgttcgtatctgcactgcccagcagggtagcaggagtcacaggtggctacagaaatgtagctggtgtgactaaggaactgaattttttgttatatttaatttacatcaatttagatttagttgcctgtggactacttgccactgtgaagaacaacacaagtctgtactcactaactccagtttctctcctcccattctctttgaattcacttgctctcattcttcctgaaatggcgttgccaaatctaagggacaaagtttcggtcctcacatggctggaaccagccacaggtgcagacaaagcagatcaagcggatcactctcctcctcctgaagctttcttcccttggcgtccaggatgcgccaccttccctgctgtgccttctccacatccttggctggttccttgtctcctcacctgctgaacagtgcagagccccagggctcagtcctggtacttctcttttttatcctcattgctccctaggcactcatctggtctctcgtggttttcaacactatctacatgctgaggactcccagacttgcactttgagcccaaacaccttcctacctgacatcaccatgactttttgtgactccacagactgcagcccatcaggctcctccgggtttatccgggcaggattatccgggcaagaatactggagtaggttgccatttccttctccagggcatcttcctgacccagggatcaaacctgcatctcctgcagctcctacattggcaggaggattctttagcactgagccactagggaggcccctacctgatctcaccacccggatataataagcatctcaaacttacctcatgttcacctcaactcctggttcccccgctacccttgttccacccaaaacctcccctttcttggctgaaggcaactccttctttcctactgttcaggcaaaaaaccttgcatttgtctttgactctctttctctcacattcactctatcagtcggttcttttctgaaaattatctagaatttggctaaataatctacctgaccatgtctctctctctgccaccgtctctcagcttcctgcaccagcctcccgagcgggctctgctctgccctcaccctgcgtagtccacctcgaccgcacaacctcacccatcccgagacccacctctgcttagcaggtcccgcggctcccatctcaccgacaaaaagcccaagtgctggtgtaccgtgaagacctgagccccgggagctccctgaccccgtcccctgctgctcccctcttactcgcgtccccctggtcacccccacggcctctgctcttcttcaacacagcagttcccacctcggggcctttgcatctgccatttcctctgcagggaaggctcccctcccagaaaagtgcaggccttgttccctcaggccttcgcttacctatccacctctcactcaccctgtctaataccacacccccaggcccatacctactcctgtcccctaaggtctcatttttccttagttccgtgagggcaggatgttttgcctattttgccttctgctaatttcgcagcacctgacacatgcctgactctggcaggggctcattcagtatctgctggatgactgaacgaatccccagggagcaagagatcacatcaccacagacccatcatgcaagtccctcacaagaggccagagactgagggggtcctgtccaacccctggggagacaggcagtgagcagcactgcgggggtgggggtgggggggtgcgctgaagcagacggaaggctggacccaccgggctgatgtgaagagggaggttctctgtgtccgtctgctcgtcctgctccgaggaatccgtctcctccatctgctgcatctccagctcggacggaagaagagccgtcaggtaggggatggtgaaaggcctggcagcgatcactgagggattggaagagaggccaggagccttacgacacatcagtgagcagcacccagcggcagggatggctcacacgctggggcactcaccatgggccaggtaacacttacacgttacctttaatcctcatctccaccttactaaacaagtaaattaccagcctcatcttacagatggggaacttgaagaatggagaggttatgagaccccctcaaacacacaggaagtggcagagtgggatatgaacccaggcaatatgacttcagagcttcttttaccaagcaccagagaggactggggctgaatcctagcgaagcatcagcttagtgatcttatacccgaggccagttagcccctcagcttcattactagagcaaagatatggatcccttcagcctgaaggaccaagtcctgacagtggacctgagaactcttggcctggagtatatccatggagctggagggcactccaggtaaaggagcaatccaattcttccaaaaagcaatgaggctgaggagaaattactgtttaaaaaaaactgaaggaaagtctctgtgtatacttctatggtagaattaacaggagacactcaaagattattttcaacatggctcaggtgtgggtcctgcacacagaaagaactaggtctgaataccatctgctcaccatgtgaccttcggcaaattactccactgcttttctctagaagccttggcttcttggaagggcagtggaaatagttcctgactcagaggttcactcaaggagctcacgaggtaacagaagggaaggatcagcatagtt

SEQ ID NO: 31182 - DNA, 1084 bp, Bovine  19866880926529
ggggaggagaggctgaatgtgctggagcctggaaccgggacaagggccagggtgggccactgggagggctaagtcctgggctgtaacttgaggcccagccccagcaagccccctccccagcctgggcagggccagacaatgtggctttcataacacgagaaggcctggctctgccgctttgggagattgagcctgctgcccaggaagcccaaaccgcaggagacccagccaaaaccccacagacgcctgaatccgagaccagaatcccccacgccccttgctgagcactgacagaacagcaaggccacggcgctaccccagggggccctgcctccggcaggaccgccaggaaccaagtcagcccctccctcagccgcccaggatgcaaacggggagcaagggggcccagggcagctctggttgggggcctggtggccaagcccccacacccttggctcccccagtggcctcctcctcctccagccctgagagccccgggagcctggctccctaacccacagcaaatttctgtccagcactggggcgtcacattcctgctcttggttctgaagtgagtttcctggggaattggagcttttagacctaaaataaaaccagctggacccagcctaactggtcagctcaggccctctccagtccttgtcctggtggcctgggcctgtgtcccatgggtcgcagtgtgtatcaagcaagcccacgttcttactgtcgtggtgccaggcaccaaccccaattctcacctggttctctctcctcctcccaacctggggcattctagactccagaactcagtcctcgccatcagacattggctaagtgccactgggggtgcaaagatgacactgacgtcgccccaggcgagagctggggagggctggttgaggacccacgcttcactcccagttacagtttacagcagggagctctgggcgctgaatcctcaggaagtggccactccgaggagggactgttggctcgagggtcagggtagtctttctggaggaagaggtgaacctccggctgggtggtgaagggtgattggatttggggagaggggaggggt

SEQ ID NO: 31183 - DNA, 1181 bp, Bovine  19866880929355
ggggcggggacggcaagaacctatcaatctgcccagggtgagcgttgttattgttattattatgaagcatctcaaggctcacactcgtcctggcctggccaggccccattaatggccccataaatcccagccataaagagtaatggggggagacaaatgagataattaggaataaatctcaccgaggtctctattcagcagcatccctggaacgggccaatcttccgagccattagctaggcccctaattaatgccgctgccggacggtgtggtggctccaggcgtgggagggacccgggacccgggaggggcaccattgcacccacagccctggcgggcgaccttgggcgcagccgagggacgtgcctgcagcctgcctgcctctgtctctagggccttgggaacgctttgtctgcactttcccctctgccttgctgtctcttcccctccttttcagcatcttactccatctctggtttgtctagcttcactctctgcttcgctcctatcagatagtcgctggctgctgagccagtgtgatttagcaggaattgtgggggccacctgtaaccaccctcctccatctgtccttccttctatgggaacccctcaacaacccctcccccagggcagtcctgggaacagggaggacccctctcccccataccgccactgcaatgcagcctgcggggcggctctctctcctgcccagggcaggcatctgcctctgggtcttacctctgctgctggagcctgagacagcctctctctcctcccaggcttcagatatttgaaggcttttgtcctttttcttgtttttctttggtcaagccttgtatcttagtcctccgacccgggatcgaacttggactctcccgacagtgaaagcttggagtcctaaccactggaccgccaaggaattccctgaaggcctttgtccttggctttccttctgcagccagatgccctgtgcagctcaaggtttccagcccggcgtcccccacccaggtgcttcctctagacccacctacagtgacttttcgttgttttaatctgccagtctgtctcccccttttgcagtcatagcactcccatttctttggggagatgtgctcacctggtcctggaggggcagccaggtaacccgtcagaggcctggctctttgggggccctctgtcc

SEQ ID NO: 31184 - DNA, 1958 bp, Bovine  19866880942112
ctcggttggacggggaggcgtctctgcaccccagcctccaactcacttcttcctgcggatcttgggtttcttcacgggccgcagataggggttatcgatgatactctcctccccatttcggctccccgacaaggaggggttctgctgcagaacagaggtgttctccttctcggctccagaatcatcctttgagcaaaagccgaaataaagcaaaacaaccagcagcataaggaaagtgatcatgcctgcggctaagaaccactacaagtacccttctcattgagaaatcagaagctgggctaatgggcctctctctgccccagaggaggccaggcagtggctgcgatcagaggaaggcgggagtgccaggtgacacagtggagcacagaacacaagatcctgagaaggcagggacaggagtcggaaggggacagagagctgggggggcagggagtcaggggcacaagtcagatgcttcagcctgtggggacataaagaaaaagagaagtgggacttccttggtggcccagtggctaagacttctcgctcccaaggcagggggctcaggttcaatctctggtcaaggaactagaatccacatgccacaacaaagataagagatccggagtgccacaaggaagccccagcgcaatcaaataaatactttttaaaacttagagagagagagaaggggccctcggtcccctgcaggactgagaggtaccggaccagaacagatcgtgtgcacggagcccctcctggagctaacttcatgtaaatcatgatctccttccccacaaattctcaagcatctggtacttgcaacgtggtgccaatggtcatatcccagcgaaggccggaaattgctggagccctgagagctcccacgaaggcaccaacatgggaatgtcatccaccacctccacatgtggcccgtggatcaggcctctcactgttcatttttcaagaaaagtgatttttggagaaaagtttatacgtttgagtatattcaatacgatcttgaagatttttttttttaaaagcacaatgggatgcagacatagaaaacagcgatgatgctgaagttttacaaactgcttctggaaatacgggtggctgattttcccttccttttttacactctctattttccaagttctttaaaatgagcagaagctgcaggagaggcgttggggggaatcacacgaaggactcaggcccaagtggcagtaagtgaccagaagctgctggctgggctgcaccccctggtgacaggccaaaggctccgtcactgaggttcctggtctgcgtgtgttagtcactcagttgtgtccgactctttgcaaccccgtggactgtagcccaccaggctcccctgtccatgggattctccagccaagaatactggagtgggttgctttttccttctgtaagggatcttcctgacccagggatgaaaccggggtctcctgcattaaaaacagattttttaccatttgagccaccaggtcagctgttgtataacttgaggcaaaagaggatctgacctcaagcaggagatggcgctgtcagaagacagcagggcagaggacgctgtcatcagggatagaagtagatgaaagaaataaagtaactaaactgagatttgtaaagaaaaggtgggagtaaaaaggactgtcaggagtgacttgggctcagaaaggccagactcaggcaatgtgtatgctctgtgtgaaccccaggcacccaagggtgctgcctccagcctcgggttccaacaccatttccatggcaacacctcccacttgaacctacccagctgtcacctctcccgtgacctccaggcctgcacggccactgtcactctaccacctgccatctccaggcatctcaaattcaatgtgcctgaaacaaccccgagcacaagcagctcctcccactgccataggtgatggcag

SEQ ID NO: 31185 - DNA, 997 bp, Bovine  19866880947624
cggacgggagcaggggtaggcggctgggggagggcggctggtatttctcccctctcctctttgagaagtggggagacggttcgggggaccctgagtggaggtgggggcgagaaatctgggtatcggggaccgggtccaaggagagtggagggctgggacgatgggggcagggcccgaacggaggcagcggccgcgccaagttggctccaactctctccactcccaacaccagacacacacacaccgcagtgtctgtctgtccgtctgggatttgtgtcccaaccgtttttgcccagtgtgtaaatatttatgggggcctcaggcggaggtgggggtgtctgagtctttctctccttcccttcccccatcctagccggagcctagcgcttcccgaaaacttttgtccacagcaagcggctgcaggatcggcccctcccctccttgccatctcctctcgttcgccttcctccccacccggggcctggccagcccccgccactcctaccctgcttgcacacacagacacacacaggcacacacacgcatacacacatacacagagtttctcccccgccccacccctctccttctctctccccgcttctctatttcaggcactcaccccaaccaagtgcccaccactcaaatgaactgtcccttcccccaaatacaggatctgtaaccttcctggaattattcctgcaggagcctaccccctctcagggtttgtgactccctaagggggcctggtaagaaggcaggggccctggggagtcctggtgatgtggctctctgtccaccttctcaccatacacatgtgcgctgaggttcccagtggacagcagggacagggagaagtcaggaacatctagggtttgttggggaaggcggaagggtggtgggcaggagcacaggcccggatgtcatgcctttaatctcagttctaggttagtctgatcatctgcctccctctcacccagccccattagccctttcg

SEQ ID NO: 31186 - DNA, 1050 bp, Bovine  19866880952491
ctgtctcatcttgtcagcccccttgccattccttcaagttcttggtgtctcaccacgacctttcttgctgtagctccagccacgactgaggaatactctctggttattctcaagggttatttacaaccttggcctagtctccccactcacccatttaaaagaggttgagtttgggtccttgattctggcaccaaattgtatccatttcagcctccaaatgggcctcttctgtgtcaggtgccatctctgctcctcccagcccagcatcccgtatgcatggtggttggagggccccgagcctaagcagggtcgctgagggcggggctggaggcagctggcggcattttgcccggggctcacactgccagggcttttgtaagcatttagctgccctggccgccctccagatggtgactcacgggcctcgccgagctgactcgctgacggtgcccatcctgacacatcccagcctggagaggggggtcactggggacaccaggggagctccagttcagttctcagaacccccaaggggcagggaagggaagggatgggttcaggcggtctaggagatcggcaggcagcagccgcctcactgacctttcttgaccctgctgagccaccttagagacaagtacacacaaggtaatccatccagattgctgcagccacctctccagccagctgctcggccagttggcaggaacagcagaggctggggaggacttccaaggtcatctcttccattcccctgcctccaagtaggaaagccccaaggaaggaaatgccgcatcctttcctgcaggccacttgcagtgactcacagccctggtgcctggaaagacctcccgggtgtctgggctcagtgttcctggccagagctctggccatctgctctaggtcagtccccacagccacgagcatgggagggccagactctggtctcaagtgacccttaccgtgtaatgcccctggggcccaagtgctggggtgcactcgtggaggagtcggggcacagagggaaaatgaatatccagagggttttcaaaa

SEQ ID NO: 31187 - DNA, 1394 bp, Bovine  19866880978853
cttctccatggccagagcagcagagtggccagccccacagcccacaccacaagcaggggctcgagtctgccctccacacttgcccagaaccacacttgcccagagggccctcagtctgagcccgcctggggcagcagcaaaagtctgcgtggactcagctgccaggtcatcaggggtccctccgtgctttctcaggcaatgaagtctccgggctggcaggcaggtctgagagacaggggcagcctccagggggtgagtgggagggtgcagagagggagagtgcagctcacagcccaggcctggccctcagcctttggcagcaggaggagggggagccccaggcgagggtcaagactcacgtccatgtagtccatgggctcggtggccacaatgaagtcaccaaagcggtacttctgggccgggtcgtgcttgtaggtcctcaggaagtcctccaggaggcccttctccttcatgatctcacggatggacttaaatttcttcaaggggattctgcagaagggctggggtcagggcagggactccctctttcctactgcgcctctaatatcccaatctctctctccatccctaactgcctcaggctccccgtcgctctgtccccggggtccgtcgcttgtatgtgtctgtctccctctttctccatttctgtttcgatctctggctctctctggctctttctccctctgcctctctttttctcttggaaaactcttctcaggacttgctccaagattcagaagacagctaccttcacccaggcctgccccgacctcatcccatgggttgtcatcccaccctggtcctccactctcacataccccataaactctttcccaggaaggggagaggaactttagacattactctttggaggatttgtgcggttggttggtttgttttggctgtgtttgctggatctttgttccctgaccaggaattgaacccacgctctggcagtgaaagcgcagagcccttaaccagtggaccacaaaggaattcccagtttgtgcatttttaaaaaaaggtttcagagggacttcctttggtgggttcagtggttaagactctgcactctcaatgcagagggcacgggttcaatctctgagaaactaagatcccacatgctgcacaacacagaaaaataataaattaaaaagcaatacataattcaaaaaataaaaaggcttcagagacggcaaagttaaccccaaagggagtcccccggattggtggccctcaggcaactggcactggcttggatgtgacagagcacgggccccagggagcagcactagactggggactcagaagacagggtcctagttctgctgctccgggtctggcctggggtcagtcatgctcctcacaggagg

SEQ ID NO: 31188 - DNA, 711 bp, Bovine  19866880988411
tataaaaagagcactccctgcctaattatgcctacccaattctgagggctttattcttcatctcatcagtcattataaccttatactttgcactctttttgttaaactcctgctaggtccctaacactgtctattcactagcaccatggattttcttaaacctcagcaacattttctcctttgattactgtctcctccagcacagaaatatgcacaaagggaaactcaggtcataatatttattaaataactagaaaacttttccaagtcagcctcaaagagaacagtgggctcagttatgtaaaacataactcaagtagcattacaagtctttaacaactcttcgggcagtgccagaatttatttctgaaaggcaggtttccttttggaagaaatgaagctagtgtgataatgagggttctatactcaatcacccaccaaattactaagtgcaatgacatccgtaattgattcacatgaggtcttcaagggacctgccttttaataacggtggaagaagcactgtatccaagttcacatcatccttgactgtgcagacataaagttcctggtcttcagagctggcaggagaaacactgtacatggtggatttcatggcattggctgtagggaaagaagactatgattgaggaaaatgccatgctcagtcgctgtagttttaaagacacaagattacaagaatgtactcaa

SEQ ID NO: 31189 - DNA, 724 bp, Bovine  19866881010354
ggcatgatgggccgctccctgcgggtctcctgcccctacaactccttgaagcactgggggagacgcaaagcctggtgtcgccagctgggtgaagaaggcctgtgccagcaagtggtcagcacccacccctcgtggctgctgtccttcctgaagaggcgcaacgggagcacggccatcacggacgacgccctggggggcacactcaccatcacgctgcggaatcttcaaacccacgacgctgggctctaccagtgccagagcctccatggcagcgaggctgacaccctcaggaaggtcctggtggaggtgctggctggtgagtgggcggctgactgcaccccgcatctgaggctggggctctgagtataggaccgaccaccctcggggcttttgggggtcctggaagatcccacggtgtggattttgtccccctgctcaactgagggccactgtggctggttgtgcagattgctgactgcaggaggagggtcaccatccagccctgtgccccgctgcaggctgcgccccctggtggaggactgcatcgcttgcaggaagggtacagtccttcctttacacacttaggagctagctgtggtcctgctcccctccaaacagctttatccatctggcatcccgttgggatgtgagcactgaggtggtccttaaggagtaggaggacattcactcattccctcacccaaccacccaatgcacctaccga

SEQ ID NO: 31190 - DNA, 1577 bp, Bovine  19866881106728
aacatattcccagagaactgagaggacagtgcattcatgaaataaaaataatatatgagaaatgcttggagaattaaaaatactgtaaactaaaagcactaagggataaaaatttgaaggacaaggatagaagggatggaagaaaaaatatgaggatatcttccaggaatcagaacacaatggacaaaaaaaaaaaaaaaaaaaaaaggaaagaaacctagacagaaaagctatgaaaatgagatgagtacaggtgattcaatatccaattaattatcaaagcaatagtgcacttcctggacgtggagaacgtggcccacaccggaagtgtctagggagcactcagcacagggcgtgaagacaggtagaccagggtgcaccatcgagagggggcttcctggatgatctccagagagctcgggtagggcactcacatagaatttaaaattaagatggactcaggcccttgggaggacactttacttccctccttcacagctctgcatcatcagattctatatttggaataccctggagatcatcttccccctttctctaatgctccctggttgccataatcctcctccctgacttcactccttaggggtgcccaggatcccaggcttctgtatttccgtgggccttctcattctacctcacccactcatatctggagcactgagccaaccagagcttggaacagctccttctccccacccatggcgaggcccatcagtgcctgcttcccaaccccatggtcactgagagccccacgtgagtgtctgaggccaaatttcctgcccccaggggaatgctgtgtcagtgcccagacgagcctcagagctgacatctccctgcccagccatgggccccaaactgctcctgctgctgctcctgggactagtaggtaaggtttagaaggagctgcactctgggccccatgtaccctgctccatgcccagggataattggcattgccctggaaacaactacatgtgtaggcccagaagtggacctctagacccctgacctcctgggcagtgggtggacccgggaggtgccctgcctgacattccctcaactttccttccctaggccagggctcagccggcagcctcccggagctgctgcaggcgtctgtggggagctccatcctggtgcagtgccactaccgactccaggacgtcaaggcacgaaaggtgtggtgccaggtcctgccagagggatgccagcccttggtaacatcaaccgtgaatcgcggggtcccagctagcagccgcatatttctcacagacctggggggcggcctgctccaggtggagatgcttgccctgcgggaggaggatgctggcgagtatgcctgtgtggtggagggcctctcgggaacccagactgtgcacagggtcactctggatgtgcttcctgcaggtgagctatcccagcctggccagcagccctggcctgccctcctgccccaacctgccgctcttgggtccctggtgggtgggagctcttgtgggtgaggaatatgggccaaatgcccaatattcttttgacagctctgcagggaacggaag

SEQ ID NO: 31191 - DNA, 1841 bp, Bovine  19866881129693
tactgggtgctcagtatagaactgattgttttggccagcttttggttacatccagaattaattcaaataacttggatttaaaattaattaagttaacttttaatcatttgctgtttctatattaaaagtagggttgaaaatttggacagaaaagagggaaattttatgaggaattccctggtggtccagtggttaggatcctatgctttcaccgccaagggtgtgggttcagtctctggttgggaaactaagatcccacaagtggcacagtgtgcccctccccccagctaaaagtaacaggggaaagcatatagttgtaaaacaccccatccatacaatgtcagcttagcttcctgaataaggttgcctcaaacccctaaccaagaatgtgtgcaagttgtaagctcttctctccctaaaaatatttgcgcatttcctggattttaccatcatgcaattgcttctgcctcctgggcccctgtttttcttgccttgtgcctctgatatgcagcatgatgtcctcagaaaggattctgattctcaggaaggccctgttcatacagggcatttgtgtttttagtacacctaactgaagaaaggaggaaaaacaggtgggtgagccctatattgcattcatgcaacttccctttaaggcattcttgttctggaaatgttccagacctcccttgactggagaacttcacctccccttcagccccagcttcactctgctatactattcctttcttctcttcctgttcctctcatcatcctcctctctgttcctttcagagataaaaacaagttctcctcatctaatgtaaagcaggtcccctttcttgaccagcattctggatcttgacagccattctgcagggaaccatccatcccaaggggactggacctgagtggtgggagaccctattgagggaacatattttcacaaagagtgtcttctaagaggagttcttgtgttagcaaagtcttaacttttcatcttgttacatggtggcagacagtgtattaatctcaagcttattgaatcctgcctcctgaatacagtgtcagaaacctaaaaaatgattgtgcacataatgtgtccaaattctagatagcttagactaatacagtgttcttgtgcatagaatgtatgctgcatgcctaagagtcatgaacccacctaacacaaagatgtcaccacttggcatcttgcatcatcacatgtttcacttacacaaaaagaatttgggcttttgaaacacaattatttttgttgccataaatttgttttgatttttctgacagtttcaagctatgtcaaggcagtgtgtaatctttaaaacctaaaataaacacagaagtgcatcttttcaggaagtaaacctttcacagttccatcagtctgttcataaatgacttaatgtttgattgctcttagctgaaaaaaaaattacagctttttatcctcactcttttacctcaatttagaggacttgtggggagttcactaaactgcattgtaatatactgatcctgttttttgaatttataaataaaattcatgaaattgtttttctcttgctatatagcagcctgaccttacagattttccccccctgtaggtaatagagacgaggaaacctaaccaatgactgtggagtaatatggaagaagatgggaaaaacttgtttaatgggtaagaaataaaattgtaataaagagttgtttatggaaactattcacaatagtattatgtaataatactaggcttcagcaggtggccgagagtggtatcctgttagagtgagcgctcagccactgtctttgtcttatcaccattc

SEQ ID NO: 31192 - DNA, 1445 bp, Bovine  19866881168899
caataagtaataataaatttatctatcagcccatttgaactctatcatggcacatgtgaatatattttatgaaataacaccattcttattccataaaaaccctgccattcaggtaggcaaaattacctcccttttacagatgaagaaattgaagctctgggacgttaaatgacttacatatgacctcgcagctactgatgtgtgtgctgtgcttagtcactcagtcatgtccaactcttcgtgaccccatggattgtagccccccagaatcctcgggaattctccaggcaggaatactggagtgggttgccatgccctcctccagggggtcttccaacccagggatcgaacccaggtctctcacattacaggtggcttctttaccatctgagccaccagggaggcccaagaatactggagtggatagcctatcccttctccaggggatcttcccaacccaggaatcgaactagggtctcctccagcgccggcagattctgagcttctaagtaaaaccaaaattagagttcacctttctgaactactagtccagtgcatttttcacaggcaccacaagttcaaaagagctctgatttctctgagacagaatgactgaaaaagtgagaactgagcatggctttggatagtgaacattctgataagtagaaggaggtagacatcactgagtatttttaaaagggagaattgtgtgagcaaagacacattaaggatgggcgtgattaatgtagaatatagatttttgtttgaaaactgtaggaaatcaggctgaataaatgataggaaacttgagagttgctggtgaattcaaggtaggaacttgcaaaattggtaagatacacattagaaagccaggaagtacatggttatgaaatataaaatcattttaatatcatctgggttcaaaagtaattgagcaggcaaatttatagctgaaaaaaatctgttatgtgtataacacatttgagagaaattaaataaagtttttcttaatcactaagaaataatttccctataaacaatcaaacaaaacctttccaattcactgttaacttgcattttgggctgagaacagaagtcactattcctgggtggtcggatgccttccttgtctgtaggtaaggtgagtgtcctagtttaatgatcagctgtgtcttactttctgaccccctccacgtccactctcagcatctccacctacctgcagtattcccttgtgaaggcctcctgacttctggatgattctgtctggaactgaaaagtgtctgtagggaggaaaagatgactgtccttaatcgtctgtgtttgtattaactgagaacatttaaaaattcctgactacctttcatgaaaattgcttcccccattataaaaatggtaaatttaggtttaatagtaaccttacatgcaagattagggtactaatt

SEQ ID NO: 31193 - DNA, 766 bp, Bovine  19866881179300
ccccaagtaggccttggatctgcccttggaaaacacagagctaatcgtgagaagtagctaatgagatgatgaaaatagcactgctttggaaagcagatccacctgggcaggctcttgccccaactgctccccagggaacaaaaccactggctgtcataactcttcagccccagagaccgacctcaggcttgctgctgctcctttgctgaacaactcactctcagggtggccaggtcttggccaggcccggagcttcccccagagtaagctgtaatcactctagtctgcatattgtggggcattgggtgggggtccagggcacatcccaggaattggctcccagcccagtggtggccgccaagcttccctgttccctccccaggtcactgcctgtgacccacgaggctgcggcaggaattttcctctggtgtggcgggtgggctgtgagtggacggctttcccgatggggaggggaggattggagagggagtgatgcccaggagggcgactgcagctcctatgtctgagcctaccctggtagcgtcagggcgtggtgtgcggaccgaatccgtttccattgccatcatcatccaaccatctccactaacatggtgaatgtttgctgactgctcaattctcttctttagaattgggccctacccaccccccgggctgccctcaggaaaagacaggagccagcatcctgtccaggagtgacatttcaggtcagaccaggaggggccctccccaagcccacccctgggta

SEQ ID NO: 31194 - DNA, 1130 bp, Bovine  19866881187339
tcggagagtaggaaatggggacactttaatgtgggttcccccaggagtggacttggagaccaggatacatgttgtacttggaacacgggacagagcaaggggaagtgagtcagggaagggaaggcagcagacggagcacttgcacaggctggtcatcaccgtgggcagcaagggctcagccccactggggagagtccggaatccagtgtcaggcagccgtgtggagggcgaggaggccggggcctttatgtcccactgttggtggtcgatggggggctgcctgctatgcatggcatggagggcaccagtgacaagagaaagccgtcagaccaaaagtgtttttaacggaggtgctgatgactggtgtagatggaagtgacgtagataagagggatacaggcagggaaagggggacacaggcaggtaaccacagcatgtgttctggaggacagaggtgggaagtgccatcctcggtcaccctggggagagtaagactcttggcctcttctgtcacaaatgggtgtctcttagagtccccgccctcagcagagaggactccccccaatactggagagacgcatgcctttgccgggggctgggggcttcgtccccctgacctttgagcacctcacttccttctcccgcagctcggtccccaaggaagagaggccgtctctccccgtggggactggcgggtcccactcttctcgcgtgggatgtgggaagatgtgggcccgagtggggtgcccagtactcatcttctcctggccctgtcctgtctccccagatacattgaattttatcccatggtgctcgtcggggtgctggcactgctccccatgcttgtgatgctgatcgtggtctacggcttctggaagaagagacacatgggaagtgagtagaacccaaccctcgcagccccccaaggacagagcgctggggagtctgacaccctttccaaagcccgactgcccccagtctccaggcggtcggtcctcacctgcatccactcaggaggaccattcgacacccaggagaggggggaagggtgggcaggcagtgaccgctcagtggaaccttctggggcccagccacttggaagcggaggcagaggcagagcggctggcctg

SEQ ID NO: 31195 - DNA, 1088 bp, Bovine  19866881191940
cgcggagtatctccctactcattcgatgggaagccaagggtggactctgggccctgctgagaatgggcaagggctggtgctggctctcggctcctcagtacccacctcctcagtgttaggaagtcttggacatcccacagcatctctccttcgaggcctggcctgccatctgcaaaacagggccatctggaagtggagggaagcctggggcaggagggaggggggatcctgagagggggaagaagatggagctcagaatgttctttggaatttctctttccatcacccactggtcctttaaatcagagattcttcactgtttggagccactggcttggatgagagtctgatatacactatggatcttccctgccccaggctcctaaaaaacgaaccctaaaatcaaccctcctgttcccaacccatgccttcctccccatttcaaagcctgggccccctccacaccacctgaagcagatagaaagagccccttcaattcaccccctgcccctcacttcctgagacctttgcctcttggggtccagcccccatccacctcttgggctcctccattctcatcttttttctttgctctctcttttccgaggggggcagtggaatttatacaatatttaagcagccagagccaagtcctggaagatattattaatgtaaaagggacgggctgcaaatgcttttggacctggttacaattagagggtgatttttctaaaggtcaatgaattcagataatatccacagtggggagagaaatttaatacctttttagtgaattaattaattataatattatatcggcttggggttcttttccagagtgattaaggggagcgatccgtcttctgtgaggccggggagcagcgcttgctgccagcgaggaccaagtctctgggctcaggatgggggcccttccctctcctctgtccagggagctggagggctgaaggcagcaggagaggcaggcgggactgggtctgactagggcatgtgggggtatttgggcggtgcccttgtgatctcagcccggctgtattcctgctggcttgtcactgagcctcacgccatgg

SEQ ID NO: 31196 - DNA, 662 bp, Bovine  19866881232271
ttttctctttattatttatactctctaacctctccgctgggtgagtaaacaggcgcattggcccataatgaggaacagactgctgcctggggctgctggaggggcacggggctgagcgtgagagcgtgcgtgcgtgtgtccgtgtgtctgtctgccccagagagggaagagtgggagtccaagatggagaagacttgttggggggctccgggtcccagccggcagggggctctccacatggtgcccggctgcagcggagcagggggaccccccccaaccctgccccggctggctgctgcctccgggaccctgagggttgcttggggatcgagtgtgctggatggaggaggagtcagaaccggagagactgtgtgggtgggagaggatgtgagaggtacaagccaagtgtgggtctcagagcatgacccccgcggggtggcctctgagtgtggccccggggtggggtgaggaatgtgtcagagggaggccgggcatgcaggcgtgtgaaggagcaactgtaaggggtgtgtaacaccaggagactgaagcagagtgtgtgtgtgtgtgatcctggtggcgtatgtgggtatgtgtcatcctgtgactatgagaatgtgtgaacatgtgtctgcgtgactttgagcgtatacatctgtgtgcca

SEQ ID NO: 31197 - DNA, 1206 bp, Bovine  19866881286675
cttcccggggctgtcagtttaacggacaggtgtttaattccagcctgtcaggtgcctggaaatgccagcatcactgcacatcagttcgtggagcttgctcttacaagaacagtgagaagttgaactctgctctctgtagctcggccctctgtgtcttgtctccatctcatcgggcaaatgtagttgcaccttgcttactggcattttcctctggggcagatgggctcagagagcctggcaaaagaggccaaaagcttttccaagtgcctccagtggagaatgagttcccaagccctaggtgtcatcaattacatccctggcacgcgctgggcctgctttttaactattaaaatcatgtaatagctaaagcacactgctcctgcagccgcggggcagagaggcagctgtcagctgtgctagccagcatataagctgcttctctcctctgtacctgcgctactcaggcatgagtcaggaacaacataaacccaggaaatacatggaggcagccccaggagtctgtccagaagcttagacatgggtgtcagtgcgtaatctgggattcactgtgtcatgctacccccagcaagacttgccatgcagctcatctatcagtcttcgggaaagtctccatgctctgggctagagacagatcagaggtcagaaaggagaacccgtctttgatggttagggatgaagcttaaggaactgggtcagaactgggcacctctgggacatgttaactgtggccagaggacagagctggacagcccagctcaggtgatgaaagcacctgaatggcgtcctggagggttgttgggctaaccctggcacacagcttctcctcttctattccttcccacacatatccactcccttcctcgcttatctatttctttctgctttcacacctcctacctgtccccccaccagacctccacccacccacatacaccaacgaggcatcacggttcctaacgaaacggaaccactgccagatgaaatatattactattaaatacttaattcttctagtgagcagagagcaggcagtatgaatacgattattaaagaaaattactttggctgatcagatatttctgcatactaatttctgacccctcttccctcactcccgcttcacgtccctcagagaccaggacagataaaattccatcacaaatagctgattaccgaggcctgcat

SEQ ID NO: 31198 - DNA, 2348 bp, Bovine  19866881398645
atttaacaatagttttcccatcttggaacaaaagcaatatactcatttaattatgtcagataatgtaacttaacaaggactcaaactttgagtgcaaaatacatagaaaaattagctaaaaagtcaaagacactgaacttgcaaaatgcagctattttctgccatttgaggaggtggaaaggaggtatagggctagagcttacttgtttatgatgaatcttctgtgttcccagtggaaagatccagggttggcatttcatccctgagtggagaaggcgcagactacatcaatgcctcctacatcatggtaagtcagagagctactgggaagaccgactgcaagcttatgttgccagaaccaaaaacagggtggtttgcctgaatcagtgactggcaaataccacgggtggacacgagtcaaatctgatgactgcaggttcgcagcccacagcaacaatggaatcacagcattccttggtgttttcatgtgtgctgggactggaaaaccctcggtcaatgcaactgagtagatgcaggaaccaaactcaccattcagaactgatgttcagttcagttcagttgctcagtcgtgtccgactctttgccaccccatgaactgcagcatgccaggcctccctgtccatcaccaactcccagagtccactcaaactcatgtccatcgagtcggtgatgccatccaaccatttcatccccggttgtccccctccccacctgccttcaatctttcccagcatcagggtcttttcaaatcagtcagttctttgcatcaggtggccaaaggattggagtttcagcttcaacatgatgagtagatacaaaaccacttacctatctaagtggctccatttcattcaccaaagcaaatttcctgcagaaccaggatacaccagcattagcaagtccagtctcactgacatcactccaggtctgcagcacagttctcaccctgcaaactgggctcatttggcgacttagatttctaaagattcaatactttctgtctgcatttagctctactatgagaggagtgagtgctttagctgttttttgaccttcgtttccatttcaggccagtccatcacagagcttgccttcagatgaaagggtcctaactcccatgcccaaatcactattctatttaactagaaaagaaaataccaaggcatatctatacaggaaacaaggagatatatgtcggtggcatctaaaagggcttccctggtggctcagatggtaaagagtctgcttgcaatgcaggagacatgggttcaatccctggagcagaagatcccttggagaatggaatggctacccactccagtattcttgcctaaaaaattccaggacagaggagtctggagggctacagtccctggggtcacaaagagttggacatgacggagtgactaacactttcatttttagggcttcccaggtggcacagtggtaaagaatctgactgccaagcaagaggtgcaggagttatctaaaagcatgccatacttaaacgggcttcttaatactatacgaagcagatgtctttactcaaaaatcgagaatggattgagaacaaatgtaaatattgctttgtgtgttagttagataaaaggctgttcttttcaagaaaataattaaatgctggctacctacaaagcttgccacagtatgtctgaagatttgcaaaatagaatgaatttttatctacttggaatgatacgggatattgactgaagttgcaggatagactggaagtcctttcaaggtcttttcctgggcttccctggtggctcagtggtaaagaatccacttgccaatgcaggagacacaggttcagtctctgatctgggaagattccatgtgctgaggggcagctaagcccatgtgccacagctattgagcgtgtgctgtagagcctgggagccccaaacaactgagtccacgtgccacagctactgaagcccgcgagccctagagctcgtgttccacaggagtggccactgaaatgagaagcccgtgcaccataactagagaggagcccccgctcactgcaggtagaccgaagcccttaaaacagcaaagacccagcagaaccagaaataagttaaattatttttttaaaagatcttttcctacccaaagcatctacaattaaggagaaaaacatttaattatgtacaacctactcattcaaatctgaatatatgaacttaaaagttttctgcttatcaaatgagattgtaaccaaaagaaagtaaattgagtagaattctacttgatgaataaatgaagataaagcttaaaaaaagtaaaaaacattccatacttca

SEQ ID NO: 31199 - DNA, 734 bp, Bovine  19866881534340
gaggcagaaccttcctctttctaatttcaacttggcaacagcttaggttattaacctactgaaatatcctccagggtctccctctcacaccacgctcctccccccatgttttcccagcattcactctctgagtctctttttctccagggctgtgaaacttaaacttttttccattttcagatctttatgtgcggataaaagacgacatccctctgcccattcctatctgatgctagatggagatgcagggcatcagtggtgagtggaagggctgagaggatgcccctaggacaaaggggaagatggaggtgagatgtggggaggccaagagggaaggaagctttgaacctggagtcgggacaccttggctcaggacctaattctgtcactcactcaacccttgtcacttttctcacattctattggttttacaaatcactaaggccaaccccggttcaaggaaagaggttagactccacctttgaatgagagggttgcaaagagcatgcggccatctttaatctatcgcagcataaaagagaaactgtggtatagcggacatcagaaggttcaagtccaaccccaacctctacttcttaccacatgtgtggtttcagcaattcatttaatgcgcttgaacctctttttctttatgtatgaaacaacaacaaagaaataaggaaagaaagaaaaagaaagaaggaacagagggagggagacaggaacgaaaggaa

SEQ ID NO: 31200 - DNA, 756 bp, Bovine  19866881686033
ttaaccaaaccttggcattcggctcctcttgccctcatctttcccagctccgaatcaatggctttgatatgctaattagggagtaatttaatttcaaaaggccgcaattaacaagggtgttgtggacatgctgtagttaagcggagtaatctaatttgcattagtaacaagcagggactaattagaagcttaattagacacttagatggctcttatgtttactttcttaacgagatggagtgggctctttggttctctttttttctttttctcattgttaattctttcttttggtcacggtactcgaaagaagtgttgagggaggccaccttgctagggcctggtggaagcattttggggcaggagccagtgaaaagtgtgctggggcaggggcatggtgatggtggcgaggcaaggttcggattcctgggaaattccagtgaccgccctccaggctttgccaccttgagatggaatcccagggaagagctctggtttgggagctgtagggtttcagtttggctcaacctcctagcagccgagaaaccttgaaacatcactaaacttcctcaaagtgtggttccttcaaacgtcacagtgagtgcctgtgtgtgacaggacatgggaaagaactttcaaggcctctgtgagtggaatagttgttactaaaatatattcacaaattgtgtgcccaggcttcacttactgaagactcagctcagaagtcacctcctacaggaaaccttcccggagcat

SEQ ID NO: 31201 - DNA, 729 bp, Bovine  19866881740023
gctagcttaaaagacctatgaaatagctattaatttgtcgagcagtgacttcaatactcatgatggtgatcttgaaaactggaaaattataatgggtcagcttaattctgcaaactattaataagactgctgctgctgctaagttgctttagtcgtgtccgactctgtgcgaccccagagatggcacccaccaggctcccccatccctgggattctccaggcaagaacactggagtggcttgccatttccttctccaatgcatgaaagtgaaaagtgaaagtgaagtctctcaggttgtctacttgaaagttacacagtcgtgtctgactcctagcaaccccatggactgcagtctaccaggctcctccatccatgggattttccaggcaagagtactggagtggggtgccattgccttctccaattaataagactaccctcattcaaatattttccatctaggtcccatttatattgtttatactactgtaatatagttttgaatggggggtggtggaaattcagatatatagaacaaatcactgtaataggaccaaactaaaaatgtagaagacatccctttaaatagttattagtgataaagtcccaaacaagcaaattccaactgtacctattataagtgaaacttgctgaactctcaggctttgtggcatgtgcaaggcaataagagtataggacgtagagtaacagagcccagttatcatcat

SEQ ID NO: 31202 - DNA, 838 bp, Bovine  19866881838164
ccagaacctaatggtctgtccctgtgtgggtgttaaaactcaagactctggtcataactgattgtgataatttcctaaccactgccatggttaaaaatgcatttatttttaattttttttttacacagatgttcatagcagctttatttgtgatagctaaaatctgacaacaatccaattatagatcaaaagtgagtagatattacatcccatacaatacaatactacccagcgatgcaaaggaatgagctacttatacacactacaacatggatgaattacaagttatgctgaattaaagtagcccacaagtatatcctgtatgataccacttatataacattacttaaaaatgaaaaataaggaattctctgatggtccagtggttgggactccatgctttcactgtggaggttggggggagatcaatccttggtgggggaattatctttagctgcagggaactatctttagctctgatatggcagattccaaattacttctgtatctgcagcctccatttggccaccagggtaatgatgtcacccagtggattctcttccactgttcagagtgccaggagcacgttccctgtaatattcaggatattccctccaaaacagagcacacgctccaggatgtcactaatgtaataactccggaagaccagcgggtcaggaagcagcactgccaacggggcctctgctggccacagagtctccccctggtggcagcaattatgaaatatttcatatgtacagaagcatgtgaataacatatacttgcagtttggagaaaactaataagatcaaaccagtcaatactaaaggaaatcaat

SEQ ID NO: 31203 - DNA, 2028 bp, Bovine  19866880451750
ctcagccatacagatacatgagtccattctccaaactcccctcccatccaagcagcagagttccctgtgctatacagtaggtcctggatgggtatccattttaaatatagcattgaaaactcacccatcttaatgaaaaactcaatgatttttaccagtggtacaaccatcactgtaattcaatttccgtattaaacatggtttcatcactccagttagatctcttgggttcattcacaagtaatcctcactcccaacctcagccttaggcaaccactagtcttcttgtctacgtagagttgcctcttctggacatttcacgggaaatggtatcatataaaacgaggtctttcacgtcctgcttcttttactacttagcatactgtttccagtgttcattcatgtaacacataccagcacttcatccctttctattattgagtagtgttccatcgtttgcttatcccatatttcatttatcatcggctgatacacatctgggttgttcctactttggggctattttgaaaaatgctgctatgaacattcatgtacaagttgtgtgggcatgtctgtgtgtgtgttttttaaccatgtgaataggttatctgtttaaaaaaatctttgatatcacaaaagattaaacagcacatgaaacaatcttataaggaaggaagtagcaaagcaatgggcgtgtgtgtgcatgtgcctgtagaatgatttgattctgttaaataattaaataagaacataaaaaagattagaaaggcagaaagctaaaatgttaacagtgttgtctctgagtgatgggatggtggataatttatgtatttgtgtgcttttctgtatttcaacaaattgtctactgtgaatataaattacttttgtaatcagaaaaaaagcacaacgttattggggaaaaaaaaaaatccttcccattcaatttctccaacctctctgttgcagaaagatatcttcgcagtaggccacaaataggggagggagggcatccctctttctctctctctctctctctcgctctgtttaatgctggtcacagcatccagaaaactgcaggatccccaataaatacaaatcaattttggagacctcgagatcagtttccatggcaacctgacaagggcatgatattatatgagttctgccccagcgtggagatggtccactaggaagaacacctgacttgaagagcccgaggtggccaaagggccatagtatttatctgtgtggcaaaggcatcaggcatcctaagactcaaagagatagacatttctccaaataatgggacactggaagcgtgaactgatcatcctgattgtgggttccctgaactgccatttcaatttatacagctgcacacagatgtcatgattcagtattttccagaactatacttaggaactaagtgtccttcctctctgcttacctcatgcacaatttcatcatattgcttcataattactcacttgtctgcacaaggcctgtcccttatatttgcaggacttgggacaagaggataattagaaggccacatctcacatgttcaaaaagttggaagtcataaattgagctaagttaatgctagttgctcagtcatgtttgactcttggcgagcccctggactgtagcccgccaagctcctctatcagtggggttttccaggcaagaatactggagagggttaccattcccttctccaggggatattcctgacccaggcatcgaacccaggtctcctgcattgcaggcagagtctttaccatctgagccaccagggaagtccaaatcaagccaacacactgttaaataagggccatcttatcttcctctaaatacattttcagaatgacctgaagaaccagacacagattcagatgccttggactccctggaattgtgagacgggacatgcagcgtcagaaaacaagaccccagattgttccccctttcaatctcacagcaaaggagggtccaggcacacccaacctgaaccactccacacacata

SEQ ID NO: 31204 - DNA, 2591 bp, Bovine  19866880472839
aatagagatagaagttagatttttaaaaaactaaggccggaattccctggtggttcagtagttaagatttcgccttccaatgcaggtgtgggttcagttcctggtgggggagccaagatcccatatgtcttgtgaccaaaaaaccgaaacataaaactgaagcaatattgtaaaaaaaaaaaaaaaaactcaataaagactttttaaaaatggtccacgtcaaaaaaatcttaaaaaaaaacccaccaagatcaacacactttggatatctggatgactccaggtgacaacaaagtcatctttctttaagtatccttattcttatcacaagaccagaaaacctccagccccaaccctcttgacagcaagaatgggatctgagaaacttaaaatataagccaccaatcttcaccccacaccctgctatggggtccatgccctggccattgggtgggggggaggtttctaatggccacatctgaacactaatattaatagatgcatatgttgccaaggaaggttaagataggatgggtcaacatgggacggttcatagtcaaggcacaacacctatacaacacatgtcaaggcagctcgtgtcaatttctctgtgcagaggttcagggtctttgcaggagtcagacactggcctgttgaaggtacaggggaggtgtggggaacaactcaattaagagcaaaaaggctgcaggttgaaaagagcaaacctaagacttgctgtaaaccccttggctcttagtccccccatcaggggtcaggggcatgagcaagcgggtgggccaggctctgattctgacccagaccctggtgggagacagacacacattttgacaaacactcttcccccaattttgaagcccctgtggattgcaagggaaatttaatccatatgtctccgattcatttatactaaactcatcaacatgttgtttcgtaagagccgttttgtgtccaaaagcctttttaaaaaaaaaaaaaaagctcttaaaacctcaggttttttttctttgaaacaggaaatcatacgctgccaagagaacaggaacttgaacccttagagggtcaaactgggttcaaagccgctgcttccccagagacctccaccaattggaggagtgttcactgcccccttgccccgctcacctctcggggaggcagagtcctaaaagcggccaaattaaaccaggagaagcagaggtgggggtgcgggggtagaagcagttgggctatgtcagggtcacactgttctgttcacagccaaggctgtgctcctcggagcccacagaggcctgcaggagggagagagagctggccaggagttccgttctgcttcattagaagtagcatcttgacaaaacagaatccctacaagcaggttcctctggaaatggcccggggcccctggcgtggagctctgtcgtgggttttggcaaggtctcttgaacggcagtgaacttggaaggtccagaccagatggatgaaggatgacgctctgctctggcttccccttccccctcggatgcacccctcaccttgctgagccttccctaaggtttcatatccacaaagacatctctctgtccctgacccggtaaagctggaggttatcaagggcaaagaaaaagagcgggttgatgtccttaaacctcagagatgcctttcaatgcaggcagggatcctgagaaatacttgctgggccaccctaagctctggccagcctgtggcgaggcacgttctctcctcaacaagaaaaccatagaatcgaagcatgagcaagcaccatttatgggaatgtgcacagtctgtacacacagcacagttggatgatctatatttcagaggttgacaatccctgatggcttccctagagagcaagaagggaattcagcgtgaatgcttatgttaactaattcaggggtcaaaagggtagaaaacaaggtagtcaatgtcagatagagcagaggcaaatttagtgcaacagagaagctacagatgataagaaactccaatcctcttccctccgtcatatctttaaaagtacttatttatgtatttctttatttggctgtgtcaggtctcagttgtggcatgtgagatctgtgtgtcatgtgggatattttcttgggtgcacagattctgattgtggcgtgtgggctttgttgcgccacagcacatgggattttagttccctgaccagggattgaacctgcatccccggcattggaaggtggattcttaaccactggaccacaagggaagtccctcttctcttcttgcattgagaaacaggcttaaaatcaaacatcatcaacataagggatggggcttctggaaagcccccattactcatagtcaaggaagcctattatagtgggtaagatggattactaatattctctttccttgttcccctgactcactgatgctcaacttggtggggtgacctacttttggtggggtgacatgcagagacagtaatagggacagttccaacccaagagagagagaatgtttccttgcacccctgtcatctatcatgagaagaacatgctctaccccttcagctggggctc

SEQ ID NO: 31205 - DNA, 950 bp, Bovine  19866880483863
atcaagaagggaaaaaaaattaaattccatcctcacaaaggcagatgagacacatgtcagatcagtagcaaacattaattaagaaaatattctaaaaaagtgaccatagtcacaatgagtgaattaaaaaatatttagtcagaatttcatccagttatagaaacacaaagaggctattttattaatcaccagtttaaatgttttgtaagtgtttttaatacatttttaaaattctcagtcaagcacttcgtctatctatccagtccattaggatacaatctacttgtttgaaggttttttgttgttttgttttgtaggttgttgttcagtcgcttagaggtgtctgatgttcgcgaccataggaacggcagcactccaggcttttctgtccttcattatctcctgaagcttgttcagacttaccactgagctgatgatgtcatccaaccatctcatcctcagcttcccccttctcctctgccttcaatctttcccaacatcagggtcttttccaatgggtcggctcctcacatcaggtggccaaaatattggagcttcagcttcaacatcagtccttccagtgaatattcagggttgatattttgtacatggacctcacttatattgaagactgctctcatttgctattgtctggcttacatgttaggttttctggccttgtcctgagtgtggaactcagactgctttgcccgccatgactcaagatcaaagatggaaggagatagtgagattgtaagtggaatccgaggctggtggcaggcatggtttggggaacacagtcaaccaattaaccaatgagctcttatgattaagtacttgctgtgtgcatagggatacagaagaagccagaaccagtatatacctgaacctcaactgacttttagagaaggcagtattggtgatcaacccccgaagagcaggaattttgc

SEQ ID NO: 31206 - DNA, 1293 bp, Bovine  19866880515142
atctgtgcttccctccctattcccgataggggtaggcagggagcagggcaagtggtcaggacttcagcctctcctcttgtaccttcctcattcctgctcaggtctgtggctctctgcatccctgccctaacctctgcatttcccaaacaaacccttttcaccatttttgccaaaccagtgtgtaacctccattatcatttacttaatatctttccttaaatggacttctttttaatttaaataaatgtattgaataaggacactttatgtagcttcttgggcttccctggtggctcagtggtaaagaattcacctgcagtgcaggaaccactggagatgtggattcgatccctgggtcaggaagctccctggaggagggcatggccacccactccagtattcttgcctggagaatccccataaacacaggagcctggagggtacagtccatgtggtcacaaggcaggagggaatcccctcttccttgagggatggtcagctcttttgttctgttcatgccttcagctgattggatggggcccacccacagaagggagggcagtctgccttctggagtctattgtttcaaatgctaatctcatctagaaatgctcagaataatgtttgaccaaatgtctggggcccctgctgtggcccagtcaagctgacacataaaatcagccatcacatttgccaaaaacataagaaaaatacaattagaacttcacaattttatcaaagaccagctggaatctacagtccctcttaagctctgagcctgagacttgctattttttcttctaaaagggagactagcaagtattaaaagtgcacggatgccacgctgagactttcacctaaaataatcatacagattgtatgtatgattttacatacaataatcacatgtatatgattatctttcccactgtgtgatctagcccttcatgttctcctgtaagtcatccccagtgcccaccagtgaaatccacacccacccaggggcctctctcccaggcgatggacctctgaaggctaagatcacatccagacgacagtcacatcgcctgcagtgcctcttatacccggagtcacttaataaacagaagatgggagatggcatggccaggagctttctctgacctagttggtggtttctgtcagaagcagcacatcatgacagaggagacagagccggaatggtgaaccacactaacggttccatctaccaaaaagctcctatggcactttggggcaagggctgtgtctacaggaatgaaaacactcgatagc

SEQ ID NO: 31207 - DNA, 2241 bp, Bovine  19866880600703
gcttaagtgtttgacctgcagtcctagaagaaattattaatggggaacttataaggttttaaacattaatgtcatctcagagcctcatactctgtccaaggaaatctcaaggacagaggagcctggcaggctatagtccgtggggtcgcaaagagtccgacacgactgagcgactgactaaataacaacagagcctccttcacagtcagtctcagcatgtagccgataagctggcaacctgccgagatgctaaatcatctctaagatcaggcagagcaggaaggaatacacttgtaattcctgaatacccaacagtgttacagttttgttttgttaaatatctccaggaaagccagtagacaggatggtgctcagataatagtattctctggatcagagcccaccgtagttcaggtggctgagcaggtacaaacacggatctgatctgtgcacgcgggcagggtgcagcagcaggtttgcttgagtctggaatttaaaaacacaggtggtgagcaaaactctgaaccaaggtaaagccccttagcccaaggcctggcttccctgttcccctatcagtactgtttctcgacctgaaaatgaagagtcctgagcaagagatagccagaggacagagcagactggcgggtggcgggcaggggggttttcaactcagcagtgtctggaccagtgtggtgaacccctgagttcacatctgactcacctgggctacttcagaaatggattcttaggtcccatccagaaatctagggcagagtggaagcatcagagtcacatggtcctgccattcagccagcctgatatccactggtcttggtaggggctggcaagttggcccctacccacccacctgtggccagttgagtgatttttataaatagaactttattggaacatagtcacacctattaactcactgttgtctgggctgtttctgcacctcagtggcaaagttgtgtagttgcaacagaagcatcatggccagcaaagcctaaaatatttactctctggccctttacagaaaaaatgtgcaggcctccactctaggggatactggattttttttttttaaacaacaatgatctttataagtattactgtaagtttattttgtctttgtttttaacaaagatagtcgaggtatctgtggttgatacagcaagaaatagaggtttgacttaattttttaaataattttatttatttattttattacttatttttgactatactgggtctttgttgctacataggcttttctctcgttgcagccagtgggagctactctctaggtgtcgtgtgtaggctgcttgttgcagtggtttctcttgttgtggagcacgggctcgagggtgttcaggcttctgtagttgcggctcctgggctctagagcacaggctcaatagttgtggcgcatgggtttagttgccccgagacatgtgggatcctcccagatcagagatcaaacctgtgtctcctgcattggcaggcagattcttcaccactgaattacagggaagcccatgttttatttaattgcagaaagaatagtatatagaggacagaaaagagtgatctgattataccagaagagataagggaggatggggattatggattaagttctctttccagcagaaagtcattagctgtgtccagagtcagcaactcagggaaacagccactggaggacggtgttcacatatgccgtgttctggcagcaccagaagtgttgggggcagcaacctcagcagcaggtcgggcagagggcggctgtcttttgttaccagtttgtttatgctcttggctttttttcaactacgtggttgttttttggggtttttttgttttttttaattgaaaaacaaatatcagaacaactttacctaaaatttttcttctaattgcagcatttaccctccaattccaggacaggaaagctctctgaggtgggcaggaaagaaattcgaggagatcccaatcgcacatattaaagcatcctacaacaagtaagtgcggaagggactcctgggcagggctgggggggaggcttctttcccctgcaggggggcgagcaagtcacatgggccccggtgcacagcaccccaccaagtattccttcttgtttggggaaatctcctctctttttataaagttgattcagaataaatggaactgtgaactgggtgcccgtatcatattgttaaagattcctttgctatc

SEQ ID NO: 31208 - DNA, 1638 bp, Bovine  19866880612370
ttggcctgtgcccgagcagctgtgcacaccccggcatgacttcagtccctgcagggatgggggagccctggccggtgcagcgggaactggggagcagaactgactcacctcgccaggctggctgcatctcgttttcctgagccgctttgttaacacggctattaagaagttctcacatggcttccccagtcttctctaacttccccggacagcagtgacagccttattaacggcaaacggcttctcgtggcagtgttccatttctaatattaataatcagcatttaataaaaacaaagcagggagagatacaggcggaaaaaaccagactgctttgcccttcgcgtttatcaccctggcaggagttaccagcgatagtctctgagtggttaatcccgcatcaaagacacgccagcgtatgcacacatgtacatacacatgtgaacacatgtgcgtacacacctgttctgggaaccgcacttcatccctctcttggccaaagtcagggttagaccctcctccctccttcctgccatacccaccctccggctccccatctgagcatctcaagtgactttgatggttcagagtcatgtcatgaactgatgtctttcaaggaagggaggtaagggaggcgggcgggctggcgggagctgctggctcttgcattggtacctttctccgtttccttctctctccatcaggccagtcatccgtaagacaaatggccccctcctgccaaggctgaggagactggaggtaaagatgtagttaattacatgtactcaaaaaggtcaactctcaagattaggagctgcgtttatcaccactaaaaataaacagggctggggaggacaggatggaagaaatgggagtggaaaggtggatgggggtgaagagggacttggggctttggatccttggacgccgggctgatatttaaagacctttgacgttgtggaagatctcagcaagcagctgacatctcctggggcctggggaggttttcacgataacaaacaatcccacctggaggctgagagggctagtcccctctctgggtgtgcggaggctgtaagaaaaggagatctttgtttgcggtgagaagtgccattcttttattctctccttcacaccccagctagtagtcctcatcccattctcgtcctctacttctgagttgtgtggacatgaactggaagctttacagagagggcgcacaggcaactgtcccagaaggagagtgctcccagggcttgcctttcccaggatagtaagttccctacatacaagcaagttccattccaagagctaattttttaagtccagtttgttcataagcccaacaaatttagcctaggcacacaactaacacagttatatagtcctggattgtaataggtttatacttttcacacaaataatatgtaaaaaaaccaccgcaagaaataaagcaaatatttttaatcttacagtatggcaagaatcccttagaagaaatggagtagctcttatagtcaacaagagtctgaaatgcagtacctgggtgcaacctcaaaaacaacagcatgatctgggttcattttcaaggcaaaccattcaacactacagtaatccaagtctatgccccagtcactaa

SEQ ID NO: 31209 - DNA, 860 bp, Bovine  19866880652206
gggggcatggcgatagacctgtaggcgggggttctggaacattctggggtgacctaccacctgctaacttcccactctctaagggaccctccttctttgtctaaaaactcaatgaacagcctggtcaaagggatgccacgggacagaggcccctgggtggagagggcttggggcaggggaaggggaatcaacctggaggcaggaggcccagccccacctggagaggggcttccagtaaggcagggacacaggcacagctggctgtatctgtagacacctggcctgtgtgtgcaggaatctttgcccagactactgcccccaaggtcgtcaggccctccacccacacctccctcagacgggaagggagtgaagggtggcgagtacctttggaatggaaacatctctccagctgcccctccagtgccccgaagtgtacggtctgaggactggatcatgaccctgtgctcggacccctcccctcctcaccgtagatgtctccttgagatcagagggctcagggcacctgcttcctactctctcttacctcctggtggtttgggtcctccctttgcacttctgctgagtctgctagggcctctcctggcccctggagccccggtgcctctgccctccctccggcaggtgttccccttgctgtgtccccaggttcaaatctaggctcagtgaccccattgcacacccctccactgccactgctcctgctcccccagaatggtcagtgatgtccagagagggagccctggagactgccttagagctggaagggacagaagagatgggttaggttaaggcctcatgtgcagacaggaaacccgaggtttggggaggcgggagtcccc

SEQ ID NO: 31210 - DNA, 3561 bp, Bovine  19866880683604
ctggtggccccacagtgaccctttagtcaaactcagctgctgcctgggcagtgaatgtccatccggtcatgccctctccctgggcttcggatttccttgtctgctttttttttttggtatttttatttttgtttatttacttggctgtgttggggtttagttgtggcatgctgggtcttcagttgcagcatgtggaatttagttccctgaacaaggatcgaacctgggccccccgctttgggagcacagagtcttagccactggaccaccagggaagtccctatttttttgttcttgaaaggctgtttcaagggtaagagcacaggctggcacctgcctgagtttgaatcctaggactgcttctggccagcggtgtgacatttccgtgcctcagttttctcatctgtcaagtggggataatagtggtatctgagtcacaggtttgtagtgaggtttgagcaccggctgtgtgccaggctcaaagtcagaccgtgtgttggggggacgtgtagatttggagtgtgtcagagttgggctctggggtcggaacggatgcctgtgtaacaggggaggtctgggtccctgctagctgacacgcagctcctccttcgtatcgcagggccctccctaggctcagaagtttgctttctggctcctgctctgaggccaagagattctggctgcatttaaggtctgcaagaaaccctcgctcaggttgcaatctgtccagtgtcacataagccgtattgatcaattcatcttatatagttgggaccaaacagccctgtaatctttctattgtgcagcctaattggtctctaggcctgtgtcattagctcgcttgtttgtaatctgactccctgggccggcctttgtgagccagcggacaagaagaccccagcctcgcctgccccatttgcccatccccggggtgggggctgaccttggtgccccttcatcctggcctggactccttgaaacggtgtgacaggcacgggcaggtgaactccttgggtcaaggagtgagcatagcagtgggatcactggacctgggtcccggccctgcacttggcatttatcagctgctcaccttgtttatttaccgtgtttgaaatcgctctgttttttcatctttattgatctttcctgtgaatgtgtaatgacattataaaacacttaacataaaatctaagtgaaggaaagctaggattcaagttgtatatccataattatctcatctgcccaagaatgaagatgagtgaggatgcccccaatactgaaggtggctgtctctgggagacgtgattataagtgactttaattttctcagtatcttttcattttttccccaaacttcctgcaaggagtctgtattactttacaaccaggaaacgaatcattgaaattagtcagcattaggttcagcaatgatagattttcttcatttataaaatcaaaacattggactggattcccaagcctggctttcagtgcactagcatccccagaagagcttgcttactaaaaattcagaggactgagccccatgccggggactgtgatgcccggcgtttcggctgtgcatcgaaggtttagaaccttgggatgtgtttctctcttggactctttctaacacgatcattccccatggacgcgttgttttagaccgtgggtgggaacaagggagccctgtggccagccacctcccctggcttcaagaaggtgcttttcgaagctgggaagaagccggttctggagtatgtggcctttggctacaaatgggtggtcccaaaggtgcgtgggcacgtggcttcgcccagaggggggccctttgctcagccagctgcttctcagagccttgcaaggtagagtcatttcccatctgatcacatttcatccccaataattcacactcttggggttcctcttcccatttcccacataggaggcacaggaaagctaagcgacttgccccgtgccacacagctgctccaggcagagcctggatttaaagtcccatctatacctgcacattttaaaaatttccagcaggttccactgggggctggctctcaggtctccagcttgggggtctttgaggtcctagctgtccctgtgggcagcagaagctgggattttatttgtgtggtttttctggtgggctgtcttcccttctccttgcctccagcaggacgcctggctcgaggagtctcccctccccgcccccaaatgcttaagctgttttcttgtttggggcgcttttgcagtgtctctctgtgtggccccgcgccacggtcattctcattgtcatccttgccattggcattctttttctttcttatttcacttattttattttctcttattgtgttttggtcttctgatgacatcagctcttaaacccaagccagctaaattatagccagatttgcttggggattttctgcaggcttttgaagcgcttccctccaggctgtacacaggtgacattttaggttggactagtgggagcatgggagcaggttgagggcagtcctgggtttgaatgcaagtttcccactgagggctgtgttacctcgggggtccctggtttccctgtgtgtgcagttgggtaatgacatccgtctcagtggggtgtgcagtgcagggttgtatttactcagttgcagagcatgggtctggaagtgctcaaagtttgtcagtcaccaccatcagtgctcttctggtcttgattttgggcttccccggtggctcagtgataaagaatctgcctgccaatacaggagatgcaggttcgacccctggattatgaagattccttggagaagggaatggcaacccactgcagtattcttgcctggagaattgcatggacagaggagcctagcaggttacagtttatggagtggcgaagagtcagacacgactgagtgactggacaacaagtcttgattttggaagcctgaacaagtcatcactccaggagctttggttcctgccaggataaactgctctggaaatggaaatgccctcatagttgggctggtagaggcctggccttggtcaaccttgtccaaggagaatgatgactacttctagagttcccagggcaagggggacaggataggttctaactcctaagcttcctctgggctccctgactgcagagcactgaagccaggaggccagccttctgcctcgagggaccagcctccagcggctctggggtccccatgccactgcagtgccccagctgccagcccgggctccccctcccttcccagttatcagggacctgtcagttcagagcagatagcaccattatataccaacagccacacagctggctggagaggattaaacttaatttgctgcaggatttccagcctcccctgtcccttgcccattgattctttctctttgatgttgaaaggggaaggcggacttggctaatgggcctcccgctgtgtccaggcggtgttgtcccgtacgtgtgtgcacctctggccctcagaagcccttcctccatacaggctggggctgtttacttatttcccatca

SEQ ID NO: 31211 - DNA, 1194 bp, Bovine  19866880716593
ctctatatgaccacatacaattgtttcttaaagaatcagacacaggcactgtcatctctccaggaagtttctcagccattgtcagaattcattttcaatgacatgacataatagacttggggtttcattaaccgacagagcactctgagaaatcctttgtttgagcaggagagaactcagacagaaggtaggatttacttggtcaatagaacattatagaggacttccagaatcgaagctttgcatttagctttcttcccactttgggtcctaaagacattcccttaaggcctcagtgttaaagagtcttgggaaaacaagcaggaagggatggactggggacccatgccagctcatgcaagcaggggtctagacttcagtagaaggctctccagtctccctgagaaaagggtcagcatagggtcagtagctaagcatgattaagagaagggcacctcctgtctaacctctgaaagtccatctggccaagaaaggctgagaccttgtaggaccttgtcacatcctctcgaaggcgggaccggtgacaaggtagggaaagtgaggtgcttttgccatgctttcagtggaggtcgtgaacagagggacagcacggtgagaaggtgatacatgtgtacttagaaaaaatgcacgttttctcacaaacagcacctcttccttagagtctggcactgttcttttgccttcagttttttgtttttccacctgaatgattcatcctctttcattgaaggcgttcactcaatgcgctttgacatgaacccttctctgagttttcccccaggaaatgggggttatgggttcttcttccatgtttgctctgctttgtatgaatcttgtttgtaggaatcttcacctgatgaagaatggcagattctttgactgacgaagaatggcaaaaccaccattccatcaatggtttacctgcttatctaccttttaggacagtgacgccatggataccacagaagacatcttttactgtatatttcaaggaccaagctttgcccagcacctagtgggtatgccaatcaatggggatgaaagaatattccatctgaaagccctttaggcactgacagcttgggaatcttggataagattgttttcatatatcaatgacactctctcaattcttcccaccatgagttggggggggagggagacacaagcggg

SEQ ID NO: 31212 - DNA, 1303 bp, Bovine  19866880716851
tgtgctaaaggaacagcctactggaaatctctaatcattgagacagaaggaaagtgaacttgtcacgcactggcatttacagcttctttattagctgaagcaagtcacatggctatgcttaggttcaaaaggatagagatgtgtaatccttctccaaagagtccgaaagaaaagacacaaaatatgagttgaacggttatacaatctcccataacccttgacttcccagggtttcaacttcctcacagtacatctgtaagttctcaccaacaccactcacattgtcatcacccaaagcaccatcattctctgtcacttccaaaaccaccatcaccagcctcgtcacagccacagcaacatcctcatccatcctcatccacagcaacatcattaacgacattattactaccatctttaacccaggctccctggaaaatagggcctgcctgggggagaagctggcctaccgatgttttgctgcagagtgcaataccagggaaaaagagactgaggcagagaaagaggggcaacaaatagaggggatatttaagaagcaagccccagtttcatgacaaatgcaatgggctggttcagtcctgcagatcttcagatcttcatggcccatctgctgcacttctttcatagtttacttgtgaggaggaatagagaagaattaatctgttgattccttcccagcccccatctcccactggtcaaagtcggctctatggagcatttcttcccttgcttgtttgaaaggtgtaacctggtctccccaggcaacttctaatggagccagagcttctgagggtccagaacagagccatcagtctttcttgttcaagtagcctccatctgcagtgggagtgatggcaatgctagagatctggttttcctgctgtgggaacaatagggtgagctctcgctaagcctgctcaacaggagagcaaggcaagtgaccaaggcccaggcagagggaaggtgtggacacatggacttaaggtggcacaaaacttgggtcccatgcaattacccattgtgcctttcatatctgctcatagccacttggaacacgtgatcttaggacaatacaccttcaattcttccccaagaagttagatagaaaattctgttcttcaaggtactggaaagttgcaatactccaaaaagaattcaagaagcttagtaagccaaacctggtacttctgtgctactctggctggtcctagagatgtcaaaactgacatttaccactacactcattcagcatccattcgactagtctgtgtttcttccctgcggg

SEQ ID NO: 31213 - DNA, 1663 bp, Bovine  19866880792536
cagtggagagggatgtgggaaagggatagttagggagtttgggatggacatgtacacactggtatatttaaaatggataaccaacaaggacccactgtctagcacagggaactctgctcaatgttgtgtggcagcctggatgggaggggagcttagaggagaatcagttcagttcagttgctcagtcatgtccgactctttgcgaccccatggactgcaacatgccaggcttccctgtccatcaccaactcccagaatttgttcaaactcaggtctattgagtcagtgatgccatccaaccatcatatcctctgtcatccccttctcctcctgccttcaatccttctcagcatcagggtcttttccaatgagtagttcttcacatcaggtggccaaagtattggagtttcagcatcagcatcagtccatccaatgaatattcaagactgatttcctttaggattgactggcttgattggaggagaatggatacatgtatatgtatggctgagtccctttgcttccacctgaaactatcacaacactgttaatcagctatactccaaagtgaaataaaaagttttttaaaaatgtgtttagaaagttgaagacatggatcatcaagtcaaacaactcatcaagttagtcatctgtgaccacttggtgacagtaacattgccagacaaacgcctatcacttatatggatttaagggagactctaaaagtattaggaataatgaaatataattaagtggccagtacccacagttggttgattctttactattctcacgaagtagctagaagctgatagtcacacactctgaacttgcccaagctcattgacaaccagacatcaagagtgaaagtgcaaatgtacaataatatcatcactcccacagttttctgagtttgggtccttcaattttaaattcctaacaccaagaaaattatgaaatgtttcataactcacccacacacacaccacacacatatagaaagacacacacagagagaaacacacagagaaaccacacatatataaattctggtgtgaggactattatttaaatgatgcctcaaccgtggagtcttcccatctcgatctcttagagggacagtgggacattctttatcattttgatgtataggatgtatgaccaaatagaggaaaatgtgaaattggaacttctatcattgtcctcctgggctgccacacccacactgtgaataatattcgccttactcatactaagacatgtgcaagccaagatgagcctactcaaaaaacaaagcatgtgctttaagccttcctggagctgctggaattgtcttgtgtttctcttcaacaaaatgcaacgattgctgagacactgcattacctgctgagcagttctgagctagacagcgtgagaaccctttcctgaatgccaaacaggtattgtcttctgtggctgggttgttttaaagagatgcaccccaggtctgaaataaactttgcaaaggcagtattctgtcaagagggctatgattatggttttggcccctctgctccagaatcttgactccaagaaacatactagatatagatggatagatatatacatacatacatacatgcatgcatacatacataggtcgatctctgcatgtccttagtaa

SEQ ID NO: 31214 - DNA, 2281 bp, Bovine  19866880800029
tatcccaatgttcacggcagcactgtctacaacagcccaggacatggaagcaacctagatgtccactgacaggtgaatgagtcaagaagatgtggtacacatatacaatggaatagtcgtcagcatgtacggagtggggtaagccctggccctttcagaataggggtcagggaccatcgaggaaactgtgagaggctccagggaggtgaccagtggaaacgcattgggcagcctgttggccgaaagatgcaagcaacttggagagagttcacagaaccagggaaagcagtcaagatgtgaagcatgactgaatttggaagtggaagggaaaacatgacccaggtgataaaaagggggaaaaaagacaatctggagaaagcacatgcaagagacaaggagtcctggctgcaggagctgctaaaagccgacacagtccacaaccacaggagctggatgagggcgaatattctgaagaacaggaattcaaaatcaaggtccttaattttactgattgaccccatcccttagctgcccaagtacttcctgaaatttgtaaagatttatgaaacaaggagacccagatgtaagctcatagaagtacagcggaagtactcacagaagaactaagcttacttactacctacttacttactactctatgagaagtaagctcatagaagtaatgctgcagcggaaggactatagcatcaggagtcaagagattgggttctagctttgtcctgtcccaaccaacactgttctccaagaagtcacttgatttctcccctaatgtccaattctgcagcaaaaagagggtggaggaggggatagttagtgggaacctgctgtatagcacagggagttcagctccgtgctctgtgatgacctagaggggtaggggaggtgagagggagggggtagatgtatacttacagctggttcacttcgttgtagagcagaaactaacacaacattgtaaagcaactctactccaataataataatgtaaaaaaaaacaatctttgtctccctattgcagcctgagacactgtcttcataacgtttggtcacttgtttcttccttcacactctttcaccaggatgaagattagagctgctgactccccactcgcccatcagcaccatgttttgactttgggtgagttgcccttgacagtctcttgctgttgccacttgccagctatcaacacagtgaaagccacggtttttccggtaagtcatgtacagatgtgagagttggaccataaacaaggctgagcatcaaagaactgatgcttttgaattgtggttctggagaagacgcttgaaagtcccttggacagaaaggagatcaaaccagtcaatcctaaagggaatcaaccctggatattcttcggccacctgatgggaagagccaactcactggaaaagaccctcatggtgggaaagattgagggcaggaggagaaggggatgacagaggatgagatgattgactggtatcactgactcaacagacacgagtttgagcaaacactgggagatgataaaggacagagaagcctggcgtgcttcactccatgaggtcacaaagagttggacatgactgagtgactgagcaacaacaattgcttctgtcttatgttttggttttttggcctcaagacacatgggatcttaactccctgaccaggcattgaactcgcaccccctgcaatggaaggcaaagtcttaaccactggactgccagggaagtccccactttcatgtgtagaacacaatgtgtccgtttccttactctacttcagcaggttgggctactgcttaacctgggaggactctgctggttcccacttaattcaatggaaagcctgaaattctccagtcttggcactctggatggactgatgtctcaatagacattagccaagagaaggctgtgcaagggctctgatgactaagagtcattcatcttcccaaatgactaggaaggatcatcatacgtaattccaactgagctacactcagggagaaaaagcacaatccagtgaggcaatggacatgatggtcatctcaccaccacgaccaccacccctgccccaagtgtatgctggccactgccaaatccagacaactgccagggctctcttggatactagtgagtgttggcctgaccacccaggcttaatgcctcagaaatgtccacccagaatgagggaaccattgaaagaggagagaccaagctactgctctcttgaggtcaaagggcttgggtgtgggaa

SEQ ID NO: 31215 - DNA, 1537 bp, Bovine  19866880806512
aaataatcagcgtcacatctagaggcatcaggccaggcatcacgcagggcaaagctgcaaagcaaagacggaggaagcaaagcctgtgaccgactgctttttccattctctctacgaggaggaacacatgatgttttctggtgtcatttttatgaacattctctgggctgatgtcggctcctatcttccttcatggcatctgcagatttaggtatttcttagtgaaaatcctctttagcttttatggatgttttcagagtaatcaaattctaggatttctatcacattttcccaaatctgcggcctgcagcccatcaatgtacaggcctgaaaacatttttttttgctagtgattcttccttcaacatggagatgcgtaagaactccaacttgcagggtgcagaggaacattggttttaaaatcagagcaacttaggtgtgagacttggatctttccgtcttcagccttttgaactcccatgagttgcttaaccccttcttccctctcctttccttccttctttggtgtgatgcttttggtagcagtaaggtccagagtcaaggcgtcttgggagcagtggatgaagcagtgtattttaactcattcatcatagaccctggctccgtataaacactcaataagtttttgttctgtatccctgttcactgagacagagcttccacctctgccccagccttgaaacactggaagaatctctttctgcctcttttataatggagcccagaggtttaaataaattcagatgagggcattaggcttgtggactggcctaccctagacgtagcctggttctacctcctggggactcactaaatgaccctgagtaagagatttttgtctcagtttgatgagaaacaagaagcccacttgccctgagcctccttttcttttgcttttggaaacatgaatgtgtacaccagagtaggaatgcctttgaaaaaaaccattcaactgtgattcctggctcagcatttaagactttctcctgggttcaccctcagaacagtctcccccctccttttgaccttgagggagaagccaagaggtggggcttgtttataaagggaggaggagcagcccacagctgcaggcctcggatgatggcctgagatgccagatgctgtgcagagggacagcttccccagtcctttcatctgagattacccttggctcacacccttcactgcaaaaaggcaccctgggatccagtcgtagaggagtgggctgtgtggaactcatgggtctcagaactctaaccttctcccagggctgggaggggcatccagaggttatccagtctttgcttcaccacatcaccagtgtcttggaactcgatgataccgaaaagtcaatgagcccaactcttccctcatcctaccattttataaacgaggacacaggggcccagggatgagccaggtggtgtgatgtaaacctaagacagggccctggagttctcaagtgctggcccattgcctgcaacacacacagacacacacacacgtgcagaatgcg

SEQ ID NO: 31216 - DNA, 1332 bp, Bovine  19866880810159
attcttcatataagggatgtcatatgatatttaaacacattgtttaaagttaaatttctgatttgcaaatgaactggtgccacagatgaatccagaggaatgacccttgcatgcatttaattccacagagaatacttttggaaatccattgataacttctggtctgtgggctgttccattggcataaatatcttagacatggattcccagggatgtgatccagtttcttggcaagaggcgtttgtgctgctattataattatcttcatcagtgtcattaccaacccctacattgtaaaaccatactcatggagactcttggtgacaactgatagcaaacccattcaagctggcttagcaaaatcagcctttattggctcacgaaacttgaaagtccagaagtagaggtggattcagtcattctacttaaataacaccgatccttcagtcttcatctcttacactgctttaatttttctccatagcacttgttattacctgacatggtgttctgtgtctgtgaaaagtgaaagtgctagttgctcagtcctgtctgactctttgagattccatggactgaggaaccccatggactgttgccctctaggctcttcagcccatggaattgattctccaggcaagaatactggaatgggtatttccttctctggggtatcttcccaggggttgaactcaggtctcctgcattgcaggtggaatctttaccatctgaagcccattctatgtctcacttcagttgctcagttgtgtctgactcttggagactccatggactgcaacatgccaggcctccctgtccatcactaaatcctggagtttgctcaaattcatgtccattgagttgatgaggccatccaactttttcataccctatctcttggtccggaatttctagagttattagtgtcaaggaagtcaaatataatctttgattccaaatgcaaaatggttaatttttcaatgtatagctctttcccttaatgttttgtttgtgtgggaatgatgttggaagctatgcaactcatttgtaaacctggacccaacctgccacctggcttctggaggaaggagggcagtggggtgaggacaagcagtactctttctctgcaagtccttggggatgaatattttcacaatgtaccacaaccagaaaacgaagcttaaatgagttggatgggctgtttgatttattacctctgtctctgccaacagatttgtttttctatgtaggaagcctagacgaggtagacttggaggcaggttccatttagtatgaagtctgtccaagtcttgttagctctgagaaagaagc

SEQ ID NO: 31217 - DNA, 1151 bp, Bovine  19866880840814
ttccgcctggagcccagatcactgggttggcaggaaacctctcatttcaaattgtctgtggctttttctcgcagccagcttcaatctctactgccatgccccaaatcagtacattcccaggaggtcacctgcttaaaggtcggggcagtaggtcaaccttcaccctgaccttgagaaagtcaagccgccacgcttggtcagccatctgtacgacataagagattagaggcttcactcagaatcccattaacatttctggactgtgcggctctgaattcccaaacctaaaatgtggcaagactctggccagaagagccctttggagaacaacgttatggaaatattggcagcacttcaaagtcacccaggaaaaggtaatgacccctccactcaccaactttgtatcctgggctctgaagacatcatattgcagaaggagatgattttcccgaagttaagagaagagctgtctataaggagagcccactggctatctgcttggggagccccgaaacactcagggggtgtctgcagtgtccacaaggccgggatgcaatgatacacagcgcctctagtgggcgctgctgctcagcccgctccctccttcagcctggctaccaaaagtacacatggctgcggtgttatccgtaagaaaagaaaaataatacaaaataatacaggtgtgcaaatactaaaagaaatatggtatatatacacagtggaaaattcagttcagttcagtcgcccagtcgtgtcccactctttgcaaccccatgaaccgcagcacaccagacctccctgtccatcaccaactcccagagtccacccaaatgcatgtccattgagtcggtgatgccatccaaccatctcatcctctgtcatccccttctcctcctgccctcaatcttttccagcatcagggttttttcaaatgagtcagctcttcgcataggtggccaaagtattggaatttcagcttcaacatcagtccttccaatgaacacccaggactgatctcctttaggatggactggctggatctccttgcagtccaagggactctcaagagtattctccaacaccacagttcaaaagcattaattctttggcgctcagctttctttatagtccaactctcaaatccatacatg

SEQ ID NO: 31218 - DNA, 1149 bp, Bovine  19866880877589
aggcgagtcttgctgcttgttacaccattcacatcgtcaccctggcctttggggtttgatgttgggtaccactttcctatggcaggaccctgactatctccacttcagcctgcaggtgctctaacctcagggctgccatcctgaaacatggtctcactgggctcattccatctctaccaacatgcgctcaactacctctgctctcacccttggcttcccgccttcagcccatactcagcttgtggtgtggacacagcactaggaccactgctctccaagtctcaccagaagcccaccctcccgcctctcatccttccaccctacaactcaggtgggcacaaacacaggtggtgtgagcacatggaaaaaggttgggtgagtgggtgtcaccaactttcttcacatttgccagaacctggctcaaggtcttgacccaggatactcctgcacccaaaagctgtaagtcatttccagtatcttatcaaggagtcatgatgtcaaagatgttgagacattccatcttcctgattccttctgtacaggatgctcagtggagaatcttagggtatcaacttactgtccactggccaacttctaggaggttatagaaaatgccaattgacggacttgaactttctaaaccagaagtgacaacaacctgcctccaataaattgatgctagctgcttggagcaatgtgttgggaagaattctggggaagcggggcagtggggaaccaagaagggtcctcagggagcggtactggggactctcagtcattcctgcctccattctggaacatacttcagctttgattccacaccctcattcctattccaactaggcagctggtcctacgtctcttttattataaaaattctagggccttacctatttgaggccaaggtttaggaagagagtcaagatcaattggcagtattttcaaatacatggatgtgagaggagtggaggcccctatgccaaatgtttgctttccttgcatctaaacagaaaacaaattttcatacattcctcatgctattgtattagtaggacagtgactacagtttatgattagtgtctgggtcttcatgagagacccagatgggagctgagatggattatatcctaaatgaagttgacaatgcat

SEQ ID NO: 31219 - DNA, 743 bp, Bovine  19866880880358
ttcctggggctcttatattatacattccagtgagacagcacgtgctcaaggagaccaattgtcaggtctgaggcctttatcaccatcatcagggcagggagcccaagagcctgagccaggggagcctgggcaggccctcttctcctccctctctgccttggctcagcccttgtaccctcagagcactgcagcctcgcctgatggtctccatgttgcaaagagggtcctggaggacaaaggcaaagggtccaggtgaggtgtatccaaggaccggaagattccattgcacacctcttgggcaccacaggatccaggttagggagaggctccctctctgccctgtctcggatcccacttcaagaggactcaggcagctgctggccctttaaacagagccagctcccaccggacactcttaaagctcacttcattcatgaattaagtccctgacatcccatatctgtatgatcaatatgtttgtttattagcagcagctgctgtgttttagcgaaggcagtgggccccagtgagagggctgcccagtaaccacagagcagggcctgggacagggagaagagaggcctcccgctggccgatgggacctggggctggataggatttcatggtaatggtcctttaattgaaatcactgctccagcagcctgttgggtaggggagctgtgctgatggctcctggcccggcccccctttcaagaggtccattaactggtggggcgtgctcc

SEQ ID NO: 31220 - DNA, 1351 bp, Bovine  19866880897105
cctagcgcagggtaatgatgggtgtttattgccagccacttacctcagcgtcatggacttatagatgaaatacagagaatgggctcctttgtctggaaggaccccaccccagaactcggagcagagatggcagccgcagctgctcctactgaaaaatatggctttctaggtttttctctagcagaagccctgatggacttgcctggaaggaagggtgtctggttacagggctgggctaggagcttctcctctgggagtggagctgaaaagagggggctgacttatggggaaagcggggacgagggactgttgcttgctccctctcattggtttaggagggaggcttagctcaatgtggcttgcagagaataggaccaacgtgggggtgggccgttctgatgcacctgcttgttggatcctaaccagccccgttaagggagctataggttgtaaaggtaacagtgatgttttgccttagccttcgtcaccagttaggtatctccaggccgtttgccaggcagtctctcatataacgttttaactgaacataaattaggattgttcccttggatttttcttcaatcctattttcaaatccatttagaataagtagcagagtcccgagaaggctgtgatgccaagtttggcgagcccaaggaggaaaggagtgctcagataccttgcatgtgctaagttgctcagtctgactctgcaaccccatggactatagcctgccaggctcctctgtccatgggattctccaggcaggaatattgcagtgggttgccatgccctcctccaggggatcttcccaatccagggattgaacccgcatctcctgcattggcaggcagtttctttactgcttgtgccacttaggaaggctgctgaaacacattatctgtttcctttctttctagaaagagctagatgattccaaaatggattatcttgggaactaaggcagttaagtcctggacccatatgcttgaacttgtcctgagagtttcagttagattaacctctgttggatactgattcccaaatcacttatatctaggtgaaatctaagcttgtcactttgccatttccccctttttatcccaagaagaaaaaaaaaaaatcacatgatttcatttcccccagagtacctgaaaatgctaagacattcttgagcatgtacttcggagctgtaaccaactagacagaccatggtccatctccctaagctaagacaacctgccttcctgttgaatctcatgacttcatcttcttctgtgctcaccaccataatcacatacgcaaactttagtagcttcatgcagttatgctaattaagtaattagattta

SEQ ID NO: 31221 - DNA, 1553 bp, Bovine  19866880903462
tatgatactgtagggttaaacgtaatcaatgctgattgtaatcattaggaattaagagatttcttctagtagtgagctaaaaatggcttatgctaataaatcaatgagcaatgagaagggaaagtgaaaagtctttgggtaataggcccaggagtggaagtggtagggagggttgtgtttgtgcagaaagctgccggcagacatgaccgcagaggtgtcacagtaacagaagcactcactcctggaatagcttgtcagactccaagtatctgaccaccaaggggctggaaattaaatagactgtgggtccaagggtattggctgacaagatctgggggcctcatcagctatgtgactttaggtgagttgcttaacctctctgaactttggtttcctcatcagtaaaactagggaataagtgtacatcttaagacagttcattcaccaattttattaagtacctaccatgtgccagacactgttctagagactggaatagcatagtgagcagaacaaagcccctctcttgtgcatttaaccttccaggggaaggggacagcttgtggataagcaaatcaataaatgcttgtcaggtaggaataagagccataaagagatatgtagcagtgtaagggggacagtgagggatggaagctaattttataaatggggcttccctggtggctgagtagtaaagaatctgcctgcagtgcaagagacacgggtttaatccctaggttgggaagatcccctgaaggaggaaatggctatccactccagtattcttgctgggaaatcccatggacagaggagcctggcaggctacagtccatggggtggcaaaagagttacacatgagttagtgagatttagaggatccagtggattcaaatgacctgccctgcagtcagcacatgggtgatccatgaggtaaggaaggcagaaggcctggatcctcctaaatagtggaagtgttgaactttggggatgctgatggcttaagcagtttcctgggactgatacacaagatcctggaaagcaggggtcccaacctctgggccacagaccagtacctcctatcagatcagcggtggcatcagatcaggaacaaagtgcacaatgaatgtaatgcacttgaaataattctgaaaccatccccccgcctccgctccatggaaaaacagtcttccatgaaaccagtccctggtgccaaaaagtttagggactgctgaagggtaccttgcaggaacaatgcttgaaaccagcaatcccaggtgctgccatttaccctgagtttgtcaaaagccagccaaccaagaatctgattcccaacatccagtgaggcaatgatggattttgattcagggtcaggactatggtgggcagctctccaagttcaagtccaggctctttggacctcagctgggcaggttatttgtcttctcctgtgcctcagtttctccacttaaagaatgggagaaataatagcactgaccttatgagattctgtgagaattaaatgaagaaatgtccggaaaatagctagcacagta

SEQ ID NO: 31222 - DNA, 1601 bp, Bovine  19866880952592
ctggagagccctgatgtagagaaactgcctgaaaatgtaagccctagctagagattctgtcagggggtttggggagtagggtctaatagtctacattttaacctcgtctctcaggggagacatactattttacattcattcagagctctgtgtattacaaaatgctttcacagggtttaagttcagattttcgccttcggagaatcgagggcagttccggggggccgttttcttgcggtctcctaattcacttttcattcagtaactatcttgctggaattagagttatttacatgtgctctgttactccgactatgttgtgaacaccgggagagagacatcattttcatcagctttgcatgggacgaatgcttgtcttatcagaaaggatcaatgactagttgaattttgtccagatagacatgtggatgtcattatttgcccagactttgggagaccagataactgagtgatctccacagtctaacttttcctgcaactaatctagctatatgactgaccttcaaaacagccattccgatgatgtttataaacccacacaggagaaagaaaaaaaaaagaagaaaagaatctgttttgctgataattaagctcagaaatacacacgcatcaattattcagttcctacaagtcctcattaaatacagggtttccaagtgcagatggcaaaataattcaaatgaggactggtctcaagtttatctgcatgttcaatgaaagaaaaataaagtatgttggtggcaggaggaggggggttgttaagacactggttaagccagctaaaaatgaaagtgagatgactggcaatgcataactgagtatttacagtttcagcaaagcccagagaggagaggatccagccacaaaccaccttcctgaaatgctatgatgtagttaagcatcacatacacccaaaatcaaaggctatggaatagttgagacccagaaacttttcctttgctatcggtctaaactgctgcaattaaaaatagactctcgtttggtttttcttcttttttactgcttcgtatgcactttacggagcactcaataaatgaggttttattgggtttttagaacacattcttgcagacctgaattccctaggtttaaattcatcttgctcctttattttggaggttcaccacttaagcctaggtccttctaggaaaaatttgcaaaaggaagaatctgatccccttccaactctggtcggaaaggagactgcaattacgcttgtggaaatgtacacagttggccatactaagcttttgtggggacaaaggaaaaggtagctttcacatattggtataagcactgagtagagaaacgtgttgctgtctgctcaaacctaatccaaaacatgcacagtctaagattcagcaagtcctcctccaggtattaacccagaagaagccccagcacatgggcacatggaggaaacaggtacagtggtgcttgggtcaccagattattgcattaaatggtgaaacaacaggggacctaaacagaaacagtgcactcagatgaaggaattactctatagcagctaagaaagatggatcttaaaatctttgcct

SEQ ID NO: 31223 - DNA, 3668 bp, Bovine  19866880977703
cctactctttgcttgattctacaacaaccttagcccttatttccttcaaaagatgggaaaactgaggctcagagagtgttaggttcacagagtggcagagacaggctttgacttcacatctcattgatcacagagctaacactggtatacagataccagcagttctcaaagtgtgatttccagaccagcagcatcagcctcacacgggaatctggtaaaaatgcaaatttctcaggctgtatctaactccccagaaatgaagcagaaactctggggagagggctcagtaatctgtgttttaataagccctgcaggtaatgctgatatgcacaattcttcaaggacacttgggcttccctagtggctcagatggtaaagaaaccacctgcaatgcaggagacccgggttcaatccctggatcaggaagatcccctggtttggcaacccactccagttttcgtgcctggagaattccatggacagaggagccttggcgggctacagcccatggggccacaaagagttggatgcaactgagctactaacatagcacacttcaagggcactcagcatacaggggagcatggcctaaaagagagattcccaaagtatgtccccagacaagcagcatttctaacttgttacaaatgcaagttctggtcgccctacccccagactgaccgacgctgaaactcagcatgcggggcccccaggactagtgtaacaagccctccagggtggttccaatctgcacccaagtttaagaacagctttaccttctgttgcctcttctttgtaagcaaagtgagggccttccctggtggtccagtggttaagaatctgccagtgcaggggacacaagttcgatccctggtccggaaagagcccacatgccgccaggcaactaagcccatggatcacaaccactgaagcccacacacacacggagcctgtgctctgccaagagaggccagcacagtgagaagcctgggcaccgcaactagagagcggccccctgctggccgcaactagagaaagcccatgcgcagcaacaagacccagagaagctaaacataaattttagaaaataagccacgtgggataagaaaagacaccctcagcttgtccaagtgcacagtgacaaacaagctccaggaatgaaatgttttaatttgttataggtgtgtgggggataggtggacaagaaggcaagacagagaaatctgaagatgcaggacccaggccaaggtgcagagtgctgcagtcctccagaagggaacatagctttagcatcatggaaacagggccattctcacatgagaagagaggaaaggtgaggtatttttttgtttgtttgtttgtttgtttctggtgatatttattcaaaaagcaaataggaaccctggtggctccatggtaaagaatctgcttgcaattcaggagacccgagtttgatgcctaggtcaggacgatcccgtggagaagggcatggcaacccagtccagtattcttgcctggagaaccccagggacagaggagcctgtcaggctacagtccatggggtcacaaagagtcggacacgactgagtgactaacacacacacatacagcagaaagacaggtggcctcaggtaaattcagtaaatggcaatccatctgcaacagaaacatccgagaccaaaagggcttgtctttgtctcttgtggacaggaaggcagtggcagcctctgatgaccactagctgtatactcagcaccacgggtcatgctttccatacacgatcattttccctcatgataacaccccttccctttttatagttggggaaacagagatgctgagaaagtaagcattttgttcaaagtttcacagtttgaaagtgagaagcaggatccacacttgccatgctattggaaagagccagtggtttctggtctggcactgtccacgaaaacttccgtataaagggaagtattcagccaacatggcagtcacttgtcttgtggttactaagctcttgaagagtggctagtggtactgagaagctggtttttaaactttactcaatcataattaaagacccacatgtggttaatagtcactgcactggagagctcagctctcgaccaatggtgagttccatctttgatttcaggctgatccttgtccctgggtgactcaagctcgagagaactggtgacaaaattctagcacaggccctggttacagagtagcaaacaccctttttcccagatcgccttcatccagcatcctcttgctggtggatggtgatgtcaatggccacctggccttcctgtggctttgacaaagcaaatctcttttttccctggggcacccccagcccaccatcacactcattataaagcgtttcctaggattatagttggccagtcacaaattaaccctagtctttaaataggaggatagctttatgcaagctactgaattcttagagtctccatttccccatctataaaaatggggagaacataattagctttgatggttattgaaatgaaatgagctgatgtataatgtaaggcatctcctccctttcttaacatccttacctgaccctaccttccacgacaatgattcctctaagatctagaagcttcccagctttgagggttattctgactattcatggatgataaggcacctcacagatctgccttaaagagtatttccccaaacgccttccagagtaaagagtccagaatccaagagcaattgtacggtcacccacaagccagcggccccagtgctctacctcttacttgcctgaattagctggtctccccagatgggttagaccacaccagccacctcacacttggcctgaacggagaccacctgagaggccctgctgccatccaccacaccaacaactccacacagcaggggcccctgcccagccgagcccatgacgaggatgtctaaaatcaaattacttttgctttcatcaatatgaatgtcaataaaaagttattattcagtcagtggacgttttaattaccaaatgtcaagcactgacacccttccattagcagtttaatggtcaagagagacagtcctgaatggaagcccagaagaatccccagccctctctttccctgcagaggaaggatcccaccagaactcttaacagtaacagcttggcactcccttctcaaacgtctctaaagggaatgctctctacctcttgaagagcatccctgcagcccaaagttttctcgagcctgctggaatctcccctggttcagtcttcgataggaatttgcaagaacagttgacgccagtttacaggcaatgaagcagaaagacactgagtgccagctgggggcgggggtcctctgagaaccccagcgtatggacgatgcctgggtccacagacaaatgagccagcttccttgggcctcagtccccaggcctacaaaatagggagtgtcacactcatgtcacatgagatcatgtatgtgaagaattcagctcagagcctggctgcatgtatggaagaaactggttttgctgttgatggtgctatagttgctactacaaaggagacatcattaagtgaattttcctccattgagtccttttttggtttcccactacattcatataggcgtcttcacttcactcat

SEQ ID NO: 31224 - DNA, 3289 bp, Bovine  19866880986191
ctgtgctagcggtgttctctattagtgttctctttccagaagccctttccaggagaagatggccatcatctcccatttcctctgaatgagcacatgaggtcataccccctgatgggagatgggccaaagagctgggaagttcttcccgttgtgctatatgcttgtgtgttatttgttcagtcatgtctgactctttgcgaccccatgaactgtaacctgccaggctcctctgtccatggaattctccaggcaagaacactggagtgggttgccatttccttctcctgcagatcttcctgattcagggatccaacctgggtctcctgcactgcaggcagattctttaccatctgagccacagggaagcctgctacattcttaatggtcaataattaaaaacccaagttctacccactcttagccaagaagcctggcatccaagtgcccttctgtattctccccggctgctttatttttaagatatttatttatttggcttccctgggccttaattgctgcacgaggggtctttacttatggcctgtgaactcttagttgcagcatgtgggatctagttccctgatcagggatcgaacccaggtcccctgttttgggagtgtgcagtcttagccactggaccaccagggaaattcccccagctacctttaatgcaggacttcccaaatggtgctctaggcatttttaaggaaaaagaaaaatccatgtcaaataaatgtgggaaagtctggagcacatgccttttttgttttgctgtgggattctgagagcttctattggtgtaggtcatttgcagttttgccagaacatttcccatgtttttgggtcaccgaacttgattttggggatacacttgttaacatctctctgtggacacagatgttcattggattgcattccaggctgttctgggcgtctagggttctgtttttgcctccccagcagacgtgggaactcacgtgacgtgggaactcactgtgcccagatgagcctgaacctgtttggcacatgctccatcctgtttcttcctgagcctctgggagggacaggaagtggccgagtcccatgggaatgcccagagttggggtggtggcactcatcaggatttctggcagagcactgaatacccttcatgcaagcagatctgagggctttgtcacttgttctctgcctagaagctcttgcaggtgcctttagcactttttaagcccctagatctggagatgctggtcatggccaaattttcactgcattccttgtttccaggcagatctggaacttcagggagtcgtctccaaggagaaatgtacaatccaagatgcaaatgccatcctcccaccccacccccgagccgctgtttccaaaccattgtatgaaaggttaaagcatctctgaatttcacgaaggggccaccttttcatcagaagagaaagtggccctggactctggtcccagcctactagctcagcaaccaggagactgtgggcagggcatgcaccttctctaaacctgagataagaaaatgagataagaaaacttgataatgaaaatgaaaaccacccaaagtggtattttttgggatgacgtggcatgagcatttgaaaaggctctgtcacttcgcctaagtggcatatacatggccatctttgccttgacaacaatatttttacaacagatcgttacaattcctgcctcaaatatgctgttcagggaaaccagcttgatggtgtcaaaaatagaggttgccaaggcttaaagttatttctgaaaagataaggatctttccctccaatgaaatcttcccccccaccaactctaagaaaaagcagtttatcacccagatccgaagccacagagatgctcttagagtcaggactgtaatatgttggttgtcaggaaatgatcgatgtagatgagcagagggcttagaccaatttccttttgggttaatgagactgaaaagctctgggctcaaccaggggatggcagagagattcatggtaagatttttgtgtttgttttgtcttctctgcttgccccgcctcccttgtcagcaaacattattttgttgaaactacagtacccctgaacccctatatacctgcccaagtgcatcacttatgttatttatatatctgtgcccatgtggtacttgttatacagttagagttctaatgcctggttgcttaagtgacctcctttttccttgttcttataagtacacagccccttcattctttctcagcagacctctacataggactttcagacataaatgtacatgtttataggtcttgtttatatttatgcatatatctcatgttttggacactgatcattgtcagttcacatcttttggctataagtaataggcaatcctgacccacttgggcttaaacaagaaggcaatttgcaaccacataactcaagcaaataggtaggaaaggctcctggtgaaaaacattaggactctaatcctgctttcctgagattttcttgcctctgcccttctgcatttggctttaccaccagtggctttcctcttgataacataaaggttgcagcagctccaggcatcacaatgaaacacatggattggggacagcacagaattgtatcttcttgtgggttgattgaaactgagaaaaccttttccaagttccccaagtagattttccctcctgtctcattgaccggaattgtgtcatctgtttattcctaaaccataaagaaaatgggactaaaacaaactcataggctcctctaaatacacccctgagcttggagatgcaactcacttcccctgaggctgcctggaggggagtgattgcctccctggagtcagtctgtcagcaagaaagaaaggggaaatggctatgagaagcaacactgcccaccaccccagttccttccccagggtcaactcctgctctgctaggagtaagcagaggcctcaaggagtagaagtggggtggggggaagatgagaacattgatctcatgcaaattttactcctcctgtatctccccttagggaaagcaaactggtaatttgtggtggttgtcagtgatgttctggtctggtaaattgtcctgctaattttcaaggctatagttatatgcccgagcagagacagatttcttcatatggttttagctggctccgatgatcttggctgagctagctgtgtgagttcctgggagctgctgtgtgatactttggaagcatcgtttctggggagtaggtgggagcaagggtggcaaagagaaag

SEQ ID NO: 31225 - DNA, 1905 bp, Bovine  19866880992294
cccaggtatatcacacttcatcttgaccccaaagtcagtgagttagggacttacaaagattctcatattatagaagagaaaaaaaggctgagaggcttaactactcagaggcagagttgggatctaaacccagaatgtaccttcacattcttcccttcttgccctctctcccattcttcctcgcgggtggactcaccccaggagggtctcctgagagcacctggtcccttcccgcatcccctctgccctccgggcttcccaggtccacgcctttctgctgaacaagccccgctgctctgacctgccacacatttagctgctgagcacgtgtagactcacatcgtgcttttaactgcaggcaaaacccatccctctgggaactgtcccagtttgagggtttttttttttttttttaaaaaggcagtcatgttaaaatagagattaatgctatagacagagagagacatgaaaatagatccaggagggatggtagatagcctatctgaatagatcccagagataaatacatggaaaacatagagaattattgttgggaataattctccatgggaggctctatggataaatatatagaccagggatagtggaatcatttagaggaagtgagatgaaaacagcacgtgggagtccgcaactgtgagagctgtgctgaatgggcctgggccttcggtaccacacgtttggtggagttgttccaagaggaggtcggaaatctgcgggcgggctgttatcttccagaagccacatggcagggtgtcctggggagagtgagaggggaattaactggggactttgtgaggggttctgggagcaggatgggagatgctgaggcagacctatgagacagcatcatcggggtgggctttgtaagttgacacggggatgtgaaggccgaatggagcctggggaaaaaggggctagactgaaaagggcagtgttcccagggacccacagagagaagttcagggctctagtccttgagggcatctggagaggagagccaagtcccccacccagcaggtgaattggtgcggcaggccgtctgcacaaacatgggacatatgcctggaggctgcagcccagtgtcataaaaaatccatccccgggtagcactgttcctgtggttgatgactgtggctctgtggtgattggatctggacttggctcaggccctgcccaccagtatccagggaagattgtgaaaagctggggtgaacttgggacagagctgctcacatgttcttcttctccccaccctggtccttgccctgtttatccagaactctgcggctctgtttgacagacattcctgactgggctgtttggctgtagaatgttctactcaagggcagatgaaaagggccaggaggctgctatgattcagaaaggtgggacagtgctcatctctttgcatgaatgctaagtcgctttagtcatgtctgactctttgcaacaccctggactgtagcccaccaggttgctctgtccatggaattctccagacaagaatactggagtgggctgcctaccacgccctcctccaggggatcttcccaacccggggtttgaacctgcattggcatgtgggttcttgaccactagtgctacctgggaagcccactcatctctctatggaacttcttttgtttcttagaatgattgactaggaaaggggtcaacaatccttaagtgagcactttgaccctggacactgattccatctttacaccccaccctccttttccaggagaaaaagggagtaactgttgactgtttctgacagagaccttgccatgatagccaacgacccataattctcccacgcatgtcaagagtatccactgactatcttgccttattctagggtgggttatgggctgtggt

SEQ ID NO: 31226 - DNA, 658 bp, Bovine  19866881002953
ctggacgctggggatttccaggggatagcgtgggtcaagagctggagagatggtggcccgggtgcccaccgtgggtctctggaagctggtgagcttcactcagcctgttctctgctccaaggatgtgtgtgtctgtaggaagccagtgggaggcagggagggtcacaatcacgtaggcttttcacggccacgcagcagtcctctgaaaaatggtccctctgaaaaaatgaagcttggggaggcagtttgacagggaagagctggttgatctttcaaggcggagggtctaagatgggactgctggagaggtcagtgactggaagggaggaagtggcttcttatcccctgtgccactgaaggaccaaaagggcaactgtggggacagggagccaggagtagattgggagtccctctgtgggtgtctccatccttgtgtcaggactccaactctttgcctgggagttgggactcctttccttgaagacaccccaacacctcagagccaggcaactggattcccacaggagctgtgcagagcggcaggtgggggaaggtcagaggtcacgggtaggatgacccttcctcaccccttctccccagtgccctgttatatccgtggctggtatgactgaactggggaagggtccagcctcctggc

SEQ ID NO: 31227 - DNA, 2306 bp, Bovine  19866881004239
ggtcatgtgtaaagtgaaggcccaacactgctatgtttaaaatggatagccaataaggacatactgtatagtacagggaacactgctcagtgttgtgtggcagcctgatgcgagaggagtttggaggagaatgtgtgtgtgctaagtcgcttcagtcatgcctgactctttgtgaccctgtgaactgaagcccatcaggctcctctgtccatgggattctccaggcaagaatactggagtgggttgccatgccctcctccagaggagcttcctgacccggggattgaacctcaatctcttatgtctcctgctttggcaggtgggttctttaccactagcaccacctgggaagcccttgcaggagaatggatacatttatgaatatggctgagtcactctgctatccacctgaaacgatcacaacattgctaattggctatattccagtataaaatgttaaaataaaatgaagtgaaggcaccgtggggagaagggagactagaggtaggtctggatcttagagaaattccacaccatagggcaagccaaggagtggccttactattgtatggctgaaatggagaggaagtgaaggtcactgataaggaaggggttgaagaggagcagtgccaaggcatcatcagcactgtttcacgtctcagaactccagtgctgctctcaaattcaacagcagaagagactttttattacaaccttgcagaaagagattcatcataaaacctctggcgcaagtcccacttggcttctccatccaagatgatatcacagtgtaagaagctgtcaggaaggaagctacctgagctcatggtggagcatcttgaacattatgatgatcgctccgagttgctacaccctccatgagtcacattcagctttgcaccagtttccccagatgggaaagtaatttaaaggcactagtcaaatctaccagcctaggcagagaacagaggtgatgtgcaaacacctgatgttccagtgactctgccatggtatcgcaaggagccaggtatgtaggcagcctgggtgcaggcagaggcatacgggctccctgtggagtaatgtaagtggaagaggaagaggagtaagaggcaggatgctgaccctcaggacccagagatgccctggcccatgttaacagggctggcagacagatggggccacgacatggaggaagctggcacagaactagcaggattttgcttccaaactgccagatgctagctacagctttccatctgcctcttcttgtcctctcctttagggtttcactgtttacatggtacacatccaaatacatttgctgacctcacctagggaggctggcttggtgaaaaggtcagcactccaacagttcagaaacgcaaggtgcctcctctctggcgtacgcccaggaagccagaattcacaggggcaccgtttacagtctagagagatcgctgaaacatccagggatgccacggcaagagccatcctcgctactatagatcatgtacaagcttcacctgccactaacccaccttgcagcctcttctgtcctgcttccttcttcctcccatcattcttggcactgtcatgcgatgcaggaccgtcaatgggaaaataaagaccccactggcaaataaagaccccattggcaaattcagcagaaaactgaccccttgggcaaccctttcaaaaagaagtttggacttccagggttgtccagtagttgagagtctgcctaccaatgcaggggaaatgggtttcattcctgatccaggaagattccacatgccgtggagcaactaagcctatgtgccacaactactgagcctactcttgcctggagtctgtgctttgcaacaagaaaggcctctgcaatgagaagcccacgcaccataatgaagagtagcccccactcactgcaacgagagaaagtccacatgcacagcaatgaagtcccagcacagccaaaaacaaattaatgaattaattttaaaagaaagctatctgaagaagtaggctcctacgaggaaaacgggaaagttccaggtgccctgggatctatcagcctggggctgttgcttttgaattaccaggtatgccgcagattgcacaagtcctgccttgatcatccagcaacttgagcctagaaggagagcaaagtgggggttcggtacccaaggaaatgggcactaagggtggctgtgggcactcggtctgaccacacagcaggctgggacacacgggggtcatcacggatgggccatctgcgattatgtggtgcgaggggcagagacacatga

SEQ ID NO: 31228 - DNA, 1666 bp, Bovine  19866881012135
ctcacctccaactgccatcacaccctccacatagctgcacacagctttcctaaaaagataggcttactcctgccttgtctgcacgtgcagctaaacaaacacacgcccattacagacgttattttatagacatgattttaatgtgagattgaaaaacctccttctggacatttgatcaatattacccacatctctggatatccaaactccgtccatggcagtgtgggccagagacgagctgagccagcatggaaatcctccttgcctgaggctgcccatggcttggtcatcaccagtgccagccctccaaggtttttccatcccctgtaagacttggagggcttcccaggtggcgctagtggtaaagaacccgcctgccaatgcaggagacataagagacacgggttccatccccgggttgggaagatcccctggaggagggcatggcaacccactccagtactcttgcttggagaatctcatggacaggggagcttagtgagctatagtccatgggatcgtaaagggttggacacaactgaagcgactgagcacataagatgaaattatggggaggtggagtgatcagccatcatttcactgaatgggtgaaatgggaggacaaagtgaacaagaacatgtttctagtcttggaagtacagcacccccagcctggtgcagtcaaaggtggtccacatcgtgccaactaggattagaaatagctcactagaatcccttaagaatgtctggagagcattctctctgacccctttgctccccagggaccctggtgattatgccccctccccacttccctcccaggctcatcatcagggcctcctcctacttagatgaggttgctcctcctcttccagaacaatccaaggccatgcccccaaatgttttgctcccatcccttcctcagttcagtggaggccgcagcaaaagtggagtgtttccagtttctctgaccgtgcttggttttaagttaatcccctcctcctatccttcccttttgctgaaaattcgtttggctgttcccagtatatctgtatccatatctccagttgtcccctgtcccccccaacatgccccgaccccgtccccacctttcgagctcccatctctttccccttctagttttgatcttctttgggggttttggtttttactttattttgcttttttctgtttttctgtttttttgtttttgttttttataggtttcagagaaattatgttgaatccaataagccttcccggacattccaagcctcttaaccatggcatctatgttgaggatgtcaatgtctatttcagcaaaggacgtcatggcttttaaagactccttttaagcctccctgttttgatgtctccttggtaggctgggccctctgagaggttggaagctctaggcattgttccgtttggagccggggatgctaactagaaaccactcgagccatcggtgccccctgcatcctttatcgccaccaagacgggtgtgtccccgccccccatccaccactggcagggttgcccttcccctccagtcatcactgtgctccttttttttctggcctccaaggcagctcctgccatcgtctttagagccaataaagagaattaaaaacctgtgcaccaggaaccatcttttaaacataca

SEQ ID NO: 31229 - DNA, 1589 bp, Bovine  19866881019721
ctgtttccctgcagaaagtctgtggcctgtgtaacaagcagaatcagagcagccttcttcctggagaaagagtctgccttgttccatatttccaacagaggaaaatgcacatggccatacctggacaaagtgttctagatctttcctgtgctctttcagctgaagagagtccatcccactctcaggatccatgagccagcatcttctatgaggaagcttgaagaaggtcatcaggagggaaaaagcaggtgaacattgaccttcagagttcaaagatctcctttcagaatgatctctacttgagttgcaagttggacagttgaaagggagtccttggccatttgagaattggaagactacaattggagagatggaagcccgagtttaagggtggtactactagctgagtagcttaatattggcagggactcaccagccaatcgaaacgtgttacagtgcaccacgaaaggagagaggacatctacacctgtccagttagctcacttaacaggtgtgcttcagctgtcttcttgaattgagtttccttttccaatgcacaaaatcgtcttcccaggactatgttgaccacgtattacctgttcatcatgccaacctggagaaggcatgaaaacatttggtgccagataggtgctgcagaaaaaaggctggaggacaggaatattctttcctccgtggatactagagacatctgaactagtcatggtacccagaggacgagccaagatctataggcaagcccagtgagttctgtcatataaggaaggaaaagaatctgtacttcaaggaatgaatagttttcaaaataagcaaagaaaatctttgaacagtcagaagataaagccatgttctttagttttgtttcagattctcctagttgacatccagagcttggaaaagaacccatcataaatatttcgagtaaggggctatgagtgacagaagttagagagttctcttgaatctgtatgtctgccagggttgaagagtctaaacttctagaccatgaatatcaacatcagaggttgtcagtcacatcactatggtgataggatgtggaagacatcacccccagtgtctcagagtttgggcagagttgaacctggaggtcgcttctgtaggtacatatgacctgactagggttgccaataatcttcacttgggatctattataacatctataacaaggaaagttatagttattgagttggatcagtcactctagtttctgagacatattcacattctaggtccaatctacaccgtctacattggcggccaacacactctcaagcagagagcaactggaaaaattacgatgttcactttggtttaaggctcacccaaccatggccaccactttccaaatgcaaacaatccagggaaatgattctcaagcatattcaactgcaaagcacctgcaatgtgctttggggaacatttttggacattaatatattaaacttgtaataaccaaagagatatatttgtggtaaattaaattataacctcctcatactagatattggcttaaataaacagtaagtgtcacagtcgtaagacaaaatggg

SEQ ID NO: 31230 - DNA, 1282 bp, Bovine  19866881051037
acacacacatacacacacacacttccagattggcaagcaccgtcccatgcatggtgtgctggaactggctcattctggcttgtgagagcaaactgttaaactttcaggagcttctaaaatcaagttgttaaacacagccattattaaaaattaattatttcctaattattaattcacagttattttactattgtactcttgaggttatttgtaactatttcacctgtttggtgaaaacaccgtataatgatgtgctactgctcatctcgtgacagctcggcattcaatgatgccactttggtgccttgaaattgaccacaccagaagaatttacagcacagatattggcaagcactgcaaaccatggcttttttcccttcagggaaataattattaaacctatcatcacattgcaactccatcaagtacccagtacagtcaataaagaaaagaccatactgagacatatcatcatgaaattttagaacaatggagataaagagaaaattgtaaaaactttcagaaagaacacatacatttcacgtataaaaaattaagccattaatggtatcagtgtaataataatactgaaaacttgaagccattacaatcatgtcctcagaattctgcaaaaaaaagattttaaaactagaattctacatcgaaataatagggtttaacacagacattttcatacacgtaaggtctcaaaaaactacctcccgtgttctttttctaaggaagcctctgaaagatattatcccccaataaaccacgaaagaatgatacaggaagtagagtcaaacagtggagagaagcacagagaattccgaggataatgtcaaagggaggctccaggatgacaggctgcgggttggaccaggtggaagcaggaagggggaggttcccatcacgggtgtacccaaggaaaggttacaatatctagaatatctgttgggtttgaatgtattaagacgagattgtctgtgctgtcccggcagggttctcagcataggcctcactgagaaggtgatgtttgagtaaagcttttgaaggaggttagggagcaagccatgtggccgtcaggggaagaatagagcaagcaaagggaatagtaaatggaaaggtccagaggtggtctcagacgtctgaggaacaccagggaactcggggtggctgggctggaggaaggaggaggcagagtaggtagaggtgtgtggtgagagacaggaccagacacatgtggccattccgaggctttggctttaactgtagatgagat

SEQ ID NO: 31231 - DNA, 1482 bp, Bovine  19866881117147
aaccccagagtctaaggaaaaaccaaaacttcgttcaaaacaggtttctgtggtctctgcagctgagttccaagtgcaatccttgagtctatgtaagcccttcacactgggactctgtctccttcactgatacccatagcaacggaccacatggtttcccaagggtcaagagggaggaatcacagatgaaaaaataatgtaaggatttaatctttttcttggtctctccaatatcttgcatgtaacatatgcttgcatgcatgcatgtccagtcactcagttgtgtccgactctttgtgatcccatggactgtagccacctatgtctataggagccctatgtctatgggactctccaggcacgaataccggagtgggttgccatttcctttcccaggggatcttcctgacccaaggatcaaatctgcatctcctgcattggcaggcagattctttaccactgagccaccaggaaagcccaacctaagtttgcaaaaggtttttttgtgtgtgtgttgaataaaggggctatgaaaactagatagctataacaaccatataattggtgtccatgcattttacagattcaagttctaggactatatttcctccacccattacagagaggaaatggaggtcatcttagcgtgttgctactgataagcaggcaacctagcatggaagcctagtatttccagtcttatccctatccactttctactgggtcatcctcctgcccatcagtctgaccacagcagtagcagggagaaaaaaattccatggcaaacagagtgtctgactctccaacagaaagctttctcctgaatcctattttcagttcagaggactttaagattaaagtcaaaagtaagcaaggtagaaccatgtgcagcccatatggtccctgtccccctgttttgaggctctgcccggtgaccagatggctgcccattctccaggacacccccctgcctggaatagagggaagggtgttccagacggccagaactgggcagagaccccagaatatcgctggagcagaacccacgcccctgccacatgccatctggatggctgtcccctcaatttttattctcatgaatcctctggggacaagtccagctagagacctgattagccagattcctactggaaaagttctctctggaactgttcccttgttatttatgcaaacgtccctcctctataaacggggcaggaattttaacccaacagaaattctggactgcaagttctctgttgagctaagattctctcatcaggcagcttgaggacttgggtttctccagtatgtcctttgcctgatctctctgacacccacatgagtcacatcgccatgattcttatccaacatagggagagagaccctgattcagagaggaaaggcaacttttccagaatgccctactgtcaaggctaatccctgagaaaggacatctgggtcttatgacatctaaaacaa

SEQ ID NO: 31232 - DNA, 1341 bp, Bovine  19866881160332
cagtgcacacgtttctcattgcagtggctccttttgttgcagagcaggggctctagggtgcaagggcttcactcgttgtgacactggggcttagttgctccagggcatgtgggatcttcccagaccagagcttgaacccgtgttcctgcattggcacgtggatccccagtcattgggccagcagggaagtcctagattccgcactcctaacaaactcctaaaagatgctgaggctactggttctgaatccattgaggcctgaatcatgttaaataattcatcgattttaaaagtttttttttttttcttccaacttccccagattggggagcgattttggcattgtctaggagcaggctgggtgggcccaagcagagaagcctctagaggaagaagtgaaatgtttgcactcagaggctaatccattgcctcctcccgggtatcagcaagatgtgtgagctggcgctgctcatctctcatgtcaacactcctcttacactgaaggcaggcagtgctgcctctggggatgtgagacagactgatcaaagatcagaaggagccagagttaggtcatgaatcaacacacactgtgctgtgcccctggtggatgaagacaggaagaagcgtgaaactgggaaaatcataggcaggaagcacccggaatccagccagtcactttcacatgcattatgccagttcattcttgatcaaaaataccctcaaagttggcattattacctgcattttctagattagaaaattgtgactcgcagaaggtaaatggcttatcagcctggaaaacatctacatgacacccaaatccatcttttcttcatgaaagcgcactataagtgtcttaaatctttttttaatatttatttttatttatttgactgcaatgggtcttagtcatggtactcaggatctttagttgcaacatgcaaactcatatgggatctagttccctgaccagggattgaacccaggccctctgcattgggagcacagagtcttagccattggaccatcagggaagtcccaaaagtgtctcatattttaagtcatgttgataccgggtagaggaactggggtgacacgtcatccacttctgaatcattttatcatggacatgttggacctgtggtccacctacagcttctttctagtattttccatcctgtgcaattaatctaatgatatggaaacaagaagaaacattataaatggaagctgtgcaaaaggaggcaatgatagcccaagaattgtggagaattgttttcttggttcttcccatctttcagagtctaccatcagaaggtaggaaaaggaaatacatccaat

SEQ ID NO: 31233 - DNA, 1524 bp, Bovine  19866881169332
gagtggatagccgttctcttctccggggatcttcccgacccgggattgaacccaggtctctcccattgcaggcagattcttaaccatcaaagccacctggaaaacccttccaatccaaggatagatccattctatgataattttcaaacaaatgtgtgattgcagtttttccttaccttgctttaaaactgaccagaggccctgccgtaaaggatctagttgggagctctctttcttgagagtctttcatttagttctcccaagaacccagccctttcatctctgggagtctagggacagcatctctccaggggacttcttgggctgcccttggaattatcaagacagcgttcagtgctccttctaaaagtcactggctgctaaatcaatggtgtgctgcccccgtgacctgtttcttggagttttagaaacagttgttccatggatatatatttaaagaaaatgtcagatttctcccagaggctcatgggactctgcattcatctttgcccgggatcaatacaccagtgagctggctgtgacttatggtggaatgaagacgttccctccaggccgagtcactgtgggagaagcaccatgtccacggagtattttatttctgtcatattgttaaataagaaaagaattatattggaaaataaagaaacccctctctgagggagcagtcgcttgataggggtctttttttttttttttttgaggaagaattgaatgttgagagtggaaaatttatctcttggctggaggggccgcatgttggctcttagctgtggctgtgattaaaatccaaacaatcccagttcctggcaaatggaagagggggtcgtattttcttgtctgacttcctgattagtccacatggcgccatctgccacaagccatgtagactgccagggtctgcccaatggagcctgcgggctggggtgtggggaaggattgggtagttccaggaagaaagactgttggtcctagaggagatggctctgtgaactggggcagccagatcatcgcaagggtagaggtgtgaggcttccagtgaccttctgcaggaacagaaggcttgaactggggcttttgacagcttcttagcacattttattccttcgtgggggatctctgcctgccccaaccagcccctcctctgatccttgatagaagaatgaatgctgttgggattccccatcagaaggctgagtgtgtatgacttttccagtagcagagaaggagaaagaagagacgtctactgagtccctaatgtatacaaggacttcccctgtggctcagcagtaaagaatccgcctgccaatgcaggaggcgctgagatgtggttcagtccctgggttgggaagatcccctggaggaggaaatggcaactcactccagtattattacctaggaaatcccatggacagaggagtctggcggtctacagtccatggggtcacaaagacacggacacgaatgagcgactaaacaacagcagcaatgtctaagaggtccact

SEQ ID NO: 31234 - DNA, 1547 bp, Bovine  19866881184663
ctgacagcgagtcggctgcccaactgtgatcttgaaagcatccaagtcttgattttcagtccctccctctctgtacctatgtttcatcaccccaggaaaccagcttcccaatcagggtccagccacgaagatgcaatctggagcctgtccgcttggtcagctcctgccctgggcatatgctagtcttctcttgcaaaagatggttacaagagagcacagagacccaggagtgtgcccagctggcatcccaattgtgaatgccatagtcactgacttttcctagaggattcaccctactgcttacagaaagcattattctaagaaccgtacgaagctccaagactttggccacctgatgcaaagagccaactcattggaaaagaccctgatgctaggaaagtttgagggcaggaggagaagagggtgacagaggatgagacagttggatggcatcatcgacttagtggacatgagtttgagcaaactctgggaggtagtgaaggacagagaagccaggcgtgctgcagtctacggggtcacgaagagtcggacaggactgagtgactgaacaacgagctccaagcatcaggcgtggccacccagagaacaacaaaaggccacccccttcactctcacaagctctcgggggctgtggcttggtgacgtcatcatgatgtaattctgacttcttccatccacgaatgcagcatataaaagaggccgttcttccttctgaagaccccacaccccctcagcaatttgtctctgcctttcgaatttttcccatgaaagaactatctctttggtcttcttgaagacagtcaactccccccgctgctaagccacaccaagattcgtttgaaattgctgacggatgtggaggaaaagtccaagaaagaagaattccttgatgcagcactagccctacagagagtttgctttaaaaggaacaaaccacagagaaagaagagactggcagaaccagcgagcttctcccagaaccagggagcttatacttcatgatctttgaacgtggactctgcacacaccagtcccacaccagagatgcctgctgcccaccatgggggcgaagtgagggtggctgccctcagcctccttgaaggaaggaagctcccggtcatctcatcactagggctgcttgccgacccccgaagggccccccctgagccgaccccctaaaatccagcccctgagacaaggaagcagatgctgccacccagtgttcctcttgaaggccaagggagtgtttttctacatcgttgatatatttgcttttccctcaattaaattgctgtaaaaggggggtgtgggttaaagccatttgagccatttttattcagctaaattacactggatggctcatttaatgaactttaatgaagccaaaatgctttctctaatcaaatctcaagtgacgtgactggtgtcttgacctgagatcaggagactggaggcagcttgtccacaaggcctggggctgagctaaaccctgggtttcccagagaacgttcctgggaagccgaggt

SEQ ID NO: 31235 - DNA, 1872 bp, Bovine  19866881231610
aagaatcaaatggtaatttcagaactaaaaaaaatctgaaataaagaagtaactcaataatgaactgaccaaagaagaagaaaagaccagtaaatttttaaaaaaagatcaaccaagaaaataacaaaattgaaacacaaagagaaaaaaaaaaaagaaggaaaaaatacgcacatcagaatgctgtgggaaaaacaaatcaaacagtgtatataaatgcaactggagtccaagaagaggaaagagagaactgaggtaaaacaaatatctgaaggtaaaatgaccaaaattttcaaaagtttatggaacacatcaatctacagatttgggtttagtgaatgtcaagttggataaatacaaagaacagcacatctgatgacgtaatagtcaaatcaccgataaccaaagatgaataggaaattataaagcagccagaaaagggagggacattaaatttagagtaataaccatatgatttacagaaaatatctcaatatggcttatagaaaacaatagaatgacatagtttagctgctgcaaggaaaaaaatctataattctatatgctgtgaaaatattattcaaaaatgaaagcaaaataaagacattttcagcaaaacaaaagaagagaatattcaccaatagcagagtgcaccaaaagaaatacgacgagaagctctctgactgaggtacaaatggaggtctagatcttcaggaaggaaggaagagtaaaagggaaagggtaaatatttttttaactttttattttatattggagtatccatgcatgcgtgttaagtcgcttccgtcgtgtctgactctgcgatcctatggactgtggcccaccaggctcctctgtctatgggattgtccaggcaagaatactggagtgggttgccatggcctcctccaggggatcttccccacccagggatggaacctgtgtttcttgtctcctgcattggcaggcaggttctttaccactagcgccacctatggttgatgaacaatattgtgatagttccaggtgcacagcaaagcgactcagttcagtccagtcgcccagtcatggccgactctttgcaaccccacggactgcagcacgccaggcttcccagcccatcaccaactccaggaacttgcgccgggactcaaccatacacatacatctatccattctcccccaaactcccttcccatccaggctgccatataacactgagcagagttccctgtgctatactgtaggtggaaagggtatattagtatattacatattggtataggtaaaatacattaaaaataacaccaatggtgggaaaggaagtaaaggaatcatactttctaaggttcttacattattaaatggaataacactaatactaattacaaaatttaagttaagaatacatattataatgtctagaagagacatttaaaataatataaggaagtacaatttaaaagccaacaggagaataaaaaggaataatttaaaatgcttgattaactaatcaaaagaagattgaaaataagaagcatataaaaaagagatagaaattggacacagagtaaaagggcaaacttaaagccagttatatccttaattacactaaatgtaaatataccagacacttcaacttttttacaaaatgattgtctggataaagaatcaatctcaaattatgctatttgtaagaggcacactttaaagacataatttgaaagcaaaggatgaaaaaagatataccatagaaatgttaatcagaagaaagtttgtatagctatattcacatcagacaaatattcttccagacaggaatattactagaaataaagggaacacgtcataataataagagtcaattcatca

SEQ ID NO: 31236 - DNA, 1287 bp, Bovine  19866881241958
tcccatggggttgcaaagagtcagacatgactaagcgactaactttcactctcatccaaagggggtcgtcagtgtctggcccctaggggaccctgcggtggtgtgtgttccttctgggcttttccactcaaaagccatgttcacgaagcaagctcctcccaacccctttaaaaaaaaatcacttcatttgtgttgtttctgtgggcaggaatgtagaaaatgagcctattcttaaaaaaaaaaaaaaattcctagaagttaaaaagaactaaaagagaatggaaagaaactgaattaggaagacctgcagggagattgaatctcaggaatttaaagagtagtctttctagagcccaggggatgcgggggcattaagcgctatccatgggctcagaacctgggattcccccagcaagcccatcagccaggtggtgtgtgtggccccacgcagagagagaatggagcaggctcagagatcactggggagttggtggagagcctggctcgcgggtggctgctccaggatttaagcccaggtctctggcactaaagccagcatctttccggtgatccttctgctgacctgaaccttgcctctcctccctccctgcagacacatagagaactggcgcggtctgcacacgctcaacgctgtggacatggagctctatactggcctccaaaagctgtgagtgcaccagctcccggtggggtgggggcaggggccagcccatacgtagttcaggcttcgagatacaacctgaacccacgtcccccgggttagtgctttcctcagtcccgtgctggactgatggttcacaaggagcagggatatttccagtcacctcctcctttggattcagtgcgagtgactgcgggggaattgggtggggaaagggaggaggctgcagtgctagagttgctggaccagagtcttatccacttgccaggatgggcacatttctcacactcacccaggtcccagtgggatgtgagcccaaatcctgcccgctcgtcctgtggtcctgtccctcaactggaccacaagtgatgaccggcgatgaagagatgcattcagtttacagaggcgactgttgtccagtcttggcctcactgctgtcagtcttggcccagagcagagctgtattgctaccccgtaagctctgctgaccctcttttcctctctctcttcaggaccatcaagaactcaggacttcggaacatccagcccagagcctttgccaagaacccccacttgcgctatatgtgagtagagctgggtccggg

SEQ ID NO: 31237 - DNA, 768 bp, Bovine  19866881307044
ctctgaaagcaggacttgcgggaaactctgacagctaagtgcaagtaagtgaaccacaggacactgctctctcagggtcccagactttactgtctttctgtccttcattccgtgtgtgtgtatgtatgcaccctcagagcacatgctcacatatcctttccaccctgtaacaacccaatcacactgaacccaggacccaggaagagacacaagtctcttgattggacagaacacagaccacagttaatgctgtaacgagcatacacttagcatgtgggagagcaattcagccctcacttggactctatttatcatttctttcagcactgagtctgtaagcgacatctgaatcaccaggacggcttgttaaatacagaccactggccccacccccagagtttctgattcatctggtcttggatggggcccaagagtccatatttctaacaaaatcccaggtgaaccggatgttgctggaccagtgaccttactttaaggaccactgcttcacagttttagagaagccaagtcttgacttccaagtgatacctgatcagaatggaatcggtgagtgtgtgtgttggggggcggggtagtggtgagccctgccaaagccaggctttctgacagctgcaggaagtgacagttgacagcccgacagcaaagaaagagacagcaaactataaaaagcagacataagaactcaaaaagcaaggcagtctgaagccatctcagtgggataaaattattatacacccctaaataaat

SEQ ID NO: 31238 - DNA, 3248 bp, Bovine  19866881363105
acattttatcttaacatattcacagtgggttaattttgtatcttggtatcagacaaatgattgcaatgcctctcttcctttttctttcatttttttttaacatttcaaatgatcttcattaagagaaaaaagagttgtttttaatttgctcatccatttcaattgtttcatgtccttttatcgatttttatgttgaaatatttcttttcatatttcaaaaacagatcccttgtttagcagctttcaaacctggcatcaggtaatagcttgcttgccaagacagtgagcttccccttccccccaactaataaaaaaatcaataagtcattagagatgcctttaatcaagattaaataaatgaataaatttaactttcatccgaccgtgaaaagcatacttgctatagtaaaatagcacagtcaagtttgaatccttgatgatcaaattgggtttaaagaataaaaccttaccaaagcctccccatcactgatgactgcctacctgatccccaggggtcaaagggacgcagaatgctcatgtctccttctccaagagatagagagggtcagctttcagcatcttgaatgtcctccactcaatgaccacaacagatcagaacaaattgatattaagagaagccatgacacacctacacagagtattaaaaagcagagacatccatttgccaacaaaggtctgtatagtcaaagccatggtttttctagtagtcatgtatggatgtgagagttgaaccataaataaggctgagcgccaaagaattgatgttttcaaactgcagttctggagaaggctcttgagagtcccttagactgcaaggagatcaaagcagtcaatcctaaaggaaacgaaccctgaatattcattggaaggactgatgttaaagctgaagctccaatactttggccacctgatgtgaagagctgactcattggaaaagaccctgatgctgggaaggatggaggacaagaggagaagggaacaacagaggatgagacggttggatggtatcaccaacttaatggacatgagtttgagcaagttccgggagttggtgatggacagggaagcttggtatgctgcagtccatgaggtcacaaagagtcggacgcaactgagcaactgaattgatagaggaagtgactcaattcaaagacccaagttgtgctgccagaagcacttttcttgtaatttgggaaatgctctcaaacaatgtggttatagatgagactttattgaagaaccctcagctgaaagctgacagcaagtcagctgagcccaggggtagatggagcttagtcagtcacgcagagaagcagcatccactctccatctgcagataaggaaaagcctcaaagaaaaaatacttgaaaatttctaattacatttgacagaatagctaaaaagcttatgtacaatcactttagtgagttctaaggctttaaaacttcatttagtttcactgcacttaaaaaaaatctctgaatattctgtcaggtgaccttccctggtggcttaaagaatccggagattctttagacgataaagaatccacctgcaaggcagaaggcccaggtttgatccctgggtcaggaagattccctggggaagggaatggctacccactccagtatacttgcctggagaaccccatggatagaagagcctggtgggctacagtctgtggggtcacaaacagtcagacatgactgagcaataagcatgcatgcattctatcaggtacaacataaaatgagtaaagaaaatatagtcttgtttctagaaacattgactcctaggagttctcctatgtctgctcttgtttatcttagaataaatttttaaatctctgatattattctgctttttatcttctctttgtttcatctcttttctatcggaattaaacttttgtttttctttttaatgtatttatattttaaatagataacacattcacatgctcaaatatcaaaatgtataagaaaatacacagtaaaaagacacttccccacctctctccctacaggtaaccactgttattatttttttgtatgtcctttggagaaaaatttttagcatacagtagctgcaaatacaagcaaatactacctcatctttggaattaaacctttcatatcacaatatgtcccactccatcggggtagggttggagtaccttctgggaggaagtgtcttgcaccatgcctggcatagaattagggatgctattatataggaagcactcagtaaatgcttgtgaatctaaagaggctactgcaggaagaacagagaaatgcacatacagcctgacttctgttcctccactaatgttatgaactcactcagattctcacttaaagcaaggggacaaggaccttaccttgtgcccccctcccgaagtcccttcaacccaatcctatttctctaccagagtggttttgagtatgggatggagaaaaggaattttttaaaggagaagacacaaagaaatgaggaaaggaaaacaactaaaaaaaggatgcaggagaggaaggggaaggtggaattcagagaagcatgagcccctttgaaagggaagggtcagatgaaacccactaaaaattctgatcatcacctgaaccccattccatccccattccatcaccatccttctgtcagacataagctgtgattcaggacactgaaacactcgagattaggactcaataaatttatcatgacacagtgattactgaacaccaggcacctggagaaaacattccaagccagactggcagtgcctgtgctgacagtgctcttttccacatctgaagaggccatgacttttagtcccacgacctaagacatctgctgagtgtgaagcctcaactcctaatctcctttatgttatgctttgctgtcagaaacaaaacctctcccctcaaaataattttttaagttctctagacttatatcctcttatctcatcccaaagagtgacttaccattctatcagaaacatatctaagtcccagaatagagaatgtcatatagtatctctgcctttgaggaactttggcccttctttcacatggtagctgtgaacgtttttataacagatatcagaaagtttccacagtccgatcaaaaacatctgcttccttcagtttgtatttcccattcagtatgtcttttgacaaattccaaagctctgtcctgcggttaagacaaagatacaattctgcaat

SEQ ID NO: 31239 - DNA, 1788 bp, Bovine  19866881367373
gaatccaatggacagaggtgccctggcggtttgaagtcccatggggtctcaaaagagtcagacacaactgaatgactaaataacaacagccaacctttggctgagtatgtcttctctcctatcccaaaggcaacaggtttgctgccaagtcattctgctttggaaggagaggtggaatgctgtcagtttctctgggatccccttccctttgggagtttctctggggagtttccagagtggaccttgggaacagagattccattcttgccacttggggcatttgtatcctgattacattcattcccatgatgcatcttctcatggaccattccgatctttgcctggtgggaaggcattggggaggagatggcctgtctccatcacttagggctgcagattctcagatgctggtttctcatccttggccccgtctcactgttcagcgcgggacacttaagctctcaggcccactttggagctcaggaagagccaatcctccttccccattcatctctgcttcatctctctttcatctaatggtttgccaccttggcaggaagggtgctgctgggagctggggaggccccctcctgcaagttctctctcctagcagggggcactgtgtttgctaataggtgttaaatgggagcatcaaattttaatcagcgccttaatggagtccggggacctgggggagttctcgagtcctgcattatgctgctcgctggagccaagttggatgcagtgagtaggaaggtggggtgggcagctgccatcacagccagagctcctggaagatgaggtggtgccggccactttcttccatggtggcccagcttaagtggccatgtcactactgtggatgctcttggtgacacatctatcactgacttcctcttggtgagaagcaggtctagtagcagatatggaaatgggaaaaccttggcattggaagaccctggttcatatcctaacattttcaagttgagtgaatgactgtggacaagtctgttgatgtggttgttgctgtcgctgttttgttgctcagttgtgtctgactctttgcgaccccatggatggtagcccacaaggctcctctgtccatgggatttcccaggaaagaatactggagtgggttgtcatttcctcctccaggggatcttccttgacccagggatagaatccgtgtttcctgcattggcaggtgattctttactgctgaacccaccaagggaagcccttctcagtgtggtagccagcttattttaatcaggacccccagtgaatcaggccttttgtgatgggatgttgccatactcccatttagaggctaagtttcttcatttccatcacactgagttgttctacgacttactttgacatagactatggtgtcagtgtcataaggaagatctggagtcttggccttaagagaccttgttgcttttactttctaccctcttggagagaccactaggaaaggaagcctctccaacctagtggaggctgagaacccacatgcagaagaaccaggtgctcccatccatggtaagtaagtaagtaagtaagtaagtgaagtcgctcagtcgtgtctgactctgcgaccccgtggactgtagcctaccaggcttctccatccatgggattctccaggcaagaatactagagtgggttgccatttcctgctccaagggatcttcccaacctggggattgaacccaggtctcccacattggaggcagacactttaacctctgagccaccagggaagatccatggtagtagtag

SEQ ID NO: 31240 - DNA, 750 bp, Bovine  19866881400837
agtcggacacaactgaggtgactagactgcacatgcatgcaaatcgctaggggaacaggtgacctactgaacccatcaaagtctcaatttcctcatctgcgaaatggtctcattttgcgaaatcctctcacagggatatttcccagggtcgcctcgaggatagagaccctagaacagtgcctggtacatggaagcggctcaacaaatgttagttccctttgtttttggaagaagctggggcctaggagccacgagatgcccagctgaccatctcattctggattcaaaggggaggaaagcttcaaggtgcaaggcccggcccgcagaggcagagagaagtgaggagatagattctggaaaagtcaagggcaaagaacactgcccagtgccaggagccagagctggagtctcatgctgtgctggactctctgatgatggtctgcatgcccagccaggctccagtctggaagcgaaggtgttaatctgcctgaatcagccacacaggactcagatacttatgccaggctccaggctcccaggaacaggcgaggaggaggcttcctaaattagaatcagagtgcagaactggggtcacaccttggagcaagggtcaagggtgggggggagctccctcactctgcatgcggatggctcagatgggctgctgcgagcgggagcggagcggccaccctggcctctgtttacagaaagcagactggaggcctgtgacccgaggccatacatgacttg

SEQ ID NO: 31241 - DNA, 1284 bp, Bovine  19866881493799
tcatgtgttagccagaagttccaatttctgctgctctgtttatgaatgatgcagttagttcgtgagttctaaaacatgctgtgaattttcttccacttatgctaataatatctctaacctgctgggcagtgaggatttccctactgttttttctcagggaagtaaagcctgaatgtcagtcgcttccttatatcctggactgcagatcagttgatccacagctggctaatgtccttgttattgttgttgttgtttggtcattaagtcgtgtctgactcttttgtgacctcagggactatagcccgccaggcttctctgtccataggatttcccaggtcagaatactggagtgggtggctatttcattctccaggggatcttcccaacccacagatcaaacccacatctcctgcgttgcaggcagattctttaccactgagccactggggaagcccaatgtcttccttggcttactttaaaaaacactctcttcctggcttttgcgatcttgctaagaatggttgtgaattctcttgtagtccacctgatttcatgcttttgaacttccctatccctttctctccaagccctaagttgcagtgagaatttcaagattgtcagataaatgctaaagccatagttctacagactaggtgcacatcgaccacattgtgctttaacctccttggccaaggagtctaacctaatgtttgcaaatcctctgagacttgttagcctcgctcagtgattttgtgacttccttctggactccttcttaaggttagatctgactgtagtaccagattctgaaaccctctctcccacttcaaatcatcttgtaatctttcttgaccttccatgccaaggagcctaccttcccttaggtgtgatctctaattgctaccctagctgcctctagcatcctagggcttggagatcagcatctccactggccttttgacacaaaagttgcatcccatttggctatcttagaataagatgcatcaagagggcatcttcagatgaagagtgcagactgatgcaactgattctggtcattgggtcactctgtgtgtgcttctgtctcggccccttttaggtgggaggacataccatgctcccgattcgctggatgccccccgaaagcatcatgtaccggaagttcactacggagagtgacgtgtggagctttggggtgattctctgggagatcttcacctacggaaagcagccatggttccagctctcaaacacagaagtacggaagggggcagatgccgggag

SEQ ID NO: 31242 - DNA, 1720 bp, Bovine  19866881523126
acagatgcctacacacaccttgtgtggggccctgttgatgaactgcagagattctcagaggagggtccaggggttggctcagtggtattgaggatctggtcactcaaagcagaggctagataccaactggtgtggacatacttcagtatttgaacaatgaccatactggtatgtatccccttactgttagccctaagctgtgcctgaatcctgtgacttccactcagggctccactgttagcccagtgcagcagcagaaagcctatatcctcatggcttgaatagaaccatcataatcataacatcaagaagtttgagctctgcagatttagaatctccaagtctgtggatcagggagctgataaatatcagcatttcgggacttccctggtggtccagtgactaagactctgtgctgtcatttcagggggcccgggttcgatccctagttagagaactagatcccacatgctgctcatacaccacaacaaaagggtcccacgtgccccaacaaagacctggcacagccaaagggaaaaaaatagcatttcattcaataattttgagtagggtctcacaaaggatggtagaagtgtctggttttattgaatcatatcataatacaatataaaagcctctctctctctctctgagtcatttgtattctccggtaagtctctttttgtctgtcccagtgcctcttcctcatctgagttccacgagacaatccaaagtgtcaaagatgtaatcttggaggggaactctcccacttcagctactcatcaatcttgtacccatagcagctttatataagacccctgtatccttcccagggacatatctatatagctcaatccatgggaaatgaaatttacatgggagaagggacggtgtctatgtattacttattcagtgacatcctgtctcattgcaaacagtgttagaggtggtttgcaaaaatatacatgggcaatgcaatgggatcaatgaagagaatgataatatctggaaataggggaaataaatataaggaaataaaactggtggcgagattagactattaagtgcctgatgatagagggagcttatggatttggctccaggcatcccagtgaccaaagcacagaggtaaatattttaggttacaggctgctgttcagaggaagaatagctttctcaaatgttgtggtttaacagacgcttctcccatagcaccacataaagagcggagtgtgggatgcagagttatgctcaccagcaacctgaaaatagatcccatggcgcacctcttaggaatgttggttaaaatatcccttgatgcaagtcagtggcttcatgctcaaacccacttcacaaactgggtgggtggcaggagagatgtttttagaagcacccacagcagcctggtcttaccctggggagacccagccttgcctggaaaatgggggcctttggggaactccattgctgagggctgatggaatttccctcttcatcccagaacatctcatctgggaccttgcaggtcagctttcccagccagtggtgctcttcccatctcaccccctcctcccactaaggcttttcttcccaggcttattggaacttgatcatgtgaggccgtaaatcaccaaaatctagaacaaatctcatttgacatttttatcttgactcttttgggggcctttaattagcatgattgcagtgcaggagattgccc

SEQ ID NO: 31243 - DNA, 1453 bp, Bovine  19866881613144
ggtggcagagttactgctttctctgaatgggtccccaggtgcctggtcctcttctctgaacctccagtgctgtgctcagcttaacactgaagcgcgaggtaccccaagtttttgtcacagtgaatgtggcagtgtggggctaccaccaggactctagaagtttccagaatgctaggattagtattccgcctcctaggattaagcctgaatcttcattaccaatttttggagacatctggcccacctgtttcaccagtaattagtccttcccagagcttatattacatgacttttgcggtcacctggaaattaaatttggctgtaaattaaagaggctggagggtaatctgagaataatacccataatattagcaaggctttgtgttgaggtacactttttactcattaaccttattggaacctatcaaattaaactggggaaggaggctggaggacaacgaggggagagtttgggtttaaagttacaaattctgtaagcaaagcacagagccctagcaatgttgctggctatgacttactgtagctaccgaacataaggaggtcatattttagtgaaggagaaaaggataatctcgaatgcggcagtcacagacaacatactccctccaaaacaaaaagctaattatagctcaaacctaaatacaagatggactcatgtcctttatataaacctggacgacactttgatataggacggcttcaccaggacccatcatgactgcgtgaatacagaattacacaaacatttactaacattcccaccagggcagactgggagatacaggacagaagggtacagaagtcaagggctctaccaacaccctctcatgacgcctgagatgaactggacactcactcacaatggtgactggctcaatggtgacttcatcattaataagaaagtaaaaaaattcaggaaaaaaaaaatctctcacaaatgtattactcagatctcaatgggcttccctggtgtcactggaaagaatcttctttccaatgcaggatacacaggttggatcactgggccaggaagattccctggagaagaaaataacaacccactccagtattcttgcctgggaaatcccatggacaaaggagcctggcaggctacagtccatagggttgcaaagagtggaacatgacttagtgactaaataacaaccatttttagtcacctctgctccttttttttttttttttaaagaatacacaaggtatgattcagaagaaaaatattagaaaccatttttccatggatggttggtaaggtctcaggagacaattttctatacagtttctcttaagggcagaatcagctacaagtcaatgagagaaaccagactcagctgactgcagtttactggcttgctctgttgtacatttccaaactcgtatataaggagacaatgtggaaacaggagaatgatgg

SEQ ID NO: 31244 - DNA, 1356 bp, Bovine  19866881621494
cctcaggatggggatgcatgaagaaaatgggcaggtccttattctcaaaaaagttacagaaggagagatgaatatttaacggatgagcatacacaccacacactcaaaagccaccacaccaccccaccatactttaaaattgtgatgggggacttctctggtggtccagtggctaagactcaaagctcccgatgcagggggcctaggttcaatccctggtcaagggaacgagatcccacatgccgaaactaagagccagcacagccaaattaatgaataatcaattaattagtttcaaaaattaaaaaataaaattgtgatgaatgcagtgatggaagagtccagagcacaaggggaatcacagagtctaagtcagagcatcacaggttttaaaatactttcaaggatgaaactatgttactgtaggtagacttatgagttcctggagcagcaggtaaataaccagctcccatggtctggcagagtttccagctaagatggaacatggactaagggttagttgaattaatgaagggctgggtggctggatggatggtgaccttgctgctacaccttcagttacgaaacttggcttctggtcccttattctcatacctgcctctattccctgggggtttgccttcattttctctgtttctcaacatcatcttggccccaccccaaagctgtctcaagtcacaaactgcatgccttggaaatgcctcctagaatgccatttgttctggaaaaaaaaaacccttcacagacaacattttccactctgccctcccagccctgcctcccccatccttgccagagttgtctccacttcttccaaggggagtttaaaaatggaaagtcacgtgcaaatggaaaccttgagaaacccagtgccttggagagatgaccatcttccccagggaaggtggcttatgctggagtcatttatctgcccacgttagactgcaaggtcttaggcagggaattttatgtctcctggagcactgaacacagtggaggcactcaacaaattgtaaataaccctggggaggagcaattgggaacactgggtaaaacactgcaaaaatgtccctcctgcatgcagagctgggatgcagcttcattctcagtccatgtctcagagcatcctgaaaccacagccctggctggactgtcacacggggtcaaggaactttatttaccccattggtaaagactgattggaaaagatccagatgctgggaagagcgaaggcaaaagaagaagagggtgagatgctatctaaccatcttcatttacgagatggttggatggcatcactgactcaaggacaagagtttgagcaaactccgggag

SEQ ID NO: 31245 - DNA, 1805 bp, Bovine  19866881624162
acacatcctcaatgccaaggcaatactgacaacaaatgtaacacaatgcagatgacaccagtgaaaagtggatgtacgcatgccttactgggaccctggatttagaggggagcctttgtctggggctcatatcctgattccagttcttcttagctgcataactccgaataaagaaagaacttcccttcgtcaggcctgggtctccctgtactgaggccgcctgctcctgccccacagataggcctgtggaaagcaagctcgtacggtacttaatgcgatgcttggcatatagtaaaaacacaagagatggaagctattactattattaccctgatacccaatgcctaaaaaggtctcagaagtcaggttccctttggggataagagggatgtgattgctttttgccgagaagcagatgtgtctgcttgagggaagagccgagaagagccaagataagccaagaagagcctcttgttccctgcatcttctctggtggccatactgggtctttaccacatggctgtaaagtttctgacatgtgcactttccagggactttgggtcagggggttggggagaaccaaatttccccaagtagctggaagactgtgagggcaaaggaaaaaaagaaaagaaattggccctgctgtaagttatgcactttttttgtcgttaagggatctcgtttaatttttactaaaaccagaaaaggctggtataatatccccatttttcagacagagaaactgagacccggaggaggaaagagattagctctagacaatcagctggtgggctggaactagagcccaggtttgcttagctctaaggtccctgcacttggctgtctaccacactgtgtcccagttccgggtgtctttgcaggtataggtgtgagtttgtgggtgatgctacagtcataagacacaggactgtgtggaggtgtatctacattccacacaggcagatgcgggccatctgtatgcagagcacacgggagtcagttattccagtcactcggagttcagtttatccccctgaggacttcttaacaccaggggctgctcttcccctgacaaatatggattgcttcattggtccttaaattctcgtttgagtgacctacaaagcacaaagaatgacagcacttcttgaattagttttgtctgtaaaccacttcaacagaggaaaatcagctacctatcgtgtggttcctcaaaacgagaatcgttgccagaattaatggcaagaccagcacggctcttaatggaacaataaggagcagtgtctgattttcagaaaataccagagatgactgattcatccatgccagagcaaattggacccactgtcagcttctaaaaattaattctaaaagagatgcacccatcaaaatctgaggacctcttatgtggatgtctgagaactctcaagctctgatatcgtctttctctcagtgacttgagcccaagtcttggaagataataaaaatcccaaagcagtaggatacttcgataaatgtctgccctcggccccagcttccatgaacatacttccacatgtccattttttcagctgttctgggagcccatgaaacgcatccatgtattatttagtgtcacataggttacactatggagaaggcgatggcagcccactccagtactcttgactggcaaattccatgaacagaggagcctggtaggctgcaatccatggggtagataggagttggacacgacggagcgacttcactttcacttttcactttcatgcatggagaaggaaaggcaacccactctagtg

SEQ ID NO: 31246 - DNA, 1089 bp, Bovine  19866881636918
acatgaatctgagcaactctgggagatagtggagggcagaggagactggcgtgctgcagtccatggggtcacagagttagaacaacaacaaagacatctccctcctcccagcagctgaaacaggttttgaattttgccttgataaggaagaaaggataggctgaaagggggctgatgtcctatatccctagcatcactgaaagacaaccaaatgaagaagcgaaacacaggcagagaaaagcgccctggcagcagagtggcattaaatgtaggttaaggcatggcttgaggtcaaactgaacagaaagctggcagacaggaaaactaaaagtagagtgtcaggcccctgatttccactggtaaaattttcctagagttctcaactgaacaaatcagttaagacaaggtgggggagacattgcaagcacagaccctttttcctatacatgtatttttaatgtggaacctccaccatacagtagagagtggaagaaatatgtgaataaaatggaaattgagcaaaacgtatgtctttttatagccaatgattcatacaaagtgacggctcttaaatattaataataagtcaatttttagggcagaaaggcagagatggagggagatgataacatttctctattttttttcttcatggtccaaatttagaaaaataaatacagtaaatactctacctatagttgcaatatttatatagtttatcatctgcctcggggtattagttctgcttgggaacaaatacactgcttcaacttgacactgagatcatgatttggagctgagaagaaactggtttcaagaattcaaataatctcacacaaatttcaaatgtgacaaagagacagcatttttcatgaaaatgtgaacctcactcatcactgatttgcacaaaaccttagcatgcatcctcaggactagaaaatctcaattgagagagtctggggacttccctggcagtccagcggttaagattctgcctttcaatgcaggctgtgcaggttcgatcccggttgggaagctaagatcccccatgccttgcggccaaaaagttaaacataaaacaagcaatat

SEQ ID NO: 31247 - DNA, 1009 bp, Bovine  19866880557138
gttgtgtttaacttgataaaacaccagccgggatcactcctctgctgaaaaacagttgagttattcttattgcctacagaataaaacctatacacctttaaggacgtttgtaatctcactactgtctacatcttcagcttcatctcctactggattcatcatctattttttaaaatttttattggggtgtagttgatttacaatggcaccccactccagtactcttgcctggaaaatcccatggatggaggagcctggtaggctgcagtccatggggtcgcgaagaatcagacatgactgagcgacttcactttcacttttcactttcatgcattggagaaggaaatgcaacctgctccagtgttcttgcctggagaatcctagggacaggggagcctggtgggctgccgtctctggggtcacacagagtcggacacaactgaatcgacttagcagcagttgatttacaatgttgggttagtttcaggtgtacagcaaaatgaatctgtttgacatatacatatatcttccatcatctacttttatttattaaactttaatggagcatctaaaccatctagcaactctgaaaatgagattttaaggaaaaatatcctcccagccctcagtaagagatagggaagtaactaaatgtgctaatgctatgttaaaatatgcagttgtgggtattaaacatggctaggttgacagattcacaaagaaggcttcttagaggaggtgacagttgagactcgagaggtgagtaggagctatcagaacaaaaaagtgagaacatcaagagaaaaggcacagaggacttaaacagttaaacattctggatttaaaaggtggttaggacatgagacttaagcacacacgaggcaggactctagacaggcaggccagactagaaaacatttggctggtgggggttattttgtaagtgccatggtctgaatgcttatcttccctcccctaaaattcaaatgttgaaatcctagtgtcaatg

SEQ ID NO: 31248 - DNA, 1021 bp, Bovine  19866880573546
ttttcttataacatgggggcacatttgtgcacatatttactctacatagaatgtaatgtgcttagagtaagtgaggctaaactggttggatctgagagtagtattgtgggcttccaaaatatatgatggccagcttaatttgaatttatatttttggtaattactgaggagactcaaattataactgcatctgcattttctcaaggaactggccttttctattaaagagattaagggaattgggcctggaaattaaggaaatacaggagtttatgcttgaatgaatcactgtgcaaaaaatacaaaatattaacactgggaaagtcttttatcacttatccttatcaagcattctggggaactaaaaccactgtgtgctggcataaaaaaatgaagatatagttacagaacaatgactatatgcaatagttcgttgcagggctgtaaggatgacaaaatgtagatgtaagactctccataaatttgaagttgtgcagtatttttttccttctccctctcttgctccactttctgccattctctccccaactctggccctggctggttgactttctggagtgaatcaatgggttctgttgttgtgtggcttctggttggttttgagctgtggtcaacaaaagcaggagaccagaggaagggagaggaggaaattctggatatctacacccttacttctagtcctctgaggtcatcaaaggctggctatccctttctactaaaggccaagatttctgtaacaaagcctgcttcatgtatctgttttttttggggggtggggcacggttcaaggaacttattcctcataccacactgtaagcctcaagatggtaactgatgcgctttgaccaaccttggaatactgaactatcctttgtagtttctttgtgttctatgcacaccttttcaatatttctttattaaaaaactactctgtttagcctgtttgaatgttctatatctttcctgttggaatctgacacagaaatctaagaactaacag

SEQ ID NO: 31249 - DNA, 1967 bp, Bovine  19866880585564
aattccccaggccagaatactggagtgggtaccctttcccttctccaggggatcttgccaacccacgggttgaacctaggtctcccgcattgcaggtggtttctttaccagctgagccaccagggaagcccaagtgtctgaaaaggagggcagagagctgcagactccaaagtaaagttgtcaactctaattattattgttttgtaggcatgtgtcagcctccaagagaaacttaacatttgatttttgatgagaaatcacccaacttttaaaagttggcaattaatttaaaaagtctgaaaacactgcccactccgcaaacatgcctgtggaccgtgtgccactgagctacctgttgacagccttggcccataagaattatcctttgtgctcatgtccttttccccagtgtcagccatgctcactaagcttcttaggtacccagtggtaaaaaaatttcaagtgatttattcccaagaagggtagaggcctgataaactgagagccgtgcagttgggagggactctaaaacatcctgtccatcgtttgcttttggagtcttggaacccagggtctggggcacactgccttctctttcttcccttagccttgctgtcttggaccttcatggctgggtctttgcttatacattttgcccaggaagtttctggctcatgagagggaagtacgggagcccacttggaccctatgattaatacagtgatgtgatgacatctgttcttgtgaatctggttaatgtgaatcagtccctaagactcaggtcagctctgggaacactggaaaaaagcctttctgggcctgcaatgctgaaggtcattggcatatacaacttgcaaagtcctgcaagtcctgagttgccatctggctgccgttttgttgctgtgtaactccagagctggaaattatagaaatgaattagtgaatctggtgaagtagcttagttcacctacacaggtggttagaggaggaggctgtatatttcctcttccaggatggggtgttgatgtgtctgctcacttgatcacatggtgtcatgtaactctaacaagagacgttttgagtggggattgggggctccagtgagatggacactggagggcccccactgctcagtgctcccctgaggggcttggcttaaattcaactgggccactttggagaatctgagtatggtagtgggtcatcttttgtttgtacccttctgtaaatggaagggagaaaaatcacagttctacaggagatagaatgaaaaggagacctttgtatttgaagtgatagctttctgaacattcaaagagagactttagcacgtttctcatcccgagaaaagcaatgcaagtggttttgtgggagagggtgtgggaagagcagatggctctctttccagggtggatgtgtcagcagaagcaagtgcctcagcagccgcccctgtgtgtgagtcggaccactgggcatggcacctttcacccggcagccgtctgaacgcgttagacagcattctatctagctggtgttctcagtgcacacgcagatgaggtgtggtggtttagttgctaagtcgtgtctgactctactgaacccatagactatagcctgccaggctcctctgtccatgagatttcccaggcaagaaaactagagtgggtagccattcccttttttggggatctttctgacccagaaattgaacccaggtctcctgcatagcaggcagattccttactgactgagctacgagggaatccctgcagatgaggacttattcctaacttcacagaatttgtaaatgagtagctgtgttttaactcagagtctctgattattaagtccatctcttgttggatacaactgtgtctgtacgtaccctcctcttatggacatcagggctctgagccttctctgaattgtactccaggccaattcaggccctcaagggaacagaacaa

SEQ ID NO: 31250 - DNA, 861 bp, Bovine  19866880595909
ctgtttgggtttttttaattaattttttaccatcaagcctgtcacagccatcttattaataagttaactattcaaaaacaaagaccagtttagttttgggggaacttggtactaacaacattatcacagagtactagacccagggttagggcgtaaaggaagaaatgaggatggttgtttaaatgggtctgaaattggaaatgaccttaaaactaaaaatagagaggaaaaagaatgtgagataactaagcacataggatttgcccctcacagagctaaaatagcttagttcttaagagtgcaagtatagcagtaagacagacttgagttcatactcaggccctgttcttcaccagttttgaccttaaataagtattacatttgagccaactatttgcttgagagagtgacacctcaggttgttctggggtttattgggaagttaacaaaatgctttgcctattgcctggcagacagttaaagaaagaaagaaagaaagaaagaggtcgctcagtcgtgtccgactctttgcgaccccgtggactgtagcctaccaggctcctccgtccatgggattctccaggcaagaatactggagtgggttgccatttccttctccaggggatcttcctaacccagggatcgaacccaggtctcccgcattggaggcagacgctttaacctctgagccatcgtgagacttaaatggtagaggaagaagctaccaaatcaaaaactcccagaaagctttcaaagaacttaaggaagcaagaaagtgcatcaccaggcaatcccttctcagaaggtgaattctagaattttaaggcaaaggcacccttattttcttcaaagaaactgcgg

SEQ ID NO: 31251 - DNA, 875 bp, Bovine  19866880606205
aatttgggggatgctttgtatttgttccacagtttcactacttagtgtgtcttttacacttgaagtacatctcagtttggactagacatatcaagtactcactgaccagatgtgagtggcattttacatcttgttagacagcatagccttagcatttcataagctgttcacagctgttctctctgagccagccaacacatggtcatggagaagacagaattaggagtcagactttcctcaaagttcttcagtcagtcttctaaagattcctgattgattagttctttgtttttagagagatatatcagaaagtttcagatgataatgatttaactgtctgaagttattaatgatataaatcgaattattttaatttgtctatcaagttaattttcttacgtgatagatatttagcatatgtgaggaaatttagtactgaagagttaaagctatgatgctgtccttgatgatgtgttttgttttttaagattgcagcaaaaattggaggtgatgctggtacgtcactgaattcaaatgactatggttatgggggacaaaaaagacctttggaagatggaggtaagttatagccataaatattttaaattgttttacacagagtttagttgaagtgattttcattgcttttcaagtgttctttttttgaaacattgcttttatcataaggttcctaaaattgtaagggttatattggcctcagaaggagagggggtaaaaagagacctaaacaaggtaggtaaaatttaagttaaccagccagttttgtcttagtagaaaacactatgttccctcttttaggattgtgtcagattgatagtttgcacagacaacttgttaatatactaagtaaaagt

SEQ ID NO: 31252 - DNA, 1336 bp, Bovine  19866880606411
acagaatgttagtgttggaaatgaccttggaatttacctagtccaacaagctcattttcagatgagactacaaaagcccaaagaggagaaatatcaaagcagacatattcccaatgaaaaccaaaccagaaaatcatgtgtaggaaaaaaagctgccaagaaacaaaacaaaatgcatttggggcagctgcatttggatagtgatactgtgggagatttttcattttctcacttttccgagttgtctaaatcttcaataaggagcgtgtatttcttatacagtagagaaaaatgactttatataaaagaaggaaaaaatagaaaggagaagctgagtttataaatagcatattatagtcattaaatgcatgtctagtatcatagtgtgaaagggttacaagatagggagaaaggtggcttgataagtttaagaagattttggaagaagagtattctggaagagtatgaagttcaagaatttatatacgcaagcaggcagagcctgaggaagcaactgttaaaaggcaccagtctgtaagtgttgtgtgagttgtctggaataggccatggaagttgctatgtgaaggacagggcttttagtggcattgacttgtgaggagtttggaaatcttgtctctgtttggatgaggcgaggttggggtgctataagctgtaagaacatcatggaatgtaaatgtttaggaatcaccttcatagagcctgtgacttcctcctcccccaagacctgaaccttccttgtctatgtaagaggtagagtcatggaatccagtttcagagtcttgtcttaattagacatttcacatgtctcgctaaggctgtgatggttttagctgaatgaaccacagaatcacaaactactggagttgtcagaatagagaaaaaattatgtctcccaaaagtctctaagctaataactggtgggccctgatagagttgccagatttaatcaataaaaatattagacacaattaaatttggattttagataagcaatgataatgtttagtgtaactggagagtctgtgtttcagccggcaaccctactagtcaatgatgaaaacccactgcctcgtgactgaagactgttcagtacttttctgaaagcaggccagtctgatttccagaatggccttacatacgagaggctatagagcttagtggctaccaaggtcaacctggcccttggggttatttttttcacctgtataaaagagttacaaatagcacctacttcacattgttgttgtgaagattaaatgaattatcacaaacaaaacatataggaaagatacttattagggtcaaatatcaaaca

SEQ ID NO: 31253 - DNA, 710 bp, Bovine  19866880651673
atgctcttccttaagtcggctctaacatcgccttctcactgagactggtaccgatcactccatttaaaattacagtacccctaaaaaaagagggaacaaaactcctaagttctagcacctcctgttcccttcagcacttaatttcctccattgatactagcatcctgtatatatttaacttgtctttttcctctcccatatactagggtataagttccacaaagaattttgtctattttgttttctgatgcagcccacaagggcctagaattgtacctgaaacatagttggagttcaaaatatgttgagtaaaagattcttcatgaaaatatggtatttaaaagcctgaatctttagcataaagctttagtactgattacaatactggtatcttatgtatgtgttaatttctttttttttaaatactatagtgtgaggaaagaaactagtctttgagggggttaggcatgaggagcatcactcatatcttcactggggagtagtaagagggtgaagtatgaagactgagaagctaagtaaaaatgacttggatccaatgtttacgtgtccacaaattccagaaattgcaaagctggaatctctggtaagtagaatgcttcctaagtaagttaagtgtatgggggtgctggcctcgtgaaaccttccagaaactaaaactgcttgcttttctcaacttgctgacgccagcc

SEQ ID NO: 31254 - DNA, 1742 bp, Bovine  19866880652729
tcttctgtgttaatctttttcttcattatcttttctatttttgaataagaatttataaagacacgtattttctatagttacctgataaacttgagtgcaaaattcaactactaaatagagattaacaatgctctgattatctcaaccaagtctcaatattgttttgctatgcactgcaaaagtattatagactaaaccagttgtcttcctcattttagctacataacacaagagttactaaaaaaattcagtgaagaggtttggagtacaaaatatttctgccaaaaattaaactgctaaaaggaaaagaaactcatttacaaagtatctcagaaaatacccctgttagttaaccaaatagttgacatgatgaaaacattagccagtatccaagtggaactggaaatttaatcactctagttttagaattgagggaatctgttggttaaaagattcataaagaccaaatccaatctagcaactagaatcaagtttttcctgtattacccacaaactgacgaatatggcattttctacaatagagggaagagaatataatcaattactgggattcttctcttccccaccctcataagttttcatcctattgcaggacatacctgaaaaggacagtcaattaaattttagcctgtccattcacattaaggcccaaatcctgcctacaatttcacatatcttacccatttgtttactgttgaactatcctctcccaaatttgaatctaattatagaacctaattataggattctcaaatctaattatgggattctgaaacactctgaaatagtatcagctttgtttcagataataaatttccagcccctgtgatcatatctgtgtaactgcttcaataagaactgaaaggaaactaaaatgctccacctaatgaaacactactgcagctatcacctttacttaagagaaagaaatcaaaagcactacctataagcttttgttccactataattactgaagtagaacagttttttttgggaactgagggactggcactccttcattaacatcaatattctagctgatggttatttagttttattaactgaacaatttttaggaaactggtcatgatatcacgtagacaaaccaaagtgaaaggttagaagagcaaaagcaataggaagtgtcactaaagattctttttctatttgtctagaacaggaataggaactgtttaataatggtgtaggaactatccttgtcatacaattctcttaagacaaatttcttcagttgaacaattacaccattatctacaatgtcaaaagtatctataaggttgaaagaaggagagtgagacctggggatgcagctatgcaattcaacttaaggttcttaatattagtctctttgaagcctgggaactctattacacactatcttgacctcttgtttaaagggatctcttcttgcttcccctttcagagaaatagagagaaagagataggcagacaaatacagatagacagaggtgaatgtatatacacttaaaaaggtaagtggggagaaagagaagtcaaggaatcacatactgcccaatacctcaagtactgaaaggtataatgctttagagattctaatgtacttcgagtcatttcatgtatcccttgttgggaaaatatttcattcctacccaattccctatagctccacattcctacgaacagctacccagactgcacaattttccacacaccaaagg

SEQ ID NO: 31255 - DNA, 1170 bp, Bovine  19866880653569
gtgtaccacagcagcatctttaatgattgattctagagtgtgaggaaggcacacagtccttctgccaactcatcacccccttactgctcactggctaggaccacaagacttttctggttttattttttagttagcatgcatttcccttaaaaggaatatagcctgaaatagagcacagaggaacacaggcaaggatttgaaaaagtatttgagtctgattcagtattaagggctctggtcctctttctgggttcctgtgaaactttgtagacattcttatgttctagctgtaaacagaggcccctttctatgtaaaatccttcctagatataggaagaatacaaatgatagctagataaaaggctactttcagtgcattttgattgattcattagatagaagtcaacagatgaggttaggtgagtgtaacagactgaataatgaccacccaaagatggttcctagtacatggaacttgtaaatgttaccatataagataatctttgtgggtgtgattaagaatcttaacatggggagattaccctatattatctgataggctctagatccaatcacaaccatcctcataacagagaggcagacggagatctgaaacgcacgatgaagaggaaggcaagggttggagtcatgtggccacaagcctaaagtggcatcagaagctgcaagaggtaccgactgaattctcctccaagactccagagggaacatggcccaaacgacaccttgagttcagtccatgataatgatttcagacttcaggcctccagaactccaaaagagtatatttctatcattttaagccaccaaatttgtggtagtttctatagcagcctcagaaaactaatacaacatgttatgttatgtagactggagtcaacagatatgagaacattttagaattacagctgcttcccttagaacaattcatcattcttcattttcacattacatgtgagtacagtatcttaaaccattattatgttattcctacccatcaaatataagttctcaggagtcgtcacaggaatattaacaagtttaatatcatcttcatctgctttgtcccaggaattagaattgccacaagcacagctatgacaagaattgacactctggacctaaaattggatggacagaagttacttcaaa

SEQ ID NO: 31256 - DNA, 1636 bp, Bovine  19866880658529
catcagggatattaggttgtaattttctttttttgtagtatcaattcttttgttttggtgtcagggtgatgctagcctcataaagtgactttggaagtgttctttattcttcaattttgttttcatttttttgaataatttgagaaggattggtattaaatttctttaaatgtttggcagaatcacctgtgaagccacctagatctggacttttgtggggagagggggggaatactaattcagtttcattactagtaattggtctattcagattttctaattcctcatgatttagtcttggaagattgcatgtttctaggaatttatacatttcttttaggctgtctaatttgttggcatataactgttcataatgttctcttatgatcttctgcatttctgtgatattgattgtaattgctttctttcttttctgaatttatttgggctctttttttcttaataagtctgtctggctaaagatttgccaatttgttagcttttcaaagaaccagctcttagtttcatcaatcttttctattgcctttttagctgttatttcacttacttctgctttgatctttattatttttccttctactaactttgggccttgttcttctttttctagttccttgaaatgtaaagttagatggttaagaattttcttgtttcttgagccaggccaatattacaaagaaattccctcttagaaactgcttttgcatcattcagcgtaaggaagagtaccctaaaagtatgagaaaggttagcacggctatcgtgctataatcaaatcaagcaaatactcacaaggtcattcatattagtttggctagctggattaatttcctccaaaaattctaagacataaaatgtgtatctatccataagatggactccaactgcaggatcaggttgatgctatgaaaaagcaaaagaaaaaaagtacatgtctaataagacatatgatcattaaaacaaaatatttaaaatataatcaaaatttccacctaagatataaagtctacataagtaatttcagaaatagctacatatttcaacaacaatgccatttacaaacaggaaaaaagaaaatgtacctaccgaaagtgaatcttctcccacttggctactagctaaagccattatgttaggagaataaaatctctcatacatggatgctccttgacaagtatcaataataaatagtagttcattgtagctgaaagaaaagtgatagtatctatgacatgaatcatgctgttaatcatacattgattaatattttataatacttccataagatgtttaactcatatcttaatcatttcatcagctaaaaatttgcgatttttcaatagaattcccaatataaatctatactagaaaatttaaaggtaaaatcatatctggggaaaccacttcaacagagtgcagtggttgtaccacaaagtggctgcccaaactcttttcccttcccttatctatgacacataactcagagtccaaacaaatgtttaattcaaaaagcacttctctggcactcacacagtcctagaaactgagctagttttagaaaaaccacacacacacacatatatatgacagtcaccatactcaaaaatctcaaaat

SEQ ID NO: 31257 - DNA, 1908 bp, Bovine  19866880743083
cacatttcttctaggtttccacctaaattgaggctttcatttcacacctggattatttaatgagaatgcctattgacagacactgttgacatctggcccccattccgtcagctcaccttgagctggcacagaatattctgctaacttcccaacgtcaattcaacacttctctgcttctaagttctccagccagacaggatcttgcccagccctagctaaacaacagaaggacaatctcaatcagtgaggcttgggaataggtagaaaaactccccagctacctctcagttgctatgacaattctgaggcagttctacaaaaatttccacaggattaaacccccagttgcccatcactggctttttccccgttcctgactatttacccttgtgcttcctggcatctcacctgcattcacgttatacccaggtctgctttcaagatagcacttcagaggaactgtaagagttacaaaagcgacactatcaagatcttgcttagcctaaagctgcccaagtgttctcttggtctcaatcctttcccaaatcacagctcattctgcatttcatgtggaccacatactgtgcgtgtgtgttgagtcactttcagtcgtgtccgactctttgtgaccctatggactgtagctcaccatgttcctctgtccatgggattttccaggcaaggatactgcagtgggttgccacttccttctccacgggatcttcccaaatctgggatggaacctgcatctcctgtactgacaggttgattctttaccactgagtcattcaggaatactagccccttatctctatctgctgaaataaaattcacttctgagaagctattttattcctaaaggccaaggttactttgcttactttcaaaatgagaacttaaaaatactctatgtgatgtacaattatttcattagtctgttgtttatttaaaagtactttaagagcagagatttccttaagaaatatctaacatataatatgatgtcataaataaccagacatttagaaaatcattattaaaggctgaggggaaaagcaaaggattacagtgatggtcagaaacaataaattatgttctcatttgctttgatgaacttggttctgaatataacagtatattgtcactcactttgaacctaccatccatgaaatgaagcaaagggaaatgcatacagttagctacttgcttgaaatcctctctgatttggtaacacaggtttcttatggtgttgattaatggtgagcagaacactgtccaacaaatcaggtgtcccattgttgagcaaggggaccacctctcctaaccccaactggagctaaatatccagttggagagtgactgaaggtatagcaatgaaaaagacaaacagctagctccccttttgacttctgaaaagctggcaaccaaaataattctgacaaaataaaagtcattttaccgttcatcatacttccccgtgtttgcagttttgaaatggaagagaatttcagcaccaaaaacattcagcacagaccatttgtgtggcatttttgtttttagtttttggtttttcatctagtctcttggcaagtttaatgtttaccacaaatactgttgtctagcatcgtgatactgtgacttggatctccaggacctatttatccaccagctgccagtttacacccttagacaacatctctccaattctcccacctcccagtccctggtagctaccatttatttccctgtttctatgaatttggcttttctagactccacatataagtgataccatacaatatctatatagcattggtttctgtatatcttataagggttctcagtgctttcaagaaattctgtgcttgagcttattttcagctatttagattacttttcacctcacta

SEQ ID NO: 31258 - DNA, 866 bp, Bovine  19866880749426
aagagctgatattttttgggatagggaagttattggatgacttaggaggttcacagaaatatttcagtttaaacaaaacaaattttttggcactagatgttagatctgaaatgatgaggcattgtttattattgatgctgtctggttctctttctcttttggatatggatgaatgctgacacttggtgcaaattccctgtgatttatggaatcccgtatttacaaagtggttgtccttaccatgatttctctagaattttgatgtgtaaggtactgacaatcatgtacaattgcaacggtaacttgcttgttaacattatatgagcatttatcattaagggtcttagctgggcacaggtgctttcttagtaataggtttttgccttgaaatgttctctctcacctctactgctaaactgataacaaggtcagtttctttatgtcattttgttctcttacctgaaaatatctctcttttttgtgcctttggtaaaattcccagtgcattaaaaaaacaggttttcaggtcttacagtctacaagatggggatacccttctactgttacaatgacatggacatttttttaactgtaccatgtttctgggaaccactaaacattttcagaattctgttgttttttctcaaagaacttttttttcatagtggaggatgattgttttattctttttaaaattttgattcttgttttatttattttattcttgttttcctttcacacaaaacagcacctttcagtgaacactaagagctcactccatttttttcccccccgtggagaaaaatcaaaggatgtttgaactttgggttcttgagcatagcttgggtctgaccaggtttacacat

SEQ ID NO: 31259 - DNA, 1940 bp, Bovine  19866880753591
actccgagttcctaacgcagggggcctgagtctgatccctggccaggcaactagatgccacatgccacaactaagacccagagcagccaaattaaaaaaaaaaaaaaaaaaagtcaaacaaaaaatctacactaaaaaaagctgctatttattcctttactttttagaaatgactacttctcacatttctcaccaaaaatctttcaccatttatgctcttcatttcctttacgagtccacagtttgtcacatgttacagttcactgtgctccaaaatctagctgaattccaacttatatcaaaggttatttcagcaagattatttcaggctttagagaaactctaatccttccataatctcaaaatgtctctgttgtggaaaaagcctttacttcctggaattcctaactcagaacaggcatgaggatcaaataagattgtatatttgaaaagtcactgaagattataacagcagtacataaacgttaaaattatctccacaacgctgcatttcaaacgattaaaataacttatctactacaatctaatgccattaaatgcatttatgtttttggttacaaataggttataaagaatcacaaaagatagaaaagtgaaagctggctctaaaccagatcaaaaataagaagcaatcttaagcagactatctctcttgcatatggcaagaggtcaaataatttatttctggaatatttcttgtaccgtccatttttttcaatcctgccaaagtaaagtaatataaagcccctggtgtagtacaatttattcctaatactttttcttaagattagcattgtctttcaataagattcccattttcccccatgtttatattaacagcatgaattcactaacaatattcatattatgttcagaccaaatagcttatttgctttggtcagacctttccagacgatacatttgcttcaaccagaaacgaactaggacagcctcattttattttgaaagagattttccttaaaagaaaaataatctgatcaaactaaaaaattctacaattctatacatctactaagcaagagtctagggatccttgtggtaaaattcagcgtcagtttagagcctacgcgcctgccggtgttgtcaccactgtcccaattttcctggccttatattgattatatgaaaacgtaacccctaaaaatacttgagtgtaaagcaccagagtcatccaacaattattcaaaagaagagcatttcatagtaggtaaatatgtaagagtaaaggtctgggaaaccacacatcatggaaactgactcaaacaaaagctgcggatgcacagacagcaagggctaccgtaacctctcaaaacagtcgggattaaatatgcatcgaagaaaaatgccagggacgacgacacctaggtttttccgctgacaacaaagaataacggggcccctacggctacacgaatgggtccgatcaccccaactgcgccgcaaagcgaaaccagaaccccggagccagcgcgctgcggggcttccagtcttccgcgcccaccgtgcggggctggcaagctggaatgcggaccgaggaaggagcggagaccttcttagggattcgtctcaccaacactcctgccttccagggaagcgccccctgggaaccctgcctcaaatctacgactgactcgcgtcctccgccgacccctaccggggcggccaccaatcatcagcgcaaagcactggaggggcctaggccttctacccacacgcgcgctcaccaccatccggaatcaagaaaaagaggccgctacagcagccacagctccggtgcgcggcagcgagaacgcagatcggcccctggctgcagggcgggcgcccttcggccctgcgcccctcccagcagcgtcgcgctcacctccaaggccttccccacgggccccgccagcgcgggc

SEQ ID NO: 31260 - DNA, 2005 bp, Bovine  19866880776051
tgtgttgagtggttgggagggtattttaaaatatattttcaaaattcattttgggtttaggttaagtcagaagtcagtccttttatcttgaatgtttaactaagttaatatgtaatatttacttatcagtatgacattcttggttatattcaagtaacctaaagagactgctaaatcctcataggtaatatgaggaaaattggctctactatgaccattaaaaaataatttaaacaactcttctattgttgattttgttgcaggagctgtttattttataaatattgtgtttcagataataataatgtggatttgaatggagaatatcattttatgtcctaaaatttgtattaaagtataaaatataaatcacagatcttgtctaagctttttagctcacaacatacctctcttttataaaaattgtgatacatttgtaccatttaattgatgcttatttaaaactgtcacatttaaaatgtcactcgtgtcatgccgtcattcctcttttgtgaaaccttagcaagatattaaattagttatgtatataaatgagttttagctaagggtgaaaagatggagataccttaaataaaaaaaattagctaaagaactgggtagcctatttatgaacatgtcttgtttaatacactcttaaaaatacagtagtttattacagttccatatatagaggttctatactaagtcttatcagtgacagtgacaaatactgcaaaagcatagactgagtgtacacagaggggtgtagtacagtgtaaatggaaaatttcaggtgagatcatggaagcccatgaatgacaggctaaaagtcttcagctttggtgaagaattgaattcctttgttagagttgtcatactagagcacagggtagcagttcttggttaaataatgataatgagttatttggatcagtataaataagggattcattatatgtatggctagatacgtgttcttttaaatagttgaggtctaaaataatggacttaaattgtatgagttggtaaacaactgttctgtgattcactatcttaattttccttctccctccacttgtttactcttgttccagtactgtttattttgccttctgtggatgatgatttttttttaatatttctttaattgatttttaaggtgttaatttttgctatacagcaaagtgactcagttgtatatacattcttttttgtattcttttccattatgatttatcccagaagattggttgtagttccctgtgctgtacaataggaccttgctgtttatccattctaagtgtaaaaatttgcatctgctaacccaaactctcagtctattcctttgccttccccccacccctcggaaaccagaatctgttctctatgtctgtgagcctgtttctgttttgtagatgggttcatttgtgctgtattttagattccacatgtaggtgtatcatacggtatttgtgtttcccatgttgtcgcaaatggcgttctttttcatggttgagtagtattccattgtgtataggtaccacatcttctttatccattcatctgtcaatggacatttaggttgtatccacgtcttggatattgtctctggctattgtgaatattgttgctatgaacataggagtgcatgtatcgttttgggttgtagttttgtccagatacatgctcaggagtgagattgctggaccatatggtaattctgtttttagttttctgaggaacctctatgctgtttttcgtagtggctgcagctacttaacattcccacaagcagtgtagaaggattctgttttttccgcacactctccagcatttgttatttgtagactttttaatggtcaccattctgattggtatgaaatgatacctcattgtagctttgatttgcatttctctcataatcagggatgttgagaaccttttcatgtgcctgtgaccatctgtatgttttgtttggaaaactctctaggttttctgcccattt

SEQ ID NO: 31261 - DNA, 1904 bp, Bovine  19866880859052
tttcagcacccgtgtccatagtctgttctctacgtctctgtctccattgctgccctgcgaataggttcttcagtaccatctttctagattccatgtatatgcattaatatacgacattggtgaaaacaatttttattgaagtaaagttgatatacaacgttgtgctagtgtcaagtgaacggcacagtgattccgttttcatatatatttatctattctttttcagattcttttcccttataggttattataaaacattgagtagaggtcccgtgctatacagtaggtccctgtcgggtatctattttatatatactagcgtgtgtatgtttatcccaaactcctaatttatccctcttaccttgcctctttggttttatggttttcaaatttaaccataaatttgaaaacaactgattttaaaagtaatgactgataaccacaaattaaagactgtggcttgtttaggggcaacaccctaattcccaaagttagtcacagtgggtcttaattgtttctgtgacagaatttatccaaactgctgtactcttcatttgatgtagcaaaatgctattaatctaaatatttgtgaataaagtactgtctctagattaaattaaaattgcttgcattattttctgaattacaaaaacaaaaagtaacggccagcctttgttgagcggtcaccatatatcaggcaccgtgatccctgctttgcgcatgagcagattcagggccccaggaaacttatctgctgagcgtgcccaccaaattgggactgtggatcctcccctgtgccctctgcactcctccccactagaccacctgtagtgactgctgttgtttgtctgtaacaccctctgccctccatggacacaatctttgagggtaaggtcagtgtcctgttcactactgtatccatggctcccgacatgcccccaggagatcagcagggctcagtccacactggtggatcaagcactgaagcctgctcactgtgtgactacagccccgaacagggcaccagattcgggatggatgtctgatccatgacttcttttctaggtggcccaggctctggcaaaggcacacaatgtggaaagctggcggaaaaatatggatttacacatctctcgactgatgagctcctgcagaatgagctgtcatcggaatctggaagaagcaagttgatcagagacatcatggaacgtggagagctggtgccctcagtaagcaacagctgccttctctggccggggagagatctggaagtgttgccattaatctagcttcagaaacaaagaaacgcaaaaaggataatgctgtattttgtttcttttaacaatccagaagcaggcaggaagtccacagcaaaggcccatctgccggaccaagttacccaggcccctggttccatctgtcttgttgctctgccagtgccttgaatgtaacctatttcatactttttcctaaaattggtcccggctttagagttaaaagcttcaaagcagaaatgatcttggtgcagcagaacctagatctagaattaccttgttgttggttcagttgctaagccgtgtccaactctttttgaccccatggactgcagcatgccaggcttccctgtccttcaccatcttctggagcttgctcaagctcaagtccattgagttgatgatgccatccaaccatctcatcctctgttgcctgcttttcctcctcccctcaatctttcccagcatcaaggtcttttccaattagttggctcttccaataaggtggccaaaatattgtagcttcaacttcagcatcagtccttccaatgaatattcaggattgatttcctttaggattgactgatttgatctctttgcagtccaaaggactttagaaccttctgaaaa

SEQ ID NO: 31262 - DNA, 1236 bp, Bovine  19866880888882
gctgtgaaaatacgtccattgaagatctgacactagctaacgttatcaccaactcttcctaagagacaatgacaacgcagaatttactaatttaaatcctaaattaaattaggattgaatttttaaaaggcaaatcactaaatgatggcttaaattctcattttagagtatatcttatagtaagatttttttttggacaaaattcttaaaaactttaaaaggctgcaaaaaaaggttaacattttactagacctgagatgttacttcagaagcggaagtcagtaacacagtttaatccccacatatggaaacatgtaattcaccatgaaaaagggttcttttatttgctagctgaaacttgaaatgcccttcatttctaagttatttaacatctcaaattacttcccccatgccttccaagagatgcaggagagactgggccttatcttctttggcgagcaatgactttgctgaatgtgaagtaatatttttaaaagccctaatatttttaaaagcctctgaacaaccatgaaagaaacgtccaaagtcccaaaactattataagttggatcataaaataggctaagttcaattttaatatagactatttttaacatttacattttcctttcaaaataaccacctaaaattataaataggacttataaagaaagcaggaatgactatatcccctatctcactaataaaaaagaaaaaaaaaggaaataaacttacaataactgccttctaaaatggcactcatgagacttccctggtggtccagtggttaagaatttgccttccaatgcaggggacacaggtttgatccctagtcgcagaactaagatcaccatgcaatggggcaaccaatctgagtaccatgtacatgtgaccacaatgaaagatcctgcacgctgcaactaagatccaatgccgccaaataaacaaacatttttaaattataaaataaaaaataaaatgccactcatgatcattctctcttcctggtacttcataccgcatctcatgttgaagagggctaacctgggtaaccaataacagatagaaataatggcgtgtgatttctgaggctacatcaaaacaatcactgcttctgtctcactctctcttgtggaagccaggtgccatgttatgaaaaggctcaagcagtcctattggaaaagtccataaaaccataaaaaacataggtttcctaccaaaaggtagcaccaacgt

SEQ ID NO: 31263 - DNA, 1464 bp, Bovine  19866880908338
gaggaaaattgctttcaatgtttacatgttgtgttggtttctgccatacaacaatgtgaatcagtcataattttatatatatatcccttccctcatgtgccttcctcccctgatctcaaccctttaggtcagcacagagtgacagggtgtcctgggaaccctgtggacacagcggatttttgtcacataagaaaagtttcgaatatgtcttgggatcatcaaggatctacatcatacaattcaattcagtaaagacttactgagcacctactttgttccagggtgtgctggatatcggaaatacacgacaggaagattaaatcatgtctggttttttgtaattattaaggcaccagtgaggactaaaatattttgcaaagatttgataaagaaaggttaaaagaagaaaatagaggagcataggcaagataaacttgctgtgggtgtaaatagcctcacgtggttcctatcttttctctatcagacttaatatggtggtgagcccagcagttagacagcaagtactcatcagactgaattaaccaggaaattcaattaattaaaatacccctttccttcctattttccattttttccctttcctcccagcattccagcagtttgagactttataaaagctacaaggtggtgacatacagatttaaacctttgccaataaagtgtctaaaactaaagaaactagttaacagtctcagaagtcgactttcagcctcgtgtgacatttggaaactttgctaattacaggctccattctctccagcgctcaatgtctcctctacaagccctaagtggtatcctggcagcctgaaaaaaaatctgaaagtgccagatgtgtgactaggggctaatttaggccccgggaaaatcaggctcattctgttttcttttacttattttttttccttccttttatttatttttcttagttgagatgctgcattcttttacttttaaaaatttctcactagcagtgttgacttttacagtcatagccaaatagggtcattttataattatatgggcaattcagtggagatcaagtggaatcagagatcagttcagaaaaagaaaaatgaagggaaatgtattttgcaatgtgaacacaggaccttaggatgaaagatgtcacttacgagtagaaaaataggagtttaaatcaaattccttcttagttaatacacattttctgttaccagtactgagaggttgtttctttttatagacttctttaggatgtcatttaacattgatgaaaacatggtttactggaatagtcagaaataattctgaataataaaataactcttagaagagtcatgtttctcgttgttgaagacatgggcaggaagtaagtatgactttggagaaataattaaatttcattcagtcaaacatggcagcgcttctgccttcaggaggtagggggcaggcatccccagggct

SEQ ID NO: 31264 - DNA, 1123 bp, Bovine  19866880956249
tgatgttgatgggggtcaaattgcccaagatatatattttcattcacctccttagagattgaacctgacaaaactgtaatagcttattgagttccaaatgacaatgacatactggatattttcaagcacttttatttttcttatcctgactggttagaaaagaaagccattatcccacaaaataataatcttgtgatgtttcaaaataattttttcacagcatgtaattttataatacagtagtgagcctcttgatgcattgtatagacatagaatattatagccaacaaatgtataaaatttatagttgcttttccacaaatttaactagatctctctggagcttctcctatataaacaagcatcatgaaactgtaaactttctctgtaaatgaccagagagcaaatagttttagctttgcagactctaaggtctcccttgtaactacttaactctgctcttgtagagcaaaagcagccatgtgtgtgagtgttaagtcgtttcagtcgtgtctgactctttgcaaccctttggactgcagcccatcaggttcctctgtccataggattctgcaggcaagaatactggagtgggtttccatgccctcttccaggggatcttccctacccagggactgaacccaagtctcatgtcccctgcgtttgcaggtgggttctttaccattagcaccacctgggaaagcagccatagacattatataaacaaataagtgtgactttgttccaataaaactttatggacactaaaatttgattttatataacatttatatatcatgaaacatctttttgatatttttcaatcatttaaaaatgtgaataccattcgtagctcataagccatggaccagccatggcgtgggcctggtttggtccaagggtaatatctagatattaagttttaaaaagatgttctgcaccttactctggtttcaaattctccaagctttagataacatttaatgatactgacatttataaaatgtatcatactgagcatttataaaatttgttaacctactgacacctagggccttgaaaaatactaggtatgtctcaaatttaatgtacatatgagtcacctggagatcttcttaaaagc

SEQ ID NO: 31265 - DNA, 1636 bp, Bovine  19866880959996
catttatggtttatagattttttgatgatgcccattctgattggtgttgaggtggtatcttattgtagttttgatctgcatttctctaatatttagtgataatggggattttttcacatgcttattagccatctgtatgttcaactgctaatttaaattcacttaagtccatatgacaactttcaactaaaagagtgcttaccacagattactaataatatatcattgttaatgtgagctgctacaaattttatactaatactaatttcagcattttttccaaagaagaaacaatatattgctatcacatgaagagttcaagactgtgcaaaaagcaagaataaatacaagataagaaataaatgtatgttcacaagccccctaaataatggggcacttggttactaggaatcttattttctccaaaaaggatgagaaataacaacaggtaagatcttataaggtgaactttttccatgctctaagaaatctaaatttttcctttaaaaagaattcagttcatacttctgtaaaatataataaaactgctcctaaatgtgtaattgctaaaaaaagaaaatataattcagttcaatagaaacaacaaacgtaaatctaaagttagaagaagtaacataaaaataagtttaaatctcttaagatgtgtaaatctactaaccatggaaaaattaggtactaatttatcttatgaaaagtagtcatttattaccgtcttttctgccacatttgttcaaaagcatctgcaagttctatgttggtaatttcttcagaatcttgaaatttcaagaaaccatttccaccatgtccttatagaaagggtcagaaagatcaaacagacattttttttaaatgcaaactgcaaacatctagatattaacattcacttcattcatggcaatattttaatatcacttgttattgtatattctagggttaaaagtaactaatttttctactataccaaataaacagataaatgatagactgtgtaaaatatagtagatatacatttaagagctttcttatcattcagttttataaaagcatatttatactttttcactggctccattattatgtcagaaatgagtttccatagataaacatttctcaaataccaggcaaacacttttggtgagacaggagttgaagacactaactagtcccttagtaagctagcactgttcacagtgtatacttgaaacattgtaactctaggaaacgcagttttcacctaaaaaattatgtttttataaccatcagccactgtactatgagagctgaccaaaagatcatgacattcaaaatgcatgagagagccatgctctctgcctggatacaaacgttagctttactacttaatgactgtgttaccttaggcaagtaacctttctatgccacagtttcctcagctgttaagtaagaaatgtatgagtaagaccatcactagcatgccaatataggccctttgtgccaattttaaaaggtacttcccactgcctatcaaagtagaaaaatctatttccgtgccccctcagaatataagcagtcctatgagcttaacagtgggtagtatatgcctttgggggacaaaaaatatttcttccctcattag

SEQ ID NO: 31266 - DNA, 1167 bp, Bovine  19866881004512
acttacgcaggtttatttgccaatgtagccccggtgtaggctttcaaataattttttaatacatgaatccaaaaccatctttagcttaaacatgatcatgcaatgaagatgcctatttgataatatcactccatgttttaaaaatcccttcggtgcacctcaataaagttgcttaacatggcatctaagatgggtcatcttgccggtgcttgtgtcttcgttaccttgtgctgtgctcacattctccctgtctcaatgaattgcttatagttctggagtttgcccatagtttcaccatttttattcaacagtctcctctgaatgccctcccaaattctgacacttgtattatagttgaatatttgatgagaatgaattttagaagagtatgtgttagatacaacaaaatggcaattctgacaataagctttccagatcttatttaaaccaattcgtatcatggaactagtccttaaactggaagggacattatggtcatctagtgagtacctcctaattttacatatgaaagtgaaagcgaagtcgctcagtcatgtctgactctgcgaccccatggactgtagcctatccggctcctcagtccatggaattttccaggcaagagtactggagtgggttgccagaggtaaccaaattcatgtcacctgaatttttatttaggttctgtacctgaatgatttagcatgactttagcagataacataggctttattgtcctcatctttaagtaggtatgaataatccctggagtttaactcaaaaatacactggttcctactgattcaaagtaaaaacttgtgccaataaagatttacttttgagctatttttgctagagtgaaccatttgatgttcactacaggctctcattctctctgttccaaagtcattttggaataatactagaatagcaaaatcttaaaaagtctcaagatcttaatatgattttgctctgtattagttcccagattattatatactctgatggttaattgtatgtaccaacacttatttcaaagacattgttacttctgttaaatccattattgtactacaacttaaatataaaactatatatatgtatatacctcatgaaagttttctgcttctctctctttaatttcaaggtcaattgctcttcttcttg

SEQ ID NO: 31267 - DNA, 1870 bp, Bovine  19866881011265
ctcccaaatgttaagtccccctaataatactgtaaagtaggcgttattacttctattttatggagaagaaaactgaccacaatggaatggaatctgctccaatgccctgtgggtggtaaatgacagctccatcagagaacagaactctctgacttgagagcccatattctttgcaaccaacattcaagtagatcctcaaatgcctgagggtaggcaacagtgagaataaaacaaaccagaccaagggactccagccagaaaaggtcttactagcagacttgaaagtgtcactgaatagacctccaaatttgttgcttccgctgcctcctatgaagcctcctttccaaatagcaactccatggctataaaatattctttgcatctggagatgtctagtattcaaggaaaattttaaggtttagcccctgctccctcttgcctatctagatagacaagctagccagcttctagattgttcttttaagtaatccacacaaacatgttcttgggaggctgtaagtaatgccaagaagggctcctggtcatgtgagagctatagttaggaataaaagtacactgtcgtgaatcagagctgaagcagagatctgactgcaagctgctattcccgctgctaagtttcttcagtcgtgtctgactctgtgcgaccccatggacagcagcccaccaggctcctctgtccacaggattctccaggcaagaatactggagtgggttgccatttccttctccctctgactgcaagagaaaagccttattattcagttcagtggattaactgtgtgagtacaagcaaatggaaacagagtgtggatagtcatagtctccatggactcacaccctctcttgttcagcatgggatggagttagcaggtaatgaaaaggatatccagccatacacaaatgattataagaaaaaagaataaaaaagtggaagcgggataaagcaataccttagaaaggagttgtagaacaacgcatggagtcattgttaacttcaggatagtaacagacagccagagggaccccacaggtactagaatgattgagaaggcactgggaatcagagcccagttgggagagaaggtcctgagcctggatcccaggctattggttggccctgcactgtgaggtaagcttgctggacaggccagggctggaggttgacaactcacttcttgcacaaggggagctgaaatactcctttccttccactcactgtggctttcccaaagcactaaatgggaagataaccaagaggaggatgtttctatcatattccatgatctgtgaaagaatttcagtccaaatgggttataaaatggaaaatctcctgcatgtgctctttggaagacaaaacttaaggactgaaagacctatttcccataaatgcctgatttatagcgaactgataatattggaattttctttaatgtaaggagttggtcagaggttgcctcatactgacccttgggaacttttacttatggtttccagatgcatgaacaagaaatgacccaggttgggttagtctcacaaaataagtggcattgaactttgtttgtgtgactggactggttttgtctgctcgggaaaatttcaaagctggtctcggtttggttttgattttaagtctctaactgaaccttccccctcttaacatttcctactcataaatactgcgtaccccaaaccttcaacagactcacctgcattcctctgctattcccgaatgaactcatcttttttaaacaatttttgtgcttgcctcattttacccatctatttaggtcgatatgtcccatctgacaaccttgctccatcttgaaatctttaaaccccattcgctaag

SEQ ID NO: 31268 - DNA, 645 bp, Bovine  19866881055744
ccctactggctccactccaccaccttaaaaactgaaatctacccaagtggcctttggtagaagctggatggaagcaaacattaccccagaaaactctgagatgaaatctggggcttatgttcccaaccttagcaggcctagcatccagcttggcagggacgggaggacgggacacaagcttgaaatgcaaagtgaagaagtgcagagtcttaggaaagccttgggaaaaataacccaccacacacattgcctaccatctttctttttttttagaaaaagaatgttaagctcaagaacagctagagtacatttgtttcttctttttttttttcacttaattgagcagttgccacagtaactcaagaacagactactcattgccttcagtgaattgcagatacacatttttcatctcctgaaagtggcagtgagcttttaaaaaaggtaatcttgagctgctgcttttttctcctggcctggtatcagtattctttctccataggaccctgaagtggcagcactttgctttcatgaataagaaaaatatgtctggggagacagggtttagaaatttcatcaggattcagggctgccagccagtcaacaacaccactccaggctcatctgtgtcactgtctgctccac

SEQ ID NO: 31269 - DNA, 823 bp, Bovine  19866881134138
ttgccctagaatttgggctgctttcctttctgtctcgatttctttctgaagattcaacactgacttctcgtttttctctatctctgtatttatcactattttcatgtctttcttttcttgctttcacatgctcttccttttctttgcttttctcttccttctcgcatcctttctcattgtgtcggtcataattacttcgttgtctgtgtctttcctgttctctggagggatatttctccctgtctttctcccttttccattctctgtcattcctttctctctcgtctcttcccctcagtctctcttcttcatgcctcttccagtgggaatctctgtgactggactctctgtgcctatgggaatcccttttttcttttcgagaatcacggtcagtgtggtagctgtcctgctccctggctggtctctcttggtgttcatcttcccttttctcatggcctcttgacctggaactttttgtgtggcattgggtgccatgttctctttcctcactagatgacggtgagcgggcaggattcctgtgatgcttggagtgactgcttagggtctctgtgcccttttcccttctgcagttccctttatccccctccatttcatcattctcactgctcttagcatcaaagtcactgtctgcatctgggttttcctctactttcacaccagtttggcgaatgcagttctcaggaggtattctgctctctgaacttacttcatcagaatatccttttgatttctcttcttttatctcagaccttaagaaaaataatgtaacacaaaatgccacattattaatagtaagtaagtt

SEQ ID NO: 31270 - DNA, 1426 bp, Bovine  19866881160960
tcaggaaggtcccctggagtaggaaatggcagtaggaatatctactgcagtagtcttgcctggaaaattccacggacagaagagcctgacgggctacagttcatgtggtcccaaagagtcagacacaactgagcatgcatgcaaatgcatacataggcttaagaatgaaaaaaaaatcttagatctcatttggtataacctttcattcaatagagaatttgtcttctcagttctttgtaaattccttgaggagaaagattctcttatcctttattataatcccaacacctaccatatatcactaccatatagtgatacagtaatatttgttgagttaaagattgaataaaataaatatatgattgaatagacattcttaatgaatagttacctaattgccagatcattattcaaaatttgtgtactccttgaagaaaattataaatacttttgataatgcaagtatattctttattttagaagtaacttctaaattttacactgtcatcagtatatcagaaaagtctgtcttaagatgttattctatcatcaaaaattgcccaataatctgtgtgtatgtctctcagtccatgaaaatatatatattggttaagtgtgtcatttctgagatttccatttagaacaatatcatttttcaactgaactaattctcacttgagtctgtaaatagttgtgtgaaattagattggtatctcagtttatttcccaaagtatgtgcaaaaaacatagaatttcattttagcctcttgtttgccaaccattcttagtactatctcataataattcagaatgcgtatgctcatatcttttaaaatccaaaccactctagaaaactgtgggaaactcgtccttgaacagttttcagttttgttttcttagccaagcaaaatgcccttaggtatttttattctttctcttttagctcacttgtaaagctaccaactaattctccaagtagttaccatgaaatcttccatataagaatttcctttagggttaaagttctctgttccctttcaattcagtgttttgatcccaattgaggtaatgctttttctaagcaccaaaaaaaggaaacctaaaggtatcaggtttaacaatattctttcagatagtctttattttctataaaaagtttgttttatatataatagacctaaaagttatcactgaaaaagcagttaatacattattttcatgttcactaagtttatctgggacttcccaggtggtgctagtggtaaaaaagctaaatccacccgccagtgtaggagacatagagactcagggttcgatcccaggttggcaagatcccctggaggagggcatggcaacccactctagtattcatgcctggagaacccccagaacagtggagccggcaggctacagtccatagtatccc

SEQ ID NO: 31271 - DNA, 932 bp, Bovine  19866881404514
agatccttactttaaggatcattttctttcctttgacaaattcagggcactaaacatttctcacaaattccttgtaaattaactagtaatcactttataaagttaattaatcatctgtagcaaattctccaatgacacaaaaagtcattatcattatacatgattagcaatgtgatcagtcacctagggaggtaaagtttaaggaaagtaattatttggagaatgtcagccattgttaaattaggagtttctctcattattcatatctgattagcatgaaatatgaatcacaaatgtgacactgattcaacagacaaatgaatatacttgtttgtattccaagtatttcttagctttcagaaatgttaagtcttaatgcaaattacattgatatcatgttattttggagttgttaatatgcttttgttaaaaattttaagaagtaatatggcaataaaaggactaaaacctgaaacactatcctcagaaaagcactagtatgtgtttaccattcagttaagttcagttcagtcgctcagtcgtgtccgactctttgcgaccccatgaatcacagcacgccaggtctccctgtccatcaccaactcctggagttcactcaaactcacgtccatcaagtgaatgatgccctccagccatctcatcctctgttgtccccttttcctcctgcccccaatccctcccagcatcagagtcttttccagtgagtcaactcttcgcatgaggtggcattaggaaatggcaaacaatttgaatgagtttatgaagggctcccccggtggctcagttggtaaagaatgcagtcagtaaagaatacttgcaatgcagaagaccctggttcgatccctggggtgggggaaggtcccctggagaagggaatggctgctcactccagtattcttgcctggagaatt

SEQ ID NO: 31272 - DNA, 1296 bp, Bovine  19866881455485
ccccttgaaagaaagctaatcttcctcctccaaaaccctccccgctcaaaccactgacattcttgcagaaacttggaccacaccagcggctcctcccgcaagcctcctccgccctcactgcgttctcctctgcagccttctttttcttcaccaagatgaccaggaaaggggctccctctcggctcggccacccagaccctcgctcgggctccaagcggtcgccagccagcccaccctgattcagcgctccgtggcgggcctcccttcggctttctattcctcctcccagacacggaatccagagggcgaaggccagagctcccgcccacccctctgccactaacccgcggccgctgagaccccacacagccctccacccacgtacctgatgctccaggcccagtgcagccggtccacgcctgcttccccgccgcagcccggcgctgagccgcagcctggccccgggggcggagtccttccggggtcaggaatgggaaggtggagagaaagtagcgggggcctcctagcctttctgcgtgaggggctacgtgtgaagcagctcccgccatttctgttgagggtagaggctcctgcctttcccgaatggctgtgaaatgtacagtggaagaattgcatcctgttacagtgctgtcaagaaatggcatcgcagtttgtaaccttttgagggccccaggaccatcctaggaatctggtgaaaaatatggggcattttctctatatgtcatttaaatacattagtaaaagaaaatagcttgtacattaccaagagaatatatataatatatatctattatatatatatagttagatactctgaaccaatccatggctcccaggttaagaacgtctactacagaccttcagcccctaaataaattaatgttgagcattccaatcctgtattaatgatgttttatttacttcgattcctttttagcttttccctaagttaggcaaggtattcacagctctgaggttctgtctaaaacacatacactaacgagggaggagggagaacaacaaaacaacatgctgtttttatatgcagtcctgagcccaaacatttcgtccaaattgcggatttaaaaattccaacttctgagcatatttgtggtgaaaagccaaaataattttgcaaggattgctaaaacatgagagcacatgttactattcctatctaagaaacaagaatgaacaattattactggtggtgttcaaaagtccctgttagtgaaatggaaaataggatgaacagtaataccaatgtgtgacatt

SEQ ID NO: 31273 - DNA, 1033 bp, Bovine  19866881457096
ccagtcagagggcagacagaatgaaacccccgatcacagaaatctaatcaaactgatcacatggaccacagccttgtctaactcaatgaaactatgagccctgctgtgtagggccacccaagatggacgggtcatgctggagagttctgacaaaatgtggtccactggagaagggaatggcaaaccacttcagtattcttgccttgagaacaccatgaactattaaagcacattactgctcaaaatgttacagacacttaagtgtactagatgcaaggaagcaaacaaataaaaggatcactaaaatgaaattggtaagattttagttatttagtaattttggtgtcatggtagttattaatgaaggcatacttattatagagatgttattctctcttctccacagttaaaggtaatctcaaattacagtttggaaaattactactcatctggaaattgtaaaagttataaaagtctaatgttgagaaatttggaattttaatatctagttgttttatttatgaaattactttgagagaaattcctttagttttactactttgtgttgatttcaaaataatttttgctctttgttctttcatttatgtttcttaattttgatttgataaaaatagagttgtgatgggtaaagaagctggatcttatttccctatttctctcaaggtcagtggtaagtgcgtttcacagctctttgtgatggactgactaccaaaaggtaataaatctaatagtttcctaatgcaagctctggataaagaagttatttaaccattattttatcttactctttttgtcccagtggattccatttattaacttaaatattttaaattgactgaaatgtttgagagaaagagagaaaactgtttgatcattaaactaaatttggctaagtcaagcagtatgaataaaccatttctagcactgagcagctgctgtttccagatataaagagaggggagtgttagttattcctttaaaaaaagggctcattttttttaatgatagtaaa

SEQ ID NO: 31274 - DNA, 792 bp, Bovine  19866881784280
cactgactcctttagccaaaataagcactgtaacatggtgtttctctattgccaaataaaaaagtgacggtacatcttgctgatgtattgagtactttatacaatacttacaaattgcaaggtcacgcttgtctcattaaatcctatgtaccctatggaaactttcagtctccgtaagaccacatatataggcatgaagaatatagaacactgcagaagtattgaaatcaagtgtgaaagtatgtttcctttacatactaactgggagagaaaacagtttcgtgatgaataaaggtaaagtacttgtgggtttttttaattaataatttcaagggttatgattaaaattgccatcaaactcagtatgaatctatcatattgatggacatgcattcttccctattcagacatgccccttgcccaccacttagtagggattcagatacatttacttaaggagagggatgctgcctggatactgctgatgataccagatggagagaagggtttatttggttataaaaactgttttgatttgggacttttaatgaagaggtttgttttagaacaaacatgtacaggatagataaatgtatatagctatatttttagactcttaagttaaacataaacttaagtatattaataagcaaatcatataaataggagttaaactttttcctagcaaggatttgaggttggagatagaatggaaaactagatctgtgtttccgtctcatcttctgttttctttgctgtctgccatccttctgttatctcatgccattttca

SEQ ID NO: 31275 - DNA, 696 bp, Bovine  19866881840367
aaaagtcaggtttcttcccttcaatagagaggggttttttatacccattccctaaaaatctatttggtcactcttgtctcttgtgtcaaaggccacaaagaaagcatcttactcaagtagtagcttctgaactgaccagaaactaaccaacctcaagcactgaacatgacaaaccattctctttaacatggacaatttcttttttttaggtgaagtataaaagagaaaaatacaacttctggaaagccactcattttatctgatgaaataaattccccagagttgtttcatgtactagcagcattattaaatagtgcaattctttgaaacagatttcaaacaatattctactcaaataaaaaagtaattaagtttacttatagctttgtttataaaaccacagcttaaaactttcagtccttcaaacaggaaaattaacccaagcaataactatcttgcttacacaatactagggatgggtatgtgcagacatatgtatatgtgtgaatcattcaaagtcactggtacctcaacaagaaaccaaaatacaaaatttaaattaaaaaatgaaatgcaaaatactatataatggaatttttagctttgatatatctaaagatattcctctattaataataagaattatgaacagtcaagtgttaaattaagaatacagtaagaaaaatccaggagcta

SEQ ID NO: 31276 - DNA, 2047 bp, Bovine  19866880653251
aatgaagacccagctcagttaaaaataaataaataaatattaaaaaaaaaaaccacccccctttagaatctgacaaagtgccttggaaacaaagtgtttcaaaggcatgacataaaatgggtgagggagctctgcttaaggaaaataacatgcagtcatgaattttgtcttgaattctgcataaaatatttcatatttttataatacctcaaaactgctctaaacccacaagcctcactttgcatgcttcttgggcctgtatcactgaccaactcacgtcacttccataaacattcctttagtcatggttatcacctgtgcagcccagtgcaggttgtatattcattaatactagggtagagactgctacagtgttttatggacaaaattcctatcctgggtttccactgcagctttcatatgccaaggggagctaaggtctttcttaatatcaccctattcaggtgccaccaagacaataacagggcaagaggctgaaacatgggaaaagaaatgggttaagaccacatttgaggataaaaacctgagtgcaaacaatacactaggccaagtgtgatgcccttgttacataaagtccactatcctgtggagagagtggtgctcagcctgagaatcctgctactcaaagcccagacccactggtgaccttgcaacccctgggaggtggtccagtggccatgaattcccatccttgacctggccccacatcaacaatgtgcatgcgagtggtggtggtcctgagcggccctgaggtctccaccccttgagtctggggggcctctgacggctgtgacccacagagtgtcctcgggcttctgccctgagaaagcctgcttccacttcctgtcactggaacacctgccaggagccctgagcttccatcaagagtccaattaccatgaggccaccatctacaagcacatggtcaccaggccagctgagctgcaaccccccaggcatccagcagatgggcccaacagagggagcaaggtcaccccatggggcagctgaatgcccgcaagtgactccatgagtctggaacaaaggggtcacccagctgggcccttcctgacacactccatcatgagagaaaatgaaacagttcatttcagatcttggaatgttgaggtagtttcttactcgcctgcagaaactgaaacagagtctttgcactctttttagtgaatctatcttccctctaaagacaccctctagatgctcttgtatagcacggatgtacagtcacttagcatgaacctacacctgctgctactcacccaacctgatagccacataccgataaagccagaggacggcgggttgggctggatcttctccttcgtgttctcctggatgatgtcccaaagctgccagataaacttggggtgaagaatgtaaaatggctggttcgggtttctctgacgatgctgaacatacggtgtgaacaggttgtaatctggcttcttgtaccactaagagaaaaaaacacacagtcaaggcagaggtccacactgtgaaaaggaaactgggcagtgctggggttgtgggtagttagaggctgaggaccagactgggaggggggttaggatgccccttctgtaggcacttctacactggatgaggggtgagtgagtataggggctgaggtccagcctgggggactggtgcttattctttagtaaaaggagggagaagggctagagcagagtcagcagacttttctagaaggggccaggtagtaaaagaggttaggctttggggccatggggtctctgctgcaactcctgggctccactgtatacttacatggaaagcagccacagatggtacaatatgtggctgtgtttcaataaaactttatttacaaaaacaaaggcaaacaaacaaaaaagaagtaaagaaaaaacaaacaaacaaaaaaaacaaagggaaaaaaaacaaaaacaaaaaacagggccagatggcccatggccatggtttcaatcactgtatttcagaaatatgctttccaatctaatctctagtt

SEQ ID NO: 31277 - DNA, 1733 bp, Bovine  19866880885392
taaagggatgaatttctctgtgaaatagaatttaagaaggataattactgggtcattggttaggtgcatttaaaatgccggctttttttttccccccagaaactaatgcctgtgatggcaatgtttattttggctggcccaaaattagttatttcactagcacttcacaggttattatattcaacagttacacctgacacaccagattctttaccatctgagccaccagggatggctcagttgaggctcaggtgactcagatggggttaaatgtttctattttgcaatctaattttctaattttctcttcacagatatctcctagaatatcacatgcatgctttaaagcttcaagaacctccgaaatttcctcttttctatcactaaaggtttttaagtctagtaaattaaacttcaggaaataaaatgaacgctaataagctggcactttgtccacagaaatggctggaggcttttttggttccaacatacttgctttatttcctgacttgtcatgcaatttggccaggtttaggagcagatggggtttaaactgaggatgaaagaggaaggacatgatgctctcacataaaacaagagcatttacttgtcattccactgttacatattgattgttttagatttttaatttaccttttagtgtttgagtcaattaaaaacacgggaggatgtcatttaatatagctcatgagccactgcctttaagggagttattggtagctgcgagaggggggcattgtggagtggaacagagtacaggcttctgggcacatgcgtgcatgcatacgtgtgcacatgtgcatgtgtgcatgcagtatgtatatgtgtgcactaggtgcacacacatgtaacggaatgtgtatgtatgtgttcgtgcattcatgtatgtgttgtccatatgcatgtaatgtgagtgcacatgtgtgcatgcatgtaacataaacacgtgtgtttgtgacatatgtgtataatgcatgcatgcatgaacgtgtgtatatatgtgatgctcatgtgtaatggacatttaaactgtttcaggtttttactgctatactgttgtccttaactcaccatcatctgtctctttgtatatatgtcagaggactgttagaagtgggatcctgggatgtaaggtcgtgagcctgaacggaggtgaatgtgtttatttcatttatgggaagtttggcttcctcttctgtgtcacctcatcttttggcccattactctctggagatttctatttttccttattaacatcagggaatttcttatgttttctgtacccaaatcttttctcaggaatgtgcattacaaaaatattttttcaatctgtgccttacccttcagtttgttttggtgtctttctttgaacagatgtttttaatttcaatgtccttagacttataaatatcttcctttatggtttatcctttttggttttgttgtttgagacaagtcatttcactttgatttcctctctatttcaagtatcatggctggtagcagagggagtggacaagaacatgaatttattactctatctagaccctctaaataacttttaaagagacttatgagggtccaaaaggacatacggtagcagctaaggtcaagtgaaggtcatccctgtgctatgctcaaatactcagtgatgtctgactctttgcaatcccatggactatagcccgccaggttcctctgtccatgggatt

SEQ ID NO: 31278 - DNA, 1297 bp, Bovine  19866880935844
atgacagttgtttgtttgttgatttttgggaattaaactgagtaccccacaaaaaaaaagaaagaaaattaaaacgagacactgaacagagaatggagaggccaagacagaatcgaaaaccaggaccaggatcataaattgagtgttacagtcaggacctacaacatcagttgaattaagggcttttccaaaagagtcttgatttcaaatattctgtgcagtcattcttataacaaattttatttgaaacaatgctccctgtagtcatatccatagaacattttaaacccaaatgatagctctgatcagagccaggaaattccacttgaacaaactgtaaggagtatcctaaaccaggtccatgaagcttgaaggagtttaatggccctgaatctaccccagataggttgaggtcaacccttcgaagtctatctttctccttctcaagtccatggggacaccaatcattagctggggaaaagagtgtcgtccacaggtcaggctcacatttctagtcaaaagctgggcattcatgagctaaacagaccctgatgggcagactgactgtgtcttaagcttctgttacccagtggaaattatctcactgcctctcagccaaccttaatattaacaagtgtcctgaagaaaacagttcaacattttaaaaataaaaacatgagtctttctctagcttatactttgccaggcagggaatggctgttttcttctttgtataatatgttctctgcttcaaagccttgaaaacatcctgaaagtctgaaaaacccactcctatacaagaagcctaaaagaacttcttttaaggcaaaatcagtgacatgcagtctaatgcatatttcgtatcttggtttaatccatctactggtgtaaacctttaatccccaatctcccctctcgtttagggagtgctgggagaaagtggtcaaaattgggattatatggcttaatactaaaagcagttgatgcttacgctctcaaagcattgcatagttgaggagtcaggcagttgcttaggcagttagtaagcgatgggtcctggtgaggcaggtcgcctgttactgggtagtaaagtaggaggttggctctcatttttctttggaggttccacttgcagctgtttttgaaaactttctcttctgaatagtcacatatgtagaaaacaaacttatgggtgctggggggaaaagaggagagagataaattggaagattgggatcaacatacacacactactagatataagatggagaaggcaatggcaacccattccagtact

SEQ ID NO: 31279 - DNA, 1280 bp, Bovine  19866880958555
ttccctagtgattgtctccatctgaacaggtactttaccatgaattattctacaaattctctacaaattcagaatcacattcatgacaggagattatagctgcaattgccattatatttatacatttattataacaatgatgcaatgtgtgccataattagatgatgatattgtagctgacaacccataccacttaatttacagaggagatcagaaacaaaacatatacatttactctcaagaccatacctagaaactctgccttcttatgttaattacctccttctcatacaccttgggttctcaatcgctatttgcaattgagggaatagctatttgagagataaatcaatgtattaaatatgtatattcatgcaagtgtatgtgtttggcaagatttaaattctcaatggctccatagaagaaccacttgagtaagagatgtttgtctctctctcaaagggaaaccatgtttcctcttttcttattcttagttacttaattggacacatttccttacttatcttgactgaaagagagcttaagacctaaagtgttttgcttgcatatagctgctatttagtaagtaaaagtgaaatgctttgttttcttcattactttacttggtttcttgaattatgttccaatgttagtgttttgattttagattcctttaaacaaacctgatgttttgagggttttgggcaaatatgtaatgtacaaaataaattttttaacatttggaaattccacaccaggcatatttttataagctctgtaggttattttctgatatacacccatccccaaaccacagagctcattttttcacagaagattgatttgcttatcaaattatatcaaaattggtgcatttagcatctaccatgtttctactaaactgaattcaaccacgaagtcagttttatggttgcacaataataataacaataaaaatatacaggaactaacatccaaatgagaaaggctttaaaggaaaccctcaaaaagctcagtgcagaactaggtaatttcacccagatgctgtaatcaaaatcaaaatgtttatgttgccaagttcaccaaaaggggagacagagctctcaggagaagagaatcccacacttaggcaacattagatgcaccgagaacaagtttcacttgtcacatgtccttcgagttgggtgtccaacgacactaaactcattctttgtattaataatcaaaaggaatgctgatacacccagaacaacttaggctttttatttgaagctgcaaag

SEQ ID NO: 31280 - DNA, 1464 bp, Bovine  19866880960015
cctcctgtagggaaagccgtgcttggatgtggaaagggaagagagtaaggggtgactgatatatttacctacctgtgccacggcaggtgcagccctgagttactgatttctttccttattaaatcctcataacccttctgtgaaatgctattgtcccctcatttcatccactgaaaccctagttccaagacttatagaaaccgtggtatgaatggctgtcttcagatttcttgctaagcaaagaaggatctagctttcccaagaaaacgttcttctggcactttcttgtacccatctctgtggaaaagaagctatttcttttattatgacagaggactagggagcaaagggtcctttcctgaacgtcctaaacaaaagtgcctacattcaaaggttttctgccactcactacagggtgttttaccagtactgcattaaggagataatgaggctcagaagtaacctgatggagtgactattttcagagaggaacttgcagtgttcaggatgcgttaggggcctgcctgacacccaggatcccagtgtccataaatattgaatagagttggtttatttttgtaacttaaagcccgggaaacaccatgtgagtggttttaaattcagctcataaaataaccttccaaatgagtccatttggttcttgaggtctccagaccatgtttcaactttacaatcacctctgacacagaatgatggttccctgccccccaaatctggatacctttgcacctttaccaaccttgcaaaacaggaagaaaagtggaaagggaattgctcattaaaatatctgcttgaagtttcattagctcaaagtaacccacctaagctttccggacccctgtggttgataaataatcggaataaacacagtactcacagtgacaatgatggcaacaaggatggttcgctcttagagaggagtagtcttctaagctctttcacattaatcaagatagattgttttttaaaagacctctaattactttcctgttaattatttatattcaccaagagttttacgcttgcttgttagttagtagcctcatgaggtatggtgcgtattaaatattgatttatgcctggcaattgtgaacagagctggcttgcccggccgcatccttggctaaagtcactcgtcctcctcagtcttcttccgcagctgcttatcaccaaccacatgcccaaaatcgaacaagaacacctcgtgtgtccagctaacactcttgttttcatcatagacacatggaacttatatacctgagagatctcttcttacaatcccatcaggagccacacaaatgatgcccttagcatcactgtgttgataagtggatttcagggtatccttgtttctacctcacactcaaagcagacaccactaatccacattgggctggtccaactggtcctcaacccaattataatggttctttacacagctct

SEQ ID NO: 31281 - DNA, 1873 bp, Bovine  19866881151010
tggacccggcactgagtgggctgttcattggacccaagggctgtcacagtctctaatgtctgatgtaggaggacggcacagtcaagggcataggatgggacaactctcctcaggtgggaggcagccctctcctggaggagtgagatttgggaagaggagccgggagtggtggagctgtgagcggaggtgctggcatctggtttctgggggccatttctctctttgtgtcttgtcccagcaaagccttttgccagaaaaagcactgaagtagagaaagcagcatttcagtagtgctattgaaaaatgttctctccctcagccaaaacggagatagaaatgccaagactttaaacactcagagaagagctgacccggagccagatctgtgctgggcccgctcggcatgggggctgctgagggtgggggcaggcaggaccttcacaagatgacgtgaaatgacaccgagcagaggcactcctcggccgccagcaccttctcattcccctggagaccacagagaagataagccacttgggttttaaacaacagaatgagagaatccagctggcatgtcccccgaggcctggggtatcctgtttcctgggccgcagctgtcccccgacaaaggcccagtgactcagggaggagatgacacagaagcctcttgtgagagttttcccgcctgggtccctcctaatgtgttcagccttccctgttttttaggaccaatttgtacttagcctggcgatggggatgaaaggagagcttcagaaaatggaccacactgatgagcatcccgactggaagtggggttaacctagagaatcccaggtcacttagggatgctctaagtgctgagagaaaaatcatgaaaatccactgtgattttaaagaaaaatatttacccagtaattactttactgggcttccccagtggttcagaggtaaagaatatgcttacaatgcagaagactcaggagatatgggtttgatccctgggtgagaagttcccctggaggagggcatgacaacccactccagtattcttgcctggagattcctgtggacaaaggagcctgatgggatatggtccacaaagtcgcagagtcagacatgactgaagcgactgagcacgcacaatcactttactacttgcagggagaaaagaagtctggtggaatcagcaagtaacaataagatctcataggaagcggtagatgctgggatattcccagactcacttgggtttggggtggtattgagagttcagaagtcactctagtgagggcatgggggcagggagagaaatataggatctgttccactagaggatgaaacacagtggaattttctttgaaaggatgttgaggggacattctttccagagttatttctccactgatctccagtagcatattgggcacctaccgacctggagagttcatctttcagtgtcctatctttttgccttttcatactattcatggggttctagaggcaagaatactgaagtggtttgccattcccttctctggtggaccacatcctgtcagacctctccaccttgacctgtctgtcttaggtggccccacatggcatggcttagtttcactgagttagacaaggctgtggtctgtgtgatcagattggctagttgtctgcaactgtggtttcaacctgtctgatgggcaaccttctgatgccctctctcagcgcctaccgtgttacttgcatttactcttaccttggacatggggtatctcttcagggatgctcaagcaatgtgcagccactgctccttaccttggacgttgggtatttccttgcggccaccgctccgaccttggatgtggggagctcctctcagccacca

SEQ ID NO: 31282 - DNA, 1792 bp, Bovine  19866881315947
ctgtccgacctcagggccttctggtcagctacacactgtagagtcgtgggtctcactgtccaacccgcagtctggactcgggggcggtgtccctgagctgcccctgggtggtgccagcatcccccaccactgcatcccgtctcctgctggtgatgctccggaccctctcagatgaggaagggaggcctgcatttcttgaggaagcagggttcctgctggctggaggccccctcgtaaggaccacctgccggccactgacactttgaccgcgaatctgggagaaaccttacatccccatggcagtatgccacttcccatccttcccatcaccgtgagtgttggagctacttcagctgtgagccttggcacattactggtataaagtgtaaatatctgaatgctgattatcataaaacaaacagaccactctgtccagagcatattcaggcagccagagaccccagctggcagtcagcttgtgcatctctgaacagccagaaacaggcttcccaaccccactgccctgccaccacctgccaccccccttgcagaaagttctgagagctaaaagctgcccagtgccacttgcccatgtgaacctttgtctcttatttatttttttgaactttttattttctattgggtataactgattaacaatgttgtgatagtttcaggtattcagccagctatacatatgtatccattctcccctaaactctcctcccatccaggctgtcacataacattgagcagagttccctctgctgtacagtaggtccttgttgcttatctattttaaatccagcaagtctctgccttttcaaccattttccatctgctctgctgccaaaggacagaccttgaactgctgagggagatggtcccaatgagaggacatgtccctgtccatctgggtatcccacccctcctggtcgcccatgtgtgtaccagacagccaggctcaccaccctggccagaagggactgagccccgcccccaactccactctgtccctcacagtccacctctggtcccctccttttggaagcaaccaggatgacttcaatcccagtctctcctctgtccactcacccatcttgggacagcgaaggtagtcagaatcatcactttgtcttcctactgagagagcaaaccccctgggatcagggacctctacacctggagctcctccgaaagtgttgagagctggcctccccttctgatgggcggaattcatgtggttggccagccaggcgagactctccagtggctgccagctcagagccctgtggattctgtgaacataaaaaaggatgttaggggaaacaggattttaggggaccacatgatcccaccagtgcagggacttaggctagaattcagcatggtatttgtggcagagaggggaaaaaatttcattaaaattttaagcaaggtgcaccatccccagctttgagatataatagaaaaagatgggactctgaaatggtgtagagaaagggaaccattcagagccaaatgagattaataatgtttgtaaggagtttgttggagaaggtgatggcattaccactccagtactcttgcctggaaaatcccatggatggaggagcctggtgggctgcagtccatggggtcactgagggtcagacacaactgagtgacttccctttcacacattggagaaggaaatggcaacccactccagcgttcttgcctggagaatcccagggacaggggagcctggtgggctgccatctatggggtcgcacagagtggacacaactaa

SEQ ID NO: 31283 - DNA, 1184 bp, Bovine  19866881369244
tcatccccatccttggactgtgccactgagtaggtaaaaggggtccttcggatggaggtgtaaatctgtgcaatttaaagaaacccattgaaggcacagcacccaccccagccaccaaggaaagagcatcagaattaaggtgttgcccctggatctcagatgagaaatgagacagactttctggcgtcacaagggggagaaccctgggtttaaagagaatcctgggtttaagtccaactacaaacccacaggctctcctgggctcaactctgtctcctccaaggcgccctcttaccccaagagactggtggcaagcctgaacggagaccatttccaaagacagaagacaaaaaacactgtttgggctaaaaccgttaacatatgctcatccttactggagcctgtctccccagatcacgtatcttgccgtgtttgtgtagataccagtgccaaagcatgagagcaaggaacgacttggagatgcacaaaagacaagagctgcccttattccctccatggcagacggtaaatggcatttctcacctacaattctttaggcaagccgaaggctgaggcaatgactgtctcacacatctggcctgcactgctccggggctcgctataaacgcctttcaatttgaacgcaccagtgaaagcaggtgcgcagaaagagaaatgggtgcttttatgggacttttaaagtgctgtgctctttgtttctagagttattgtctctgttccaactcttcctgcaggttgggcatcttgatgtttcatgatgaagatcatggtggttctggtatgaatactaatgatgtctgatcgaacactggttcatttttgagataaccagctagtgattttcatttgaaaatgggtatgcaaataattttgggcttcccaagtgtcgctagtggtaaagaacccgcctgccaatgcaagagacataagagacttgtgtttgatccctggctcaggaagatcccctggaggatagcaactcactccagtattctcacctggagaatcccacggacagaggggcctggagggctacagtccatggggtcacacagagtcggacacaactgaagtgacttagcacgcactcacacatacaaataattgtatacatcacagggaaaggaacacaatgtgtgtttttaattttttatgttaacaat

SEQ ID NO: 31284 - DNA, 708 bp, Bovine  19866880345189
tggtgaatgggagccggcggggagacggatgcttgcagtgactttgttgtcgccccaggttgcccagaagagaggaagaggacggagcagagatccaggtcatggtaggcagtccccagcaccaggccctcagatgaggcttctgtagtcacagctcctccccagcccctgcccacacccccaagcagacagaaaaatcgtttggccaagagttaacaacgccctcgctgtagctaatgagagcagacggtgctgtagtgggaggcttcaggccagtgggcagccagaatgttcccaggggacccccacacacacactgcacacggggccacagcctctacgccacatacgtggctacacccccggattgcggaaatgcacacgtatgtacgcccacactccggaagagccagaccttccccggccagcccagaactcctggggcaccgcatctgtcatagctgccctgccggcaccacacacagcagctcctttgctcctcagagcggcaggtgacaatcctggtgctcaggcagaggaagggagggaaggaaacgtgaggtcagaagccagaaggtgtgccagcttccattctgggcacctgggactcttcagggtccacactgaccaagatgctctccctggcccacctctttcccaccacaccacactcccgtctgtggagactggggcccacctcagcttcct

SEQ ID NO: 31285 - DNA, 807 bp, Bovine  19866880434870
gatgcaaggcctggtgaacgagtcaaattaggaagctgagggcagagcaggttttcaggagatgctgagctcagtgaggatgtggggttgagggtcccaggggttggcttgagggcagccaatctcttcactcattcattcatcacacattctctgccaggggcttatttcagctgggggctggtgcagagccatggatgtgatgggaacaggaggaggaagaagggagggggtcagggattgcttcagagtatgtgtcaggcttttcctctgggtggtagggacccctgagtgaacgttctcacctccctgaagctcccatatagagatggagtccgaggcctgacttcagcccccagaccgggaccccagcatagagagaatcgcccttcttcctgggagggtcctggccccggaaagtgaggtcaggcagctcaactctctgggaccctcctcacctgccctgccttctcctccccaggtaagagcaaggaggcagagattaagagaatcaacaaggaactggccaacatccgctccaagttcaagggtaggctgggggcccatctcctgggtctgcgggaggagtgggctgggggctggagtacccgggacttgtaagtatagtcctttctcacttttgccaccccgtcctccttcctctgaccccaggggacaaagccttggacggctacagcaagaaaaagtatgtgtgtaaattgctcttcatcttcctgcttggccaccgacattgactttgggcacatggagggctgtgaacctgctgagctccaacaagtacacaga

SEQ ID NO: 31286 - DNA, 1535 bp, Bovine  19866880467670
tgcatcgctcccaaatcagtcccttgctggagttacttctcccctcacccattccccactagctccttctatcccagattctctctcctccagagttctttcctgagatttgctcccgccgcttgtttcccctaatttcgtgctcgcattttcatcttcctctaaatatcctccagcgtttgtcctcccagtcctacctctccgaatttctgtgccccccagttcctcatcctgcccaggcatgccatccccaacccgccgcttcctcagttccaactttctcattcagaaggttcttttctcattcagggaattccttcccctttcgtagattccaacccccatttcgatccacccattgtcccctctagttcttccccatccacctgtttccatctttccccttttggattccatgtccctccagttctatttcccctcttggcccaccaccccttccagttccttcatttccgatttccttccctctgggttcatctcttcagttatactccccctaccctcctgcaggtcattattccctccctagcctcggatctatccccgcccttttatttctctcatcctgagttctgtccccacccgttgagtgtgtccccttggatatttctttacccctgagttctgtcccctcccctgggatctatccctgctttgatttttgcccacaccctctggaacccgatccaggtatacatccgtgagtactttccgcgcccgtgagttctagtccctccctctggaatctgtctccgccacctgggatctgtccccgccctctgaactcttattgcacccctgaattccagccctgcccctctggggttgaacctcgactgtcctcggccatctccagcccgaaggcaggttctgctccgctcctttcgccgccagcccctttccccgacgccgagtccacctccagatacagcccccaggagggtgctcctttccccatcgcctccctgcgtcgggccaaaaatgcacttgggattaaaatttcatgatgtggcacaggtccgcgagggagtgggagggagcagccagcgcggcgggcgggcgccaaggacgaggcgcagcctctcgcctctagctttgcctcgctgaatctttgggtgtcacagttttgcctgtgtttgagaaaacctcgaattcttagggaggagaggctgggggctgggactcctgggttcgagggaggagggagccgggagctcggagtccagagtctaggggagaagcccgcggagccgtccgcacgcgccaccctgcggcggcagaatccccggtctgggtgtggaggcggcggccgcggctccgagccaggtgtgaaggtggagcagatggtgaagaggagggagtgggaggggagccccgccgctgccagatctcaagccttcgccggaaccatcaccatggagaccgcggaaggcagagaggacccagccccacattttcgggacccgggaacgagttcttcagcctcccacggagggttcctttgcaaactacaa

SEQ ID NO: 31287 - DNA, 2044 bp, Bovine  19866880585007
tgcttttgcctttcacatttaagttttaaatctactggagtcacttctgtctgatgaaaaataagattcaattttcattgtttccatgtggataatcacttgacacggctccatttgtcgaaaagtccattctttgcctgttgatttgcaaagccagctctgcagtaactcatgttttcacatgcaggttcctgggcttgattttttttttcctattctgtgattttttcctgtgcaaataccacttagtcttttttaaaataaatttcttttatttggttgcactgggtcttaattgcagcatgcatgatctttgatcttcactgctgcatgtgaactcttaattgcagcatgtgggatctagttccctaaccagggatcgaacctgggtgtcctgctttgggaacatggagtctcagccactggaccaccagggaaatctcccactcagtctaaactgttatatatttgtagtaagttcagatattcagtagagcaatctcttaccttattctttgctctcagaggtgtcttgtaattttttttattctccacttcagaatcaccttgtcaagttccagcaaaagaaagactcctccacttccaaaaaaaaagaaaaaccatttgcattttgattgcagtgcactgaatctatagactgtagaggtaaaaactaatatgcttgtgttattaatcatctcaacttagcaacatgaactatagctctgttttggtctgctttaacatgtctcaatagtgttttatactgttttcataaagttctttcacatcttttgttaggtttatttctatatgtcggtttttgttgtttagttgctaagttgtgtctggctctgcaaccctctggactgtagcccgccaggctcctctatccatgggattctccaggcaagatcactggagtgcgtttccatttccttctccaggggatcttcctgacccaaggatcaaacctggggctcctgcattggcaggcggattctttaccactgagccacctgggaaaacccctagttactctcagggtctacagcaaagcccagaacagggtgagacacagaggcagtgttcagtgtgttgagtgaatatgaaaaacagggactctgctaccttgggcagactatggcccccagccctgcctcagcccccaactcaccacaccattcactgacagcagctggtccccacgcttcaggcctccgtggcggtcagccacacccccagggatgacacgggagatgtagataggtgaattctgctccttgccccccatgatgttgaagcccaggccctcatccgtcttgggcagttccactaccctgggatgtgcatggccctcactggctgtgaaggcggccaccgtggcctgggaaagagaaagccttgggaggtgaggaccccccacaatgggcatacgcattcaggtagaggctaggcccctgcccaggaaagggatttggccagggagctttcctcaagaatggggcaccggccacacaagtcaacacaagatcactctggtgacaggacgtcagatttagtcactttggacacttcactttcaaagagaaagtctccatttggtgtgtgtgtgtcttgaatctcactttttttgccaatctcacctttttacagagagaaaaaaaggcctggacagagagtctcaagcctcgagcaagcaaacagcatctaaccgtggctaagtaagatttcagtgtttaacccaacttcattgttttcatcatgtaaaggtttaaagttatcttctggtcaggcatttcatactagtttctaactgtacttgctaattgccaggagaattccatggacagaggagcccagtgggctatagtccattggatcacaaagagtcgaacacgactcagtgactaaaactttctcttttcactttcaaagatacttttatatgacattgaagctacaaatgtgagactcttcaaaatacattataaatactagtaaaggtgatagatatggcaaacatcagaaggaggaaacagga

SEQ ID NO: 31288 - DNA, 1801 bp, Bovine  19866880601381
gagattctaggagagaatcctctttgctttttccagcttttacaaagacctttttttcttggctgccctgatcagggaaatgaacctgcaccctcagcagtgaaagctcagaatcctaaccactggacccccagggaacatccagaagtaaactcaatttctttgtttctttgccacgcaacacacttggcaggatctcagttccctgaccagggatgaaacctgggcccttacagtgaaagcctggaatcctaaactaggatgccagagaaccctataaggacccttttgatgacactaagggcccaccaggataactcaggttcatcccccatctcaagatccttggcttaatcacatatgcacaggcccttttgccgcatcaggtcatatagtgaacaggtaacgtctttcaaggggccgttattttgcctacaacaaggacacagaggagagaggggagagatctgaatccaggtgtgagtgaagccaactccccccaccccccaactctgctttcctgtagagaatctggggaaggcgtttaggcacaaccagccctctgcagcctgctggcctgtgagaacaccaggcaggggtgagcaggctcagtcctgggctccgtccccttcttcccctgggggcagtcctctgccttcaggtcccctgtaagttaccgtctggatcaacagctctaggtcccgggcctcgaatgtgtgctgattctgagggtccaggtgttcaaactgcttcaggaggttcaggtgatccaactgtatgtctggatgagagggaagagtggggggaaagcatgaactcatggaatgttccttcttccaaaatccctatcctggactggatgggctctaaaggaggtcacagagggcatggaaggatgtcacagaggacagcatgaatgggcctggagcaatcagggaaggcttcctggaggaggcaatgaacacaattgagtctgatgctgaaaatgataataaccaacatgtgtcaaatacatattatatgccaggccctgctccctaaacacattaaatatattaatgcatttacttttcacaaaagtctcacataggttctgccattatctcactttatggttgtggaaacaggctcagagaggggaagggacatctaggtcaccatctaagaagaggcagaatgaagattagctgggcttcagagcacatgatactcagcctccttatgggttgaactgccttgcccccacattcacacaggggttcaaatcctgacccccagtatcgcagaacttatttggagacagggttttagaggtgatcaacttaaaatgaggtcatgagggtgagccctaatcccatatgacagaagtccttataaaaatggaaaatctgggggcctccctcgtggttcagtggtgaagaatctgcctgctaatgcaggagacacaggttcaatccctggtctgggaagacctcacatgccttggagcaactgagcctgatcgctgcaactatcgagcctgtgctctagagccggggagccgcaactacggaagcccactgcgcctggagcccgtgctccaccacaagagaagcccctgcacggcaactagagagtagcccttgctctttcacttggtggtctgcccagcaaggaagacccagcacagccaaataaataaattaaaagaaaaaaaatttttaagtacatttgtggtaggaagaaaatttgatcaatcttctacacagattttacaaaggccttgagaaggaggccccgaaggcgcccccagcccaaatca

SEQ ID NO: 31289 - DNA, 1098 bp, Bovine  19866880616009
cacacacacacacacacaatggctccagtttcagaaccattttatacaaagtcacagtgtcagaactctagtagaaaacgggggcgggaggtggggggggaagggtgatcagctcaggaggtgtccatggtttcgccttctgtggggggaaggaaagccacatggtcagcacggcccagcaggcagggccagggctccctcctccctctccggggcaggcacagtgggggacactcactgagctcattgaagaggaaggcatcttggtattccttcatgtattgcgtggagcgtgactcgtccaggaagagagagtagacccgcttgatgtcatccacctgcacctcggtgccctgatggggacacgagacctcaggggggcctcacccaggagtcaggtcacgtcctgccatggccacctcctggctgtgggccccaccgctccatccctcagtttctttacctgtaaaatggacttaacagcatcaactgcagccaacagatatttacccagcacctcccatgtgtcaggctgggagccacaaaaataaacccaagggcctgaagttcccgccttcgagaacttttaagttctgggactaaatgccaccgcctagggaaagtcctgggagtagcgtgtggaccgctcactcctctgacgctgggtggactcggcggctcaccttgcgtttccggcacaccaaactggcagccgtgatgagctggatggcatagcgtagcgaggtctccagcccgatgcgggtcagaaccgtgtaggcatcctcactcatctccacgtcttcttcctcacacctgcgggcagggaggggcgggggtgttcagccagggacagagccatgaggagtcagagtccttggaagcccagaacgcggagtgagaagggccaccgaggcaggagctggacctcaaaactcgggcctcccgtgcctccccttttcagggctctttcccaagcgccaggcacccgcatagcccctcccttgtccaaagagccccgccccccccatcagaggccactgctcggatgccccgcccagtcctgcttctggcaggccaagtgacctcccccgcagacct

SEQ ID NO: 31290 - DNA, 1560 bp, Bovine  19866880642765
acccagggcaagtcactgggccttgccgtccccccatcttgaaaacagagctgagggaactccttggtggtccagtggttaggactccgtgcttccactgaagggggcacaggattgagtactggttgggaaactaagatgtggcaagccgtgtggcatggccaaaaaataaaattagtaagataaggggcttccctggtggtccaatgattaagacgccaagcttccaacacagggggcacgggttagatccctggttgggaactaagatcccacaggccctgcagtacgtgtcgtgcggtgaaaggaatggaacagaatggggctgagacgatatctactcctgagctccttttgaggaaaggctgagccaaaagccaggggcaacttgctcattatccctggcaatcgcacccctttcttccctgtgcttcagctggcacaaggccgcaatcatgcacctgagcagccccgggcagtgggtccaggtggctgtgctgggtgcagccttcaggcccccggctcttgtgagctctttgccccccactttcttctcccttccttttgaagatgaggtgaggaagagccagcaggcataaccgggcacagcaaaaccctatggcagagcttcccaagttttatggtatctggtactcttcctgcctcagggatttttccactgtatccttaggtcaagagaaatactaagctgcattccctttatttctattcagcagtgaggtataagcgacttgctccctgttctcccaggggcctcctcaggggccggcagggctcaccgggtgatgccgcggttggtagccatgatgaggacaggcgccatgtcactctccagggcccggttgaggaaggagaagctctcaatgtccagcatgtggacctcgtcgatgaacagcacctgggggccattgggcaggtgtcaagcccaccccccgcaccccatgcccctcttctcccacgccccccacctggcctggcccaggtactcacgccagggatgatctctgccttgccctcctcccgccattcggccaccttggcgttgatctgctctcggacttcggacttgatctctcctgtgtcgcctgcgggaggcaggggttggggtggggggcagagtgtcagagaggagaagggatccagggccgggggtgggggaaggcagtggacgaaggcagagagagacgggacgccggggacacagagagcaagctggagtggtgactgacagtggctggggactcagacctcccagagaggcaacagatagggagagacgaaccaaaccacaggtggagaagaacggaagccggcaaagagggatggcagagagagggagaggggaaagagggctgggaggggcggggggagggagccgcctgcgggggtgggacgggagggcctcacctgagaagagggccaggaagccctgggtgcgggagttgatgacgtcgatctcatggagagacaccgtgtgcaccacctccttgcgcttctgcagctccccgtctgggcactgcacgaacttggtctatgggc

SEQ ID NO: 31291 - DNA, 3542 bp, Bovine  19866880653825
cttgggcagagatgctcaccagattctcccataagtcttccctctcttgaggttcagagaggggaagtcactggatgtcacacagcaaggaagtagaaaagcagattaacactaataatcattgtaggaaaataatactgggtagtagtcaaaatcccaataactcatatttaataaatgtttacaagatttattaaatatgaggaggactagaggactggtgtagaggagcagactgaacacatgtctcccatgtgttcctcaaaacaactttaggaaatagatatcattattccctaggtctcagggaggtttaggtggctgatccaatgttgcagaactagtgatgaggctgaaactaccgagggtgaggaggggctgaaggaggaaagcgggactgagaacaagagggaaagacagagaccaggaagaaagagggacagagatccagaaagaagggaacatagacctaaagacagagagggccagagaccagcgagaggtggggaagaattccaggagacagagattcagtgtaggacagggacagagactcagagaaaaggataccaggagaccaggaagaggcccccccaccccaagtttactgttcccctcttggaaggtgtgtgggtggggaatggggctgtctggagctgtgcacatggagcccaatgtcactgcctcccatttctcccaggcttgtccttcatgcccttgcagatctggtccaaggtcctggccgtctcaggaatcctcaccatgggtcttgccctcctgggctgtgtgggggccctgaaggagttccgctgcctcctgggcctggtgagttcccctccacccttccacctctaggatcattcacatcttgtccttaaatagagccctggcagccccttcatcttggggagttcagcctgacctgcccactctgtcttcctccctgctccagtattttgggacactgctgctcctgtttgccacacagatcaccctaggaatcctcatctccactcagagagtccaggtgagctcaccttctcctctcacccgagctagtgggtggggagggagagagtggaaacagacagaagcaaaggcagacaggggctaagacagacaaagataaataacagagagagatagagaagacagaaagacagagactggtagagagacacagagaaggatctagagacagacagggtcagagaaagactcaccaacacaaaggaagacagagatccaaagggaaacagaagcgaggaaagaaaacccttggagaaacagctccaagaaagagaaacttaatgagatcgtgggagacagtggagacccggaaagacaaacgggggaaacaggcagagggcggtttggagggacagagacatagctagccattcagtgaaacaccgaggctgccacgaagattctcagagaccaccagaggctgggacggctacggagtggctggggtgggttggagcagagggcagtggggaagcaggtgggggattcagcctcactctcggcctatcagctgaagaagaaagtgaaggacgtcgtgcagaagaccatccaaaactaccgcactcatccggaggagacggcggcggaggagagctgggactacgtgcagtttcaggtgcatgaggccccccccaccaggatccttccctctagctctgggattctgacttggctccgccctctgcctggaggagacttggccccgacgggatccaagctcccagctctaggaccctaacgtaaccctacccacctaagccacctccagcccgtggcgacttggcccagtcccccagctctcaacccctgcagtgactcctccccctggctcgacagactccgccctcagtcccaaggccctagcctgaccccactctctgcccagtagcgactctggttcccaagggaccaggcccaagcgagattcctttccctggtcactcacatggccccgccctcccatccattatccccctacttacagctggtttgtactgcctacccaatcctccaaagcacgattctgcagctctttccccagcctcaagacccccgcccccatgacacctctctcccaacctcatgtacccctactgtcccttggccctgctgtgatcccaccccagcccagttttgttagccctctactcctcaatatgacccagtacccagtcacacccatcacctagtcctctgaccccccaaagcatcttgcatctctctagtccttgttcctgacttttttttttttttttttttggtagttgctttacaatgttgtgttaacttctgctgtaccctgttcctctgacttttgttcttctcagctgcgctgctgtggctgggagtctcctcaggactggttccatatccccagcatgagacgcaacgagtccaaaggggaccgcgtgccctgctcctgctataactcatcggcgaccaacgactccacaatcttcgataagatctccccccagtttagccggctcggatcactggcgcagccccgacacaatgtagaagtttgctcggtccccgcgaacagctacatctaccaacaggtggggaagatgtggagcgcaggaccagaggggtctgacagggtgggcctacgggaaagggctgttttacaacaggggcagaacccctacaaggggcgagatcttttggaagggcgggggcctaaagaaaaggcccaggcgaaagggcagaatctggaacgctgatacctggggatgaggtcttcagcttggatggactgaagcccagagactagagacccctgataactagggaatggggtggtacctgaaagaggggttaaggctggactgaggacagtgggctccgggcttgagggcaaatcccaaaagtaacctacctataacctgtccctgtatcctcagggctgcgaacggaatctctccaactggttgaccaacaacctcatctccatagtgggcatttgtctcggcgtgggtctactcgaggtgatctggtcccgcccccactcgcgattggcctagatggccctgccccaaattgcgcgtccaaccagtctctgggaaaggcgcatgcattgatagaagtacagccaatccaggccttcctgggactccacctggcctagcctctgtgagccctgattggttgcacgggagcaggcgttcccgcccttcctcacgaggctcccattggtcctccttgatatctggggatataccttgctattggccgcaatatccccctttccccgcaggtgagtgtagcggggttgagcctgctattaccgcgcagcctgttgcaccgcgaaaccccagccgcaggtgccgggtgcctacagttcgagctccgggcgcagcggcgtgctgagcagcagtgggcgtagcggcagtctgtggggtggctggggcatggctgacgcctgccccaactggggggacaaggccccgctgggcaagctgcctaaggtgctggggactctggttgctttgggatcaagacgaggaaca

SEQ ID NO: 31292 - DNA, 1596 bp, Bovine  19866880737713
aagacacggaggagaagacatggaagaagaggaggactgtgattcagaagcaactgaagatgagggagaagccgaggtctcctctgccaccccaccccccagtgccttcctgagtgcctgggtgtatcgaccaggagaagacatggaggaagaggaggactgtgattcagaagcaactgaagatgagggagaagccgaggtctcctctgccaccccaccccccagtgccttcatgagtgcctgggtgtatcgaccaggagacacagaggaagaggaggactgtgattcaactgaagatgagggagaagccaaggtctcctcttccatctctctgacaagtaccttcctgagcgcctgggtgtatcaaccaggagacacagaggaagaggaggactgtgattcagaagcaactgaagatgagggagaagccgaggtctcctctgccaccccaccccccagtgccttcctgagcgcctgggtgtatcgaccaggagaagacacggaggaagaagatgagtatgaggacgaagataatgaatcaggagcagctgacttggggcccagcccctcccttcagacccagagtgccctcctcagggaccagatttatcagcctggagagaaaacagacggaggagaagctgctgagaagtggggagaagctgagtcctgccccttccgagtggccatctatctacctggagagaagcccccacctccctgggatcctcctcggttgcccctccgactgcaaagacggctcaagtctgcacaaacccccaccaggcatcaggaccttgaacgtctcctgaagaccagaaaggtgggtactgagaacttagattcttgaggttagggaggagagggctgggagctggcactcctgggcctggggaccaaaggactggaggccccgactcctggctcccccaacttgcagagggttgcatgtgagctccattgggagggctgtgttcacgttaatgcaatcctttgcaagaggctggcccctgtgggaggaaggagcctctgagctcatgtcaaccccagggccccacctctaccttcagtgagtcagctggggaatcacttggcaggcaagataacaagccagatgacaagcattgttgcgcaactcatttttgttgttgttgtttctctttctccccacctgcggccctctggatcttgtgtgtgtgtgtctccccgtgtctgtgcccgtccatctccaggtgcgcttctctgagaaggtctccatccatcccctggttgtctgggcaggaccggctcaggccgcccgcagaggcccctgggagcagtttgcccgggatcgaagccgcttcgcccgacgcatcgcccaggtccaagaggagctgggtccctacctcacccctgctgcccgggccagggcctgggcacgtctcgggaaccctcccacttccctggccactgtccctgcccctacccagacctcaccgatgtcccccatccaggccacgcccttgagccacgctctggcctctccctcccctccctgtgtgtctcctagacctagacctcagtgggaggcgggctaatgtaagtagtttttgtgtt

SEQ ID NO: 31293 - DNA, 1568 bp, Bovine  19866880784840
actgcaagacggattctcaaccactggaccaccaggtacgtccctaaatattttttttaattcctgtccccattctctgaagccccaggtaacctctattctactttctgtctctatgaattggcttattttagatttttcgtagatgtggaatcatacactattagtcttgttgtgtctgactcatttcagttagtgtgttttcagggttcatctgtgttgtcactctgaagaattagagcttcattccttttattctgttgtatagatagaccacactgtctattcatccacttggtggacaggttgggtcttagtagaattttttttttttaataaaatgtgatcatttcacatttcttgttgtttgcctatcctttttcactgtgcagcccttcttggtgctcattctctgtcagtaatatagatgtaacttgttctttttaaacagctatcttattccataacatgagggttgcacggtttagctaactggtcccccatggatggacatctaagttattgctagttacctctcttgacacctgcttcattgagctcgacgctccccatttgacatagcaaagtctggagggaccaccccctcatttaccccctcccttgaccccaaccaccccagctgtgtgtctctgccccactcccaggtcagtgactggtgggaagaattcgtgtacctgcgctccaggaactcactgatggtgaacagcaactattacatgatggtgagaaggggagacggaggttaggaagtgggcaagggatggggttcattgttcctcgggtctagggctggggtgtctggctagaatgtggggtttagggtcagtgaccccaatcacagtctggaattcaccatcccgcctgttgggatcaagacctgtgtttgaggtcagtgcctccatcctgcgcaaacctgacgcctggcctggcccgcaggacttcctgtacgtcacgcccactcctgtgcaggccgcgcgcgcgggcaacgcagtccacgccctccttctgtaccgccaccgcctggaccgccaggagatcctgccagtaagagggctgcccctgcgggctggggatggaggctgtggtcctcagatgtgtggccaccacctgggtcctgggaggcaggtcacgagcctgtgatctcctgcagactttgctgatgggaatgcgacccttgtgctctgcccagtatgagaagatattcaacaccacgcgaattcccggggtccacagaggtgaggcccctctacccctctcgttaatagaggtagaacagtatagtggctaagaacacgctctctggagccagcctacctgggttcgaatcccagctccgtaactcccaagctgtgaccttcagttcagttcagtgaccttgggcaagttattaccctctctgagcttgagtttcctcttcgctcaagtgggacaataagggtacccgcaagccacttggtaagtggctaacaaaggtccttattcttacaacgtatcccccccaaccccagatcacatccgccacctccgtgacagccgacacgtggctg

SEQ ID NO: 31294 - DNA, 1915 bp, Bovine  19866880792509
cctttccttcctctgctctacctttccctatacacacagactgtgatttcacacagaactcatctttttgattaaggccttggagctttgcttgggtctctgctgggaacaccctgacttttctctgcctgacaactcaggaaggtctgtggcatcttctcttactccctacttacatggcacccagccccttgggctcctctgtcgtgatcaccccggaccttttcctctacacttgagcctccacagtacgttaccccagttagagcacacagtctgtctttctgcctccctgccggctgggactagccttgacagcaggcacctgactcctccgtatgccccccgtgccccaggtccctcgatctgaagcctccaccttcagtgcctcccaccacgtggcctacttcgaagcttctgccaaactgcgcctcaacgtggatgaagccttcgagcagctggtgcgggctgtccggtgagctgagcccccttcccgtgatcctcctcgtcccctaagcccctactccacccaaactcaccagcctcttcccacaggaagtaccaggaacaagagctcccgccctccccgcccagcgcccccaggaagaaggccggaggttgcccctgtgtccttctgtagggacaagctgctctcgctgagcccccttcccgatctgggtctcccaggacacactacacccccacccgcgattcctggcctcccccggggggccgtgaccaccctgtgccttctgtcaccgctgccttcccccacccgagccccagggtgagggctcccgggcacccgggtcactgctgtatataactcccctccccagagaaaataaacgtcactgccaaggaggtgtttttttataaaagggaccgggtgaactccaggcctgtgcacacttgctaaagcctagcgccaccgagaaccatcagatctaagaccctttgctcagggcagagacaagctgagccagccatctgacccccacttcctctcttaacagattccacccttttctgtctcaatgggcattttgttgggatgaggattaatatttgaggggggacttccctggcagtctagaggttaagactttgccttgcaaggcagggagtatgggttggatccctggtcagagaactaagattcccacaggcaggcaggcagggaggagctggtgaccggggctggggtgggggtgggggggcgtaaataaaaaaatctttttttctgggaagttctagaactgcacttttcagtctggtagctggaagctatatgtggctatttaaattaacttcaatgtaaaaactcagctcctgagtcacacagccacattcaaaagctcagtattcacacgtgtgacttagtggctactacccacaccccagccccaccgccgtgggcagggcacatacacaatattctcattactgcagaaaggtctgtcggacagaagtggtgttctaggagaccttggagacgagcagcaagtgctacgaaccgtgcccacctgcctcccacctccaatgtgtactgagaaaggcggtttggttgcgcaggggagaaggaacaggtgggctgaatggtgtttaagccgcagacaggcaggttctcagttccagaaaggtctcggttgggctgacgtctgactctcaaccttgaattcaactggaggctggtgtggaggaacctccctgccagcctctcctctgggggtggggccgaagtgtagggtgacaacggtttggggatcaggacccccaattctgtaccgcagctgctaacttcgaagactggagccagaaccggagaacaccactcccccatcgcccaggcccatcagagaggccatcttttttttttttaatatttccttatttggctataccaggtctgttt

SEQ ID NO: 31295 - DNA, 1401 bp, Bovine  19866880795300
cttgaagcccagaccaatgttcttgtagtatcgagggagcttttctttgccagtttctccaagcaggaccctctttttattttgaaagatggtcggttgcttttggtacgcacgttctgtctaaggggatgaggaggaagcaggtaagacccgagcaggcaacaacctggcctggaaagcttcacaaaatcccaataccaccttgtcgggtatttaactccctgaacgttggccaccagcgccaagcaccccagaattatcttccaagacactaacccaaatatatctctaattcagactcaactctgaacccagggttacatcagtatttatgatctaaaacacctcctaccacctggagcattcaatccttaaagccccagcgatacaaaacaagccttaaacaccaaaactgttcagcaaaaattattcaagacacaaaaacatccaaccaggatgcacgccttaactaacataggcggctccagaattaaataccaaactgacgggctccctggagtggcccttagacgtcagttctcaaaggattaaccctacagcctaaagcctccccccccccaaaaaaaaagtactctgtaaatcttgatttttgaaaagacaacttccaaaatccttgaaccttaaattaaaccccaaatgcggagcctccaaaatttaagtgttagtcgtccagtcgtgcccgactctttgcgaccccatggactgcagcccactaggctcttctgtccatgagatttcccaggcaagaatactggaatgggttgccatttccttctccagaggatcttcccgacacagggatcgaacccaggattcctgcactgcaggcagattatttaccgaccgagctacaaaggaacatttaggaggtgctaatcgagattaacgccaagacaactgccctctgcccgatttaacccctgggaaattaacccccaaactggagcgcggagtcccactctccaggactcgcctctgaaacccagaccccgcagagtcggcatcggcacgtagcccatacctgaatgtccgccatcttcccggctgcctgaaaaaaggaaggccgcggcggcgtccgggtttccttatcgactgcacaagggttagagaggaagtgacgacaaaggggcgggacaaacacggtttggggcggtgccttggcgagactctgattggcgaacggtcctacctaagcacgcgattcgcagacagaacgaaagctgccatgatggtcaaggcagaggagcgggaagcggcacactgtctcgcgagagtcttacgccatcattgcgcgccggcatgctagggtcacgttgggaaggcgtggccagccttaaccagcctatgttatcgcgacatttatcggaaggcggccatgtt

SEQ ID NO: 31296 - DNA, 796 bp, Bovine  19866880820010
tggccccccacccccggctcctcattaccgctggcagctcctaatgagcctggggtgggggtgacccggtgcccccggccccctggtctgcgtcactggccgctgcgggggctgtggaggcgatataagggggctgccagcctcgctgccgggagcccactgcgcggtagggcaccctgcaaatgggcttcgggggtgggtgggtggatgatggggtctggtttctgggcccagacacgggcatcactgagctctttcttgtctctccacaggtgatggagacccgccaggtacccaggagcccccgggtgcggctgctgctgctgctcctgcttcttgtgtcctggggccaccgcacggcctcaggagtcgccctacctcctgcgggggtcttcaggtaagtgggacatccaagtctcccagggaagggtggggactccgagaggtggaaagagacccgaagagaatggggaacaaagactcagaaaggggaaatagagacccagagaggaggccagagataggaggttgacaggtaggtaatctgcaaaataaagagatacaaaaggattctgagaaaggctttgagagacttgaaaggagtcgaagcaggaacgagtttgttccttgagcaacgtttattgggtctggggtgtgtgccacgcgtgcgccgagcgctggggcgggacaggggcatcagactcggtctctgtactcaggaggctcggaactggtgaacactgagccgaagacccacacagagcaagagacaggggacagagaccgagcccctccg

SEQ ID NO: 31297 - DNA, 1036 bp, Bovine  19866880880066
ccccatgctcttccccaccccacgctctccgccccccacccccttccgcccccgcatgcctgtttcccttccctgttctcctgtcttcatggttccctcatcctttcgtccgtctctctctcacccgacccttagacccacccccacagtggcccgaggagacctccgcccagggctttcgccagctgctggagctgaacctgctggggacatacaccctgaccaaggtgaggctggggtccccgccaccaggcctgggtgacctcctgaccatgagcttttcagacccactttgtctaagagccaaatgttttgtgtgccttgctttgatcttattccggaagggctccgttcttcgtagaaaagaaatgcccatagatccctatatccagccaaagctacctgtgttggctacatagccccatcttcttagcaaccttccagaaccttccagcatggtgtggtgagggatgttaaggatatggagggaggggttgggacaaggagtcagtaatagacagatacagctttgccatccaacgaatagctattaggaggaaagagcatcccccctctacccctatgcctttcctctgaagcttgctataaccgcctcctatttactgtctcagttcaaataccacatcttcagaaaggcccttcccaatcatccttgcttatgtggcatctacacctatatatggggcttccctggtagctcagctgggacagaatccacctgcaattcaggagaccacggttcgattcctgggttgggaagatcccctggagaagggaaaggctacccactccagtattctggcctggagaatcccagttgcaaagagtcggacacaactgagcgactttcactttcacacctatatgttcattctctatgataacagcttgttttcatcaaagtattttttaagattatagtttactctcttttttggtaaggtgttgttgttttttttttttgatgtagaccatttaaaaagtcttcattgaatttggtgcagtattgcttctg

SEQ ID NO: 31298 - DNA, 1418 bp, Bovine  19866880898115
atttgagcaaagacctgaatgagatcaggttgagccatgtgggtatctcggggaagggcattcccgactgagggaacagccagtgcaaaggccctggggcaggaatgtgcctgcctcaggccagtgtggccggactggagagaggcaggaggagagaccagctctgtttaggccacaatgaggatttggacttgtgtggcaggtgcgcgggtaaggggccagcgtggagcagaggagggaggtgaggggacttagatcttcacaggctccctcaggctgcacatggagaacagactggcaagcgagggctgaggcagggaggctggtagggtgaggaggaaacgattttcaggtgggtgacggtggtggcagtggcgggggtgagatgcggtgggattctgaacacattttgacgatcagccaacaaacttgctgatggatcggactgtcagtgggcggtgagaggcagacggagtcacaggtcccctccaaggctttgggcccgaacacctggaaggttggagctgtcacttactccctgtggaaggagatgggggttggagagtgggggtggggtttcaaggcaaaggtgaagggctcagggtgacctcctcctttcccgagctgcgttgattctagccagagacagatccacgttggagcccccgcgccacattcactgtgtcccacccgggctatcaacccaagctcagaccccttgagcgtaagtcccgataaagcgccctctgcggcgtcagctgccacctgtcaccaccaggtggcgccccttgcaccagcccgatccaccccagctcactctccccccaaaatttcctttcactttcgatctttggctgtcacccggcgtggccccttccacacccagctggggcaagcctggtgcgtgaggagaaatggactccgggtccccgaagggcggggccggggtccccctcctggggctgagcgcagacggcggggggtcgggttcctgggtccctggcctgagcagagttgcgggcaccggacgtcggagttcttagaaggggagatgaggagttttcaccgtaactgtgctttacgcaggaagccctatagagtaggaggcggaaacttagccacatcaaaggaccgagggaggggcggggaggtgaaggggcgggcaaggaaggggctggggtgtgggggtccgagactcgctcttctgtcccttccaagatccggccacaggcatgaagggcccccggcagaaatggtagtgctggcgccagcctggagcccaactgtgcgtatcccttggggttaaggtgggggaatggcagtgtcaagatgggcagagcttagaggggaggtggacagagttggggtggacacgagtggggagatgaacaggggtggggggagatggacagagttgg

SEQ ID NO: 31299 - DNA, 1805 bp, Bovine  19866880967651
tgtctggatccggagctccccgcagcgtctctcggcgcttttccgatctctagtttaaccgagttgtaaacacattggcggtcgggcattgcattggggaaagtggggtagaagagccccaaacttggacttcgggtgtctgcgtgtgtctgtctgcgtgtctgtgactagccaaagtctcgtgctttctggaaaaaaaaaaaaaaaaagctaaaggtctgtgctcttccgtgtctgtgggtccgtcccatgtgaacgcttcctgatcttctgccccgtatcactttctatttttctgcagcgtccatcgatggccccggtgggagcttagaaggcggcaggcgaagagggctaggaggggggaagagccaaggagaagcagaaggggtggcgggcgagggggtccgctgagccggctccgcaccgggtcctaagagggctcgcggaggggaggggaggccggggtcaccccgaagccatggcccggtccgctaggacggcgctgcgttaaggcacctcggagcaggaagacacaccaactctccccttcccgcccggaaaagctgcacccgagcggcaggcgagagggattccaaactgaggagcaggcggggtggaggggcgggtctccagaagccaagtggctgataatctccacctgccggctcggaagccccgcctctggagcgccggtggggagggcgcgtgggtccgccacccatcccacctccctcgcccctccccgccccggcccggtcccccgcctcccgcctccggccaccatctctgcctcccaccacctccaccatgacggtgatgtctggagagaatgtggacgaggcttcggctgccccaggccaccctcaggacagcagctacccgcggccggccgagcacgacgaccacgaatgctgcgagcgcgtggtcatcaacatctccgggctgcgcttcgagacgcagctcaagactctggcgcagttccccaacacgctgctgggcaaccctaagaaacgcatgcgctacttcgacccgctgaggaacgagtacttcttcgaccgcaaccggcccagcttcgacgccatcctctactactaccagtccgggggccggctgcgccggccggtcaacgtgccgctggacatgttctccgaggagatcaagttttacgagctgggcgaggaggccatggagaagttccgcgaggacgagggcttcatcaaggaggaggaacggcccttgccggagaaggagtaccagcgccaggtgtggctgctcttcgagtacccggagagctcggggcccgcgcgggtcatcgccatcgtctccgttatggtcatcctcatctccatcgtcatcttctgcctggagacgctgcccgagctgaaggacgagaaggacttcccgggagccatccaccgcctggacaacaccaccgtggtctacaacgccaacatcttcacggaccccttcttcatcgtcgagacgctgtgcatcatctggttctccttcgagctggtggtgcgcttcttcgcctgccccagcaagacggacttcttcaaaaacatcatgaacttcatcgacatcgtggccatcatcccctatttcatcaccctgggcaccgagatagcagagcagaaggggaaccagaagggtgagcaggccacctcgctggccatcctcagagtcatcaggttggtaagggtatttaggatcttcaaactctcccgccactctaagggcttgcagatcctgggccagaccctcaaggctagtatgagggagctagggctgctcatctttttcct

SEQ ID NO: 31300 - DNA, 1315 bp, Bovine  19866881073108
cgctgcaggccgttctgcaaatggaacagaggaaacagcagcagcaaagccacaacaaacccagcccccggccccgagggacagctcaagttccacccggacacaggtgctggcctgctgggcccaggggccagggagggagctgggggcccagacttccgtgtctgagggaggaggggctgcgatgtctagccctgccatgttctccctccgttttcagatgatgtacccgtcccagctccagctggtgaccagaaggatgtggatgcttcagaaaagaaggtcccagaacagacccctgagccaccccagctggattcacagcacctgtgatcgttccaggaccccaacactcagggttcctcccaaggctcatgggaggggggtggagtgtcacaatcaacctcctctggggacccggccacacttgtggcctcctgcaggagggggaacaggctggctgtttccttctcatactgctgcccaggccctgtatctgccacctcagtctccacagccttccagtctgtggtcccctctttctgttcccctccaagggacttgccttctcgtatccagttgagtgctcactggcctcagcttcactgagggaagcccccttcctccagggagggtctgctcacacctgcctttctagttggtttggccttgacgcccaggttgtggccactccagcatcccgcatccccacagctgctgaaatcctgcctgctgctctgggcccagcttccgctggtctgtggggcttcagtggcccctcaacacctttctctacattttgtgggactggcgatgcctcaaagatagtgtctcccccacagctgggtgtgagggccagaagagtcctctgcatcgctgatcaactctgatcccaggagccctgactctcctgacccctggtttccagccatctcagccccctccctgatgtcatggctcctagccccttccttccacatccccagaaggatcacagaactgaccccaccgcaggattaggttccagcccctcagcctttctggctttatctcacacggctccctgttctgctctatatgctggttccatccaaatacactttctggaacaaatccatgcctctgtttctttggaaaccctgtttcttctgaaactccacttgtgcttcacctgccaaagccctcttcattaagaatcaattcaagcatttctgagaggctccatcatggcatctttgtcctgtcctgatgggtctgctgcctacacacatgtgcataccttcagtagaatcccttcagccacaaggacagaaaa

SEQ ID NO: 31301 - DNA, 1391 bp, Bovine  19866881075945
cccagagatcccagcaccaggttgtggggagtgggtgtgggtaaagggaaggccactcccaggatgttctagatctagaaagcccccaggttggatataagaaccagctgtagcaagaggggtctcaatcactctggtcaagggacctgtagcagcagagtgggcggtgttccaacttggagaggaggggtgggcacagagcagtaaaacatcagactcatagaggcctggcagcagcagacaacgaatggtcagactccctgaagactagcagcagcaggacggaaggtggtcagacttagggaggacgtcccatagcagttaacgagtggccagaatcaacgaggccagcagcaccaggatggaaggcactcagacgtggggaggcaagcaacgcaggacaagaggctgtcaggctttggacgaactggcagcggtggggcagaaagcagtcagactcaggaagggttgctgcagcagagggagaaaagacaaccggaagtcgggagcacagttccccaggaggacctcacccagctccaccgtgaggggctgggccagccccgcgtgctgcaccacgcagcggtagtggtgctcgtcgccactcttgactgtgagtgatgaccaggcgtagaaggagccgtcgccgttggggcccatgtctatctcaccagagccaatggccagcccgttccgcaggaagcgcagcttcagctcaggtgggtagaaggagaaggcgctgcaggtgagcacagagaagccgggactgccgggtcgggccttcaggcgcatggagggtggctctgcagacgaacaggcagacaggcctaagccccaggcccagggaccccccaggaccaggcccagagttgcgcagagatggagagaggcctccattcctccccctctacccagcaggtctcaccatgtgccgtgtgctgctctgtgctgtgtgctcagtcgctcagtcgtgtctgactctttgtgacctcatggactgtagtccaccaggttcctctgtctatgggactctccaggcaagaatactggagcaggttgccatttcctactccaggggatcttccggacccagggatcaaacctgcgtctcttacatctcctacattggcaggtggattctttaccactgtgccacctgggaagcccccatactacacctgatcgtgcactatgctgtcctgagcctaaaggccttcttaggggtactgatatccaacctgcccaccacaagggtatccatctctcttccagtccttcctacaatgacacacgcatctaccatgggatgtgccaggcactcttccagacactagagatacagcagtgaacaagagagacaaaagtgttagtgctcagtcgtgtccaactct

SEQ ID NO: 31302 - DNA, 2174 bp, Bovine  19866881109047
gtgcctggtgctcctggggctgccccgggtgcccccaccccttcgaggtgctgctgcttcactcactcgacaggcccttccccattgatgtcgccatccacgtcaagcatcgggtccttctgcgtgggctcctcatctgacttcctggcgtggagggacacccagagtgaggaataggggagagggagggtaggagaggagttctccagagagacccaaactcagcacccagagacatggcaggaaggagaggaattaccccaaagggacctgcccccagagccctagtcagaaagcagaggaatcgtatagagtcccccgaaagcttcccctcccacaacgtgcccccagtctgggggagggaaagaatgaacatggttaggcaaagcactagacagaccacgtagaaaggcggccagaactgagcaggaaggagaggcccgatcgccccaccccacccccaatcccgcctcctgccaatttaaccccagggactgacctgaaggtgatgaggtcggtgtagatgagtggggggcaaaagaaggcaagaaccagggcccagatgggcgtggtgctgtccatctccccccaccacttctgtgtcagcagagactgcgggggtgggggaggattaggagcctgaatctcccccgcaaccccctcccgaagaccccaggcaaggattggaccctgctccagagcccagggcaaatgctccctgcagtggtggggctgggggcgggggggacggaaagggtcaaaggcaggaccacgtgtcgcagattttagtagagttaaacagccaacatttgttaacacaatacaccagatactgggctaagcacttcggacagatcagctcacttaagcttcaccaccccgccccccaggaggacaggtactattattttctccttttccatagatggggcacagggaggttacggaaggggcgaaaactggaacccaggagtttaaccatcattcagagtaaaggactctgggaaagtacttgaagtgccagcaagtgaaggtgggactccctgctgcgtaggcaaacctcgtactctgggtgggactcactgagcccctgtcagattcagactaaggaaaccaagagaagtttcaaactgtcaggattaagggcttccctggtgggtagtccagtggttaagattccacgtttccacttcaggggggcgtgggttcgatccctggtcagggaatttccacgtgccactgtgtgccccccaaaaaagaaagaaagtagaaactgacaaccagaatgcaaaaatgcggggctgagtacaaataatgaggtacgaaatttactcccaattatcataaataagtcttttttttttttttaatgtcaggattagcagaatgggagagacagaggggcacacagagcttcccaaaggaagggtaggattccctaaaccagagtttgtctccacctggaacactaggtaattgtccagtgacgccgttctgattgttgaaacctggaaacggggacctctcagggaagtgggaaggacttcttgtgtgagaggcgggacttcctactaaagtcaccagtattcctgtatctggaatagaattttttttttttggccacattgcacaggcatgcaggatcttagttccctgatcagggctcaaacttgtgccccgtgcagtggaagcacagaatcctaatcactggactgccagggaattccctggaatagaactttttaaaaaatatttgtttgttttatttatttggctgtgtctagtcttagctgtggcatgtgggatgttttagttgcggcatgtgggatctgactccctgaccagggatcaaacccaggcgccctgcattaggaacgcagagtcctaggcattgaagcaccaggaattcctggaatagaactttctagaagggtgtgctttgctgtgggaaggttggctttcctgtggcacggcgtggggcttctttggggaagagcaagctttctgggtgagggctgagattttctggaggaggggtggtctccaggaagggggtcaagaccatggactgcccatggtcaagaccatggcaggggctcatcctccagacttcccagagtccagctgaggactgtgtggggtgtctcagatgctcacctgtaccccatcctggg

SEQ ID NO: 31303 - DNA, 924 bp, Bovine  19866881111971
cttgtaagatcccaaaataagtcataattaaaacaatgtttgttaacctgttcagtgttggctattactgtaattattctttcatccacacatgcatgtcaattacccatcctacttattgcgccaacttcaaaaaactcttctcagcagttcaaacaagagtgctccaaatgtcctgcacccggtccagcctcataccctgcgcctccccactggttccccagcaagctgatgctacaccaccctttccgaaaaccactaatcccccttccacctttgtatgagccgctgccttatgtagctcgtccctgacctctctggctcagctagctccttgtggttattcagatagagcataaaagtatatatattttagagatgccttgctctgacccagccaccttatattttcctcctttatagcaggcgagcattttgaatttttgttaagacccatcccccatgatcagactatgatttcaggagagcaagtgttgcccataagcccactccctagagcacagaacggggcgcccaggcgccatctagtaagtattggttattagtaaactcatgtaaaaaaaggcatgctgaggcccttcctttaaatgagcaggcacagacgctgatgagagttgtttattgaatttactcacatgccagcttcccatcgaaactggacaagcagatggcaaaggcttggagcgggcaaagtgggaagcggaagtccatggtgaacgtgtctggggctacacgaccaaactggagcacgaggtagtccgctgaagaggaagtcaggaactgagggtgtgttatttccctgccgcgggcctctgagccgcgagaactacgactcccgagaggctgtgcggcgcccttattccgcccagaatcccggaagtgtgtttacagggccctcagccg

SEQ ID NO: 31304 - DNA, 884 bp, Bovine  19866881163305
ccgttcccaggaatccggggggactgaccccggctacagtaagtaagaagacagggctaggtacctggattcctggggctggggcaggaaggtcactggggcctggaccccagagatggggctgggggacccagtctcctggatctggggtggtgatcaggggcagtgtggaagagtctgagggcctggtcccttgggtcctagaggcagtcacattgagggaattggttggatccttgtgttttcttagcgtctcaggagtctgggttactgagaggttggggcctggggaaatgggatgtgtggtcctcacatgagcagggacagggtggagcccctcctggcctattccaggtgttggacatggctgccgacggcctccttgcggggctggtgagcatcctggatcccccagacacctgggttcctagccacatggacctgcggcctggcgagtgagtatctgggctgctggactgggagaggccctggcgtgggggtcggacacacctctgaggctccctcctccctgtcttgcagaagcgaggacatgctggagctggtggccgaggtccgaattggggacagggatccagtccctctgccggtacccagcctgctgccccgtctcagggcctggaggacaggcaaaacgggtatgtggggccagggccgccctggcaggggtcaatcgaggccttagctgtcgctggtagcagtggtagtgctgttggtgtcatttagacaaaacctgtaccttaacgtctttcctgctagacttcaggaaaggctgtaagcacgcacgtgtcgatgtaagtaaagctgaaactgacgtgagagctagtgcctgggagcagtgagccgcgtgtccagggctctgtgta

SEQ ID NO: 31305 - DNA, 534 bp, Bovine  19866881186563
ttggcctccaggaagctttggaggagaggaagaggggggcggtggggtggggccccagagttttttgagaggaggaagtttgctagaaagaggtttgtttcttgtaaaagaagaaagaaataacttttgctgatagggttggttttgataaaggaaatcttaacgatgcaggagacagcagttgcccctcccttccctctccaccccccaccccccaaggcaagggattggctgggttccaggtggttttgaggatgtcacgttgaaaacctcacggggaatcgggcaccccgggtcaagacagatgctgggtgtgggagcagcaacacggcgtctccagggagggggtgtggaccactgggggcctgcggcacctctggcgggctgtgctgtcctcccccttccccccgctgccctctgtctctgcctgccctgtcccagcccccctcatggccgcactctccccacagcgtgacctggacttcaccatcgacctggacttcaagggccagctgtgtgagctctcctgctcca

SEQ ID NO: 31306 - DNA, 684 bp, Bovine  19866881257291
tcttgggggaaggtgattccatggccttcctcacctcctcaaggatgtcagccaggagctcactttccaccagaggaatcacaggactttccttcaggcctgggagagagtgcagttagggacaccctcctactcatatccctgaagaccaaaagaactacaattcccagaatcccatgaggcacactaattcatggttctaacatatggatgccacaggaggtcctgagagatgtagttctaaacagttgcttgagtggatgagtagagaggatacccacctccactaccaggcttgccctgctaccctcccaccctcccacccttgttctccacatgcttacctttctgcaggcattcccggacatgcttggcttcataactcatgcccattccatttgtaaaattgaactccttgcctggggctggaggcagtgggaactccttatgctcccccttcaccaccagctctgttgggctccagcaggggtcgaggagctgagagaagagataagaggtggtcccaccaccctcaccaacagggctgctcaggagctctctcttgtcagttaagcaccgatcacccgccatcctcaggaaggggtttggggtccccacccaacccagccctgccttggttgctggaggattatttcttagcatcaggattgccacagtacaaga

SEQ ID NO: 31307 - DNA, 1281 bp, Bovine  19866881270493
gcatccgcctgtgtggcgagctgcaggcaagtggcatcaccccagagtgggcagcgccgaaggagcaggcgggcggaccgttcctcgctgctgcggtagcattctccaaagaggtctggggaggaagagttgtgggaagacagtgggagggaagagatgaggggatcgcaggggaaggggcagggttactagagaaggaagggggagacttacaacccccccttcctggctgctgcctgtagtgcccccaggcacccataccccacgcaccaacacccagcccctcgaacttggccgccagctccttcctccgcgccgcctcctcggcctcagtctccaggcgccccaacactcgcagcaacaaagaggcccccaagagctgaggccacagaattggaaccctggagagacagagacatggggtcatgggtagggacagagtttgaagtgagattcatggaggtggtagagaagatgggaggaaagtttgtgatcaaggaaagggacagaggccagaggtcatcagaaattaaccaaggaaatcaggaaccaaggatgtctgcagatggatctggaagaaactggatgtcaagggaacatgtcagaagtcagatggttcagagactgcccgggctgggctggaattaaaaggacatcagagccgagaagcagtcagaagtgtcacctaaaatggcagaggaaaaaggaagacagcatctcacgtcttggccagacctattgaaagacagctacatgctcagtccgactctttgtgaccacgcggactgtagcccaccaggctcctctgtccaggagattctccaggcaagaacactggagtaggttgccattcccttctccaggggatcttcccgacccagggatcgaacctgagtctcctgcattgcaggcagattctttatcactgagccacctagtaagttgagagagatggcagaggctgctgctgctgctaagtcgcttcagccgtgtctgactccgtgcgaccccatagatggcagcccaccaggctcctccatccctgggattctccaggcaagaacactggagtgggttgccattgccttctccagtgcaggcatgcatgctaagtcgcctcagttggagagaacctcaaaacttggtccctccgcaacggcaacaaataagctggctaaaaaagaaaaaactgtcaggatcagctttttcagaattctggaatctaacataaaatttacaacaaacaggagaatgcttaataagaaagatttcagtaaagag

SEQ ID NO: 31308 - DNA, 1113 bp, Bovine  19866881339368
cactctcccttgctcccagtgctgtcagatcctcctcccatcctatttgcctctcaggggtagtgaagctgcagactggcagtttcaaggatacccaaattcccctaaagcttctcttctccactcttttctgcctcagtggtttcaaatctctcctttcagggctttatttgaatggacaattcagactcttcctctctcttgtggttttgggcacctccccctttccttgaacccctgggactctcaggagaacccctgagattactcaacccccctcctctttcaaaaaaattcaaggtcttcctctagaagtttcaaatctctcccaactgtattctgctttttccaagttggtttaactaatcacccatccctgccattctagggattgattctcaccagcgtttctgaggggaaatggcagtttcaagtacccccacccaaccttttcatccctcccccaccagcagactctgctgcagcaccaaatttccccaaaaccttctcccagcttagcacattgcctagggaaacaaccaaaatggcagttttaacaatatgcctctcttcacccccatgcactttttctgacacgattttcaggtctaagaagagcggctgctcaagtccatcaactcaacggtttgaagccaccgccactgaacttccccatggtggtttcaagatgctccccttacccccaattccttgcactttattctcctgggtggttttgaactgccctcattttctcagtggccatttattgcgtccctcaggggctaaatgactccaaatctgggatccttcccctctcagactcccctatttcggcttagaatttgggggaacatatgtaaaggagaagtcacagaatcccaggaaagggaatggggctggggaaaaggggtgtttttccccggggcagggttgtgtctttgtgtctctgtctctgtgattgtaaatcctgccctgcccctctcccaataaaatgcttcggtgtacacactccgtcgtcactggccttgggaatctccaacctccttctccctcggaccgaggagcccaagcccccagtctcctgaccccagccaccctcctctcccaggt

SEQ ID NO: 31309 - DNA, 1926 bp, Bovine  19866881357594
ccacttccctctccactccttccctctctcttgcctggcctccctagctctctcctctgctgataactcctttttccaacatcaccctccttgccctgaagtgcctcccttctcttctttaaccctttccctgctcccaacctggtccaggaatggagactgcaggtggaggaactgggacacgatgtagagagcaaagaggtggcgatcgaccccctgtccactcatcgctgccttcagcagagcttggtgcttatccaccgccaggcggaacagggcgaggcactgtgcgtcctggggacccccggggaggtcacaggtcatggaaagacaggaaatgggcttactgctggggcctgtcgcacccccggcctcaacccagcttgcaacttccctgcaaggcagagatatcaactccacttcgcagcagggatacaggcacagagaggggaagtcacttgcccagggtcacacagcaaggcagaatcaggtgggttcccaggtatcgagggcccaaactcccttcactgagcctcaaaacaagtagggggagaggaaacagaggtgcctgcggggttctgagcgagagattatgtagggaacatgaggaatggtacaaatgaaagctacaaggtcacacagaggttaaataaagagacctacattttggaaacgggtgcccactcgtgccctctgtgtgatccccattaaagcatgtagtacactatgctgaactacctctgtctcccccatcagtgagctccttaaggtcagagactcggcttgttcctcccctgtctcatcacagagcttggacctcagaaggcgctccttaagtgtttgtaaatgtatgaatgagaaggtggaaatgaccgaagcctcaaatgaggcccacacccactgtcttctctttgtcctccatggctctcacaaagtcgcgggcctccctcgtgcaagaacgcaccgtctctgtgcggccttccaggaacaagcgagtcatggtggattcataagtcaggcagaactgacccctgtcctggggacaaggaggagacacgcctgtcagccaggctcaggaagccttcacagacctgacccacctctgtgtggccctccagcctccttccacccaggaacatgcagttgggagagggctcgatggagcccttaatcaagatggcagacccaccaccaaggagtcatgaaagggctcgacaatacgggtcttgggggcccaggggaactgaggtcctgagaggggggctgggggttaagaacccaactgaccccggaagtgggccagctgcaaaggtggtctggatgaagctgtctgaagagagatggcagcgtttgatgaaattcttgccaaagtgggagaaggggaagacgtggcagtcgatgtttccagacaaggtcttggctgccctcagggctagagagatggatagatggatctgccagagaaggagggagggaggaatggctgggggttacagacaggaggaagttggagttggggctggtgctggcagtgaaggtcaggatgggattgaggtttggggacagggatgggatggacagggaatggagctgggaatgaggaatgaattaggactgggaatggggttgggattgggtataggatgggatatgaatgggggttatgtatgggatggggttgaggagggcatggcaacccacttcagtcttcttacctggagaatcccatggacagaggagcctggtgggctacagtccatggggtggcaaagagttggacatgactgaggccacttaggatgcatgggatggggttagggttgaggatgggattgaatttaagcatggtgatggggagactttcctggttgtccagggctaagactccatcatcccaacgtaggggcccgggacaaggaactagat

SEQ ID NO: 31310 - DNA, 2097 bp, Bovine  19866881378204
cccccacccgccagcgccttcgggctggggggggcgctggaggccgccgagagcgaggggctggggctcggctgcccttcacccctgtaagcggctggacgaggagctgaagcggaacctggagaccctgccctccttctcctctgacgaggaagactctgttgccaagaaccgggacctccaggagagcatctcctcagccatctctgctctcgatgacccgccactggccgggcctaaggacgtctccactccagatgggccccccttagctgcagaggctgcagtccccgggccacccccgctcccggggctccccagcgccagcagcagcggcacacctggtgagagctgggaaggaggtctgtgggggcaggccagggattccccaagattcagggcacaggtctgatggtgtaggttacacactggtcagcataggttgtaagtgatggggacaggtgggtgacagggtcggagagagcttttaaaactgatgaggggacatgggatgtgtgaagacctctaggggttagagatgtatgacagaggacagaagagggtctgggggagcagacagggacttggggagagttggttaaagaaacatgcattaacaacgactagtcagatcgtggggtgtggggcatcaggaaaggctaggggtacagtcatgtctgaacggcatttagtcctgagagggcatgtcggacaaaatttcaggggctttgataggggcattggggatgaaagagttgaggtttgggggagggtgtttggagcagtgaatgaagcttaggtgctcagaggagtcttatggaatggtgacgtcttctggaaggtgggaaatggggagtaagacagtgagagactaaaggaaagcatcagggaagagatgggaaagactggcaagttctatgcagagcgtctggatcggctgtaatgggagagagcatcatggaaagagagggccttggaagggtcaggaaggctcacggctaaggacccagggatggatcaaaagcagtttgaagagtcaggagatctcaaggcgttgggctgggtgagtgaggatgtttcaaatatcatgggtatttaacaggaaggagagggcattggcaattccgaagagcaggctgaggaaaggaaaggaaaggggagagcttggatagaggaggatgagatctctgagcagataaggaacaggtatacagaggggatggcccaggaatcaggagggacattaacaaatgggaagtaagcaccagactgggaccccaaaacagcaaaggtaattctggactacaatggactctgtgggaacctgtttcaggggctcagaatcctcactggagtctcagggagggatgctggtgtggcaggaggactgttggggagctgagtggcaataaggaaggagccaaggggctgttggcacagggagagacattcacggacaagagcagaggtgctgggatggagaatggtatttgcagactggggggcagggcagggccagaagatttgtagggactaggctagggagccaggaggggggtttgatgggaccagagaggcctcctggccattgtggtggggggacactaagcaatgcagttgggttgcagaactgccctatgacactgggggtctgcgaagaccggggaaagatgaggaccagagtggcatgtctgcctgagtgcctagtcaataagtcacgtctgactctttgtgatcccctggactgtagcccgccaggctcctctgtccatggggattcaccaggcaagagtactgaagtgggttgccatgccctcctccagggatcttcccaacccaggattgaacccaggtctcccacgttgcagatggattatttaccatctgagccaccaaggaagcccattaggacattggaaagaggagttaaaggaacgtgggcttcttgtaggtgtcggggatggggcaggtgttgaaggtcagggagaggacagtgagcgggtcagacaaggaccctctttgaaggaggagaaagggcaacagaagagtaatggaaagtagaaatggaggggggttgaggccagagatggttgttag

SEQ ID NO: 31311 - DNA, 1151 bp, Bovine  19866881385093
cgacggcgcagtggggcccggtgggagtctgtcccgggtccccccatggccaggctgcccaggccgctgcccaggccctggcggaactcctcgcagagcagggtgaaggcccagaagtagagcagcagctccagcacgctgggcctctccggctcgaagtcgatgagcagcacgcgcgcaaacagcagcaggaagaggaggtagctgaccacgttgcccatgaaggccgtcaccggcgccccccagaactgcggccagcggcgcaggcgcggcaggcaccccccacagcagtccctgcgtctgggcggcctcagtacccccaagggcatcttctcagggggctctgtggccctgtgcgggagaaagggggagaagggaggagggctcaccctgatctctgcacctgactttcaccaccatcaagactcagctttctgaccctcctcatcctgctttccagtcaatccccaccttcacgccttcggacaccctccatcttctcgagttttgacccctgatctaacctctgaaatctaccttcaacactgctgagcttccacccctgactttccccacccttctgacctctggcctctggcctctggcctgacttctgactcttttctggcttttggctccaagtccctcttctttccccctcacaatctctggctctctttctgaccttggaccatctacctgacctctggccctcatatataacctctgacctcctcatttcgcgacctcggttccccaggtttgacaattctgttaactacagttggcacttgccatctacctctacagggcttcccaggtggcattagtggtaagagatgtgggttggattcctgggtcaggaagatcccctggagaaggaaatggcactgaaaatggcacccactccagtattcttgcctggaaaattccacggacagagtagcctggtggcctacagtccatggggttgcaaagagtcggacactgaagtgactgagcacacatctgctcaaggattaaatcaggcgctgctgcagctggctgaccttcaacaccccttgaagggaattcagggtggaaagcaggaatgaggcactctgtgctctggggaaaacggcagaacaggttttcagtatagatattttcag

SEQ ID NO: 31312 - DNA, 1929 bp, Bovine  19866881390870
ctgaccccctccacctaccaggcagcttcgggatcttctggtacctgttctggctgctcgtctcctacgagtccccggcgctgcaccctagcatttcggaggaggagcgcaagtacatcgaggacgccatcggcgagagcgccaagctcatgaaccccgtcacggtccgggcccaagcctggggggtgggggcgcggtggggagaggagagctatcaaggcaggggagacgggaggaagaggggctttgaatccgcactgcgtgtggatcttggtagatctacatagacatttccatagacatttagaggagacgatgggatcgccagttggatggcgctagaacctaggaggcgtgattaaagcccagggaggacggagttagcaggtgcggagagcagggctaggtggcgaggtggtcggaaccactgatgggcctggttaaacctgcagaggcggattagaatgtggggttttgctcagacctcaggatgggtgaagatcgaattagggggcataattgggtggaaggagactcttgggtccacatttatgactctctgaaggtcagcatggggtctggacacccaccagcctgaggaccactgaggctaggatgtcagcgttcccatagggacgcgatcaggccggcaaccccgcctcctcggcggctttagtgagacagggaaatctgggtctctgcgggactatcgtgggatccctgaagggactcggagagcgcccgggcctgttctttgtcctagcagcccttccctcctctcgcccaccacagaaatttaacacaccttggaggcgcttctttacgtccatgccagtctacgccattatcgtggccaacttctgtcgtagctggactttctacctgcttcttatctcccagcctgcctacttcgaagaagtgttcggtttcgagatcagcaaggttgggcccggaaggggagagctgcgggcgcggcgggcgggtgagcgcgggaaggagaggaacctggatcccaaggggttggaaagggggcagggaggaagcccatggtacctgagcccgtggtgagagccctgggcaggtggccgccgagccgcgactccctgtacgcccgccggcgcaggtgggcctggtgtcagcgttgcctcacctggtgatgaccatcatcgtgcccattggaggccagatcgccgacttcctgaggagtcgccgcatcatgtccaccaccaacgtgcgcaagttgatgaactgtgggggtgagtggggcggggcctggaactggtatgggaccgggctgggatgcgcggagcatggctgggcggatctagagggctgaaccatggcggatggggcggggtcagagggcgtgtccatgggggcgtgtccaaaaaggcggaggcggagcgagaccaggtctggcaggaacagaatctcaggtggcagcctccggggcagtgtctgtagaagggcaaggcgggtgtggctgcccaggtgaagcaaaggtgagaccacgttgggtctggaaggacggggcctatacgaggctggccagagtaggatgggaactgggtgatgaagagggacactcggagagacaaaggtgtgagtgtaatgaatggggactgagagggaagccgtgaaggtgccggggtggggcctacaccctcggtcttcagggcgtggtctagtcagggggtggggccattgaggtcccagctggggcagcgaagcctgtgcacgtggtcaagggccaggcactagagaactgagggcttggttagggcgggcgcgggcagaatggaggacaaagccagggacaggcgtggaagtggcaggactgggtcaaactgggggaggctgggagccgggagtgggtctggagaggcggtgcggggcggcctgtgctcagagggggcggccctccgtagg

SEQ ID NO: 31313 - DNA, 1511 bp, Bovine  19866881413387
ccctggcggctctcctgaattctgggtcttgttcctccccagccctgagaagcctcacctgagcctttggctggaggcccctgacctcctcttggctgaaatcgacctccccaaactggtgagcgcatcccctgaggtctggggtcttggacagggagtgatgggagagattgcaacaaatgttgctagaccagtgtgagcctggctagtgctgccccgtgagcccagctgccttctctgttccccggggtccttaggcccacttccggtgctgtccttacagtgctcagacctgtattactgtgtcccacctttttccggggcatccctggtggctcagatggtaaagagcctgccagcaatgtgggagacccagattaaatcccagggttgggaagatctcctggagaaggaaatggcaagccgctccagtatccttgcctggaaaattccatggaccgaggagcctggtgggctacagtccatggggtctcaaagagtggagcacgacagtgactaacactttgagtttcacctttttcctgggagattagactcttttaatatggtaccccaacacgtgaggcttctctctctggtctgtgttctgatcatcctgctgctgggaagggaagggtgggctgattctcgcgcacctccaggatggtgctctggggctgtcgctggaagtcggggagaatcgcctggtgatggggggcccccagcagctgtaccatctggatacctacatccccctgcggatcaactgtgatgagagcaaggcagccttccatcagaagagaaaggtacctgggggctgggggtttggggaagctaggaaccctgggaggcctagactcttggatctgagggaagagggggcagggggctggacccctgggctctgaatcctctctctgttttctcttctcagcaactgatggtggccatgccccttctgtcagtgccttcttgaccggatgtcttcctatgcttctgtgttgaggggagaggctggtggcttctctaaaactgaaataaaagatgtttgcctttgtcttgtgtgtggctaggagtacatggggaatgggagggaagatggacattgggctggagtcccgtagaggtcactgccccagctcaggcctcgtcctcttccccggatgttctccctggcctcctgacctcttgtcttaccccttgtttgtccccaacaaggtctcagggctgaccttgcccggctcctgttcacggcccctccttggctctccagcacccctgggagaaggtccaagcccctccgccgagcactcaaggctctgtgctatccggtccccttcacactccattttgtctcttccagtcactcaggctaatcacggtgaaccacactgattttttgcacctttctgtagttccccttcgtaggatccttttctcgagtacacctacccagatctactccagtacatctcgtttgccctcacagggctcatctgacttttcaccca

SEQ ID NO: 31314 - DNA, 889 bp, Bovine  19866881565575
aggaaggaggaaatctcagggtccggagtactgggtctgagggaagagggagatggggccctggattcttgcgtctgaaggaagacgagggacctggacttttaggtccgagggcagagggcggccggatgccaggaatcctgaatttgagggaagacgatctgggcatccagactcttggatctgagggagggaccacgcttctaggcttctggctttcctggcaacgtccccccacccccaccctcagggccgggcttccagtatccggcccctatttacgattcgacccactacctcacccgactttggaggtggatagaagcccggagtgactgacagaggagaggcggtgtctggcggaatggcaatgggaacgcgctatgctgggaaggtggtcatcgtgaccggcggcggccgcggcataggagccgggatcgttcgagctttcggtgaatggggtctggctggctctaaatattgggaatctgggagaggagggacccccgagggctaactaatgggtgtgagaaaaagtaggtcctatactggagtcttggagaaggaaatggcaacccactccagtgttcttgcctggagaatcccagggacgggggagcctggtgggctgccgtctctggggtcacacagagtcggacacgactgaagggacttagcagtagcatactggagtctagattcttatcttacaagatccggtttgcaaagtgaacgaaaaggtaggcagtggttgcctagggcctgagattttggcagatttccaaacgccgtttctgtgttctcagctgtctctgcaaacaggcggtttgggggacgatgtctcttgcagatttcgggtttactctggaacccaggaaggcaggctcag

SEQ ID NO: 31315 - DNA, 1060 bp, Bovine  19866881649524
attcccgtaagccgcacagtttgtcaaaaaaaaagtttatacttgtaaatggcacctggcatgtagtaagcactcattaaatgttagttatcacttccctgggagttgggagtttggttagttacccagcagcttgtgggatgttccctaaccagggactgaaccctgaccatgacagtgaaagcgaggaatcctatcaacttgaccaccagggaatcccaacccaacattttcattcattcctcattcattccaaggccagcccctgagctctggaccctgctgtatcaattgttttgcctttttgacagtctcaccttcagggtcctgcctgagagtaacccctcctccgggagccctccctgactccctcagcctgagcaatctgccttatcctatcgccatgaccactcactgcattctggtctgacctccttgggggcaggacccagatctgtttattcctcacagtatcttgggcacgcatctcaatgctaagtcaacatctaagagtggtgcttagcagatgggataagtgattgaataggtgacctttcctctccacagaacgactttctcacaggtgtgttccctgctagccccctcagctggcttttcctcttcagtgcaattcaacttgcctgcttcctccagctggatccttccttaggactgatggagaagatcaaagagtctctgccagactggtgaggttccccacttcaacccagtaacctcctaaccccttggcctccacccaggacatttctgtatcagcatgtgtgcctgttaaagaaaagtcacctctaagacttacctggggtcagattaataaaggtaaagcatcaagtaaagggaggtgatttcctctattgtctctgcacatttttcatcctggctgcttcttgctaaagggaatgttggcaaactagacaaaggccaggtatggttatatatactaacagaagtatgagttctgctaatctacagttgtgtggtcttaggcaagagacctcactgttcttggtgtcaggggcttcacgacccaaatgaacttttg

SEQ ID NO: 31316 - DNA, 932 bp, Bovine  19866881753740
cagtaactccttccaacgccacgacctcacttctgagggcctgctaaggaactcagacttgcatgtcccaccactggggggtctgcttcccaagtctgtgaagcctgagctccacacagatccagcctctccagcccaccttccaggccctaactcacacttatttctgtagaaattgccagaaatgttgatgccctcacagcgcacgaccacaaccttgcggcctagagggaatggaaaatggaacaatcaaggagggcaaaagtcaggaagccaggtgcccagttactgcccagaaaggagaccccagccctgcctgaaactggcccctgtgcacaaacacaccagaaggcaccaaatctcctaccccaagtcaaagagcgctaactggtggagcttgtctcatgctcaagttcaatttgttactccaacaaaacatgttttgaattcacagcccctgacccgggaggggaggatgctggcaggtctcagagcggtgcatggggttgatctcacggtcgtgagactcaaacgaaagatggtgatttttgctcatcactgacctgctgagctcatgtctgatgggagctgtgggcagcgggcagacttacccagaagcacctgcttggccacaatggccgccaggcggcccaggagatggcctcgggccatcgagcaccaggacctgttggagacaggtttaagagctcagaagggctcagaggcacccacaactttgactgcccacctcaaccaattactcctctccattagttaacttacctcccagaacacctgctaaccagatattagacccaaaactagaacttaaggctcactgagatggccaagaaagcaaatgactcagaattttcagtgagcagctaagatacaaaataaaccaatccctcacattttcagctgcttcaagg

SEQ ID NO: 31317 - DNA, 659 bp, Bovine  19866881766556
ctataccctgataaaaataaaaagtgaaaaaaaagtcttagaaaggctgccattgaaggataattaaagccgcatctaaaaggctcagaaaaaagaaagagtgccaagcatgaggcctgatgcacatcaggtgctcagcacatgtctgctctgaatattaacatggccatttgctgaagtgatcgtgaccagggtcccttcttccagaatgggaagctcctggccgagcgggatggagtgaagaggaggagtgaggagctggcctcggagaaggacattttgaaggtgccacccctccctagtgccttgacgatttcctacctccccaaggcccgtttttaccctcaccagtttcagcccctgtggtctggtgagatcagggacttgactcaagccctgaggtccccagggccagtgggcagctcactgaaggccctctcggtgtagctgatgtccagagacatgaagggaggttgaggagaggagctccagagagcgggataggccagggagggcaggccagacacatggacgggctccttccttggcagcggcagctctatgaatgtgaacacctcatttgccagcgagacgccatcctcttccgaggtgagtgggctggaggggaaatgtgccttttgatgtgtctcctgcctcaa

SEQ ID NO: 31318 - DNA, 931 bp, Bovine  19866881993155
aatccatgacagcttcttggccccgcccctttcatcctcaggccccgcccacacgagcgcgaccccacccctcaccatcttgctcacgatgacgatcttgggccccagctgtttgttgactgtgaagatgtgcagcagcctcagcgtgaagatcatgaagtcaaggcagaggacagtgcggcccaggtcatacaggcccggggtcagcctgggtatagggagacgcggcagacgtcactcaagggttacagggtgcaaagaaagccccgagtcttcccaacaccagactgaaggcgagaatgtggcctctccagggccagaattgggacactccccactccagttcacctgggatttactcaaaatttggcaccgtgagactgccaagcagggcttcgcagggcgctggtacccattaaataatggctgtatgaaaaacggccttagcaaaaagctgggagggaggcccctataacatcaagttgggaaaactgcaggtatatttgcccaacctataaatggcaaaatatggagccttccagcaaaccagtaagcagaagacaatgaacctaacaggaaaatggataaaggttaaggacagacaattcacagaagaaggtcaaacagtgaataatgttagcaatccctaaggggaaaacgaaaattatatccctattttgcatcatcgtgtacttcaactttgaaggaattaaaaacctaaagttaaaggtaagacatcaaatcttaataagaaaatatagaagaatttcttcatgaacttgaaataagataactgtcattaagaaaaagagtcctatatacaagacacaaaatcatggcaaaagaaaatactgaaaagttaactactttgaaatataaaatttatgcatattaagagataacataaatatgatggacagagaaaggcaaa

SEQ ID NO: 31319 - DNA, 1680 bp, Bovine  19866880357432
tgagaggaagagtctttaaagaatcattaagttgagtcttagggcagatcatcacccaataccactgatgtccttacaagaagaaatttggatacagacacacacacacacacagagaaatggtggaaaggcaaagagaggagacagccatcaacaagccaagaacagattcttccctcaaggtcttcagaaggaaccaaccctcctaacacctagatcttagcctgtagcctccagaattgtgagaaaatacatttttgttgtttggggcaccccgtctgtggtactttgttagagcagtcctagcaaacaaatacagatgccaagtttgaattgtgtcaaaccaagtccagtttctttttggtcttcctcccattggtagatagaagatcaaactttgagtcttcttagtttcacaggttttgccaatgactactaaaagaaaaatgatattttccacaaaaaatagttcataggtacaaaacattctaaatgcaaaacttatatatagaaaaaaatcattttcctaatcattccccacctccctgaaaaaaaataaaagccagcagaatctccaaaataggttgctggctcaactataaatagccatttatgtttacagacaaaatactaagcttctcagtgtaaaaaaatctacctcatgattttccccaagtacctttataaatgtgtaaaacataacaaaggaatgatatgccccaaagaagaattcaaatctccacctttcaacaaagagaaaaacagcttagaacttcaaaataccaactatgctcacatttgacccaccaggaaagagctggagctgattcatgtcactgcttcttattccatggtgtgtgagttgtatccaaactactgatgaatgaaataaatggaatgacatggaaaaggagagtgtttattttattctcttctaagagactgcccatgatcagagcacagatttcctgagaaccagcttacttctctccattcaggctcatccttttacctcctgtcttcccccttgtctgtttgcatcgcttctgcttactgagtcccctacctctttcccattcttttcctccaactttatcacagcctttccttccctgtttctgtctggatgacatgcctctgtttggagttggaatgctctgtttcttggattcaaaatgacagaaaagtcatcagtatctagagcagtagtgctcacagtgtggtctaccaaccagtggtggcatacgaggtcattttggggagtccacaaataaatttttaaatttaatagctttttaaatctaaatgtacattagaaaaaaatagaactggcacatcaaatctttacattctgacatcaatgagcagatggaggaagaattcagatgctgaagagagttttccaggtgaccttgaaatcaaaccacattagattttataaacctaagtgctttctctgacacatttaaccactgaaatagtgcaggtctccttccataaagtctcagcaccatgcaattctcctttacagcacttagcccaattacagcccattctttgtgtaactgtttgtcaagtggccatctttactaccagactcttcactctgaaaatggtcccatgactgcttgcctcctattgtatccttagctcttgcgcattctctcatatataagcttt

SEQ ID NO: 31320 - DNA, 1387 bp, Bovine  19866880499718
tcagcccaaactcatcgacctttgtgattactggggtgctgccaataggtagcctgactatcttggttagctctgtatttgcagttcttcacttttttccccatggctttagcgggaagctgagagaggctacatcaacggtgctagtcagctgtcattttaaagctgatatctgacttcattattaagatatacatttccatttcaggatgttgttaattaaatatcacctcatctttgctgtatcttaaattcctttgttttcttcaattcaagaaacaagcatagtgggtttgaatcttcagctgccacagtctgtacatttgagctttactttttgaattgtgcagcataatagaagacaaattcctagtaccgctgagatttgagctgaatcttggaagagactggacctgaacagataaatgtatgtggggaagggcatcctcagtggaaaaaaatgatgtcatcaatggccaggaaaggaaagcctgtggagcgtttggggctaaagagacaagggcactaagattgtgcagttcaagtgagtgacaatgaaggtgtgaaaaggagttgaatgtgagagataagacagaactaggaggggcagaatatggtgattggatacaaacagtgatggggagatggttgttgacaataactcagagttttcaagcatctgtaattagaaaggtagaggtttaagagataaggagagagagaaggcgaagagaggagaagatgctgagttcattctagatgtatcacagttgagacgcctacagaggtgagcaggaggccttactataataagtttaatagcggggaagaggttggaactagagatctaggtttggaacagatgataactgaagccctaggagttggtgagatccctgtgaaaacggaaatggagtcttccgtagcatgggtcaggctataatctctgggctgaggccatggccacttgctgagttttggcaaggaggatgaatgggagattagatttaacagaacactgctctttaagatgtgcagacttagatttttctactaaggtactaaggcaaatggatatgcagtcaaggagcacacatgagggacctactgtgctaacctctctgtcagggaaaaggaagtcgtgagttctaacgctgtcccggatgttttacatttaagatctcatttagtcatcaccgttgttttgtctaagtcagtttcctcatctgtgatatgagatataaatgactaattcatagtcattgtgaaaatgaagtaacacaatggatttaaagtatctgaaaggtggtaagtagttaataaactatagttctgatattacaactaatcattttaggaattgtctgtacataattgacacactgca

SEQ ID NO: 31321 - DNA, 1983 bp, Bovine  19866880515590
agagactggcaaaggtaacccccttcactaccgttttctatgttctcccttatctgaagctacagtaattgattttgtctgtttatcatttgtcttcttccttgcccacactgttattcagagcttagtgcacagcacagaacaggtgcatataataatgcaataatcatactactaaatagtagatactaatagtggggcttccctggtggctcacacagtaaagaacctgcctgcaatgcaggagacccaggttcaatccctgggttgggaagatcccctggagaagggaatggctacccactcctgtattcttgcctggtgaatcccatagacagaggagccttgtaaactacagtccatgagattgcagagtcggacgtgactgagcacacgcacacacacacatacacacacgtataaattaaatcatatacccacactcataggcacacacacggctagtaaactgcctaagtgaatggatgcctaagtgaatggatgcatgagtttgaaccgagagagcaaacctctctttcagcttggcttttactcagactttcatgccttgtaccagttaaaagcttttctctgtttaaatctgcaaatgattgtagtttcatctttttcatcctgccttctctactctcccctctaccccctcgcccactgcattgtaggttgaaattagactccatgctttcccagctggcaagaagaggactgaattctgtccttacttaagtcccttatataagaaaatattgtgatgctctgaggtttgttttgggggaatcacttgtaaggccttagtaaaaagtgcaaagacatcagagaaaggaggtgcaaacacaaataattggtcctaccctatgcctgaggaaaagcatgcaccaccagcacctcagttctgcaaagcagtcataagatgatacatacatccatttctgggaagtttatttacagctgaaacactgttcccacacaccctagcagacacgggtgttgctgggatctctgactgagccactttctttctacactgagtgtctcagggctcctttcccttccctgaatgctcagtgtcctcccctggacatcggccatctcccagtgtggtgatcaggtgacttgagggggccgtgggggtgtgcgggctggtggtccccgtgttaagcacctctgggctgctttgctggagagcccgcccgcacgccgcgctgcctcctgctgccgccgtcggctgtcatttcaccagctgtcgggtgtccccctgacgctgtcaccccctgccttcttttatgtccgcttgtcagaatgatggcttgggggtggatccacctctcctcaggagccaagtgtatggactttatgacagtcattttccacacagaaggtattttttccctttattaaccttgagattctggatggtagtgatggttagaagtgtggcttctaggaagtaaatagggccttgatttttctttttataatttctatgaaattacaaattttctaaattataactgtatctttgtgcaagcatgctaagtcactttagtcatgtctgactctttgcctcccaaatggattgtagcccgccaggctcctctgtccatgggattctccaggcaagaatactggagtgggttgccatgcctttctccagggaatcttcctgacccagggattgaacccaggtctcttatgtcttctcctgtgttggcaggtgggtctttatcactagcgccacctgggaagcccaaattgtatctttaggattatataaatgtatgcttttactttaatgctaatatattaatggacttaatgcgtatgtatttattatgtgcctattaagcaccggacatggtggctaaaataatgctgggcaaaaccaggttggttttaccttcctggagctacggcggagaggcaggcagatcagctagtaagtgcataaatgtcaaactgggactc

SEQ ID NO: 31322 - DNA, 624 bp, Bovine  19866880524379
ccttgggttgggaagatctctggaggagggcatggcaacccactccagtattcttgcctggagaatccccatggacagaggagcctggtggctacagcccatggggtcacaaagagtcggacatgactgagcaactaagcacagcaacaccacatgggaagccctataactagattatggatatgcattactgagtgcacatacaaacaactccgtttattgagagttacctgaatctgcttcttgtgcgaatcctttttgcccaattatccacatttgcattccttctgaggcctcatgcttcttggtctggacctgatcttccattgttggcatattttgccttcttgctttcctggctccttttggttcttgggatgttagtaacaatattgaacaccgtcacatggtagttatccatcagtttaaccttatatctcccaagaacctttcctgagatacagccccactgagctggagcttaaagtcagtttgtacaaaccactgtgactggcttcttgctaaggtaggggaaccttgacagctgtgacagaatgcttctgtggataaaatgcagtgagggaaatggctgaaaccatcattttaaatagaatcaatgtttgt

SEQ ID NO: 31323 - DNA, 1706 bp, Bovine  19866880574876
tgttgtagaggtggagcaaatctggtttagttactcttccagaatcatgttctaactctggctattagatgtttagcactccattcaagtataagggtcacacctgcatgatggaaaatagtgttaaaatacagattaaaaacaaaacaaaacaagaaaacgttgctccctctaattgcattcaaaactgtctatagtgtctcacgtgtgttttattgagagccactgttttctggccagtgatccacaaaataagaagatagaaaggacaagaaggccagttgtcagacgaattcaaatcagctttaaggtagggaaagaatgagaagatgagacacatgagtcagcaacaagtttctgaagtaaaacaggcaaaacttagggctttctgaagtctttcttaacagagataggtgtaatttattattcataactgttctgaataagagcaagataaaaactgaaagcagaaaggtattcatgatcttatttctaacacaacagaagtattattgataatagcaggggtttaattttaagactgcttatttatgatattaataaatttagcatatttgcaattcatattagcacctttcaggatttaggcattggattaactacacaaggtatcattggtcctgttagagaatgtctattgcaagattcattaatttattaagcatgctttgagtaattattaagaattatgtttctatactttaaagacaaatgtgcctaagataaggtatttgtccatcattgaagataaatagggagatattttaccattaaagtatgtatgtgtgcatgtgtgatgggagagaattcaactatttctggtagttgataaacaaaatttactaaactacttttcagttgcagacactatgctatattatttagtcatttaaaccattttgataaggaactatgatttttttcctttgagtatcagatgaagttcaggctttatccatttaataggcaccatattctgcaaagtgaaatgtaaagggattgaaatgcatcttgaacaattagtaaattatttaatttagttatctataaataatacatttattcaacaattattcatgatcacttgccaagagaccagctccattctagaagctgcaaaacaaaacaggctaaataggttttctcgtattctaacgggagaaataagataacaaataagcaaataaatggatattatgccaggtggtgataagtgtgctgatggaaaatgaagcacgcctgggcactttctaagggaattagaaaaataaagcagagtgagcctccacccactttctgtattttcaagcctatgaaggtatccagaggaaagtgtcactggctttctagcaacattcctgcgcagatgggctgaccagcattactctcctcctgcctctagagggcagttcacatcagtgtgacagctgcttctctgaaaatgagtcttcttagggataaagttatatttatacataataagttccagatatgtgctgtacatcatagttcctatagttaacataagatgttgcgcacttagcatgagatttgctctctgctagcaaattgctctctacacacactaattgctaattgctctacacacacacacacacacacacacacacacacacacacacacacacaaagaaaataaaaactgacagaggtacacaggaaaa

SEQ ID NO: 31324 - DNA, 1174 bp, Bovine  19866880619584
tatgttgaggcattgctttttgaaacttggtattgagctaatacagctttcacttaccaggggggaagtcttttaataatagaaaagtgggagagctccaagcactctgctccctgcttctctgacccatttggtactgggagttagagaggcttggttttctaatcagttttatctcaataatcctgacttcagaagcagcagtaacagaactaactgggcagaaaaaaattcccttgagaaccatttcaatttgtaaacccttggtaagtagtttagcacaaggatcttcaaccctggaggaatcatatcaaggtttaataaacctaagccacaaaagagacttttagatctgcaagattttatttgaaggcaaaagtgaagacagtaggggggaaagtagacttctggtttcaacatagaacaaaagccattgatggttttatttttaaacttaatcacagcttaaaagaatgataattcaccttaagttttagatttattttttccactttgtgcctgaagacctgagctccttactgtcttaatcatatgcctccgagtaggtggatttgcacaatggaagaataattccctttttccaggacaggaaaaaaagttagatgtggaaatgtgagtttctttgactctattacccaatacctgtacttctcctgattgaaagagccatattttacatttgtaatgtgcaaaacacaaaggtttcacatcaaagtttctggtggtttaaaatatttcttgagtctgatcacgagggttttctcccactttgaaatttccaccatttacaatctagctccaaatattacaaatctggagtggctgcttttatactcaggttttagatatgtccttttctccttgtatatgcattacgcattacaagtgattcagaatgttggtgaagttcccttcctaaaatgattccctgggagtaaggtataaatgaagggagagtggaggatgggtgagagggtgagctcggtgatggataattccaaggaaaaagattggagttttaaaaaataaattgcaacttacttgcattttttaagattaattctgtactgttaaacttcttgaccataggcattttatccaagcctgggctgtatcattgtcttactgccagcaagtctgtcagctaggatcc

SEQ ID NO: 31325 - DNA, 819 bp, Bovine  19866880628933
tgcatctcgagttgtttgaatctctgcctctctgcactctactttctctttccctggctgcagggggagaaatgaatagaatgcttctaattctgatattgaatggtgtcctttacctaaagggcatccaagcagacaaaattaaatcagatgctcaatgggggaaactttccactaagcaggaatttaaaatagggaaatgtattaacatgttgaaaaatgggtaaattaagccgatctgtggatcagaggtgtgacttttcagcaacaagccacagaggtatttttatgtgcagttgcctgcacattgagaggtgacacatgccttctttacccttggaaatatccgtgtaatacatacctgggggactcatataaattggctggtttaaaacagtaggatgagaatccagattctgtttctttttagactagagttgatgtaatggaattacctatcagcattttccatctgagaattcttgcaaaggatgatgattcttgccttaatgagcggaggaaaagctctgttatttttggtccccagaatggttaaatgaaattgtttcattctccaagctttcttttatggtaaaaattatgctatgttttgaggaaaatgggcagtgtttttaggcttttttgtttgtttcgtttttctcttttagtaaacagaggagatggagacaaaggccagcatgtctccagagacctgaggccatgctctcacgttactcttcagtcttttctcctgagcaggtacatagcagagccaaggtcaaagcaacctactctactcatggggaggggcttttaaaa

SEQ ID NO: 31326 - DNA, 1445 bp, Bovine  19866880654478
aaaatccagccctttccatgcatcaagcactgtttcagacactcaacaggtatgttaaatcttttcattctcacagcagctatatgaacaagctattaaatctctccatttcgcaggaaaagatactgggcttactatcagagatgttaagtaactggcccaaggtgacccagttaatggtaagacttagatttgaacctagatctctctggctccaccaggaattccagctatgactactcactcagttttaagcacttcacctgacagatttcattgaattcgatcccatttccctttgacatttttaaaataattttatttatttattcttcgttgctgtccaggctttccctagttgcggcaagcaggcttctcattgcggcggcttctcttcttgcggagcgcgggctctagggctctcgggcttcagtagctgtggctcacaggctccagagcacaggtttaacagttgtggtgtacagacttagctgctatgaggcatgtgagatcttcccggaccagggatcaaacctgtgcctcctgcactggcaggcagattctctaccactgagccaccagagaagaccctccttttgacatctgacattggaccttccttatgaccaggggcatagcaactaagagccaagagtttggcagacccagtggagaaaggctgacgctaaattcatttcctataaataaaagacgccaagaagaagatctgtatgagctactctactagggacttctttaaaaataagtgttttactatgaaaagagaagtttagactcttgagcatcctgcaaatagaaaactaatttgccttatcaatttttgtccactgtgcttgatccttgggataatctgtgaggcactgtatcagtctcacttatattgtagtcttttatcatatggatgcaagatatatttcttgctgtcaaaactaatcatcaaagcatacaagaaaaccaaagcaaccttatttacttcctcagagatcagagcaaatgtcctactggtatttttttttaatactaagttgaatttttttggctgcacatcaaagcacttaaattaagaacaatatatcttcatttcaaatgtcggttgatatcccttaaatgtttgctttaaaaaaatgaattcaagtttaaagctggcaataattggcactgtattattaacaatttaaatcaaagtttaatgcttttgacatcacaaagacatggatcccacgttataataacctttggcaaatgaatagtaaactaaacataagcttccaagatagttaatcctgaaaggtacgacacagacgagagtagttaaatatagcaattattgatatatgctctcattccaatacaggggagggatagaggttgtttaattttaataatgtccccagaggttgactttgctcataacatttataaaa

SEQ ID NO: 31327 - DNA, 1224 bp, Bovine  19866880669541
caggcaaattctttactgactgaattacctagactcctctatattcatatgtgttatacatatatgtatatcaactttggattcttttcccatgtaagtcattaaagaatattgagtcaagttctctgtgttatacagtaggttcttattagctatttattttatatatagtcaaagaggtacatcgtaaaccaaggtgacaattttgtgaattgctaattgcagggcaccatcaacaagatagtggagttgttaagacttttggtcttgaagttctgtctcatttccatcatctgtaaaatgggaaaataacatctaaatcattgacttttgtgtaaaggattattagtattagcatggcacgaagccagtgtgttcaagtgaatctgtacgaaactatagtagtctgtgttagccccagaggaagggattttttttttttaattttaagtcatcttggagctaagttactcacagaatgacgaacagctaatggctttgttccctgctgtgtgaccaccctcccgcacacttcaaacccacatgagcaggaaacaggccgatcatgagctaaggaagattccctgtgtttcctttcaaaatcctttgattcttgtcccctttcttataggaatgaccttaagaggaaaccaaatctctgcccatgcaaatgactctggaaaagcagttccacaaccagcttgctggtgtggagggagccctggagagatcagggtgctactcagggatggacacaaactgttgctccatgggcgtctgccagctgaccctcgggaagaccactgacctacccaaaagcctccccattgtatccctggaccagagaatcctccctgacattttccccctcatctttaaaagtgagtatgtgaaagtgaatgtacagtccattaaaagtacagttcctacacttggtttcactttaaagcaggacagtagctctgcattctgaagtatcagcccccataggctcattgatggggtcacaaccttaactcagtagttaaagagggctcagggaccctctagccttatttaatttagtttagaaattcctttattacagttctcgaattcactggcctttggacgttacctgagttattcctgtgattggaagtctcctatttgggaatcagcttgtgtggtcatattccctcttctccatcaaaaaaaaaatttattgcatacttccaaactata

SEQ ID NO: 31328 - DNA, 635 bp, Bovine  19866880701512
taaatgatgaattttaataatatgtttttaaaagtcaggagggaaagctagaaaagtactcaaggaaaaagaaaaaaaggaagttaaaaaggagattcataaaaattggaaataccgataagggaattaccagttattggataatatcttcaaaatgttaagctacagaatgcaaaatattacacattttaggaagaaagacatattgctcaaaactgtttcccacctgtaaaaggatccgctgcaggaagggtgttagaagatcctgatgaagagcctggaacgtaccgaccgccacctgtgcatgtaaacaaaggaaaatctgaagcacgtcaaaattctgactttcataaatagcacactgcttacatcagaagactccaagtgtggagaaaaaagaacaaggcaacaaaagacagaataagaggagttatcttaagaggggttatcatcagaagtcttacagttggtcagtaaaaaactaaaatttcagcgattctctaagttttgtttttgttaactttaatactttttattatatcttagtttctgcacttaaatagtaaaatgactaggaattcaaatataaaaagataaattgcagttggtctctgacctaaataatacaccacaca

SEQ ID NO: 31329 - DNA, 872 bp, Bovine  19866880863503
catgtagtcagctgtcttttttttttttcctttaagggaaaaaaaaaaggctaggcataagcattttagttattattttatttgggatcaaaagttgttgggttttcttccccattgaaaaaataagataaagtgatttggcctttccaatcttataccaaccttgaggtcctgagttcaacctctctccaaaaagaaaaatgtcagggctgaaatgcacccaatttcacctaattttctgtgcctctatcttcaagaagatggactgagatggctcaccacacagaatggccacaacttacttgagaaaataaaaactgcaagcctgcgggttaagaaactgtaccattctggggcaggttctaggccctctgcacaattctcattttacagcttacccagaccagttgtgtaattacacagagcactctttctattggcaagatccattgatccttaagtgtacattttctggcatcccataaataaggacagtgtgtaagcagtgttttctgctcctggaacagtaaaggactaattagttgcatttgcagattaatgactttcaactagaaagggtgaatgcaaaaggataagccacagccacagtgacggaaggcaaatacaagtatttataagggcaggaggagggggtgggggccaggaagggccatcgattgcttctggcctctgtaccgtggacacattccaatgagggcgggtattccagcagcctaagaggtttccgcaaaggcaaggcatgaaaggcatcaggtacaaggatggccgtgaggggaggcacagaaaagaattctctgcagaaagagtcacagggagcaaggaacctctccctcctctcaccccagccagcc

SEQ ID NO: 31330 - DNA, 1577 bp, Bovine  19866880895652
gtggggtatgtgtgcacacagagctgagtcactttgttgtacagcagaaactagccccaccattgttaagcagctatacttcaagaaatacatcaatcctgaatattcactggaaggactgatgcagaagttgaagctccaatattttggccacctagtacaaggagctgactcactgggaaagaccctgatgctgaagaaagattgaaggcaaaaggagaagcgggtagcagaggatgagatggttagatggcatcactgattcaatggacatgaatttgcaccaactccagaagatagtgaaggacaggcgcgcctggcatgctgcagcccatggggtcaaagagttggacacaacttagcaactaaacgacaacaacaacgcttcagtaaaaaaagaaaaaagatgtagtacatataatcgagaaatgataaagtgtcagtatcgtagaattgtatgtagagtgtggttgctgattcctaaagcccagaaaatattggaggggagggagggagcactaaggaattacggagaaagcacgtccagtaggagaaatgacagctcacaatgaaagaagtgaaagagctctggttatgtggtccttggagaccgtttagtgcagggcaaatagtctcactcaggaggttttgtttgcccttagtatcacactatggtgtgaaagctgatgtttctaatgatgaatctgagtctgtaagaagtgaagttcatgtggtggtggtcgcaaatttttgttgtaaaaatgtgtaaaaagcagaattttgtgtgtaaaaagaatacatgtttatgtattgggcagcttcatatgtatcaggcagccaggctcccctgtccttcactgtcttctggagtttgcttaaattattgtccattgaataggtgatgctatcttttcttgatttactggataaatgaggcattgtctttaggcaactatttgaaaacaccctattatgttatctcatatctgctttgagctctagtttctgtcaaactctctaagtttgtcagaatatatataatttctgttcactgaaacaacagaataaagaaaatggacttgtatattccttggtggatggccccataatgtcatttgaagcttgagacatggtttcactgaaaactgaaattagccccaaactagtggcctgtgtttttttctttaaaggtatcaactcagtgaggaatgtaactagggataacaggcttttatgcttggccagggtaggcggtgcatatatttaatatacagtgcttgatattactctcttgacagattctctaaacatcatgcttttccatggcaacgtgtgcccccgtgtgtctggtatttgatataagtaagatttttaaaaagtgtttgattgtagttaaatgatgagaactctgtggtatggtcaaagtgaaataccgtatacttcgtatgtaacaagtatgaatattataatctatctgaaatatatcaagtcaagaaatccagctttttaatagctatgagtttgctttctctagcttcctggcaattcagtgcatgttgcaatgtacactttgaggg

SEQ ID NO: 31331 - DNA, 1626 bp, Bovine  19866880905228
tttattatttaccatgtaatcaaattccaattattatttgaaattcatttttgaagtcacccaatattaaattaattttttaaagtcccactcatatctgatcctaggggttcatgctactggtcttagcctctagcttcagtggatataaaaaaaaagtgaggaaaaaaatattttttaatgatgaatcaagacagaacaacctcaacctgcaaataacacttatagagatataatttcccttcgtttattttgttattcccaggtatcttcatatttccccaaattcttaaaacaaatccattcattaaatttgctttaaagaacactcaaacttttatggaatgaaagtgaaggggggtggtggttaatactgagcagttgtagtaaaaagagagtgttatgaaatcaagctgtctatttttatgggctgttgaattttatggacttataatatgcatccaaggaattatgaaatgaaagaaaattgtttgaataacactttagactgactctcactacttcactgtgctaagcagaatgtgggctccttggcagtgtggtgtagagatagggctggtcaacagaaaagaggtcagaccatcaagggactgggggctttgaaagcaccactaagtcccggtttgctaaagacagttcaggttgttacttgtcgtcatggaataaccttaacactgctgtctttcacttttcaaagtgccctgatttagaaataaattatatgattttacacagagaacacaaaatccagctccattaatttatgggagaggagtttctgagtggctgactgtactcagcaataacaaacacatctcttgtcctctggatggagtccaaactctttagggcacaatacagaatcctgcaggattgagccctggttcccgctgagtctctcttcctctctctctctgcttccccatatttctctttcacttttgcacttgttcacctctcattattttatgtcgtatatttgtggggacacaccaaagtagtattagtattgttttctcaatattttcagctactctctttcttttagataccgaagaagattgaacctaccagcttctaggtgataccagttgatcacactgagtagcaagcgtgtaggcgttttcttcttgagccatgtagcagaagctgaaaataattccattttggaagtcatccatttttatatgctctagtttctgtaggtctatcggattgtcttattcccatttttctttaatttcacttgtttttgtggcttgcttttcaaaggtgaggcataaacgaatattgaaatgccaggcatagtgctggacgctggagatccaagagtcaataaaacagggaccctgccctgggagacttcatcatcagcggggagagttgcaccagtcccaagcaaggaaagaggtgtgatatttatggggacctcttggagactccagcactgggtgcacggaccagaatggtgaacactaaaaatcaaaggcttgaaataaggggaatcaaaatataccctggaaagacttttggtaagccaggctgttgtgaccttgaaagtttgcggaggcttctattaggccagggggagtgttatagttgggt

SEQ ID NO: 31332 - DNA, 1234 bp, Bovine  19866880908934
ggccatcctgggagatgagacataacctcccagacacatcctgctctctagggcaatccaccaagaagagtcataggttctggcccaaagatgctggggaaaagatacccagaaacaagaaaaggtacccttccctggaagagggaagggatgagagaaaaagtcaaaaatagttagcttttctctcaatttttctaaagcaatttttctctgtcatcaatgttatgaacaccaaacaggaaggttgagatatatacattgcctcttataagtagtgtcgtatcaatctgacctagataggtaaactaagcgggaaacaagcgttagtgtgttctgatcaaaaaaataatcgtattgtacacttggttaatttaacacgtgcacacaggttgcttaatatgaatgaaagaattgccactatttagttatgcttgtgagacagcaaaaatttacaagtataatagcaattccttatattaatatcctatacacacacttttaagaccacccatatggtttttgtaaatctttttgccaatgttattttgctttgattccatttattaaaatgtaatttcatgcctgttgaaactaaaagtaataaaatcgagtgtggattctctatgttgttttaatttcatttttccagttactcatttttatgttgcttgatgatattgtcaacccacgacagcctggaaaatgttaacaaacttggtcgagcaccacagctagtttgagcaccactgcttgaccccaggctacagaactgagaggaaaaggggaggaagagacacacccacgtttataataacgataccatgatcaaaacagctctgtctgaaacatggtaacacactgagacaggatatgaagtcagcttcataaattatgaaccctaaatccagattgcatttgttctgcaatgatttgaacaagtttttcctgaagattgaaactaaaagcaaagataccaaagtagggggtgccatcttgtggcaagagccaccaacaccaggccccagctgtgccatcgtcctcctcacccccaaagcacgccttcgctcccctcggagcctgagagtctttttcagaaccccaacacttctcctttgaaacacaggactccagaataagaacaaagcccctgcctgcccccatttttcttcccagcagagctgtgtgtggtgagctaggtttttgagtcagcttctttagtcataggacataagga

SEQ ID NO: 31333 - DNA, 1801 bp, Bovine  19866880999436
ttgaaaggctcttttattatttgggtattttttaaaataagctttttttcccaacccaaatgaatgaaatatacatttaaaattatgaacttctttaatacttctcaatactcattggtgtgcattggttcatagatgatctgtgacaatgaaaattcttttcattgcagtgcttaatgtaacgaagccaactattgaactagttttaacgaatttggggaagcattttagtttctctgtcaagagttattatttcctttagggaattgaaaattatatctgagatagtaatttcctcataaagagatttggagggattatttttcccatagagccaatattccaattaattcatccaaagaaggaggtttctcatgttgagccaaactcaaagcaccagagtatgatgtcatgaattttaaaaaggcagccactctgccagatacttgaggtgccagtgcacacactcggtgattcataattgggctggttgactacatgatttgtcaaatagtcattctgctaggtaaactacttccaatggtgaaaccttattattttttcttttcttaaaaaatttttatgacaacattgaatgaaattctcattctttaaaacgttcagcctttttgaaaaggcttctaaatattctttgcctcaaaggagtggcttccctggtggcgcagtcagtaaagaatatgcttgcaatccaagagactgcctgcaatgcaggagatccgggtttgatctctgggtcaggaagaacccctggagaagaaaatggctacccactccagtattcttgcctggagaatcccacggaaagaggagctgtgggctatagtccatggggttgcaaagagtcagacacaacttagtgactaaaccacaaatcaccacaaaggaataaagagaaatataagacaaaaggaaagatagatattattgatgactcacctgattcatgtacttataaacatttccactaacatagatctgatatttggttgtgtgtagttctcatcaattcaggcaaactgattactggtctgagtgtggctctgtggtatagaaccctctgtatggagacctatgaagtttcagggcatctcatgtccctgggagaaatggagcaagtatctatgcatctaagtcacagggacagaaattaacaaaaacatgaaggcaatgatattcccacttgatatgttgagtattttcccactttgttttccagatagaaatatgagctatgaagctatctggctcaaaatttggtgtcaagggatactaagtgacatagtattagtcactcagttgtatccagccctttgtgaccctatgggctgtagcccaccagtctcctctgtccatgggattctccaggcaagaatactggagtgagttaccattcccttctccaggggaatcttcccaacccaggcatcaaacccaggtctcctgcattgcaggaagattcttttctatctgagcctttggggaagcccagtgccttgatgaaaagtctgttatactacttaagcaatattaaacaggaagaagtaaaataatttatttttaaaacaagaatgaacagtttaataagaagtttgtgagacatgttttcaagaggctttcatgtaacaatacaaaagcaggaatatgtttattcaaaaatactcagaaatacttcatagaacattcagagcaacaaatgaatgtaaagttagagaaacacgcagagaggtaccctgagcagcactgcctggaattttacaaagtttatgaaaagcatagggga

SEQ ID NO: 31334 - DNA, 1335 bp, Bovine  19866881092615
atttttattttatttttagaataaaatttatcttacttgtggctcagctggtaaagaatccacctgcaatgtgggagatctgggttcaatctctgggttggaaagatcccctggagaagggaaaggctacccactccagtattctggtttgtagagttccatggtccacgggaacgcaaagagtcaacacagctgagtgactttcaattcactttacttacttttttaaaaacatatctagggctctcctccgaagatttcttcttaaactaggctgctatcacacgaaaggtgatacagttagagaaggtatcatttctttgaagagttaacagaagtttactttggattcctttcaataccattaaaagagttgcctttactttgttaactactgacatggatgctgagatttattatcatctgaatcagtggggcagaatgatttattcttggcactgaaatttaggtcctcaaggatgaaaacgtcaccaaagaatgcaaatgatcaaattaagcactctattttttctatttctaaggatgacttggactatataattcaggcggtttgctttgctaaagtaagatcaatgtctcctgcctggtttttgactcatacttgtttgcctggagttacagggaggacttttataagtgttcctcgtgatactaggctcttaaattgatatattctgatttttaaaactggtaggatttttgtaccgagtaaaacaccaaacttcacacgtcaaaggagaaaatggatttctgatctgcagaaagcatagtgtgcatccatatcttctctagcacccagtcatgcctatttgacacaatttacacctaaattggttatattttaggaattttttgcaatagttatatctaaaaattacatttgctgcacaggcatttaatatactactagatgattattgatttttttcaaggtctttcaaaaccttgatgtttttgagaggaactgtcaccctcagcatctctttccctagactgagaatatatgattttatcatgtgcaatgggcttaggcatcaagcgaaccctttagaccgatcacatattctcaagattctttgaggttaattaaaaatggacactgtaacattatgcaaagacatctaagcttcctctcctggaatggagaaataacatcgaattttcccagctttatcaagtgctttacagaaatcataaaaggagaacaattgtttccaaagaaaataatcctttgaaacttttacttctctaaaaatccttatcttttgctgctttcagggtatcacttcatttataacatatgcacacacacac

SEQ ID NO: 31335 - DNA, 853 bp, Bovine  19866881131803
atttccctccactctctagtttttggaagttctgttatatcttgatttgctccataatggcattaagggaaaagtattagtaacttgcacatttcaacaaatagctgctgatagcttactttatgtctagagcattgctagatgagtaagctatactaagttcctgacctcatagaacttacagactagttatgtggatagacaaagaataagtatcagacaatgatatcagatgattgggaattatgataagtagtatgtaaggaacaaagatgattttgttcccctgctgcaagtgggaatgtgaagagtgactgctcactccaaactgaaaaattttgtttggctttgagcctccgatacatttccccttcttggaagacttcagcagaagaaaaatgtttgcaaaccagtgccctatggaattataaataaatgtgagaagctgagtgagttgggcggagccaagtttcctcatctataaaccacagataacgttatctgtcctaggggttgctgtgagggttaacaactataaatggaaaagaggcagaagagttactggctgaagactggagacagccagctaggtttctagttcctccgcttaccagctgctgctgtgtcaggtaagttatttagcctctctgtctcagcttcttcatgtagagggtggcgatggcgatagtgcctgcctcctaggaatgattggagtattaaataagaaaaaaaatatatatatggcttttaaactggtgcatggtaagtgataaaccaagtctagcttctgtccttgtcataatgtcatcatcaccaccatcgtcatcttcttgggtcctaacgtaagcaacag

SEQ ID NO: 31336 - DNA, 864 bp, Bovine  19866881149349
tgcaaggcttatcccaaagtacaaccatctctcatctgaatttcttttctcctcacattcacttacaacccagatataatgaaatgccaggctttgtcactgaagctttatttttaatggctgcaaatggaaacaatttaaatatctatcatagacaaatataagaacaaattgtgatatattcagacaatggagtactacttaacaatgcaaaggacagagtatctacacacatgatgaataattcttaaaataataatgctgagcaaaagaggctacataagtcagaaaatatactgtgtgacctcatttacacaaaactctaaacaatgcaagcttgtgacagagaccagatcggtggacaccagggaaggaggcatgtggggagggtcaggagggaaagattacaaaggtgtacaatacaagaagaccttggggagggttatgtatatgggttttaggtgtggtgatgttttcattaatgtatacatatgtcaaaacttatcaaatgatatactttaaatatgtgcagtttattgaatgtcagctatttctcactaaaagttactcttgtgttaagacaaacacaggctcctatttaattatttgtttaaatagactaagtgacatgatgagagtgaccaaggctttttcattcaatatctctgccagtgactggcccaaggtggattttcagaagatacaggatagatgactatagaaggagttaagatatactgcagttgaatgatgtactattttggccttgctttggttcacacattaaaatgctgatcaggctgtagtgttagccgttaaccacattatttcccttgttgtaaagccaactatagtataaatgtc

SEQ ID NO: 31337 - DNA, 1117 bp, Bovine  19866881188347
ccttgactttgcctttttagttctgatatcaaaagtcacactgatgctaacatatttcatggctaattcttttcaatgagggttttgttagtggctcagagggcaaagaatctgcctacagtgcaggagaccgaggtttgatccgtgggttgggaagatctcctgaagaagggagtggctacccactgcagtattcttgcctggagaattccatggacagaagagcctggtgggctataatccatgggtttgcaaagagtcagacacaactgagcgattaacactttcacttttcaacaaatataacgcacaaacacaatagcagtcaaagatttaaagaccacaagttagaaatcactgatccaaagctaagtcatactacctggccaggtaagcaaaagactggttagctccagataggagtccttaggtgaatttcattgtttctgcatagaggtgtgtgtgtataaatgtgtgtgtatgtacgtgttggtgtgtatgtgtatttagtggattcattgctaacttaaaaagtgtgtaatttcatataaagggctttcctcatagttcagttggtaaagaatccacctgcaatacaggagaccccagtttgattcctgggtcgggaagatcccctggagaaggggtaggctacccactctggtattcttgggcttcccttgtagctcagttggtaaagaatccacctgcaatgtgggaaacctgggtttgatccctggatttggaagatcccctggagaagggaaaggctacccactctagtatttcatataaaactgatctctgcatccaaatgctttaaaaactgagaagacttgtcgattgaattgtagggtttcacaaacactgggggtgtgctttccattcccagggttggctgcttcattcttttatatgtcctgcctggttctggtaggcttttcagtttgccacccccaactagaaaagagaagccctggcctcttgcctcgctttgaagatcctttgctatgcggtcttctctccagccgctagcccattagttatgatcaaagctctttaacagcaatgggcccttgaaggcagtgcaggttcagattcgacagcaattatcaaa

SEQ ID NO: 31338 - DNA, 760 bp, Bovine  19866881192267
attaaataaattaaaaaaccccttgcaggaacaccaaaggagtacaaaaatgtaaagatgcattccattttcagtgttcatgacatgagttattaattccatgggtcatgaagcaaaactttttaaaaagttaacttgcatttacccttttgacagcagtttgcatcacagtgattgaattttattaagagaattgtttgctagagctatctgtcttcattttggccactctggcataaatatttaatttatgttccaaattaaaaaaatgtctcataaaaactgagtggccgtgcggtaactgttcactataaaaaaaaaaaatgaggcttacatattgctgcacatgatgtaaagtacatctacgtgaaagaaggctttatttgacttgaggatattccctatttctagtgtctgtggaaaagaagagctggaaagcgatttccccagacaaaccttgctttaaaattctacctcttgtcatgtacttctgattcctacttaacacagatactctcctgaaaataattaagtagaaaatttatatgcgggaggatggtaatgattattgttgttgtttagttgctactttgtgtctgactctttgtgacccagtggacgctagcccaacagactcctctgtccatgagatttctcaggcaagaatactggagtgggttgccatttttttcaccagggggctctttctgacccagagatgaacccagggctcctacacggcaaaggattctttaccact

SEQ ID NO: 31339 - DNA, 895 bp, Bovine  19866881206349
gaattccttctgcctgactgtcttcaaggtgagatatcacttctttcccattttggacttggagtgaagcattggctcttcttagatcttaagcctgctgacttttggactagtgctgtatctttattattgtttagtggctaagtcatgtctgactctttgcagcccaatgaactgcagcatgccaggcttcctgatccttcactatctccttgagtttgctcaaactcagtggccaaagtactggagcttcagcttcagcatcagtcctttcagtgaatattcagagttgatttcctttaggattgactattttaatctccttgttgtccaaaggactctcaagagctgtatctttggctttcctatttctcaggccactggactaggaccacaatgacatcatcagttctcataggtctccagaatgccttgccaactgcagatcttgggacttgtcagcctccataatcacatgaacctaacccttataataaacaaacaaacaagtaaataatacattttcctttgttagtcagcattctccagagaagcagaaccaatagaatgtgtgtgtacacgtgatgattaaacttgggttctataacatttctatccagccaacagtgctacaagaggggcaaaacaactaggtttgcccagataacaaagagttaattgagccgcttcagataaacatatggaaaaaaattatgcttggggtgtttcccaaaatagcaatgctcacgtttaaaattctaaataaaaatgtaattactgagtaattcctcttgattagcacctctgttctcatgatgagctaggattctataataatgttagaagaatgacacttagtcgaaagttcaagtgatatgccactgtattagcagta

SEQ ID NO: 31340 - DNA, 1903 bp, Bovine  19866881233537
ggatataaaaggaatcatgacacataatagataaggaagctctggtagtagggtctggtgtaggtgggaaatctaagctatatgaaacatattcagatttgaatttatacaactaatcttagacaaatagatgaattgattaataaagttttcactccatgtcctgatttgtaataaaaatgtaataaattagctggaattttgggtaccatttgaagtgtaacatagatgaagaagctctttgctcaaagccacaaagaataaaagaaatcattgtttaatatcacaagtgtgatgcatcagtcattaactgcaagtttttgtagacacacttctcatttttcaattcagattaaatgagaagattttaaaaacatattttgataacttagttttgctgttcacagaatagcagctgccctggtgtcttccttttgctgaatagcagatcattggtcataaacaatctaaggaactgagaaagaaaacactagctgtctttcctttctaaatatgtatgaacttatcaattccaaacagcttcaatatctgtgtaaactaatttctggtttcttttcttgaaatgagtgatccttgtatggaaagaaaggatgcagacgtcaacgtgttttctcaaagagctgtgtcataagaggtagggcttagtgggaaagaaaggtaaaccagtccacagagagagaaagagagcctacacagacagagaaaacagagttatggttaccaaaggggacaaagggcttcccaggtggcgacagtggtaaagaacctgcctgccaatgcaggagatgcaagagacttgggtttgatccctggattgggaagatcccctggaggaggaaaaatgaaaacccactccagtattcttgcctgaaaaattctatggacaaaaggagcctagtgggttacagtccatggggtcgcagagtcagacatgactgagcgagtgcatgcacgcacgcacacacacgcacacacacacacatacacacacacacacacacacacacgggacagaagaggggaagagtaaactgggaatttgggattaacagatacacactactatgtataaagtagataaacaacaaggacctactatatagcacagggaactatattcaatatcttgtaataacctataataaaaaagaatctgaaaaaacatgtaattgaatcactttgctgtatacttgaattgttataagtcagctatacttatgagggtgggggttggggagagacttgctgtgtggtcttgggcagtctatttagcatctcagactatccttatttgtaaaattgggcaatgggttgttgttaggataagagaaaatatttagaaagcatgtgccatttgattggtgcttagtaagtgctagctaattttcctcttataattgtaaggagctgagatgcaaattgcaatgccactgaaaggtaaaccaatcaattaaccaaagaggaacgcaaaaatagaagtaaaaccagtgaaacaaaactgtttaacacatcgaagcagtagatgagctttggggaaagagcagttgtatttacctgaagcagcttcagtctattttgtttggtaaagaatggagtgaaatcatgtaaaggacttggaaaaatgtggggggctaataacagtactcaactcacagagttattgtaggcattaaatgagatgatatttgtgatgtaccgtgcatggtacttggcacaaaataattgcttaatgatcagagataaaagtgtctattcaggccaaacatatattttatagatgaaaaaagtcaggctcaggagaattaggtaactctaagtttgcatcaaaaatctcactgtaatacactccataattaacttactatatttattcagtaaacaa

SEQ ID NO: 31341 - DNA, 1971 bp, Bovine  19866881234249
ctctttctgaaggtgcagaaagtaaatctgtcaattaaaaacttagtggaagactggcatgtttataaaagttcttacatgtaataagccaaatgatgtctagctgtgagattaagtttgaatttcacattgctcactttcaaatagcaatttccccccccccgttttggaaagctcaggtttgctgccggccacttcattaataaatgctattcagttttcccttcaatgagaaaggaagacattaaatgtctgtggcatgcatagaaatgaacaaacctccaaattttaatgggaacaatgccatatttctagaatcattcattccttatcttgtggctgcatgcctgctaagtaggcctctgtatttgcttcaaattcatcagtttgagatggctgctgtattccattcttgcagatggaaaataaaaatggatcctttactgagaagagaaacacatatttttagtttcacaccatgccacatcgttgttgaataggtttttatgttcagtgcttcaactcttgtaggtgatcaattcaaaatttactcagaaatcattgcgatgattatgaacccataaaaatcagagagcttgttttgtttttttaaacactaaactttcacattaacactgggctgttgcaggtggcatctttttcacagtatcctcaatttgtctctcaaattgataggcccagtggccccaacttcactagatagcttttccataggttagttaggaatgtaaatgaaatgggcattaggattttttttttcttttcctggagatacttttctaggagagagtgataatttcttatatcatgtacaattagagctgaaacaaagatcttttctttcctcctctttagttgtcacatactcctgtcctctcatttacaaaggtgataaacaaggctcagagacccacacagggtcacctaaccataatgtgtcaaaagcaaggctaggaccagattttctggtcccagttgagggctatatcatcaataaatctgaaatagctggtttaatatagccccacagtagattcaaagagccaacacattggaaaaatggagaagaaaatggcaacccactccagtattcgtgcctggagaatcccatggacgaggagcctggtgggctacagtccatgaggtcgctaagagtcagacacgactgagcgacttcactttcacttttcactttcatgcattggagaagaaaatagcaactcactccagtgttcttgcctggagaatcccagggacagaggagcctggtgggctacagtccacggggtcacacagagtcggacatgactgaagcggcttagtagcattggaaaagactctgatgctaggaaagtttgggggcaagaggagaaggggtgatagaagataagatggttggatggcattactgactcaatggatatgagtttgagcaaactctgggagttaatgaaggatagggaagcctggcgtgcagttcagtggggtggaaaaagagtccaatacaacttagcaactgaacaacaacggcagattaaacaatatttaatacatttgatgtaaaattaagaaaggattcttactataattgtaatatgaactaaagtaaataatggtgataagaagcccaatactgagatggataaggacttggaataaatgaactaacaattccaattaaggacatttagaccaccaggtggctcagtggtaaaaacccacttgctgatgcaggagacatgacactgtcggttcaatccgtgggttgagaagatccccggaggagggcgtggccacccactccagttttcttgcctggagaatcccatggacagaggaacctggtggcctatcatccatggggtcacaaagagttggacatgattgaagcaacttagctcacatagcacacatgcatgtatttataaaagcagcagttattgaaagtat

SEQ ID NO: 31342 - DNA, 1674 bp, Bovine  19866881237200
atgcagggggcacaggttccatccctggttggagaactaagatcctgcatgcctgcagggtgtggccaaaaataaaaaacaataaaaaaaagtgactgtagttatattgaagtggattcacctggcaagaggccccgcccatatgccgtatcgcgttggctctggcttggttaattactcagaacacaaggaaactctggattggttaatacggaaaacacgaggactcttcctcaggtgtcccgtttctgacctgcagagagccctggtggaaagagacgctgcccggtgcccgctcacatgggagtaaggatgctataccacgacaaagaacctttgttcaacttggaattatcgaagctggaaaccaagaaggttttaataaactccatgggagaaaaaaaaaagatacgacctggtgagtaagactgcttaccagttgtagatttctaaagcattctagctaaaggggctgtttctgaaaagtgatgaggcatacattatagaccttcttccccaaaattataaatggaagagtaccaacattaatctgtaaaggagagatttctggagtcaagttcacaggctaagaattctgaataactagcattggctgacagtcagtgaggctgaagccaggatgttctccatttatcctctttcctctagatactattgagtttttgttgtctttgcaaataatattgaagtttgggaacataattttgaatttgttcagatttggccataagatgaattataagattctatatattgtggcttccctggtggctcagtggtaaataacctgcctgccaatgtaggagatgcgggttccatccctgggtcaggaagatctgctggagaagaaaatggcaacctactccggtatacttgcctgggaaatctcatggacagaggagccttgtgggttgcagtccatggggttgcagagagtctgacaggacttagtgactgagcacacacacatatatgatgtttaatgtaaattctcaattctggttgttagctaagacgtccatgtggacttattttgtttggaatagctaaaaggtactataactcagtggctacacttgcattatgcgttgaaggctgttctctgctttggaaatctggcttgctcttcctggaatcaaagcaattgaacaaactgagaagacatccacattaccattacagatacagtataataaaaagcatgctgtgagtttattttaaaattgagtctatgactgcagtcagattgctcgctaaggattttaacacagctgaaatccattctctagagagattcttttgtgtttcccttgattctacatccgcttctttgagtatctggataatatctgtgtacattctgttatgtttatatcttgcattgtataccaaatgtcttcattcattaatctgtgcattaatattgttcctttactagttggttaaatgtttttccatttgtttctttgtatttaaaaacatgtgtttccatttgccccttggtgttgataaaaggttggagttgggaactgaaactgggtggatttagttttgcttgagtagtaataagaatgaagagtttacaatgatttaaaattgtaatatttaaggcattagagtggcagcagtagacaacgttgtggcaaatataaa

SEQ ID NO: 31343 - DNA, 1671 bp, Bovine  19866881252349
ttaccactcatgccacctggaggtaatctaggcaaaaaggatgttgtcttggctcagcattctggcagtagacctgagagactggatagatttggaaaataggaggcaaagttgattgaattgtcttaaattacttgcctgctttgaatatgattggatatttaacagttttaaaaatgacagtagctctggtaagcagtggtactttattatgtatgtgatttgtaacattttgctgctatcctgtttctttttaagaattaagaatgaccacacatacataaaattcttgggtgaatggtctactggaggagtattgtattcttcagaagtctgaaattatagaaaactattcaatattgagtatattttcatttgtgtgtcgtaagatattcttcactttttatcaatttgctgataattacagcctggagagtaatgtcaaagaatactgagcaattaaatagtcttttctatggttttcaataactgatttatgcaaccaaagaatttgaagatgtttaataaagattttattaaatgatgtatgatgttatagacatatttttattgtttaatggttctttatgtcttttaattttaggaggccaaatatcttttgccacctctggaaaaagagttatttttggcagagcacagtgaccttgaagaaggtggattagacctgactgtggcattaaaaccagttagtttctatatatcagacaaaaaagaaatgcttcggcagtgtttctgtatcataggagagaagaagttacagaagatgcttcctgatgtgttaaaggtacttcatgacatagattaccaggttctccactatatagaaatatacaaaaactttctttgtagcagtcattttacttaatggaaattataattgtatgttttcaactaagctacttcaaaaagatacagggattttgcagaaccataatggctttgtgtattgaaaaatttgccagaaagaaatgggacactttactatatttaggtaaggaattttttgaccttctgggaataattctattaaatattggcaatttaagtaactagattagatatacactgattcttttgctttaaggagtatactgctgtgtaacagtatgtaataaagaaagaaagtgaaagttagtcactctcatgtcagactctttgtgaccccatggactgtagcccatcaggctcctctctccatggaattctccaggcaagaatactggagtgggttgccatttccttctccaggggatcttactgatccagagattgaaccctgggtcttccatgttgcaggcagactctttaccaactgagtcatcagggaagaccacagtatgcaatgatagttggtaatagcctgtatttcattaaattcttaaatgtttttggatgtttatttctaaaaattactcagaaacgtatgtggtgttgtaattttactgatatggaaaaaagacttgggcaagttaaacccaacagcatatatatctaagatgaatggagccagggctagaatatttaagcctttagtggtattcgcctaacataaataggagaagactcttgaaagtcccttggactgcaaggagatccatccagtccatcctaaaggaaatcagtcctgaatattcattggaaggactgata

SEQ ID NO: 31344 - DNA, 975 bp, Bovine  19866881281116
tgttttaaacatattattgttcagttaagagaaaacagactgttctacgtatttataagggctttccccagtggctcagcagtaatttgcctgtaatacaggagctgcaggagactcagtgatattctccagatccagggtttgatccatgggtcgagaagattccctggaggagggcatgacaacccattccagtactcttgctggaaaatcccatggaaagaggaacccggtgggttacaatccatagggttgcaaagagttggacacgtctcaggtgacttagcctgcatgcaggcatgcgtttataagtaacagctggggaggtgtgggggaaggttgagggttggcagagacagaaatagcactcacattctaggctttgttggctcacgcggaatttgggaggaaagcacatcctccttgatgacacagcggaggagcttactcctgttcccagctggcctcacgacaggctcttttctttctcacacattcagccccgagagtcaggtgatgactccggccaccctgcttcgggcactgtgccgcccgtgttcctttacaaggcctggctcccagctgtttcacggtggaggcatctgacactctgataaatgaacaggccatcggatattccatccaacagagggcagtggctcactgaaactctcacatatttgctctgaaaatagattttcctgaaactttccacttaaatagctgggattaactttcagtgaggccaacctagtggcaactaagcagagcatgtaaccccagatggttgggcagccacacgtggtcacagttctgccttaattcgctgctgattacttcctttgaaatttgcaaccagattctaaactattcacctttcaacatctggaaatgctgagcgcatttggtcatttattcgtcttgtttaagctgtacacccgggttggggtaagactgtatttgccaaagcagggt

SEQ ID NO: 31345 - DNA, 1699 bp, Bovine  19866881565398
aactttctcaaaaactgccttgactttttgtgaaattatgtttttgtttcatggttgcaatatcttatatctctaaggatgctaatgctgattttttatttttaagttattttctccctaagtggtctgtttcctctaaattggttgtttcccctccctgtttgttttggtcactatattagcccaaatgtctagtaattcttatcctgcgcttagtattagggtgtgtgcgtgttcagttgtgtcgactctgtgaccctatggatcatagtccttcaggctcttctgtccatgggattctccagggaaaagtactggactgcattgtcatttcctcgcccaggggatcttcctgacccagggcctctgcatcacaggtggatttttcacccatgcaccacccataccccaaggctcatctgtgcctgtgttaccgccctctccttccagccaaagacttttctgaagaaaaaacttctgacttttgctgggtacaaggggcagtttgtttgtttgtttgttttttcttgatgctgtatgcattttttccccccactgattcaagaagtacttaatgattatcatgtagaacactgtgctgcaaatttaggaagatgaaaaaaaaaaccaagtctggactctgccattaagagcttcacagaacactacacacaaacattgatactagagagtgctaaggggcacatttaggtagatttagtactttatataatatagactttttaagatgtcttatcttttacatttctttggacttattgataaaatgggttctgaaaccacatttttaaaaaaccacaccaaaatagacaagttaaaattttacatgtgtatacctatggccaattcgtgttgatgtatggcagaaacatcacaatatcatcataaggtaattatcctctaatttaaaataaaattaaaaaaaaagaaaagatttggaggaaaaaaaaaatagctactaccaaataccttcctttgaagattttttgaaatgattccacttctgactctgaagactttcaactagctttcctaattctagttcctccttttttttgtccccatttcctagagatacgtaatggtgctcattcttgagccttttggaggttcattggtaaattgggcctcttactttccctgttcctgtttagaactcattttattcacgtatcctaaggctgttactacatttctgtcagttttccatattcagtgttataattgttccttttttttttttcttattctttctgaccttggggatttaatacctttcttaaaataaacatagatagaaacagaatatgcattatacaaaacaatatgtattgttataatggtgtttggaaaaggaatgaatgagtgtgtgtgcaatatttatctaggactcttccctctttatgtacacttgtgttatctcctttagctgaaccacaaactccttgatttagtttgagtcagaaatataattctttaattcccctcagcagctaatttattgccttccacgtggtgtgtgtatatatatatgtatatctgttgtttgtcttgttatgtaaggcagtgatgccaagtaaatgatatatataacagtttggtaattattctaatccccaggcagttattaatatcctgtgtccctagagcagtcatttatatgtccctgtattagtcc

SEQ ID NO: 31346 - DNA, 1042 bp, Bovine  19866881633789
aaaaaaaaaaaaagaagacgccataggaaccaattgtttaaagaagctttcaattgggacagtttgagaatcaaaaaagaaaacaagatgttagggaatcaactcattctgaaactatcaaaagaggtgggggagggcagaaggcaagcatttacctgtcttttctgggtaagtgtgccacagggtaaacaaacagtagatgtggtaggttcttaactaaacatgctaggtattaaatccagaaataatggcagaattagagtaaattttttttttgaggggtcaacaagctacggcctgtgggccacctgtttttgtacggtgcacaaactaataatagtttttatatttttaagtgggtgagaggaaaataaggcacttcttgacatatgaaaattatatgacattcatatttcagtgtctataaataaaggtttactgaaacacagacatgttcactcatttatttactgtcaatggctgcttctccatgcaacagcagaggtgagcagttatgaaagtgactgcatggcttgcaaatcctaaaatatttactatcttgccctgtacagacaaagtttaccaaaccctattatagtgctatacattgaactatttacaaatgaaatagtatattggaaatttcctttaaaataatgttctggaaggggcagaagatgaaaccaaataggccatatgttgataatccttaaagctatgcaaatacatgggtggaagagagcattatagtatttctcttaaaatacgttgtctctacttttatacacatttgaggatgtcctttaaaaaaagttctaaaaaaatctgtatcactctgtattgcagatttcccatacctacacacaaagcattttgcaaactccttaaaggaattcagtttagaatgcttatgggccatactatttgtttacagatatcccaaactattccagacacaacaacaacaaaaagtacacatactgtattgattaactgtatcattttataaccaagagctgttaagcaatcacaagtccaggaa

SEQ ID NO: 31347 - DNA, 1157 bp, Bovine  19866881713478
atttccattcaatctgtttagaaaagagatggagtcagcaggtaattatgtccagaaatatataaatgttttagtatgactggaaatataaatctgcactatactccctgatttcttccaaccaccccaaccattctcattattcaaaagcactcaccaaatcctacttcatgaaggaaactatctagtgccaaagactattacatattcccagcatactcccccaaacttgaatgataagcaattgtgttcccccggatgtgcatatgaagcctagcaaagaagaacataaaataacaggaagaacaggaagaaaacaaacccaaagctaaaattatcagtggaactgattagcatatgtataagagacacttgtacagatgtgagatgctttctttagaatgtaagttctcagagctgtgattcttaatcaattttggagttgtgacatcttatcatcatttatttgccttttatgatcatcactaacctcctcccaaagtgtatttttaaatgagagcaaataatttttattctcaagcatttgcttttatttttactctccttgagaatcaccctagaggctcacgctggcccatacggttagcagtgggtaagaatttcatgggttctgccctttgcctttttcctttttttattgtggtactataaaatagccactgccacagcaatgagtgtggacagaaggaagaaagctgaaatgcgagctatttctacaagaaatcttcaaagtccagacaggatcaaaatctggatgggacattttgaaatagacccaaaagcggagaggatgaacactgacatgccttctccacatacacttctataccattctatttaggcaaatgttgtgaatcctgaaaatcagtctccatgaaggttacttcagtgattcacttcattgcagactcgatcatgctaaactgttttcatggaccttactgattatttgagacaacagaggataagatggttggatggcatcaccaattcaatggacatgagtttgagcaagctctgggagttggtgatggacagggaagcctggcgtgctgcagcccatggggtcacaaagactcagacatgactgagagacgaatgactaatgattatttgaggaatgggcccaatacata

SEQ ID NO: 31348 - DNA, 1605 bp, Bovine  19866880454318
aaaaaattacagtcgcttggatctcccaatcacctgaacttcaatagagggttgatttcacagacagttatgaaaattgttcagttggagaagaaaacctctttgtttaccctgcatttgtaccttataaaaatcaaacttgattagatggttcagtaacactggctggatgaaagaaattgatttataggtgtgcattttggagaatatttgtaacattgataaataaaaaggagatgttttcctagactttgtattgttctaactcacatgaaataagtggtttaatttaattctctttccccctgcttttggtgagattttatagtcccatcagctgtggttcttttgaggacagtgatcccatgactgatgatgacttactgtctatgccgtgcgtctcacaagttcaacacacacccctatgtctcaacaccacatataagaacaattgtcttggagggattcattggtagtttttcaaaggtatttgaagagaaagccaaattcttgttgctcccttcccctaccatttccagaagtgtcatcacacaggttgactcttacctctggttgccccagaccaggataaaaggtctggcttgactcatggagactggctttggctacacggcgaaagagccaagctctaatcctgatgatttcataagagccttctgtgtggtctcatggaaggaatactcagccaggagtcgggaaatcggagatctgctcctggttcagttttgagggcaagtagctgggccagctttgctggactctagtggggcttgtgggcctcctgccttcccatttcagtgctccttaaaaaagcaaagcctttgaattcacacatcacttggcttcaatctctatcactcatgaaatgcaatcattagatttacctctctgtatctcactcttctcatttataaagtggagaagctaactacatcatgcgacttaagtgaaaaccaaatgaattaatatacataggattgtaccatatagatagagcattatgcttggcatacaacaatctcaataagtgaactccactgcttttcctcttagagctgatctcaccatcttgtttcctaacaaacccacttttgattaattttcagagaagaaaagatcatatgagcttctatattatcgactaatatggaaagaagtaactgttccttctcaaatatattggcattttaacaagaaaacattagaaattatagctataggatcatattgaagcagcaaggagaagccaatagggactgtgtctgaagatataggagaaattacctagaaattctttgcattagagcatttttgattcagtcgtttgagttaaaccttctaaacattaagtggtcaatattttgaaataggtaggacatcaagatcattatcagatacacctcagtgtggcatagcttttcagatcccttttcagaagggaaattttaatctatgtgtgttgagtaagtaggatgcagttcatacaacctagatatttgataggttagggacaacaggaagatggaaaatatgaaaaataacttgcacataactatacttgaacccagaattgtaagaacataa

SEQ ID NO: 31349 - DNA, 1451 bp, Bovine  19866880585208
agttaataagctaattaaaattcacctcttctcatctgcccttcactattctgccaaacatatgattgtctcagtttcctacttagcattaaagttggaaacttggaccctgaagcagaggcattcatttgcctacaaatttatacataataataaacactgtattcatgtaatagcagcttctgttatttcatgccttcactggcctgatgccagaatttcaccaacaggagaaaatcctttgttttgtcccattgaatattgtttgggatcaaacagaccatggaattataaaccaaagacatatggataatataacagtatcaccattcagaattcacaagttacaatggtggaacataatggaatatgtttagttttcatttttataattagctggttgtgagtaaattataataacataatatttaccatatactatttaagttctatgtatgtatcaacatattaatcatcttgataattaagtattattactatccttgtcttaaagaaactgagacagagaaacgttaagaatcttgtacatgatcctacaatatgtaaatggcagagctaggatttgaatgcaggcaaagtagctcttttcctatgctggactgccttgagttgttataagaagtaagtattaactaaatttgtgatttcaggattcatctagtgacacgtgcctctatgattcttgtgtttgaatgtgtgattgacttcctctaaaccagtggaaaactttttcctgattcctaaggaccaatagtgtggggttagcaatgcttctacctagaggatcagccaagtcagaatgaagaatccatactagcctaccagggcagatcagggtataccaggcaatatcaaccaaatgcagagagcattgagctgagattactaactatatcaggctccagtaattgaaatgtttcataggaaccatcttttctaaaagcaagggcaaaattctcataattctcatgtgaatttttgataaatttcagaaccttaaaaagttatatcaccctgatattcacttaaattaactagatcaaacagctgagaccatggtcagggctctcaaaatatttttgcttgtagatttggatggatagatggatgatgaatggataagcgaaagaaagagaactgaagtacataacatttcaacttgccatggtttgttgaggctaccaagcaatttttaaatgattttctttttttattttaatagttttgtcctctcctaatcccctggaaaaggaaatggcaacccactccagtattcttgcctggaggatcccatggatgagaagcctggtaggctacagtccatggggtcgcaaagagttggacatgactgagtgacttactttatttcacttcaatccttgatagggccttcccaagtggctcagtggtaaagaacccacctgccaatg

SEQ ID NO: 31350 - DNA, 1206 bp, Bovine  19866880591117
tctgggttaggaagatgctctggagaagggaatggctacccactccagtattcttgcctggagaattctatgaacagaggagcctggcaggctagagtctataggtcacaaagagtcagacatgactgcacaactaacactttcactccatttttaggaaacttggaatatagaagaaacctatatagaagaaaataaaattgcccacgataccacaatgctaatagccattgtcaatattaatttgcatagaatattcattatattattttctacgcttttctatagaaatatatcataagttttttagcaatttgggtgtattcctttttgtgtacatgtattcatgtgatatatattattgatttttaaaccaattatataatttacaattttttgtagaactatatctagtgtgtaactttcagcctagttgaaaataatttgtaagctataaagctgttgtatttcaaagagtttgggctcacgcagacctctattcattagttttaagacaccactgtgaaatgacgtaggtggcaagtattattatcattgtattgcagatggggcacccaaagcagacagcagttgcataaccaaggcagagctagaaatatactggggttattttgaaagtaggtagaatgtaaattacaggtgaaattaaacgttggcacttaatacttctaatcaaaagcctcatctctttgaaatgataatgcataaaatgtaccagccctctcttacttctccacgaattaagaaccaaatatgaccttggggagtccacatgggtatgagtggaaagttaaaccagttgcatatgccaagttgttgccagattcttgcctgaaggtttaaatggtgtgttaaagctacaaggaaatctaaaagattgcattgaatttggatgatgaagtcaaaatacccataggtgtgtgcatgagcaaacatacagagatacacaagaattttaagaccaaaagtaacactggagcccaattccatggtatttttattagtaatctttacttgggcacaatttcacttgaaggtagtggggattctttttcctgagtcaagcctgcggactcaagtctgttgggagccagcagaccacagcagacgtcatcaaatcctggtgcttcaggatgtacatactgatcaccgcaggggtcgggaaagattttattttttaacttg

SEQ ID NO: 31351 - DNA, 1889 bp, Bovine  19866880591238
ccaaaggatattcaggactgagttcctttaggattgactggtttgatttcccctgtagtccaagggattctcaagagtcttctcccaacaccacagttcaaaagcatcaattcttcagcgctcagctttctttatagtccaactctcacatccatatatgaccactggaaaaaccatagccttgactagacggacctttgttggcaaagtaatgtctctgcttttgaatatgctgtctaggttggtcataacttttcttccaaggagcaagcgtctttgaatttcatggctgcagttaccatctgcagtgcttttggagcccaagaaaataaagtctgtatctgtttccattgtttcccaatttatttgccttgaaatgatgggaccagatgccatgatttttgttttttgaatattgagtttaagccaactttttcactctcctctttcactttcatcaagaggctctttagttcctcttcactttctgccataagagtggtattatctgcatatctgagggtattgatatttctcctggcaatcttgattccagcttgtgcttcctccagcccagcatttctcatgatgtcctatgcatataagttaaacaagcagggtgacaaatacagccttgacatactcctttcccaatttggaaccagtccattgttttatgtccagttctaactgttgcttcttgactcacatacagatttctcaggaggcaggtaaggtggtctggtattcccatcttttgaagaatattcagtagtttgttgtgatccacacagttgaaggctttggcatagtcaataaagcagatgtttttctgaaactcttttactttttcgatgatccaactgatgttggcaacttaatgtctggttcctctgtcttttctaaatccagctttaacatctgggaagttcatggctaatgtatttttgaagcctggcttggagaattttgagcattactttactagcgtgtgagatgagtgcaattgtgcggtagtttgagcattctttggcattgcctttctttgggattggaatgaaaactgaccttttccagtcctgtggccactgctgagttttcctaatttgctggcatattgagtgtagcacttttacagcatcatctttcaggatttggaatgctggtttttctgatatataaatgtcaatcaatttaaaatcaatcaattaaaaaaattaaaatctacctctttattaaagtggccatggctatcctctctcataagagtttaacgaagaatgctaaatggatgaaccaaagcatatcaggtgaactctgcagtggcagtgtattacagctgagtagctgatctgaagaaatcacacactgatacatgccagaactctgcaaaatctagctttcccttggaggcaacagaggtgtcaattgctttatatcattcttaatttcataaaataaagactagaaatgtttgcacactatgacagacccgtgaaagcacaatttttagacttttgctaccagcttggcttttgccaaaaatgttctcacagcctccggtcttcatgcgcttcttcatgctgtcaggcatggaacaactttttccatgaaaacaaaacacttcccaaggagtgttctcagaaattctaaggggctttaaaggaacatcctaaatcctcatgttctgatggtttcacaacgcttacactgcgtccaagtaccctatccctaatttgttctggtgagtttttgttttcactcagagggttttctcaactgggctcgatagctcatgtcagcagagagtcaaaaatatccttactgggtgccaagaaagtggtaaccacacacgtacaaaatacaactgttctactggacttttactc

SEQ ID NO: 31352 - DNA, 1470 bp, Bovine  19866880600462
ctgattcaaattgatgtttgctcaaataaactctgaaaaaaaaatgtcagtatgcctcagtttatcttttaacacttctaattatattagttgaaacaagattaataattgtaaagttctatttataggctctttttgctatcccttttttgctatctttttgcagctccctaacgtaagttaaatattcagcatcaaagcaatattcagtcaatctttctaaagaaaaaaaaagttataacatttagaaatcatcttaccatcaagaaaattgtatttagtagaatttttaaaaatatatgataaattttagagaaattcctattaattgataaagtcattcaattaccagaattcattagaccatgaataaaatcatttcttcaatgaatgacattagctgcttctttaagaacagaaagtatccttctaaaaactattcctttttaattgaaaattcctgggacgaatacaccactaaagaggaatattaatcgtctgatctgatattactgatttaatttagtaaaatttagaaaattttaaaaacctaaaccatgcgcttttgttgaaaataccagtttgtcacagaagaaagtcaaaactatttaactatctcctgctctaataaagccgatttcacttcctggagcatacaaaggtaactctcaaatagtcagactgtcctgaatatgaaccatacacaatacacgtatcaagagctgtgagagataagggataaactatgacctcaagaaaggtaggtcacaaaagcaaatctcagaaaaacaccttcagaatgcctgatccttgtgtagtgatggctcattactcaagattaagaatgatttagttaaacaattctagataaatgaatgcattaatctgcaatatgaagatgtttttcagtagtctctccctccatgaagctttcctgtgcaagtcatagtcaaccaacttccaagtccagtagtctttagctcctgtagaatctatttccaaatccactgctatcacctctatcctaaacaaacagttttcaaagcagtacctgtgccgcactgaatatgagatggggccaagaattacttttctaacaaattctcaagtggtgcaaatggcacatggaccacattttgagaacactgtcttgagatatttcttctagattagtataatagtctcctaactaactattctaagtacacccacttaggtaccacctttaatccagtctctacagcatatattaaaaaaaacaaaaacaaaaaactcaaatctaatcaccacacccatattatcatcagtctcatgaacatgccatgatctttacttcattcatagtactaactagtgctaccagacactacttcatcacctagacaactgattatgatgaactgtaggcaccccaaaaggttaacccacagagttggttttttttttttaacacattgcaaatgacaagtg

SEQ ID NO: 31353 - DNA, 1232 bp, Bovine  19866880618861
tactgtaaactttcctggaaaatgggtgatgttaaacatcttttcacgtgcatgtctgccatctatgcatcttaagaaaaacatccattcagatcctctgcatattttttaatcaggttctttgttttttgctgttgagttatatgagctctttcatattttgaatattattgtatacatgatttgcaactgtcttctatattcccacaatgagatattacttcacacccattagaattgctattattaatattaaagggggagaaataacaaatgttggagaaaaggaaccttcatatactgttggtgggaatgtaaattgatgcagccactatggaaaatagtatggagggttctcaaaaaatgaagactagaactaccatatgatccagctattccatttctgatcatttatcctatgagtatgaaaacactaattagaaaagatatatgcacccttatgtttatcacagaatggtttacaatagccaaggtatagaaacaatccaagtgcacatcagtgggtgaattaataaagaagctgtgcaatgaaatactacttaccaataaaaaagataaaaattttgctatttgtgacaacatgggcagaccttgaagctattatgctgagtgaaatgtcaaatggataatgacaagtactatataattttacttatatgtggaatatatatatatatatatatatatatatatatatatatatgaccaaaccaaaccaaaataaacacatagatacaaagaacagattaatgtttaccagagcggaaagggatgggtggagagcaaaatggttagaggagtttagctgcatggtgacagatggaaactaaacttttggtggtgaatcttgtgcagacagtgtaaacagaagtcaaaatactatgttgcattcatgaaactttaaaaaatttttaaaaataaaagtataatagtataaaattattatttctagtgtattttttatttcagtcattctcacactagaaagtatttatttgaatacccaattctatatatatatattactgtggagaaattcaagaagcttaagaaatagccccaaatctcaaaaattttataatctcactagaagacaaatagtcagaaagcaattataacaaaatattaagtatcaaaagatgtcaaaggaatacaaataaggaaggattagaggttaattggtcctggagggggaaaaaagcatgaagagt

SEQ ID NO: 31354 - DNA, 841 bp, Bovine  19866880654619
tgactgggctactgccctggaaatgctttttaaaaattatactataatttatcattagaacgaaaagtcattgtgtgtatagaaaggctagaaactatggagtgggatgtctatttgatatcagtgaggtaactattactggagggatgatccccatatcttattttcttgcaaattaatgaaatgcgttggtgggtcctaaaaatgggaaatacaagttaaattacttgtgtaaggtgttgtgaatgagataatgcataaagaattgtctgtcgccttgctacaccacgtgtggttcctgaaccaagagcaccagcattaccagggaacttgtgaaaaatgcagaatctcaggctgcatgccagacttacaaaatcaaaaagtgcatttgaagatccccaggtgattcatctgcacattaaattctaagaaatactgatatcacatgctaagcccgtcaactagaggaaggaggaattgtctaatctctttgaagagatggaagaaatttcaaaacaaagagttgtgatcaattcattcgtcaggcaggactgtcattcagagatcaaacaccaatatcagaaacttcctgctgagtttgaacagcagctgcttaactttctgtgacatgtgattctactaaagaaagttggttaaataagaaagactaaccaatccggggctttttgatttatctccaaatttactaaaagaattttttctgtatgcatgaaatgaaaattctaagttataagaaagcattgttgtaattttattgacagctttttttgattccttagcatttcttaaaaatcatagtgtacctagaagggtgggatgg

SEQ ID NO: 31355 - DNA, 2842 bp, Bovine  19866880659313
ttggtgatggacagggaaagcatggtgtgctgcagtccgtggggtcgtgaagaagtcggacacgactgagcaactgggctgactgaaattaggaagagataagttctaatgggaaagtctgaaagacttttcgtgcctgatgtaacacttaagcttaggctttgagaagaagtcaatatcaaaaaggaagatggagccaggaaggaagcacattccaggaaacaggaaaagcatgaactgagtcacagagacatgaagcaatgtggaatgtctggggagcaatttgttgcagctggaacataggagatagagcagtaaggttggaaggctagtagttcttatagaaagctttgtttgctatacttaaaaagtatggattttatccagtggaacagttgatgatgggttttaaacaaaagtgttgctcaatcaaattagcattttagaaaaatcaccctggtagcagtatagaagaagaatcagtagatgggaagacaaatcaggagacgactattgcagtggtagcactgatgatgaaggagtggaatcagatgccagagcacctgactgcctaaatgagaactctgcgtggagtgtgagggaagctgtccagggtgatgcccatctgtctggctggaacagcagagtgggtgatgagagctttccccaaggaagtgaacagcataggaaaggttagtttggttctgaacttactgatcagaagagttttacatgaaaaaattgtcaacatgaaaggcagatgaagcgatgaaaacatacatctttgcctgggataaccgtgtggtgtgaacgaagtagagagcccagtgggtctagcaggcaacacagagaagcagtggcaggatcaccaacaaaaaatggtttcccagaaacacgagagtgattgacagtgtcagatatctcagaggcctgagtgaatctgccaaatttgatcatttgaagtccatgatgactttagtttcagatttagtgttctgatagatacaagctttgttgtagctgcttgaaagtgaatggctgagctatatagatagcagttattggctgtttttcaaaaactttaacattcaatgaaggttaaggaaatttatggaatcatagtaagaattacttgttttctattttgtagtaaagtgaaaagattaatgcttatagcctatagacaaacagctagtagagaatttggaagagccttaaggatagccacatggagaaggaaatggcaacccactctagtattcttgcctggagaattccatggacagaggagcctggcatggtacagtccatagggttgcacagaatcagacacgtctaagcatgcatgcaaagatatcttcaagggaacagctgggggattaattttaaatggaagagtacctcttttatctgggcttccctgatagcccagttggtaaaggatccgcctgcaatgcaggagaccctggttcgattcctgggtcgggaagatcccctggagaagggaaagactacccattccagtattctggcttggagaattccatggactgtatagtccatggggtctcaaagagttggacctgactgagcgaatttctctttcacctgtttatctgacactggaaagaaagagaggaggacaggtgtaagaggtttgttcttggaagtgaggatttcagggggttcagaaccaaattttctctctggagtaaggaaatatactgagagagaaaggaggtgaaggtttgtactgtagtatgcatcaggttaattggctttctctgaggcatattactactgggtaagtggtttgaaccagtactagatgttaattttgagctttatacaggggaatatattagtaatttttgaaccaccagcccttatactcaaaaaatcttgattaaatattacaaaataaaatgtgatgactgatccccatttgaatgctggtttagttaatactgtagggggtgaactaatatgaggagagattttctagctcgttaccccactgtaaaaatttaacagtaacaatgtttcttccctatccctcacttcattgtcgcaatttataagggcagtatctaggacctagagagatcatgttgcatctctctttatgacatcacggcctactcatttcttaggttttactaacctctatatcacagaaaatgtaagttgcttttagaacttatgaggtgttcagataactgacttcagataacttgaatctcactttggctcaagttttctgtttaacttgttttgtaatactgggattttaacttttacagcagacatataatttgcaacaaaaaaatttcctaggtgctggttttagaagtgtcttcaaattaaagcgttatctgcattgttgttcaaatttagtttaaaaaaaatagatgtccagaagaagggggacacatttgttaacataagtgtataaacagtgttaatatcttttctgttatcattaaaatcaagtttgaagtgtcttcacaaattgaaactttgaaaacaattcttcaggttaataaagcatataaagtcagctaaaaggattagacttgtaagtatatatggaaatgagtgttacatatctcccaatggttttacaatttaatcactaaagggtaaactattgtagcctgtttagctttgtgcattcaatttgaggttagagcaatgacttttttaacatgaaaattaactcctcctagagaattagtatttgcatattttatcaaaactgtttataccctgaaagagcaggcaaaacagtttttgtgattaacttggcagttctaggtggttgtttttttcttttcttcca

SEQ ID NO: 31356 - DNA, 2030 bp, Bovine  19866880660252
gcccacgttgcaactccagggggcgctgttcacatactagtctaggtcaatggcacgatgtgggtggtgggtgcatcactttccaagaatccagtgtgtccgttctttgccatgactctcaggtcatgcttaactctgttcatacttgcaagcacttacttttaaagataattgaaaaaggagaggtttccctttcctttagtttttagtaaaactggtttcctgagcagaccattagctgtgattccaacctactattttagaaagtaaagagtctaagaaagaaacacagagatagccccttccattaaaaaagccactctaaagacaactcaaataaagaattcccctaagaagggaaatttttctagagatgagattgccaatcaccttttctttctaaatcctaaccactttaaagtgatacttcctctagttgagttttctactgataagttagataaacatgaatcctttcaattatttggaacatgtagtgttaaatctgttcactgttattttcctaaatacattcttacaagtacctatttcagtccagtgagaatatacttctctaaaactatgatgcaagcactctttccttactttgttatcttttttaacatgttataaaaaaaaaaaaaaatccagtattttaaaatggaagtccactcatgtgacaccagtgcacaaacatttctgttggttcctcatcttcagcaaatccagaggcctcacaatgacacataggatctgtctccaggacctctcagctcctcctctacatccctgggcctctgcacactcttctccctctgctccttgggctgcttcagggtactcttctgcagggcctggcaatgcccacttctcagggaaagctttggcagttctagttaaaatctgtaccactgcctctacctcctccatctttgccccatccttgtaggcaccctgcctgatttcttcctcagtagaatttcttccattgtcctctttaaaatgaggatgtacaagatctttacaatgaagatgtacaaaattaaaatataaaattaaaagtataagatttgtattaattaccactccttccccccaccatcatattcccactagaatctaagttctgttagggtaggaattttgtttgttttattctctgctgtttttctaatgtgtagaagcgtatacagacttataagactcaatagccatttttattgggcaaatcacattagcaaatcatgtagttatagaatattatgcgttataaattctggattaaccaggctcatattacaagcaaaatgccacacaatttctctttctctaatcattagtgtataagcagacattagaaatcttagtatagtagtactatttaactctgctctatgtaatgacaatgggtatggagaagattcagaagctgtgggtttttagggaagtcactgaatttccttccagtggatggtttacttaaaaaatgaacccagaaaataatcttgttatttaaaaaacaaagacattgctaaaggggtcacaacacatttttaattttcctgtgataaaacaataaactaaatgatagagcctgaacaaatgctcacttgtctctaagttctcagggaagtttgataccaaagtccccctggacagcctctcagaacctctgcagagctcaccaaagcacaataacacactgctttcagccttccccccatgcctttttatccctttttagctgtttatagttaccagaatcaccccctgacccagatatacatagctcccaccataatcgatatcccccactggaggggtacatttgttacaatcaatgaacctacactgacacatcattatcacccaaagttccaattttacattacattcactcttggtgatgcacattctgggtttggacaaatttgtaatgacatgtatctaccattataggatcacacaacgtagcttcactgcctaagggccttcttcatgtttatgggttttctattataagagtaata

SEQ ID NO: 31357 - DNA, 1975 bp, Bovine  19866880695683
ggcatgcccagaagtccaaatgtgggaatgctgagcaatggaaatgcatgttatgtgcttttccagaaagctaaataatataaaatctctgatgacaccttgccttagaatactgtattgatgtttttatccgtcttaaacttaatactttaattttattccttcacaactgtgaacacacacttgaagaattgagttcagtgggcatccagttgatgtaaaagagtgaacactttgggcatgcttgatgcttttctcctttggccacttgtatttttgtatatgatattcaaacatatgttatcactttgatattttgtttttctgcctcttaatgaaatatatgatgtgcagttatgtgttgagtaattacactgccagtctgtagagtcgcacagacttctgtctgaaagttaggtatgtggcactaataccgtgtcagtgtatgattgaagtgtaaattgtttaaaagttaaggcctatgattttggtcagctcttgggttcaagcaaaattagtagttcctggaaagtgaaaattgaactagtctgtttttagtattcttaattatgcaaatgagcaactttgatatgagtttaaaatgtttgtaccatagaaaagaaaatttcagggaagctagagtagtaggcaagcatgagatattaggaaagataatttttgagaactgtggagaaagtaagctctgtgtttatgagataggagagaagaatgaagacaattagaagagattagcaaatggttagaaggacatttgggcagaatttggggtatgatatattttgtcttagtgtttttctcttttcatccagtattatgactgtgggcaaatgactttaggtaggaggtcagaatctttaatttttactttgtattgttaaaaaaaaaagctaatgggaaatggttatagcacagccttcttccatcgttttatattctagctgctcagtttatttactcacgacgtgacaaaccttcagctgttgaacctgtagaagaatatgattatgaagatttgaaagaattctccagttctcttgtgaatcatcagctaagtggaattgatcaaggtatagtaagaattagtctgtttcttatctgaaaatgattaataatttactgagatttaccaatgttatttatcagttttattgttcataatattaatcatgggtagaattggtatgaactaccattatatcttgtatcttcaaggaaaatttacattttgttaattatgttttgtgaagactatatggttaactatatggttgaaaaattgattgtgtggctgttattcagtaactggaatttgtgattgaaatcttcttaggagagaaacttccgcgattcgttttcttttatcagtatttattgttttataagctgtatgtagagcttatggttagattacagaagctcatttccttggaaaatgttaggttccaaaagactggtttttattaaaaataataataagttcagagtaacactatacaaatgtcctgattggtcacagtcatataaattaaatttcaagatagaacttgtaaatggtaatggctttggttctgagtttgcttctttttagttctcttaaacattttaacaaagatattttatattttggctttcatcttttataaataaatttcaaatgtgacagtttcagacatactgctccagtcataggttgatgaataggggttgtagaaccaaaatcatcaggtataaaagtagtgctctctgttggtgctgagccgggctcagcttgtttgctccttctctggagtgtactctttctctggctttgatctatgaatatttttaaattgaaaatttataacaatttgaaaacaggaaggagggaagtatataaatctgagagttgatctttgcgtaaatcggtacaatatatgtcagctgcaacccaaaccgagaaaaatagaaagcacag

SEQ ID NO: 31358 - DNA, 1251 bp, Bovine  19866880736668
taaccttaatgaagaaacactaccaatttttgctaagatacaggaaagtaagatgctctatccattttataagtacttatttctattagtgttatgaatagaatggtttttaatttaagaagctttatacttttggtaaagtacttaacatctttatgcaaattgatttacaaccttgtgaaaatgagcgttattttgtgcactagcatcatgatttttagagtgaatgttttgtaataatgaaagtaggccattatgcttcatttctcttatagattactatgctttattactatagaagtgaaatctaatcttttacccctcttctattatgaccagacaactagacgtttaataattatggtgtctatttactatattaaaaataattatagaagatagtattgaaggaagacaattaaatttcccttttaatctctgtacatagtatttgtatgtatgaaatatacttcagttgctggttccccacttcaaagattcatataaaataggctagagtatatctcttactaaacatattattgtttcttatcctttctatataataaatctttcaagtactccatacaattcagcatttcctattgtgaggaaagctttagtaaaataccatttttaagaaaataagaaagtattaagctgtatttgaattttattgataatcaatatttttctcacagacaaattgattccattttctgtttgtaataaatccatataattgattcagcatgtttggtaacttaatgtgcggggcttcagaaaagactggtgtttgaggaattaatcatcagcataatcatgaaaagtacatgagcatagtgtacttatcctttagtgagtatgctaaaagagtagccattatattatgtaaattttattcattaatattaaaaatagaaggctatagcagcaaagtactcaaaacccccttctccagaaggagcaaggaaatgggttgagaagggctcacagtaggcaaaaaaaagatggtggcagcaagaactagagtcaccaaatcattgtatcaaataatgctacttttgccctttgcatttaaaatattgggaataagaaaatggtgttttagccatatttctagatacatcatcagtctgggatgaagaggtgctgacaccacagctgattctaccaaactgaagaccatttaataaaactagacccagagtatactgggctgtatgggatgaacaatgaggaatgaacatt

SEQ ID NO: 31359 - DNA, 1758 bp, Bovine  19866880760422
atacccatggggaaaggtataactccgtcaagacagagactcccacttctgctcagggcacaggttggctgtggtagtttgaaaattccacagaactcagtgccccgtagccttcaggaggaacccagagcaccagctgcagtggcagccatgcccagtgcacactgactgggtctagcagcaatggtgaattgtgagcaccttggggagttacaggagacacagagggctgaggagaaaaccttggaaagaaagtgacagatctacggtcaccagtaggatgtgtttttctaggagcacaggtgaaacgtctgagtgaggatcacgaaataatggatgaaagaatcaaagacacaaattagctgcattaaaatcatataaaatctatagtaaataaattctgtaaagcaattacccttcaattaaaaataaattacttttaaaaaatttttaataaaataaaatatgacatagacatagagaatagacaggtggttgccaagggggagggatggagtgacagtatggattagcagatgcaactaatatacatacagaataaatgaacaataagctcctactgtatagaacaggtaaccatattcaatatcctgtgataaaccataatgggaaagaatacaaaaaagaatgtaaggatatgcataagtgaatcactttgctctatagcagaaattaaacacactgtaaatcaactatacttcaattttttaaaaaagtcattgacatggtacccattctctcccatatccctatgagttaatcttatcatcttcttccataggatttagagggatgggaaaaggattaacatcatgagggcaccaaccttcagcatctacctccttcttgggaaatacaactttcagctaatatccctctgacaataacatttatatggccctgctgcctgctgagcaattttatgcatgatcatttcatttaattctcaagacagaccccatgagtgggatacagcgctcaccccttttattcacatgaggaaaatgaggcttagaaaagtaaagtaacagaaaatgatggagtcttttgattgaatatttttaaatgaatctagataataaaatggattgatttatcagccttagaaggtctgtttatgaatttcaacctcatggttatagactttaccctttaggatgttaatgtgattgaacaatttcatcacatgctgtaacttgaaaatgtattatttcacctaatctggcagacttgtagggagcacatttctaatataaggctgttttagagaataaaacctaattccaggaggactgataatttgtttaatatctctcagtcagtgcagaaagggtcaaactcaggacctctggctcagaatctgtatccaccttgaatcatagccctcatgacctatcacttttcccacaactacttggtgaccccagagtcagaaggtgaaagctctgggctgacaattgggaaatcccaaatggaagcctcctggctcttgttcagcttctcttttaccttggggaaagtcgtagctttctattttatttctccatctgcgggatgggttaggtagtaataacacctacttacccaagcttacatgaacgttacaaggacgaattagataatgtctgcactgagctttgctctcttcagaagaaagtccctgtaaaactgaagggagaaattcattacgggggctaatgagatcaaagcctgcggccaggagctggggaagctctt

SEQ ID NO: 31360 - DNA, 1030 bp, Bovine  19866880760706
tctgctaatttaaatgttgattcctccagaaatactttcacagaaacatctggaatgtatgaccagatgaaagtgaaataaaatataaatatagacattttaggtaaaatttacttaaaatagcaaactatttgggattgtttttccttaagcttattcctttctgtatattctctgttgaaagcttgaacaaacatgtatgatttatttccaaatgatataatttttgtaggcaatctaaattgaaaactaagcttatgtctatacataatccattttaaaattctagttttcaacacattcttatcctgaagttgaaactgtaaaatatgcatttttttctttgtacttttataagctaaggatgtagattttagggggttttggtttttttattttttacatcactttgaaactactttctaattggataagaagtttaaaatcagtaatcagccgaggccagttttatggcagtcagattatagtagtgaaaacacatatgtaagatgttgctaattgctgaaccctgtggtatgaccactctcatttaaaagccagagtgtcgtgccagactgttcttagtggttgcagctagaggggattgtgagaatgtgggggctggagagatgaggatttcaccattagttctgtatacttcagtgtcattaaagtctgcagtaagagtcaacattatttgaatattttcaaatatgttttacttgggtttttaaattgttttttcaaggccagtgttatctataaataaaaatgtctttccatcaaaattactttaaagacacagttattaatacatttaagacagagctgttaatttgctatctagtatttcttcaaagaaggacacctgttttactagactcttaaggtcagaaatcataatttatcctttataatcttatcttttttatttttatatggttttttaaaaattggaacataattggtttacaatgtcatgttagtttctgctatacaacatcttgaatcagccatatgtgtacatata

SEQ ID NO: 31361 - DNA, 1361 bp, Bovine  19866880788761
ctgctgctgctaagtcgctcctatgccttggcaaaaaagcatttcagatgccatgtcttgaaatcctcacattcactgagccatcagtttttcacttcctacctcattaatgattatggacatttttttatgtttatgctttgatatttgttaacactctcttacaagtgattttcaaataagcaaaaacaccttcaaggaaaagtttgattcaatccaaggcagagcctgtggatttccttttgctggtcctctttgcactttcagtggaacaaacagtgcaatttttatcctttccgtttttagagctgcagctgtaaaagtaattaatggctaaagaaactctagcacatcctgcagaaggccattctgcattcagcataagctgtggaaccagggcctctgcatgctagtagccctggagagcatatcctggtgaatgctgaaggactcctatcttaaccttggaatctgcaaagcaccccaatttattttggccactgatacccaaggaaaaacttgtatcaacaggtgttttcattgcagtttcagttgatgattttgctgcatgtaaaaatattttttaatctctgaaagtagatagtgatgacctcagactttctttgcattattagctaagaaatgaggatagtcacacattttataaaaggatatgcatttccttccccgtgattatttttcttctccttttttgtctccacttttttctttttgtctaccttccttccaaatgcacttgtgccaaacatgcctgcggttaagtaatttcagacataatgaggaaacggatcatgtgtgccacctgcatagtcaatggacctgaggtgggattgcaaccagatgagctggcttcctggcctggcaaggctcttatacctgtgactttgagtaaattgcttcaccctctagattctcaattttctgattcctaaaaaaagattaacaatacctgcctggttttcttctcagtgtccttgacaaataatgaatgtgaaagtgctttataaactgtgtctttacaaacacagggaataatggtgttgttttggggggctgtgtcatgaggcatgtgcatgtgggatcttagttccctgaaatgaaagtgaaagttgctcatttgtgtctgactctttgccaccccatggactatacggtccatggaattctctaggccagaatactggagtgggtagcctttcccttctccagaggacttacccaacccagggatcaaacccaggtctcccgcattgcaggcaaattctttaccagctgacccaccagggaagcccttagttcccgactaggaatcaaaacacgtgtccctgcagtagaaacgg

SEQ ID NO: 31362 - DNA, 1353 bp, Bovine  19866880846799
actggaaaatctgcataaagcagtcctagaaaaacacaaatgcccaagaaaagccaacaaactgccagaagccacagataaatacaaaacaccaaaaacctggttttccataactagaccagacattgactctagcttagctaaatttaatcctggttatagtattttgtttgcaactatttgaataataattagaacaattgcactcatctcacactctagtaaagtaatgctcaaaattctccaagctaggcttcagcagtatgcaaaccaagaacttccagatgctcaagctggatttagaaaaaggcaaagaaacaagagatcaaattgccaacatccagtagatcatagaaaaagcaagagaattccagtaaaacatctacttttactttattgactatgctagtctttgcgtgaatcgcaaaaaactgtggaaaattcttaaagagatgggaataccagaccaccttacccaactcctgagaaatctgtgtgcaaatcaagaagcaacagttaaaaccagacatggaacaatggactggttcccaatcgggaaaggagtacgtcaaggctgtatattgtcaccctgcttatttaacttacatgcagagaagagagatgccaggctggatgaagcacaagctggaatcaagattgcagggagaaatatcagtaatctcagaaatgcaggtgacaccacccttatggcagaaagtgaagaactaaagagcctcctgataaaagtgaaagagaatagtgaaaaagttggcttaaaactcaacattcagaaaactaagattatggcgtctggtcccatcacttcatggcaaatagatggggaaacaatggaaacaatggcagactttattttcttgggctccgaaatcactgcagccatgaaattaaaaaactcttgctccttggaagaaaagctacaaacaacttagacagcatattagagagcagagacattacttcgctgacaaaagtctgtctagtcaaagctatggtttttccagtagtcatatatagatgtgagagttggaccataaagaaagctgatgccgaagaatcgatgcttttgcagattaaagagtgaagttaagtctcaagcagggtaaataataacaaacctacgctaggatataacctgactttcaagacaacaaagagaaaagagtcaaaaaccatagaaaagaacagactattatctacaagacaagagggctcagttgaagagcagatctttcatttattaacagagtccaggaaacaatacaacagtttcttcagagaactgtggctacagttttgaatacctcaatggtcgagcccgatttttggttagca

SEQ ID NO: 31363 - DNA, 1001 bp, Bovine  19866880917442
tttgcacagtatcaaagaatcttagagtattattgcaagcagctgaaactcacttttccagttccatgtgctttggattgctcctaacttcatatgaattgtttatgaatttttcagtgaggcaaacccttttgcttgattggcatggctaagaagtataatgcactagcatgcacacaacaggctcttgggttctaatccagacttccccaatttctaattgcatgttttgaattcattaacttcttaaaaaaaatgctcatctgtatattggggactgtagtttgtcctccatgtgtatcatacagggttgctgtgaagatcaagtggatatagtgttactttcaaaatgacagcacacttaccagtatgcattggtggtacctactttagatagtccctgtccttagaaacgtacgcaaggaggcttcaccaacagcaggtccacttgcactgaggtgtattatttcctctcacatgttctttctcattccttcttccactctggcagaactgtgtcagtgggtcaccaaaagagattgctgattcaactgattcctgaaaaaaagttagtcagatctcttcggtattatggagatcaaacaactgatttactggtcttctctatttttctgctgcccttgttggcatgtcaacagacagagaaacagtccgtctccgtgtgacatcgatctttccaggcatttcttagtgttggtatgctattgttgacctgcttccctggatacctctgtgttcactttgttctcccttgggtcactttttttccacttgccctggcaaggtttcatatagctgttagtaatattgcagcagcctgctttcaatatatcttataaaataactttgccatgtagagttttgggatgaactggaaaggctaaatgagtgaggaaggaaagttgagctcaaattcagagtgccctaccccagagagtacaagacctggattttttttgtttggttgggtttggtaaaca

SEQ ID NO: 31364 - DNA, 2911 bp, Bovine  19866880955974
ttgaaaacatggatagatctagagggtattatactaagagaagtaagtaagatggagaaagacaaatatcctatgatttcacttacatgtggaatctaaaagacaaaacaaatgaacaacaaaaacaggctcagatacatggggggatgggcgaaacaggcgaaggggattaagaggtacaaaattccatttacgaaataaattacagcacaaggaatatagtcaataagattataataattttgtatagtgacagatggttactagatttactgtggtgatcacttcataatatatttaaatgttgaatcaccacgtcgcatgtctgaaactaacgttgtatgccaactatacttcaaaaaaattaattaaaaaagatgtccaagatacactggtgaaataaaaatattatgatcctagtttcatcaaaacaaagaacagacatgaacagacatgtattcatatattcagataacatctttaacagggtatgcaagaaacagagtgaagatgaatgttagctggataaaggaattttatctttcatttacactattctctattgtttggatttttaaaactatgagcatatattacttttatagtataaataaaaattttacaaaaggaactttatcaacaactttcctccactaatacatgaatgatgtaggttagtacttaggctagcaaaaataaaaagcctaaagagttcacagtataaacacaaatgaaagttgtcagcacttctgttttcccaaacctcctgagttgcttttctccctgatagcaccagtactcttctttctataagacgtaaatttacagcacactacagtgaagattttctagaatgagcttgagaaaacattctcctatacccccgtggtacatgttaatttggggagtctctggccatttgtggagtgtaatgaacaagactcatcccctcctcttgcagacgaaaagccaaatgctgccatcacctgccaacacttcaatgaaccagatgaaatgttgggaggtatctggtacactgagcgacacaacaggtgtgttccacttggaaggactcagacgatttagcagctgccaaatggtataattttacttcttattctatagtttgaatagaaattaaaaaaaaaacaactattgaaggggtttctttcctgtttttcttaagaagtacagacaatatgattctaaaggcttccacatgaagaaagggtacaatgaaacaaacatataaagggatgtaaaaatgcagcgtgagggcttccctggtggttcagtggtaaaaaaatccacttgcccataaaggaggcatcagttagatccttgatccaggaagatcgcacatgctgcaaagcaactaaccccctgtgccactaccactgagcttgcactccagagctgggagctgcaaccactgagcccatgggccacagctactgaagcctacacatcctagagcccctagtcctcaacaagcaaggccaccacgagaagcctgcgcacagcatctagggagcagcccctgctcttcacagctagagaaaagcccttgtagcaacaaagacccagcacagccaataatgttggctattatattaaaaaaggcaatgtaatgcaaaacgtggctagctgtgcaggtaacagctgtctgcctgtgctgctgactagacgtggaggacaaagggtactggcctgagagcacggaggctgggctcctaccagcagggttattctgaacgaactccttataacctttctggatctatcctgatttcctcatctacaaaaaggagctgactagaatcaccagggttgatctctaaggttccttccatgtcactaattctatagttctatgaactcaggacccactctccaactcgtccccaattctagttgcttatcagagatcacttttcaggtccttttttctttttaagaaaaaacttatctcatatatgataataaaaataaaacttgcacatgaaattaaacatctgatagaatttgtggtaggtttataaggcaggatcttgataaaatcaaaccatacatactctgataaagaaactaaactgaagaaatgcaactctgccaggtgctaaggaagcccagatacacatttctcaagggctggctgtttgcgtcacgactcaagagtaaacccaaggcattttggttacctgggacagcattaacgtttcccggggacttctcacataagcttagatcattctttatactttctccaaaagggacataaaacagtgtctaagtattcatgtgctatgttccacatgtgaagacaaatacatatatgtaggattctagtggctcagacagtaaagcggccgcctgtaatgtgggagacctgggttcaatccctgagttgggacgataccctggagaaggacgtggcaacccactccagtactcttgcctggaaaattccatggatggaggagcctggtaggctacagtccatggggtcgcaaggagtcaaacatgactgagcaacttcactggttggttggtagtctaatacatggattcagataaagtagatcaaaatgtgttcttcaacaaaagaaatccttgtatcttaagccctaaagctttatttgagctccatcttctccaggagaatttttctcctttttttcctaaatgtattcctaggctctcacaaatccttactctacctatttatgtttttaaatgttttacgtgcacatctacaagctctttggatctgccggaattagggtttgggcagcagtgggatagcctgaagcagatctcaaaggtcaggtagggtatctgaaggtctgttgggatatattataaaggtctacttccagcagaagaagtctgtagaagacaaggcacacac

SEQ ID NO: 31365 - DNA, 4928 bp, Bovine  19866880997385
ggaagacaggtttgacagtaattttttaaatatcagaaattatttttaaaatcatatcaaacacagtatccagatgacagaaacccaaaatatcactctttttcatatcacaactagaatattaagttcagttctggatgctatttctaaagaacgtgaacaaactggatggattcagtatagattcagtaggattaaatggatggaattatcttaaaaaagagatggtcaagatgagacagacagacccaaacatctcaagagccatgtttatagaagaggaaactgacttgttctgtaacaatctagaagcaaagcaaaatcaagatactaatcttttgtagtaaagcacaaaacttgagtaattaacaaaaacacagagtttctaaagtagaagtaatttttgttttctaggaaagaatgtatccacaagcaaggggactgttgttttttttttttttttttagtaaccagtgatacatccttctcatacgttgaagctaaatggctaaaggtgtgtagagattagaaacactgcaatgctttcatcagaatagcccactattagcagatagtgcagtctccggcaaacaacaagaactccagaggctcttcggtaacatgttaactaaaaagaaaaaggatttcctggctcactatttgtgtgaccctagggaagacacttatcttttcagtgcctcagtttcctaatttatgaaattgggataataataagggataatacttattgaagaattacacagatgaaaagaaagtaagtataaagatacactggcaagagtaagtagtcaatgcacatataattatgatgaacaatcttggaggtttgggatcattatgaacactagtaatataaataatagctagtgataccacgtgtgacgcagttgacagttctcatattgtagcgctgaacaagaacgtggaaaacctctcttttagtggtgtttacattttactaggggagacaaaattccataatttttataggcctttctgctataaagccttgcattctgtagaatgaggctcatgaaaaatgcagttgtttcagactacttaaaatccatggaacttataactagagtgctgatagaaactaacaatcctaatcaaagcattaaatcaaagtattaaacctctgctggtatctgcacccagcacgactgttaagtcaggtccatgaaaaaatttactttcagtagagaccagttaatcaaaattaaaaacccaatcaggttttagatttcttcatctctcaaacaaaacaatttttctgaaattaagggaaatgtttttgcagcttcttcatttgtactagcagctattgaagctactaaatcagccactagcaaaaggcatttcagctttttttctaaaattactcagtctttccatttggttatgagaaaagcctgcctttgatggctgtgaacttaaaccatgcaggaaaaagtcttcagcaatcttattgacatcgttcatctatttactaactgcacgttggctaatttgtattacagaaacacaaactgcacttacagtgacagtaagtactactccaaagaaacaggttagagggtgtagcaaatgttttgagtggggcacattgccacctccccttatggcattttacagagctcctgccttctggctcctgtcttcccagtttaagttcccgagggaacagactcctttccagcacttgctctttttgcccttttcaggagaaaaaaaaatgaccaaaaataattcctctggagtcaggtctcaagggaaccatgtgttcatacttctagacatctcactagcttaactaagaaagtatttcagctagaatctaaaatggaaagattttcattttagtttttttttttttttaatgctttggatgtactgttttaggagatatatgtacttttgaattattcttgattcatagttttgatgagctgattcctcagcttctaccagtttatataactgaacatgtttttattgttgtaaagacaggaaagatagagactgaaaagagccaaatagattactgggtgctctttcagtagagccccaggcagcaggaccagtgtcccttcttctccctgctgtactgcacatactctccaacgcctgctgagttaaacagttatctcaacaccatattctactgcttggcatcatttcaccaagcactgggcttacgaaagtggagagatttggttggtattgaaaggacttaggtttttgatctactaaagacaactaacccatgtccattaattaagcagcatgaaatttctagtagcaatggtggtgatgggcatttgtcagtcaattcagtagacacaagtgagctctctctatatattatagatatatagtaaacgggtgattctgagtcctgagaacagaaagaatgagagaaatgatcagtgattattcaagtgatgactatcagaaatttgtttagtttttcttctttaatatgttttcttggaatagtaagagcagataaaaaagacccaaaagtatacctaaaagatcagcttcttcaaacatcctcattttaccaactagaaaagttttaagtacttagtaaggcatcacccaactcagtggacatgagtttaagcaaactccagaagatactgaaggacagggacgtctggtgtgctgcagtccatggggttggacatgacttagtgactgaacaaaaacaacaaaggaatcttgctacagctgcccttacgctgctcctttgtcaaatgctaaaatacagtctgcatctttctctccattgaggttcctggatttttcccttcctctgagaaacgttttgaaagtaataatgttgcataaatacaaaacttaacttttcatttttgaagaatgtggaaaaagaaacatttacttcattgttctatatgggtttctttcatggcagccctttgacacaacattactttcttttgtgtaagtcaacaatatacacacaaggctatgttaactgctattgcattttccatcctcctctcaagacaggtttcctaaactgcttccagttcatcatgcttccattctgctcccaatctcccaaacatttctgactacccatgacagcacaaaaacaccctctatttagactcccctggcttctgagatgctacacaattcctgactttctatgtctctcttctctgtcttccatggggctttttccaaccttctgaatatggacatccctgaggtctaagctagctctttgcgcttatttctatagtttcagtctttattcatttaaactgtatatgctgacaatctataagaaacggtgatgaaagcagacatggcccctattttcaggaaacttacatccatttgactgaggaagacaaaaagataagtatgaaaataactgaacaaaaaattacaaattgagataaacattaagaagggaaaaaaagtgcaataaaaaagactaagtggggaatatctacttcagatagagtgatgaaggaagatcctctgaacgcctgacatttactgggatctaaagaaaaagcccattatgccaaagggtgtgtatattcctggcagagaggccaaatgttcaaggctgataggtgagtgtgagaaaggctggctgtgttccagaaactcagagcagagaatgtcataagttgatgctgaagaggtaggcagagaccaaatcatgcaaggccctgtaagccccaggaaaggatctggggtttaactgtacatgtaagaggaagttattgaggagtgttaaaaaggagaaggataatccattctgactctcattttagaaagttcactctggctgctatgacttacagaatggatggataaggtgctcacacatttaggattgcccaagacagtcctagtttatatgtttgttgtcctggtgtgatctgatctgatctgatctgtcctggtgtaactggatttctgcattaactcccagaaaaagccacaatacgcaataaatacatacatatgaaaagagaaaaagaaaggaggttgatcaagacacaggcaggcctttgaggcaacatttatcagatttcctggctcttggtttccatgctctagctgggactctggggtcctcccttggattcttgaccttagggttgggacatggtcttgttcttattatctggccatctcctgtgatgaaataatattcaatatccgttatacagaaacatattgagtggaatgtatctcaactcattcattcctcacaacgatccttgaagtaggtattaccctcatttgcagataaagagataaagaatcttgtctgaagtcacatggagtaaaagtggccaaagcaggactttaagccaggacatctggtctggactcagtgttcttaagccctcttctaaaattactcctcactgcgagagacctggacatgtttagagaactaaaagtagctcagagcagccagcgtgaacatgggggaaaagctggaagtaagtctaaaaaggtagcaaaaggcttcaaatcacatgctacatagcttggccttcaactggtaggagatagggtgcaccccaagacctttaacatatgatgtttatgcttggatatgggcttctctgatggctcagtggtaaagaatctgcctgccaatgcgggagacgtgggttggatccctgggtcgggaagaagccctggagaaggaaatggcaacccgttccaatattcttgcctggacaatcccatggacggggggcctggcagactacagtccatggggttacaaagagttggacacaatttctcaactaaacaacaccaccaatgccttggatagataactctgtggagcacaaacttaggagatagtagaaacagtcggtttcgtgcca

SEQ ID NO: 31366 - DNA, 1345 bp, Bovine  19866881022992
gttcttatgttgaaatctcctatttattttgaagtgattaagagaggacacagtctcttgtaacacttcctgtaatatattttgttattattccaggaaaaatttttgatcactgttactcatttattacaaatgaaaatactaaacttttggaatcaaggaagtaatattcagttgctttcttggcccgccaccattcatacctttcacttttaccactgccaacattcctttagagccctttgttcccgaaacatttcttcatctcaaccccaagagtaattcttttttatattcaaaatgaacaatcttcatgttggataacactctcaatgttatcactacaaatgggtcaccagtacttcatatgctatcatccatatcatataaagaatattagttaaaattgatgaacaaaggaataaaattatgaaatttggttaaaaatgaagttctaaagtcaagatctgattttaagtacctttatgttaactactcatcagtttcatgaaataattactagtctttattttcaaattttacacctttatgtggtttctattctctaaaaaggaaaattagcatcttttctgaccttttgtgtaaaacctttaatgtaaggcaaattttaaggaagataaaatatcagccaacatattaacaactgatgtttcaaataagtggttaggtgagttggcaaggatgattcctcataaggaaactattttgatggtcagaataataaagccaaagagctctggcacatgatacttttaaaaaatgaaatataacacaaactttcaattgcacatgtaattccaatagcccagaaatcttatggtgaataataaatgtatattaaagcctttgtcgtgtatgcaccactaaaatatttggaatatgaacatcttggaaataattttatgactatttttatttcttccttattttctaactcagctgcataagccagaatcctaggtgtctgacttgatttctccctttttctcgctgcctcacaccttagctccctcagcctcaaaacaatttaatgaatttttaagtccatttgcttatccttctcaaattcatctactttccctaacccactgccagtactcagttcccaaagggctctcatcctgtgctttagatttgcaaagctgcctcgtaaatctttttttcagtgttacctccctccattctaatcgtcacatagcagctagaatggtctatgaatctgagtccatcacttctccgcttaaaagtctcccctggctacttttccatcatcatcatctcgaattctcagctggccgtcaaggctttgtccacacttccagca

SEQ ID NO: 31367 - DNA, 3272 bp, Bovine  19866881031011
ataagacgaataaaaaataattaggaatgtcaagtttataagcacgggcttcctaagcagtgcaatgataaagaatctgcctgccagtgtaggagatgcaagagacttgtgtgcaatccctgggtggggaagatcccctggagtaggaaatggcaacccactccagtattcttgcttggaaaatcccatggacaaaggaacctgtccatggcaggctacaggctcatagggtcccaaagagtcagacacaactgagcgagaaaacacgcatgcacacacacacacacagagttaataagcacttctgcattagtaatgtcccatcagcaagatagtgaccagaatgcttctgttcacaaagtttccagagctcaccattgctcacaacacaaaacatctaagcctttgcatgtctcctcaggcctctgacagcttctgactcatctttcctgacattcacgccctcccattcccaccagactctctgctcttacacacagaacgatttgtaatcctcaaagagggccatgttcttctgtctcttggcctttgcacgctctgtactttctaaaaggctcacccttcccatcattgccacccctcccaaccccacctcgtttagctggggaactgtcactcattcttcggggctcagcttctgagtcaggtcctcggttaaggctttcctgacacttcacgctctgacctgaaagagcccaacaatgccttcacgtcagctttatgcctggtgcctaccttcagtacatacctacctgcctccatgtagagagcttcccaggtggctcagtggtaaagaatctgcctgccaatgcaggagtgcggattccattcctgggtcaggaaaatctcctggagaaggaaatgacaactcacaccagtcttcttgctcctcttgcttgtagctctgaaacagtgggtaatccttagttacatccattttccctatcttcaggaatcaaggtcgtctacaagacttgcgcgtcttccaagtagcacaaagcctaaacagtaagacctttgccggagttattttctaggaacttggagtccgctgcagcatctagttggagttcggctgtctgaaccgtccaggaccaccaaccctccacctgggcacacgagcttctgataagtgaccttttgactcagaggactgaaaattccaccctcaggtggtgttaagcgcctgtgtattttgcagagacctataactgttacacatgtgcacaacaccaacaccactttctccagtcaccgctccccacgctctgcacgccgcccacgcccactatgtgcccatgcccaccaaaccagcccccaccacacccccacattcagactgccttcttctttatttttatctcctgtaaacctccaggctggagaatcccagagggacctggtgggctacagtccatggggttgcaaagagtcggacacgactatgcaactaaacacacacacacaaacctccagggaggcagattttagagttgttcccctgtctcctgggttggccgccttgcgaataaaccctctctttgccgcaaacctgagcatcttagtgttttgatttactgggcaaaataaacctggtccagtaacccttttagtggctagctggcacttaaaagtgttcagtaagcatttagtaaaaggatgggtggatttagtataagaatggtgaagagtaaggatttgtcaaggttttccaaactagcagacacagagatactgtgctaggttttagagaaatgctttttacctgtataatctcagcaaaaaaataaggaatctgaggctcagagaggtataatcacatgttaagttcataattagtaaatagtggcgatggaaaggtaatagtaacaataatagtaagtagtagagtaggttcctttgtctccaaagccaatagtcttttcacaacacggtaagtttttatcctactgagtatagctgtgacagaaataatatatacaacaaggcattttaaaacacaaatgtcctgagaaaaagaatatgggggtggctactatagcttgaaggaaacagttaatacctagctggttttgctttgcatcttttcacaccaataacttaccaaactgtaaggtagccagccttctgaaagacattcctatcgggaggtcatacctgaaaattactggtgtccggtgttaactctcactacaaagtcctaggaatcttgtcaccaagcacatataggttgctagttttttaatcaggtttatttgtcttaatacaaactgatggtctagagggtcatcagtagtgcatgaactgtgggcagaaagaggctaggaaacagagctgcctccatcccaagtgtgcagggttaaggacctgatcgacagtataccacctgaagcctggtctgaaaagtaagctagtgggcaccattctcttccagatgcaaaagtctcttagctctgacaagctggagggcctgaagcagtggtcagctgcacagcagtttgtttctaagatgacaaagagcagaaaatacaaacaaggcaaggttggagacctcggtcagaggccctgggtgatcccagtgttgccaagagcctgaacttggtagtgtaacttctttgcttgaaagccctcaatcaagcgggacctctgaggcatacaactgtaatttcaaaccacaaaagaaaacacaaccctctcaaacttttattttgctgaggaagcggatgatttaaataagtctgtttgacacatgcctatctgacttcccagttcccttaggtttcttgcaagtcagccataaagctattccccacttgttctgacaggatttatgcattctacatctggtattcagcaagcatatttttcttcctttttcattgaacttctgcccgtacacacatacagggtctcattttaatagtgggattattccctgtgtatttaaatacacaggaaacaggaaatcatctaaaagaacacaatgatctcatggttatatcactttcccccacaagtccatttggaatcagagacaaagagaagattctggagcttatagcttaagagtttctcaacctgagaggccgactgaccttaagttccctcttctggttcttaacacagctcaaattaacaaaatgaaatagcacatttattccaagacacggaagaaaaaagggggctttttttttttttttttcaaaataaatctgtgttcagctctcagaaaaggaaagaggcttctcaca

SEQ ID NO: 31368 - DNA, 821 bp, Bovine  19866881037539
tctctgcctctttctttccaaggatttctttggcgtgtgtccttcccatcttatcctgtcttgatgtctgcttcttggatggtctgaactgacatagggataaatgaacaatagacattcactatttatttgaattttagctgttttactcttccctttatgattccaaatcaatttgctttctttctatgaacagtttcttcctgttgttggatatagagttaaagtgagttggaattttgttaatttttaatggaaaagtaggaatgatcttcctgtttgttacgaaacaactcattatttcagaagaatgatagtttagaatttactgaagaattttaagaagaaatgaatattttaagtgaaagtatttcatatcacttagtcttagactttacatctaaatggactagtaaaatctacattggtgtacaggatcactatatatatatgtagacatgactttgaggagggccagctaaagggtagtagagagagtcaaactcctgtccagcaaaagtccctccactgtctgcatttgctgtcagctcctcctctgtctcttctgctggcatgtccagccagtgaatctcagatgacccaaagcatggaatttcctgcaaggtagcagaagggacaggaaacaccatgtgcttcctggttttggaggtggcacagggatatggagcagccagtaaaagcaaacagcctgaagtgggaagggatttggtgaccttgtcaacagagttttgcttttcagcagaatgatacaatcacttgtcaaacttcaatctgaactcagtgaataactactgggaaca

SEQ ID NO: 31369 - DNA, 1680 bp, Bovine  19866881065105
taatgtgatactttataggtaagagacaccaaacacagttccaatgtgtgaatggggcgtaaagtgtataagccttgaaataaatggaagctgtgcacaaacagtaataatatattgtgctctggattatttgtgccttgtttcatacttcctttcccatttaactatgtaacagtcctgagagacaggttagagatgattgttattccacttttagaaaggaggaaaatgaaattgaaggagggttaagtgatttgcccaagaccccaaagtcagtctgaaaatggagattgatataaagaggctcttggttggtaaacaattgcaactgaactatatctgagttgctttcaacctagcagctttctttagctttcttccttttgcaagcaaggttgttttatgtgcaaacttcaagtcagttgtcaagaaaataaattttatttaaaagagttggaatgacaccacttgtccattcttccctcttattctctcctgtccatttccaaaattcaggtgaatcatgagatatccgtttatttgtcacatatggttatatattgtcacaaagtaaaagggtgaggtctccggaagggaaagaattaaggtggtattagtacagtcaaagcctgctttatgtaatgtcagtgcagtagaaatactgtctttactcagcggacacctcctaccacatggcaggtgcttagaatacagaagttagtaggctattgtctcgttccacatgaggcatctcatggaggaaatgtgtcagaaaacactaggcttatcccatcactgagctgtccagtatcagtcaggacccatcacttttttacctaattatcacaagtcaacaggaaatagaatagagacaaggggaaggaagatgaggggaaaaaaagagaacaagctttattctgacttgagctgcagatgttcaggaaacttgttcctgatagcaatgattggtgtaatgattgtagctccaagattactaaatgttcttaagtatgtatagtgtataaaactggagtcaaaaaatagtttatcctcttgattagcagttcagagctatttctctttatttttacaaatatgttatatacccctcttttgtaatgctgtctgaatgcccaaagagtaaagtgttctgcacatatttggcaaggctttatggagaacatcctctgctaatctggaaacttcctgagggtggaggttcatgtcattcatctctgtgttcctagtacttaacaaaaaatagaataaattatgattgaaaatatgacatttttggaaatcagtcaaagtatggaaagattgggcttcccaggtgacgctagtagtaaagaacctgactgtcactgcagaagacataagagatgcaggtttgatccctgggtcaggaagatcccctggaggagggcagagctacccactccagtattcctgcctgaagaatcccatggacagaggagcctgatgggctacagtctatggggtcacaaggagtcggacataactgaagagacttagaaggagtagcaggagcatggaaagattaacctactagttattttctttttttatgacagttttattgatggtttccctggtggctcagatggtaaaacgtctgcctgcaatgcgggagacctgggttcaacccctaggtcagga

SEQ ID NO: 31370 - DNA, 1603 bp, Bovine  19866881181680
tcttctccaacaccacagttcaaaagcatctattctttggctctcggctttctttgtagtccaactctcacatccatacatgactactggaaaaacatagttttgactagacagacctttgttggcaaagtaatgtctctgctttttaatatgctgtctacgttggtcataacttttcttccaaggagcaagcgtcttttaatttcatggttgcagtaaccatctgcagtgattttggagcctccaaaaataaagtctgtcactgtttccactgtttctccatctatttgccatgaagtgatgggaccggatgccatgatcttagttttctgaatgttgagttttaagtcaactttttcagttttctctttcactttcatcaagaggctctttagttcttcactttcttccataagggtggtgtcatctgcatatctgaggttattgatatttctcccagcaatcttgattccagcttgtgcttcatccagcccagagtttcttttgaggtactactttaatatatctttatgcaatattgaattctactcttttacctcaaggagttgttccttttgagattattcataaactcagtgagtgagtgaatgcttaattccagcaaatttgaaaagctttcttaatctttgtgaaaaccatttggtaagaacttgcatcttttctaatcactagtacgtctttcctctcctttcctttcctcctctcttacttcttccctccctcattcccttccttccttctttctatctgaacccatagtctaagaaaatgaagtttctttcaccagaacaaagacaaggtaatagctttaacgtaggtgttattttctttggtcctgcaaatcaagtggcctacataatttaaaatgtgaaccctgttgggataaagtataccatcactctactctttccatttaaatttattgctagaaatattaatataaaaatttgtggacatataaaaacaatattacaaaagtcatgacatctatagagatgatttattttaatttacttttcagtgttaataatggttctaaagaaataggtaaaaatagtcagttggcttttgaaaaatatcagttcccagaattatcttaatttggtttaaatacttgtgtcaagcaaatattttactttttataaagacaataacctctaaagaaactatatcaaatcatttataatcttttgtacataattatgaggaagttccaaagtgctagttttgcttggagctttggaaggctcaactgattctattttattttagagcctgatggagaacacttttgcaactgaaaggcaatatttggtttgaaaaatgttaggtacataaaagtttgcctatgaaaattctaatttatgttttagtttagattacatgtggtttcttttctgaaagccctattgctttttctttcttttaaaaaagtaaaagaaatggcatcctactagggtaattaaagagcaatatttatgcaaatacttttagaaactattcatatcttcagactattgttttttaaaattcacaattttctatatatcaatatataagtaggggttcagatcagatcagt

SEQ ID NO: 31371 - DNA, 1925 bp, Bovine  19866881182333
ttgtttgaggaatatctatatggatgggtctagtgaagaagaaaaaggaagttaatgataatactactttcatcatggatgtttcctctggatagatggaggggggatgtgagtgtggagaaaaaacagaaggaatatcaaagatgtggtgctgtaatgttctcttcccgtgcttatggagggtaactgagtcctctattaacattctttaaattgtacataagtatttataccgtcttctctgtgtatgatatttcacaataatacatgttatttttccatctttatattttttttaatgttgtctgtataatttttaactgctctctgcagttgctatggaaaatgagatatctgggcaacagggaccagtggtaaggtaagatgcggagcccagggctggtagggataagaatggaagagtcagcatctaaaagtctgcagctgcaccactgggatcctcaacaaacaagcagatgtgatcacaggagtgggtctaggatgagtagagcacatctagcccttcatcctgcttatatatagcagaagctaccaagtatccctcttaacacccttaactgctgacataagccagagcatgtttctgttgcttgcaacccagatccctgattggtgcattgcttttgaggtgtctatgggaacaggtgagaaggcttaatattgccattagaaatacagcttgaaatttaggaaggatgtctgagcctgacgcacaatattcagtcaaaagtgtgactacatatgacttcacaccagggagggtgtgaagcataaatcccaaagaagactcactacaacacctagcaggcatccaacttcacatctgccagtgtcttgtgctgagatgacattggcacagtcttgatacccatgagtcccacttctctacaaaccagggtcacagtcactgctttaggaacataggtacagcctatggatacatccgaatactcactgactgtatttttaaactttatttcattacatgacttctacaccgccaagaatattacttcacgatctaaagaaaatttctctaagaatgatcccatacttttaaaacatatcagagtattcctctgtataattaacctacattcttgtatcagaagcataaataagcaagagttaaaaaataagttattaactaataagttagcatatagttacatactagtaattatatagttgatagcacaaagctctaccaggccagtatatataaatctttacactggacgaaaaatatttaaaacattagaataaaaggaaaaagcaaaaacatttgattgtgaaaaaggattcagtaattgcagtgaacatctcattaaacacagtctttatttgcaagaagattggagagctctaattaagtcataagctgtccctctgagtaattaactgtggcaggaaaattctaggtggcctgttaaatctccatacccacagctgttcaggggaaaagtataagcaagcccagcatgtgcttgattttagtggtgaatttttctccaactggatggtcttgtccaccataggtcatacataccaagaactgggatttaaaaaaggaaaacatttcatgaataattttatatgagttctatgttggagtgatcatttttttaactactagaaatacttggctactagaaattttaaaatttcatgcatctcgtatttgtggtttgcatgtatttatatttaatgaccctttggatttgtgggctaaaagcatatgtggaaatatttttaaaaagaagtcagagtatttgtgctatagaatttcaaactagaagaaacttttaaaagtgaatgatgtaaaatgcttatatgttctcaactgagcccctactttctaccacacacactcacacaagtttgctgtgcatctcaaactagga

SEQ ID NO: 31372 - DNA, 3092 bp, Bovine  19866881236091
caataagtaaaggatttttccctgtagcaattatactgttagaaatggagcagtatctgatttacttttttttgaaaagaaacagtttgagtgtcaattttctttgcattcttgtaggaaaaacttattggaagattcatttcaaatgtgagcgtctttaaaaaagcaacttttcaattgatttagcattggtaaatggaaactaatctgtgtacatgtgtccaagcttatatatatcaatagcttgctattcctcaacagttgaaatatgtagttagtatattgactagcacttctagttcctctgctattagtttatttagctattgatttatttaggtagaaagttcttttcttacatttttattgaaggttagcttaaattctgataaatatccagttcttagatgtacacttcattcttacaaagttaacacatccatgtaaaaccacacagatcaatgtagacagcttccctcgtaccacctcccggatattacctcccagagatccagactcactgacttccatcaccatcccctaactttgaaatttttaaaaatagaatcagatagtgtattctttttttcatcagcttctttaattcagcattgtctgtaagattcatccattctgctgcatagctgtagttcattccttttctgtttcttttgctatagagtagaggtcagcaaataacaacctatgggctaagattggcccatcacttgtttgtatataaagttttagtagaaaacgtccatgccctttcatttatatattgtctaaggccatttctacactgctttggtagagttgaatagttgtgttagccagcatatgatttccaaagcctaacatattacagaaaaagatttctgagcactgctatagaatgttccagagcatgtgtatgtgcatgtgaatattaattctagaggtaatgaacacttggctatccctagttttggactattacaaatattaataatacagctgtgaatattcttgtgcacaaaattacacattttctcttgagtacttaccctggaattgcaactggtgggtcataaggtgtgtatatgttcaactttaactgattttgtcaaatagttttccatagtgactgtaccaatttacttcccaccagctgtgtatgaaagtcccagaaataatttaacacgtgataattatcattaagtacaagttggaatgcataattcatcattcaactcaatacaaacaacatttcatgtaacagactttaatgacgatcacaatacatttatgtaaataaatcatccaattcataatagtagtaataaagcaggtatattttattttttcattttcagtaaacatacatgagttgatggagtttgttgcataaaacaaatttatagttattctttgttgaacacttagaattaaatgtcccacaagtgatcctaggaaatgcctccccacccacagtggaaccataaacaaaaccccagttcataaattctcttttctgttgagataattaatttccatttcttattttactaaaataatacacatccatcttttttatagatctgaagttacattaagttataaaataaaagttatgatatgaaaattatagttaaggcttctaattgtgaaaaatcaacaggctagcccctcactatgaaatcacacagcatagtgattctaaacttaaccctcatatgttgtttctgtgggtttgctcacacttgctttaggaatgaagcaaaaagcattttcattttgctctttttagcagtttccttcagtatgaagcatgtccaggtgatgataggaaggtcaccattgctcaatatcagaactgagtcaaatgaaagaattataatttccctatactcaagaaacacttttggctgcctggataatgggatcatagatgatttttatttccttccttttgtctctttatgttttccaagtgttcaacaaagactacacactcattttgcaatcaaagagactttaggtagttttctggtttctgaggatacaaagatttttgtagttgtttgctctactaaaccctacacctgacaagtgtcaaaatttgaacacttactctggtggcaaactagttgtaaatggaggggtattttcaacagaagctgtgccttgggataaccaactgctacactactctgattgctacttcttggagataagttgggtttttgttgaactctctcacagagtcaccttccctcaaatgaatggactttctgagatcggccattccctttgcagaatacatgttacatctgtgccttgtgtcataggtaaaaagtgccacccattgacacacagcccatgaaacagcactgacgttgcaaaacgataggaaagtcaagtaactgaggcttgtggttccatggcaaatgaagctttccagaacaagcgctaagagcctgtcgctccagggatgggagagggcttgttaacaatgtagaacaaaatgctgtggaacttccttgggttctcagaattgttagatgtagtacacacacagacacgcatgcgtgcatgaacacacatacacactcaacctgcctcctccccagagaccccatcaaggtggtacaagaggtttttcaattatttcaagagactgcagctttcattagactaaaagacaactgctcatttccaagttcaagatctctattttgttcctttcttctcaactgggacccaaaaagcacaaggttttaatctaagagaataaaggtatataagcagttgttttgcacaaccagttagtttactttcagtatttggagaaaagaaaaggataaatgtttaatagctctaagtgtcctaaagtgtctcaaataaaggaagattctgctaatgtaaaaccatataaagagctacacatatactgtgttttgccaaatataaaagattgcatatgtgtgtgtaggggaaaatttagcagtaggaaaaaaatttaactttacttgattcatcatattttcctgcattttacagctctcctaccatctacatacattacttttattaatatttttactcttttg

SEQ ID NO: 31373 - DNA, 1422 bp, Bovine  19866881237568
tgggaagatctgctgaagaagggataggttacccattccgtattcttgggcttccctggtggctcagctggtaaagaatccacctgcagtgttggagacctgggttcaatccctgggtagggaagattccccggagaagggaatggctatccactccagtattctggcctggagaattccatggacagaggagcctggcaggctacagtccatgagtcacaaggagtcggacatgactgagtgactttcacttttcactttcattttctttaatgtcttcctaactcccatcacttaaaatgtgtacaaaataatgttagggcaaagttgttttgcagtgtagcaacccactgattattcaactggattgagtctctcagcccatctcattttcttatacaaatcttccatggaaacttagtttagagaataatataaattctcaataaagtcttcataattgtttcaataaaccattgataagtgtttgaaggactctttcatgattctgagaaggcaagtttagattctaatctttgaacaatgagacacataaaagtataaaatatgtgatgctgtactgggggaaaccaatgttcttcttggtgcacactttctctgacagtgactttaaggtctgtttgatagcataataccgtatttgctctccatgatgatattttcaaaagttaaccgtaacatccctcttataatctattacagatctaaattttgaaagatgtcattgggaaaacttcccaccagtcattccaagttgtaaactgccctttagatagtggcggaattgattgctctcactccccgtcttctgacttgacggtcagcgtgtcctttgcttcagaagttctgtgataccctaactctgctgtccttttgttttgtcaggcactccaatgtttctcagcctgggcactgttggcatttggagccagataattctttgttcagaggaaatgtgctgtgtattgtaggatgttgagcagccttcctggcctcaaccctttagagtccagaaacactaaccccctccaattgtgacaatcaaaaacgtcttccagacattttccttggggatcaaaattaccctacccacacctgaaagcaactgctctattttaatagaaatatatataatatttttatacatatggttatatgtgtttttcctcaaattataattctgattttaagatcttaataaggaaactttgcttttatttccccattgcctgcaagtatgtaagtagtgttgttggagttacatactacacaacttaaaaacaacaacttcacataaagatgtatccaggtatgtgaggctcagtgtgatgaatgtgtataaagtgtgtcaattaaatttatatgtcacttgactaatcttttatttccttgcttaagaaa

SEQ ID NO: 31374 - DNA, 1466 bp, Bovine  19866881239209
tctcctaaatgaaccgagtcagtctatggtttagaaaacaattcctacccctctgtctgttctaaagaaatgcaacacaaatggatggcaatagtacttcgaaccaatgttaagaaacaaagaacagaacactttcagacagaagtgttgaaagattatacttaggtatttccagctttgatgccaaggctgagagatattccttttgtattgatagaccctcagagacagtgcttgatggatgctcctctagaatgaaggtgacattgtgtgttgaattctctaggtgttcagtaagtcttagagtacctgacctagaaaaccaattcctgtttgccctcaggttttttccatcaccatcaaacaagttattttagaggctatgcagcagagagaagagacactgtcacgcagcccagctttaaaatttccaaagatggtgaacgaggctgcctggcctcatcagctctgtgcgggtgtgtctgtttcccccacaacaactaccagtgtatctcgcacagagttacttttcacacttgtgcacaagaacattagtcacttggggagtcccccacaacaactaccagtgtacctcacacggagttacttttcacacttatgcacaagagcattagtcacttggggagtccccctggaagggctgaatttgtgtagagtccagacagccagccatctgcatggtgttctctccagcagtctctggaacttgcacggtggatggattgaggggttgtgtggggacgagggcagtctttaacaaacaaaagagcaaacattgggaaggctgcacaaatagctttcagaacctccacaagaggttctgaacatgtggaaagaggccaagtgcaaaagaggaattacctcctaaacatcaagcccgcctagtgagaagggaagtttgttactgctgattacaagttagcccttggggagaaggctccagagcccacaagtggacacttctggatcttcagctggtcccgaggcaagggaaaacaactgttaaagaagtgatgctattacggatcagatagcttcattttctgataagtatattataaatcaccttctcttagcacaagaaacctcactgatgaatcttcttgatcatttaaatgcccaaaatacaccataacatgagcacagagcatgacctcaataactcttatagccatggagaaatggtttgacttctgaatggaaaaaatgacatgcagacaactctgacacttcctttgagagtctttgtaaatttccaactattacacatgcccaaaaagcttcccactctgtgtctttggtcttgacatgcctttgaaaagagtgcatgctaagttgagggcatctgtccagatgttcaggtctccacactcaaaccagttaatctggaagtaaaataatcaaagaaaccctgtgacctggaaaccaatctatctcactcataa

SEQ ID NO: 31375 - DNA, 792 bp, Bovine  19866881243301
ggttcctctacgcttgtctgtgcttggttgctcagtcgtatccgactctttgtgaccccattaactgtagcctgccaggctcctctgtccatggaattctccaggcaagaatagagtggtagccattaacttcttcaggggaccttcccgatctagggattgaacccgggcctcctgcactgcaggcagattatttaccacctgagccaccaggaaagccccattccaaatcaaagtatactttggaacaatggtgtttgatatgagacagtattttagaaatcaatgttgccataaaacagacttggaaattttatttagagataattacatgttatggaaatgatctacttaaacttcacgtagaaaatatacatgttactgtgttaaagctttgaattacatatgaatgaaagagatataccataactatctaatgaaattcttaaaagtccagaaaacaaaaaaaaaaacaaaatgaagtgaaaggaaaggagtaaaactttctgtttcagtcttaacttctttgagtaactactgctttcccaggcttatctctactgaaacttgctttgcctttttagatttcctccttcacaatcagatttcagccagatttggcactgagcacctttaaacaagtattccttttcttatcataaagatttcaagaggattttgtacttttctggaccataattatgtgatattattgctggctatatagctttaaatcaagcatgtaataaaaacaagagttaaaggacaaggagactttggtggtgagaggtg

SEQ ID NO: 31376 - DNA, 1052 bp, Bovine  19866881264493
tattttaaaaccctttgaaaaatgtaaaatatcaatcaaatgctaggcatgacaataaatgttctttatacaatatcatgggaaaagagttgaaaataatgactatatttcataaagctattcactttaaaaactaagcagataatttaaccctattttgggggaatcatcatatgtttaaaaaagttgacctatatcaactataattattgaaataagctttattttattaccacacccattttgaagctaataaaaagcagagccttttcacattattaagccattccacagattgagataaatgttctccactaatgagaaatgccaattttgagagagtctgtgtgttttgaagccaacataattcaaggagtattatctattttactaaaaaataatgattttcccacagtgtagtgccatcacagagaaattaaatttatggttagcatatttctcaattgtgaatattttgccttgctcattaggttatatgtcataatattggcttctatttctggttaaaaaccacgtaccaaatactccatctagtgaaggctatggtttttccagtagtcatgtatggatgtgagagttggactgtgaagaaagctgagcaccgaagaattgatgcttttgaactgtggtgttgggagaagactcttgagagtcccttggactccaaccagtccattcttaaggagatcagtcctggatgttctttggaaggaatgatgctaaagattgaaactctagtactttggccacctcatgcaaagagttgactcattggaaaagactctaatgctaggagggattgggggcaagaggagaaggggactacagaggatgagatggctggatggtatcaccgacttgatggacgtgagtttgagtgaactccaggagttggtgatggacagggaggcctggcgtgctgcaattcatggggtcacaaagagttggacatgactgagcgactgaactgaactgaactgaaaaagactagaattatctaacatatatttttttcaaaacacacacaaaaa

SEQ ID NO: 31377 - DNA, 1385 bp, Bovine  19866881351656
tatggggcctatgcaactaccacaggcccagtgcccataattcagccctgaatgggacttgcaggaagctgaaagctctagaacccagatttacaaaggataaataaactttgcatccgtagaaggtagatgaactctgtgaggttaatgaacggtgttgtgtgatatgtagcattacccgtgcaggatgactgggcagctgatctccactattgggtggatacagacctgttcggagatctctgtatatcccaggagggactgagaagttaaaaactgcattcaagtggtattgatgctgtgattaaaagtaatactatgtttctacacaggtcaaaagtattttacatcataacatttgatgtaatattacaatacacctaatatactgttggaagactctgacatgattgggaagactgtttttaagactattttgggtgaaacatgtttagaaatgttatttcttattggaatgtccattcaaacatggggaaaatatcgacaaaagtgacttggcgtctataagcatttctgggtttttaagaacttgtggtggcccagaaggtgacgaaatctgcaagtgcacaagcagtgtgggctatgtgttagggagaaaggttctcttggagatcctcactctcaagatgtgtattccagcctcagcaacaagcaaactgctgtccccaggataagagatggtatccagggtctcgggaacatttgtttccatttccaggtggagatatttacttatactaactcaccacaagatcaggtgctagctctactttgcaacaatttggtctttggcaaagaaaaagttctggccttaaatgtcttgaaaaagtccagtttaaacatacaatttcttgcccattccctgtggtatttaaatataaataagacatttggtgtgatgcgaaccaactctgaaaggaggacaatttaaacccaaactgccttttattcagttggtaatatttttgaggaaaagtgttctattcaaataaagaggggaaaaatagactaaatttataccatatttttattattttgaaaaactttaagtacttacatacttttcatatattttaccttttaatatttacagattggttcttctaggatatcacatactggatgccgattttaatttctgcacagactcatggaaaactgcaatttcactcaaaatttctattaattcatctaaaaatatcagagcttatatataaaacattaaattcattcacaattgctttaaaaaaggaattagatgttttgatgctatttagatcaaatgtgctgtgcttaatcactcagtcatgtcggactctgcaaccccatggactgtagcccaccaggctcctttgtccatgggg

SEQ ID NO: 31378 - DNA, 618 bp, Bovine  19866881533077
gagacataagacatgggttggatccctgggttggaagatcccctagaggagggcatggcaaccactccagtattctcgcctggagaatcccatggacagagatgcctggtgggctacggttcatagggtcacaaagatttgaacatgaccgaagcgacttagcacacatgcatcaaatgtatctccgtgcaactctggttttttcaatgtaatgttttggagatattgttattgaaccaaactggtctccaaattggtggaacaaatttatatacctacatccttctttgtgtattttttaaaaaaaatgtccaggtatttaatactatttatattaaataggaaaggatagagaatcagaactgaaaaataatgaatccattttcccttttatctttccttacttgatctaatttattggggttgaggaatggaaggaagatgactagaaagtgatatcatttctattggatactaaattttctgtcaaattggtgcttacattctttacgttttgttctcaatattgaaacaaaacaaaatcaaacaatgataatgaccaggaatctcataactgaaagtgacatggacatgacttctggtttattattatatttt

SEQ ID NO: 31379 - DNA, 1422 bp, Bovine  19866881610722
atcttgaccttggacttccgtctccctgaactctgggaaaacacatttctgttacgtaagccactcagtctgtggtgattttttacagtaccctgagtagatgatgacagcagtgagtaaagccaggtccaatgatctaacaatcaactgaagagctcaccatctcatgcttattgagcaaagtgatgaggggtgcttttaaacatggcctagcaagctaaacttggtaaatgaaccgggaccaggaattccagctaatctttggacatattttgttatggcacctatggtcattaccctttgcatttgaattaagggcaaacagaattatcattggcttctaacataagaaagcaacaaatcctgccctgatcatgtggtgggggagggagaaaaccgaacagatctgacctaaaaggttaagtggaaaagaagcatgtggctagatgagcatcacatgcagacacatcacaaattgtgtgggctttgacattaccagtagaaggaaaggaaatctgtatatttttataatcactacacaggtgcttattttagattgttttcttgaaagctgttagttattctttttttttttttttttacctcactgccctgtacttgttgcctcaaaggaagcataacatgagataaaaatacagaagctgctctccggagttcaacaggttaaaacagagctgaaaatagcttctaggcatgtcatatggttggctgactatttaatcctctgataagtatgagacatggaagccttcttttatctgcatatctaccaactgtccatgaaactttactgtcctcgggatttttgaggacatggtcatggggaaattgagtttactaagctggtgaaaattacaaagttctcctctgctgatggacaaaacctgtggcagaatgtgtactttctgtttgtggatgagacacaccttgtatgttcagatattgtgattccattcagacagaaaagaagccctgcatgtgtagaattggaattaggtagggtcccagattccaattctatacacacagaggtccatgactgtttgggcagaatcacaatcctggggcttcccaggtggctcagtggtgttgaatctacctgcagagcaggagatgcaggaaacattggtttgatccctaggtcgggaagatcccctagaggaagaaatggcaacacatgctagtattcttgcctggaaaaccccatagacagaggagcctggtgggctacatacagtccatggggtctcaaagagttggacacaattaagcgatagagcacttgccgcagagggtctcagataaaggatgaacacactgggacagttataaaaataccactcaaccctgagggtggtatggagacctaaggttggaacccaaaataagggatctgatgga

SEQ ID NO: 31380 - DNA, 953 bp, Bovine  19866881781868
atgaagataatctaattctgacagaaaatcacctgtggacatggttttatctcatttgatttcttctgttttctgctgaggatcagagtatttatttaaagtgcttcagtaggatatcccagttagagctctgacagtctgtttacagttcatctctgcccaggggcgactcaaaggtacacttgtggataagtaagatgactcgcgggcaagaggaggaggatgtgtggcaagattattaactttgaaatgaattagggtagagtgacatgtctgcaacagcaccatgggttagtcatttaacaaggattcatgtgcagagattcttaccaattctttagtgtaagtgaaactaacatttaaggagagggaataaggaggatgcacaaggatctatttgacagtattaaaaaaaaaaatccttctagcatgaagacatttaatcttcctttgtcaaaactattctgtctgcttgaaaagttggcctaggaccccaaggcttcacggtaaggagggagaaagaaatcgcgagaaggggcagctgcccttttgggtggtggacttcaacatttcttttcttacccagtacttgaccttctgctcttactttgctttcgtgaagtaggtttgtgattgctctgaccagtttttccattcatggttgcaaaaagtattagctttatactttcatgatgcagaaaaggagctgtccactgaatgtgctcgcctttttgttccggtctgtttttcttgcacagagtgggtactgtgtcctggtgtctgtctacactgggagatttaggtgttgcaagtcatcttgtctgctctaggctatgagcctcaggacttaggtgcccctgaaatgctctgctttctgaaatttggatatttcagttaacttgatttatttcttcataaatttcatctctacttgggagaggctgattgaattt

SEQ ID NO: 31381 - DNA, 1411 bp, Bovine  19866880271813
atgcttgaagaagtagtagttggttggtgagaggtcaggtgaatatggcacataaggcaaaacttcgtaaccaagttcgttcaacttttgaggtgttggttctgcagtatgcagttggccattgccatggagaaggcagtggcaccccactccagtactcttgcctggaaaatcccatggacggaggagcctggtaggctgcggtccatggggtcgctaagagtcagccatgactgagcgacttcactttcacttttcactttcatgcattggagaaggaaatggcaacccactccagtgttcttgcctggagaatcccagggacggggaagcctggtgggctgccgtctatggagtccagagtcggacacgactgaagcgacttagcagcagcagcatggagcagaattgggcctactctgttgaccaatgcaggctgcaggcattgcatttttcagtgcatctcaggtgtaatcatttcaccaggattcagaaagctgtggtgcatcagaccagcagacagccaccatgacctttttttgttacaggtttggctttggggagtactttggagcttctcctcagtccaaccactgagttggtcatctctggttgttctgtaaaacccactttttgttacgtcatctgatcaagaaatggttcattgttgggtagagtaagagaagacaacacttcaaaacgatgatttttctgatttgcagtcagctcagaatcccagggacgggggagcctggtgggcttgccgtctatggggtcacacagagtctgacacgactgaagtgacttagcagcagcagcagcagcagaaggcacctgcttattaagctttttcaccttttcaattgcttcaaatgatgaacatctgtagaatggttgacgttgagttcttcagcaacttctcatgtagttgtaagaggatcagcttctgtactaacactatatgttgcagcctgctgcaaaaaacagaggaggaagtgactgaactgtacgttgttttttcccattaagttttaggtgtcattcagaaaaaggagttgaaggttcatggttggcttagttgaatggtctttgtcaccacaggaaggaaataccctcagttctctcctgttcattgtgtaggctttaggtttgtaggacgaagtgagccagcctttactgtaagccagcctctgggaggaagtcctataaattccttgcatttataagcagaacaaaatactgagtaacatgatttctttatgcttcagtatatattcaggaaaagtgttgtgtactcttggtatggtgatgctgctacataacatttgtgaaactgttgttcattatttaccaaggaatggttatctaaggatggggaaaagaagatgggaaggacaggaaagagatgatg

SEQ ID NO: 31382 - DNA, 692 bp, Bovine  19866880434990
gactgaggccatggtgaccctggagtttctggaaggctctatttccagctcctcccccatcccacaatcaggaaggaaaggaaggggcagccctagcaagggctggactggcctctcccacgatgggtatcagggctccctggggaaggctgtgccgggcagtgagcccaacttaggctgtgaaggatagtggaggtgcaggagggagccctggcccccttcctccaccttctgaagtggcctgggtctcacagagccagattgctaacccatcctgcaataaatagccttggtcttgcttcctcctaaagtttcctggggtggcctggcctcctggaggtcagggatcaagggctgtcagaagggaagtcacagtggcttccacagcctacatctcagcacagcccaggcctccaccccctgctttctctgcccaccagtccagctgtggccctggggacagggctggcccctctcagagagctgggtcaatatttgttgagtgactaagtgactgactcagcataaatgccagcgcccgccaagcgctgaggtatgttctgctgggccaggcggggacagggattgagttacagtggcaatgggcagagcccggccccatgccaagcccagcactgcccacaggcagggtgaaggcaggagcagtttccagcaggtaggctgggtgggga

SEQ ID NO: 31383 - DNA, 1717 bp, Bovine  19866880437391
ccacgctgagggtgcacccaactctccggcatctgcagggtgcgtgcactgcatgagaatgaaaaccagacttgagatgtgacagtgacttaaccctgggccttctcttccctctgtctcagggcaactgtccacgggtgtggccaggagctacctcaggagtcttatgaccatctgggagctgcacgggactatggagaccatctgagccaatctctgaattttcaggggaaggaaacaggcccagagagggaaagcaagtttcccaaggctgcacaccatctggcagtgtcaggaaaccgagaggctggtgaatttcagtctgagacttcataaagcttggggagtaccatgggctctgtggcacagatgggcaaggctgggaaaggcctggaaatgctgtcccttcccaccttcctcactacctgatcctcagacaccaaagggccacccggcgacacggtgcagccctcctgttggagtgtggaaagcagcgaggagtgtttggatggtggtatggaaatgggtgggggttgtctgagatgtgatatgggttgggggcaagggaggatcaaccggcactcaccttcatagcaagggatcagcgtcctgcctttggcctggaggttggacgggatgatgtaacagaagccgtggggcaggatgtggtctgtttcatagtaaatgttcttccagcggtgggcacaggcctacgggacagagagaggttcagagcaggacagtcaggccaggaggtcacaaagcagagcccagcagtaccaggcagttctgtgggagcagagcggcacagactggctgggaagccacattctctcccacccagccccggcgccatgctaggcatcagcagaccgtgggagcttggtcgggggtgcccctgggaggcagcagacaatcaacaaacatataaacaaacaaggagcataacaaatgctggggagaaaggacacagggtgatgggctaaggatctagcagtagggaggacggttttcacctggaggccaggggcggtcgaaaggatgagaaagagccaaacaccctgggcacagagggaatatcaggggcaatggagaagaaggcttgcagagccaagagaaagaaaggcggcctgtggggctgctctggggcaagctaaggtcagagagaggacaggggcagtccccggggatcttgcagacctccaggatgactgtgactttagtggatgtgccaatggagggtcttacacaggtgagtggtgtggtctaactcacaacttggaaagataattgggctgccaagtggtgactgtaggtaggtgaggttaagaggtgagcatccaggtgagagatgctgctgcctggaccaggatgggggcagtggagagcggagaagggggtgacctcaggatgcagaggtggagctaacgggcctgaggaccaaaggacatgctgagaaaaagctagagacaagaggtgttgctctgcccccaacagaccctgatcttcacggcaccacctgcttgcccactcgagcagtcgctggcctccatcaaacttgaggcccttcagagtcacctggaagtctcactaaatcacacagcactaggccccaccctgagagctggcttggccaatctgcaggaccctgagaatctgcattttaaacaagctcccgagtgagccgaggccactgatctctggagcaccttcagaa

SEQ ID NO: 31384 - DNA, 1616 bp, Bovine  19866880470297
caacaagagggaactcgtcattctgcatcgttgactcggtcctgaagttccaaataccctcaaaattgctaccaaaggttgtgatctccccgacttgtaaagcccagggaatattacactctgacttaatattctgtcatctcaacagagcataatgtggaaaagtgaaggtggcagctgtgtaaacccctctggagctcaacctttgctgagatttcctgagtacagcaattaaccaagtcagtcttctatggtcaactgttttgaaagaagcaggagtattaagtgattgaaatgacccatatgctcactgtaacttctgcactgccctagcaccttgagggatacagaacatcatctagcaaacccctttatgtacagccgtaacacagggcagaggcctggacttggcacacgcagcaggaaccttgtccttggaatcactggagcttgagaagggctgcaacccgcccgcctcacctcccccagacatcaaggcccacattcacccatagtgagctcagacctctcccatcagcccctggtcccggaattcagtcttagtgtgttttcctgggacaaagagacatctatttcagcagcaagcaaacttcttccataggaagatagtcctgaattaacaaaaaaaaaaaaaaaaaaaatcaaagccaataagaatataatattttacaactaatttttttgaatgtctgctatactgttgatgcatattcttcataaatactatctactcctaatgggctgagaaatttcacaaaattacctttcaattgaacttccagatctttgactaaaagcatccagcctagcctgtgagaatcagagattcaaatggagttaagcaagtaaaatcttaggaccttatgctaactactgtaaggttgccacgggctaccgaattctgttaatacttcactcacgttaccttattcgagccttacaacaacgctacgatgcagttactacaagttctcctcgcatgaggaagctgcagtacagagaggtgaagtcatgggccaaacaccacatacagagctaacacgtggcagagatgggatctgaatccaggcagtctggccccagtgcccacgtcttaaccgctcttcccagaatgtgaagagaatgggaatgggtgagatgttcactttgtgggaaataaaagtttaaagtttaatcagcttacgtttaaaatccattagcgttagttcatgggtcctgaattcccagcaagggtgacttatcatcctttttttcagctccccacactgggggcacagcatcacagccctgctcaagttcacacagccccacgatcaccatcacagaatccctggtggaaaggaccagactttctcgctgtgagaggaattcgagaactggggttacccaccccagcctagttctctctgtcctgctgctgactagaagaacacaaccacaccaggaaaaacaggaagctggtgagcagatacgccagaacaacaggtccactgttcccagcaacgggcaagaagagtggccagggacagtgctgggtgagacctgcggcacggccctcctaaagcacctgcctttgcagggcaaggggaggaaag

SEQ ID NO: 31385 - DNA, 2646 bp, Bovine  19866880562454
gggtaaactctgggagttggtgatggacaggggggcctggcgtgctgcggttcatggggtcgcaaagagtcggacacgactgagcgactgaactgaactgaacacagtttttagctcacagtgatcattcagtaaaagggaattttctaattaactttttaagtactatttttgtctcctttcgtcttcacagaagatatccagcgatcctgctttaatgaataatggagggtagaaagctgggtattgctaaaaagattttaggattccttgaaaatattatattttttaaaatatctttgaaaatcctatttgcaaaatttatttgcttggtaagcgctcctcttttatgtagaggatgtaaaatttaaattacgccatatttaaatgttctcaagtttggaatgattggggtcttaatctgtctaattttactgtcccttaaaatggtcccatggattcccaagatttctgtaccattttctttgtatcagggggtggccaggcctttaattcctaatttcttctgcatctctcacgacagagatcatttatagagaaggaaataaatagatcccctatttagatgcgaagattcttcttctaatgttgtggcctgtggctccacaggggatacaaatcaatcaaggtccatttacaaatgaaaagcagttgaggttttgttttgttgtgtttttgttttgaggagaaccataaaaggctaagttaatccatttaaaaattcaagaacaagacccatacatttttattaaataaagagctctacatttacataggattttatggtttccaaagagctttaataaacattatctcatttaagtaaatacagcaaattaaaaaaaagcacatgcagccccatattaagggccgttaatgcagagaaggacccttcgaggggaagctggagggtgcccagaggggacagctagagccagacgaggggccagatctcttgcagtgactcttgggctcaaggagccccatcaagcttttccttttgtgtgaagaattcttattttgggcacagaaatattctacacttcaaacatgtttccatacattgtgtggaattgttgaccacttaaactctgtcatctaaccgtttccttatagatattcaaatgttatgaatctcctcttctaatattgcttatctatgtgatggatatcttcagctttattccttttagagacactgacagattgagagttaccaaatatttttcaagcagacgctttctgggttccaggtattctgcttggaaagcttaacatttatgattttactggataatcacatcataggggagtaactattcttatgtccattgtacagacaagaaaactgaggctttttggtttcttcccttaaagattactacaaaacattgagtatagttccttgtttgtatagtaggtccttgttgcttcttatctattttatgtatggtatatgtgtgtgtatatatatatatatatatatatatatatgtatgtataataagtagtgaaagtgaaagtgaagtcgctcagtcgtgtccgactcttagcgaccccatggattgcagcctgacaggctcctccgtccatgggattttccaggcaagagtgctggagtggggtgccatcgccttttccgataataagtaatatgtatgtgttaatactaaactcctaatttaggcttccccccttccccttaggtagctgtagtttggtttctatgtctgtaagtctatttctgtatttctgttttgtgcgtgcttagttgcttcagttcagttcagttgctcagtcgtgtccaactctttgtgaccccatcgactgtggcacaccaggcttccctgttccggagtttacccaaactcatgtcgattgagttggtgatgccatccaactctctcatcctctgtcatccccttctcctcccaccttcagtctttcctagcatcagggtcttttcaaatgagtcagctcctcgcatcaggtggccagagtactggcgtttcagttgcaacatcagtccttccaatgaatatttaggactgatctccgttaggatggtctggttggatctccttgcagtccaagggactctcaagagtcttctccaacatcacagttcaaaaacatcaatttttcggctctcagctttctttatagttcaactctcacatccatacatgactactggaaaaaccatagctttgactagatggacctttgttggcaaagtaatgtctctgcttttgaatatgctgtctaggttggtcataactttccttccaaggagcaagcatcttttaatttcatggctgcagtcaccatctgcagtgattttggagcccctccaaataaagtctgtcgttatttccattgtttccccatctatttgccataaagtaatgggaccagatgccatgatcttagttttatgaatgttgagttttaagccaactttttcactctcctctttcaatttcatcaagagactctttagttcttcttcgctttctgccataagggtggtatcatctgcatatctgaagttattgatatttctcctggcaatcttgattccagcttgtgcttcatccagtccagcatttctcatgatgcact

SEQ ID NO: 31386 - DNA, 830 bp, Bovine  19866880573440
gtaaacatgacccatccccctgacttaccacctgttcttctaaattcacacgccccttgagcttaaaaacccagagaatgttttgaatgcctactctgctaattcaattacctactgcctactcttgtaacaaagatatcagaagataacaagtcccttctctgtcatagaggctgaacactggccacaatggctttggtaatataaattttaaattgaaacattatttcaatgttcaaaataaaaatagtcctcataaaaggattgagaaatgataactggttaactggctaatttagcagatctaagatgtttactactagaaagataaataaaagctacacttccattcagcaaaatgtaaactatgatagttttctatagtctgaaagtgcccttaatattcggagaaggcaatggcaccccactccagtactcttgcctggaaaatcccatggacggagaggggcctggagggcttcagtccatggggtcgataggagtcagacacgactgagcgacttcactttattttttcactttcatgcattggagaaggaaatggcaacccactctagtgttcttgcctggagaatcccagggacgggggagcctggtgggctgccatctatggggtcacacagagtcggacacgactgaagcgacttagcagcagcagcagcaacagcccttaatattatcccttatgttaatcacattgctatgattttctattaagtgtcttgatattcaccaaagaacagtgaaagatgacaacaatttaataataaatcctaagacagatactttttatgtatcacccttcattt

SEQ ID NO: 31387 - DNA, 1162 bp, Bovine  19866880626195
ccactacttctctggcctgtctcgctcctctctccccgcctctctctgctgccgccacacctcacccacccaagtttgtgtttctgggggagggattgggcagggctgaatccgaagcatgtctggaaagctggcattcttgggttaatctcttgcctccccagggtagtggtggagggaggggccaagggaagtgacttaaggtaggcaccagctctgacggtaggtctggcctgtctccaagtcatcccagaaacttccccttacacccaccctcactcacacatcggggacaggaaggtcagctgggggtgtgagacgcctgaaagtccaccattagacaactcgtctctgggcaggcatggcccctggatctcaggggcatcctgcagaggtaactaactgagagctggattttaggggagtaatttgggcacctggccagggctgggcccacagaggtccctggttgtttagggcagagggaacagattccagcaactgcaattcagtgcaaagcctctcgcttggctcccccagccccaccacacacagacacacagtccccacactgaacacgcttacacacagcagaagtaatcaagtagagtgcctcccacccagtagaagggagggacagacaggagagaagaagagaggagagtcttggggagctgctgacctacaggttagagcagcagcctggcttctctgaacagggtgtggcccagccctcttttctgactgaacctggctgcatgggccaactctgagtcagccatgcccatccggcccagcaactccaggctccagaggaggcctcagcttctctggcctgagccagaggccagaagagggcctgtgtgcgacaggtttgctgtgtgcaaaggaaaagccaggctgcagcccccaccaggggcatcagagggagaggtgacaggtcatgccctggtttcaggcttggggctcagagctgggaagtgacatgaataaataggaatgatgcttaagatgaagccgagccaactgctggtgttaagttttgtggtgtggctacctgggaagagcagggcttgggggaggcccaatgctgagcagaggggcttgcaggcctctggggatgtcagaggtcccaggactcgccccaaggccagtggagacc

SEQ ID NO: 31388 - DNA, 1879 bp, Bovine  19866880642408
ttgcacaattagtttagatcaaatgaggacctgttgaacctttgccccacaggcaagctgaactttctagaggttcaaagtctctcatttttcagtattcaagtgctcctgggtcctggccttagccgcaagtagaaaagttaatacgcgtgcagaaggagccatgcctgcaaagcgtcccagctctgctgggtgtcaggaatgagtctccggtgggcgttcctgcctcttggcgtttttcatcacgttctttagacatgaggcattggtggaatatatttgcaaaccaacacagatttgcctctgttcatggctctgtttttaaccatgtagtttatttactttctcctcagacgcacagtgagaatgtccatggaccaagccctgtcctaggggatgaaagagaaaacagggctctcttgatcctgttgtcagaccctggaggcctccttgtgaggtgttaacagcccccaacgaagccctcagttaaacaaatgagtcaacctctgatctttccaggaacataaaatagcactcatttaaatgaacccactcttgacctgggtggcagctcactacatttataaactaatttctacacttaagctgaaaataggttaattgctatctatttagacttggtaccaaaaatcttacaatattgtgttcaggcaagcgagcgacttctagaatctcatctagaatccattatttttctgggaatttaaatgagcctggggtttattgacacagacaaagttgaaaacatcactacacactgagctggaattcttcatcacgtcttacacagccatttgaaatctaaagaaaaaggctattagtgtaaggactcaatttttaatacctaatttctagtaattttggtagtctgaaaatctttatttttttaatttgttacagagtggggcttagaatgccaaacatataattcacttatattgtcataatctttttcaattcacaaaatgtttttcaaatgacaaaataaaacgtgtaattttataatcctaggactgcccttgtggctcagacggtaaagcgtctgcctacaatgcaggagacccgggttcaatccctgggtcaggaaggtcctctggagaaggaaatggcaatccactccagtactcttgcctggaaaatcccatggatggaggagcgtggtaggctacagtccatgggttcgcagagtcggacacgactgagcgacttcactgattttataatccagtttaaaaactgaaatcaaagctaccatggtcttccttctcattttagaagtataatcctagtacattgtatacataacttactgatttgacctaagatgaccagacattactgggaatgtctgcttaaaaagtacaggtctggctgtgtccatttacaagagagagaaagagcagttccagaagtgaagcatttggtgggggaccctgaggggagccaggttctagatccaatagagacagatgtttgagctctagattcaatagagacaaatgtttgagctcctaggatagcggtgaccctgcattgggatgacagatttcatgctttcctctttcagaatcatgtctccaacctcctttgtgtacggcgagtctgtggacgcatccaacttcattcaactggatgacctggagtgtcatttccaacccctcaacgtcacccttcaggtacccacccatggagaccttctctatcactgggtactaagggacgggcccatgggatgtgccttctatgaaaagcaaccaaagggccaggctttttctaagagaaactcttcccagcctgagtgtgtatgtgttttctgtaaccacacacagaaacaatccctttgctgcctggtactctg

SEQ ID NO: 31389 - DNA, 2332 bp, Bovine  19866880655614
ggagaggctcccacatgactctagagcacgaggctgagagaagccagggaagtagtgcccagggtaccatgccaggctctccctggggcctgccccaacctgtggtcctggccctgcaggtttctcacatccccagtcaggctctcccaccttgctggcgattctgagagctacccgataccattctaatccattctgcttctgctaaaaggagacagaatcagtctctcctgctggcacctagaatctcaacctggtgcccactccacatggcaatgacttatttatccatttgtggatttccatgatcatcacatatgttgctatttcaaagtatcgacaaaatagatttgctctgtaactcacacaagcctcccatatggccaaagaagggtgtctgggatggcagctctcagtagcacagctggtgtgctgtagattcttggtttgcccccagggagtttctagcctcagctgttggcagctctcccagaaaagtagaaagggttgggttggacataataggaaattcagtgtattatattggcaccgtcagcactgaacatggtcactcagacctcatccagaattctcaggtttgagtctgtacaaagccaggtaagctggtgtggttggtcttgacacatggctaacactccgcccaggaagggcacctcaaatgtattattaataaaaaaggaaaatgcctcaaacatccaggacgtatttctagctattcacccgtacgatctgtaaagcactccccataccatggaatgaaaataaaagacacaatgagtcccaagaaaattatctgtattccctgtcagttgaatttatcaccatgtacactttatgtggttaaaaaccgattgctttccttttctcacccacaccctgctcgctaccagctgcaaatacacttcctgttcattccaaggccatacaaatatggtgcctgatctcaaatcttgtgaaattttgcccgatttaaatttggtggctagcctctatggaaagttcccttccgatcgatgattgacagagtgccaggcattcagaagaatcacgcagggaggaacatgtttgttctaaaaaggcaatcctttctactcagaaaggatttattttttcctgccaggaaagttgagaacagattgtagtacttcatcttggctcatgtattgaaaggcaaagtcatggaaaggagaaagatgggggcactgtggaattctgaagggtgttccttttttcttgggagtacgagaaaaaattcagttgaaaatgagatctccttccaaagaactcttgataatgaaaatatcaccacagtgctcaaaatggaagagtagttaatggaagcagtattttgggggcgcacagatgactcagaatccaacaatgggatgtcaggcaatgtcttttctggatccccacagctctatgttttaatcaaaggcaatgcgcccgtgatagttttttcatttacccaggggattccacctgtaggaaccctgttaattacttccgttagctcttaattgggaacagtgtggtctaccagaacattccaaacctctccctattggccacgtatctcatcctataagctttttaactggagctgtgacaatgcgcagtgactctgcattctttttcactccccaggtgaaggtctggactggcagttaaatgcccaaatggcagggaggaaaagacaaaagccaactccagatattttgatctccagaaacagtgagtctaggagtgaaggacttcagcatcattccactccatcccattcatttcctgttatttaaaatgaccaggtggacaatttctcgatgtgagtcaaggaatttaaatctgcctctgacagttctaccctgaactgggcatggaatacccacgctttggggtagctttaacgtcctcacagattcttatttcttctgtgccagctgatgctcttgtcttctgctcaggactgagggttcatggaggtctcagggatttattttctatatgtacccttcctagccaccgttttataagagtctctttgctgtgatccccatcctaacatttagacatgtggtgtctcccttgttactagaaaataaattaacatgtttttctttgcaagcaaataatctttgtgaatttttcacttctgtaaatttgtcacagcaatattgactctttcaagagagggtaaagtcttcctggagagaagtaaattccaggaaaaggagatgcaaaaagctagcattaccgcatagcttattggcaaaatcagttcagaggctgctgttttccctttctatgtacc

SEQ ID NO: 31390 - DNA, 1399 bp, Bovine  19866880683752
aaattagacaagaagaagtacccctactggcctcacaagccaatttagagcttataagctcaagtccatggggtcactaagagtcgggcacgactgagcaactttactttcacttttcactctcatgcattgaagaaggaaatggcaacccactccagtattcttgcctggagaatcccagggacagaggagcctagcgggctgctgtctgtggggtcgcacagagtcggacacgaatgaagtgacttagcagcagtagcaagcttaagtctgggagaaagctctggcccttgaattgcaaactctggacattaaaaatgattacatagcaaaaaagaattgcaaaggttaccagtaaagcagtgcttcataaagtgtggccacccagccagcagtatcagcctcccttgggataatgtcagaaaagaaaagtcctgggtcccactcctgaccctttgaattagaaactcatggggtggatcccagaaacctcggttttaacagactgattaggtgagtctgatgcagttaacaactgagacagtagaagagctaagagtaactacctacctatcaaaactaggaaggtgaatggtgggaggggacctttatgtaggtgagttcaatttttatctatcatggaaggaattcagtgaaataatgtctaaatccgataaatcaagaagaaataggattgatactactaattttctaggaattttctagggacatggaaataaccatccaaagaaacataaagggacataaccacaatgggtaatagtggttcctcctgagaggaggacccagtatagagaggtgtggggtagaaggttattattttaaccatgtgattctttggttgaaaatgaaagaaaaatattgtccttagattgagaagattgtctaggagcctgagaaaaaaattggggagagtgatctttgctttactccttttcctgattaaaaatatatatatatatatatatataagataatttaatgatcttcctccatgtgtcttccagatgttggctcagtttaaggggaagaaacattctgagagctaggcccactgtgggaagcagagctgttttttgacttgtgtatatgtgagaggtccacaaagagcatctgacctctttcacaggaaggagtaagctcactggagctcttcattttgccagataacattaaaatgtaagtgccatagtctcttcagcgaaaaggcaccaaacccatgctggtgcacaggattgcacaatggagcaggttaaattatggcgatcttttagagtcaagagtcttcccccactgatggtctagttcaggtggaataagtgcacagacagtggatataacatgtagtcaggactaaagcatgttaagtgcaggctta

SEQ ID NO: 31391 - DNA, 1396 bp, Bovine  19866880700399
acttcaggctctttcaaactggaaaattcatgaaatttttcttgaataatttttcagtgatatcttttcttctgtttttctgttttccttttctggaacccccttttacttaaatgttgagccttctcaaataatcctctaatgttctcatcttttctgtctcttggctttttggctctgttttctggaaaatttcctcaactttaccctaaaatctttgtaatgaattttttcattttttctataatgttttcaattcccaagagctttttgttggtggtagtgccattctctaaatgcttcttttcttaaattaacagctaaggcataattcacataacactgatccattcaaggtattacaatccaatgatttttagtatgttcagagttgaaaaaccatctgtacaatcaaatttcaatcatcttcatcactctttccacttcccacaaaacatcccatacccattagtagtcctacccaatcccttacaatctgctcaagtcccaggcaatcagtaatctactttctgtctctatacatttgcttgtcctggatatttcacataagtagaatcatagaatatgtcttttagttagcataatgttttaaaggtacatccatgttatggcatgtatcagtacttcattccttattactgctgaataatattccattgtataggttcatgatattttatatatccatttatcagtagatggacattcagtttgtttccacattttagctatgaataatacttccatgaacactcatgtacgtatttttatgtgtacaaattttcagttctcttgggtatggctaggagtagacttgctgggtcatatagtaactttgttcagtcttttgagaaactgccacaaaagtgaccacaccatcttccatttccatcagtaatgggtgaggattctaatttctccacatctttatcaatacttgatattgactgtcttttttgttatagttattcaggtggctgtgaagtggtgtcttcattgtttctgaatggtgcaaagaaacttcccaactcactctggtagttgcaaacagtgatttaacacaatttagaattaattatgtaccatactttttcattccagttgaaagcggagtactactgaggcatagactattgctaaaagaatatatcaagcatgctaaagaaaagactgaaagaaaatgagtaatattcatactgttaacatagcattagtcaaatacactttcaaaacacaaaagtaaaacttctaatttctcagaaaaattgagttaaatccacatttacctttttagctctttcagaaatgggttggtgctctctgcaatattttttcttgaagaaattctttattctggagaggaaaaataagtttt

SEQ ID NO: 31392 - DNA, 1023 bp, Bovine  19866880737833
cccctggaaacgtgcacattcccatgtagtatttccccagtgatgtttatcacattcaaatgtccaacagaaatccatgactacccagacaccagcatctccaccccttgagcaggggtgttagaagctctctggagaatgaacagcagcagacaccatcagatttacagtaaaataggaacagaggcagccagtggactgtgcacaggtaaaggcaagcacttcaaaccatccattcttctcgaaccctggcgggccagccgtccatcacagcacctttaaaggcagaggcacaaacatcactagtgtttgaccatagggctgcgtggttctgggtttcatgagaaagccatcttgaatgcacagggctgtagaatgttgccaggttctagacttacagacttccttttcatcccatgcgttcacacgctgcaaccatgacaagtcagtgtcactatggcatcctcctgtctccaagatcatctcagcaagatggcaccacgtcagaggagcttccccaccagccgtcagctacgacgggtggtgtttctttttaggatacagatgcattgcttacagctaatgagtgagaccatggaccaacatgtgggattccagagcaatggaagacagagcagtaaccacctccactgtgcctgggcgcctccactcgaggcccagccagagtccatgacccatggtatcctgttccagatattaaagtgaaaaataattgtccaggagactctattttaacctggtaccaaaaggaccatggaaactcaggaggtcagatttttcatttggctaaagagttgggggtgttttggtaacatgggaagtatatggcacagagataggtttccttaggttttaaagcccacaatctcataaaaggtaataagtaaaaacaatacccgtatttaccttaaaaacataaaccccaaacattcatctcatttcttggccttatgttagaattctattgcttcatttacatgtagatattaaaaatatatatat

SEQ ID NO: 31393 - DNA, 2797 bp, Bovine  19866880745040
ggagatatataaatgcaaaaggaaactacagcttatctttcagtatccggtctagatatccaatggggataactgacctcagtgactttaaagttttctgatggttctccgtgtccttagtcagcatctcatgcagtgggcttgggccctcctgcgttagaactggtttgggagcattctttaaacatacagatttgtgggccacacccagtggtctgagtagattactgagtagactctgagactgtggggcctgagataagcactttcaatacaggttaggtgatacagtaagtgttctgctccacaatgatttggcagccattgctatgagttccccgttctctggtccattctacaggctgcttaaggaatcttcttaaaatgcctttctctactgtgaacagaataaagctcaaaatctgaactctggcatccatttggcccctacctttctgagtacatacatcactgttctacaaatacccttttcttggtatcatttccacaccttttgtctcagttgtttccactatcaggaacacctttcctcagctattcctccatggttttcttctcccatcttgccccaacactaatgggtgataagttggcatatataatatggacatggaacaggatttggaatggaccccaagcatggactcccatgatcagcactgaagatacaggtctgaattactctggaacagaggagccctacatttacttggctttgatctaagactgcttctgattacctgagagttgctgaactaccttatttttgttaattccaaagatgcaagaaaataacattagtccagcatttactgccttattccaagtctctcttccacctactcagtctaacagaaatgaaaattccagttggatactgaggtggagaataagcaaaaagagcgaaaaccaaagacttctgtaggaaggacagtgctcagcatatagtcatgactcaaacactcttggatggtgtcacagggaggaatgtcatggatcacccttctgtgcctgccagcaccagcccagccctcccgtggctatgtaagtcctcctgactgaaaggttttaattctgttctccactctccactgcagcaattagggaaagagcctcctcttccctctcccaccctcagagcatgggcttctacatgtagatggtgcaggtactgcacccagaacccctttactggatggcttccagtccctggttgaatgggaactgctttgtctgagaggttataacatccttcctctgcagcctatgattgacaggggtgcagaaggccacccctttgcctcaaggtgagaccagctgtgctgtgagattcatattccagagccctgcgggaacaggctgagagcacatccctgtttgcccgtgtcctctgccctaggctgctcccttattcctcttctcccaagagcatttctgtactaaatcacttgcacaggaatccccatctcaggttctgcttcagcgaaccggacctcaaacaatactctttacagatgaggctgctggtaccaagagcttctggaaagtgctaggcatctgttcccaggtggggagaggcaacagaaggggaccccccacatgctaatgaatgttgttcaaattcataccaatcaaaggaagactttccaactgcaggttatatagctgccccgattagggaagcatttcactttaaagcccatcagcacctcctttgctctggttttatccagagcaggctgggccatgaacttaaaaaacagggtcattatggagccaggtaccagacccgcccccccacccccagtcccttccctgtagtcaggcaggtaccctgcaggcacaagaagtctcagggaaatttaaaaaatgtatttgggatgatatggctaaattaagcctggtttcagacagcatcaagaatagtgatctagttggggagagaatgcttattacctctgcccaggaggtacatgatgagattctagggaccacacttctccttggctctgactcttttcatgccccaaccattgctcacatttgagaacttcaccttcagcactattgcaagacttatgatgaagagctctcagctaatgaggaatgtggaccagggaactgtctaccctttgtccctgattgccagacagtgtagaatctgattactcaattcaaatgcactgaaatctactgaacccttgttgcaaagctgcaggctttcatgaaatcaactaaagtgatgcacagaaactgctcaaaccacttaaaagtctctgatctatctggatctgatgtagttacttaacagttaaagaagtcaaaattatccttggatgataacactttaagatatttcagaagataaggatttaaaatgaaaagatcaagagaagcctttggggaaaatatactatcataaaaacaagctttttgtgattgtcctcaaaaaaacaaaaaacaaaaaactggcaaaataggaagtaaagaatgttaccttatgatataacaggaatagttatatccaaaagctccctatctagggactcccctggtggtccagtggctaaaagaccccacgctcccaatgcaggggcctgggttcaacccctggtcagagaactagatcccacatgccgcaactaagacgtggcacagccaaataaataaatattttaaaacaaaaaacaaaagctgcctacccagcactcagttacttcttctgtttcagaaattaatgcacttccattttaaagatgctaataaagcaaataag

SEQ ID NO: 31394 - DNA, 1420 bp, Bovine  19866880783713
cgttctgtagatttatggttttatgggtctggatatactatctcttcatcttggatcatcattatcatcatcttgaatattgctaattacaataataataatgatgactgtcaaagttaaaggctgagcagattaggaggcatggaacagatctcctgcagttgtagaaaacaaacactttgaaagaaatcggaatcctcagataatttaaaaaaatcagatcttacatttcaaataaaaacttgttaaggtcaaagcaattaaactgcaaattcccttgtctggggcctgaccttcagatcaaagggaaataaacagaagcggcagcccaggtgaaccacaaggctgatgctgctccgtgtccttagggaggcgaggagcccctggagcccccagggaggtgtggctggctttgggcctgacagaggcttaactccatccctgagatttctgctggtttccgtagaatatctgcaaggaaaatggtcctccaacacccacatacgacaccccatggcttcctgctgtcttggggtatagactgggctggggacagcagtcagtgggatatattccatggtaaagggttgccactgatcacaaggagagagatgcagacaccaggccagagctggggacaagaaaggcttgaggctttgtgattcagtacaaatgactgacgtgcaagcagcagccatctgggccgagggtgaagaagaaacgagagtggcttgccaccatcagagccatgtcagggctctgtcaacagtggaagtgtggcacaggcaataaaactgtcaccagggccacttgtcaagaagaggaactggatgggtaagtgtacagaatcataatccctcaacctgagctggggacccaggccaggaaggcacttcctgtgatgtaatattctggaatcaaagggtgaccaggggtggttcatgtcgggccctctcccagctccaccctttttaaaaggagagagagctacaacagggaagcagtgccgtgcgtgtccaacttgcccctcatcagtttcccttcaaagcacccagggagagcagaaccgttgacagctctccaccagccagagacggaaagtgggtaaaacatcccatatcccccgtgcctgtggcttatcaggccaacatgttgctgccacgcctaatttaaaaaataaggctggaatgactattctaaggatattcacttatacactgacagttttatacggactgacacacagtttttccaaaggaaaataaagagaatctctgtggataacatgcctattttatctccacatgattgttttaaaatcaatttgttggatgcagcctttcatactaagaagtgcttatgagaaaataaattacagtgaatttgtattattttttttaaccacttttataaactcata

SEQ ID NO: 31395 - DNA, 1386 bp, Bovine  19866880788730
caattcttcggtgcttagctttcttcacagtccactttcacatccatacatgactactggaaaaaccatagccttgactagacggacctttgttggcaaagtaatgtctctgcttttcagtatactatctaggttggtcataactttccttccaaggagtaagcgtcttaatttcatggctgcaatcaccatctgcagtgattttggagccccccaaaataaagtttgacactgtttccccatctatttcccatgaagtgatgggaccagatgccacgatattagttttctgaatgttgagctttaagccaactttttcactctcttctttcactcccatcctctctgcaaaaagaaaaacgcaatacacggcaataaaggggtcagtagtcaacggctgaaaccaatctttacaggaatgcctgtgctatgctttcaaacttggaaactctggcacttctttgtgacggggatattctagcctctcaatttacacctgttttatatcatattaactttgcaggatcccctcccgaaacattctctaatcccaccaagaatgtggaaacgtgctaacttggtcttgggtaaagatgtctttcataatgactactattgatctgaaagacatccaactgagaagactttcaaacctagcccaatccacgtggctactcttcactgcattttaccaaaggcttccagtttcatcttactgacttccccaaaggacctaagtggacaatctgagaaaaactgaagttcaatgacgtcacacaaaagccaaggctttgacataatctcagatctgctgggccatacagcactagcttactggccccagttgcctcagggaaaaaactgcaaccttccaaggccccgagacaggtgatcatttgagctccaaagctgagaatggatagaacaccttctctgtccagtaaggttacagggaaggccgagccgtggactgtagaaataacttccgcctagaaaaaagatgtcgtcacggggcaagcttccggttccactctgtcccgtggaccgagaccttttattccagttggcagtcgtccataccccaaggctaccccacccagctgctccctcgggtttctccacaccctgcggggccgtttgcacgtctcgcgagtgtgacggttacgtggcgacgtcacttgggagaacggtgcaaagcgagtagcgtaaccgtgatcttgcaggaccggagccttgtcgcggaacagcgcgcccagcgcgtggaggcgggactaacttatgactgacgtccacacccacttactgccgttctgattccttctcaaataagccaatgaaagcgacgacggagacgacaacgtgccctcgccgccagaagtggctccg

SEQ ID NO: 31396 - DNA, 1054 bp, Bovine  19866880790099
ctgcttggaacaaacttcctgcagataaaccacacactcacctcacctccttcacgtctttctgcaaatgtcaccttctcaggaaggctttccttgacctacttaaaactcatctctatccccaggggttcccatcccttcccctacttttatttgttcttcatcatcaccagattataaagtccataaaagaagggatttctgtctgctttgctgctgttatctctagcatccaaaatagtgtctaacacacaagaggaagtcagtaaatatttggtgaatggattagtcaatcgagtagtagcatacattttccagaaaaaaaatctgctaatttgaggcagaacaaacacagaaatatcataaaaatcatgctcgttctccacacaaagatttcatgggcgtcacctcattattaccgtcataagcactggttaacatttattgagctcttaccttgtgtgccaaatactatgctgagcactctcttcacttgcttttttttttccatctaattctcacaataattccatgagttaggcattattgatcttacaaagcaaggcaaacaaaggtaagacaggtcattaattaccgaggggcacagaagggcctagaaaccacaactacatgatgtttcaataccatgctcttaactggtaggcaactgtctcttcagattaaagctaacatttattaactgattattatgtgtcaggttaaattatttacttacaatgtcttatttattttaatttgaaaaaaccaaaaacaaaaaaacacgaggccaacacttttagttgcctatccagcatacaattttcccttctttaataacagaactttgacctactttgtctgaagtaataatgtgcttggataaaaagtgtcatttcatttgcaaatggcccaatgacacagttctgtccaataaaatggaaatgtaagtcactgagtaaggcttccaggaaagaaagccctttgaaagggaaccacctgagctgtcacagactctgtcctttctccgattcttcggtcggaacacaagcacaag

SEQ ID NO: 31397 - DNA, 867 bp, Bovine  19866880795799
cccaactaccaaagaggtccatgcacagaaacgaacgatcaaggactttgtcttaacgggaaactacacaatgagaggcaccatccctgtggtttctgaaatgcttcaaagtatgcttccaaagctgcagaaagaaatgctgtgttgtttcagtcttcacagggtatatgaactccctggtctcagcagttaaaaatataccgtccattacattttatgacaggttcaaggcctgagctcaaaatcaccccagggctcctggggttttaagaatttggtcctggataggtatttcaggctagggtacagcagagccgctacgatactgagagttatatgaaagcatctgtttccctgtgtgagcccatcggagggggagggtagcgagagcgggttctctgggctgcatgtagcgttcactgcctttacaaaaagaatcctgacctctctggggcaggcctgctgcttcatgagccccgagagggtaccgagaaagctgagaagcctgccccagaccttggtggtgtgtgaaaagcctgaaccgtgactgagatgaagaagagagtcaaaataccgaccgcacaggatttccaagctcctcaagtcacagtgggcctatctgctcagcttgggggccaactgagccagcacagttgctttgaatgatttgcagcttagcttcacttcattagcaagagaagaaagcagctcccctcaaacctgtaataaaaccaggtcattaaattccagtgaatttcatcaaaactcattgaccctttggtctattccattctccttgccacgctgtttccactggttttggcaaagatcacaaacagctgtcaagtggcatgatccaatggatac

SEQ ID NO: 31398 - DNA, 1136 bp, Bovine  19866880842842
tgtgccccattccctggctggctggcgcagtggtctgacagctggcctacgggtggataagctctggaagtagtgattcatgctccagagctctctcatgggaccaagctgaggctggacttcttgtgagaccacatccttaactcacttttttccctgccccatcctgtgtccctcacttctgggagcactcttccagcacaggtgcctcagtggttaagaacctgcctgtcaatacagaagacgtgggagatgtgagttcaatccctgggtcaggaagacaccatgcagaaggaaatggcaacccattccattattcttgcctggaggatcccagggacagtccaaggggccacagagagctggacacagctgagcatgcactcatgcttccagtacatctctggcagaaattcccattttggcttctgcttctggggaaccagatgcaggagaccttgtaatcaattccacacagaatttgttggttacaatctcattaaagaggtgagaaaagctgaataaagtgcgagggatgacctagagctcatgtgtgaccaaaacacaagcagatctgagtcattaggggaaaagagtgggaactacacgcagactatcatgttgaccattattctccattacttgcagcttggggttttactttgcccttcttttattcattctcagaaaaacaagagctagcactccatgaattaaagacacagatcagcgctaggcctcctcaaggcaaatctgttttgttttttttttttcgtttcttttttagagctgttcgtgaagcatctttgtctcctgtacatgaggcatcatgttttatagaaggcacagtgcccaaagaagagggctgggaactggccccgaacagctgatgatttattactgcatgttacataaatcatagatttttgttggttttatactttcaaccaaaattatatcataaagccagaggttcttaacctagaagagaattcagggggtctgtgaatttggagaaaaatatgtacatttttatttttattaacctctcactaaaatttagcatttcctttcattataagtgtacacagccaagacatggaagcaaccctaaatgtccatggataggaaaatgg

SEQ ID NO: 31399 - DNA, 2048 bp, Bovine  19866880853450
tgtgctcacacctgagtgtctaccattcagaagcacatggatcctagctctgacactggttatggagtctgccctttccccattgaggctgcagaactgtgggcctgccagctatcctgtgacactctcaccagtgcatctgcactccttgcaggaggctggtgagcgcccattactgcatttagtcaaagttgcggatggagttgtccatgtctaccgcctaagaatcccaaaaggtgaaagtgaaagtcattcagtcgtgtctgactctttgcaaccccatgtactatacagtccatggaattctccaggccagaatactggagtgggttagacgttcccttctccaggagatcttcccaacccagggatcaagccgaggtctcctgcattgcaggcagattctttacccgctgagccaccagggaagtcctaaatgatttattaaaggacaccatgaaacaagcaagagaatgtccaaggagagctgcaaatgaggtttcgtaaaggaatccatgctctaggctctgctgtgggaagatctgtctcccccgggcaaagtgtgcgctggtattccgaggggagccagcagcactcagcacagtgcctcaggcacagctggggtccgtacacatccgtcctagctgaactctcagggagagctggttcctttgcctgcatctgcccgttgttacctcagggcctccacccctcagtgagaggctctatctttaacttccttctaagaccagcctagttcatacccttgaccctctggcttctgtctactcccatggtcactgggaagggaagcatgatgcattccgcatctgcctgtatcagagtcaactgcaaaaaaacaaagacacgcgtgctccatgccaggttcgcaagcgcccagcactctcatgatttgccaaaactttaggtatctttgcaaggacaggccaagtatgtgtatagaaaaacctgtctcccctgcagttgagttctgtgtcttttcaacaacactcacaggccccttacatgttagcctccagtcaacaaggccctaggagagagatggtcttgtttcttgtttcattcgcatctgatgccatctgtttgtgcctgcggcttgagcaggctgtgataagtctctgaggactctgtcagaccctgttcttagacacatcttccttcataccagatggctttccagcagcggcaacagcagccagggctgctccccgttactgagtgttcaccccaggccaggtgcagcgctcaacacgctacctccaccctctccttgcctttcagagaatcacaccgcactcaaacctggatagcactgtgcatctggtgactaacacggtcaaacagagagcttgcacggtgaaggccatactcggccttcagctccgcaagggaggtgatgacgtcagcgctgtgcccagagccctttacatcgtttctgtgtgcctcccagcttggggtgcagctctctttttgaggactgctcctgagctatggaggctcttttgctggcatgaagtgaaaacatgtttatatgtgccctgaagtgacttccttacgtggcctcctcccctttcctgtcctgcttccctcatgtctttactggtgtgccctggggaaacttccttcataagttactgtgtgaaaatccttgtctcagggtccacttcttaagaatcccacctaagatacaattttaaaaaaaagacaggttgaatggtcatctccgggaaggactctgcaattaccattagctgggacagcaagagtgctggggacaatggagacctctgactcaaattaccgtgaaaaggcaacttatcacagcattcagacacaagtctctgcctgacggccactgatttagtcctggtggtgtgtggactctgatgcactttgtccaggatgagatgccattctgaggtttaccagataaccaactggcactgctccaatctttcaaaatgtcttaatccaagtgaaaggagggtggaatgcctgctctataaggtgatgcagagcaggccgca

SEQ ID NO: 31400 - DNA, 1296 bp, Bovine  19866880861525
gctcttagggtttcttctagtttggggccttacagacccaatattttgtgcgtgtctcctgtagacgtatgtgtgcgtttctgctgggtatgttcctagaaagcggattgctgggtctgagggcagacacctgtatagctttctatagctgtatagttgatttgttttgcgaagtggttgtgatcgttcacactgtgcccaggaagggtgagggtcccatgtgctccgtatccttgctagcacttggtgttttcagtctttctggttttagtcttctacaggatgtgaagtggtgtctcatttggatttctctggtgacagagttgagcatcttttcacctgtttattggctgcttttctttcgtcaagcatctgttcaagtctttggtctattattcgttgttgatttgggggaattctttatacattctggataggaaccctttggtggtatgtgttcccaagcaaactcagatgttctctaggcacgttaaaatcatgacgggttcacagtaggaggcccttccttctgcctctcccccagccaccaccaccctcagcaccgtataattctggggaatgtctcccagagagcattcagacaacacactcacggctgggtgaggatttagcattgactgcacttgcctggcactggattgtgaccgaacgccctttattcttgatgtgcagggtccttgtgggtgcaccaaaggcggattccaagtacagcacttcagtgaagtcccctggggctgtgtttaagtgccgagtccacaccaaccctgaccggagatgcaccgaactggacatggctcgaggtgggtagatttttcactgccaagatggggatgggttctgcaccctcatactatcctctttttcttcctaactattcactcacttttccatctctctttcattccctctttccctcccttccttccttccttccatccatctacccatccattcatcatgtgctcagtacctattacttcctacgcactgggatataccaaacaaagatcctactatcctgggccttactagttagtaggtaaaaaagacattaaaacaaataaagatcagagaagaggggaggtgagtatttgatctgatctagattggagggtctgggggaagtgactttgacactggaaagatgcacagcgtttagctggggcaggtgctagaggcagaatctccaatgggaggaaagtttgtggcattttaaaatccagagcaagccccagcatccctgagtggtaagcaggggaccaggaagcaggggag

SEQ ID NO: 31401 - DNA, 1963 bp, Bovine  19866880890250
tcagcctgggagcgcagctcacagtgttcaagtctgacctttctgtttttcagcagagtctgcaaggctcaggcaacaactaaagacagcaactagctgacttctgggaggaagcggtgttctccagctctgtctcttggctgtttcctttccaagggtcagggctgttgctgtctttctattcaccacttctcatcttggccattttttcaaagccacaggatatactttgcatttacttctgttgctttgtttcctgattttttttttaagtaaactttttgttgagcagtaacagccatgcagaaaaatgccccaaatcatctgtatacatctctttttatagttgtttttttttttttttataaaagtttattcttaaatgaacaatggtttccaagacaacacttcattctagctataggtggcaacagatattgtggcaggggatccagatgtttaaacaggaatgcagctaagagtcatcattgccgcaggcataaggaacaacttgctttttgccagatttcttaattccatctgtggccaggaggcctctccccacagccttcacttttagctcggcgagtttcttctgcttctccttggatgccttatcttcctcttccatctccttggcttgcttcttagactgcttcaagggctgctgcttgccccttcacggcccgacgtggctcctgccgccccttccccagctgtatatatattaataaattttcaggaggtgaacattctcagaatgactttcccagaaccccagtagtcgccattcctgggcctcccgggccaccccctcctccatttgaaggggagctgctttggggggtggaatctgtggtatcagggccctgatctcctgcaccccgtcttctcagtggctgacggcctgtctgctcctgactgtgctgggtagacctgaggcatgggaaaagctctggtcatctgtgcatggtgagggtgggtggggtggcgggagagccatctggaggggcccagtacctgcccccctaatccaggaaggacattgtcataccacaaaaaggccttcaaaataaattgcttctttatttccttcttattcttttggtagcaaaaacaacccttgtaacttgaaatatgtcagatgctgagatgtggggtggtcctagacctttcccccttttgttatacttttctggaatctgagttggagtaagtcttgctgtttccagagggtgctctctttttcctgttggaggtccctgtctcctccctgccccccacccttctctctcacagcagaattcatttggaaagattgatagagattttaatgctttggagacagtccctaggaatttttcttaatgttggagtcagattgacatgtgtgtatgtagaaggataatcagggctaaacagtcttttctttctgtaatttatgttcagagacactttttcttgttttcttacatgcaaactgcctttgacactttgatctctgacctcacagaatgccttaattttagtttagtttgctgtgaatgcaatctttggctcttctaggaattccccaagatcactccttaaatagtttatgacacttaaaaaaaaaaaaaggcaataagctggacatgaaatacagaaggtccatcctcataagagtagtgtgcaccatgacaaacacccgcctccctttacagtccctctaacccatacatacagtaaaacacggaaagccctggggctttgccaaatccataaactaaaagataactcatttaccagctaattggatggtaagcgattcaagtttggaagctatcagaatgtagttggaaataaaaataaaaacttagtggaatggagtgattatccactgaatgatagctttgtttagcttcttgcttgacatgattttagtctatcgagatgtgctagaagcacagaacagcacagaatg

SEQ ID NO: 31402 - DNA, 1049 bp, Bovine  19866880926753
cttatggttaccaggggataagagggtaaaaagacaaattgggagattgaaattgacacaaacatactactatataagaaaacagataactactaaggacttaactacattgcacagggaaattttactcagtactctgtaatgagttatatgggaaaaaaattttaaaaagagtagataaatgtatatgtatcactgattcactttgctgtatacctgaaactaacataacattgtgaatcaactatattccaataaaaatttaaaacaacaaccactcttgttaaatgaaatctctctagtccaaggaatcgaaaactacaggaagggccaaagtttcatcaaacagacaggggcaccagcagagccagagtccactctgtgagacttcacctgcctagcacatgtcctgccaggccactgtgcagaagtggcccagccctcccactatcccagggcccctcattgggggaaatgcctgcttcctcctcccgggatagagcctggcagaggaaggtgaggtgagcaggaagcagaagtgagcagtacagacaaaaggacttcgatgagggttgttaaaagaaaaaaaaaaaaaaaccagaatcctttgaaatgacaggctgagaccttcacaagcacctctccctccaacatccgtcagatcagttcccccaaacctttttgtttcaactccaagtattgtttcaggaccaggaaaagcccagaaatctttcataagcctctctgatcacttcctcagaccttctatggcataacaccaggagcctgtcaccctaacaccggacctgccctcttgagctaatcccagagaacaaacttcctgaggccagagttgggccagcccacaccctggtgggggcgggagactgggtttcatgggctgagatgaaagcagaggggcacccaagggcaacgctgcaaatgcatggagactttaaaagaagctggtggctgcaatgctttttttttaattgaagtatagttgatttacgttagggtggtttcagggataaagtggattcagttaa

SEQ ID NO: 31403 - DNA, 1159 bp, Bovine  19866881043795
cagttgctttccctcagactttgatctctgcagatgttcatttggaactggtggaaacttttattctgcattatgtacgctctttcaaaattttattttacagggaggagaacatttgtttctttttttaaagcggagtcgggcagctctttatcgatcttcctgtgttggtcttcgcctctgagaatggtgctttctggccttgccttcttcttttgggaggtttcttgtcctccccgctcagtgaggctcagtaatcttttcagaggagagccacaaaagcacatgcctttgggtcagcagtggtgctgcatcacactgtacctgatgcctttatcagcggttcattacctattacctcgtagtcatggttaaggtgttttatagctggtttgatttttctctcttgattactttctatttattttagggctgcattttatggcccctttccccctcactctacataatctttcaaagtgtttttctcctcttgaaattatttgttaagtatactttgcttctagtttccagcagccaggctttgattacttacagagaggcctgtgtgcagacaggtactatcaggttgggagtctggtgcccagtgctgcaggaacgtccagccactgactccctaggcaaagacagacagcatataggaggtggaaggacccccatgacccaaccacatggtcaataagatgaatgtggttttggagtcacacagacctggtgtgtgtcctggtttgacacatgtgtgtctcagtttctgcatctcttaccttgaaaggtagtcacagaattaagattaagtattatatgatgaaatattcttaaagggccttgcacagagtctgccacacagcaggcactcagcattattattatttggttggatcatatgtaattgccaatttctaatgttcttgacttacaaaaatggcagttacatgtagttcaacatgttattattagccagtggctttctggatgatagcaaaaatagtctatggattggagatgaagtgtccctctattattatgttgttagtgccagaacaggagaataacagctgcttctacatgcttctggcttgtagatagagaatgccgcacacatccatggcactttggcccagagcctgagtccttgccc

SEQ ID NO: 31404 - DNA, 1102 bp, Bovine  19866881059816
ttcccttaggaatactccggtatacacatgtgcacacagatacacacacgtgacaccgtgggggcaacagatgaaaccagatttgctggatgcaggtgactaccgaagctgggtgatgggctcacaggggaacgcgacagtctcttccctagttttgtgtatggcctgtgtgtgtgtgtgcgcatgtttttaaatttcgaagcaaagactttttaaaaataaggaagcagagtggggtatgtaaagaaaccagattcctacctcataaactggtccaatttcataatctgtgaaaaatccgatggagggcttagctagaaacactggagtatcagcacaactgtgggaggggaagggagggcgagagaggctgttagtttcatccctgaaagtgattcatggaaaataaatacattcaagccattaaagagattggcgactcatcatcctttgggttttattgttggcaaagcaggtcacaaaacaattttacagcaagactgaatctttgtgaagatatatatagctacacatagcataaggaaaactctgtaagcttaaacaccaatatgttttttttaatttattttacttttacaaacccttgtgttgagggctgactttcaatagatcgcagcgaggagctgctctgctacatacaaaatcccgaacaccaatatgttaattgcatgttttatataggtgctatttttttctcagcaaatcttttcatttttggtttttctcttttctttttggctgcaccaattagcctctgggatctcagttcctcaaatagggatcaaatacagcccccctgaattaggagcacagagtcttactggaccaccagtgaagtctaagcaaatattttctgttttttttttttttaataaaaacatattatttctctaatgctgctgctgctaagtcgcttcagtcgtgtccaactctgtgtgaccccataggtggcagcccatcaggctccaccatccctgagattctccaggcaagaacactggagtgggtcgccatttccttctccaatgcaggaaaggaaaaggaaaggaagtcgctcagtcatgtccgactcttagcgacc

SEQ ID NO: 31405 - DNA, 1112 bp, Bovine  19866881067818
ccaggacgtgcagtccagctgagtccaaggtcaggcggcatccctcgcagctctcacctcgggtggccgacacgtgcttcccccctcggatgcgcagcagtcgctggatattgtacacgttggtctccacatgcttgagggcagaggccaggcctcccttcctgtagctgaggagagcacagggtcccacgtgagaccacagactgccactcgggcagtgagtgcagacacaaacatgggcacgtgcacatgtggggacacacatgtgcctaacatgtatgtgcaagtagatatgaacacgtgtgtgcaagcatatgggggcaggactgtgcatgtgcttatccgtgtatagatatgtagacacacgcatgtgcatatccatgtatgcatgtgggtatgtgtatctatatccttgtgagtatagatgtgtatgcatggaattcacgtaactgtgtatgtgtgtgtaggtggacatgaatactcactgatgtgtgcccaccggtaggtggacatatatgggctggcatgttttctgcatgtgcatgtatacatgtgtgcatgcatttatgtacacactatttacatgtatttgattcaacagaatgatcgaatactggcagtttcctatggttcaatgcatttggtaattaaaaacatgtttgaagcaatttacaacaaaagacatatttatactgggcatggtaacacaaaagcgaactcaaaacaaaactgggatccactcctgggtatacacccaagagaaatgaaaaacaaatgtccacacaaagatttatgtacagtactggatgtgagtaaacttactgcagtaatcacttcacaatacctgcaagtaaaaccattgtgctgtacgccttacactgatagagtcctgtatatctcagtaaaaatgggggcaaaaactagcccaaacctgtatgccaatgttcacaacagtattacctgtaacagctaaaaagtagaaacaagccaaatatccattaagtggtgaaaacaaataaaatgtggtataagcacacatggcattgtctaattctatttaagtaaaatgtccagaagagagaaatctaaacggatggagggaagggagtatg

SEQ ID NO: 31406 - DNA, 945 bp, Bovine  19866881071383
ctcaagaaaaggtcagaaaagcacaaagccaggactctggggatgtcccaaggccacacctgtgggcagccccgaagccctgctcgactcggatcctgagccctgggccccaaacctcggggaccctccagaagccaaagcagacccacgacctgctttctgtgctttcctctgcagggtccgagtctctgagaatacaagtcaggagaagacgcacctctcctccagctctccgtcctggaaggctcctacccgtgctggcttcttgggaggaaagagaagagacttgccccccaacggagtgttaggagggaaaaagcgagggtttctcaggaagcggttccgactctccatcctggcaagctgaagccgctccaactgcctctggggcacccgtaaatggttcatccagtttttatttttcggtaaacctgttttctttgaaatgcgagaaaaggatagagtcaatgagaggccgagggggcatgtgcgttgacatcttgctgatcccgagaccccagatggccaaggacaccctcctgttttgctgtggcttcattatgacgatgtttgtcacctggaaccccttccccttcatcatgaccctgccccccctcccccatcaccacaaactggctttaaactcaccttgatggctgctctggatctgagcttggccttaaaagacgagtcccacgtgaggctgtccatagtatagtctgtctcctctgcagactgagaggacatcttcctgcacgcgggcttcttggtcagctccttctttgggatggaacgtttctcagaactaaacgtcggttttgaatatccagggacagagacacctgtggcaccaggaaaaacatgaagttaccagacccagggggaagaggtgacccatccaagatgactaaatgaaattaccaaaggcagcgctagcttcttttt

SEQ ID NO: 31407 - DNA, 1343 bp, Bovine  19866881075695
tttccttcaccgccaggtatggccccccaacagcctggctggcgctgccccccagagccctgggccagtacccctcctgatttgagccccggcttcccacaggagctgtgagctgtacgagtccacgctggtggtggaaggcgtgctcggggagaagccgtgtaccctgcggctccggggccgcggctcatatgacgagagacatgcttcaccccagcaccagctctgaggctctgccctcagcccccagtcccggaaataaacgtggcccggagctctggagcggtttactgggcatgggcctctgctgggggacctctgaacggctcctgggatggagggacccctccaggcctgcgccttgtcctcagggctcatccgagggtgggtccgccaggcggagaccagggcacttagtgttcagatggagcagaggcaggaccagcctagtgagaactggccctgcggaagaaccacaggcactgaggtaagaccgcgcgtttactgtgtctgcggcactccccctccacagcgtctgcccccagggaccacacggcggcctcgtgggctgggtgtgcctccgcacccgcccctgtgctggggcatctgttcgtgttttgtgtgctcacagcagctcgggtgtcttgacttgctatccctcctgtggtgtggcactgctgcgggagctgcacctctgccctggccaccgtcagtttccggggtattcaaagacggcggcggctcccatgccagtcccgatgcacatggacaccaccccgtaggccctggggaaggagacacacaggtggggtggaggctcggccaccaagctctcgctgggaaggctgagctgggtgcaccagggcccagaggacgccagacctcggcgtgtgggccccagcctgccccccaggcgcgcacacagggtgacagatgcctactgcaggccaggatcccccgtctcctcagcttggagcatgtgggggtacgtacacctccccctgatgcccccacggggccagcctcacctcttcccgcggcgcttcagctcgttgagcagcgtgataacctgtcgagcccccgtgcagcccagcgggtggcccaaggccactgcaccccccagagggttcaccttctcaagggggagtttcagcttctccacacagtacacagcctgggggggaggtggagcatcagctgtggacccctctctggtcccctttgcccctcgccccctggctccaactgggggccccaggccacactgcaaaacaaaggctcacctgactagcaaaggcctcgttgatctcaaagatgtccacgtatccacggtcagccctgca

SEQ ID NO: 31408 - DNA, 1665 bp, Bovine  19866881127645
ctgtgcagaaaaactgagtctctcctctaaggagaaggattgctaggaggtgatgtctggatgcttaatgtagcctcacacctgctggcaagaagacataaacttaactgggcgttgtctctctcccacccccttgaatcaattccttccataggtctcagagtcaaactgactcctggagaaaccgtccgaacgggggtccaaatgggccagctcaccccctctgccccgtggcctctggccaggaggtgcccccaccagtggcaacatccttccctggatgtgaggaccagaattcacacagagatcaaggatgggaccagggggcgcagggggatcagaagactcacctcaaagggcccctgaaacccccattagccaagaaatgaacacccatgagagaagaggggcccaaacagcaatacccacctcggtgaagaagcccgctatcccggcctggcaggagccgtgctcctctccgtacttcttcttgtactctagaggggcggggagggagagaagcagaccacagcctcgtcagtgtgtgccaggcgtgtgtggagcagcccggcgcgctggccacggccccgcgtgcggctgtgggcagggcctagggacgccgtgcagactggggcgcagaaggaaggtctcaggaatccaccagacctcaaaaatccaggctccggggccatcaggtagtgaggctgccaagtgccccgacggacttcctttgtatgtgggaaaggaggagtggcagccaccataattaagtgggaggctggtgacaattacttcattcagcccagaaaggatggggagccccaggaggaaggaagagctgaaaacatgacccagaaacagaatgatgtggccatcgcagtgtggagtcccctgggagacaacgaagcctcccaaaaagacactacttccagctggaggcaacacgccttcccgccctcagagcccaggcgctgcaggaagagggcatcctgctggaccggccccagcgcacggtgacagcatcactctgaactcctcgtgtggaaggaaaaggggagacctctccaggccagaagaaaacacacgaatgggttctcttcctccgccatttcctcaactcccagtactccaacccaacaaacgggaactctgttgctactgtttcatatttcccttggcattttaagtttagcaggttctgggcactgtaccagctgtactcacatatcatttcatcaatccctcatccctgggaacgcatagggccatttgtaaacaagtgaaagccccagaggctcagagcggttaagtgactcctccgagggcacacagctagtaaatggcaaagccagattctacccaagtgtggcagactgggaaatccctcattctttcacctctgtgactgatcaaaggttttgcaaagtgagtggttataccaaacccagaaggtgactagccatttgaaataatgacaggggtaaagacatggaaatggaatgatgtccagcttaagtgattaattacctgtgaaactgacttggctggacatagactcagggcggcccccgggcaccttcaggtctaagctaccctgtaaaacaacccagtgacccccttccccatgtcactgccctgcctccccaggctcctgacaagtctctg

SEQ ID NO: 31409 - DNA, 1122 bp, Bovine  19866881189559
ccttaactgcctttgtcccctatgcaacccccctacccaccttgattgtttccagcttgtctgtcctgggattccaggcccacacaacacagaaacacactgatccacactgattttaacttttttgtgccatggaccactttagcagtcagatgaagcctgtggaccccttttcaggatcaagtttttaaatgtataaagtaaaatacataagaattcgaaggaagcaatttatattgagatgtggttctatccataggtcctcgaggagtccttggccctctggttaaaaaccattgtgtggtttctctaaaacagaggcttccccttaccctcagctcccttcactgcaaatgaagaacaacttgtctgtgcccatattccagctcaccttcactaacacacgttcccatgctttattattctccaaggtgagaccttaggcaagtcactctgcacttcagtttatcattattattgccatgcttgtctgtactaataactggctttgcgagtgactcactgtcagtgctggtgactggagctgcagtgaggcaaatgaaggaactattcagaggcagcgagtaaaagagaggagtgagtcaggcctctgggtgatgtcctgaccttggcacacaggaggggctcaataaataattgctgggtgaatgaaagtggggtggtaacttacatgaaagatcccactgtaccaagcacactggcagcacagtttcgtatagagttggagtcctcacctatttatcaaagcaaacctgtgttaatggattcatttttaagatcggcattttttcaagaattccattcgcatttggcatcttggagattattccacttcaggtagagaaactccctcagaaggaaacaggcctacttgggattcacatgtgaagcaacggcccactcagtcacaatggattcgttgagtgactgaggtaaaatatttggcgggctccggtgtccggccgagctccatcctcaactctgcctggcctggccccacccggctgtccgctagaccctgcagcccaggccgccgccgggcccgggcttcccttctcggctcaatctcgcccagcccttctggttctccgccaggtctcc

SEQ ID NO: 31410 - DNA, 1618 bp, Bovine  19866881202360
actttctgaagcctgcagctgtggccaggtccttcgtcctcacacccttcattcctgtgcttaagcacatgttttcaaagcaccctctcccccacctcgggctctgctcatgtgcgtggttgcagcctgttatataactgccaccttaccaaaaccaaaatgctgaactgctgtagagctgttaaattatgcaaggcttgaccttattgctaggaaatacctagcatattttaattgtcttggagggcccaggcagcattttgaagagcaattactacattcttagtcattcctctaatctatgctcatgcaacaaggggcaactgataactcttggactgataacggtggagagcagtgagtctcattatttcatcacagttttcgtgagataattataataaccgcagtcccttactgaacacttactatgtgccaaatgctgtttcaagagcttttcatgcattaatttgttaccttcatcacctatcctgtggggtaggaattctttttatttttttgtaatacaattataattaactttatagtaatttatactctcactctatagctgaggaaacagcagcaaagggatgtcaaaggtcacgtggctagaaattgtagatacaaggcacagacccaggcaggcggcgtgcccagagcctggccctcatcaccgcgcagacggctcctcctcctgccagcctggcccggctgcatgtgccggggcttggagagcctgggcatacgcttgggtttggtttacatggatgccttgtgacacagacagttggcaggccccagagcccgggcatccacgctacagaaggtgctcagaaacaccctgggccagggggatgcttcccaaagaattccactacactcaacatttgccaaggtattgcctccaaggactttgaaaaataacttggctcctgaggccaaatggctgtgcacatcaggaagacaggcgcttgggcccaggccagtttggggcctgagaaggtgaacgggtcacagcaccagactgctgctgtcacgttctagacagggtggctacccaagcctactctcgagatgggaagcttcgggagagcttaacagtgtccacagggaaatgtcagagaacttaacaaagaaagcaaaaccaaagacaagaaagagctctgtttctcaaagggtgcgctgagggctctctacattaggatcagccagagatcctgatgtagatcctgattttgtttatttggttttaatgcagatactccgaggcctatcctgtacctactgaatcagggtctccccctatcaggcgtagcagtctggattctgagcagtctgatatattctcatcactgatatccactgctttgcgtctctggggcttcatgtccaggcatcagagaaaagctttatttagaaagcagtatttaattcagtgaggagtgttcaggtctgagaatcagggttccagtctcagctccatgaacaacttgctggttgactttcgggggcttgtctcttggcctcccttgactcttaataagatcaggaaccaaggttcctcccagctctaaatcctgtgcttccttctaagtatatcagagtgtacttgtca

SEQ ID NO: 31411 - DNA, 899 bp, Bovine  19866881249508
ggtctgtgttacgtggtgctctcaggaccaggacgcgggcagaggagatggcagactggtgcatccagggctcctgagtgtgtgctctgataggtctgggcttatctacgtgtggagacccctgtgcagaaggtgtgctggacggtgggtgtgtgtgggatggtgtgtggaatggtggctgtgtgtgggatggtgtatatgtgctgaatggtgtgtgtgtgatgttgggtgtgggactgtgggtgtgtgggacagtgggtgtgggtgtgtgtgcgcgcgtgcgctggatggagtcttgtctgtctgtctggggagttggcccctgagtgcgtagggcgtggcggggcctggatactaccgatgtctgtgtctgagtacagccctgggagggtactctgttgccatgctgtctgtacatacatgtgcgggaacgtgagaggaaggtgactcccagcccaggagtgtgtgccccccccaggcggggaccgcagatgctgccactgaccagcatgttctcctgtgggtggagcaccagctgcttgcccctcgctgctatctcctcaccctcctgcttccagccaagggcccggtggctgcggctcgccccgtcttgagaaatggagaagggcttggagaccaggagccagaagtagtgagggatttccgtggtgttggtcagcttcaggtggcgggtggtcaccagctcactcagcacctggcaaccgcaggaagggggcactcagactgtgaggctctgcccccagagggctggtggggggcacccgggtgacgcgggagggcagggcggctgcacactcaccccggcgcagggctgctcagggatgaggtcgctggcctgctgccggaacaccatgctgccaccgtagtcccagtccacg

SEQ ID NO: 31412 - DNA, 2374 bp, Bovine  19866881272461
atcacccaccctcttgggcctcagtttcctcccctcttcccagccttgtcacctcttgttgctgcggtagggcgcccggccccccagagcctcccagaagttgggaggctcctgaccctccagcactatctccatatccttcctgcagatgatggtgaccaccgtccgcgccatctcacgctggtcaccgctgcagccctgcaaggcaggaagctgggtcaggccctgcagcgggagagggcctcacctctagcccctcagcccccgctaatgggggcctgggagcgggagtcacgtggggcctgggctcgcggcccagcgtgaacaagcgtctcccttcctccctgccccgcccccgcccgcccccggcttctgtctcctcaggcgatcaaggtcacagggaccctctccaggtcggagcacaggatggagacctctagacttgcagatcattcaggttttacgctgaagatcagctgaagatccccaagacacttggggagggacctggtccctgaacgaggccggaaggagaggaggtggccccggcctggcctggctctgacctgtggacgcccctgtccacctgtcacgttataacttcccccaggttccagaaagcacaggtggctctccgcagcctccctcctggcctgtctgaggctgggcttgcagtcagcctctgctgaggagtggacttccctggcctggtgcccctgccccgggcgtgggctacctttccaaaccagaggtagcagaggttggcttgtcaccagcaggaagacgtcgctggagttgagggctgaggcgcgggctggcacctccatggtccgggtgttgtagctgtcggtgccttggatgtggaagaggctcacggcgggtgctggctgccccttcctgctgtgcctggggtgcccctatgagaggactgggcctcaggctgaggtaaggggtcctgggctgccccctctcccagggcgggggctgtactgcatcagcacccagggccccctcttaaagctacctctattttctgttctctgtgagtgtgtagtgggaaaagccccttaatctggaatagggcactaggccctttctaaatggatccctcaccccatctcggaggggtcagagcaagggtcccccaggctttaaaggtggagagtggagagcagctgggtctgtgtgtgaccccagacaaggccccggctccccttctgttcagcttcctcactgcgcccctgttctgtggttggctctggggatgggggaggaaactggggcaggccggggtcaccctcggagcgcctgggcctcagagaaacaccaggaagctgaggggcggtaggctggcccctggcctgcagagaaggtgctcagcctgggcatggaaaggccacaggcacaccgaggactggggaagccgtggcggcggcagcaaggtgagccctacctggaagatcacgagctggccctggaagatggcgaggaagtgggggggctcgctgcccatggtcacgtgctcctgcaccagggctccacggtaccacaggtccagctcctcggcattgcccctcagggcgctgatctcatgtgccgtggcctggaggccctgtgggcgggagcggtgagggcccgcgcaggtcacaggccccgtccttggctcctccgcttcagggcttgagggtgcccgccacccgactcaggccggcgcacctgccacaggtacaggacgtgctggacgaagcccatcctccggtaggtgtacaggacaaggtagcagctgtcagcgcacaactgtccgtggcgcttggggtccacaggctgcctgtgtgaatcctggatacaccatatctggggaacaggggaccgacaggcacgggtggtgcctccacctaaaccagcccacccacctgtccagccaggaagctctccgcagccagaggccggccgcacctgtgcaggcaaggggctccctccgaggtgtgcacccaccccaggctctgtgctccccccacagacccctggggcctacatctgcgccaggctgctcgcagccaggactctgagttggtgtggagcacctgcaacaaacaagtagggaggactccagaggctgccccggctgcttcaggccaccccagcctgagcccaccagccacagccgagcaagggccagacaggttctgcactgctgattgctgctcaggccaggggagcagaagctgggtggaagcaaggcccaggggttcttggaaaattttccttttctcaagtgtcatttagaaaagcaaagcctgttcaaagactgaaaaggaaacagtctgtcacacttagcatgatttctttttcctgtggggagccaagccaggga

SEQ ID NO: 31413 - DNA, 1304 bp, Bovine  19866881336381
cccccatccactccataactccaagcccactccggaccacatactgaccagccccacttctgatcccagaactgctaccatcctggatcagggtggcttcaagatctacgtgtggcagggacgccgggccagcctccaggagagaggggctgccttcaggagggctctggtgaggctgggggccctgtctcagagggtcgttgtgccaccctggggtctgaggatgggggacatctgtgttctggggtctaaagggaggggtagtcctgccctggagccaggagggggatacctcgtgcccttggagccctgtctgatggaggagaatataacccggtcccggggtccgagcctggagacccactgccctatctgagggaggagacacactctgaccacagatcccaggggaacacacggcccctctctagggtaccacaggcttgtggtcttgaggtacaaggtcttgtaccttgaggtctgaggattttccagcactgggcccaccttccttttccaggaagggaggcagggttctgcctggggtctgaggagtggtcatagcccgcccttccggaggcccggagtaaggggaacctgcgtgtccttggggacctcggagaaatcggtagtgtcagagccagctccttatatgggtcacgagctcagttaattaatgctgctcagtgcacagctggccccgcagctcccgcggggtagagtggagcagtgggcccctgggccacacgcctcacccaactcccgccccagaacttcatccaggccaagggctacccgagctacaccagcgtggaggtgatggacgacggcgccgagtcggccgggttcaagcagctcttccgatcgtggtctgggcagcagcgcaagaacaagaaccttagtgggatgggtgagagggcgtggccagagagcggggcggggctccgagctgcagtgggcggggcagggcccagaagagtgaggggtgtggctggagggggctttttgtgtgatgggcggggcaagacaccctctgtcccaccctcaggtaaactgcttcaggtgaagctagacgtgggcaagctgcacagccagcctgagctagccgcccagctcaggatggtggacgacgcttctgggagcgtgcaggtgaggagcactggcttggctgggtgaagatgtcttcaggtgaaccatgtggctgctaaagtgtcgcaggtatgccctagtgcacgtctgcacacaatcagggacctcgggggcatgtgtacacatacccacaccgcccctgagccagctcatac

SEQ ID NO: 31414 - DNA, 1239 bp, Bovine  19866881348395
gaactgattttattgtgttctgctttctccggtgtctcttgtcaacttaatagtagcctcaagtaaaatgcaacccttagatgtttatagtcatcttggccgggccattaagatgatgaatgaacttggtgcttgcccttgtaagagagccctgagggtggatattgatactcagaaaataataagtcttttctgtccctttcctgtttttaatccagtgccctaagccccctggtgctttaccttgtactcctgcttagcgccagggagaaaaaccttacctggatcccagcccatttgaggctctaatacagagcaagctctttctctcacactgttggtctttgccatcctgcttgtcagaggcaaatccctagagcctcttggtgtttctgacttgtttctgttggccctgaacttcctcttggaaaggatgagcatgggtggtggggagcagggaccaagccaggtttgcaagtcctcttacctggggccattgcactagcatttttctggccctaccaccagagccatcctaacctacagtgaagctgtgcttgggaggaaggctgggccttttctgtcacagctggcagtgaggaagcaggggagaaactcggacgcctattttaaatcacactgtggcctcagtgttccatggtagggctcagctttcacatatgtgaaaagctacatttgtgtattcactgcattgggaaggaaggctacgttttgcttgagaaatgtcaacagagctgtagctacgacaaggatctttcacgaaagaggttttccagagctgcagacttgggcagacctggtgggagttggtatgggcgggggcggggcgggggggtagtttagaaaacatatgttaaacctctgtaatttttttttttcttaatgaactgcacaacggcaatttaataatttcctcttttaagaggaaagggggagtcttggattttaaatctttttttataaaggagcacagcacctcttaaaaagaaagccatgaaattaatccatctgctaaatccaacgaaagaaaactatttaaaaaaaaaaatcaagaagaacttaggtgtttcagcctgggtttccctgaagcagatcccgaggtaaggattgtatcaagtggcttaagagggatgtgctactcagggagcgcgtgaggagtggggggtggaggccagggaagggtgccatctcggacaacgtcctagagaggctggcctg

SEQ ID NO: 31415 - DNA, 700 bp, Bovine  19866881406144
ccgtagtcccagtccacgctcagcctgccggcgacagccgggacgggcctctgggcctcacctgcccctggccggccccgccctcccgtgcccacctcttgttcccaaggcctgggttggtccccagcagcgcccaaggaggctgctccccaccacgggcaggaggcgggctaggcggccctgcggactcactgcgccggcctgacgtagccatgcaggtccagtctcatgggtcccatggcaaagtcctgcaggcggcgcctccggcccggaagctccctctccacctaccaagctcaggccccatcactggagtcctgagaggtgaggtggggtggggtggggttgggtggggggaagccctccccaggcccagagtgctcacctcatcgtccaagctcaagaagcccagggcatagccaacacactccaccttgtgcaggacgccagggcccagcaccacgggtgtgaaggagatgtggatggtgctgttgccccccgcagggaccacctggcagacacagcagcctcagcgctggacaaccgccccccctccccagccttgcttgggggacgctccccgaagctcccagccccacccactcaccacctgcttggggctgatggagaacaggtggtcagagggcaccccctcatgccctcgcaggatgactgagatatcttctggggggcgccagca

SEQ ID NO: 31416 - DNA, 636 bp, Bovine  19866881520438
ctaggaaatccactaaggggtttcacagcaccctatgggtcccatggggcatagtttgaaaacctctggccatggaccatgcctgaaggctggacctcagaagatctaggtccaaaacctgagttctggtctgtgtgattgttggcaaatgacttaacctgagtctcattttccatatccagacaaagaactcatctcagagttgctgtaaggctggttttaaagttccttaagtcttactctttcctagtcacatctcacttgcgtgttgtgtgccattgcatctcagtcatttcatgactcagcatccacttttctttagtatttggccttgttgatgctactacgtctgcctttcagattttctgccattattgtctcctagagaatggaccagggtaacagttggctttgggctacaccgtgactacctctgaagggagtccaggctcatgatcttttcttgggatggaccactcatccagatttcttttcattttcaggtgggccaagagaagggaaactgttctttccagaaaaacccaaccccctgcatcatccctcaagaacaagaaaatatcttccatacaatatttgcttttttcacaaagtcgggaagaaaagtctggtaagaat

SEQ ID NO: 31417 - DNA, 1124 bp, Bovine  19866881615585
atctggtttgaataattggcttagaaagtccaaggactgtagtcaactcctattttttcagcctgaggtttctatcaaagtgttaaatttacatttcagattccattggctggcaaagggaaaacctttgcaacccaccaagtacaaagttatacatttctcccagtagtatgagtctaatcaagagtgatggttctcgtccaaccacttcatataccactgttggtcagtatatactaaaactaaacatatctatgacctagtagttccactcccagctatgtcccaaagagaagtgagtacctgtatcccccaaagacatggacaggtatgttcacagtaatctgggaacgatccaaatgtccatcgccaggagaaagtgtaaacagttgcagtgtacccatatactggattattacaagcaataaaaactgccatcccaacaacatgaataaatctcatggatataatattgagtgaaaggagctagagataaaagacagatggtgttttacttacatgaagttcagaaatagcaactctgtcaatggcactggaggccaggacagcagttaattttggaggaatattgataggcaggagcatgagggactctgcttaggtgcaggacatggtcttcatcttgatctgttatgaatgtgtataaagatatgtcaagatggatcctttggatttattctgtttactctatgtaagctacaccttaactttttaaaaagtgcaggtgttaaaggtggaatcagatgcttttccaaagcctcctttctccacatctttggttatatctcttcagttccttattacagccatggcacatctcactaacatttccctcctcttttttttggcggtagaattagtaggactagtggccttttggaagtttgggatatttttacttacataatgctgatgatcaactgttatttaacagctttcagaactgttagatgtattgatatctagtagtttgacaaatgcagctctgtatctggctgaaatttttaccccatatgtgaaacatcatgaatgtatattcacacattttgaatcctataacacaaaagaattcttcctttgtaacttggaacttaggttcctag

SEQ ID NO: 31418 - DNA, 837 bp, Bovine  19866881822818
cacgactgagcgactgaacctgaacctgaacctgaaggcaatagtagtaataatgaaagtatataatattacataataataatgaaataagactaatggcagtgcggttggaggaaatgaagatgctcttattgagagagattgattttagccgtgagtgcagttattcctcgaacagcttggtccttctccccacctcccaggctgggagatcccctgaagacagcaaggactatattataaaggcatgtgacccaatgcgggacatggagactgcttgataaataattattaagtgggggcgtgaacaaaggaatgcaagacgtaacagaaaacatacgtgcctcatgcataagaattattctacaggagctgtttcccatttaagacaaaataagaaacacttgttgagtggatggatgggcttcctccagggcagcagggggcgggcacccgtgtgggagctggcctctgcctgtggagatagagtccatcttctctgagtcagtgctctgggtgcatggtgggcagggctccagtctgaggactagtagacaaggaggaccataataaaagatattctgacttcaccagcattagaaccccagggaaagcactttttccccttctaactgggtcttcatctcttaacctccaaaatggcagtgaccgtgccagccctcagggctggtgttccagaggctgatatagaatgtttgcctgagcatcaaaatccagatttcctgaccctacttctgctctaaagaatcccactctggaggtgggtcctgcaatctggacccacattaaaattacaacaaatcttcaagaaggatt

SEQ ID NO: 31419 - DNA, 1366 bp, Bovine  19866881844727
accaatatttcaagtcccacagatttcccaagctgttgcttcttgtcctgcatacaagtttctcaggaggcaggttaggtggtctggtattcccatccctttaagaattttcctcagtttgttgtgatccacatagtcaaaggctttagcataatcaatgaagcagaagtagattttttttttttttctggaattctcttgctttctctgctatctatagaatgctggcagtttgatctctggttcctctgcctcttcaaaacccagcttgtacatctggaagttcttggttcagaactgaagcctagcttgtagattttgagcattactttgctagcatgtgaaatgagcacaattgtccatggggttctccaagcaagactactggaatgagttgccatttcctactctagtgcaccacattttgccagaactgtgacccatctttctttctttctttctttcttttttttttgttatttatataatttaatatgctacaaatgaggaaaataaacagggaacggggatgcaaacaggaaaagtcctgtaaagattcttcattttgattgtattgttttcttgccttcaggggggaagatttcgacttcaaaataaacaaaatatttgagaaggctatttacatctggtgttctagatggtattcttcagctattttctcagcagtccatgtttctggataaagtttatgattactgagaagtgtcaatgcctctaacaattaaaattttgcctttgggaatgttcttaactttcatcatgtcaaactgatgttctttcagcaacctgaactccttaggcttctgatgtgtgccggcatcctaaagaagacaagggatcttgggaatcaacatacacatcttttagtaatgacagcagtttttcatcttttctgtcaatttgtcccttaatttctggatggttgctcatctgctctcgcaggatgttcatggtggaggggtgcctgggagcaggggagggcttcattcctccctgttctgctcggttcactaggttgaaattcctgatggtgtgagccactcagcccccatttcttcacaacatgctgccctaagttataccacacgtagctgaacactggcgcaggcgaattcggggacataccggaggatgcgcacgtctggggtcgacccgcgagggagcatgaaaacatgacccatctgttttgagcgaccctgcactgcttggcttatagcttcattgagttacacacgctcctttgctatgacaaggctgtgatccatgaagctaataggctagactctttctaaccaagttgattttgaatcttttagttattcacagcgttcttcatgtaacaagg

SEQ ID NO: 31420 - DNA, 774 bp, Bovine  19866881974142
tacagtcttctgcagtttatgacctctggatgctcatttgcacgataagctttatggtttatgcatctctttctgatggttgggccagagatacaactttagcaataaaaaccagcccagagcccactctggcgagaggcatgttgtcttttttagcaactgaggttctcgttaggaagcaatatgcttgaactcttaaaccaggacttcctaaatttcactcacacaccatcatcccaatttttgccacatctgcttatcatatcacctgtgataagtactttgtatttttactgcctcactctttctatttaaagactattttaaagagaagaatgtatatcactatcacagatgggaatccaggatcacttgccataaagaggaggtcatcataaaaagaaataatgaaaacaaagtgatgttgaattctgttgcctgctgaaggctctgagcctcaggtctcctctgttttgataaaagggagataaacaagtgatagagacattgcagcactactggagacttccacctgcaaaaggttaggatagaaagagcattgaacaggtagtagctttctcactgtcagtcaacgctgtttagcgctgtgtccacacatcacctaaaagcatctcaggtgctgccagtagtgaccatcctctgatttggggagcaccttctcaagcaaatggttttcactgtattcacatcaggcaggtgtgggaatgggggaggactacttgggtggggcttatagagccaggctccaccaca

SEQ ID NO: 31421 - DNA, 1620 bp, Bovine  19866880358309
agtcgtgtccgactctttgcgacccatggactgcagcacaccaggcttccctgtcctcaccaactcccggagcttgctcaaactcatgtctattgagtcggtaattccatccaactatctcatcctctgtcatccccttctcctacctgcaatctttcccagcatcagggtgttttccagtgagtcaggtcttcacatcaggtggccaaaggattggagcttcagcatcagtccttccaatgaatattcaggactgatttcctttagcatgaggttgttacttcctacctggtaggacaggaactgatgagatctatggtgtctcctttagggaacagactactttgtgtgtatccattctggagagattgctgcaagctttggagcccgttcatgtggcccggaacctcagggttgacctgcagagaggactgactcaccctaatgattctgtaaaaatcctcactctgtcccaggtatgaatatttcactagcacgtaatggaatcaacatttagtgaccatctgccctgggccaggctctgtgctgggtgccagaggcagagaggtgaagaaaatgcatgctctctctgtctgtaagaattgtctagtctagtgtgtgtagctgattataaatggggaatgcaagctgaagaggttccagtaagcaccatctgaatcagtttttcgtcaaatatggagttgcttttgtcagacgttttaccataagatgttagtatatggtaaaatgcctgatacaaaagctattaaataaagcctgtttctctcctccaaggagccccaagtcttaaaaaagagattgccatggtaagtcttactacagtggcatgaatgaagtactattataaaggtcactattccaacaaactgacaggtaactcttaccagcctagtaaccaaacttgctgccgtttgggtgaagagctgctgctgaggattatcgtgaagggacagaagctgagcagttagttatccaagagatgttcagttactgtttgttcttttttcctctaaagtatttattcaggaaaaggggaaggtatcaagttacccattaaccatttccttgcagacactctggctttacctatttaagtttcatttaatccttattatgatcctgcagctaagtgttgcattcctatttgacagacaaaaagttaggctcaaagaagttatttaatctgctctctcgattaaccactgaaagccgacagaactcggatttgtactgtgttcactcactgaggcgtctcaaacctcaactcgcctgttttgcttttttctttcaaagatgtgactgtgccatctgtgtgtttgactttaatgaatctgagtcatttggaatttttaatgactcatggctatagtcagtaactcctaaaataactgtacactaaggaaatttgactgtcatgtgtttccatgttgcccagccttggaagagtatttctgattgtttttttcctttcaggttggaaggattgttgaaaattctgatgctgttactgagattctaaataatgctgaattactgaaacaaattgtttattgtattggtggagagaatctgtcagtagctaaaacggtgagtcagcta

SEQ ID NO: 31422 - DNA, 1350 bp, Bovine  19866880358500
ggagaccagggttcaatccctgggtcgggaagatccgctggagaaggaaatggcaatccactccagcactcttgcctggaaaatcccatggacggaggagcctgataggctgcagtccatggggtggcaaagagtcggacacaactgagcgacttcactttcaggtttccattactgccctcttgccctcctgggatttctgttaaaatagacaaggctggaatttcactccccttgttggcgtcagcattaggacttcaaactatggatcctgacgtcccatcccggctaagggcagccaccagaggaccctggaacctgtgggctctccctggagccctcccatgactcgaccttcccaggcccccgtgctgggaactcactgaacctgagtgtcagtgatcactcagcctcagaccccatcctacccgactgcaccaaggctttgtaaccggatgtgactctcgggatgctgaatgggaaatacaacgtgtgcgtgctcaatcgtgtgcgactctgagaccccatggactgtcccctgctaggcatctctgtccgtggaattttcccggcaagaatactggagtgggttgccatgtcctgctccaaggatgctgaatgctgaattttagatgtaatagaaatcacaatagaaaacacacgtgtttgcctcaacaggctgtcagttacgatggccaaagacaaggtccagcccaaatttccaactacagtaaatggataagtaaccataaactcacatactagagcagtacacagcagtgaaaataaacaaaacacggctatataacaccaggtgagtacatctctcaaaaaaaataaatacaatagaaactgtaagagataatttttgtctaccaaattcagagagaattttttaaaatactaacactcaatgctaaatagagcagtcttttaaaaagatcactctcctctagggagcatggtataatctttctggagaacaatttgaatgtatctataaaacagcgttaaaaacatgcatagtctttgaccgagtaattatacctctatcagtacataatcagttgataagtatttatgtacaatgatgtttcttacaggacttgttacaaaatgaaaactatacatcctacagtaaggactagttaagtaagttgtagtgcattcaagcgatgaactactgtgttcacatatttaaaaaaaaaaaaagtttctcaagaaaactcttaacggccacacaccaaaataaaagaataaaaagcaaaacagaatacaaaaatgcattttcagggactctcctggtgatcccgcggttaggactgctgtgcttccaatgtagggggcacg

SEQ ID NO: 31423 - DNA, 1083 bp, Bovine  19866880362893
aaatggcaacccattccgtattcttgcctggagaatcccatggacagaggagcctgttgggttacagtccatggggtcgcaaagagtcggacacgactgagcaacttcacttcactcattctttgtccaaataactcttctggagagaaaacacagaggcagagctgctcagggagagttcgcggtaagaagccgggcggcccctctctccccaccacgtccgcctcctgcctcagtccccaggagccacgaggctctgcagagtgttactggagcaccagtatctcctgctctttctgaaagttcttacatcactgagtttctatacctcattaagattttagcgaagttttcctctgtatgtttaaaggtaaccactgacaagctttctcatagtgaagcctcctgataagatggaaatttgatggatgagaaccttctcattctccacctggctggtgataaaacaaactagctgcctggcgaaggaagtgtgagggcctggcttttcatttctaatgtgattctaagattatagggatattttatttttcatataatccacttaaaaaaaaaaacacatctgctgtaagagagcctctgatatgcaaaggcagcgctcagctcggtgctaggaatcttcaagtcaaagagtgtggcccatgtgggtggaaattgaggccgctctgttgatggcgtcatgaaggcttgctggggccactcatcgtgaagggtggtggtctggtgtagggtaagggggtcttcagattttttccccgcgtctttttgtttagaagcaggtaaacagatgtatctgcagattcctgcattaaaacccattatgaacttgcgtgctttcctccagccaactgactcaatttctggaggaaggcctgggaacatgcggttacatgatgcagacagccggccaggcttccgcactgctcatccgagggctttgtttgcgagctcagtttgaaaaaccacttgtttagtgaaaaggacacagttaaacctggttttgaatctggattccaccacttttctcctttggttaaattgctggagctctctgaactgcag

SEQ ID NO: 31424 - DNA, 3885 bp, Bovine  19866880381508
gatttcctggccttccactggagcctgcctgtttggagaagcccagggcagcgctgcttgcagatggcccacactattgcagtccgtctcgctgcagcggggcagcgctgggctccaggctcacttccaacagtcattaccagtgcgagttagggcaagctagctaacttctaaacctcctgtatcctgcaacgtgagagctacgtgagaatttatatgaggcaccttagcggtcctcaaaggagaaaaggggcatttactgaaacaagttttaagtggtctaggttataaatgttagcacttaaaggggcttagaaaaggtctgcttgaatgtttttattttacacatgaagaatctggtggtgtgggagagatcactctatatggctctgtccataaagagctcagtgaagataccacagtcatactcactgctaactgccctcccaaatttacagaggccagggggcctttcaagtaattttttcttgagccaaaggggtgtgtgtgtgtgtgtgcgcgcgcgcgtgtgtgtgtgttgggggcgtggttataggaacagatgagactaaatggccacgtggggtcacccaaaggacagagtgtagcagggtcactcgaggggcctgagcagcctgacgagacagctctggagtgggccagcccctgacacgggctgagggacacggcggggtctagggtgagaccctctgtcgaggacgaaccgttctcctctcctcggcctggctacacaacaggcgatcagaggtttccttgggagtttgtctcttacagacttgtttctggcataaaatctagtatttcaacacagcactttgggacttgataaaattttatgctgaagaagtgtcatttttctttcaaaaactaacaagtttggtgaacttaacgcatttcaaaagtgtatcttgggggcattttaaaagtgtatcttgaacaaatactttcttcttgtggcaagttctaaatttcaagactagaagaacaatctgatcactagtctgacagttttcacagagccgcgctccttgcacgagcgcggctgagacgcgccccgcgcccggggctgcgggcgcacctgcttcttgagctccgcgtactcctgctgcatctggctgagctcccgcatcaggcgccgggcccgctcgtggttgtcctgcgccacctgctcgatagtcgccatctccttctgcatggagctgttctcctgcttctgctcctagcaagggaggaggagaacgactctggaggtgggcgctgctgcctggcactcgccatctctgagccttcgtttcctgtctggcctccagctataaagggatgatcggccggcctcctgcagcagcggcggcagagctggagcagaaagcctgaaccctgggtgtgccgtgtcagcacagatcaggcgaccctcccctgtctgggagacgtgaacagcagccaccatcacagggttcctgggagggttaaaacctagacatctgcccactcccgtcacagtcctgttgcacgtcactggctgtgcgtggtatcgccctctgggagatacatccggatgcaaagccacattcacactgcagggcgacatgaacccctccaaagggggttagaaaatcctcttctgggacagtacctgtcgctgcctgttggtctggaggcatctgagtgccaccacccacaattcatctcagggataagagcatgacagattgaacctcctagttttaggataatgattaattaaagctgatgctgaccaaaaagggcatgatgagaaaacctgtgagcacagactgcagctggggaagaggctcttcagaagctcgcccgcccccaaacccctgcacccccgctggagaggtgcgcagaggctggctcgccgagggtgctgtctgagcctgtgatcagcgttccagccagacagccaactccgctagggctgagcccagacgcaggcaaaatctcccattagcttcaggcacaaactatgcacaaatgtacccaaaacaacagttgggttagggactgggttgcccggtcatttattttctctacatggaaggcgtcatggcacaagccacccggggtggggcagggggcacaagccgccagggcggggcgggggcactcacgagaagggtcttctcatggaaggcgtcaaggcacaagccgccggggtggggcagggggtacgtcaccgcacaagccaccggggcagggcggggggcacaagccggcggggtggggcgggggcactcacgagaagggtcttctccagctggctgcgctgggtcttgagcgcttccctgaggctggctacctgcttctcagctttcttcctctccgtcaagaactggtttcgcaagaggctgaagtctgccctcatcgagtccgcctctttctgaagagccagcagctcagctgacttttccaacaactgctgctcccgttctgagagctgttgttctgaaacagcatttcaggcagtttagcccgaggccctgggctggctaagggcagactgcacaaggacgagacgctcactcaggcactttcttccaccagccagttgtctaactctcccctgacccacagcggcagcccagaaaaaggttcagagaagggtgccttttgatgtagtttgttattgaaggacctgattccaaagtgacaggcggccaccattttctgagtctttgagactggagagcaccaattctgtgaggtgcaaggaacacggaggagaccactgagatgctatttatttattcacttgcttatttaaacatctattcaagtccttcctccacttttaaaatttttggctgctccatgaggcacgtgggatcttagttccccaagcagggattgaacccgtgccccctgcattggaggtgcagagtcttcatcactgcacagctaaggaagtccctggaacgcttttttataaacctacttttaaataaagggaggtacatagtatttcttcctccatgggaggccgtgcaggaaaagaacagaggatttggaatggcatgagtcttattttctatagaggaacccatttcctcgtatttaatgggaatcgtgcatgcagacacccagtgcatggtgagtacactcaataaacgatgctcatacacaacagtgatatttaacacagatttttctaatccacctgtgtaaagcaacaccctgcccagatatcacttctcacgcctctggcacggtcagactcggcatatttaggtttgtttcaaaatgaaaagggttgggtctgaatcaagagttcccagggaaaaaggaataataatcctttcaaaacccaagtcctcaaagtttccgcaggggacaacaacattttctgagcattattaaaacctgaagtctaagggaaaaaaattcatttactgacgtaagaaccatcttttgcccttgagtcaagttcattaatatacggctcaaaagaataaacagaccgaatggccaacaactgtatcacagaactgttaatattgctttttgtaacaggttgagatgaaatggatcactgctccaaagctcggaattaaggcacttttatagaaagcctttagggcgccttgtggcacttctttgccttaatattccacttccttgaaaaagcgttctcaaagacagtgacacactcaaggacaaacacctgactgtgtcgagatcgaattccatctccataaagagagtctgctccctctgggcccgcctcctcagctttcacaggacccggaggaccgagtgagggcggcccccatgccgctcctgcgtcctgcctgggccacggccgaggccgggcctcctctacgccttgacagtcagcgggtcccc

SEQ ID NO: 31425 - DNA, 4399 bp, Bovine  19866880478667
ccccactgagaagaataaaatatacatggcagggtttatgtgtcggccctaacctccctccccggcctccgctgtgtccacatctccattctctaaatctgcgtctctattcctgcccttgggcttccctggtggctcatctggtaaagaatctgcctgcaatgtgggagacccctgggttgggaagatcccctggagaagggaagggctccccactctagtattgtggcctggagaattccatggggttgcaaagagtcagacacgactgagtgactttcacttacttattcctgccctgcaaatagatagctgctgctgctgctgctaagtcacttcagtcgtgtccgactctgtgtgaccccatagacggcagcccaccaggctcccctgtccctgggacagctagtgggaagcttctgtgtagcacagggagctcagctcagagctctgtgatgactagattgggggggatgggggatggggtgggaacaaggctcaggagagaggggataagtgtatacgtgtcgctgatgcacttcactgggcagcagaaattaacataacactataaagcaattaaattccaataaagtgtgtgtgtgtgtgtatatatatatatatatatatgaatgattaaatgcaaaaaaagaataaaatacccagaagtcagtctaccaaaacaggcaaaagacctgcattctgaaaagtataagatgctaatgagagaaatcagagctgacacagatggaaagatataccatgttcttggattagaagaaccaatatcatcaacatggctatactacctgaggcaatctacagattcaatgcaatccctgtaaaatcaccaatggcatttttcacagaactagaacaaataaaaagttttttaatttgcatggaaacacaaaagaccctgaacagcaagcaaccctgagtataacaacccatgcagctggctcccagcatccgagtttcgtagataaggatacagaggctcagggagatgatgaagtctttctcgatgttagtcggctggtgggcagaagggcagggcttcaaatcccagccgcctgactcggggtcactgtatgccctggtacccgggctcagtgagggcaggagggtgacaggcaggatgacaggcaggcatcagccagccggcacgggctgcccctcactgcaggcagagcggggacacaacagaagccaaagcccaaatgaaggccgcatgtgacccattcttaggactgaacggcgctgcactcagagcccgggaaacaagaggaaggtacacaggctgaacaaaggcctgggggagccagtgaagaagctggtagtttatctgagggtccggggagctgcagggggaactcaggagccagggagcgccagagtgaccagcggtgtgtttcaggacccaagctgagtgggtccttcatgaccgatgccctgcactgagccaggagcagaggacgcagggaagaagaggccacagccccttctcttgagaaagaggggcagaccagtgtctgctccttatcaggctctgcaaggtcatcttgaagggtggatcccaagctccccctgtatatgggactgaactgaggcccacggcggtcacaggagccacagcctaacagcgaagacaacacaaatatggccaaccacagtgcagggctgcaatagctacagcgatcagcactgactaagcccttcattaagtcactaggccatgcactttcccaatgcatgtcattgctgtttagttgctaagtcatatctgactctttgcaaccccctggactgtagcctgccaggttcctctgtccgtgggatttcccaggcaagaacactggagtgggttgccatttctttctccagctccaaatgcatacgtttccccagtctgctagctattaagagctaatgaccctcaatctacaggaatgaggaaacggaagctcagagaagccaagtatcttgcccaaagtcacacagctagtgagggccagagcaccctcattctttgccaccatgtctcgctgccccgcagcaaacgtgcatccacagagcttggtgaggacagaaggggtttgaccaagttgatgaggttcaagctggacctcaaagaggaggatgaaggaaagggcattccctgcccttgacagcatccagggacagtcaagggcatagtgggttcaggacgtctggtaggaaatttggtcagacagaaactgggtcagaacaggaagggccttgaaggccaggctaaggagttgtgactttatcccgaaggcacagggaggcagtcagaggagctgctgggctcacacggtgttgaagggagcactggagatgctttagggacgagagattggaataaaggagggatggcggccacgatattggctgttacggtcatgattttgatgagcccccaaatcctgagcatccaccatgcccaggcactgcacacactcctctcatctttactagaccgggacaggcaggcatgattgtctcctttggacagatggggtcgtagcctgtaaaagggtgcgctcaggagatggtccctcccaggggagcccaattaaagttgcttccatcccacctccccggtcagcttcctcaatgacccatgatggccctgctgccctccccagagatcaggaactgatgggagcttcatcccttccccctggactcctactgtgtcctggcccctctgggctctgggaaggaatcccagaccagacacgaggcactcactgctgaggtcatcaaaagcaaacaaatccatctgaatccccagctggcaccccgccctgagccgtccccacccccagctcatgtcctggactcgaaacaattacttgcaggcacattagcagccttgagctaaatgctgaaatgcgtgtttcctgctcagagggatcggttatcgctgactctgcaagggttgctctaagtgcttgagagctggggaagggggttggctgccctccccccatacagctcagatcccccatatttaaggagcttaccaaggagagggggtcatgcttaaaagcatttttttaaaaacgcaaaacaccagacaatttttgcaaagccacaaatggagagaggggtggccagggaagagaagaggggtctggtaaataggggagtagaaattggagcggcaaatagaatggagacggtggaagaatgccagagccctttctggcctgggattaaggcgtttctggggctctcaggtccaagggaccgcccaagttccactcatgtccataatatttactgagaatctgcctcgagatcaaggtcacacaggtcacgccaggatcaccttgcagcttcgagagtcaactgacattaagtctgaccccttacctcaccttgcaggtcaaagacccagagtcgagtgcagcctccctctgggctccctgaacgtggaatttcgatctctcccagtctgctccggctcccaccgtgtgtttctgcggctgtgattcagcttacaccctacaagtgctgtcgcttttccacatcacctgcaatggacacattctgacttcctctctctcccttatcagcccctgccccacaacatgcaaggcaggcgttgctggaggcatcttggcaagcggcagaattcacagtaatgcactcccagcgcccacatctccatccaaggcactgtcctggtcccggacgccagccggtttccctgcctggtctgacccgcctctctttccagctggtctcaccctacttgccctcttgcgccctgagatctagccactctcacatcttcactttgctgaacacaccacattccctcctgcctcaggccctctgcacacactgctcaccctgtctgcaaggctctctctgttctttccttgcagaggcggagacggtgcctgtgcaggtctcagcacaaatgtcacttattctgtgagagttctcatgactccccaagccaaccatttaccagtacattctattcttgattattcttttgctttgttgcatacatcactgtgtgtgtgtgcgtgtgtgcatgtgtgtgttaaatgtcaaccagatcacaagctgtatgatgatagggatcaaatgtctagcagatggttgataaagttttgttaaagcaaatgtcagttgaattaatgaatgggtgctgtgtataggatacaaaagcagcctaagaggaatggtaagtaactgtcacgttgagagtggcttcagagggacagccacacctaagaagggggtttgcatcagagagcagggctggccttctctggcgtgaacagcagagggtgcagaagggaatggggatgagggaatcacacgggaatagacggggagacgggcaggagag

SEQ ID NO: 31426 - DNA, 1872 bp, Bovine  19866880504097
cttcccttggttccaggcagactcccaagagggttccctggagtgttcggtgttccttgtctcctgtaaagcactgagagacagaagctgaggcactgctcctttcctcaagtgcagaaaccccaaaggtaacctgagaaggaaccagatggaggaagagaggatgtggtttggatcatgtcaccagcagcacacgtgaaggaaggaagtgaagtcgctcagtcgtgtccaactctctgcgaccccgtggaccgtagcccaccaggctcctctgtccatgggattttccaggcaagaatactagagtgggttgccatttcattctccaggggatctttctgacccaggaatcaaacccaggtctcccacattgcaggcagacgctttaccatctaagccaccagtgaaacccacatcatcagtggccaaagagaagtcatcaccactttcctttctaatatggaaagttcatagctagatgctcacctggccaaggttaagaccagcttagcccagaatttaggagtacacacaggctttggagccagacagacttgggtcaaatcccactcccactgctgactcactgtgtgatcttgggcaaggcatttcatctctcccagtctcagttttctcatcagcaaaatgggtaaaggctgccacctctttgggctagtgtgagaactggcaccattagtggggcttatgctagtatcagggcacatgggaggtaattgctaaatggcaaccacactttgtactgatgatcaagaccctcctttctgctttgagttctaagtctttctagtccttgaaggaaaatctcgtccccctcctccctgaagcctccttggatcatctgacaaggaactggtaccttcacggagtcacatgtccagccagtaactggggagacaaagatgacccagacatgactcctaccttcaagtggcttatgggcctcagcaaaacccaaactccttttgcaccacttctccacaatgagaagggagcaagcaagttgactttttcccaggtacagctttctcatctctgcaatggggatgatatttcccacctgcactggtggtactaaacatggaaatagacaggagcaaggagggaagagaggaaaggagacgggggagaaaagggagggagggaggaggggaggcagagagatgggagggagcaggaagggatgcagagggaggaggaggggaacgtgcgaagacccgactgcccggagataggaactggtgaaggagtgagtgaaccagtgaatgaactctctttcccctgctgtctccaggtcctacaagctgtcctcctctggctttctggttccaggatgcctgtcccagatctttatcattctacctggagagagatttcatttcccaccttttacagcccaattttcgatatgtgaaacctgtttaaatggccgctgctccccaaaacaatgcattggacagagagcccgtgcgttcatccgtttgtgggcgttaataatacatggcaaaaagccgctgctttattttattttgtcctccaagtcaagctctttaaatcaaatatttaggaagggaatatttaccttcacgtcatcgaggaagcatttctggtcttaaaggcacatgagcactgtggcagctatgagatggtctgcacaacagggagtatactttctaagaagccatcagaaaactactagatctcatcaacgaattcagtaagggtgcaggacacaaaatcaatacacagacgtctcttgcatttctgtacactaacaatgaaaaatcacaaagagaaatgaagggaacaacgcctcgtaccaccccactagaagaataaaatatacaggcaggg

SEQ ID NO: 31427 - DNA, 1244 bp, Bovine  19866880540412
attatgacagtggaaagcatacgttaggagagtcacatggtgggttgggctgaatgcacacacagttgctgcagttgaatgtatgtgcagccactgctctggacgcacagtgtcaggcagcacagagccagcgttgtcccagacactgaaggcaagcaagggattccagcacagcacagaagttcacagggtcacacgttgccatcgcagtacgtcacccactgcgtccacaaatgactggttccagatccccaagaagacctgtatccatgattctcatcacagttttatagccagctatgacccaccctctgacaaccccgtatctagggaggcaatgtgactgctgctcccttgtcacttgggaggaaagccctccctcctcccgtgagtggtcctcgagtggcagctgcagcagtgtgagacagcagtggtccacagcctgctcctaatggaagcagcccagatcctgttcacctcggtgatgtggcagaaatgggcctcttgtggccagagggcttgggtatgcttcccagcgccgtgtcttgctattttgagaaccagtgtgggcaagcgatgcagttctgcgttttgttgtgcttattttaactgaaggtcatcattagccattcacttaggctccattgccttcataattagcatttttgctgactgtatactatttcatcagataaaagaatctgtcaaaatagctccttattatggactctttaagaagttccattttgcgttactgtaaaagttgcttcaatcagtatctttgtcaatgtaaccttttgcttcagttgaataatttccttaggaaatggggtaagttttgactacctcttacggaagaccagaaggatgctgtgatgacattttttttgtattaccattttgtactagccaaaaatgggatgaccagacctattcttttttaaaaaaattctttctttattgccatgctgtgtaacgtgcagggtcttagttccccaaccagggactgaacccacgccccctgcactgagagagcagagccttaaccaccaggccaccggagaagttccaagaccagaactattcttaagtaataagtgcttaaataaattatgttacatccaatcagtagaatactatgcattaaaaagaatggggattattcataatagacaaaaagtagaaacaatccaaatgcccatcaaataatgaatagataaacaaaatgtagtctgctgctgctg

SEQ ID NO: 31428 - DNA, 935 bp, Bovine  19866880586826
aatggtaacccactcaggtattcttgcctggagaatttcatggacagaagagcctggcgggctacaatccatggggtcagaaagagttggacacaactgaggaattaagatattgttgtatagtttggttagagaattgctcgtaattcatttcttattaagaactctgataactaaaaataactttcatatttactgtttctttatccaagtgaaaaatattgttttaaattctgatataaattcaaaaataaagaaccaaaaaatcaaagacttctagacttggaagggcctctgaggcttattagaccagtgtttctttaacatgagttctttaaaaagagattaaactttgaaattttataaagagctgaaagttagaattacgttgatatttaccattttgagtttattttataaatgtttagattttataattatacaaaagtgataagcacaagaatattatgcttttaggtctgtacatatttaacactgtactgaaaatatttctttatttttataaataacaaaaagtcaacacttgagagtcctccagaatattttatcctttaaaagagttctatatattactcaaatttcagaaacactgatctaaataaattctaaccaaacgtaggaattctttgcttcatgtccttgatgataagtgctctaaccttttagcaaacaggtccacttattaggtttatgaggaaataaaattcatttccccaaagaaggcacttttatctgctgccattagccacaaacatgtggctgttatctttaaatttaaatcaatcaaatgtaactaatataaaaaattcagttcatcactcatactagccatgtttctagtgcttaaatagctacagatggcctgtactgagcagcatagttttaggacattcccctcaccacagaaaacgcta

SEQ ID NO: 31429 - DNA, 910 bp, Bovine  19866880597137
ttgactggttccttcttgttgagtcataagataatcctgaacttcatatttgatgaatacaggtttactttgctagatctttaagtacctcaggggtatttttatgtaagactgtgtatatgtatgtaggtagggttcttttttttttttcccagttgttttctcttttgcagagttacttgagagacatgcttggaaatgtaaatttctattacagttttaaaaatcatcttctctagtctgatcgatgcagacttcaattaagattaactaaaatcactgtggacgcagggctgcagccatattaaaagatgcttgctccttggaagaaaagctatgacaaatctagatagtgtattgcaaagcagagacattacttttctgacaaagtctgtgtagtcaaagctatggtttttccagtagtcatgtgtggatgtgaaagttggaccataaagaaggctgagcaccaaaaaattgatgcttttcaactgtggtgctggagaaggctcttgagagtcccttggacagcagggagattcaggttaaccctaaaggaaatcaaccctgaatattcattgaaggactgatgctgaagctgaagctccaatactttggccacctgatgcaaagagctgactcctttggaaagaccctgatgctgggatagactgagggaaagaggagaggtggcgacagaggatggggtggttggtggtgtcactgatgcaatgggcataagttggagcagatttcgggagatagtgaagagcgggaatgatatgctatagtccatggggtcacaaagagtcggatacaactgagtgactaaataacaacaaatacatcaaaatctgggttgtgtctctgagaaccttgggactttgctaggctgcagtgtcttcaagcagaa

SEQ ID NO: 31430 - DNA, 1440 bp, Bovine  19866880599270
tcaaataagtacatttgaaattttgataaatactatcaaactgttttcctaaaatgctgtacccatctatacatccactaagaccaaatgagaagatccatttctcacatctttctgaatgctgaaataatctttttaattcttatctattagacatacaagatgagaaatggcatcaaaccactgttctatttctcatctctttgacagtaatgaaactgaatatactttcatgttaacagccatttataatacttttgtgaacagacttatcctctgcacatttaccatttggtgtctctttctattgaatcacaggtgctctttatattatgcggatactgttacacatgctgaagacactacctgccagcttgttgtttttctttaactttttaaaagataataattcgttaaacaccactttttaatctttatgtaagctaaatctgtcagtatttttctttgtggtactagggttagtgttcgattagagggccttcccaactctaagattaaaaacacactctttcctaatactttgatagcgcttttgttggttgatttttgttttgttttcattaagattgtcaatctcctggaattaatttttgtgactggaggcatctaagttcatatttttccaaccaaaaatattaagttataaataataaaaaaaataataaacaaaataataaaataataataaaataaataagaaattatttttattaaaaaaataaaaattaaattccagtgtactcatggtgtatagtttatgaatagaataaagtagtaaacagtttggagcagggatcagtaatctttttctgcaaaaggccaggtagtaaatattttttggctttgtgaggcatatatagtttctttgacaatcacttacttctgatattgtaacacaaaaacagccacaggcaatatggaaataaatgagtgtagctgtgctccaataaagctttattaacaaaaacaagcagtaggcctaacctggcatttagactgtagtttgctgacgctttctagagagaatcactaacatgtagaataacaggaggttatgaatttgaagaagtcacacttcacacttctgatggagaactgtcactagaaacagtaaaagatctgcaacaaatccagcgacattaggatgaaatagtactgtaaatcccatatatatttattttttcattttaaagcacaaaaattaaaataatgtctgtattcagaaatgttggtaacctaccttaaatttcttgccaccatctttggaaagtgaaaggttcagagattttaccaaggccaaattttcctgtttagtaagttttttaacaagggcttctgtaatatatcgaactcctgcatgtgaatcagcttctgaagttatgcaaacagcatcattatcaaaagaggaagacatgaata

SEQ ID NO: 31431 - DNA, 673 bp, Bovine  19866880604761
cctcagcatgagcgggacatcaagttagcacctatacacatcacattgttgaagcctaacagtgcttcggtggggtgagtgtggcatcctcgtgttaccactgagggggtgaagtctcagagaggtgaagtgcctgtcctaacgtcgtccagctagcggccagttgcacgagaagtcccactgtcctgactacagagccctcagtgataagggctcccagtttagcaggagtggcgtctgggccatgcagagagaggagatcccagttgcacactcggctactcttccttatttttacccagattgaagaacttaactctgaaatcgaagagctcagtgctgcctttgctaaagctaaagaagccccccagaaagcacagacccagaaattccaggtaagtgtcggctttgtttgaagtggtcctccctgtgatccttacccctgtgaggtcaggaccgtgctgctagaaggagcccagggagctccgagaggtcgtgagaacagagttggctcagccggttagaggagcttctcctgcagctgtgggccgctcgccagccccctcgtcagtctgacatgaagacggtgacggctgcgcccagcggtgcgagtgccgggcgcagggccgagtgccctagctcaggagttggagtagactgtgagatgtgtgga

SEQ ID NO: 31432 - DNA, 1460 bp, Bovine  19866880643598
ctgtccatgagattctccaggcaagaatactggagtgggttgccatgccctcctccaggggatcttcccgacccagggatggaacccgcatctcctttggcccctgcattacaggtgtattctttactgctgagccatgggggaagccctacgtggcaacagagctctgcatttccatcgcccacctcattttggagcacttaatgtgctctccctcacttaatgcactctgcctattctgcctcctttcagaccctttcctacctcatgactgcacttgctgcttcttgcagtttttgcagaactagcttcttcttttgatttcagactgaatgctacatcctcagagaggctttccttgaccaccccaaggaaatgtttcccagtttctctttgtcacagaaccctttcttctgctttgtactatttatcgtaggctgtaaatatcttgcttacttacatgctcattaacaggtgttaattggctatctcactcgatatattgtaagcaccacaagggcgaagtactcacccttttttaaaatcttattcactaggatatctcttaatcagtatttaatatgtttctgctgaatgaatgaatgatttaatcctcctagaagcagaatgtataaaccaggcattatatactcactttacagatgtccaaactgaagcctagagggctggattcttgccctgatgacataggctggaagtggtatagccaggccctagatcatgtgcttttcctgctagaccctttcaccctgaagggagatagactctgggtggggaacccagcttgtctgattcataatctaattccccaacatgagaccagagagccaagattccaaagttcctgtctgtaaagaggtgtcagtatgtggctaaggattgcaatccgttccaaattccaggctgcattgacgcatacacccaatacactcaatgatcacaagaaaagtgcagagactgaggaagaaaatcagacccacaggcctgagagctggcctaatctcctaggatcctcttcagagctgttctaatttaggcctgatggaatgggaaagatgttgtttctagttcctttagtttaatgtggcctaatttggaagattttgccattttgaggtctcaactactgcctgagagcagcccttggttattgttatcatctaaaagaatactttggctgtcagtagagagctagcagcatttctttgattccaggagggaaagttcctggtgagggagcctggtgacataagaggccctggaccagacaccagaaaggcgggtgctgtgagcaggaaggccctgggctcccaccagcagactgttggcccctcgccggctcccagcttcctcctctgtaaggaatgatgcaggtctgattgtggcctgagagtcaaggggggtttgggatctgaccccggctctgtcactaacgtgga

SEQ ID NO: 31433 - DNA, 1166 bp, Bovine  19866880655733
cttttacacatttttcctttttttttttttttttttttacaataaacacacattacttaaataatcaggaataacccacattagaactcatttggatctggggatatgtctgccagccatatcctagatctgcttccatattctctcttcttaagttgatgaggaggagaaaattttaagttgtaaattcagattaatggcaaagcaccttccccaatgaaactaaatgctgaaatcctgcctgaaagtccttctgatgctaaaataagctcagaaaagcatttgctgtccttctccgcgatccactgaaggacgtcattcacagtgggcaccgagtcaaaccctcgctcgtcatcaccgctggctgcagagcaaagaatctgaaccatttgggagaggaatggggtcagggcttcacaaataactctttcccttagcttgctataattataatacaggggattactgacaggtgcagaacacacacggctttcccagtcattgtctcgtttgagctttgggaccactctggagagaaggaggcggggatactagcagtgacaggagtagtgtattgcactaggaatcgttagagtagcagtatactaatcgcagtagtgactaacatttactgaccacttattatacgccggacatcatgctgaaacccttcatgaacattttcccttttaaccttatactgtgaggtagaagtgattgtccccactttctaggtcaatatagttaaagtgaaagtgttagttgctcagtcgtgtctgactctttgcgacccatggattgtggcccgtcaggctcctctgtccatgagattctccaggcaagagtactagaatactggagtggattgcttttcccttctccaagggatcttcaagacccacggatcaaacctgggtctctctcatcgtaggcagactctttaccatctgagccaccagggaagcccataggtcagtatactgctgcttaaaaaagtcaaatgacttacccaggatcaccaaactagtaaatggaagaaagtgaaagtgaagttgctcagtcgtgtccaattctttgcgaccccgtggactgtagcccaccaggctcctccgtccatgggattttccaggcaagagtacgaagtgggttgccgtttccttctccag

SEQ ID NO: 31434 - DNA, 910 bp, Bovine  19866880713234
tttgctattataagagtactatagttacctttgtgtacacaggactttgttttccttttcttaaatgattttctgattgtcctctgttctttaaacgtgactgaatttgttaaactcacatgtataagccagtcctcagttaaccctgtctcaaagcattggagttacattgtttcagagctttcacaataaggaaattattttgttaagtttctttaacttagtatcagagttagtgacataggaaaaaaacttgcaagtagtcagttaatataccttaggatcagctataaaagtacttgttttagttaattgaggaaattcgttcatggttaggctttaaatgataccaaagaattattttttaaatatgtggtagaggtaattgtgttaaaaaaaagtcatgtttgacattttaaaataaaacacaggtttagaaactctttgaggagggttgtgtcataatggaaacaagcagcagctgtgggccttgaatcagaagagctcggtttgagtcataactgtcttggcaaaacagtacgattgtgattctggacaagttacaattttctcatccttctgtcctcatctgaaaaggagatccaggatcattgacctttcacgtttggtgggaagaattaaataacctgtatgaaaacagtttataaactgtcagtcacatgcaaaaccttggcatttcagagccacctgtatagaaatggtgacatcgctggcctgtactcatcatggacgacagtaccttgctcaagaaggagtcattgatcagatttctaacataattgttggggcagatgcagaccctttctctagcttctatttgccaggtaagaaatacttgtggaaatgacagcctgtgttttgattcagaattaatctttgacaggggaag

SEQ ID NO: 31435 - DNA, 1073 bp, Bovine  19866880733712
ctgaccatttcttttctgattaaaagaaaaaaattaaattgcaaaagtaatgcattcccaatgttgaaaatactgcaaagaataaataagaaaaataaccacccataatgccaccacccacagataaacactattaaggttttatcgtatttccttccagtctttttatgcttttcaaagtagttggaatcatactttataacctttttctatcttgctcttttacttaatgttatatcattaagcatttttccgtgtcgttaagaacacttcacaagcatcatttgtaggggtggcacacgtattctatctgtacagacagttccatttacttagccattcccctaaatccagcatctaaatttttcttcccataatatttcactattatgaaacgatgctgcgacaaacatatttggcacatcaatctttgtccacatgtcagattattttctttggagaattactcagatcgaaaacttcctagtcaatttgctttccagaaataccagatgcaggttttactctttttagccaactgtgaagatgtccgggttctcctgctccctttaccaggcgtgactactatcaggaaaaagaaactttgctaactcgatgcgcaaaaagagtacttattcttatttcaggttgcatttctttccttagtatgctaatgctatgctaagtcacttcagtcgtgtccgactctgtgtgaccccatagacggcagcccaccagaatcccccgtccctgggattctccaggcaagagtactggagtggggtgccattgccttctcctctttccttagtagtatggcccaataaatattgtaatgtttcctggctatttgagtttcctctttttgaattgtcttgtttctgtttgatcatccccttttctctaggtgctggtttttcctctggctttttgtctacaaatgtgagttatccaaatcaattaaaaaaaaataacaagaactcaagagcaaacaaactttaggttgaatcacaatgcgctgtaaaaaagacgtttgtaatctattcctgagtaccagaccactccaaaacgca

SEQ ID NO: 31436 - DNA, 1064 bp, Bovine  19866880752645
cattaatataaatccagctaaaggcaaaatggtttggacaaatcaaaccccaacctcaaagcaaaggaattcagaaactcttgtctaacatcttgacaagacaggttttatttgtttagttccaggcccactttagatctcaagaggaaaaagaacagaagttgtctctaactttgcttgaagactttcaatcagcaggaagaagagctttattttttaccaggactcagatagaaattggcttttatcaacatcagcaaaactgaacatccccccttaaggaggaaaaaatgggcctccctgcttaaattgtgtatttgcccaaacatactgacttgtaattgaggaaggaaaaaacaaaacaaaaaaaaaaaaaaacggtgcaaggaagggatttaacctaatttataaatgtgctcagcctagatatacacctgtcccaaatgactactgaatccattcatttgcagggaaaacatggattacaatttcttttttcttttggcctcaagtggtctgtactactgtttgtaaacaaaatcctctcaatatcttttccacctgtcacatgcacgtctgatatttacatgaacaaggaaagtggagccttaggaggaatcccttcaatttctgatctattggtcgcaggaggtactgtgctggtttccaaacttccccagatcacccaggcggaggggcacggtgagcgaaccgaacccaaaagtttgcgcccatccagcgcgtctgacaaaggcaaagacagcgctgtttggaaggaggtgcgatgctatccacgcagcagtcgctcccctcccaaggaagcacagcccaagtgggggacaaaaggctttccagattggggactggggaggggggtggggcaggctatctagagcttggacctccccttgaagtcgaaatctggggaacctttgggggccagaaatgctccattccagccaagaagcccaacgctagaaggacgggcagccgcggggagggtccggcggccgaggaggcgctgggactcacctgggggaggcggagagggggcttcggtggca

SEQ ID NO: 31437 - DNA, 1053 bp, Bovine  19866880799111
agatatatatgtggttctgctttgagaaatttgaatgtaattttaaatgatctactgattttagtcatacttacgtttttgcacttgcttcaaggaacaataaacctaaaaataaaattcagactatgaaacacatttcaaattaactcacaaggacattctcttaagtcacttctgagtaaaacgttcccatcagctttcagtactaccaccacagtattttatgaaagactatgagtctgaaatggaaggaatctttatgtcattaaataattctattgccctcaaaatgaatcccaaatacaaacgcattttgtatttcctcattcttcgatttgagcaatttgcacttaagaaaagaaaaaactgtcaaatcatctgcattgtcaaaaccccacttctccttagaaatctcacatgtgtgaccgaacgccattaaacctcacaagaaacccaccgttttcttcagcaaactgtttggcttcctcatacgtcacatcccgctgagcctccagatctgctttattccctataaggattatcacctggattgtaaccgaaagagagacgtcttacacaaaagcaacctttaaatcagacatgaaaactctaaaatccaaaaatctggaggaaaaaacatgcaggtctacaaaggaaactaaatactaccaattacccatcggacgatgaccacagaatcgtggaaggtgtaactatgaagaggcacagagggtgtctccaggacactgcctggaagagaagggttctgcctttcattagattttcctaagttcctggaatccacagaaagctttaaaactactagttcaacttctgaggctacacgtaaggaaactgatactcaaagcaaacaaggacttgttagaagatcactcaagagtccgtggtaggcggacatcagaattcaggcagaaaacccgaactgtgaccttccaatcctgtcctcccctacactatcccctcggttagacgagggtctgtagcagctgataacaatgactgcatccaggagaggggacagcggggggtggg

SEQ ID NO: 31438 - DNA, 4110 bp, Bovine  19866880858581
tcctcaatggaggaaggcattaatatagaggaagaggccatccctcttgagaattcccattggctgcagataatggtactgaacagaggctcagagtcccggaaaacatcaaaagtcaccctggtgtggctgggttttatgacctctaagaagtcccaaagctctgcctgcttctctgtctaggcaatggccatgacttcacacagactcaaagcagagccattccagtttattgtacttcagctccatgatgccactgggcagaaagatggaggaactggggtccttttacaggcacagcttaaggaatacaaagattgagcagatgccgttatagccttatttgtcttggtcacgcagcatgccctccctccttagtttgcaacaatcctagatctacatgtggctcaaagcacttcataaacaccgaagccaccaatcttaacacaagttggggtagaagggcaggataggtaagagccgccagagctgaatacaaagcaagtagcatttacactgacaagcagctgtgccagagaaactcagtgaggaacagcaaggaaatcagctctggtttaaaccaaaaaaaaaaaaaaaaaaattcattactgctattatcataggccttcaaatgtgtacagatacatatgtgtgcttgcatgcatgtgtgcacattcagtcctgtccaactctctctgatcccatggactgccccttgccaggctcctctgactatggaatttaccaggcaagaatactagagtgggttatcatttccttctccaggggatcttccagacccagggattaaaactggtgtcagttatgtctcctgcattggcaggtaagatctttaccagctgagccaccagagaagcccctacatatgcatacatgcatttaaaaaataaaacttaaacatcacacacacatataaacacacaccaattttctttgaaacagtaaattctctttcagaaatgacttggaattgggttaatctcttagacctaaaaagggcctcacagatgatttggtttatatgtctgcattatactattttataaatttagtcatgtttatagaggtcctaccgggtgccacaaagcaaatatgtaaagttaccttacctaaggaaaaaaaataacagaaaatgaggcttagaacacagtttcctggctccctactgtagtattctctccattatatcttttggccagttaggaagctgctgctgctgctgctaagtcacttcagtcgtgtccaactctgtgcaaccccatagatggcagcccaccaggctcccccatccctgggactctccaggcaagaacattggagtgggttgccatttccttctccaatgcatgaaagtgaaaagtgaaagtgaagtcgctcagtcatgtctgactctttgcgaccccatggactgcagcccaccaggctcctccgtccatgggattttccaggcaagagtactggagtggggtgccattgccttctccaagttaggaagaaactacttgtaattaatgggagaagtcctccctggagcaactgactgcaagtcactgcctttgacaattctcagagtaggtgttagttcagcagtttaacaacactagggctgatgggattttcccttggtcttttcatcatgcatgttgtgtcaggtcacaatacggctgctgcatctccaggcattataacctcctttcagtgggaaaatggagtatgggaaaaggcaaaagattcttctgcctgtactgcattgatcagaactctactgcacggccgcccaatctgtacgagagactgtgaaatggaatatataaaactatccacattgctgcctccaagggaatctataagcaaagaatggcttcccaggaggcgcaggggtaaagaatctgtctgccaagaaggagatgcaggtttaggccctgggtcaggaagatcccctggagaaggaaatggcaactcacttcaggattcttgcttggagaaaccccatggacagagaagcctggtgggctacagtccatgggttgcaaagagtcggacacaactgagtggctaagccctaaactattatttctcatatctaagagattaattcccagaagtgattgcttcattttctcttttatctagttctcaaccaattgaagaaacagaaattaaataacaggagtccttatctcatctacttggcaggcctaatacagtgtttatattctgagtcttcttgatatacaggggaatccattcaagaatgatttaactaaataacattagacccttttatatataaaatgagaacatgtttctctttactgaattgaatatgagtaatttatacactggtgaggagaaaggaaaattttttcagaactgttttgctttaaaagaagtgatgagctgtggaaatgaatttggactgttctggcaaacaggtgcaagttaaggattcatttgaccatttggtaggagggatcccggtgaccctgagcgcaaaaacgctcgacgcgaaccaagagataactgacttggagtcgaagaaaagtgtaacacgttccagtgacggagtagcttcttttgtggtgaatctcccatctgaagtgacggtgctggagttcaatgtgagctgaattctcctgttaaattttctaggacagtgtgtacttttgactgtgtgtttttgccaatgtgcagaaaaaaatgtggcagattttagacatgagtccagcgaacagttccacaattttgcaaccaaaggaaaaaaaaaaaagcaccagaggcaatcttcaaattaattgaatggtcctttaggaagataaatgtatcagttttttatttccggtggattattttctcttgcattaataagactgtattaaaatctagaagcatgaaataggaatagcagtgaaaattagtgatagaaagtctctctttcccgcttcacagcctttcgtctctcttcagggccacaaaggggtcaagtgtggaaacctctctttttttctagctatgtgaatcactgtatctgaaagttcacttaatagtctcgtctcccagcaaataacatttaggttcccaactccagataaaaaataacttagtaatgtgtgtcaacgacatcgacagcatgtcagcggcacagattcactgtcgtctgctgagcccgtatgaggtgccagacgtcatactaagagctttatgtagaacacactcaatacccatttaatcagctctcggaatcagagaatattgtctttgccattttgctgctgaggaaacagaggcttacctctcttgtggttaaataacttatccagacttaataaatgatggcccttgaatgcaaaccaatgtatatctcaccccaggcattaacccctctgctgtcaaaggccgatatcactgccatgatatcattcctgctccactctgagtttgtaagcccttgtctgtgccacgacttcacagtgaaactgggccagaaagtctgtgtgatgtccattcataactcctgtccccagtcctcgggacctgcccactgctacccctgtaacccataagaaaagaaccccaagcttgccaagacacttcaagaaggatgccaatatttgctccatgagcatcattctgttttcacttcaccagactttcccaccataactcacagtcccatatcatcccagcttctgtccagagcctttgtaaagttatttgataccacagctgtacaaacacattggaggagtggatttctttttctttagcaattggtgttgtgaaatttagaaatgtataaagcaaagaaaggaatttaaaaggtatgtttcacagaaaacatacctttacatcacagtccatgtatctttgtttaacttttgttttccttttcagatcaagaccgaggatctagatcttcccgaagaaaatcaggccagtgaagattaccgagcagtagcgtattcatctctcagccaaagctacctttatattgactggacagaaaactataaacatttgcttgtgggagcacatctgaatattggttgttacacccagaagtccgtatattgacaaaataactcacta

SEQ ID NO: 31439 - DNA, 1688 bp, Bovine  19866880899321
ctcctctgtccgtgggattctcaggcaagaatactggagtgggttgccatttccttccccaggggatcttcccagtccagggatcgaacctgggtcttccatgttggcagacaaattctttaccactgagcctcctgggtagctccgtccaacaaccttgtgactccctgttatcagccagaggtgtccaggtctgtcagtgtagtgtgagtccagctcacctcttcacacagtccttgctctttctttgcctgtctgtgcagcttggatcttcccgcgtcctcgtggggaagccctctgtgccgttcccacccgtcctcaggccagcctatagggtcccattggcctcccactatggttagtctgctgactagcatccccccactgggcctgactcagtgttttgttcccgagtacttcgctgtgcagttcatttggcagttcatcacgtggtaccttttgcagttggcaaaccattagcttttacccttgatctgtacattttttaaaatttaggtgaatgctttggctctccagcaacaatttaagattgagttcttatgtgatgctcaatacggttaatattttaataaatttcatgcattatctcaggggctatgtgttatgaaggggagataacttgaagatgtcagagcactgaggttaagtggaagagcaggtacacacagccctccctcttcaggcttcctgctctgccgtgttctttttcgtttattattaacgtgcagttggtttacagtgttgtattaatttctgctgcacagaaaagtaattcagttatacatatacatacatttttccatattctcttccattacagtttatcacaggatgttgagtgtttcctgtgctcaacaacaagaccttgttttgtgtctcctctgtgtataatgttttggcatctactcatcccaaacccccagttcatccttctcccatcccactgcccctggcagccatgagtctgttctccttatgagtgtgcttctgtctcgtacataagttcttttgtgttgtattttacatttgccagataagtgataccagagggtacttgtctttctctctctgacttcttcacttactatgataatctctaggcccatccatgtggtggctaaaatgatggctgcattcttttgtatggctgtgtcatattccattgtgggcgtctgccacatctttatcctttcgtccatcagtggacatttgggttgttcgcatgtcttggctgttgtgagcagtactgctgtgaacgtagggtatgtggttctgccatattctataaacatccaaagtgctctgagtacagcagagcaggacgtttgatgaccactctgtggttagacatggggagtccttgccagtgtgatgttcctctcctttgcattttaacgacgtgttcttttctctgtggcaaagctcatccaccaacagaaacttttggagaaaattgctcagactcatttatcataatgatctttactcttttaatcttacgcatatatgtgtagatttacgtaatcacgaaacattattttgtattgtgctgtcggaattgtgctctgagtctttgcaattatcataatactttgtaatattcctttattacatgtaatttgctaaaccattcctgtttgggtggataattgggtcatttccaattt

SEQ ID NO: 31440 - DNA, 2996 bp, Bovine  19866880942139
tgtggtcaggccactgcctgaggaaagcccaaagacgaggaagagagccagactcaacgggccaagagggctcctctgctgcccccggggcggggctgccagagcgacccgcacgcccaggaaccacacactctgcagcgcagacgccaggacttaacccttccctggccctttcagactctcaaatgccgccacgcgagaacttccagaggcaggaagctggacatgtgggcccggggacaccaactgtctgttccttatcgggtccgccgtgggggcagggcacagggggtcccgggtaagtgcgggaagaaagaacatgcatccggccaaagccaggggaagatgcatggcagtgagaaggcgcgtttagagggttaactcaggaaggagatggaaagagtgtttactcgtttgtttttccaaggtaacgggtttgttaaggttccatctatactaccggagtgactggtgacgggacaactctccgactcctgggaccttaccagtcctccagacgtgcccagatgcccgtgacctgcagcccagatcccagggccaggcctggagtgcgggcatcacaaaacatcaagtgcatcctcccagaaacgacccaaacttgcggaaacctacaggcagacctgttgacctaagaaggcctccaaagcccgtccacagcaaaggtaatttccacagagacccccagaacagatgcagccttgacacgtgtgtggggctgttattctttgtgatgagctcgtgatgataagagcattccttcttacctctgtttgatctactgactcaggcttgttgtctcctgggaaacccacgcaggaaagatcaaaaatggttttctttaggtgctggttgtccgcgtacagctccttgaccagctggataaggtcgccgacctgggagatcagagcaggagagacccggctacccacaggcacacttctgcctcttggggccatggttactgagcagacctcccagcatcacagtcatggagagccaggcagcctgactccaggcttcaggctccccccaggtacagtgagaaaaacacccaggcatctctctgttgtagccccagagatcctgggcaagctgcctggtctaagcctccgtttccgcttctgtagaatgggctaccacgagaacggaaggtgaccacgggccacggtgcactaatgccccctgcgcagtctaagtaccccatccatgacagcgtacagcacctctgtcttgcacttgagagcctccggaggaaaatcccccagactgacacttctgaggctgtgtcggaggcttgttctatggcctccgccttcctctctctatgcctatctaccactgtccagaataacaacagtcttcagttccaaagcaattcatggcaactgaaacactccctcgagctttagtcaatcactccttacaaaaatcccacggaggtgcacaggccggtgtgactgtccccatttgacaaggaaaagcccgaggtataaagcagctcactgcccgaggccccagagctgggattcctggagaattcagtgatgtacaacactggccagagtgccaggtcaagcgggcaagggcagctgcccgcacaaagcagagtcaggcctggactcccggtccaaggcccctccttaaggcacaggtctcacaaggacaggtgcataagcagctgatcagacaccacctttatttcctgcaaacttcaaattccagtggtcagtgactttccaaacccttcttcaaggggtaatcattcgcccctgaaataagcgggaaatcccacctcagcacaaagagcaggtgtcccctgcacccaaacgtaacaccaatcagacccaaccctaaaggttacagagggaagaacgagacagtctgaccctgcaaacagccacggagtgccagccaaggggactagctcccgcccgacacacagccacagtagggaccagccgtggctcctaccacctcagcttcctcaccctcagaacacggacagatgcctcagtgcttcctgctgcattcctctgaacataactaaacttctacactcctgttttttatcttttctgtaccttttttcctctccctctctgccgagaaagttttctagttagataagctcctactcattgtccaaaaccacctcaggtctcatttctgttgagacgcttcctctgatctgggaagggcctcccccaccccctacccccaccagacagacaacctctctttctctgctgcgcctgcacctcgcatctctgcctggcacagccctctgtgcactctgcagtaacacggctcggacacacatccatctgctctaccaggatgcgacttattccaagacagaatctgaacctgtcacacacagatgatcattttacaataaaccacagtgtcctctgagttcacacttcctcctcttatcaatggctcttagagccttgaaatactcaaccaccctaaccacaccaatgataacagatgggaagacctttccaagttttagaaaagatttattgaccaaacctgaacctttattctttcaaaaaccatctattaactcccactatatgtgccaggcaggcactgggaaatcagaaataaataagatacactcactttaaggtgagtggcctactggggatatagaagaataatcagataattatagaccagtatagcaaggacatcaatgaaatcaggtacaagaggagaggaagaagaccagagggaaagagggctaattccaggggggatggggtgcttcctggaggagatggggcctgggtgggggtcctcaagcctgagaaagagtgcatcagacacggggggtgggggggcggtctccatggaatgtccgtggagagacgggcagggagagaggcagcagaggcagggagaagggcttttggaacctcacacctctaatcaggaacccaagagacaacaaataactaacaaag

SEQ ID NO: 31441 - DNA, 997 bp, Bovine  19866880983029
cactgtgctgcactctttcccttataacatctcactgacttctcgaaacacctgaaggaaaggcactgtccccgctttatagaggagggcagcagggcaggccggtgagctgaccgctgaggtcctggagccgatgagtgctggcgccctgggggcaggcaggcccagctcctgcccgactcctccctggaaggaggaaggcgcagggctgtcctttctctctgagagaagctccttttgttcccccgactcctcacgctgtgcagggatcctggggctggggaaacagggatgaccgacgcaggagctgcagctgtgtacttttctccctgccagagagtggagaaggagtgaagcagtcagctctccccagctctcatcgcagaagcttcgctggagcagtctttcttttttttccccctggttaaatgtgtctgcagcacgaccgcatccgagcgagtgctgtgctatgacacctctgtgaggttttccatcagccttacaaattgatcattatgattgtcttgaaatggaactaggtacaagttgctgggaaggccccttccctggcaaggaggctgcctcacaatgaaccatcttcaaagcagcgagcatagaagattagacatgatggtttattttccttccaatagatgttgatttcttcgtgcagttcgatggacggagctggagggagtcgctggaggagaagagggacttgagtccgtggcgctcgtatcttagagcgacgtctccttagcatttggggctgtggacccctctagaacaacccgatgaaagctgatgggcccgctccctaaaaaaaaaaacccacacattgataaactctttcctacattttctaagtgttgatgggccttctcggggaaaaaaggtcacgtgcgagacagagtgacgcatttcttggtatttaagacaagctttctgactcgctaaggcgtttcaggagtcgcaaagcgtgttcgtttgctttgac

SEQ ID NO: 31442 - DNA, 1409 bp, Bovine  19866881020179
tcccggagcgtgcacaaactcatgtcctcgagtcggtgatgcctttcaccatctcatcctctgtcatccccttttcctcctgtcttcaatctttcccagcatcagggtcttttctaaggacacaaatacccataaaaaagaagacaggctttatttcaattcttaaaaaatctttcttcagctcttccagttttcatctacaggcctccagtcacctccatatccgaggatggggaacttgcagattcagagagccaagtgtacattgagattggaagtggctgttttttattcatcctggaagataacccttgctgtgaggcccagttcacatggggaaatgtctctctgaattcagtcattaacaagaagaaactagggacttccctggtgctcccgtggctataactccaagctcccagtaaaggggacctgagttctatccctggtcagggaactagaccccccatgccacagctaagactttgcatgccacaattaaaagagaagaatattgcagtgaagacctggtgcagccaaatacgttttaaaaataaaataaatattaaaaaagaaactagcacactgggcagtgtcaaatccaggaggtggcctttctagagcacagtgaggaggtttaaaaaaaaaaacacttgacagacgtatacagtttgaatttcaagcattttccctgatgttccctcatgtacactttcctatggctggacgagatttacatttgtcatttgtgagcttctcgtcgtattccttccagcggatgggccagagtttgttcatccagctgtcatttggtgcctgtgtagctctacctgctattatatatacaatcaacctttattaaagcaagacttttaaaccgtctttagaagtacttctttgggataaattcctggaagcaggttgagagcgcaaaggcaggagtagagtttcttggcctttcctgaaggttagatcattctgataaaaacccatgcatgaagactgcccatgtgtccttcctggtctgaaatggaaaagaaatacagaggcagtgccaataaggtaacaggacaatttgctgagccaggcagaactttctggaaggggctggacttttcttttccatgagaacatcctccgctgatatcccagtcctcagttttgtgttgttgtcgttcagtcactaagttgtatctgactctttgtgaccccgtggactgcagcacaccaggcttccttgtccttcactgtctcccggagtttgtccaaattcatgtccatagggtaggtgatggtcctcagaccatcaggctattcaggaccactccccttcacaactacctctgctagaatcgtacctcagcagttagcacagaaccgggcgctctctggaatctcccagaatttcc

SEQ ID NO: 31443 - DNA, 810 bp, Bovine  19866881055693
cacaggccaaggacaccccgccccgggccctcatcctttccaaagagaaggatcttccagaggctccacagggtgtacgcgctcactgcctccagtggctgctcaacagcacctttgcagaggctggctttgatgctcccgggatgaaacagagccacctggcccccaggccctgtcccctgactcagatgacttcctcctctcatttcattcccacctgccatgccgtgtgtcgtgtgcttactgcacccgtccccgggcagaggaccctggccccacctgctcagcgccctgcggccgtggcatgcctcctgaagcagccgctggttctctctctccttcccgtctacctctctctgcagccgctccttctccgcctgcacagcggccagctccccctggaggtgctccaggctggcagccttcctggagagggccttgcgcagcttctcgttctccttctgtttatctgcacgcacagagaagcgccgctgagaggagacaccgtttgtttttcccaacctcattacgcaaatacagcactttagccggagcacgccaagaatacaaaggagagaaggagatttcatctggcatttgtgattgtggtattccaattatctcatgcattttgggcagataaatctgtcaacatcaaggctgcaggttaaacgtcactgggatgagatgagcccgtttaattttctattaaataatgggctgtgccaacctagttactgtgccttcacagagcaaaaactgggcagacgttggagacagaggcaagaaacggggctcaagactctggcg

SEQ ID NO: 31444 - DNA, 821 bp, Bovine  19866881082813
ccctccccgtctccccttagagcgcagaaagtccttggagttctccagacgacacggtttcatcaggagatgccatctgagatttctcctctttaaggcactgaattaaagcatctttgctcttcaaagacagcttcaactcctcaatcagtctgaaagagaacacaatttaaatattaattctaagctgttccctcagctcagtggagcaggaggtaggaaatggggccagacaccttcaaaggagacatgtgggaggactgaagagttgcattttgcaggtgggagactaagggccagaattcacggggcatcagcggtccccttgcctccagcccactcatggccaatccaccccctgagcagccagactatggccagatcgagtcaccctcctcctcaaagactttcatcagcccccactagcgacggccatggattatgaatttgggccaggtcgggcaggggggcggggggtggagcgggaaatcttctctcccaaggaaatctgggagtgaggctaaagaaacaggaccgacagagctgagctgctgcagtgataatgaaaacaatgagtgcgtcttccaaggcttctcagggcaacgtgtaacagactggctgccaaggtaaagggccagctcctcagcaaggcactcaaggccctggcttaagggccaaggcagcccggcggccctgctgacggccaccctctctgccccagggcctctccagggacctccgtctaccccgggaaccccctcacaacttctgctcccacccccaccctgatggacgcccacccattcaccacccatggtcag

SEQ ID NO: 31445 - DNA, 1133 bp, Bovine  19866881156546
ttatggtctcctccaactccagaatggtagcccaccgaggttactgatcaagtgaggaaagggttgggatagatgacgcagaggtctctttaaacttcagagattataacacatgttatcataaagaagcaaatacttggagactcccattagcgagttaaagcctaccaaggaacagggcctttccttcaagaatcttatccatttacttgtttcatgtcctcatctctactttatttcagctacaagctcagcagtgaggaatcgtcatctgggtcctctcacgcggtaatggatatctctctgcctactggagtcaacgcaaacccagaagacttaaaagctgtaaatgtcttctcttaaatattgttatggatacttgcttttatttactgcattattttacaaagctatttccattcattctatgtcactttcttagactctcccagaatattcttttcaaactgataatctacctaagtttttatttttcaaagtgaaactgaaaaatattcagttttatatttatataaatattcaggggcaagtattatgcttgcaggtacagaatagtgtgcgtgcatgtgatgacatgttcagactctttcaagaggaggagctgctcttcactgtctttaagtagtggattacatccccacggcctcacattccatcactgggtgaacgcacttaaacagaaaggtcacgagttaaatttgagctcctctctttgttcccttagcttgtggaacaggtggatcaattattaactgactacgaaatcaaagatgggcatgttattctgcaactgaactcggtaagttccacctctcaccatttttcatttattattactatttaacagctgctgcctaaaatattttgagtcttttgtctctcatgattttcttaatctttgaatttgtcagattccttccaacgagttcctttgtgttcgattccggataattgaactttttgaagttgggtttctgagccctgccaccttcacagtgtatgagtaccacagaccaggtaatcaactctaaggtttcttccgaagactgctctgtatttattatggaatttgaagaaaggcgctcgaggcctgcagattgtatacatttctt

SEQ ID NO: 31446 - DNA, 1022 bp, Bovine  19866881224510
ctaggatgggtaaggcagggctgctttggaaagctgtttgcagtaacgtgagtgtggtaggcttaagggtgaagaggaaaagaagataaaggaagcattggctctgaggtgtgacgtgaccacatgaagccagagcctcagaatgttcggggcacggccctaaagcagcaggtccctggcgatctggcctcagagagctcctctaaccttccattctcccagaggaggctggtgtggagagaaatccgctcccaaccgccccctccccaccagcaactctccccatagatccttcacagggtggaaggaaatttgtgtggagataaaatcagagaaaagtttgcatgaagtcatccttattcaatttgggctgatttgaaatgtaaatattaattatttgctttgccagaggaaatatcactctaagtatagtggtctggatttatttaaaacaaacaaacaaacaaactttttttccctattgctgtatccctgaaagaaaagaaaaatgatacaatgcaataataggcaaattttaaccatttattaagaactacagcagtctgtcttttttggtgaaaagaactgttaactgagaacattctaaatttcataaatacctgtgtatttaggctttgattaagtgctcaaatgcttgcacagttctaactttcatttagaatatcttagttggagggaaagcaaggaagcaggaacaatgaggaatggctttgttaagtaatcagcattactgtgttttcaaataagcatgttaaatttaagaacgtaaatgactttttcttgggtgttctttagattgatggttctataagaaaatatcatcatgaaggataaaatgactgatgtataagggaagtcaggctgctgttactatttcaatgttttgcgtttaaaactaacggggttatttggggaattccctggcagtccagtggttgggggtcagtactctcactgcctgggttgatccctagtcgggaagtaagctctccaaacccagc

SEQ ID NO: 31447 - DNA, 987 bp, Bovine  19866881291880
aacttctttttccagaaagaaaaaagtatttatgaaagaatttttaaaaagcatatttttcttaccaccactcgtagtgtttttactaagatttcatttccaaccgaagtctccagtgagaagctgaggttgtggaggccgacttccagaggaagcacagtgaaggtgaccaagtggttggaggaaccctcgattttctggagcacacacttggagaatcttctcccctgagagtcagtgactggggttcctgatgaacagatcccctccacaggatgcattttaacacagaactgaaatatcaccagtgaacaatgatttcaaaacactttatgataaggaaagcacgccctgactatgttcgtctggacacaaattctccccggtacctgtcaaataatccctcatattctaaggcggtagagaaagttcatttcagactttctaaaacatgcataccagttgctgcttggtggattacagtccataggatcacaaaaagtcagacgtgactgagcacacacgcattcagcaaatgttgtcacgatagcatttgttacaccatctctttacatgtttataattccgagagtgggaacccaggctcaggtacgctgtgtgtgttattcatctttgtatcttacagctcagcctttcgtgttcagtaagtggttttatgaaatactagaactctatctcctggcattcgaggccctgactgatatgtcccccctagcttttccaatcttgcttctcattaacttcccatttgtatcccattatacatccacactgtggctccaggaagatctaagctcaaatcttggctctgccacgttctgtgtgccaagagcacatgaccctccacttcttcagctttgtaatggggagaataatgatacgtactgacttacggctcaaatagtgaacattttccatctgctctccaaaatctaatgaccgacagattatccccaaaagaataaa

SEQ ID NO: 31448 - DNA, 762 bp, Bovine  19866881338265
gctgtgaagcacgtgtcgtgatgctgtttggctggctggcacctgtagagtgggcaggcgactgtgagagcatctccatctctctggcttacctgagcatgtggtgaagtaaatgcagtgtgaaccgggagggtggaaacattctacccccgggatttctcgtcgttaccttgaaacagagagcctgaccctggctcacagggttgtcttggggcccgagggagatgtgggtgccaaggaaccgcccgcagggcccattctgggagcctgagcgtcctgccccgcgcggtgctggcactccagaggccagcctggtgggcgcagagggagctgcgggacgagaagcaagcgtgggtctctcctgtgatctcctcctccatgccatcgtgttcgagaacatttccttttaggagtagtcttggaaatggtacatgtgggtactgtttaattatagtctcatttttccagtacagctactgaaggtttgttttttttctttagccacccattcgtttcttcagagttcctcccaggcttcaatttccagagttcggaaatatttttaaaatacagttgttcgtttctgaaacgtgggctccgtgctcctttgcgacggcgtgtggtggcgcgcagggcagcggagtgccgtccccagctgtgtccgcagcctggttttgttttcctttgtcatttcttccggtcacccacctgcggcagacagcggcttcagctgcacgcacaacctccttttcctgggaatcc

SEQ ID NO: 31449 - DNA, 1165 bp, Bovine  19866881350374
gcctgtctttcccttggcgctccagccctgcgattgggcatacaacaggttattcccattttacagattaaccggagcctcagaatttaaatggctttttaaaaaaagaatttaaatggcttgatcttggtcacgtagaagaggataaataatgtgatgtggatccaggactgtggactttttagtttcaggactttgctaagatactatgctgaggctatgccagaccgtcagtatttatgttaagaatactgtgcttttggcaaaaaggaagactgataatttcagcttttcagtggaccacagtaatctgttttcaagaccacctaacttgtgtctgggttatttgaagctttcaaacttgtcattgtttctatgtttcagaaacattttcagagatttatggacagtcaaaattaaatgcgttagggtcacagaaaaatgaggatgacgagtgaaatggaagcaggtgaggcaggagagatgcctgctgtgatcgtggtcgcagtgctagagacgggacttaacacccggctggtcgttcctggcagcgacagtaaaaagggaaatgtagttacaaggtctccagtgtctgtaaagatgaagacattaagataaagggacagcctttgctggcactgaggcctaagggaagtattgcctctggtgggtttctataaagagttctctgagcagtatacagagccctcgacaataccccattcaataaaagcaattttgcccagggccagatcaatgtcatccaagtcgggtaagcctataagtatttaggctttcagtccctgggactgtctcgctgtttcccagtattctcgtttcttggacaagaatcacaaagtcagcgggaaataatcctgcagctctgtcttgagacgatccctcactcgaagccttgcagtggcccctgtcgagcagcacgggtcgagccagcctctcttggatgtgatcgaaccatcctgtgctcgtgccaaaaccatgtactgccgcctcattgttccccctgctaagcattttggaaggagacagtgcctgtcgaagatgcggcttggatctgaggcgtctgaattcacagtgtctgatggtgcgtgaacacccgagacgtttggccgggagagtcagttcactgtctgtagctttgttttaa

SEQ ID NO: 31450 - DNA, 1202 bp, Bovine  19866881365538
ctcctccgtcctgggattctccggcaagaatattggagtgagtcaccattcccttctccaagggatcttcctgacctagggatcgaacccaggtctcctgcactgcaggtagattctttaccatttgagccaccagggaaatataaagatatttgtatacaatataaaatataaagacatttatgtacaaatatataggagatggtgaaggacagggaagcctggcgtggtgcagtccatggggttgcaaagagttggacatgacttagcaactgaacaaagacaatatacacatatataaatctgtaatacatgaacatacaacagtgtactagatacttctgtcccctttggaagagttctcaacacagtctgaggtgacgggtgatactgtggcaggagacacatctgtccagtggtttgtcatttacccaggagtttatagataaattccctattataagaatcttttgaaatgttactgattgggccttgtaacaatcctgggaggtagaaaatcactttacgggcattttattgacaagggggctgaggttttgggacattaagccatgcgcacaggccatatagtaagtaagtagcccagctgggctcagaggctctgccacccttgacggccttcagcagagggagctgagggcttttctgtggccccttctccttccaccagaagtcagatggggtggtatcggggaagccgaggccagagagatgcagtcacctgcctgagagccaggggtccgctcgccctcgcctcccatcaggagtccctccctggcgcctcctccccaacctccccttctcctccgacccctcacctcactttctcagagagacagacggcgcagcagacagggccgggctctggggggtcctggcaggcagtgggggggcacccaaaggggaactcgttctcatcgggggccgggcgggggctgctggctgagccagaggccatcccggggtcccaggcgggccgggggtgcggggcctggtcaaagctcctcggggcaggggcccagccctgcgaagtctgtgctggagaagtgctctctgctgggccaccggctctgatatgcgggcggctgatgcctttatcttctcgctggcttgtatggtttgacgtcacagctgagtcacagcagggaagagacaggaattacccttggtggtgcaaaaaa

SEQ ID NO: 31451 - DNA, 664 bp, Bovine  19866882117973
tgctgatcctgactactgatttttcctctaaaaatgagtatttagagaaaggccttacttatgatacaactgcctgtagatgtcactgctgaacaagggcagcgaagacattctttcgagccatcaggactctgataaaatccttctgtgcattcttcacagtgatccccttcgctgttatcctggcaattgaaacaagcacctaaaagaagcaaatcattttaagacgttaaagatttactgcaaaagcacggtaactttaaataaattatatgtacctacaaaccaaaaaaaccttaagaggaaaccagaaaaagtcacccaacacaggtcgcagagttcagtttctctcccatcttactcctacactgaacaggcctacagctccggtccctactagcctgtaaatgctttaggaaggggctgggtacatgactagagctgtaataagcccttgttgattgattgactacataccgaaagcaggccaacaatttgcaaagaaaaagaaaccaacctaaagatctattaaaagaagaatagataaactgtgttatttccttggttgggattctgtagctaaataaggaaactaggcctatatgtatgaatacacataaatcctacaaatattgcatggaaaaaagcaaactgcagaataata

SEQ ID NO: 31452 - DNA, 561 bp, Bovine  19866880411186
ctgcgaggcctgcttagcccaacttctgcaccaagtgtcaggagagcctgtacctgcacaaaggccgctgctaccccgcctgtcctgagggctctgcgcctgcagacggcaccatggagtgcagcagcccgggtaagccggcagggtccgggcgagacagggcgggacccctacggagagcgtgggctgggctccgtgcagggaaagctcatgacgaccaccccctgagtttctctggggacttttatgctctctggactttaaggatgcctctggcctggggctgaggccgagaccaggtgggagaggctcccgggggcgcacgtggggccaggtgaggagccgtgaccccttcctccccttgcttccctcccctcccgccagcacaatgtgaaatgagtgagtggtctctgtgggggccttgctccaagaagaagaagctctgtggcttccggaggggcttggaggagcggacgcggagggtgctccatgcccccgggggagaccacgcagtctgctcagacaccaaggagacgcggaagtgcacggtgcggaaggacg

SEQ ID NO: 31453 - DNA, 855 bp, Bovine  19866880444777
agctggccacctcttggccacttcctgttcaggaagggcatctgtgacggttcctcactttcatgttgaatggaggctggatctctccaatgcgtgccgctccctcatccctcctccatccacatggcctcggggttagctctgccaagaccccgaggtggcccagcacacctgacaccagtctcatcctggttcactatcacacggaggccacagtaatctccaaacgtgaactgcctacgcgtgacactcaagtcacttggatagcatccaagacctgctatgatctggcctccacctctcctgtccacgacccctgacgcccgtcatggcatgctccatactgatctgccttgccttataatgcgctgcctgtgtgtgcagtgacatcccctcttctctcaagacagtgtgaggctgtgtcccctaccaccccgtcatctttgccggctcccagggctgtgcaactcctcccccaaaaggccactcaccctctaggtccccccagcgctctgtctgcttgcctattacagcccgattgcattgcagtgattggtttgcactctcatctcccaactggccatcagctcctcgagggcacagacacaggattatttattgccgaatccccagcccagctgagggcccagcacatagtaggcgctcaattagtgctggttgaatcgaattccctcaccactcctagaactgattcaatttgaaaatgacattgaatccagagaattgatttctgtctcccccaagggcgtgtgaagatacaattcatctcctcgttggttgctcttttttacagaaaactcctgtttctggatggaattgagcctgcagactgtg

SEQ ID NO: 31454 - DNA, 4340 bp, Bovine  19866880464354
cttctactcacctagactgtatgattatttcagtgctaatttaataactaactaaaaatcagccacatccactgacccagccagaggggactgtttgtagaatctgtcctccaaaatgtttgcacagatatgcaaagacctttgtttaaggatgtccctcactatggggttaagtaaatcatgctacagctaccccttggaataccttgcaactattaacaagaattggggtagggcttccctgggggtccagtggttaagaatcctcttgccactcgggggacacaggttcgatccctggtctgggaaactcccacacgccgcagagcaactaagcccctgtgtcaccactgagcctgcgctctagagcctgggaaccgcgactgctgagcccaggccctgaagctactgaagcccgcacagtccagagcctgtgctccacaaccagagaaagccagcaagcagcaacaaaggcctaccgcagtcaaaaataaaaacaaataaaattttaaaacaattggggaaagatctacatgtggcattatgaaaagatggtcaaagtatagttaaggaaaagttgcagaaatcttatatacatatacatacgtgtgtgctaagttgcctaagtcgtgtctgactctttgcagccctgtggactgtaagcccaccaggctcctccgttcatgggattctccaggcaagaatactggagtgggttgccatgccctcctccaggggatcttacctacacagggatggaacccgcttttcttatgtgttctgcgttggcaggtgggttctttaccactagcgccacctgggaagccccatatacacatatatatgaacataaatacgatgtaaatgtgtatttctttaactaggaaacaagccgtattataaacagaatacaaatcaaaacagaaacaaaagtgatactataagagtgcagtacgtgtgtgtgtgtgtgtgtgtgtcctgaaggatgcacatcatgctttaagataatggggcttcgagtggggagagaggaggtagggacttgcaagttttccagtgagtataaattactttataattaaaatctatataaacctataaagcgaaatgaatacctgcttgtggtttgagaactggagtcttgtgttaaggtaaaaggaagaatatttaattcccacaactctgcgataaccgctgttgacatttttatgcatttccttatgagtctctttccctgttcatgtacgcatatatttttataataaagttggaattatgctccatgagaaattctgttgcctgctttttcacttaatgttttagtataaggattttcccaggtcattaaattcaccctgcaatcgtgctaggaggccccacgatgggatggccacctgtatgctccctagccctgtgtgtgttggaattacacatgcatgaacctccactctgctctgagggactgatgctcctccaggcctgggaagccacgatcccatcctctgctgcatcaccaggatagtaggctgtcaataaatatttgatgatgagtaaatgaatcaacagaacataaacgaacgcacctccaaaggtacatttttttccaggagtcacgtatggatgcaagagttggaccataaagaaggctgagcgccaaagaattgatgctttcgaattgcagtgctagagaagactcttgagagtcccttaaactacaaggagagcaaaccagtccatcctaaaggaaatcgaccctgagtatttagtggaaggactgttgctgaagctgaagctccaatactttggccccttatgtaaagagtcgactcattggaaaagaccctgatgctggcaaagactgaaagccaaaggagaagggggcagcagagaatgagatggttagatagcatcacagactcgatggacatgagtttgagcaaactccaggagatagcagaggacagaggaaactggcgagctgcagtccatgaggtcgaaaagagtcggatactactgagcaactgaacagcaatggagcccaaggctatgtggaagcaggaggagtgatggggaggtagggcagtcatgtgatctcagacagctgaaaggagagtagttacaagggtgatggagtatgggttctgaagcagacaaagacagcagcatctcagacagccctctggagagtgctgagacagggatgcaagccagatgctcagttaatgggaggcgatattcattagtgttcctctccctgggatggtgggaaagctctgaaaagagtccagaaagagactccagaaagacaagccatcagccacagtgatatccacagagcaatgaaagctaaggacaccgatacaggaggctggcaataattcctaggaaagaaaacccccaccaggcatccagatataagaggagtgggtccctgagattaggaaatgatggaaagaagtaaagttctctcaaactctggaccagagctcacccatgggctccatgctccttcctctttacctgtggcagctgctttcaagtacctgaatgggtttttttctttttccccctgcagaaattagcagagacctggaagttaaatttcaggaaaagcatcaaaaggcaggagaaatccttctgcattctttttgggtttagaacaaagactggcagaatagcccaggctggagccagagagaacagaggctttttacaatgaaatgcttctgtggatgatcaggctgcagagaaggcgagagggatcccctcaattcttgctactaatgaggttattggggaggagggtgggaaagaagtggcacaaagctacccggctttatccaaatcccaccatctccagagccagttctccccacccagagtagctgcaggcttgacaaggcagctggggctggaaccacatgttctctttacataagcgggtctcagggtacggctgagtgaagcacctacttggagagggcacagggattgcacaactagatgtcagtgaccagcgggagcagattaagaagtgttgatcagtatgattatccctgcctctcattgtccattcgccactccagctgcgttcatgggaaaatgatctggagaagcactgagaggtccagagagcaagggctgccgcacacgtggtctgctgagcggtacaacgtggctggtgtctggggccactccccacaggcaccatcagccaccccggaacatgaagacaacccccattgtgcagtcagagtcccattctcgaccaccacccactcgctcaggttgtcttccctcctcctgcttcaagccttggagtcacttgtcacttggccctgaactttctgacaagcaccctcttaagcccaggaaggctgaccctcccccttccaggagccactgtgactccacattttctcaaggtttctgccttttccacatctctgattctgcccttcttggctagaattagacgcaaggtagtagttcccactgctacttcctctcccctcagagaaacgaaagacaggcaagatctcatcagggcttctttgtcctaccaaatgcagtgaccagcaagtgtgcaagttgcccacccttgggcccacatgatgacctgcacccagtcacctcctccatcttccccaagaggctatgacccaccatccaccacggtccgttgtcttcttctcctgccttctaaggacagtaataaaaaaattttaagccatcatttctcaaaggaaaggaaaagccaggcactgtgctatgttttacataaatatctcagataaccttcacaattagcctgggggtaggaactctccccatttaccagatgaggaaactgagctcagagaacaagggtctcgcagctgaaaagtgacagaacaagggttttaactcatgcgtgtttaaccccaaagtcagggctgtgtacccggggctagacgtccaccaatgccctaaagttcccacaaaagggcccccgtgcatttcgacatgtttagaacctccatggccacttcctgccccttcagacctttgactgaagtcacagtacccttcccccgccccatccctaattctcagcagctacattcagcgccagtaggtgccctgcagatatccgagaatggaggaatggatgagttaacgaatcctgagtttccatcccaggttcacacatgtatcttgacctcgccaaggctaagaggactgcgtccagctcctttcacaggtgatttttgtcggaggtctctcagcaccttcttttagtgggcatcctaactccaatgtcaagccagcactcctctacaatttttcaggttttcctc

SEQ ID NO: 31455 - DNA, 1734 bp, Bovine  19866880500441
gcctgctcctctatccacacccatgtgatgagtcctttcctggctcaggtctcacctctctaaatgcctttgtcataagactgtcgacattcacttagctcagcacctttccagactgggaagcgcttccttcctgaaggcaaaagctgctggcttctaatcccttggcccttcttcctattttccagggcccccagacctatatcccaccgagtacatcctgacgaaacaggctttcattttaagctttgtacagaacataacagtcatggaaattaagttttaacttttttttaatctttaaaatccacacagagcagttccccctctagggaatgaggtgtaagcaagcctcccagaatcctgctcctcccacatttgctctaagcatgctcagccctgtcctgactggtctcggcctaccatccctatatgggcagggaagggaagggtgagactctgggaagtctgtgtctgctgcacacaccctggggctggggtctctatttccagggtgagggcctgtaccaagccatttatagccttgccatcaagaactggccaggagggcaggaacacagagcctggtctgagtttcatcaataaagaagtgcccctgtgagttcctgattccaagggtttctaccttcagctgtaaagtgtgaaagaaaaaaaaaaaaaatcattcctggctaactttttcagccacctgaatatccaataaatgaagaatgaatgaaggtaaaatcagtttatccactagataaaacattatgcaaatattaaaaatatttagtttttactgtgagcatatattaaaaatttaatgatgtaaccaaatggaaaagagctaacgatttaatagtaaatgaaaaaagtcagccatagaagaatttaattacaactccaaaacacaaacaccaacagtgtcaacccccacagatggcggagaccacccagggtgctcttggtagtgctcgccccggctcccctgacgtcctagcctgtaagtatacgcaaaagttaccctgctgttcttgagtaagtgttggggttaggaatgaactcatctgtttgccaaacttgctatataaaagattatactccttataaaatgaaaaaaatgaaagtatagaaaagtaagactggggtcaggcagttccacgcggttcagtggctggactttggcactttcgttgccccgggcctgggttggatccctggtaggggagctgggatctcagaggctgcacggctcagcccaaaaacagactgaattcaacaacccacaattcagatgggggaaggggctttaatgttgtttgtatcgaatgtcaaatctacaaaaaaattatggttacaaacaggaaaaccaagtcacttcgaccaatggaatttgaagttactgggagaagaaaatgtaaactctgctccatgtggaatgagaaggcttatctataaacttcaacgcttccgacgactctcaaatttgtaaatagctggggagttcaccgtttctttcttcacttttaccttctgagttttatcctacaaaacaaaaaagttaccagtaaaggctgtaacaagagagggctgtgtaaaatagaaagtttaataactaaagcccctaattcagcccatctcaacattcaaaagagacaaagcccttcgtcctaaggcatccctgactggatgactcaagtcctcccccaggcttccgtaatgatgctggtt

SEQ ID NO: 31456 - DNA, 1051 bp, Bovine  19866880506787
tagcactgaatgtccagcagtgtggtgacctcatgtcagagcacaaacaaaacatcgctcagtgcaaaaatcctgaacactgagggttttctgtcctcatggatgactgttacaagtggggaggtgtcatgtccttggggatctatcatatttgagtagccataaatgtgattttttttccccccagcagcaagcatctaaagttgagaaggtgttttttaccactgcagtaccagtggccagtagcacaggtacgtaattctgtgttagctgtaaatggaagtcaactctctgggccccctgaggcacagttagttaatcttgctttgccctggattttaatttcttttaaattacattttaatttcttttaaattacatttatcatgtattgtctttctgttagagtatttcatattcttaaagctattgaaagttactgcacttatagcataaataccacatttaacattctttaactagtaatggttctttcccttttacatgtagcctttaatatagccagaacaaagtctgaatcacagttaatgctaaagagagaagttattaattcactggactcttttctaattacagtaatgaagaaatagcatctgggtcagaaactcctataaagctaaagggtcctttttctcaaactctttcttttatacattagaaaacttaggctctgaaagatgaaacgagtcccccaaaggcatcagtgagtttgtggcaacgccaaagcatttgttctcagacaggccttgcccccaacctgttctcttgccccatggtctctagctcttttgagacacacaaagcctgtctaagttcagagtgtgcttgtgcacaacagacataggaaaaagaggaggaatgtgtgcacaaatgtgtcagagaccatggctgcaaagatgagcagaatgtcctaaaggaggtcagagcctctggggcaggcagggctaaatggtacagtgccctctgcacacgacagtgccctcgggccagccctgaggtataagcctgctgcaaacactgcctggaggca

SEQ ID NO: 31457 - DNA, 1447 bp, Bovine  19866880535260
tggtagtggcagcccctggctctagagcacaggttcagtagttctgacacaggggcttagttgctctgcagcctgtgggatcttcccagaccaaagatagaacccgtgtctcctgcactggcaggcagattctttaccattgagccaccagtttttaaaaggaaatgtaacaaacccaggttttaaaggaaatgtaacaaaaatgcacaatttggggacttccctggtggtactgtagttaagacgttgtactcccaatagagggggcagaagtttaatccttggttgttgaactaagatcccacatgctccatgttatggccaaaaaataaaacgtacaattcgaaacttatataaatgtcaattaaaaatacatagattaaaaatattaaaacatgacagtaactgcagtctggccaccatctgctattatatagccagtgagctaagaatgattttcttactttaaacagttggacacaaaatcagaagaataatattttctgatgtgtgaaaattatgtgaaattcacatttcagtgtccttaaaaaagtcagagaggaacacagctacgtccaactgtttttctattgcctgtggctattttggtgtcgacagcagctttgaatagctgtgacagagatggtatggtttgaaaaatcaacaatatttactatctggccctttatagaaaaagtctgccaacctctggtttagtgcatagctgtataaaaggctttttcagggaagcaaatgatatcacttgatgatgcttagaattgctggcgcttggtgatgaaaatcagactgaattttagctggttttactattgtgatctctacaactggggtgcccccaatgccccccacccccaatgcctgtccctgggaccaccatggccccctgcactcagtgggctacaggaaattaccttttggcctagaatgcagccaccctggatattcctgaaactacagtcatgagttttgtgctcataagttcagcagatctaatcctcccactccactggctgcaggtggcagaaacctgagtgagcagagatggagcgctggggttactgcctcttgtccccatcttcaggaggctgggggctgctgggcttcgggacactttgctcttatgggacagcctccgtgctcagactcatctctccatgagggaccaggcatcgctggctggcagcacccaggcagcccccagacagcaggcaggaaggggctctggccaggaagcatctgatgggtaagaagatggggatgaggatggacagaaagagcttggaagacagtagacccttgatgcagaagaggaaaatatccagatggccttgagttttttttttttaattgaagtacagttgatttatatgcaatgtgttagtttcaggcatagagcaaagtgattcatattatatatatatattat

SEQ ID NO: 31458 - DNA, 2656 bp, Bovine  19866880565761
gaatagtgtgtagggagcaggcaaggcagctgagcaggccggtggagggagaagacagaccagtgtgcggggtctcaccctagggacacaagaagctacggagaagccctacccagtaggatcagaacaggacctcctgaagataaatctgtagagcgtggccactacctggaggtagcttcttccttcaaaggaaagaagccagggtcagaaaaacctgcctagagacggcatgcgacaaagggtccaagtgagaccgtggcgcacgcagtggggatacagaagggatctccgagaaacaccacggaaacagaacggaaggacctgacagtggagccaacacccttacaacagcacccggcacacaggaggtgctccgcgagcgcagcccagctgctgctgccacccacgcagctagcaaacagtgggctcgggggacaaccctcaagtttacagactaggtgaccagacagggttgacgctacaactgaagaaaaagggagctgatggggtggaggctggtgggggggatggatctccatccatttgagcctgcagttccatgagattccagttgggaggcagctgcaggaaaccgaagaaaaaaactagaggcaagagtaaatgaaggtagaaactccagccagagagtagacgcgactatcaggcaagactagagagaaaaagggagaggactccaatgaaacggtctttcggcttccacccaagccttccctcagaacacagctgggtgataacataggtctgatcagattactcctctactcaaaactttctacagcttttgtctctctcaggataaaagcccaaatccttccaaagacctcggaggccctcccagccctagccctgtctcctgacagcaccacctgttagaccagcccctttcacttggctcgagccctactggatgccttgctatttcctgaacggaccaagctcgctgtcacctcagggactttacgcttgctgctccttctacctggaacactctttgccccaaacatccacacgattcttcccctcaccctcttcatgtcttcttagacagcactttctcagtgaggcctgctctgaccaccctatttaaaactacaagcccgcctttaacccttgctttccccattccctgctttatttttcttcaaggcacttaatatcatctgacattttatatattttcccttttttaatgcctagttcccaccacctagaataaaggctggaaggtagcatctgctcaataaatgatttgaggaatgactgtacaaaggaatacaggaggaatccaaagagaactgacttaaactacgtatttgtatgtaatctggtgaaaactgaagttaacaagacttcctagaacagctctgtgaaatgtgtgcaaaggatatgaattccgataatgtctctcaatgtcctgcaaccactccaacatttcagccacagaggggcttgcagctgaagcctgcaggacagcatcgaggccgatcgtgtctgcgtgctgctcatagatctgaagcacgcgctccacgtggctgctgaccacatcacgcaccttgaggagggtggctctgcggggggaaagtctgatattaggcaatatgatgagaaaggcctacggccaggttcctcaacctcggtaccaagaacatcttggacctgatgattctttgtggtggagggctgccctgtgcgttataggttgttcagcagcaaccttggcctctacctactagatgacaagagcaaactgtccccacccatctcaagctgtggcaaccaataatgtctccagatattgccacacatccccaatgggaaaaactgcctccgaaggagatctactggtcccaggtgccctggatggaggggtggcttaacaattaagaattgacttaaagatgatgaggctgaagttacatcactctcaaaagctgtgtgatgggcccagctgccaaagacagaaaagaccaagcaggctttctgggactcccataaaggagaagaaatgttcacacgtagtcaaatgccacgtatgtgaaaggaataagcaagagggaactacagcaatagagcagtattgtgctcatgctatatcgtgtcccaccctagtgaattcttgaatgggtaaaatttgggctcttgacacacacagattattgtggatctcaggaaagttacttattctcaatcacgaacaaaaacaagtctcttttgttcactgtgcatcctaagtacctaaaacagagactgacagacaaagcaacaaacgtttgtccaatgaaggaaaaggactgttgtgaagagtaaatacagtaatgcatattaagccattagggaagtacctagcttatggcaaattttattatattatttttacataattattttttaaattattatataattatttaaaaagttattattccattggtgactccaagaggtccagccaccaagacgaaggctacaacttcccaaagggcaaggcactccctagcctagaaccgcagctttcaagtttgactgtgactcacaatgaaaacctaggctaaaaataacagcccaatacccacataaaaacatgtaatcaactgaaataaaagttcgctaccttaaaatgtgtaatgaccta

SEQ ID NO: 31459 - DNA, 3294 bp, Bovine  19866880588723
atgggtttgaatccctgctctgcccttactgagcaggtgaattgaggcaagccattccatctctccaaactgcagtcccctcacccatcaagtggggataaaacaacagccaccttccacagtgatggttacaggacacgtctcttcttgacagcccctatataaaatgttctcaatcaaatggcagatgaatgaggacctctataggtgatgttggtgggtgaccaggtatgtatgtgggaagaagggcaaatggggtggagaccatggagattaagaactaagagcctgtcttttgagaagagcctgcctttgaattgtcaagtactatgcagcctcagtggagaaggcaatggcaccccactccagtgttcttgcctggaaaatcccatggacgaacgagcctggtgggctgcagtccatggggtctcaaagagtcagacacggctgagcgacttcaatttcacttttcattttcatgcattggagaaggaaatggcaacctgctccagtgttcttgcctggagaatcccagggacaggggagcctggtgggctgatgtctatggggttgcacagagtcggacacgactgaagcaacttagcagcagcagcagcatgtggcctcagtttctatatctttaaagtgggagcagtgatccctctgtcatagggttgttttaaagtttaaatgagtgtgtgctctggtgcacagatgcctgtgtgtctgtgagtataatataatatctgacatttactgggcgcttattacatgccagtcactattctaagcagagtgctgtattaattcattaatcacatgaacccatgaggcagacattcttaccccccataggcaagttgaaccataacattaatatactgacaagagttgtcactggtaaggtatcaataacccttccatttctcctctagtactgcttttttcctctccctgatgctaaggggtggaaggagcagatgcagagcccacatcttgccagaggctgagcccactcagccgcagcacaaggactcacctcgtttcacttcccaaggagctcctgcagtcctggggagctccatgcagtgttcgaggtaaagggggaacaaataggacagaagcaaaagagttggcactgtttctccagcatcccagagccctgagaggttatatgtctgtgccccatcctcatctgcgggcaggaccaggctgacctagtctgatttcagttgcatccagggatttgatcaagtcataaaaatgaggctgtcttaacactagggcccagggatcactcccttgttcacaccttagagaagcgcttgccatgtgtgcctggagacacaacaaggatgtccccagtggtggcaatcataactgaatgttggaaaaacaaggtgtgtcacgggcacattctggaactctatgtggccataagaacacatgaacggcagctccacaatcagcttgaaggaatctttaaaaatgggatttttgagtgaagaagttgcaaaataattaccttttttgtcataagaagaaaaaacaaacaaacatggacttccctggtggtccagtggttaggaatccacctgccagtgcaggggacattggttctatccctagtctaggaaggttctacatgctgtgtgcaactaagcccacgtgctgcagctactgaagcccacacacctggagcctgtgctccgcaacaagagcagcctgtgtcctgcaatgcaaagcccgcacatggcaacgaagagtagcctctgctcaccgcaactagagaaagtccccatgcagcaatgaagacccagggcagccaattaattaatttttaaaaaacctctccaaacccagactttatgtttttaagaaaacagcggaatgataaacgcaaattttaaatagcatgacccttgacagggaacaaggatttaccatgagggagaagcacagcagagtttcagtagttcaggaaggttctagttcttgggttggggtggaaacatcagtgttcattttattaccttcataatacacacacacatacacatgcatacttttatttgaatcaggtgttaatttagaaaaagatattattcttataatatcttgtatataaatatatatgtgatatatacaacaacaaatctccctcctgcttatccaatgtgttcttaccatcacagtaataacagcaaatattcatatgacccttgggactgggtctttctctagacgctctacatgtatttgacctccatgaaaagtatcactattatctgcattttgcagatggtcaaactgagtcagagaggtcacctcactgaaggacatgcacccactaagtggcagagccaggatgcaccccagcccacccagttctggacctgtgtccctaaccactggactgagcccgtggtttgcctccattatcctatttagttcttacactggcccttgcagggataggttagttattattccatcttccagaagaggaagccaagccaaacttctgctggcgggagggagcacatttataaacctcttccttcaccatgcccccagcgggcccagctgatggatcatggcacagactcaagacccgccccttgtaggcagttgtcattaatcaattaaggtcagtccacactttaaaacctgtttaccacccctcagcctaaacaacctccacttctgcaggccctagtggtcctcccagcccttctgtctgaaagacctctgccccctcctcagctgtggaccacacctgactgccactggggcactccggacctgagaggttggtcttcccaccatccagtgttccacgtctgttacagatcgaaactgcccttgaacaagcctctgacgccccttgcctcggtttccccaaatgtgacttgggcaaaaggttgcatgacctgtaccgaccctaaagcaacatctgtgtctctgctttctgcctgtcttggagggagggtgagttaaagaccaggaccactggggaccccatttctggagaatcaagactttgggggccctgctggcctcacccctccccaagccctggattatactccaagccgctcctagcagcagcacattgcaatagatattaattgctacattaaattctatgatactgcttaagaagaatgttcatttaatttccctgcaactgtggtcaacctgatctttaatcgaaactgacaggcacaatttaaatcaggtagcaaactcccctctctttaaaggagccaagaatggcatgaatattaaatg

SEQ ID NO: 31460 - DNA, 2916 bp, Bovine  19866880609505
agtgattaaacaaactggtatgttctaccatgactgtgctaaaaaggaataaactattaatacaagcaacaatttggatagatctcgaggacattatctaagttaaaagaattgatctcaaaagtctcatactggaagatgccatttatataacattcttgccactaaatggagaaggaaatggcaccccactctagttcttttgcctagaaaatcccatggacggaggagcctggtaggctgcagtccatggggtcgagaagagtcggacacgactgagcgacttccctttcacttttcactttcatgcattggagaaggaaatggcaacccactccagtgttcttgcctggagaattccagggacgggggagcctggtgggctgccgtctatggggtcgcacagagtcagacacgactgaagcgacttagcagcagcagcttgcctttaaaaaattatgaagatggaggataagtcagtgattgccagagggtagagatggtcacatataggacaagattaaaggggtagcatgatggagatcttttgtggtgatggagtaggtctgtatcttaatagtggtaatggttacacaaagctatttacgtaacaaaaattacatagcgctatatacacaatttctatcaatgtaaatatcccggttttgatatttacataatgtgtaaactgtgggggaactgggtaaaggatccactagacctctctataccacctttgcaactttctgtgaattttaactgttcaaaataaaaggtgctttttaaacataaataatactgatggtgagtggatctgagaacttttcagactgctataagaatctattaattgacctctttgcaagatacacccgtgaatatttctatgcttggtaacctgaaaatcttgcccaagacacctctttggcaaaattctaggcatatttcctccgtgcttatgctgacatagcttataaagaaataaaaaacataaaccgttgccatttgtgtccctgtatctaggcacgcctgagtgcatattgcgagaccaagggagagaaaataaatgacttggatccttaaattgatggagagtgtagattcattatctgcgatatctattggtggcatcacaaataccatgaaaacaatggtgatccgctgtccatattcctaagtggaaagaaatgctaaatttctgcatcagcttatttaaaataaatatttcttcccaaccaagttcacagggactctgaattcttatcctaagttacacatacctgagtattcttttaactgccttcccaagttttgatttgttcctatttttcattcctgttcagttcaaaatatttttctatttccattgtgatttcctctttgacccgagggttatgtagacgagtattgctttgcatctccttcaagcccccactccctccctatatcccttgcagatgtgctttagaggtgaagctctgcaaagcttggagataatggagctcccctggcaaagctgactgagaagtgcactggaaggttgtcggagccattgctactgcagcccagatgaagtgtttaatgtgcagattttattgctttaaaatgtatcattttttaaaaagagcaataacacaagctcaagcttcaaagatgccatggttgcctggaggaaacctggggcttaggcaaagactgtgaggccaagagaggggtgcccacggttgattgacccctcaaacggctgcctgccaagcttcatccttctgctttgcttccaggtgagaggagcccctgaagactaccagggacagggctggaaacttctagctgagcagaacctgtggcaagtcccaatcaagctgccctacatcctctaaaaccaaagagacacctggggaggcaggagaagtgtaggaagtcaggcagaggagaccactgtggatgccaaaacagtctgcaagagttggggcactgactgtggtcacaccagattgagagagctcgtctccagtctggaaattcagggtgtactcctcaagcttcagttgggtttcgcaagatggataatggctagaaattaaattcaatgggatttacttccatgattcaacttgttgtgtgacagtgagtgatacctcaactttctagtcctcgatttccctatgtgtgcagagaagaggttaaaacaatgctacaaagtccatgatgcaaactgctgagtaagtggcacagcccctctgagcctcggttcattcagatatgcatgcaaggtggcgatgcctgtctgtgcccaggatcactgcaatgaacaggtgatggtgaacaagggaaactgtgtctccaggcaccaactgagatgaaacctgttttctaagccaccccagcctaagaggtaggaacaagctcacaagaacagtggtaagttggtgtttcttggttctgccctccacccactctaggagaactccacactcacactcatacccaaccccacttaaattctcttgcagacttctaggatctcccaggagcatctcacatatagtcaggtgaccatgtggcctcagctacattatgactcgttgaaatgatgcccctattcctggcaagcctgcacatgacagaggtgccacccacaccctcccagggcattgtaccaccctgtgggcgcccactgtctgttctgaggatagcagtgtccagggcatcactcctgcatggagcatggatccatggtttgggagtagatccccaaacctctctctttctttctttcctacttgcagtcccaagtaggagtcccctgccagggtgcaaaatttagggcccagctcactttcaggcttgtgcagagcctgaccctgctctttcataagacccaccatgattgcctctttaaattgtacttcctag

SEQ ID NO: 31461 - DNA, 562 bp, Bovine  19866880611171
catctacctatactccactcatccatgcaacccttgatcacctcttcagccacccacctatccacttaccccaaccactcccccatccatcctctcaaccaatcatccagtttaacaggtcccatgttgagaagttggagaaggaaatggcaacccactccagtgttcttgcctggagaatcccatggacggagaagcctggtaggctgcagtcgatggggtcgcacagagtcggacacgactgaatcgacttagcagcagcatgttgagaagtaggaacatggaggtaaataagaccagtccccctgttcttaaaatgctcctagctagcctcttcccttcccctacctctcagccatatagagtaggcatgtgagagcccaagtgagatcaccaactgggaggaaacaatgaagtctattgttacatccatggatcttgtgtgtcagagcactggcaacctccttgccctactcatttcttcagggccttacagaagatggagtcggcatggcctctgcatggccctaggactccccttagctccaaattctcattccag

SEQ ID NO: 31462 - DNA, 1988 bp, Bovine  19866880611241
ttgaatcgcacagagaagcttcatgccatataaattttggttttaaaattcatttagctaatattttatttgagattttacatctgtatttttaattggagggttgacaaaatgtgggaatcaccaaaacgcagcccagagacatgagacgagtaaatgctgctgggaaacggcaccagcagatttgtcgcatgcatggtggccacaaaccttccatttggaaaaaaggcaacatctgcaaagcaaaataaaacaaggtctgtttgtacagatgtcaccggactagtgagggctgagccagatgacatgcatacagcacttagcacagcgcctggcacttcgcaggcacttaataaagggtagcttttattattattagcagaattgttttaaacctgctgtgggtgggtcctggacaggccaaggctattggcagccctgctaacaacagaggctcagtgtgtccccatcggttaccattatgaggctggcaacgcttgagggattctgatagaggggaaatcgattggggtgcaggcacgagggaaagaactacatttgtcagggagggttgttgcccaagagaaatataaagggctccttttagctcattctctttcctccttgagaacatctagtcttattaaaatacaatgaggagcatggttcccaccttcatcatagctagttgggaagcagaagatgctcaggcaaagcagaagaaggaaccaagccatctgtctgttggggcgaatgcataaggcgtctctaaggatcaggatgaagagaaagcgtgtgtgtgtgtgtgtgtgtgtgtgtggtcagcagcaagagcaccccagccagggctcaggtgcagggaacccgtgcacgacgggtcctgggcatggggtaggcttgtgtggtcccagatcatcttttaataccagcacctctcctctcgcttcatgagtcccacctgtcccagccaagtttctcaactcaatgcccccactgatattttcagcccacatttgacagtcccatccgtgggtctgggtccattttttcattcagcccattgatctgtatggatgcctgctgggtgctgggagagacacagaaaatgtaactgattcaaaccttcagggggtgtgtcctctaatcactgagatgtgacatgtgcaccaacatacccagtcacgtcaatccatcaggccactcttctgatgagaaatctacagggtctccaagcacttgcaagatggtatccaaagccttgagcctagcatctgaatcctcacaattagccataagtaaccagctccagccccattcttcctcttcttccatactctgcctcctcttatccagcctgttgaacaccaacgtggtcatgcctctgggtctttgcccctactatactctcctcctttggagaaatttctgcacttccttcaatgtcctgctcaaatacctatttctccatctctcttatcaaggaactccaggaaattttggtctcttttccttctatgtttccaaaacatcagatgcaaatattcatttcagcacttccagagctattatatatatttatacatgttcatattccccattgatctgtgagctctttgaaggcaaggcccgtgtcctaggaatatcttataatacaacagtaggggattaataaatgtttgcctaatataatagaaatggacaataaatataagtaaaaatgctcaacctccctaatagtggggatttccctgatggtctagtggttaagactctgtaactccaatgcaggggacacaaatttgatcattggtcagggaagtaagatcccatatgctgcgtgacaccaccaaaaagttttgcttctctggtagctcacatggtaaagagtcttcctgaaatacaagaggccccgggttttgatccctgggtcaggaaagaccctctgaagaaggaaatggcaacccactccagtagtcttgcctgaaaaa

SEQ ID NO: 31463 - DNA, 848 bp, Bovine  19866880625114
cactgaagacagatgatggaggaggtgttggtaagatattttatgcccctaaaatgtactgagctaaatgtgttggaattttatcttctatatctgcttgcattgactgaacttttgcaaagttaggagtgcttgctctgggtcaggctcagggccatatagccactagtaatagatctgggactctgatccatgcctatctcactgtaacactcatactcttaatgacaatacagaggctctctctctgaatgggttcccttaacatgaaagagtcagaatctccagcctagggggtttctcagattctgaccttatctgatcttatattctgtatgctctataccaacactaaaaaggtatctcaaagggaaaaggattaagcaaaagaagaataaaaaagaagcaaaacattttaaaagaaaaaaaaatccatccctcttccaccctaccacagtcatttctcacttctgcatattatctttcagtccttgttgacacactgacatattttccatcattgcaactaaagcaattgtagtatttgtattgtatgttccctttgtgtctgatcataaaccttttcccaagttattctacagtctctgtaatgatcacttttaatgtctgcataatgttcaaacaaatggatgcaccatgatttactaaacaaccccctaattgttgaacattaaggttattttcagttttttattttgtagattgtgctatgatgagcatttttatgtgaaaaccatgtggggtgattgaaagagcatgagcatggagtcagacagaatagagttaaaacacagctttgcaatttacctctagtgagttgaaagaat

SEQ ID NO: 31464 - DNA, 1223 bp, Bovine  19866880638051
tttcaggaaatgatgtgatcctttcaggagcacctgagatttaactggattccattcttggggttacttgcgctttaataaccaggggaaaaatatgcaaacatggcaagacagcagaggctcttccaggtgtttagagagaaggtctctgggtgaggagggcttaggccctgctgctcaacgtcctacgggcaggtttgtgggccatgcagcttttcttcctgcctcctacccccaacacctcctgttccaaaactgttgtttatttccaggataggactgggctctcggtggtgggcatcatggcaggctttcagaaccggctgcagtctcttcttaccctctcctccccagccaaaggtcccgctccctgctcaggcacccagcctacctggaagctcccagttcagtgcctcccagagacgcagcttctatgtaagcactggagcttctgcaggggtgggactgaaagagccaggctgctaagaagccagaaccaggtttgcaggcaagccccagccccaccctgtaattaggcaggtgctggtgaggaaggggaaggggaggagagagagaacaggcctgcaaaaccgccgcatgaagtgcctgccagcgggattctgggttcagacggtctcccgacccagccatggtctcctgagccatccccgacccagatggctatccgtgacctcagagagaaccctgagggggtagggaatgggtagagatgggctgagtggaaaggggccttttcccagcctccccggtggagaattgctctcttgatgaaaagcaggcccactttagagtgagtggctggtctgcgcagtggcgcattcatctggtattcataagcctggcatgttagctctaatggcaaggcaccgcgggctctggctgagacactcagcacggctttgcagctagctccctttcccggcccactctgtgatttcccgttagtgaaatgaacatgcagaactcagatgacagtagcttggactgccaggggtacacacacgtgcacacatgtctacgcacgcaggcacactgggctgggttctgatccaacgtctgggtgaaggtggcaggacagctacttcccaacacagctacacatcgtcgaaggtcggcttgggagcctctgcatcacagattgctagagcgtcggagacgaggagcacaggctggaagccgagagaccaagatgcaagtcccag

SEQ ID NO: 31465 - DNA, 1223 bp, Bovine  19866880639623
catgattgcagctgtgggtatatgaataacacatgtgatcaaattgcatagaactaaccacacacacataagtgagggcatgtaaaactggtaaactctcaataaggtctgtgcattgtaacagtggttttctggttttgataatgaactgtatatatagttataaagatgttatctttgagagaaactgaatgaagagtccataggttctctaaatgctttttttgcaatttctgtgaatctataacaatttcaaaataaataaaataaaataataatccaagatgcaatgtccaaaaaagatggtggaatagagaaggatgcctctttaatatctaatgaaacaggagagaagaactctttcccacaaaaaacaaacaaaaattcccagtgttcataccagcacagtttacagtagccaagatatggaaacaatctaaatgtccattggcagatgaacagataaaaaacatgcggtaggtgtgctcagtcacttcagtcatgtctgatttttttgtgaccctatggaccatagcccaccaggctcttctgtctattgggattttcccagaaagaatactggagtaggttgccaagccttcctccaggggatcttctcaactcagggatctgggtaaatttactgcccgtttatctgggtaaatggtaaattttatgttatgtatattttaccacattttaattaaatcaccttggaaggaagacccatgtgatgagggatggggccaaactatagatatagttgaaggtttccatcaaaagaggaaaccaagctaggaaaaaaaaaaatactcttacagactgaactgaaaagtaaagcattttaatgtgttcataaaggcacgtttgagcaacccgtcaggagaccaagggaaagtagggtctttaccttacagtcacgtgactgagcagatgttgatgtttagggcattttattgatctttgttcgcagtgtataacgataacgcctgtaagatgttcaatgcaaatttcctgacgtgaaatagctggttaagaaaatgttaacaagataatacaagcttctgagaaaaccacggtatcaactggagaaagtgaacagatggaggtaaacttctgcaaaattgcagaagtggcaagagcggtcgctgacacatcctggctgaggcagagcctcagtcacagtaacgcttcccctcaacggctctacagcctcagtcaca

SEQ ID NO: 31466 - DNA, 2656 bp, Bovine  19866880646308
gatgctaggatgaaaggcatcgatgcctggccatctagaggaggaactgcacctgacccctcagaggaaagaaggaggaaatgagccctgacacctgcccggcccttgttggcttttccttccccttgtcaccggactttcacaatgtcctacaaggtgtgggttcacagataaggaattcagatcagaggggctgagaggctcacccacagccccccaccaagggcccattcactgcccgctgctgggctagaccctataggagcagacttcctacacactcctatctgcttgtataggtgatgctcccagcagggaaggggcggggtgacatcttcccaattcctttaggtcctgtgctctgtgcactatgtcatcctgcccccaacacatctgatcacggtgcatgctggacatgctgccatcatttcatctctgcacacaccccctgattagagcccctgccacactcacagcccccaaaggtgcatctcccctgtatctgtggccccacttctacgggcccggtattcaggaatcagggcagactctgacccaagctgggccaatcagaatcccacttttgggcatttgaacataccatggaaagacagtgaggccctggctgcagaatttataagcaggcttggggaggggaggggaaaaggggctgccagcctgggcggctgcaaggtgcccttcctgcagaggaggcggggttggtatggagagaactcagagatgaggggctggtgattcctgccacgcttctggtcatcaggctccatgagacactcctgaaggctttcaaacactagccccttttgtactggctcgtcttttcaagggttttggttccccacaaagtcacactccctatgggccagggagcaaccacccagctcagcactgggactgtatctatgctctgatccctgagtgtcagttcagtgagccctttctaagcaactgctgcctgcctggctccttcccagcaaccttcgctgtggtctccttgacgtcagggacccccagaacccagtcccagccgcttttctcactcatgcccccctcccttggccatcccctcaggtcctttggcttcagctaccatctctgggttgaaagcccccaacttcctctctctctctctcagctctccagatttctcttttcaaaatctgttatctgattcagcaaagaactccctggagtcactgaggagggagtgaagtcctaacacatgtaatgctaagttgaaagcaaagttttgctttaaagaatacaattgtcaccaaagtgagaacagtttaactgtagattacctatcaaattcagacaataaacttaggcagaaagagatagtggatctggacctaactccacttgttaaaccacccttgagctgcaaccataggctgaccacagatacaagaagtcagccaaaatcaagaaaaagtatcctaggagaatcaactagccctacagagtttacaataaggaacattgtatactttctattattatttgtaaatgattggttacacagtctccacatcagtaaaattaaaatttgagtgcatacattcattactgtgagagctgactgttaaacatttatcagtacatcatttatcagcatattatttatgctgagccctggcacaccaccagacctggcaacatgttcccacagtggtacttttccataaaatttgaaacaatatgtttctgcgttctttttcttaaaaagggtgcaaactatgcacagaatccagccacagaaagtctgcatcagcccccaggggaagctttttgtcaactgtgaacagtaggcagtagtggcgaaaatggacacgatgacgggttaccgaaaggagacccgagcaaagagggagagctgtgtgtccacggtgaggaggggccaggaagaaactccggctgggtaggccgctcagggggccagtggagatgtttagaaacaaagcaaggacttatgctgggagggacttgtaaagaaaaggaagccggcaagagagggggacagaccgcagctggtaatgcaacccgaggtccctcccagacccagactcaccttctcgaagtatctgatctcatactctgtgccgttggcccctggggctcccgcggggatgggctcccgccacgacagagacacgctctggggctccactcggtccctgcggatctcatcctcctcccagggcgctgaaagttgagtaatgcgaggttctctggggcaggggcagggggctggaaaggcggggcgcgcggggagccaaatggggcagggcccaaggggctgtgggtggggcaagagcctcctgaggggcggggcctgagggatagcctcttcatgacgctagaggaaagctctgacaccacagctcttggcttccttggttctgagcgggaaagaagtaggccacgtgctgcttgcccaccccctacactccagcttcccttcaggtggctggttctaattgccccaggctatttctacatgttctatggctcggagatattagacagcacagcaggcaggaagacaagctacttaactattctaatagtctggtcaagaggtaatatactcaaataaactaggaatagaaggaaatagttcagttcagtt

SEQ ID NO: 31467 - DNA, 1817 bp, Bovine  19866880662758
agatcagtcctgggtattcattggaaggactgatgctgaagctgaaactccaatactttggccacctcatgcgaagagttgactcattggaaaagaccctgatgctgggggggattgggggcaggagaagacgataacagaggatgagatggctggatggcatcaccgactccatggacatgagtttgagtaaactccgggagttgatggacaaggaggcctttgtgattcatggggtcgcaaagagtcggacatgactgagggactgaacggaactgaactgaaaggggataatgagattaattctggtgaactcaaggcagacggtggtggcaagcttgtgaatgtcttggggtaggagggatgggtgtctgaggctccctcccccttggtacttgtctttggaggttaggaggtctaggaaaactgggtctggctctgagcaaacagacccctacttgacctctatggatggtagggagaaggccttgaggcaagggctagggatgagggttggcgaggaattcggggcaaggtcccagtcccgatgcttgggatttcctctctaccccttcccaggaggggagcctcacttcatagtggcaggtccccctcttgaactctgatactttagctataaacctattttcatgtgttcattaggtatttattaatacttcttttgaaaattgcttattactatcctttgcccattatcctactaggctgattttcagtacttttttaaagaagccttggtatgtttcttcatttcttcaaatctttaaaaaatatatctgttacaattgacccttggacaacatgggtttgagttgcactggtccacgtatatgcagattgttttcagtagtggaggctgcagtacaccgtgtcctgagttggttgaatttgcaggtgtagaccctcaaatacagagggaccacgtatagggaaaccgtatatacagagggctgactgcagctgcctggaggattggttcccctgtgccccagccccctcattgttcaagggtcagctgcagtaaatttttacaggtttcttcttatataattcttaattttattcctaggtattgagtaatatttgttactgttgaaataagatctttcaaaattactattaatacattttcatttctggcataagagaaaggtagcttttttctttatgtaattatcttggactgcaaggagatccagccggtccatcctaaaggaaatcagtcctgaatgttcattggaaggactgatgttgaagctgaaactccaatactttggccacctgatgcaaagagcagactcatttgaaaagaccctgatgctgggaaagattgaaggcaagagaagaaggggacaacagaggatgagatggttggatggcatcactgactcaatggacatgagtttgagtaaactccgggagttggtgatggacagggaggcctggcgtgctgcagtccaaggggtcgcaaagagttggacacgactaagtgaccgaactgaactgcattatcttgtatgtgactacttaattctctctgtgagttgttttttccctaagtttgcctgtaggtattcttgtttctcaggctctgaacctgggcgtgtgctgttagagctatatttgggcagcagcctgggataccttggagaaggagatggcaacccactccagtattcttggctgggaaatctcatggacagaggagcctggcaggctacagtctgtggggtcgcaaagagtcaaacacaactgagcggctaacactttcactgggtggtagccttgcaagcgaa

SEQ ID NO: 31468 - DNA, 708 bp, Bovine  19866880664055
aacccatgcccctgcagtggaagcttggggtcttaaccaatgaaccaccgaggaagtccaaggcacgtacttattggtctagctagccagttggctttgaggttgccaaagcctgatccaagtagggacaggctctttctataaaggaccagttagtaaatattttaggctttgttggccagagagtccctgttgcagctgctggactatgctgttgtagcatggagcagccataaacaacacagaaatggatgagtgtgcctacgttccaagaaaacgttcttcaccaaaacaggcaacaggccacatttgacctcacacccatagtttgcccatctcctggtctgattcgtggactccctaacattgctgtgattgccgcaagcttctgccctgggggctgtgagatgatagaaatattagttagtgtcagtggccaattacatccaagtcagggaaccatagcccctaaatgaaaacttcccactttttactccaaataaatggtctctgcctgcacttcctgcttttagccattgtaggatgtctactttgccacttgtgtcttcgggagcccatgtaattggcaggtttttttttttttaattattatttttattggagttatttattttataattgctttgcaatgttgtgttagtttctgctgtacaacaaagtgaatcagccacgtgaatacatatatcc

SEQ ID NO: 31469 - DNA, 1245 bp, Bovine  19866880723183
acttggtgactgaacatgcaggatcttagttcccccaccagggatagaacacatactccctgtagtggacaggagagtcctaaccactggactgccagagaagtccccagaggggatcttttcatttcttttgaataaaattagtcagctgctcctccccacactaggtactagtcaacatttaatgtcgagtacatacagatatgagacctcaatggaaatacaatggtaagcaagatcagctaacgttaatgttgtctagtcactaagtcacttgtgtcccgactcttttgcaaccccatggacttgatagcctgccaggctcctctatccatgggattttctaggcaagaatacttgagtgggttgccatgtccttctacaggtgatcttcccaacccagggatggaatctgagtttcctgcattggcagttggattcttttaccactgagccaccagagaagcccaataatctcattagtttccacccaaggggaccagctagtggcagcactgactgacttgcatcatctctccttcccatctcacaccccatcaccacctgagggtgaggaggcagggacaggtgtcagctggtatgaggcccacgacagataacctgccccaactctgactcttctgggaagaaaaacccccccactgccaactcagaaagcactgctgcttcatcaggaccaccactcaagtcactgagatgtgaagatctggttccagggcaggtgtgggccctatcactcccattccctcgacaccctccacaactgtcgacttctactcccgcaatactgattcaaagatttccttagcaccaaaatatacctgtgaacacaaggtcttctgtgctagcaaagaagtacattttgaaagggggctatatttacaaattttattattttttattccaaaaatacatataaatgaaaacctgctcctcaaatgcagggaggcctttgcctatgatattgtattacattttacgtcacaaaacattctcataggaaactcagtatgcggctctttcacacacaattttttaaatatgtacatatatacatacacacaacagatgtaagcagttgtgacttttctacttccacataatcctctggtggaaaattagaaaatcgggcaattcccatacttttcagccttgggaaggtaaatacaacttttctgaacgttgttttaaaaagatgaaacatgtaaaccacacaaccgtctt

SEQ ID NO: 31470 - DNA, 1098 bp, Bovine  19866880728457
atagaatccggtaaatcccaattgtttgtcaattaaaattttttttctttcacaggatacaaatcactcactttgtctgaggaatttaagccttctgtccacagattctgaatttcaagaaaattccaatacagtaagtgtacctgtgatatggatgttattaaaataaatgcaagaattgagcctccctttagtgggaaaattgagtgaggccagtcttggaagtctttcagattgagttgtgttcaattactagccacttagggtgttttgattttgtttcctgataagagctctcattggagaggttgttctctccaacgcatagtgccttttggcccagatcactcgcttgataacctcctgcaccagaaaataacttctttatttatttagcaaatatttattgagtgcctactccagtcgggcatatcagaccaaccctcccacagaaaacaactgtatatgctgggcaaaatatgaaaacaactacgtgaaggcaccagagagcaacccaaacaggcagaggcaacatttgaacaaaggggccacttggaggatagcagtggcactggatgggtcttcaggctttatggcttatccgtctcagaccaagcccagttgataccaaacaagatggctcaggctcagtaaacactcgctcttactggagtgactaccaggaggacagagttcagggctactgcagcacctggagagtcgagggggatgacctggaaaggagaaaacacacaggtcgagtcccaagttctgtttggagctgtgtccaaacctctaggtgacccctgaactgtgggtgtgtggggcagaccccaagcagtccagctgaggctaaagagctggatgaagatgacagctgccatccactgcagggaagacagagcttggagttagagcatagccaagtcactggaatgttatagcaaacaaccaaatactcttccaagaagtgtaacagaatcctgagtctctgcagcatatcatttgcaatgtctagggttatccaaaattagtaaacataagacataggagaacattacctctactccagagaaaagttcatttatggactatgga

SEQ ID NO: 31471 - DNA, 587 bp, Bovine  19866880757108
tgggaaagactgcggctccatgtaagctctgggctctcccttctgcacaggtggaacacagccagcaggggtcctgggtggggccgggggctggaggcccccctgggatcctggccggaagagtggggctgctcacacctgcaccccccggccctgcagctggagcacccgggcccgcagggcgctgatcccgctgaggaggtcctcccggtgttccgccgatgagatgcccaggctcaccaggtccctgggaagaaggctggtcagatctagctggctcatccccaccgtcttctctcccttccactccaccccgccaggaaacaacccagaatgaggacaagctgggcctcccatgcaggcaggggcagggccccccggctcctcagactcactgggcagtcatggcggccacggcctccaggctcccatagcccacagcagcgaagctgtctttgtagcggcccaggtccagggcctccagccatgcgcccacagagccaaaggaggggaaggtggagaaggcacggtcctccaggggcgtgggaggcctgggggcgggggggtggaggagctgggtcagtcga

SEQ ID NO: 31472 - DNA, 2002 bp, Bovine  19866880758711
tccatggggtcgcaaagagtagggcacaactgagagactaatcccccacattccattgttcggatataacacattttgtgtagctattcaccagttgatagacatttgagttgtttccatttttgaggctgttataaataaagcactgtggacatgcacacacacattttttgtggacatgtgttttcatttctcttgggtagatatctaggatattatcccactcttataagctaatctggatccttcccttgttctcttcaacatccatggctggggtgtctctcttccaattacaggagaattcttcagctctgctctgcattttctccttccctattgccttgagggtcttgctccattaattctcctttttctctttcttatcaccagcattctcctgaataaaatggggataataataaggcctgtctcatagtgtttttgtgagaattatatgggtttaagggtgtctcaggtggctcaatggttaacaatccacctgccaatgcaggagacactgaagatgcaggtttgatccctgggttgggaagatcccctggaacaggaaaaggcaacccactccagtattcttgcctgggaaaccttatggacagagtggcctggtgggctcatccatgggggtcataaagagtcagacatgactgagcaactgagcacacgggcacacaaatggtttaatacacatcaaggtagatagactctagggtggcctcatgatccccatctcctgctattcaggcttttgtgtaattccctctgatggtgtagacaggacttgtgctacatttctaatcaacagaatatgacaaagatgataagatgtcattcccatgattatgtcacattatataatactccatcttagaaaacagagattccctcactggcttgatgatgctcacagccacattgggaagctctgtgcatcctctagggactgcaagtggcctgtaggaagtgcaagtggcttctaggacctcagcgaagcctctagccatcagcaagagccaaagaactcagagttgcaaccacaaggaactgaatcctgtcaataatctcagtgggtttaatctgccccagttgagcctccagatgagaatacagcccagttgacactttgattgtaggtgtcaatctacaattgactgtgagactctaagcaaggggacccaacaaagccatgtcaggattcccaacccatagaaactgtgaaataataaatacatgttgttttaagctactaaattggtggtaatttgttatagcgatggaaaatgaatacacacagagcttagaagagagtctggcacagcctacgactattagctggtgctagtggtgattccagattagcaattttcccttagagtataaccaagcaaaactcatctcaaaaatcaatggaaccttctttatttttcgcccctgaaaaatctcttcctagagttttctgtattcatgacttgcttttctgttcactcccgttttgctgaaatttaattcctgtttcctctactccactggagctcttcttctcaaggtcaccaatcatctcctagttactgaatctgatgaatggcttgaatcctttctgtaattgacttctctgtggcctttgatgttggtgactgaagtgcctcggagtcttgtcctccaaagacactcactgaatctaaatctctttcagaggacccaagagggatcagatccttgacagggtggctcctggtaactttcattattcattcatgtattcattcattcatatacttgcacacttctgggtcttgcagatgcagcactaaagaactcaacagcctaggcacagtctccactctcagtggaaattatgttctacacataagggcaccagttaaaataagtcaacaatagtatgatttcagagaatggtaggaattatcatgacagtagatagatagggtgaaatgatagaggctgctacatcaaggggcggcta

SEQ ID NO: 31473 - DNA, 1648 bp, Bovine  19866880803711
gagcctggtgggctgcagtccatggggttgctaagagtcagacacgactgagcaatatacctttactgccatccttccctaagatcacctaccctgggggcttcagaggaagcagattgaaggctgctggggtaagggcttgggtttggttgcccacttttctttcccacccatccatgtttttaactagcatttattgaaaatccttaggttccaatctgttcaagtaatctccttgccttctagttgaatgacacttccatgcactgggctgatggagaatgcagccataaatcagatgaggttcctgtcctcaaggagcttgccatccaaggagcttccaaagggaaccagacatagaaacagtcaatgaggcagatgttccaacggagacctgagtaaaatgtggtgggagtgaatgtgtggggggcgattcactctgatggagacttttgggccaagttttatgaaggaagtggagtgtaagctgcccctggtagaatgggccgggatttacaagctgctgaagcaggtgaggagagactcagcctgggaaatccagcttgagagatgttcagggacctgatgtgcatggtggtctgggggctgtgagtggacaggatcagggtagagtaggtgggaatatgcctagaaccacgttatcctgaaacccaccatgggttcagtactctgcttaagactttacaactctcattctatccttatagctatctttcaaggtcagtatgatcattcccaatttatagataagataactggggcctaaagaggacaagtgatttgtgcaagatcagacagtaagtggcacagctgggatttgtctttatgagtccagaagtggtgcagccagaaacaggcttaggaatttgggatttatgatataagcggtggggaaggacttggggtcttaaaggttttgaggagaagagtagaacttctcaaccgttgccttaaaaagatcagtttgtaaggatggtgggagatggagggaacaagcttggagaactgtggactgcagggtaagccaggcagaagagcaggaacaatgcaacgggaatggggaacatggcagtggcagtggaggatctgggaagaatgcaaggaacagggctcgatgacagcaggatcgggatggggaggtggcgtttctagaactttccccaccgtttcacagaacccatgggtagggagtgttcacgaggccgtgcagtccactctcctgtgtacctgaccctgatgcttgaatccccttgtaaacaacctgggctttgggaatccagtgaaccactccaccagaattcagaaacacctcagcattcaatcacactgctccagctcaggggtgttcactttcttttgattcttggatgcttccgactattaaaaaggtctcctttcaattgaaatgaaacttgcctctccacactctccacccaatcagtccaattctgtctcttgggacaaggcagaaagggtcatgatgcatatttcatatgcccgatcatcagatacttgatgacaattttcatgtcctcctaaactcttttcatctataggctatacagtaataatggtaataatgtgaatatttattgtgccttttctgtccccggcactgtgccgagag

SEQ ID NO: 31474 - DNA, 1145 bp, Bovine  19866880863554
caggtcaggctttgtttcagaggaactctgctccagaaacaaaggctaagagcatgctttgggggctggagtgtgcatggaggcagaggcagcattgtggcatcatctggcttggggtccctgagtgattgacaggactcccaatacttgatctttccccgtcttcccaggagaggtaaattattgtcttgcttttagatcttattagactatctttccagctgtgctcggtcgcttcagtcgtgtctgactctttgtgaccctatggactgtagcccgccaggctcctctgtccatgggattctccaggcaagaatactggagtgggttgccatgccctcctccctttccagctgtatgggaataaaatagtcaaggagaacacaaggctgttgccagtgaacttggaccaagataactgagtaagaggcatgctagagatgatgttaaatgggatggcaagaggaaaagagaccctgagcagtcaagttccttccccatgcagctcccaagagactgagcctccgggcattctgtcagaagcacaccggatagggtgggcgaagcccctcctaatccctgtgccctttgtgctctgtccccgcagtgtgatcttgtggctgggggacctcaactacaggatagaagatccggatgtggaaaaagtgaaaaaactcatcgaagagaaggcctttcaaacgctgtatgcgtatgaccaggtaccagcggccacccaggcactcttcaggcagctgtcgttgccctgccccaccccccagggggcacagaaagcctggctgcccagctccagctccgcctcttcttcctcatcttgggagggttccctgaggagctggcgcccgccatcccttccttccctccatctgtgctccctctcctatagctgtctgccccactggtcctgcccttgaggtttgtctcccctggaggcaagagctgttctctttctctctgtctcgtgtgtgcccattcattcagtcattcaagttggggccaaaagggagccaagcttctcatcaagacgatattagtcctttgtatatttcagatgatttactgatgtttcgagtgggccccctgcgccccctgcccctcagcagacctgtgccgtgtgcgggaccact

SEQ ID NO: 31475 - DNA, 1543 bp, Bovine  19866880893086
ggcccgcgggatgcgtagaggtatctcctcacaaacccgctgtgattaagtcattacttaccgtaatgggatcctttcagtcggaggtgatgcctgccacagccgataaggcgggcgatggccacggcggcccggcaggctgcagtaacacgggccctcccctctgtgacaggttcaagctctcacgctcatcgaaaagtccattttccagcacaactgggtacacttccctgtgacaaatgcctgttcgcctttaatctgttacaagccgaagaggcccaaaggaagcactccatcacaggaggaatgtttttataagcgtgcacttggagggccccgtgaggggccgagcggcactgcgtggctgggatgtctgagcacttaaggggcgctgcctcggtctggagcccagtttaggaggagggggtgtgccggggcgtgtgggtctgtggtgagtggggagggtcacacagatgtgcaaggcatattttcgtgtacctgtgcttagggagggcatggggggtggggtgtacctgagaggactcagtcctttgtgtgtacatctgtgtgactgcaaatgtgtgtccccgagtgagggtgtgtctcctttcctgcagcgtgtaaggaaagatgagtgcccaggggtgtgtactcacatgcgtgcattggacctggagcctccacagtgtgcagcagtagccctgcgtatgagtgtgtgtgcttgaattcccgtgcatctgatggagcactgtacaggggctgtgagcattcatgtgtctgcctgaagagggatgtgtggtgttcagcagcatgaccagcttccccggggtgtcctggagagacgcatggaggccctgaacccaggtaccctcaggtcctcagacttcatgccaagatcatcccaaggcctggaagctacagattcactctgagccagggcttggggaccagggtaggagaggggggctacagaggccagagctaccctccctagcctagattctgggtgcggagacagaggttctcagtttcaggttgaagccagaggctgcaagagcttgtccatcggaggatggcccgggagtgggaggagcaaggaagctttgaggacagcccagagaggtcactggctgagctggagctggaaccccaggctcgaggagccagagaggaggagggagctctggtgatagacaggaaggcagctatgtgcctaggagttactaaaagggaccctccagcctggggctcccgttttctgatgtgagaaacgtgcccctgacactggagggtgacaacgggaaaaagtgtgccctgggcgtcagcacatgcccagcgtcatgccagccacttcatttagtatctgcaccactgtgtacccagcccttggcatgccgaggccctgagatactggtttacaatcagaatcccccaggacttactaagaatctttactgaagaccaactctgtaccccgccagcatgtcgtgtgcattatttatgacgaccgtgagcaggattgtgataaatagctattctgggt

SEQ ID NO: 31476 - DNA, 832 bp, Bovine  19866880902942
tctcggcacctgtaggctgctgaggttatcacagggtgtggtcagtgagttgctcgggtagttaccctgtttcctggtgtggagcaggagatataggagtcctcacagccagcttcccgtccacttatcctttcacctccccattaatgccgtgacttgaacgcatgcctctcttccaggtgaagctcatccgactggttgggattatgctgctgctatatgtcaaacaggagcatgccgcgtacatctcagaagtggaagctgagacagtggggacaggaatcatggggagaatggtgagttcctggttggtacagggagggccttggtccctaaggtcttgagcctgcttctcatgataccacaactacctgtgtcccagcttgagggtactggcagcacgagatgaactgtcccctcatgctgtagcaggaattgatggaggaggccattccgaaattgtattttagtgacttcctggctgacttgcccagttagcccgcatcctcacggcccgctccgctctggagcccccaagtgggtccttccatttaatgcatgacccatgtcgcagaagctgtactggatcaccaaggaaaagaaagaaagaatgctaataataggtttgccgtttttcttcttgaagttgttaaagtcctccttttaggttctactgtgagagcttagcttcccagggggaagggagagtgtgtggcttgcctgcaatctattgcagagtggactcgccttcgccgctggctgcctggtccttctgtcttcttgcatttgttttcccacctataaatatgtaactctgctttactcatctccc

SEQ ID NO: 31477 - DNA, 900 bp, Bovine  19866880912511
cgaaagtgaaaatagagctaagttcccgcatctgggggtgtgcgagcaggggctggaagaccaccgctcgactctgctctagaggggcaccctctgttggaatgaagaggagggactggaatgaagagtgactctgactcgtggaccactgttgtgctgtaggttggaagggttttgggcgttgggcatttccacctgccctgcagacactgctgaatcccacggggggttgggagaagggctgaagcaagccctgcagatacgcaccagccgtcagggggcgtgcaggccagcagaaggctgccgccctccctccttgtacaatgcaacagccagggacctcctgggtggaggaggctgggaaattatttatctgcatcctctgttccacacaattggctttcctttgccaactcccagttggggtgggaaggcgcgaaaagcctggaaggggcgtcgagccgtcataaaacacttccaaaaataagcggccccctcccccgctgtggagataaatagctctggcagcccctcgctccgggtcccttctgctcaatcccaggtcaccctgctcaccaaaggaccccatcgctcctggcaaggctccagaacctcccagacactacctgtcccctccccacgcccctccccccacaggagaggcggcaccgcagccgagacaccgtgtaattccggctgtcactagcctaattacaccccatggtcctcccgccagcctcttgcgccctgcgccgcctgaataatgggctttttttctttaaagacactctctccttttcacagctgccttttgaaggcgaacaatctcacacaatgggcttaatgacagcaccactgggtaatcccagcccccagccctcttcctctccctctctctct

SEQ ID NO: 31478 - DNA, 1163 bp, Bovine  19866881007993
ctgacaatttggcctggtaattctttgttgtggggtctaccctgtgtattgtaggatgtttaacagcattcctggcctctgcccctagatgccagtaacatccccttactccctcaatgtgacaacgcaaaacgtttccagtggttattgccaaggtctcctgaggcaataaaaatcaccccagttgagaaccgttggccaaagatcttgtgggagtggcaaagtcaaggctagagcccaggaagtctccacccgaccctctgtttctctcaattcaatgcctattctgagcgtgaatctgtattgttctgcagttcaaagttagggataaaactttaccctgagccttgtgaaatccaatgtatttcatggcctttcacttatgccatgctgggctcactggacaccgggaagaggggcacacactttctagaacagcagacagtcttcccagccctgcatagctcctatccttaggacgggggtgagtcccctcaccttatagtggtttgctagggaaagggcatagattcccccttccctcttaagaatctgagagattcccacttgtactcactgggggaagggatgacctttcaagatctcttctactctggcttttttggattccagaagtggggagggttttggagtctgcagagaaggactagtaattaaagagtcaaagttaattgcccccacccaccaccctggccatggccaatagcctttgcttctgtcaatctcttctcctgcaaagaagaaaggacggtattaaggtattaaattagtagaaccagagagggtttctagttctgtgtcccatcacccctgcccataaacacacacacgtgtgttcagcactgtgaaaagctctgcaatttttttttttaaagagcccctctctgcctgattccataatgaacaggaaaggacgcagtggtgtcattctcaggggaagtgaatccgctctttctaagcatacagtggctacgaggcgctcgctgcttttcgttgtcttctataatcgcgtgtttttttattggtacataaaagagcttcctgtaaaacatattaaagcttccaattctgaatgaaaagcacttgatgtacaatctccccgtgaacaggagcctcaggaagtaaggctgatggcatctgcc

SEQ ID NO: 31479 - DNA, 1184 bp, Bovine  19866881025074
atcccacgcaggggaatcaggggaaatcaaattaccgagttattcactctttttgtacagttgatgggctgattagctgtcaatcacggcctgcattaacatctgacactgtgtgcataacaattaccagtcacattaaggaaacctttccctttctctctaaagggagaggggaggggagagacaggagagaggaggaggcaggaggaggccctgaagagaggaggaaattcaatcagcataattagctcaatcagaggagaacatcacttcaccagctgagcagagcggccgccaatgccaaaggcccccagctgaccagatgctatggagcctatgcccacccacgctgccccgcactaagagtctttcctcttcctgcagccaccgctcgggccaaggcagactgcccttcctgtcagtcaaccacttggccccaccctaaggcactccctgctccaatcaggcaggcccattcctgcctgcttctctgcgattggctctgactgaaaagggagaatgtaagactccaaggatgaggcagagttgggaggtgaaggtgaggtggatggaagaggttgaagacagcacagtggaatccaagtttatgattattttgtggaagagacttccttacattttgtgaaccattctgctgttctgtcggctccttcctaagagcccccgtctgcatcctctggcccccaggaatccttctgaattgcctgaccttctccaagctgaactacttatttcttcacttgatttcctgggatggtgtctctttttaaaaatatttatttatttatgtatttgactgccctgggtcttagttgcagcacgcaagatctttagttgccacatgtgggatctagttccctgaccaggagaacctgggccccctgtattgggagcacagagtcttagccactgaatcgccagggaaggccctccaggatagtttcaagcacccttttcctaaatttcacttctgaaccctctccagtttgtccctgtttctgaaactaaacagtattcctgctatgttggaaccaatggggccttcctggggactcaagccccccatgtgtaaaataggatgcttctatgggccctccagactagctttttgagagactctcagtctgaggagccctcactttgggggctgcagatgccccacc

SEQ ID NO: 31480 - DNA, 1201 bp, Bovine  19866881034067
ctgggcttgcgcccatgggcccaactcctgatccagagtgtggctccggggagtccttggtcctctgtgtttcaccaacactcttcctagaggcagcccaggggtactccgaggtgacccctcttttgcaagcttcagcccctgtaccatccagccctcatgaaatgcctctcccctctgggtcctcttctgcaaggctttggcaggagtggttgcgctgagctgactccagagctcctcatccaggagggcttcctggaggtgggagtgatcatgaggccagggctttcgtaggacagaaggcaggcaactggccctggagagggtcacccctgacataatcctgctctggggtgtggctgtgtgtgggtaggatgggatggggtgggaaagggttcaagggctacaggaaggggtgaaggagacacagccggcccttggaggggccagacgaggcagggagatgagctcaggctccaggaagtagtacacgtcccttactggcagaccttggggcctgagggctggtgggccagaggggcagatgggcactctggatgtgtgtaaatggaggggtgtctgggaaagttccctggctgagtctgatacatccattgaatgggaccttggaggagctgggggaggactcttagggttgatggagggcctaggacaaaaggaatccaagcagaggggcctgcagaggatcctggagggaggaggaggcagcacatccctgggagtgctccgtggtgggggtggggcctcccaacagtgcctttagcctcatcctgccaagcagggcaggagtctcccagccccgctctccatctcctgagcacctggctcggctcagtgtcctgggggtgccaggagaggctgagacactgcttctgcctttgacagtgctggagggtcccttgccagcaccctccagactctgcccccactgcccccaggagagcctggaaaggacacaccagcaccccgtcttggtggagggagcctcgccccatctacagctgcatcagtcatgctctgggggccagggtgtccccccaccaccagctgttctacagagtcccctggctgtgttggcaggacttcggtgtccagggtagacctcccttcctgtgaggagtgaggtcccagcatcctgatgggtcccaggcctcagccccgcacaggttgccggtgtgtt

SEQ ID NO: 31481 - DNA, 886 bp, Bovine  19866881047125
gaccagggtggcctgtctgaccaaagctgagaacggaattgcagattcttccccttgagaatttaactgaggactaacactggacagcccatgctgggcagtggagtagggagtgcgactacccagaaccgcatgcagacccaaggtagggggaggagaaccaacagcctcatggagaaggtgatattctgcttaggggggaaggacaggtgcaggagaaatgagtgcttgggccccaaagacagaggagatgaaggagctgacgcagcagagcagagccccgtcagcccctggcactgtggtcccactgcccagagggcctggctggccagcacgctccgattctgtgggagtccttggaacaggctcctcaccctgttcctgaggtcaaccgctatgccataacatacagaaaccaactgcccgaatgaagcagagttttgattttcttgtagaacttctgtggtaggcactctgggttggatcaaaactcaacatcagtttagggacagaactgctgctaggtaagcaggagaacctagcgtcaaaattccttgggggaaacagttgtaagtgtaaagcaccagcccagacccaaaaggcaatcctaagaatggctaaacccagaaggctccaccctgtgtgtggagaggagtgtgagacttacagagagcttcttaatgtttcccagggcctctggatccagttgtgcgatatcgatcctctgcaagtcactggccaataaccgcatgctctgtggggaggggagagggttaaagtggctggtccctcagagcaggaaccaccctgccagcagcccagggtgccctggggggtccccttgatgtcctgcacttgtagggggtgggggcaaggcaagcaggag

SEQ ID NO: 31482 - DNA, 677 bp, Bovine  19866881059109
catatcgctcagtggaagtccgttgttcccatgtttcacaaataaatttggtaggcttttacataatccaaataaaactatttgggattttaaaaaactttcaaccaagacctctggccaatgactagtgtgtgtcaaaaaaagaaggttgttgtgggtcctgcctctcctggccagaaaatctgagccagagattcagcaaaaccctgtttccagccaccttccccaaacaggaactaggagtttacagggaaaaataacagccaccttgaattccgacctccccacccccatattctccaaaacacaacaaaggatgtagactgttgtgtcaaacggcgccctggggaggcctgaggacacgggggaaaagggcaagacgggcctcttggacctggcaccactatgaggataacaaggatattgcagaaaacacccctgggtttggtgaagaaaagattttatgaaaaatttccccgtaagaaaaagagtagaaactgcattgagctgagaaagtgacatgacatcacccaatttggggcccagcaagcacaccaccaaaagggcagtgtgtggttttaaactttgcttccagtaaaaaaagcttgtactatgtacacaatgacataaagatccagtttaatttgcattttttcagtgcagactagaagccctct

SEQ ID NO: 31483 - DNA, 5032 bp, Bovine  19866881065165
aggagagggatcatccccatcccgcccactgtggcaccttcttccagtgtgaaatcccgagagactggcacgatctggtccaaggagacatcgtcccccagtgatggccatcctccggtgtgtatacaggaagagactgagggcaggaagcatcgtaaggacagggtgcacggggccattcctccggtccactgtggaagcctcagcgtgctcggctcgcattctctccttggtccctgggggctgtgctcatgcttctctgcacaatggtgcccatcagagactgatgggttatcaaggctggacttgcctcactttgggaaccccgctttgttagtaaaacccatgtgtaatcccccccttgtgcattctaggactgtatatgacaagaacagggtaatcctcacctcctcctctccctccctgaacctcagcttttccatctgtaaaggaagggtgatgggttcaaaaatgtctaaggctcctccttcccagatctgagaccctgagggtcacttttcagctgtgagaactttgatcattattctcgctgtttctgggtaataggtgggtgttactagcaacatttatggagccctttttacgtacttcacagcattttaactactttatatgcagaaactcattttaatctttagtttggacacattgaggtttgctcaagatgtaacaaagcctaggtttgaatccaagacagtcaggccacggggtttctcatcagattttgaggattatatgagctaataatacatagggctgggcatatagtgttcagaaactattaactatcattattataattattctagaagcctcagactctgtcctagaaggtgtgaaatccagctggagggatgatggaaaataataaacccaaacaggcaaggcccaaccccatcacttacgcgtgttcctggccaccacgctccggacggtagcgcacaagtcccaggaggcggctctgcctgctgtcgccctcgcacagcacaccttgcaccgcctgccgctcagggtcaaggcaaagggaaaggaagcctgcatcagggtcttgcccaacccggcccgccccaccagccttgccctggcttgccctgccctcacccatgcagtttactgtgtgaccctgggcaggtcacttcacctctctaacccttcatctgtgaaatagggatatcaacccccaacttcacagggggtgggaggataactgagtatttaaagcataaggcagagagtccaaaactgagtacatagtaagtactggtttccttccctccacccccgcgctccccctccccccatggcacagagagagggaggcaaccagagagacacgtagacacctgccattccacttcccaagcccaggcagggaggccctggggctgggagctccaggctgcagggaaggatatgatcacgcaatactccccatcagccagggtctcctggatggccacagattggtccatgctggtgcacaccctggggaagggcagaagggaggttctttaggtcaatatgtcaccggggatgtgatggagttgcctctgaggaccaccggcagggatggggggctctgctgggagaaggcggaggaggccccatcctctccctccccctccccctttgccatcctttgcctctgatgcgaggtacaacttgctatgccggcctctgtcctgaagggcatccagtcgctccttagtggggtccagtctacttgcaggacgtgtggtgccctgtcccattaccggagaggaggctatggtctttactgctccaggacgggggctctgcctctcttttgggggagcagtgtgagttctgctaacagctgtctgggaagtgtcaggggtgtatctgcatgtatcttgggaagggagtgtctcattctggaccaggactccagtcctgtccctcttgccttggagatgggcaagtgtcccgttactccttggccctcccccagcccagcaggccacattgcatcagccaaaggctgggggtgtccggttctgacagcttcaggacagggcacccagctctcagcttgcccagtccctcctgtccagccctgccctggcttccctgccccgcactcactcctggccccctgctattgccgcctacctcctgagctgtcaccgctgctgggtgtgcggaacctcggccgggaccggtcaaagactacatttcccagcagcccctacgccacacgatggtcagccagcctgcaagtcccagcatgcttgccaatgtgggggttggggggctcctccctgcgccctccgccgctccgttaactccttaagtcctgtggtaccctcggctccctattctggaaagcttttcctaaggactccccccgacatcctcagccctcgagcggccagagttccttatccaggacctggaaggaagatggtcactttaagggaaaacgttttctccgtttcatcctcagctcctcgcactccaggcaggccgacactggcctctgctggaacgcttcctccccaggtacctatcctgtcctagcttcaggaagaacaatactatgaagaaccacatacccccattttccaggtggagaaactgagactcagagaggttaagcgtcctgaccaaggtcttgcaactgaaaacgtgagactccagcttccatgccgcggacactgccaccccacggccgcatttcctcccttagcctcagcaggggagtgtgacgggaccagcccatcctgcctgcctcatggggctgtgtggggaaaaaggaggccaacgcgcgttgtcaagggtgtgaccgtgttcatatgcagcgcctgtgctgaggccccattctctctcctcctgaggagagacatcgagggagggcccccccccagctcagctctcacaacagcctgagcctacactttgttgtttccagccctttcccctgattcactggccactgggcaaggctttcctcctttggggcctgcccttctccacctaagataaggaggctgctccagatggacgaagggccagctcagattagggtatccaggaccagtctctcccagtctattggccatttcactaagctgtaagctccctgagaacaggctgtatcttttccttatcactccagtgttgtttctggcacacaaattcaccctgagaacatgtttattgagttagtgagttatcttaatgagtactttttctcttaagctctgacccaaactgaagggtcagtgctggggaaggagtgaccatgtgacttctagtccattccccgtccttttcccctaagctcagagttgctgccctagtgaccaatttgaataagtaaatctcttccagagaaagtaacttcttcccaattttcttttcctggaaatatccacagcacaaatggagctcaagtttatttgaatttggtttcaaagctgagttgaggacgaggggaaaggggattgattcagatccttcgagataaagagggctgaggtcacttcaggaaatcaggggaaccccaattccagcccctctctttgtgtcaaagtctggggaggatcagggaaaagtggacagggacgagcactttttttttggcttctgctttttgtatttttggccacacagaggcatgaggaatcttagttccccaaccacggatcacacttgcacccctgcactggaagggcagagtcttaaccactggactatcagtgaagtcccaggactgggcaccttttacagataaagaaactgctccttcacgactttggggtcctcgaacttgatggggatcagataggagattgttctgttttatcagacaaaactccagcctgcccccttggagggcatcatgttcaggcctaggccctgggacctctagcacagagctgcagtcttgataaatccctttcactaaagatacagtcacaggaatcagagctggcagtgggcctggcaacttccagggcctaaagggtcttcctgcctggttctccctgactcagcctggcctagctaggggagcaggaccaggagcagggcagagtggaggagaagcagctgcagccagggtcccgtgcagggggctcctggtggcccctggtgctgccctgttgaaatggaggttcccatccagctggaggcagctgtcagggcccgaggcttggcagcgctcttggtagcagggctgagccacagccccgtgacacctgggggtccctgctgtgcaggcctggctgcaccctgcagtgtggcctgagctggattgtttcagctacaagaagagacgagactattcgtcctccccttgccttcgtcccccattcatggaggcaaaaaatgttaagtggggggacttccctggttgtccaatggctaagactccatgctcccaatgcagggggccaggattcaatcccttgtcagggaactggatgccacatgccacaactaaagccagatgcagccataaataaatattggaaaaaaaaaaaagtgaagtggggctgtgggctgagttgaacttcactgggctgctggttcccagccagctagtcctcagagaacatccaaggtgatcagaaacaagggcatgtcacggggacttggaggattccagctgctatcctggatttcagcattatgtggagcttagaggggtccagcagcctgggccccagcaggtctagctccagccagattcagctgctgaccccgctctgtccaggcaggaggaggcctgcagttctaagggagggcagcgctcgaccttggagcactccagggctcacctcacagaagtgcaggccctcagtcactttgaagcagtcactgccttggcaggagaaggtgggacagggtttcctctggaagagaaagtgaaagaagagtgagggatggggagctctgtgaattctggactcaggtgggggctggctgcctatctcactgggctcagccactattgcctattcctgcctccaccacctggagcagg

SEQ ID NO: 31484 - DNA, 1261 bp, Bovine  19866881086405
tgtgtcccatgtgccggcactctgcctttggtaataggcttatgaaggagttactattattatgccgattttacagatggagaaattgaggcacagagtgattaaacaacatggccaaggtcacacagccaggaagcagaggaattcaggctctgaacatgggcagtctggctacagaagaagtgcatgactgtctcttcagtttcatggtacctatttttctttagagcagtgctttcaaagagtcgtccccagacctgcagcatcagtgctaacttaggaacctgttagaaaaacacattctcagtctgcactctgacctcctgaaccagaagctttggagctgggccactgcagcctggtttcttcctctgacttagaaacctggaagtctctgtgacttagaaagtcccttgggtgattctgattcctgctatagtttgaaaagcacagctttagagggttaaaataaaataatgtttataaaagtcttagcacagcattcaacaaatgttggctattatcatgaccagctttatttggtgagaatgaaaatactgttgtggggaatataaaaaaacacctgtctgcttggtaaggtgccatatgaagcaacttaaactggcaagaagaaaaaaaaaaggtattcaggcgaagactgaggggggagatattgacaaaaccatcatggtatacctggcacctggcacctgatcctttctaagtgaacgcagcccaccccaaggggcagagctcattttgtcatttgaaggatgctgctgcctcctccaagaacccgaggaatgtgctggccagctgattcactggctggctttagagctagacgccaccccagctccctcctgggcaccccagtcactgcctgtgcggcctcctgacttaagaacaaggatgagccctggcttcctatgcctaccagggtatcaagaagatacgtcccttcaagcatgacctgcccctgtccgcgtgtgtcaccctcagtgctgatgggccttccctgctccaggatggttgtgtaattggcctggcattacccagcagtctctggggaattgcttctgtcaggagcagaacaagcttatctgtttagcctgaattatgtcaccatgtgccccgtgtaaatctgaccgccttcccaaagcgctgggcctggatggatctgtgaataatttcaccaccacaattattttacaattttgaatcttctctggcaacataatgcatagtttgcagtaagaag

SEQ ID NO: 31485 - DNA, 654 bp, Bovine  19866881088740
tttaaggtgcttgcgggagccatgccatccgtttgtggtgagccgaattagagccagattagagcggggttctgggttcccggctgcggttggctctccatggtgctccttccagccgaccatgtctcatcacctccgggctcgcttgctttgaggcattgaaatctattttcagacacgattacaaagaacactcggagcttcactctctccatagtcaagtttgtaagcaggagctttcttatcaacatttaggttcaagttgaaaaaattaagactcctgaagaccacattggtgctgtacttgaacgagcaaaaccagagtatatcagcaagacgtacaagattaattcttgggagaacgctgaggactttctggagaagctagctttccggacagggaagttattaaaggtgagccaaggtttgtgagaattcagactgggacctgcttcaggcctgtgtgcacaatgtgtggtgtggacctttttttttttttttggtacatgtgtgtgagcagtgtgaagtatgaaccttggcaaggtggtgacggacagctgggacagcgatgtgccaccaaagcgggaggcggcttggttgtttgaatcgggcatctttctgcaatgtttcagggtggagagcccaacctgcgga

SEQ ID NO: 31486 - DNA, 3306 bp, Bovine  19866881263609
taagactcgtcctcatcgtctcctgggtactcctgttcctcctcctcctcattctccgcagaaaggctctccagctcgtcatcgatatcggacatctccagaggaaccaggtcatccccagaaaactgaggtgcaacgttgatcttgccaaagttctgccggacccgcgccagaatctgctgcatttctgaatcgatgccacagtgccggggctcctctttttccttctcgaggatggattccgactcctcacctactgtttccgtgactttctctcctgggttgttctgggttgtttctgcggcaacttccaaagatgaggaggatggaagctaatcaggacagaagggtgggggtggaagagaaatggaatcagaaaatgaaaactcaatttctttattttgttacattggagtatagttgattaatggtgttgtgttagtttcaggtataaaaccgagtgattcagttacacatatacttgtatctcttctttttcaaaaaaaatttcccaatttataatactgcacagaaatccctgctgaatttctgaacttacatatcatgctcttaaacaaggcaggcctcttctcaggaccaagggaaagtgtcaaaaacacgcacgtctcagtcatgttgttaatgtagcgtttagtcaatatgcactaagccctgaacccagcatgggaggatgagaggaatacagctacgcgccaactcagagtactcagccatcaaaaccaaaaccactagacactgtagacacaggaggctgcctacaccatccctgaggactgaaggatcaggggctgctgaggaagcacgtccccagggagcacacacccgggggaagaatggaggcccagcagaatgcagagggccaaggaggcgctggttcagaaagtgctgaggtggaggagaggcaccgaggaagtgctgcgcgagaagagcgggaggaaacggaatgttcagaaccagccctgaggtggtggacactcaggtgccaggcatgttctggggaaggggcagagggaaatgtgggctggcagtgtgaggcctcatgtagtgccactgggcactcagagctgaggctggaagaacccgtgcaattttccaaaggcgaggtggctgcacaaagcactaaatacatcaggaatccataaaattcaggaaacagtatacaaaattcctacatatgttttcatatgtttttctgttgaggtagatttttagttttgggattctcaagggagtttctgccaccaccaaaaggagagaagggcaagtcacagagtggggaaaactgactgtctcaacttaacagctagacatggaggaagagttacagaaaaccccaccgtttccacacagggtcacacgggggcaaagatggtctccttgggccagaggcctcggccccaccagccatagtgctgcccaccccgtggccgccctccagaaccagggcacatggggctccccttgcctcaggtgttagggggtaccgctcccgacacctggaacctctcctgtgacatccatggagctcctgcttcaggttaccaaggtctcccctaaaaggccccttccccagaggccatccctaaccacctcacttacaaagcactcctgtctcccacaaaccctcaacctgctttagtttccctcacggcaatcggtacatcctgacatcacgtatttatctgtgtactacgtgtcttccaatagtgtaataaaaatatgcatttggcctttgacccccagttcctggcacaagagctcctaaaacctttggtgtctcttgttattcttagtaagtccctctgccccaaatcagttaatgctagtgagacgactgtgctaggacccagcttcagactaggagctggccaccaagagcccaagcaactgctgacaaggctggaaattgagttcaatcactgacggctaatgagcctgtcaaccgcacctgtgtaaggaagcctccaggctggtgagcaccctgacgtgctgagagtgtggcctgcctggagagggtgtggacactccatgccaccctccaccccataggtgccctatgcacctgacatttggctattcctgtcttatatcttttacaacaaaccagtaatcacaagcaaatcactttcctgagttctgtaagtcctttcggcatatgatcacacatgggaagccctgaattcatagtgagctgggcagatgtgtgggtagccttagaatgccatctatcctggcacgtgaagtgggggcagtcttgtgggatttcagtccttaacctgtggggtctgcactaactctggcagttacccagctggtgtccggagcttgcataacaggtacagaaagatgaagcctatctgggatcagaaaacaccaggtactcctccactggcacatggacatggacatgtgtgtgcgtgcgtgtacaggagggcagggccttgtcctgcagtactggttgtctggtggttttagggggagaggagaaaaggttgagtaacatcagtttcaggtatgttgattttgaaatgctggagaaaatattcaaatggaaatttctagctgacaatggaaactctgggactggagccaggtgagaggatatcagagaaatatggaccccaaagactggcatgaagcaaaacttaaagccgtctcttcaagagacttggctgagctctgaagaagaccctagaaatagaaaagcaaagtgcccaagttggagtcttgtgcagcccactgccaggagagagagacagaacggttgggaagcttctcagggtagctcagagcccccagacctaagactttccctgagcatccactgtaccactctcctttcccgcctgatcacgagcttcctgagggcaaggaccatgctatctaatcccgtgctcccagtgcccagcacctggctgggcttgtgaaacaaaacaaaccttggaaatgtctctgttcttccagcagaagacgagacactgaagctgtaagcgagcactcgcatgtaatgagctctcctctttcaaagccctgaagactggcatttacacgcagtctcctatcacacctctacttccaggtaaccccccacaaggtcacagccagtggcacctggggagacaccacagttcaaagttataccccaaaggaagatggctgcagtccaaagacatgcgggtcagtaaccccacttccagagaggtgggtccacccttgtcttacctcgggggctgctgggggttctgcattgggcggcttgacaaagaaaggaatccggcccctctg

SEQ ID NO: 31487 - DNA, 1455 bp, Bovine  19866881290643
caggcacctgcctctgggcctgggaaggggccagagtaagcccccccctctgagtggcttaaggcttgagtgaggtgatgcccacttggggcagagaagggaggtcatcctctcacgttacacaagggctggccctgtgacacacagcacgtgcatgctaagtcacttcagctgtgtctgactctttgcgaccctgtggactgtagtccgctaggctcttttgtccatgggattctccaggcaagaatactggagtgggttgccattccctcctccaggggatcttcccaacccagggatcgaacctgggtttcctgcattgctatctgagccaccagggaagcccaagaatactggagtgggtagcctatcccttctccaggtgattttcctgacccaggaattgaactggggtctcctacattgtaggcagattctttaccagctgagctaccagggaagcccctcaaatcgtctatacagtttatctaggccagagattggcatgttttttctgataaagggccaaatagtaaatatttcaggctttttatgccttttggtctctgttgcagctactcagctctgccgttgtagcatgaaatcaaccatagacaatatatattataaatgaataggtgtggccgcgttccaatacaacttcatttactaaacaggtgatggtctggatttggccaatgggccataatttgccagcccttaatctatatcaatcccttcacttttcaaaaagaggaggaagcccagagtcaacaggtcacccatcccatggtggccacatcactcagggactgaggacagacaggcaggcaggaagcctgattctccagcttcttccctgaattattctcttcttgttccacgtgagttagctttctctcccctgttggtttgtcagttgcacatatgctagttactcattaaatattcatttgattggcttcatataacaatacatctttggcaacacatataacaatacatttcttggaagcttctgcgtcgatcctttggagagagctgtgagatcagagaaagggaccatgagttggttcaaagttcccaggtgatgagcttgcctggtggtccagtggttaagaatctgctggcaaaagcaggggacatgggttttggttcccagtccaagaagataccacatgctgtggggcaactgagtccctgagccacaactactgagcccgtgggctgcgactactgaagcccacgtgcctagagcctgtgctccgcaaccagagaagccactgcaatgagaagcgcgtacctcacaacaaagagtgacccccacttgctgcaactagagaaggccctacgcagcagtgaagacccagtgcagccaaaaatgaattaaataaataccaaaaacaaaacaaacaccgccctaaaaccttaaacaaagcaaaacaaaaacagggt

SEQ ID NO: 31488 - DNA, 1225 bp, Bovine  19866881309073
ctctcctcaaagctgcacgttgtccaggtcagaaccttgtgtcctcctgacctaggccttcctgtggccttgactcagacacatctctgttgttccttttccataacctttgctggccccacccctggacttttcaaccaatgctccagggagctgcaaagaagctatcccctagagtgctgtcagaacagtggcaggaaaaccaggttgatacagtgtatggaaaccaaaggaggaaagagtctcaaaaagggggtggtcagtacagagagggtcaatggtgtaggagttcatatccaatcacagtagacgctgcagtctgggtttggaacctgaatcgtctgctagatgtatatgaccttggacatgtcagaagtcctctgagccccagttcccattgcatacaatgatggctcccacctcttaggcgggttccatagtgtaaccatgttgtaaagtccctgacacactcaaaccattcaacatatgatagctctacctctgaatattaatttacccagcaaactcttgtgagcacttgcaaaatgatcctgccaatgaggatgctaaatcaagacaggcttcagtctcaaagaggagatgacatcaatcactgaattccaagagagcaaatgctgagtggcctaaaagaggcccagagggtgactgcaagagtcccatgaaaggaaaatccctgttgttgccagagtgtgtgttagcagagccccgagcgctgaagctcaccatagaggagagaccctctaagccaggccttgaaggacacgtggatgaacagctggaaagcgggaacaatctgggcaaaggcccagagggaggaacctggactgccaagagagcttctcagggctccctgctgccctctggtgccaagctcaaaggaaagtggcctcaactccagaaggtgaattcatggcagccacgttcccaatcctgctctccctgtcacaagtgccaggacacgatcattaggtgattatatttttaaggcccaaattgttttatttgtttccctgccagctttcatgaggccatcagtcattctgcacacagataacatttcttatgtacattgacagaataaattacatggttctcatccggcaaatcaacattacagaggaacattatcttttgcaaaacgctgcctgggcacatcataaatcctaaccaggtttattacatctgtcttgtcatagattcattt

SEQ ID NO: 31489 - DNA, 1923 bp, Bovine  19866881312374
ttgccgtttgtctttggcagtgaaaatgcaaaatgtggtgtgcagagaagaggaggggtgggtcgtgggattggtacatccgctgaggttctcctcccttaagacatgtatcagtggacagcattcttctacactgatggctgacgagctgtttctttctttgtttctcagcctacatactttcaaccttagaacattcaagaatggtctcacgtgagtgactgaggcgctgactcacctctgatttattaatgaggatgtgtatgcagcccactcagaataggctggtggtgcatgtctgggctttaaatcaagtcgcatcggtagttttgtactgtattcttcatggcagcaaagtaacacaacctgtttgtctcaagacactcacaccaggtgtgtgtggtgtgtattcttttctttgaacagttgcacactgacaagaagcagatcagcgtggggttcattggctatccaaacgttggcaagagctctgtgataaacacactgcgctccaagaaggtctgcaacgtggcccccatcgcaggtgaaacaaaggtacatctggctcgaggggccttatttactctgacttatttcccacggagggtgctaattcaggacacggagatgtctgtctgcctctctcggatgaagatttcccctgggagtttggtctccttgtcgcaggtggcgatgtcctggagctgtttctgcccttttgagaagactgagggtgctctgtgtgccactgcctgctttgggcatggtttgctgtgtgccacttgagtcctgttttcttgtcactccaaccttttgctttgataaacaaaactagagaaaatttggtgtctggcttaagaaagaaaattcaagtttaagatagactgtgttgggtagggggcctaccctggaacacggagtgtggggtgcagcatggttctgctgaaaagaactggggccaagcagcatgaagcttccagaagcacttttagagacgtcagagaaagctttactggacgtcattgcacaatcctagatggagagcctgcctctgcattattgttagacacttagctgatggaaactatagtttatgccttgtggaagtgcctcgtgcatggcatacagaggaggggctttggagcttcattacctagtaggctgctccgctatgaccgcctccataccccgacccccagccccagccccagccccctctctcactaggtgagcatcagggcttcgtgaaacccctccgggactgacccggagcagtcagaaatggaagtctctgcttttaggtctggcagtacattaccttgatgcgtcggatcttcctcatcgactgtccgggtgtggtttacccctccgaggactcagagacggacattgtgctgaagggagtcgtgagtattttggtcccgggaggctctttgtttgccttcgaggggagcgtgctgtggggagctctggagacccctgctttttactcattcagcaggcagcttggggtcagcctgtctggccagactggaggaacatgacactgaacagggcggcctctctgttccacttcagcctgtttgaggaggctgaagggcatatctggtcaacgtcatcccacaagagtgtttgtcgtttacacacgggatccagagggaagcagggcctgtttatgtttagcaataattcatcttcgtgggtttatggattgagtcattttggaactcggtcatttcctcacttgttcctgaagacaaccgagagctttaaatgattccacttaacctttgccagtgtttctggctatacacatcctggacggttcctccctccttccttaaactatttatccccttctctttgtgtcctggaatcggcagacttttaaccatttctgcaagtcagtagcacaaagcattc

SEQ ID NO: 31490 - DNA, 709 bp, Bovine  19866881375456
ctcctcgtaagactgttgagaggttatccgtgttgttgctttatttttcccaggttcccttaaatgccttctggctttcattttgcctttgtactactgtagcaaatcacttttgcttctttgaatttgcaggtgatagattcatcagatgttgtggttcaagttcttgatgctagagatccaatgggtacacgttcccctcacattgagacttacctgaaaaaagagaaaccctggaaacatctcatttttgttcttaacaaatgtgaccttgttccaacctgggcaacggtaagtacagctgctaatgcggaacagataaccaaggccacgtggctcgttatccatgaataagtaggcagcgtgatcagtaggatttggggcagcagataaagtgttgcactgttgaggttgtagtcactgaggtgtcttcactgagagcaaagctcaaatgggcttcattgatgatgggcagttacctttgatccctgatggttggcagtggcacagctgcagtgcccacaggaggactggtgtgggccctttagaaggtgcggcagctgcagcccctggcccgtttcacattatgttaggttaattgcatttagtaacagtgaaggcattttgggaatactgtttttgtgtttataaggcaaaaaacagcatcaactgtcatacttgaaaaaatatttcaaagaagtacagctag

SEQ ID NO: 31491 - DNA, 1360 bp, Bovine  19866881416923
tcactgctgcccaccagaggggacttttatgtattatgactctttttttgactctgacaggcaaagtcagaacctctgtttcctggaactccttgcgctgttgtttagataagtttaaatgagctgtgattaagctaattttgaggtaattaacttggggaaggaatccttcacttcttaaaattctaagtgactgttcattataagagggagcccttgcaaaggagccacgcggctttcaggagccccgcttaattaaaacatacggaactcagccacagagcaagagtttaccgtcattaatgaaaaatgaatattctttatctaattacatggcataattaattgctgtctccaaccacagagacagggagggggcagaggaagccataggctcctgttcccacagactcagcaaaggttcaagcctgattctagggtcctctggaagtcccttcaaagcccagtgctcagggagaccccagtccagggtacagaagggccaggcagagagtgactcctcacagcagtgggtgttggcacctgctgggtcccagtagatctcttttgtggcagtttgagcccacatcagccatccagggtcctacttggagattcaagtttaatgagtgcctactacgtgcttgattgtcaataaaacagactgaagtcttgcccttaggaagcacgtaggtttgaatcgtggttctgctgtttactagctgtggggcgctttgagcaagttccttgaccttctgtggctcagttttctcatctgcaaaatgggactaacagtagcgtttatctcatagggttgctatgaggattaaatgagttagtgttcatgaaacacttagaatagtgcctggtagatatacctgctctgtaagaagtgttaaagtaaataaaaaagaacacaagttgggatgtaacaggacaacagcacgggaggaggactggtgttcgacttggtgttcagacagaggtgggggaaggggacctgacttcttggccctcttccccttccctcgcctcacagcttcgctgttgccacgaggtccccatgtatattctgctgtctctaccttcatctccattttcctcttggggacttcctaggtcacccttactaggatttgccctccgagaacccccagcacatttcaccgggcagggggtgctgtcaagacgccagctctctacaggtgaggtgatcacagagagtacctgatgcaggtcttggagatgctcccatccagctcgttttaccaatgaggagactgcggcccaagagacactgtgaggtggctggctgcggggcctggagaccaggttttctgactggcatcctagcctcttg

SEQ ID NO: 31492 - DNA, 1198 bp, Bovine  19866881509287
tgccaatactgtgctaggctcttcacacacaccatttcagccctctgagattgtgcttttactatcttcaattacacaaatgaagaaactgaggctcaaagaggaagtgccttgccccagatcacacagctaagaagtgatggagcctgggaggtcctattagagtctgtgtgctgaacaactctgctagttattgtttgggtttggagagagaaatgaacaaacccttcaaaccttccagagggcccttttcagccacaaattgagcaaatgatacaaaactgcgacaagcaacacagaaagactgatcaataaagcaccatctccaagaagcagagcaattaggtgaggaaatggaatagctttcctgtctgtaaaataatgggctcatattaattttaaaatattttcacttcattgtctagaagaaattcaactttgattccttctacttggatcactcctccttgtccccttgcatggctgggcttttttcatccttcaggtctcagtttgaatgcccctcctcaaaggagccttctatgattctccaaacataaagtaggtcaacctcaaggttcagtgctggccctttgctccatcatagcaattctttgcatggtcatcatgtacaattatgtgtatgtttgtgtgtgtgaaattgttctatctcctctaataggctctaacttggtgaggctagggactatacttggtacattcaccctgtagaccctgcacccagcaatatatcatttatgcagcaggtacctagctagcatttgttcaaaagatagatgaataagtgtggaatattcttatttgcaagagttcagaaatctatttttatgttctctgatcttatttagtaacaaatcacttaaaagcagtttgatatccattgcaatatgtaaactgggaaatcatgtaaatacggttatcactttctggttgtcaatgatgcccttgtattcctggaagggggagaaacagtaagagaaagagcaatgcacagggagttgggggatctggggatgggccttggatttactgttactagctgtgtgaccttgggcatgaccttttccctttctggtcctgagcttcctcagctgtaaaatgagcttggactggcaactctctaaggattctttcagcggaaaagtttaaactctaaaattacataaatgaacttgcg

SEQ ID NO: 31493 - DNA, 763 bp, Bovine  19866881527413
gctttatctaaaatgctttatataaagtactaaagtactttcatataaaattcaattaataacagcaattgttaggccaaggccctgttggttctcactttcagcttgtcctagagcagaaacagaataaataaatgcaactgaattgtttaagagagtgtaaatcctagttaatcaatacgtaactaaagttttctttgaagcaggcctaaaaggcaaagtagacatttgtctgacaggcaagaggccagccagggtggcaaacatgtagctggcatcttgtcctccttgcaccccctactcttgccgcatctcccctgcctagggcagacatcattaatcaatcatagcatctcatcttgctgaacctggattctgccctatgatagttttcctcctgtggtttttctgtagtaaaatattctaaagcaaatcttaaatatcatgtcattatgatcctgcaggatacatttctaaagaaaatggctgccttcttacataacaacaaggtgttgcctcacctaacaaaattaacaacaacaaaaatcctttgtgttgtctgacacccagttcatgataatattttcctgattgtttcagaatatttaggattatgtttaacacagctgtggaccagtagtcagagtcttttaagcgtgagtcagaagcatcttcaggctgcccttgaggaatggaaatgagggacttctacccctagatggctttgtgccttcaaaggctttttcctaacgggggggagcat

SEQ ID NO: 31494 - DNA, 743 bp, Bovine  19866881587205
acacacacacacacacctgaaactaagaaaggagcagaattccctgacacactgccaagcaactgttccatttcccacaacaccctgcagtttcttcaaacacaaagacgtttgccacacggtcagtgaaatcatttgggaatgcgtcaaaagaacatccatggcactgggatgtctgagagtcacaggatttccccatgcctcgtaaccgtctcaagggctgtcacctgtctccccagctcagagctccctggggagtggtccctgtgagagtggtccctaagataactccacagccccatcagaccccacattcctgaggagggttgccactgagggtctgtgtggccttgggggcaccttgggctctgaacaattatcatttctccttcctggagggtgtttgaactcagcagggtcaggcagtgtttggaaaatgtgtcatctcctcctgcctgctcacagccccgactggctatgtcaccttgccccagagccatggaacaaagcggaccctcagtggagcaagacagagatctcagagctgcagagacaggcagattcaaagagaccacacaaagacagaacctggagttggtgagacagagaacaaagagaacacccagcaagaaggatgccttgggcccttgggtggggccaggcctggagacagctcagcagaggggagtgcattcattcattcactcatggaaacacagtctatctgctaggcactgcactag

SEQ ID NO: 31495 - DNA, 966 bp, Bovine  19866881656931
acctgctgtatggcacatggaactctgctcaatgttatgtggcagccgggatgggaggggagttgggggagaatggatgtatgcatatgtgtgactgagttcccttgctgcttacctgaaactatcacagcattgttaatcggctataccccaatacaaaataaaaagtctccaaaaaatttaaaaaaaaatcgaacaacagaaaaaaccccagtgaattatctgaacactggtattgctttctttccaaaagtagttgccgggatatttctcttttcatttcagtagcatgcacagtacatagtcattttgtggattgtggctctctaattgctattaaagctaagtagaaatgttcaaagtgggtctctactgtctgaagttatcacaaaagcaacaaatgtcatggcagactgcaggtcaccccttggtgccacagtcacttgtctaggacagctgtgacatttcttaagtcttcaaattccagcccagagagactgaaacctgccagaatcagcatccagtgctctccctgtcatgtccatagtcctcccaagtgaccagttgattgtctttggcaacagattttttgtaggaacgtacaatgtgaacggacagtcccccaaggagtgcctccggccctggctcagccacgatacccaggccccagatgtgtactgtgtggggtgagtgcttctcttctcgttgtctctgcattttccagaatgtgtagctgtggttgaagggatgggggcatgaatctgtaactgagacttcgcagcaggtgaagggattgaaaaacgagcatatgctcaataacagctgctcctctgttctgtgtgcttcctcatagtaaacagatttctggcactattaaagtgatgtgcttggcactggaatgctaatagttaattttgagtgcaacccctgtgttaaaagcatgcaccctcgaactgaattttatta

SEQ ID NO: 31496 - DNA, 1108 bp, Bovine  19866881666502
gggcctccctgctggcagggctcccgccgcccatctccctgggtctgtctcagcagaactgcggggaagaggcagagagcagcctcggaactccaagaggcagtttccttccccaagcccagtgcgtagacttaggaggttcgagaggctgcccagttcatgcttctgcttgttctccttccctgacttctctggtcagatggaaaaaaacctctcctgcttcctcagactccctataaggaatctccctgttccttatttccagatgcatcgtcagtacttttgggaaagtgcagtctaatctgtatctctcctaactgaaggggctacctcgttctccctgcccagttttgtctgcatcccttgatggccctggtaatggccatggccctttcctctcttgtgcgaggcgagctgactgggcggggcggtggtgctgagggtaatggtagaggctggttcaaagcagagccagggacctactgtttctcaccaagaggagtttatcggggggctgctctttggggtaaagggtggaaaggaagccctttcctttcctcctgtcgtctgtcacctgatggccaagcccagatcataagtgttaatgaattgtggtgccccggaggcagctgggcagcccccgctgccctgaatcagcctgactcatttacagctctctcccagttcccccaaaggcttctttctgaggtgacaaatgggggggtggtttcaggtttcatgtgttcacattactggatggaaaaaaaacaaaaaacctttccaaaccaaaaaaccagcttctacagcagaaacatgtcccgagagcactgaaaatttccccatcttctcttctcagctgctcagtgacactgaggccagtgacagaggggttaagaggagggggttggagccaggctgtgtagaacgttggggacagtccctttaaaggtggcagcacctgctttcctgcataaagacaggggaggacctttgcggggccctctagttctggagtctgtggccagctgtggattgccaggggactggcatgggcaggggctggggaaagggtggacctcttgcatttcgagctaattgatcccagggg

SEQ ID NO: 31497 - DNA, 1756 bp, Bovine  19866880362484
atagttaagtttgggggtactacaaagttattttaggggaataagaaaaactctgcagccttcttacctcacaggtagccaggctgtcgtttttagtcaagagaccacaagaggcttttttttttttttacttaaagaaatctgaggacctccctggtggtctagtggctaagactccctgatcccactgcaggagtcctgggtttgatccctggtcagagaactagatcccctatgccacaatgaagactgaagatcaagagggctgcaactaagaagcagtgcagccaaataaatttaaaaaaaaaaaaattttttttaaataaatctgactaagctaggaggaaaagtctaaatatacagacaacaagagctccctgtgccagacaaggatctccagggaagcagagaatcaacaggatataggtatatttgcatgaagacatttatattaagggattggctcatgcaattatggggaccagaaaatccaacatctatagggcaggtcaacaggccagaaagtgagtcaggatttctttgttacagtcttgaggaagaatcacttttcttaggaaacctgtttttttgctcttaagggcttcaactgattagatgaggtccatccacatgattgagagtaatctcctttaaagtcaactgactgtaggtgttactcacacctacaaaataccttcacatcatgtctagaatagtgcttgatgaaacaactgggcactataggctaggcaagtgaaagtgaaagtgaagtccctcagttgtgtctgactctttgcgaccccatggacggtagcctaccaggctctgcggtccatgggattttccaggcaagagtactggagtgggctgccatttccttctccaggggatctccccaacccagggatcgaacccgggtctcctgcattgcagacagccgctttaccgtccgagccactagggaagctaggctacacaaattgacccagaaaactcagtcctcacattccctgaagcaactttccatccagatgggcccaataccaaagcccaccatcaacaaggcccacttatgggagaggcctcttagtccccttttctaaatgtcccatgctaaagaaagaacagtcaaccaagaatcagtagacatctgagcaaagtcatttgtggaaacaaagataattcaggcagaaggaaaaaactgaaaaactaccagggatatctttggggagataacagaagacaagtctatcatgaaacaagaaagaagctactggagaaaaaatgacttcagagatcaaaaagaagctcttagaaattacaaacattataacacaaatgaaaaacttggtaagaggattataagataaagataaggaaatctctaagaaagtaaaacaaaatgacagaaagatggaaaacagataagggaaaaagagacagagagatcagtttgggagaactgatacctaaatgaggttttcagaaagagagaacagagaaaatggaggaggggaaaatatcaaagaaacaattcagaaaagtttccaagcattaaaggtcatgagtttccagattgaaaaggtttacccagttcagctcaggggttaaatccatatctacatgatagctacctcatcatgaaattgaagaaaacagggagtaaagcctgggtgagaaggagggacagattacatacacatgatcaaaaatcaggctgacttcagacttctcaacagcatcagcagagaccaat

SEQ ID NO: 31498 - DNA, 1364 bp, Bovine  19866880365120
aaaagggaagctctccttagaactaggaataggaaataataagactgactgaagttcaatatcattagttgaatatctactacctgttttttaaggggacaaaattgcctaggcggtgctcttttatgtatcaatgagggcacagaagaaggccagccttaccatggaccctcaccaccggctcaaaggtgtatttatgtaactttattgtaaacaaagagcaaatggaaagcagcaggagaacaatttggttcacgtttcaccaaagatatttttcctccaggttgaaggtaaccagagacttctaagtcattgcaaacatgtcttaatccagcaattacatataggcaccatatgaatctttggaaattagataaaaagaattctaatgtaacacaatagcaacatgatagtttagaaaccatgatgcctcactgatgcatacatctgctggggaatgagcatatggtggtgcccagtacagatgtaaagaaaacctgcagttatggctctttagtatgataattgattctgagtaaacgtatgagttttgctgcttgtctaattttcagttgttgggtttttgcttttgttcattttttttaatggcagacgttcgggaggcaaaaagcctctatgttcctggtgtaactaaatctagcaatattactagtaagaccagggaaatatactaaacttagcagaaagcggagacaataacaacatccaaaagtgttctttgaggctacttatcctctgacaaatgacatgatagccaacagccaagcactgaaaaaaactatgtctgtatctcatatgtttaacattaatcaattttattctatggcagcccattatctatatggtgacagaacattccataagcagaaaaactagaaagggggattatgtttaaaaataaataaaagcaatgttatcagactcacctttaaagctttgaaatgaagtttttcgttcctttttatggctaatattccattgtgcataagtaccatatcttccttatccattcatctgtcaatggacatgtaggttgctaaaacgaaatttttaaaacatgaactggagtcccgttttcaacagggaaacaggatgagagcagaacctgaagtctattgcacaaattaaagtgcattttgatcagtatttcagggacagccactgcctgattatctgcatatgcttgtcccctgagcagtttgcattcttcaaccatcacaaacctcccagtcaaccccactgggttcccccatccccacactacaatgtgtgtgtgagggatggcaaatcatttacaatttggtctagaccaaaagagaaaaagtctaggcatgtaactctat

SEQ ID NO: 31499 - DNA, 1656 bp, Bovine  19866880563003
aaaacgaagatcatagcatctggtcccatcacttcatgggaaatagatggggaaacagtggaaacagtgtcagactttattttttgggactccaaaatcactgcagatggtgactgcagccatgaaattaaaagatgcttactccttggaaggaaagttatgaccaacctagatagcatattcaaaagcagagatattactttgccaacaaaggtctgtttagtcaaggctatggtttttccagtggtcatgtatggatgtgagagttggactgtgaagaaagctgagcgccaaaggattgatccttttgaactgtggtactggagaagactcttgagagtcccttggactgcaaggacatccaaccagtccatcctaaaggagaccagtccttgggtgttcactggaaggactgaagctgaggctgaaactccagtactttggccacctcatgcgaagagttgactcattggaaaagaccctgatgctgtgagggattgggggcaggaggagaaggggatgacagaggatgagatggctggatggcatcaccaactcgatgcacatgagtttgggtgaattccggggtgttggtgatgaacagggaggcctggcgtgctgtgattcatggagtcgcaaagagtcggacacgactgagcgactgaactgaactgaactgaactgaattgctttacaatgttgtgttagtttctgccgtaccacaatgtgaatcagccacaagtatgtatatatctcctcccttttgaacctcccattggctatctgttttacatatggaagtgtatatatgtcaatactactctcaactgatcccaccctctcttccctgccctcctgctgtgaccacaagtctgttcactacacttgtgaacacttgtgaatactacacttgtatgcgtgtctattcctgcactacaaataggttcatcagtactattttgatttttttttaaatgttgaagtctgttttcctttgaggaaaatacatagagattatcatatcatagagttaaataaatttgttattatatatatatggacctgatgtatttaaggaatgctagtaaccttaaactggttatataattttgtacaaaatacatactttcagaaaagcttatggtatgagaaattctattttaaaaacatttttatttcacatctttggtattagactgatcatgccaatgatgtctggattatgggaaggaaggagcctgaatcttatgatggaatcaccacaaatcaaagaggagtcacaatagcagctcttggtgctgactgtattccgatagtttttgcagatcctgtcaaaaaagcatgtggggttgctcactctggtaagtgtacttagttaagcacctaggatttttaccaatttggggggaaagttataatttttctctgatggacattgtttttgttcattctgtaagtaatggtctgactctctgtgacctcatgggctgcagcactccaggcttccctgtccttcaccatctcccagagcttgctcaaactcatggccattaaatcgacgatgccattcaaccatctcatcctctgtcattcccttctcttcctgccctcagtctttcccagcatttaaatagttaattactacccatggtgata

SEQ ID NO: 31500 - DNA, 5169 bp, Bovine  19866880663714
ctggcctttcgcgtgatgtactctgcatataagtaaatagcagggtgacaatatacagccttgacgtacttctttcccagtttgaagccagtctgttgtccatgtctggttctaactgttgcttcttgacctgcaggtttcttagtaaacaggtaaggtggtctggtattcccgttttttgaagaattttccacaatttgttgtgatccacacagtcaaagggtttagcgtagtcaatgaagcagaagtaggtgttttcctggaattctcttgcttttctatgatacagtggatgttggcaatttgatctctggttcctctgccttttctaaatccagcttaaacatctggaaattcttgggtcacgtactgttgaagcttagcttggaaaattttgagcattactttactagtgtgtgagatgagagcaattgtgcggtaaatacatgtgtgtatgtgggtgtatatggtgcatatgaatatgtttgtatgtatgcatatgtgtatatatgtatgtatgtgtgtatatgtgtgtgtgcatatgtgaatacatatgtgtgcatctctgtatgtgtatgtacgtgcatatttactcaggcaactgttaggggttactgctgtaagtgatcatccatagttataacacgtttcacgtgtcacttacaggaaagatgtcccaatgggatgatacctcctcctataatttcagctaactttggggtgacttggtcactcacaagggaggtaacgtccactgatgcctttgtgaagtccctgaactggaaggtcggtgaggaaagaggcagagctccttggcggggtccttctgaagtcacaccaggatctttccacaatgaggtgaaccctggggcgggtggttgagaatgacacttcaggaccccaccccgcccagttctcctccgggagctgattcaaacatcatcatctatacacatgttcacacgttactgagggatgtctggactccagcccattacaatccatcatccttgaagccctgtgtccacagctggaggcagaaagcacatgaaattgtacactggaggagaaaaatgcatcaaatctcagaagcgagctctcttcaggtttcaaaggtgattgggaaatctaaacaatttagaggttggtttggtaaaacccaaagaaccagtcaatgcagttattaaaaaaaaaagaaagaaaaacagacacatccatgattgtagcaatgctatccgcaaattcacacctcctccccagccaaaaggtggaagcagctcaaatgtccatccatggacacagatgaatggataaacaaaatgtatatgtgtgtgtgtgtgtatttatgggagaaatatccataacctcacatattcagatgacatcacccctatggcagaaagtgaaaaggaactaaagagcctcttgatgaaagtgaaaagaggagagtgaaaaagctggcttaaaactcaacattcaaaaaactaagatcatggcatccagtctcatcattttatggcaaatagatggggaaacaatggaaacagtgacagattttattttcttgggctccaaaatcactacagatggtgactgcaggcatgacattaaaagacgcttgcttcttggaagaaaagctataacaaacctagatggcatattaaaaagcagagacattattttgccaacaaaggtccgtatagtcatagctatgctttttccagtagtcatgtatggatgtgagagttagaccataaggaaagctgagtgtcgaagaattgatgcctttgaactgtggtgttggagaagactcttaagagtcccttgggctgcaaggagatcaaaccagtcagtcctaaaggacatcaatcctgaatattcattggcaagactgatgttgaaacagaagctccaatactttggcaacctgatgcgaagagctgactcattagaaaagaccctgatgctgggaaaatttaaaggcaggagaaggggacgacagcatatgagatggttggatggcatcactgactcattggacgtgagtttgagcaagctctgggagatggtgaaggacagggaagtctgatgtgctccggtccatggggtctcaaagtgttggacatgactgagcgactgaacaacacttttccatgaaggtgaaagtattagtcactcagtcacgtctgactctttgtggccccatggactatagcctgccaggctcctctgtccatggaattctccaggcaagaatactggagtgggttgcatttccttctccaggggaatcttcccaacccagggatcaaacccaggtctcctgcattgcaggcagattctttagcatctgaactaccagggaattccatacatatatgtatattattcaaccatgaaaaggaaggaccttctgacacaaactattacaattcagatggaccttgaggacattatgctctgtaaaataagccagtcacaaaagaacaaacgctgtgtgagccagcttatgtaaggtacctagttagtcaaattcattgagacagaaagtagcacagtggttgccagaggctgggaggagggggaaatgggaagctgtttaatggggagagagtttcagttttgcaagctgagcttctggagtctgattgcacaacaatgtgtagaaacttaacacgtctgcatgacagattttaaaatgtttaaggtggtcaattttgttacgtgtgttttaccacagataaaccaacaacaacaaaacaaaaataaggcaagataagtcagttgcataacagcagagctttgttaactggttgtttgaacttcctggaaacgaagccaggagtggctagccagggagtggggtcaaaggaggtaatgagctcagcggggagggaagctgccctggggaacatttttggaggagggagtaggaacgttctgtgccctttgccttcctgagagttgacccctccatccgtgacttctggagaaaagtcagcgtgaaagtgtctgtctctgatctctgtgttttactctaaatctctgttttacactgtcctgggcagggacctgctatctcatcaacattcctggagacgggggtaggtttgtgtttccttggacacagatgaccagactggtcagacagattgggaaatgctgcctgggttggtggctgatctaacataatgtttctcaaacacggggcttcccgggtggcccagtggtaaagaatcagcctgcccatgcaggagacgcagattcgatccctggtcgggaagatgccctggagaagggaatgacaacccactccagtatccttgtctgggaaatcccatggacagaagagcctggaggactatagtccgtgggatggtgaaagagtcagacacgacttagtgactaaacaacttttatgatataaatataatttaaaattatgcatttaattgaatagttggagcatccggatgagcaacttgtcactagtatgatggtgtaattccaggtcccacatttaggattgtcatcactccagtgaagggcaagtgacatcttgaagctttgcatgaatggaggtgtagccccaagtcaacctgaggaaagcggtgggggaatggagtcaacccaccacacaggatggcgtgagcctgccgcactcacgaatgccaatgtctcaacactgtcattgtatttgcgctctgagttagtttcagcaaaatattactggtgccattactgtaatattgtttttagttttatcgacttttgaggtttggtttccatttaatttgtggccttttgctgcttttcagttatatttgcgttataagcagaaagcatttctgtctagactaatcttggtgtgtatttttaaatagcttcataaagaggttaatttataataaggtcaagttaaccctcagggtccaagttgccttcttctctttagaagcgtctatagcttctgctgttagaagcccgtgacatggaaagtcaagaggctccacttatatttgatcagatttagaggaaggaactcaggactttatgaggccaacccagtgacttattgaggatggactaagttgtgtttaggagttctacgcattgtctccaacactgatacataaacgcctacgatataaataatagcttccggttcctgttggtgaagaaagcagtgctctgagtgtctggcctattgtttcagactcagttgacgctcttctgtgtttcacccctttcttgtcctttctctttggaagctagaagttggctgcttcttttgttcaggatgcttgttttatgtaccaaagcttcggccagcaaaggctcagattttattaaaaaaaaatatttttttattgaagtagagctgatttacaatgttgtgccaatctctgctgtacagcaaagtgacttagttatacagagatgtgtattctctgaaatattttttccattatgatttatcacaagatatccaatatagttccctatgctacacattaggaccttgttgcttaccacagctttcatctttctctttttattggagtgtagttgctttaccatgttgtgttagtttctgctgtacaacagagtgattcagctatatgtatgcatatatcccctcttccttggatttccttcccatttaggttcagtcagttcagttcagtcgctcagtcgtgtctgactctttgtgaccccatgaaccacagcatgccaggcctccctgtccatcagcaactgccagagcttcctcaaactcatggccactgagtgggtgataccagccactcatctcatcctctgtcatccccttctcctcctgcccccaatccctcccagcatcagaatcttttccagtgagtcaactcttcacatcaggtggccaatgtactggagtttcagctttagcatcattccctccaaagaacacccaggactgatctcctttagaatggactggttggatctccttgcagtccaagggactctcaagagtcttctccaacaccacagtttaaaagcatcaattcttcggtgctcagctttctttacagtccaactctcacatccatacatgaccactggaaaaatcatagccttgactagacggacctttgttggcaaactgatgtctctgctttttaatat

SEQ ID NO: 31501 - DNA, 3123 bp, Bovine  19866880663915
agaaaacttacatgaaggtctagagaaacgtagttttaaactagggtttaccaagtcacttttagacctttatattaataatactgtcaaacgtgccttcagttcagttcagtcactcagttgtgtccaactctttgcgaccccatgaaccgcagcatgccaggcctccctgtccatcacgaactcccggagttcacccaaacccatgtccatcgagtcggtgatgccatccagccatctcatcctctgtcatccccttctcctcctgcctccaatctttcccaggaacagggtcttttcaagtgtgcctactacaactcaataccatcactatttttgtagagtctaatgaatcaggaattgattttgttttatactagaatcattcaaaagttaataataaagggcgattccaaggtgtcagctagacaaagtagccatggttttgtgaaaaactggcagaattgtaggatctaggttgcaagctctgcttctggtgccggaacactcagaccctgccctctcctgggccttcccttacatttctttatcatttttggctgctttgcagttcctgcttggcactaccattcagttgtttaacacagatccactcagaaaagaatttaaggaatgagtaaaattcctggaagtaacctgtctatcctccaacctgttgaaagattgcacaactacaagcctgcctaactcattactagtttccactgacaccattcagattttatgagaaccccattgttcaccccaagcctgccttgagtttatagggtacaagctgccttatttacttttctcaaggcattgctattttctgtggcactttttttgcaataagaagatgaagggttaccctctgccctgcctgtctctccctccctctccttccttccttccctcccttccgtctctccctcctgagaagccactacccagcctgcctttggatagttggagagagagccagtagaagcatggctgctctctcttgaccagtgagtgtcatttctcgctcttaggggtacagaacttcttggagcacaaaatgtgttctccattcctgtttgcacaacctcccactcttcttcttttaaggaggaagggacttctccaggaaggggctatgcttcttgcatggggtacaaactctgactctgttgacaaagatccaaaaccaccattagaacaaggtggtgttagtggtagggtcttcaattgggtgctggtgaggaagcacaggggagacgtggtcccggccccactggaccagccgaagggccccattgcagagactggccactcagcagacgcacctgaggggtttctacaggtcttaacatcaggatttaggagtctgatgacagttctgagacccagtggagaaaggaagggggtgaggaagagaagagaaaggctttaggaagaaataggctggagggttagctctccttggggctgcagccgccacacacagactttctcagctcacatgccagttgatcctcagtctaacagtgagaccaggaactgatggcatcactgaagtttctagcacattcatgaaacacttaggcccacagtactctttgcatgtctgtgtgaagagtccagtgtatttggactggggtctataggttgggaactcctaatgaggttttgttagggcctctgatcctgaagtctggtgccaccactggctgcatctgctgtgtgtgtgtgctaagttgcttcagtcgagtctgactctttgcaacccagtgggttcctctgtccttgggattctccaggcaagaatactggagtgggttgccattgtagtcactctctaattgctcctcccacacccatgtctgaggactaagaagctgctgtagagcttctgtgaattcctggctcgaggaattctcttgaagcctcatggtctaaactctgactccatctctcccgggttccactcagcttctactccagcaggtgtcacagtgtgacagccccttcctgtgctgtcccttttggaaataataattgggttctgaacatgtactgctggtctgcaatccctatagaaaactgacttgcacacttttctttggactccattctctgttctcatgacaccaaggaccattgcccaagacaccaatgaccaggcaaggaaagtagacacattgtatgttccctaaacacaatggaatctgctaattggctgagtggcagaaaaatgtccaagggggagagaagcttatacaaaatagaaattcatctacattcaaggggtatgcattccatagtggacaaaaccttgagaacgtacagcttagacatccttcatgggcctaacatgtagtgatactgattgaaattcagaaagttctgagggagagggatagggtgggatgatttgggagaatggcattgaaacatgtataatatcatatatgaaacgagtcgccagtccaggttcgatgcacggtactggatgcttgagcctggtgcactgggaaaagccagagggatggtacagggagggagtagggaggagggttcaggatggggaacacatgtatacctgtggcagattcatgttgatatatggcaaaaccaatacaatattgtaaagttaaaaaataaaataaaattttaaaaaattaaaaaaaaaagaaattcagaaaggcacattgatcaatctgattagccagtaccaacaaatttgatgaaaaagactactaatatccagtcagaaacaaatgtatgctttattgtagattttattaaattatctggtcagtttggtcaacacatttaaactgactaagtatatgggcgtattctggaaagatcaatttggttcttcagttatcatctcagccaaagagtatcctaagttgtttagcttgtgtcattcatcactgaccagttagccatttaattgctcttgtcttatgaagaaggagaatgatgggaagagtacaaagggagaagtttctggaaatggtgtaaaactttgacgtaacttcccaaaccatctcttgttctcagtgacctggtctacagagtcaagtgcatgcatatgtttaggaggccagcagtgccaaatcccctcag

SEQ ID NO: 31502 - DNA, 610 bp, Bovine  19866880793630
attatctttctgaattcactaactcctacataattaaagttcatttaacctcactgggatattcaaagatagctgatagcgaacttctgagattcacaggcaaaccatatttagcccagggttagttagcttgattaaagtatgatactgatcaacccattgctctgatgtttataacacatcctgataagcctcacttttccatggactaaacctggcaagttatcttcacatggtcacattgtggacttagttttaaagagagagagattgaaagaagggaagtatatcagggtaagactgccacctggactatacatcccacatcccaacacaatctccctgcttctactcttcttctagaatccattttttcccacccagtagccagtatgatcttttataaaacacacacagactatgctgctcactccactccagcttcacttagactccttcagcagaattctactcacagtgcaacaggaacctaactcctatagggcccacagtatctggcccctgcatctcacaccaatgtccttgggctcctcacacccagccaccaagctgcccttctgtctgctgagaacatcaagttccttcccca

SEQ ID NO: 31503 - DNA, 759 bp, Bovine  19866881024874
cttatgaagcaaaaaattaagtttggcaacatttttcagtaagccatttaaaagtgcctaaaagagaaagaaaaatgagaaaaaataacatctctgtgaactgtctgcattcttacccattcctaatttacagactatggagaatagagatgtgatagtaatcatactgacacagtctcgagggaagtgacagcctcctcaaattagcgtgaccaaaatgatgcgacaagcctgttgaattggcccatatatagccaaatctgaattcccttcttcctgccaaaacccacagagaagaggtaaccataaatcatgcaggagatgccatggttgttactaaatgtcctgtgaatttcaaggaaatgtggctctttatgctatgggttctgggggaagccactcaagtcagaaagatcattccactttatgttgaaagaggctaagggcttggtctgttccatatgctctttggttttgaaggacattgaaatctaagaaaggtccttcatagtattccagagtcattactatagcatagaggaaaaaataatgctgatgtaaccaacatactcaactcagatggccctagcaggggatgtgggtggagcatagtaatctccaactcctctttcctacctcctccattcagcatactcttggaccaaacctaggatgagcagtctgccagaaattatcctcctgcttaaacaggggatacaggcatccctagaggtatacctaggacatgcctacttataa

SEQ ID NO: 31504 - DNA, 1004 bp, Bovine  19866881197160
tatacctttccgttgctgaaattctctgattttccaaacatggtggctctgatgaatgccagagacatgttatcaattctctaaaactttttaatgcatactgctatgccatgtatgcaatttctaagattttagcttatctcatatgttgcattttattatctcattattttcttatatgagttgcacatagagggtggtaacttacttaaaactttcataattcacagtatagagtgtatattccttagaaagctcctatagataattaatctcaccttgttttctttccttccttcttattgtcagttctttagatttcaagagtgatgccagatgtcctggtctcttggattggcagagtgggataggctgagttggagttgttttactttgggaacttgtgctctgtacaattaacaaatcagcaaaattatgagcattgttacatgtttcattaacaatgatagcttcctaggtaaaacaatgagtatgctcagttgcaaaagcaggagattcttttggaattacagtcagcatttgtgtcttgaaggactgtttatggaccctgaaaacaaaataaaacatacttcccaaattttgcctgcagcagttgacgcaaaacatgaactcaaataatttacctcctggccaaccttctgtataaccagtagatggtcactccagtgaacattctggttacttattgaaatcaagaatctttcctgttccatcagggaattcagtaccagatccaaggtcagtgctggaccacatcttgggggtgggggttaagtaatgcaaagcatccacagaatggctagaggccaaggagcagggcttgtgactccagaatacgtcagctcaaggtgagatgaagtttttaaagggtcactaaaaagtgctcattgttagatgtgttcaaagtggggaagtacaaaggaaaggtttcaaggatgacttggtaaaatcccatttaaaggacttgctagcaaagaaaccat

SEQ ID NO: 31505 - DNA, 593 bp, Bovine  19866881204223
ccctcacaatgcccagaggaggtcaagaaccgggagagtgctgatttgctcatgaatgcagctgacttgagtttcagagatcctgtgatcttttttttcctctatgtctagctacaggccacctccctttgaagcccccaatgtccctaatgtataggagtcagacatgtggcccacactgccactggctactataaaagtagcaaggattaaatttttctttcacaacctttgcatggattttgggggaaaaaaaaggcaaaagataaccaggcactccaatgtagcctgctcgccctcaagataaatgtgtccagggaggtaacctcacagttgaatcgacccctgaatttcaatgaagcaggagcagtttggggctggggtcttggctggagagttaggtggagcctgaagtgtgtgcacatgtgtgtgtgctcagtcgtgtctgactctacaaccccatggacggtagcccaccaggctcatctgtccatagggtttcccagacaagaatactgagtggggtgtcatttcctcctccagggactctttccaacccaaggatcgaactctcacctcttgcagctcctgca

SEQ ID NO: 31506 - DNA, 1367 bp, Bovine  19866881215108
tatagtctagtaataagcctatcaaagatattcatcatttctcttatggtgtttttgatctgtagcatttctttttggttctttcttagaattttcatctctctgctaacattacccatgtgtttttgcataactgtctactttattcattaagcccttagcatatcatcagagttgttttaaattcctggtctgataattccaacatctccgccacatctgagtctggtactgatgttatgtttgtgctctctcttgaaactgttttctgcctcttagtgtttcttgtaattttttcttgatagccagacatgatttactaggtaaaatgaactgcaatcaaccatcctttagtaatgtgattgttaggtgtggggtgcagaggagcattctatagccctgtgatcaggtttctgtcttttagtgaacctgtgcctctagactgttaacttcacatgtgctttttagtctgaaacccccacccttcacttttacatggtatagaatggctagagcttgctagggttgggtacttctctttcccctgctcagctgatttctgataaaatctgagcaggttagactggttagtttctcctgagggcagaatttaagaagaacaggatgctgtggcatattcaaaatggttccttttccctgctggaagcacaaggggattttcctcctgttttcactgtgaggattaggactgctcctggaggtaacactcacaaaattgtggagttttttgtagatccataactggattcccctttggagttttaactctcagagttatccacacccgagcttccagcaattggtcaattacagttcaggtctccctatcctggcaatggttcccacggaagttgctgctcctggatttctgctctggtaacttggaattctttgtatttgcctgcctttctttccaatttgggggacagccatttggcttgtgacctcacttcttttgtggacctaagagatttttcagttcagttctttccttgttgtgaggatggagtggggacttccaaagcttttcacgtaccagatcagaagaaagaagtccttcatttcctttttattgcatagtaatattctgttgtatggatatacctcattttatttactcattcatcagtggatggacatttaaattgtttccagtttttcttttcaattgttaaaaaatagaagtgtagttgacttaaatgttgtgttagtttctaatgtagaacaaagtgattcaaaatacatatattcaggatatgtgtattctgtatgtatatgttctttttcaaattctttttcaccatagtttattacaagatattgaatatagttccctgtgttattgt

SEQ ID NO: 31507 - DNA, 931 bp, Bovine  19866881242113
attggctgtgggctgtcacttgagggccagaaaccctatctgcctagtgaaatagatcttgttttagtagacattaatcctctccaggggcatctgtgggtcactggtgctcaacactcagagctggtacttttaccatacgtatcatgactggtaaaaaatagtatgggtgtgataccaatagtgtctccaggaaatagatagtgtgaaataatgctgattgtagttatcgagcacctactatgtgccatatgctgtgctaaatgctatatatacatataaaacatatatgtatatatatgctcatataatctttggaatatagctattaggtaggctttataccatcacctattagtcccatttccactggactgatgaagaaactcagaaagcaccatacttcatgcttagaatatttcctgtcggtgtctacatttttatggatagaatcaggatattatacatccaactggcctgaattctatgcattcattcaactcatgaatcctaccagtgctttggagaaacttttgcgtgccatgcatagctaggctgggctagggacatatcagtgaactgaatggcttggaccctgctctcaaagagtaggactcaccttaggcccagttccaatacccctgtgatgcaactaaaaaatattttagaacacctgttgtgtacattctgttctgtgcatgcaccctagggtcgcttcagtcgtgaccttactctttgtgaccctttggtccatagcctgccaaactcctctgtccatgggattctccaggcaaaaatactggagtgggttactcttgtcctcctccaggggatcttcccaacccaggaatcaaacctgcatctcttgtgtcttctgcattggcaggcaggttctttaccacctgggaagtccccacatttccatttgcat

SEQ ID NO: 31508 - DNA, 1194 bp, Bovine  19866881307619
tcctcatagtggaaagctagtaaaagtgtaaacagctcaccctgactccaaggttaattgcacccccaagcccagctgtagtggctgctttccaaaggagctgcccacattgggggcaaggaagcgccgttgcactgagggaggtcacgagggcacttgctgaatgctgacactggacattcttgctcagtgctgattgcttctttggttcctgtcttgtgctttggctctgagctttgctaactgtgacttttggctctggttccttttgggtttctgcccgctggcctccatgttttctcagtagccgaccttgcagctctgaccatcagctgtgtccttgctctggcttgttgcattcattccctttaggcctcctgctctcttttctccacagtcctgggctgaggtcctaaggccatgccacaatccaaggtttggtcactgacagtgtgtcctgggaaggagaagggaggccagaaacattcgttttctattattcttcatgaaaaacagactacaaagagtctgcccttctggactacataggtatgttataaagattaacatccgtgaagcctgtgtggattaatgtaaaaagcagccatgtagaagattgccaagctattgccttggcaacatcccccacgttaggaagagacctaaaacataagctgtcattataaagtaaggaggcttgttttttcccctaccaaacgcatcaaactgtatacttgtagataactcttgtccctttcaaattaatcattgtggggaaatggtcacttattacagcaactaatgcccactcaaaaaaattttttgactcaacttttggtgtttcctttaaggacagaggctttttatctttccctcaaatctccttagtggtaaagtgtctttattttatcaaggttgtcctgaatttaaaacaaccaaatctggaaggaaagtcagccatgagtcagggaagcattggagagagacagatacacagagcgaaattgattgattccacctgaaactaagaagaaaaaaagacttgactctgtagtagtaaggtggatgtgcatgtctgcaggcatgcatgtggatggtggaatgattgtgtataggaaagtcagagagaagaaccttggtatttcaatttgttggtaggactttgcatcccactaacaaagaatgcaaatcgaa

SEQ ID NO: 31509 - DNA, 1375 bp, Bovine  19866881472885
tagtatcctgctattcaacctgatctgtaccttattttattattattttttcacttcatgtatcatggagattgattcacttcatttgatctaagtgtatatcattcttttaacatggttgcatgatatttcaggtgtgaagaaaccataattgatttaaccaatctcctattgatcgacatttagattgtttccagtttattgctacaaaaatcaatgaatagctttgcctatatatttttgcaaaaatacatgcatatatttattggaggacttcccagaagtgtgattactgggccaaaagttatgtgttgagaagtgtatggagattatcaaattatcctcagagatattgtatcaatttgtatacttccttcatagtgtatgtgaatgggttcagggtattttttccttagttacatggcactggacaagcactcttgggtgagtggcatgacttctttttgtttctttacaggctttcctagtgagagtgagtactgtaatgaggccacaggcatgaatttgtccactctgcagtcagttagctttgttgtctctttcatcaaggtttcctgctcagtgagtcacaatagggaccagaggagaaaatggacagatgggaaatattcctgaccatttctggatttccttagagtctactttcctaaaatagagaattataaaaaaattgaaatgtttaaaaaataatattattttgtttgttaagcttcactgtcacaagacatgtttatatctagtacagagctctaacaatttggagataaaggacttatatttatgcacaatccttattgtacagaaattgctttcagtagactgtgagctccttcaacacacagaccatggatgttcattatggtatccccagagggtgtctgatgacagattaagtgaatactgaatgagagaatagtgaatacagaaagaatttgggagatgtggatattaattacaataaatatctatttagtgtattatacagtttgtatttcattcgttcagagtacatgtcaacttgtgttagatatgcagagcaagttcatactccaagctgtaacccagccatctatagacaacagtaagcctctgttttcgttgcttatgttactttcctttgatttaaattcaaagttatatcaccatttagaataatatacatgttttacttgtccgggtcactcactcctcattatagttgtgatttttatctgtcacgttgaattttttttcccccaaaatccagtcctttcaataatgtcatcacacagttgtttcaaaggagctttgcggatgatgaagaatgctctcggcctttctgaatgtcagcacattcaaccaagattcccagctt

SEQ ID NO: 31510 - DNA, 959 bp, Bovine  19866881503358
aaacagcaacccatatacccttaacagtacccttgttgtatccacccactcagaagcaatggtcaggaaacactgaattctgttagcacttttatacttaaagagttgagaaatccacatcatcgattttttgctttttcataactgagaagaaaaaagtcatggtataatttcaggcagtggaaaagcttctattcaattcagctttattgtagattagaggaaggaagcatttttgatgtcaccaaagagatcttctccttccaggaggcttttaaaaatatgtctcccagagggttctctggtttgcagtcatcttatagaggtaaagactctctgcttgcccacaatctggaataatctaagtcaagcccagttagcatactgtaggagcaaaaccatgctaaaccctgtctaaattactatatatatacattactccacatttccagcttgtaatcttcacaatgtttgtgtccttgggatggctgtatctgaaagtgctaacagtcagcagggacaaagacatcagggactcttgttctgtctcctcccttccatcctgtcctttgattagttggtgctgtgaaaacaaatttacatgctgaagggcacattttcaaaggaatgaagaatgccaagacaatagctatctgcaaatgtggtgcaactggcagatgtgaaaggtggagaaaggagatatttagcatgtttacatttattaatagcttagagctaagcaattacatattttgttttgatatcttctgacctcattcagttttcctttattcagtccaaacatgtgcaataaataccttctcagccagttgcagataccagtgtatttttttttttcccaatcagggtccttggttctctagtagcagtcaggagaaacaaggacatcaggtgtcttgttcttctctccttttattttccatgcctgctctttgttg

SEQ ID NO: 31511 - DNA, 726 bp, Bovine  19866881802545
ttgtaaatcaactgcacttcaataaaaaaaatgttaaaataggtttatattgttattggatttatgtttggaaaagattattctagctgtggcatgagaatcagttgtagaaggtgaagtgagaggaagctaaaccacccagcagtttttaccaggggagatgatggtggtggagacagtggagatggagaggtgtcagattcaagagacatgttaaaatcagcaggtcttggagaaggattttacatggtgactgaagacaagggagacatcaagggtgtcttctcaggttcttgcttgtgcaaatgggtctgactgacagtgatgccattctcggagacaagaaacacggaagaaggccaggttttggaaggaagataataaattcagttttggacacattcagattgaggattttttttttttctgtaaaagcttgttctatagaatgtcttttcaagattcttaattgattattctctgtggtgtttgttttacttatttttcttacctcctccagtctaacacttgaagaaatgcaatcacaagttcagaccatggctgtttatcatgtctctgcatccaaatattgatgcttgcctaatttgaaccttcctggggagtaatgaaaacaagagagaagatggaaaatttgtggagattccccaggagtgcttgcaggatgtcagacactgaccccagttagactccaaatgtgtcagggaa

SEQ ID NO: 31512 - DNA, 753 bp, Bovine  19866882005980
cctggaatacgttctcactgtcccatttgttaaaattgttaatctgtgttctcttgctgttcatgaaagtgacaatgaaaaatagctgtccattaacatgaaagcaaaatgtgatgcagtaatgattcttgaagcttcctgcagtgctggaatttttagaaatcattaataataaattttcagcaatgccatgagcaactgatagctcttctctttagtagctagaactctccatttataaatgataatataccaggtcaatatgtcacagccttcagcagttttcctaaagttattttatgttaacaccagcattgccaacataaaattcattttacagataggaaaatcaaggttattctaccaaatggttgttcagaatgaatcagagtattacatctaaggtcaccaggttagctccagatttaattaagacctctggcatatttgttaatatgggaggcataagtagaattctttggttaatgagtaggggatggagtggagatggggttccattaatcacaagctctgggtcatcttttttatccatcaagtttaagtacaagcaacatgataaattattaaaaggtagacttggcctatatatctcaatatgtgactgggggccacatggggagtaagccagtgttctcttagaggaaaggaaacaaacagaaagcttgagaatgtgaaagcaaaacactcttgttcaaggtccttgtttatcagctcaagagcggcatactctgt

SEQ ID NO: 31513 - DNA, 860 bp, Bovine  19866880368452
gaatttttctattttggaaacaaggttggagaaattagctgcttcgagaagcccccgttccttcacctgtcctcatttataaagacgagttattaaaataaatagaaagcttgcctggctttttaaacggtgaggctcgccaccctccataaaagacgttagaacacacatcaccgacagggtagaaggtgtttcaacttcatcaaaagccttgaaaaggaggacatcctttgtatccatgctttcggaagttttgcaggactggtatttattttaaatcagaactgctcacaaagcgaactccctttacaaaatgcataggatgaagccatcctagagatgacctctaccgttcgagcctggacagagatattatttttatagaaaaaaaaaaaagaggatatctttaatcagctttaaaaaaacattgtgaacagtcacttctcttatttaaaagtttaactttactttcatcaatttataatcagagttcctctggtatgtttgattcctgacaaacaaggataaaagtcttgtgcccccattgctaatgagatgataaaacagcagggatcaagtttttaattactacaggcaatgcactggagaggtagcgatgatattttctattgcatgtctaagttgtaacttcaggcttatgacagtcctgctgtgctccactgcctttgatgatcagtcatttttgtctcctgagaacacacaaaaatttctgagctgggatcctggggggctggcaattattggcgtaacctggtgcaggttcccctcttcaaccaggatgctcagtaaggatccaggatcttaatgcctgcctttatcccgaaagggaaatggacatt

SEQ ID NO: 31514 - DNA, 1784 bp, Bovine  19866880513170
tttttcatcatcccaaaggctcaggttgaagctaagaaagaacatgaaggtgcggtgcagctgctagaggtaagtgagccagccctgctggctttcttcccccgggggtgggtgagctcagggcatgctgtgttaatgctttgtagaagtcgtaaccgaccttttactgagtgcccactgggtacccattactcctgccgtttacacatccttcccgtgttgtccatgcaagcagaccatcagatcagtatcgttatgagtcccatttttacatgtgaggaagtggggcccagagaggttaagcagttttcctgtggccacacagccagcatcagaactgtgagtctcagaggtgctctgctctcctctgattgaatgggaagcagggagggtgagcctgcttccttacaggagaaagggaagtggatcattcctacgggtgtcaggtgaatgggggtattttaaaggatagcgccaagcctgaggaaataaatacctggcatccggggaggcatttgcagatttagagaaaggacagcgaagggagtcgcagcagtgaacacggtcaaggcgcggccacaggtactgttcccgtgagcacagcaggagtcaccctccccagccacctgcaggccttaatcactggctctgatgctgggggcttggcaggaggcaggtgacgtgtcagaatcactcttctgcccccggttggtggcctcccatatcctcgggaatggaggaaactcctggggtcccctggggggcctttgcagtctgcatgcctcatgtataataaatggacataaggaatctcccttttgaagacagaggtcccccaattactgacccctcggtcaagacataacagcaggaggggtggctgcacagcgtggggtggccccacaagcgctcctcccctagttctgttctatccagaaaggccaggagggcctctcccctgggcctgcgtctctgcataagggaagcgcctgtcctctttaagatgaccttgtctcttgtcccccagggcagcttcgtgaccacttaaaacagaatatgtgcatctcttacattgccttttaaaatctattcctcccccaggaaacggtttcatcattatcatcatatatattaaaattgatttttttgaaagcctccattagctaatgaatatctggagggctgggagtgataaatagcaggtgggaaaatatataacctgagagagtggaaacagacgtcccaatggccatacatctccctgaaacagcatttcattcccctcgcaggatcgcccaccgcagtttgatttgcatagtctcctggctggaagtccagcttctttccttcccttcaccccaagcccatcgatctgatggtctgtgttgttttaatctgccttctgagctgctgctctgtgacagtcccgctgaggtcacgtcacccggcgctggtgcggggtgcaggccctgacacgtgggggacgggtgtaacgtgctttggttgggaaaacagagagggccacgcagatgggctgagaacctgggttttcttttattcaccacgtcttcccgtcattgtgttttgcttcgctcttcacccagaacacgctggacagcatgcaggtattttagcgagtgatgtcctcccctcccatgtgcttggtgaagttttttcccatgagtggaccggccgtgcgcccctgggccagctccatctccctcttcttctgaacatgggcagcttctgatgcagtcgtgggtgcccgggtctccctggggtgg

SEQ ID NO: 31515 - DNA, 970 bp, Bovine  19866880544038
ttcactctgtctcaggagaccctttcccacccgacctgcccttggcaaacctggaagttgaaacgtttctgagctggagccaccctgagttctagagctgcaccaggcttcatggagcattagcacatcttgggttctctgaggccatggatctaaatacacacagtccgtcgtttctcccaacagtcacagacagcctgggaaccatcctagtgagttgacttctgctcttccccatcaggattttcttattcagtgatcgtagcaagagggcacagtagagcaagtggaaacattctgtccctgcagaacagcccacagcatggtagagcccagccaccgtggctgcgtcctcccccacagtagctagtacaagctctcgtctaagctggcctaattattagcagtcagatctcagtaaatcaggactccacagagctgtcttaaactgctcccttggactctgcttccgagctgacaaccctaagcgtttcctcacactgtttaactcagaccacgtttggaggtcttccctgcatccacccagtcgcagacctacatccgtctggtttaaatctactgtcctggctggtctccttgattggactttgactcagtattggctcaaataattgtttttttctctccgctttggtttgtgattttcctagataactatggctgttcaaatggccgtatattgttaagactttttttttccccccaagctacattcatcagcagtgagaagctttaaagttttattagtatcataaaaacccttctcaaatgaaactacttttgataactgttcattctgacaatgagaatttgttgagggctgttggcaagtgggaggaatttgtttttgaaactgaaattggcaggaagtaatgaccccaagtgctttcttcctcttgatttcagcccccacgccctcaacgcactcctctctccccaggccctaccc

SEQ ID NO: 31516 - DNA, 1026 bp, Bovine  19866880682774
cagaaatgtccgttggttgagaatgtttgaatgaactaagcctggatggtagtgatttacagagctgttaaaatttatgtgcaggcctatgtttgctgccaagtcgcttcagtcgtgtccgactctatgcgaccccatggactgcagcctaccaggcttctccgtccatgggattctccaggcaagaacactggagtgggttgccatttccttctccaataggcctatgtttattggcatccaaaaaaaggtacacaattcacttgctggaaaaactacttctgtgtaagacaatccttctttagtatctctctcttcctctcctttactctccagaatctcattctatctctctctctccgtatacttagagctgtatcgtgtgtgtgtgtttaagtccacaggtgattctatagatctggacagatagatgctctggatactggaaatatgcactatttctattctctactgtacatatttttgaaccatttgagtttgtgtggacatacattcctttcaaagtgataagaaaaaacagcagtttatttctattaaaataaaatcagacaatatctgcagttgacattaccctagaggatcaaaacatttcaaccgcagtttagttttcattatcaaggtcagaaacagaccccagcaaatcatgatcttggtgaccctttgaaagcatgacatttaacatgtcaggactgagcttgcaaaggggttatggaacttctcaacactaatttttattacttcaatatcaatatagatgaatatttcatcaaaacagagcacagttatgcaaggcatgctctctcatgattagcactgagcttgccctgggctcttcccccacagtggggaattttattatatagtagcctgccgagctctcctgggggtcagggggttaaagctacagaaatatgatttgtgaatcatctgagctcagttttgtcgcaaagataaacaaaaagattatcaaagccttttttacagtattatttaaatgcccttcca

SEQ ID NO: 31517 - DNA, 1511 bp, Bovine  19866880712097
ctccaatgcattaaagtgaaaagtgaaagtgaagtcactcagtggtgtccaaccctcagcgactccatggactgcagccttcgaggctcctctgtccaggggattttccaggcaagagtactggagtggggtgctattgctttctccaagtggtcccacctaaccttccaattcctagtcctcctgcatctcagtttaaatattagttttgtcgcagacagacctcttcagtatgtaaattagttcctgctttcctctttgtaagaacattctttgttccttgttaaacttaaatatttgtggttatgatttttttctgccgtttccacaagggctcacatgtgttgaatgctcatggtatgccaggcactttgtgctctctgtgtgttcgcattgagttgttctcagttgacctgtgcggtataggttgttattgactattttacaaatacagacgcgagtcgtaggttatgtgatttgcttcacaggttatgtgaagaagagccagtctggctctgataataacttgatgatactgctttctactctatagttgggggtgagttggtagagaaccttttatacatggtaatatatttgatgcctgatagatcctagcttacattaggtactcatttacagggtgctgttgaaaaaatgtggggaattgttgatcatgtgtggtaggagcagtaaaggagtagtttggagatgaatgactgtttccttagagacagagtggatgccactcatcaagaatgaaattatggggcgtaaatgatgtggttaaaaaaaagattaagctacatgcaactgtggaatgatccaggaagatacagtagtgtatgtataagaattacttaaagggcctggcataaagcttaccataagagccctctttcatagattacatatctaggtgtgaaagaactattcaccaatatcttaagactttttataattaattcaattgaaagatgacatactacatgaaaataagtcttctacttcagtgctgtcacctagcacaggagcacttaggttttgctgaaggtggggatactgccttaagaggcaatattggatagtgccttcagaggctaggaaactctgtgattacccaggagcttattttagaatcttaaccaaatcagtttaaagatagcattgtagaaacactcaaatacaattgcaaacattgagtattgtcttcatgattatttcctcttaagaaaaaggaaaatgactgggagagccagagcgagagcaagaggaagggctcgtggtcaggagatggtgcagcatgtgggcgcctctgcggtgagtatgtcactcttttctaactgcagggagagtccttgagaaacaaactggcaaacgaagatcatggcatctggtcccatcacttcatgggaaatagatggggaaacagtggaaacagtggcagactttatttttttgggctccaaaatcactgcagatggtgactgcagccatgaaattaaaagacg

SEQ ID NO: 31518 - DNA, 570 bp, Bovine  19866880786294
cgagcaggtagcagttccttttaatgctaaagcagggtgccctggggttctgcagtttaggggcagaagcctacaccagaaaactgcatcagtggagttagcaactgagccatccccaaagctgggctctcaccacctcctgctccaaatttcaagcagctacagtgaggcgtgccaaccacaaagtgcccgggctgcacacagagccgagaacaatccgctgttggctgagatctgagtgtttgcagggtttcttggcacctgtgctttcccacgtttgccctgtgagagaatctggctgacggccaagctgccaaccgacaggaagcttgatttgctcagccaccattctcacgtggaggcaggaggcagcccccccccccccaccacacacatgcacacatgtgtgcaaacacactcaggcctacacgttcatatgcacacacacatactgtcatccacacatgcacacacaacagtcttgtacacacacatgcaacgcacatacatgcacagacacacacttgtgcgcagacgcatggggccccagaagcccgggccaccctctaa

SEQ ID NO: 31519 - DNA, 1420 bp, Bovine  19866880789365
gaatgactgtaaatgcacatgaagtcttcgctcacctccctctgtacagcccagttgctgaggacccctgcctgaaacaaagacaggaagctctggagacctttcttggccagaggctacagtaataaagtgctgcctctttaacccatgtccttgatgttgtatgtggctgaaaggatcactgcaagcttctggtaggggcttcactagtggctcagtggtaaagaatccacctgcaatgcaagagacataagagatgcgggttcgatctctgggttgggaagatcccctggaggagggcctggcaacccactccagtactcttgcctggagaatcccatggacagggcagcctggtggggctacagtccatagggtcgcacagagttggacatgtctgaagtgacttcatgcatgcaaacttctgtagggattatgtcatactcatttgcatactgaacacatagtagccgctattggttaaatatttaactgaattaattaatgtttctccaaagaggggctttctgaacaacaggatccagttctctgatcttcccctttgggactcagggctgtggagtatgtttttgaggaagcagatcaataactgtatccctggttccacaggcataaagaacccaggatgaatcatgagtgactttgaagataagcactgtgtgtgtgctgggagataattgtatttcagagctcataaacctctccccaaacaccgaggcctctagactgggctaaacgatgcctgggagctcagcaccactgtcataacaaaactcaattaaggcatcaagctgaaagccaggctggacagtaaattaatttttaatccatggatatcacgcacttttcagcatgatggatgtgcaacaacccagcggctgccaatccaacaggaaataaaatagataatcacattcgccacagtgggtctgtctctccccaaccttagcatgagtggtggccctgggactccaggcagctgggagggtttgtctgagccactcaaggtcaagaatcctggtgacttgagctcactctgttcaggtagtgatcttaatgaatgctagtggttctcctagttagttaaaccacatagtgaattggctctgacagtaagagggttttgtttgtattgtttgtcgctaaattgtatctcttttgcaaccccgtgaactgtagccctccaggctcctttgtccatgggatttccaaggcaagaatactggagtgggttgccttttcttactccaggggatcttcccgacccagggattgaacgccagtctcttgcattgtaggcagatttgttaccatctgagccaccagagaagccccattaagagtgttgctgctgctgctgctgctgctaagttgcttcagtcgtgtccgactctgtgtg

SEQ ID NO: 31520 - DNA, 1480 bp, Bovine  19866880867705
atatggacctagaaaaccgaggaaatggttatctaccaacctggcttagcaaagaggctaacaacccactatccgggtggtctctgcccggggatttgagaggtgcctcctgggagtcggcctggggactcatcttcctaaacaagggtcaccttctggctcactcacttcagacttctagctgtgtgtgtgtgtacatacacagacatacatacaggtatatgtatacatacatacacacacagagacacttatatacacatacgtatacatacatacgtgtttccctggtggctcagatagtgaagaatctgcctgcaatgtgggagactcagattcaatccctgggttgggaagttcccctggagaagggagtagcaacccattccagtaatcttgcctggagaattccgtggacagaggctacagtccatggggtagcaaagagtcagacacgactgagtgactaatacaggtatacatacatacctacatgtagaagtgcaggcacatagatatatttgcctgcctgtcactcaaaattgcctgggtcctggggagggggagtatttggatgacagtgggaccacatcccaggtgaaatgtgcgatgagatggaaagttgtaggaaacacccgtgaaaggatgcaggcagcagaggtgcagctgaactaggccatgccctcctcctgcctctctctcccttgggtgaatccgtctcccagggtgcccagttcatctgctccaagccggaggtcagggcccaaggtcaggtggtctctgccctgatgcctcccctctcctctcccaagttagagaaaaggagcatcttcctggagaggagcagtggacagtatgcaaactcagacgaggaggacggctatgagtccccggacgtcaagaggaggggcgcatccgtggatgagttcctgaaaggctcggagctgggcaaaccggtgagtgctgcccacccccctcccaccatggtggctcccggtgggaggggttcaggtccctgcacgccctgggtctgtgagaaagataaaggaatacagacctttatcttgtgggtgacaacaatcacagtcagtctggagagtttagactgaatggtgcctgtgcatttgtgacctcactgggggacaatttcaaaagtctgtatgtgagccttttgccctcccaactgccctgaggatccatccgtgggctgattttgtgcctcagctgagtctccaggtgactacctggtctcaatgtagttaaaacctaacatttgtttctttacttttgttcatcaggcagatgtgtgatgtgcattggctaagtgctaagcatcatgggagattcagaaactgaaaggtccatatcccatccttggagggatgaaatgtcagggcttctcctcccagacaaggctcacaagtgacaaatccatccaagatggggttctgtctccaatttctgatcatgcctattctaa

SEQ ID NO: 31521 - DNA, 1598 bp, Bovine  19866880873004
aataagtcttcagaggctaattgatttcattcttgggaaaattattctgacaatcagcctcaagtttcctttcatcctctggtctctaatcctgccttcgcggaccagcatgaacaatgggcatccctccttgatgtttgtcttgggggatgtttatcacatcgctctttgccatcagccgccaagcagctttaatgcttacagtgtaggagacatatctgccccaaaggctgttaagcttcattggtggtgagaatcgggaggaggctgggaagctaccaaaagtcattaaaagtaatttcattccaggtaacaattacgccccagctgcatggctttcttcccacccacccagacagctctaggcactctccctgctgttctaggagtagggtccaggaagtcccaggggaagaaactggcgggacagagaatgacggcagaagcctagagcagggatgaaattctgaatgtgaggtttgtaatcctcttgcccatgctcgaataaagcaagcagaggtgagaagacagggatgcagggttgatggacacctccatggaccacagtggatcctgttactcctggattcagtcaggatccctgagtgtgtgccccacaaaaccacactaggggttacaatgcctgatttgcctaaagagggtgctgttacccagcccctgccaaaagttattctaaaatgatgaaggtgcaaagtagcagaatattggatttttttcaagaaaaggaggaagtcaaaacatttactttacatttcctggttttttaagtatggcagtttaaataattcaaacactgtgtaaatcaaccacatatctgaggacaaatttggtccacatgccaccagcagataacctccacccaacatccatcatcttgatttaggacatttgtgtcctggaatgtctttctgctgcagctgaagtttttttgtttgtttgtttattttttgatatcgcattttgttttactatttcaagttctgattgacttctatatgtttcctactggttttactttaaagcaaaaatattttacatatggctaacatttatgcttttaaaaaacattaaagacttccctggtggtccagtggttaagaatctgcctgtcaatccaggggacacaggttccatccccggtccgggaagatcccacatgttgtggggcaactaagcttgcaggccacaactcctgaagctcttgtacgcctagtgtctatgctctgcaacaagagaaaacacctcaatgagaagcctgtgtaccacgagagaaagcacacaggcagcaacaaagccccggtgcagccaaaaattaataaataattttttaaaagatgttaatacctttgaagaagacgttaatatctttcagcacattcggtcttcacaaaactggaggtagagtaggttatcccaccgccaaataaaatgtaagcaactttaatgacttagataatgctcaataattgcaagatccatgtctaaacccaaggagttcgtctattcctgaaaatagaattgatggacttacaaactactttccaagttatcctaagacttatagtcctgggcccttt

SEQ ID NO: 31522 - DNA, 1392 bp, Bovine  19866880882782
ccatatgttaagcatatttcttctattagacataatatttttagctgtgagaatagaaaatacgcccccattccctgctttctgagaactttgaagaacttctaagtgtatctagaaactccaatatgctcatagatgccatgcacacaatctgggacttttgagccacaaacagcaagatgttgtcctctgatgaaaacttagttattttttctgatggacacaggtgaggggggtcccttttggtctttttaaaattttctatttttttatttatatattttggccaaaactcacaacatgtgggatcttagtttcctaaccacggattgaaccctagctctctgcattggcagcatggactcttaaccactggaaagccagagaagtctccattttgctctttcatttgggatcttgggatttgggatgtcaccaaatatcttagaccacttgaattcttattgccacttttagcaaagaaaaaaatatatatataaggtgatgagggtattaagcacataaagatggatagaaggaatggtttggagctaggtgtagcctagtctaatgtaaccttcttagtgagatcatgaagtccctgtgattattcccattttgcaaatgtggaaactgagcttggaaatgatgagaatggacgataaatcagccctgtttatttccaaggtctctgttcttcctccaccctctgctctcctgttgtggagtttggcttggtggtgtgccctcggttgctaccaaacttactgccatcccagcattggaaaggaaaggtctcccgtgttggaggcagacgctttaacttctgagccaccagggaagccctgcaaaggaatacggaagaaacaaaaagcaaaaccaggcaactcatgcaggagaagtaatcactgtaggctcctcttccaatttcaggagctctgttgagactactggggttttacttaatattgtctcccttaacggattacaagttgatacatgaaaccacagggaagtctttgaatcatctgaacaacatccccctcgccacccccgaccttaatatattcttaagttaaaggaatgctcttaagaggtttttgtccccagggttccatccttggctcacaaggcctcattccaaagctccacccagctccttccctggagctaaggattcatttatgggaggtgtctgccacagctctccaccttggatgtcctgcaggcactacagctcaacaagtctgaatctgaacccctcttcctcttgtattttcagcttgagggttgatatctctgtctccccaagcccctgggctagacaccctggaatcttgcccactccatcttcttaaccctctcccatgcaaagctccaaaccctccattc

SEQ ID NO: 31523 - DNA, 2430 bp, Bovine  19866880900057
tttcacatctgcaaaatgattcaggaaatgtgcccccagaaactattacttagttaattctgagaggagacaaagtggaggatatggtggaagtcttgtccccctacccccgcctcaaaggccccatggggttctatgctcgggttgcattttcttcctgcactttgagtcttctagtgtaaagtacacagaggtggtttgggtgggttggtgtgctgggcattgggatccacacgggtataaataatgtcctacaagcagctccaaagagctgttaacaagtcagagaaggtggatttcaggggacagagggctgtaagcaagatctcagacacctgagcatggagccacccccaccatctcccgtctttgtcacagagctcaagatttggattcggaaaagagaagatctgatgcatttagcctgggtcacaggcctagagaggccacatgcaaacagggcctgggggtggggtttggttctcccaaggagaacaggtacggctcccagaacaggtggaaaatgccagatggacacacaacagctggccactcaggtccttctcctgctggtcccacatggtctgaatcggaggttccaaatttttggatctgaatctcttcatgtcacttgcaatctcctttggggagaagatggttaaaatatgttcacattttgatgctgagggcaataatatacaactatagggtttttatgtatcatgagtttcattctcatttatacagaaagagcactgttcttatcagcaacagtgcaaagccgctgggatgggctgaactgtgcactcctccccaaggtcatctgttgtggtcctaaccctcagtacttgagaatgtgactgtatttggagatagagggtctttataaaggtaataaagggaaaatgaggccttcccagatggcgctagtggtaaagaacctgtctgccaatataggagacataagagacacggattcagtccctgggtggggaagatcccctggaggagggcacggcaacccactccactcttcttgtctggagactcacatggacagaggagcctggtgggctacagtccacagggtcgcaaagagtcggacgtaactgaagcatcttagcacacacacatgcaaggtaaaatgaggtcatatgagtggtccaatccgatatagctggtgtcctataagaggaagaaatgttttgttgttgttgttggagtatagctgctttacgatgttgtattcgtttctgctgtagagtaaggtgaatcagccacatgtatacatacatcccctcttccttggatttccttcccatttgggtcactacagggcactggtagagaagaggagaggagaatagagaagaggagaaaatttggacgcagacacacagatggaacaccatcaaaacacgtggagaagacggccagctgaggagaatggtctcaaatcaattctgttgacacctggatcttggacttagagcctctggcaatgtgagaaaattaatttcttgtgttactttgttatggcagccctgacaaactaatacagcctctgtaattcctgtctgagaatagacagtgcgtcctattatagaagtttggggaactttcacatgtattaaaggttatttttgttcgtttttcagaagttctctcttttttaactccagcaagcaggcagaccacttgctttttgaacctgtctgtaagattaattgtccagaaaatgttgtgaattaattgcttacatcattaaaaggtcagtaggaaacaggtgatgcttttttaaaaaggtggtttgctgtgcaggtttcattggctgctctggtgtttcactgagctcagagttgcagaagtgcaaacagaagttcagtgacactgacaagctaccatgtaagagccagaactaatgatacctattataaattaatttatatgtatgaggaatatatatataatcatatcaatcctattattatctagtatagcatattttaattatttataatataaatagtttgttccccaataattatgtagtatattatattaatatatacaataatatatattataatataattaatacatataattaatttttgacttcttattttttagagattaagaactttgcagaagcaatggtgaaattttctactttcacgctcttttgaggtacaggaagtcattttgatttggctttctggacccctaaaaatatcagtcaaccacaacccccaatttcccttctatcagttttagcatgagtggtccaggcaaccaagcacagcatcctccaaatgagttgattggctcaagcacaagcaggtgatctaagctggtccaatcagaacaaagttcagggctttgtaagatccactgaaaaagaagactgctgatcaccctaacttgaat

SEQ ID NO: 31524 - DNA, 1502 bp, Bovine  19866881132442
tcaagcctccaatgttgaacctgagcaaataaagaccagacagagaatcccttaatttagttattgctgccttttaaaaactctgctatgaggataaaataatttaggatgtagaaatctgagcataaaccacttctgatcatcaaaattggccggtcctagtcatcattttcagttagctctgaaagggactactagggagtatctgcaggtgttatatgtttcaagtaaactaaaatacaaattttgggggtttcttttcttttctttgtctttgattctggtgtttttgtactgggatcactatggaaatgacttctagaaaatccattatgagacctgtgtgattaaaacatatttatttagcaaacatttcaaaattctttccgaacttagccttcaagcagttaccgttttgtggacttccccaggggtacagtgtcccctgacagtgcaggggacctaggttcaatccctggtccaggaagattccatatgctgtggagcagctaaagcccacgtgccacagctactgaagcccacttgccctagagcctgcgctctgtgaccagagatgcccctgcagtgagaagcctgcatactgcaactagagaaagccccagcgcagcaaggaagacccagcacaaccaacaaataaatattaaaaaaaaaaaaaaagattacactttggctaaaatttctgtgctagcaaaactagagttagtcacatatgtacccaccctgaatggatgctttttaataactggcagattctcaaaccgtgtatcttgttggcatatctggcactgctatgtttcaaccacacgatgcctgtctggaagtggcatctaagccgactcatcacagccctgccccaggacagttgcatgggaagtgaggtgtgggggaagccgtctccctacatgatgcaagactgagaagccactggccacgcttcccgctccaaacaatctggaggaaagcaacacgaggagaacagatttaagagacaaaatctgtctgctgttccagtcccttattctgatcatttctaaccttctgtgaaatatcttagtttcacataaactcaaaaaaatacatttatttttttgactgtgtcaggtcttagctgtggcacatgggaccttcactgcgacacacaggctctcaagttgtggggcacaggcttagttgccccgcggcatgttggatcttagttcccagaccagggatcaaacccacatcccctgcattgcaaggcagattcttaaccactggtccaccagggaagttcccgaaccccaccttttaaagctggtctaggttgagttggctcctcattactagatcatctctcatctctcctctaacctgacccactggttgagctccggcttctcccctggtcgaggacagactgaatcaaccctcgccactcttcaatcattccctcccatggctcccatcccagtgaaaagctcaagtcccaacagtgcccttca

SEQ ID NO: 31525 - DNA, 1109 bp, Bovine  19866881176297
accactctctgctttggaattttgcggcccctccttcctcacgttgacccccgtggaaagcggaagtggaagtgagtcctacctttaggacctgttctaggttctccagcttggcttggagctggtgtttctccttcacggccaaatcacgttctctggtcactatggtgagcgtgtgtttaagccgagcatactctgctttcacctaaagtagcaagaatggagagaaggggtgtttacaatatgcacgggagctgcagtgggtatttgtccccagctgtcatctgtcacttcccctttaagttctttttggagacttcccctccctcatcctcagtcctggacttcgtagtgggtccactcctgctggggtgaatacgtgtgaccaagggctggccaatcagcacacagcttctgtttgcatcccacccatcctcaccacagccacagtgattggatcaggtctggagatgtgaccaaggcgtagccaatcagtataatcccatcccctggatgtgaggattgggagagaaggggcatagaacccaagtagcatccacagagaatgagatactagactgtgtaggaatctgggaagagattccttgggaagagattcacccactgtacttggaaagttaaagacaaaggttggagctacactgctatttgcattcatgagggaagaactcatctgagaatagactctggagatgtagaggaagaagcagggtcctaatgacattgtatgagcaactagatcaagctgtgcctgaagctaatgctttcctttctagttacttgggccaatagattcccttggtttacttgtgtccatttgaattgtcttctgtccctttgaactgaaagtgctgacagacacaaaatgttactcaaattgtgtagccatactaaattcttttgcctaaaatttcacctctgtcataaaagtggacaaaaatggcaacaaagcaccacatggatttggatgatggatgctccaataacctcagaaaccatgtccattttcagcccagaacccctaggactcccatgtttaaaacttatctgggaggctctactatcctcaatctctcctcagctttcca

SEQ ID NO: 31526 - DNA, 1722 bp, Bovine  19866881190808
aaacgacttttttaaagaactgacagttttaattgttcttaccaagtaacattgtgtataatgcaaaataattttactagtcttaagatattgtgccttatagttctaaaacattaaatgagaaagtaaggtttaaggttgagaagttggaatagcataaaaacaggggagggatacttataataacctttcttaagaacaaaaggtgttggaagaatatactcatctgaacaggagaaacagccaatgctttctatcctttttagttttaattttagtctctaatagtaattctgcaagtttctaatagttacttccccatccatatagcataagaaattacttaagctttaagaaattcttttctctttatgtttccattatattgcacattaccaagtcatttcaaagtttacttttttagagagtacttttacttttttatatttttagtatatattttagtatatatttttagatttttagtatatattttagtatttttatattatttagcctttgttttaaattgatatatccacacattttaatcaaataccaataggtataaccataaagcatatggagtagatgatattgactgggaccagaatccaaacagcatctttaggaaagcagatggctctgaagtcagcttcttagagggcgacaggtaggtgagactttaatgttgatttttacctttttaatgtgaactgcttagaccttagaagacatctgaaatatcttcagtagaattgtttaacaggagtacatatggaagaagttgctcttaaagctgtacatattaataaatgtgctcatcggggctccctggtgcctcactagtaaagaatttgcctgccaagcagaagacgctggttcgacccgtgggttggaaagatctcctggggaaggaaatggcaacctgctccagtattcgtgtctggaaaatcctgtggacggaggagcctgacgggctacagtccacaggctcacaagagtgagacacgacttagcgactagacgacaacaacaagtatgtaaaacattaggttttatggtaaaatgtatatacagtaaaatatataaattttaggtgtacaattcaatgaattttgatagatgcctgcatccatataattcatatttctattaagatgtaaaaaaagattttattattgtagaaattcccctctctcctcttcctgataaatacccagttccagtagattagtgttttcttttctagaaatctatacaggccaaatatatttcatacatatgaaatcatacagtgtacagtgttctgttcctggtttaattttcttagtatattttttgaaaacttcatgttgttatatgagctcaatagtttttcatttttgtagtctgtattcagttgtatgaatatatcagaattatttatctatccttttcttataagcatctgagttgcttatactttggaactattacgggtaaatctgttacaaacatttccaatatagtctgtgcgaaaatatattctaattttccttgagtaaattcctaggagtgaaatcattagatcacaggaggatatattctcaacctgaagaagaaaaaaaatacctaacagttttccaaacgattgtagtgcattacacccctccatcagtgtggaaggaaagggagagtaaaaagtcggcttaaagctcaacattcagaaaataagatcag

SEQ ID NO: 31527 - DNA, 673 bp, Bovine  19866881236500
cgccccgccgcccccccgcccccgacaaactgcaccaagctctaaaaattcacatgtcaccatggcctcgtagcttaataaaccacatcaaaagcattttgcaatgatgcttcttcctctatgaaacctgaagccataagtggacctgctattaggcgggtaattaagccgctccctgggcccagtggatatgcattcaagctgccaaaagatgatgaaactcgtgccttcctcagtgggatcctcggggcctgactcccatgttcccccagataccttgctccaacaatgagtgcagtcagggagataccagcatgtgaaacttggtttcaagcacaccctttcaaaacccaactgactccagcaagcagcttaccaaatagccatggaggagaccaaaaacacggctttccactgtgctcctgaggaaaaaccagccactgtagtcaaaatgctgcctgcctcagctggcctctgagaaagcaaaacagaccctacagatgcctgtctgaccctgtccatctcctcccctgcatccaggcagagctctgcttgggtaactgccctccttcacaggactccagggctgcatcctggatggtctatgccaatcactaggctcttaggtccccagcctctgccaaagcatcaccctttgaaatcccagatagag

SEQ ID NO: 31528 - DNA, 1677 bp, Bovine  19866881416716
tgtggattttcctggtaagtttttgaagaagtaggatacctgtacatttctatgggttcctgtacttcttttaacacagcacttttcattttattgtttctgaaagtgcagcagcaaaatgttaaggtccaacagaactcccagactttgacaactgaaatgccagcagtgacaaatgactctttggttccgtggtgtttcccatgcatctgtcaaatggtgttactcttgtataatgattggaaatattcatctttaggaggagcgctgcgatcattcaagcctctgatttctgaaaagtgacatttttttcatttttatgaattgccatcttatggcatgacacacacaggcacatggctggctaattttataacataagaagaaaacacacacaagaagctataggctgccttcctctgaggatttcctggttgcctcagtgagattaatttccatggccaggctgggtgcactcctgcctgggagggtagaggcatgtataattttatttatggctgtgctgggtctttgctgatgtgtacaggctttctctacttgagacaagtgggcgctaactctaagttgcagtggatgggcttctcactgctgtggtttctcttgttgcagttcctgggctctaagctcatggccttcagtagtcgcagctcatggacttaggttgccccttggcatataggatcttcccggaccagggattgaacctgtgtcccctgcattggcaggcaggttctcatccactgtaccaccaggaaagtccttttttaaaaaataaataatttcactggatagaggcatttaattttggaggacagcttatacctgggcaactcttagaaagtctgagatttccaccccctaatcagaatgtagacccagaccttttgaatttctactctgtgattttgatcaccttgcctggttttacattagtgatgaaaatcaaaaatttagttttttccctagagactctgacagcatgattgcattcaaaatgggaattagtggccaataattgaaatgtgtttgagtaaactctgggagttggtgatggacagggagacctgacgtgttgcagtccatggggtcgcaaagagtcggacatgactgagcaactgaactgaactgaacagaaataaaaagacaacaattgtctaccctttatacaatgcagcccagctgggtgagtcctggaaatatacattttgctttcctaaaatatctagaaatcagtggtgctttagaaaaagaatcagtaatctgtgaatagaccagatcagggcccctgcttgtatctgtaaataaagttttattggaacccagccatgcacattcacctaatcacctatggctattcttgtgctacagcagtcagagtagttgtggcagagcctgtgtggcctttaaagcctaaacgtgtgctttctggccctttcaaggaaaagtttgctgacttctgtctcagaagaaactttgctggctttctctactagaagcagagtacagctaccaagtgtcacagaccacgacaccctacacagcctctgtcctggcccccattaggctgtggtttgccactgtcattgcaaataccaaaacttctccatcatctgtgcaacaaataggcggcgagatgaggccagggtccgtcattta

SEQ ID NO: 31529 - DNA, 897 bp, Bovine  19866881503519
atttgtctatgactgcagggtcaaatttaaaagtagtactttgagatttgcactatgcccatggtagaattattgaagaatttttggctttatccctgagaacttaccaaatgtctctgaactttcttctagtttgaattacaatccacaatttgcagattggtcaaaagaaacaagaggtgcaccattaattagtgttaagccactagataactggttgttgatctatactcgaagaaattatgaagcagccaattcgttgatacaaaatctatttaaagttacaccagccatgggcatacaaatgaaaaaagcaataatgtaagtttatcaagtcatttctactctgaaaattgactcatagtcatttggaaggtgggaactcaaactgttaaaaactattaaaaacattaaattatcttaatttaaagatctgataaagtcccttgtagggtggacacagaaatgtgttcgagttgctaagaatgagtgagacaaaaaaaggactgtttctcaaacaattgctgttgggtgtgtgagaaatccttttgactacatggcttctcctggtgttctatttcgttatttcacccagaagtgttgcttgtgttacaatctgtgggaaccttttaacacatagtacatttttttggttaactttttctgaatgttgaattacgtatttccattctaggattgaagtggatgatagaactgaagcctatttaagagtcttacagcaaaaggttacgtcagatacccagatagtaagtagctagttgatatgtaggcagctgacctggaatcagttgttgtaaattgggcgctggtaaaccttggaacttgagctcagtgttaaaaatgttataattaggttcccaaacaagtcacaagaca

SEQ ID NO: 31530 - DNA, 974 bp, Bovine  19866881585333
cgcacatagtccctaagaatgccaccaatctctccctttgaggacatctgctgtgagagaccacctgttgtcagagaccccctgagaacatcctctcccatcattacgaaaacccctgaagacaccaattgcaaaagttcctttaggtcaggtggaggtgggtgtgttccaaacatggtttttaatgaatcccttcctataaactgaagacccctgaatgccagcctggtaccaaaaaaaaaaaaaaaaaggcttaaaataacaaagtgaaactcggtgacaggaaaagtccgactgggtttcggccattgtgcaagatctaacagcatcaccttcataggggtgggactgtttaagtccccaattacgaccgctcacctcgacaactgaaacttattctttgcacatttcaaacgcatctccttccctcctccctccagcttggccttcacactcttaataaaacattaaaaaacactccacactatgttgccggagcgtgttccacgagcttccctgaagtctggcgtttttctccatctccatattacagccatcttcatccatttgcgtacagaggtgtccgcacatgaggtctgatttcctgggaagttggctatgatgtgattgtgttcaaagaaaaagacagagaatattttccactgctgcagaggcactgtgcctgccttttaaacttgaaagatcagcgggtattctgtggaacctgaacacgggtattggaaaaagtgtttctctaaggggaaaagagaaaaaaaaaaaaaaacacctcattctgtttaaagatcattactcattagcatgctgggttcatcttttgtggggaggggaaataaacataataataacatttattgaacctagcttaatggcaacagtcttcgaaacactttatacataagattttatggaatcctatctcctgaactggagtgagggacagatggattaacaca

SEQ ID NO: 31531 - DNA, 1453 bp, Bovine  19866880256044
atgttggcatttgatctctggttcctctgccttttgtaaaaccagcttgaacatctagaaggtcacggtctacgtattgctaaagcctggcttggaaaattttgagcattactttactagcatgtgagatgagtgcaattgtgtggtagtttgagcattctttagcattgcctttctttgggattggaatgaaaactgacctttttcagtcctgtggccactgctgagttttccaaaattgctggcatattgagtgcagcagtttcacagcatcatctttcaggatttgaaatagctcaactggaattccatcacctccactagctttgttcgtagtgatgctttctaaggcccacttgacttcacattccaggatgtctggctctaggtgagtgatcacaccatcaaacacagaaaatttcttagcaaattctagttttctattgctgcctgccagacttctgttaaaaaagagtgttggcaattgctaggagaggaattaaagacagactttgttgttgtttaattgctaagttgtatccgactcttttgcaaccccatggactgtagcctgccaggctcctctttccatggcattctccaggcaagaatactggagtgggcagccattccctttctgacccagggatcgaactcacatctcctgcattggcaggtggattctttaccactgagccaccgtggacgcccccaggctagtgcctcactgaactctttctctttatctaattctaagaactggaggaaaaattgaagcaggaatagcttcccctgagcaagcctatattcttgaatgtcacttgccagcactggggcacacacaaaagcacctttccaatcagggtaagcccactgcctccgtgtgtctccaggctggctctgtggaccacgtgagaccacacccaccagtgcatggcaaagagcagaggttctctgccgatggggtgtatcatcatcaccatatcagcactcaaagcaggagctctgggctgtggcagtcactgctccccacaggccctcagtaccctctgtatcgagtccaccgacttgtccagccctctgaaggcttagatcagaaagaactttaaaagcccaaaccccaaacaacaacacatgaaatcatccctcataatccaacctctgtatttgaggcaaaatcagagcctcttcccggaatctggaggtggatctgtgaagccacagtcttgtctagagacacctgtggtccaagctggtcagcaccctcgtgcggctgagatcggtcttccctccttcgttgtgacctgtctactcagtaattagtcctggcagcctcagattggctcttctgttttcataattcatttacttttgatgatatcataaagagtgtatgaatttcatcctcctcccctaacatccggccccacgcccacatccactaatacaaaga

SEQ ID NO: 31532 - DNA, 1695 bp, Bovine  19866880437543
cttttagataacatttgaaatcatttctaatctctcattgccaccctatgtagtgctgggcaagtgagaacaccgtagggcatgcagtgtccagccctctgagaagtgagactcaatttccttctaccattgactcccttgtagaagggaatggtaacccacgccagtattcttgcctggagaattgcatggactgaggagcctggcaggctacaatccatgggatcacaaagagttggacaggactgagtgaccaacacacatacttattgagtccccagctcttctggggtctatcacctctacccagtttgggataactttcttgcttctggccacacctacagaactttctttttctcacttctatgccatttatcacactaggagtgactgtttacctgttgtcctcttgcatcagccagggagcaattcagaagcaggttcttatcgctccctgtactggggctcagcacagaccctgacctggagacagtcttgggaaaggcccatctcattgccttacctgtgggaccatcacacgcaagaaagtttccatcaagataaatggtgactctggagtttctgctgtgacaggcgaacacgtgaccccaatgcaggggatgggcctggtgagctctctgggttttgtattgccttcttggtcccgttggacaacttcacttgggtggggaacacagcagagttttattatgagatcatgctctagtcagaataaatccgcagcaaaacaacagttggaactagagatttgttttctcgctgctgcttacacagctaatggattttgacatgaacttcctgcaccatcatgggaaaaagtgcccttagctgagaggggtgacagaggataacagagcaaggggcaaccgggtctgggctgtacttggcagagtcagtcggagggtcaagggggataatctccgttatcctgagaaaatgtcttggaagccctggggactctaagcactgatgggtgactgaggacaaggcaactactggggattcaagacaagaaagatcgcaaatcactgcacagatgcccaaaggccttgcaatgggaggaaggccttgcaatgggaggacacaaccaagccaccgaaggcttattctgccctgggatcctgctttgctgtgtgaccactgtgtttccactcttactacctgttatcttctgagtctcctcccgtgccagcagcaactaggacagtgtttcccactggggcaccatcggcattagggcagggtcaagcttttgctttgaggaactgtctcatacacatggttggaaattcagtcaccctggactctggtcactaaaagctatttataacaatgcccctccccaagtcatcatgacaacctccttgtttgtgcccaaacaccttctagggcaccagagtccttctaaactgcggcctttcctgttacctgccaaaggggagcatggttacagctcagagtgggaggaaaaaaggtccatgtttggggtctttgtttcatgaaaacttgtcttttaagctttaaaaacccaaatactcaatgactagggctgcatttacatcataaacccgggtcagctgttctgatccacctctgcttgccacatccggccttcacctgactttataagtaaagtgtggtaacacactcattcaggctcattcagtctgt

SEQ ID NO: 31533 - DNA, 2641 bp, Bovine  19866880537330
ttggtagctgtaagtttgtttcctatgtctgtaagtgcatgtttgtattctatttctgtttgtaaataagttcatttgtatcatattttagtccccacatttaagtgatattataagatatttgtctctgtctgacttacttcccttagtgtgataatctcgggtctattcgtgttgttgcaaatggcatcgtttcattctttcttacggctgagtaatagtccactgtatacctgttccacatctttgtccgctcatctgctgatgaccgtttaggctgcttccatattttggctattgtgaatagtgctgctctatcacaccagggtgcatgtattctttcaaattacaggggtttttttctggatataaactcaggaatgggattggaagctcatatggtactctagttttgtatagaacctccatactgttctccatagcagctgcaccaattcacaaggaatataacttattttttccctatcacgtcgcaaaaaaggatggacagagatttgtttattgctcgaatgctagtgctggagaagacaataattatatggtgctggctctgaactgcaagctttgctgactgttaactgctgccactgccttgtagctgaaatgggacagatcagcatgaatgaaacaagaatccttttggagatgtctctactcctccaagcatgcaggttccaaatttagacacacaagaaatgattgaaaatcaaatacacttagcttttgtcatttatttggaattacttgagagttggaaatgagtactgcaagagaatacaaataacaaattaccatgaacctatcctcgggggatcctccacctctcctaatggaaccaggtgttaatttgctgactgtcagagttggaaaggagcagaggcattatctagtctagtgactgattgtcaaaaattatttggcaaaagaactctttttttcaaaaagactcattcaggtacctgataagttattcacattaaaaaggaaattctctagctgaagcaagagttagagacctgaggcctcatgcttatgaatatgaccccatatttggccctcatcttccagccctggccctcccatgaccacaagccagctcggcaaagtctaagcttacacaaaagaaaaacttctaggaccctgtgtgccaggctctgggaagcccagagcagcaagtaggcagcagggcttccctggtactctagtggctgagaatctgcctggcaatgcagggcacacaggcctgatccttggtcggggactatttcacactctgctgggcagctaagtcccatgtgccacaactgttgaacccacacaccctacagcctgcgctcaacagctagaggagccactgcaacgagacgtctaagcactgcgacctagagcacccctgctcaccacagctagagaaagctcgtgagctacaacaaagacccgacacggccaacaataaataagataactaagtaaaaacatgaagattaaaaaaggcagcaaatagaggcaactgcagccccagctttcatggagcaatcaatccagtgccagaaaccatttcccacttcctccacaagatctgcaaggtcagttttgttttttcttttttaattgaagtatagttgatttataatattgtgttaatttctgctgtacagcaaagtgactccatcatacatatacatatattcttttttatattcttttctattctagtctatcccaggacattaaatatggtcccctatgctatacagcaggaccttattgtttatccatcttatttataacagtttgcatctgctaatcccaaactcccagtccatctcttccccaccctccaccttctctcctgacaaacgcaagtctgttctctatgcctgagtctatttcttcttcctagataagttcattttcatttgtatcatattttaggttccacatgtaagtgatatcatatggcatttgtctttttctttcttcacttcactttgcatgataatctctagttgacccatgttgctgcaaatgatattatttctttcttttttatgactgagtagtattccattgtatgtatgtactacatctttatagccaagacatggaaacaatctaaatgtctatggacagacgcaagttttttttgtaacaaacctagagtagactttgtctaggctcaggaaacccaaaagatcctagagcaattttgcttatcttgtgaggaaagttatagaactcgtaatggcagagtcatttgggagtgtgaatttaccatttcagagttgggtcttggcacatgcagataagagtaggtttatttaagagtctcaggtcacttacgaagtctctcaccctgtcactttagcatccaggaaaggagggcaagcaaaaaataggtctaaccgtgtactaatttgttcatttatttattcactcattcagttaatatttcctgagtgatgacctggtccttgggctaggggcttagtctgatagggacagaaaactaaaatgattgcaatatatctcgtgtgatcaaggctttaatagagagacaaacactgtatcatggggacactttagagaaatgaacaaatgactggtgggtaaaggtgga

SEQ ID NO: 31534 - DNA, 1403 bp, Bovine  19866880537982
ccccgtgccttgccttgtgcctggcacacagtaggtgctccaccatcattactggatgctgagtgaaggccacagagccgttaagcatcaaagctgctgttgggatgtgtgtagggtgtctccatgacttctccccttgctttatcctgattcacactggttatctgccttgaaaatacatactcttgtgtttataaataaccctctggcctgtgtagcctgacatggggtaagaatttcctcccagtgttgcttgtctgttcagtcccctcacagaaggcctaggttttggattctgggctctggaacgccttctggcattttctgctcagtgagcccatccattcccattttcttcagtggagctgaagatataaattgcaaaaaggccttcttgcagattgctgggagagcgcatgttcctggccaggaattcctttgctgctgctgcaggggcagcggggcaagctccactgggggcggtgcaggctgcactgtttgtcactgctctgtgtgactagggatgggcagaacgggggcaggggcagctgccaggcccagctctggggccggcaagcatggatggatgagtggcggacagtcggggatccagagcacagcacacagaactgaaatgcaggacccagtgtccatgctgcttacggtctagcagtagggagtgactcaacctgggttgaccatgagctgcatcaggggtggccagatgggaggtgcagcaccatgagaagtgtttatacataatgggagtctggcacgtgctagtggtcctggaggactgggcaactccaggagactggcaaaagttagctggttacccaagccccaggttacagtctgaggttaggaaggaaggactctaagatatcagatcttaagttcggaaacagaaaggccttagcaggagtattttgtttgtttgtttttagttgaagtatagtttatttacaatgttgtgttagtttcaggtgtaagcaaagtgattcagttatacatacatatatatcatacatacatacatattatatataaatatatatctacttggcatccagtcccatcacttcatggcaaatagaaggggaaaaggtggaagcagtcatagatttccttttctcgggttctaaaatcagtgaagatgttgactgccaccatgatattagaagatggttacttagacctgggtttgatccctgggttgggaagatccctggagaaggaaatggcaacccattccagtactcttgcctggaaaattccatggacggaggagcttggtaggctacagtccatggggtcgcaaagagtcagacatgactgaggacttcactttcacttctggaaggaaagatatgacaaacctagacagcatattaaaaagcaaa

SEQ ID NO: 31535 - DNA, 2279 bp, Bovine  19866880581846
acacatgtctgtggtgaagttagaatggggtaccatctatgaagtacccagctgatgctcagagctttctggatgctgtaggtcattagaagtccggtttcaaccacgtagaactacaacttctctcctctctcctctattttcctgatcgccagccagactggaggcttaggggattcagagttggggagagggtataagtcttctctttgattccttctttccgtcctgaacttcttggacagtggactgctaccgtctgtctctgacacccttcctgtctgctccctcttccggggacaagaaagaggaggcatagggaagaggagccatatctgctcactggcttctcttgtcctccgcctttgatcatcactgctgctctggacaacactgatgggctttgacgccctctgtgtgaaaggaactggacacctgtgcgttcacatgggcacacatttggatcccggaggagagggatgaggccctgccttctgcactcagatgctgactcaaaattccaaagatctcctcctccttgccttcttatctttcacttatgtagcccaggaggcatgggatgggcttggggtggttttgtgccgatcagacttccttcttagtgatgcctcaaaggccgtctcaccttgtccatctaagggccctggcgagttggtctatttaagtgccctcctaaaccctgagttctgaggtgacaaggaacctgcccacttcatctctgtgccacatggcatggaacagatgccagcatgtatctgttggatgactaaatgaggccacttagtgactttacaaaggagagagatcaaaggaagatggactgggttggatccagggaaagagaatgggtaagaatccatcatctgctcaagttgttgacaaaggatagaaaagcacatttcagtgacgtacagctgaaagcagggatgtgagaaaaacgatagcttcgtgtttataccccgaactaagttcagaatatattttaaaaaaccacatgccatacattatttagtgtacttcctgcaaccaccatctgggggccgatgtgaaaatcggggtcaaggggcaaagtgcccgcccaaggacacgcagatggtgggtctgctgcccctgaccttgcatgaccccaagatgccaccagtggcaagaatcactgaagtcacttaacctacaaagaagactcatcttggcagctcttctcagctattccaggaagtcaggaaaggccagggcagctgtgtcagaaaatatctctgcctcaaggtttgaagatccaggagttctctgacctcaaaccttcagagcctctgaaatgacttaaagagacagctacaagcttctccaacagagagaaggtgtttcttagatgctcttttttctcattaatcttacatcttacttgactgcttcctactccccaccactggcactcaattttttctcttaagttggtcttaagaacagcagaaaagtggtggtgaagtagtagttgaaatagagatcaaatggcaagccattcctaaggctagctggttctttaagaatatgatggtgacggtgatggtgaggaggatggcgatgctgatggtggtgatggtagtgatgatgatgatgtaactgactgacttcaggcaaggccaagaaacctgagagcttccttgggccagatgtggcctcagcagtagagaaggctagctgaaagcttacctcctgctgaaaggctctcctggaagggactgactggagggatggccaaggaacccaggaggccaagggcctgaggagagacaggtcatctaaatgagagacatcaccagcactgcaggtgtaaccagagggttcccggagaacccacagagaccccctcgtagaaaacgtcattagccccctgcctggccagagaatgcaaagccatcttgtcatgtctaaactattgcttcaccgcccctctccccactcgcctcacagtgtgacacgaaagagcagctggtgttcacacggactggtggacacttagtttctgaaccgaggctggggcagggggctcgggtggcgtaggcctgtctctatcgcctaggagggaggcgtaagagaggcacggggagccctctccaatgcaggagacaaaaataaagttgtctttgacactcctgtaaggcgttcttgatcaatggtagcagttacagcaaaaacaaccctatcagttaataacagcgacatctctgctgacagcggcatctcctccctacctgtggacc

SEQ ID NO: 31536 - DNA, 1229 bp, Bovine  19866880658659
tgttgcctggagaatcccagggacaggggagcctggtggggctgctctatggggtcgcatagagtcggaaacaactgaagcaacttagcaacagcagcagcaacctcccccctagagtaggtcttagtgccctctatcataattttcttttactcccagttctctccagaagactatgggtaccttagaggactgtcttagagtagaagtcaacaacaggagggtaggagggaggggagaaagaaagaaggaagaaaagaggggagggaggtgacaggtgggtggttgtatgagttatgagatggttcacatacatactgactccaacactttgcttttaaaaagtagagtcattacttgacggaaatgaagaataagaatcctgggacagatgagcataaggaaccttcaggacagaagagctaagagagctaaaaccatgttgggggagggaaggcaggctggcaaagaccaacctgggaaccccaccccaaagccacaatcagtcctcagctcaggaatgcaccctctgttgaagtgagatatcgatttttcacattgctgctttacactcttcctagatttgggactgattaactccaataaaaagcactgccagctggtgaaaacttaaaacaaagggtctatacaaaagcatcgtgttccccctcactttcatgtatttgaagcaagcttaccctccctagtcgcctatggtttctgcataaattactctgcaagaccagcctgctgtgagcgtgcttgcctgactgcctctgctccccttcaaatctgtcagttaagctttaagcatcttgaaaacgtattgtctggaatgaaacaaccaattatgctttcaggttttgtggcataatatcgcagaaactagcaattacagaatcagagtggcatcaaatggggtagaagggagttagcacggattattctttaaatagcagttacatgaactcataataaataggtattaagtgttaaatgtatgataagtaattcttgacaatgcaattatccaaacaggagaggggaaagtggcaagatggcattgtcaaagtcttttgtgcacggcatgctcagttagactgaaatggggaggaaatttgtctctgttccaaccagcagtggaggtaagagtacagatgtgggcactgaagggcatttggctgggtcctaagagctgctatgtgttcaaaagagcaaagccctttctg

SEQ ID NO: 31537 - DNA, 1810 bp, Bovine  19866880678987
acagcacgcataatgcccacagggtactctggcaaacagtggcacctgagcaactctcagtcctctcctggtaccagggagtccaggggctggtgagaggggtgggcccctggggagaaaaccggagctggaactgaggctggtccctgaatcgagctagaatttgggtatacttgattcccctcaccctccaataaagaccctgctcccaccagttcccagtgactggctgtgagtcagctccgctgctgcctttgttttgatgggtgccggatgccgcctggctccacaatgatgcagaggctgatgctgttgctaggcaactgagctacagcacaagtcctgtgaggcctttctgcgactcacccctcaacccagacctgctgacagtggctgctttggaacaggctataaaaatggggagagattcacctgaaatccaagggtgtattagagtagtgggtgtttacgtgcccaacagggaggaagaggagcaaagtgataccttctgattaccgctcacttgtcccgtgccaaccactgtccatagatcaactcatttaatattttataacagctccaagaggcttcccagttggtgctagtggtgaaaaacttgcctgccaatgcaggagatgttagaggtgcaagtttgatccctgagttgggaagatcccctggagaagagcagggcaacccactccagtattcttgcctggagaatccccatgggcagaggagcctggcaggccagggtccatacggtcacaaagaattagaaacaactgaagcgactaagcgtgcacacacacacacgcacacacacacacgcaagtgctcaaagatgaatgttacaactactctcattttataggtgagaaatccaggatttagagagaaaaagtgacttagccacgtctgcctaaatattaatctgagatttaaactgaggccccttctgattccagggctcatgagtggaagagaaattcagctttgatttcttgcctgatttcagcaattcctgctccatctactgtccttaattcattctctgcaaagcaaccagaaatcagacctgtgctcctgctaacagcccacccacgtggtctgtaccctcaggacactccttaaattgaatagcactgctgtgtgtggcctaaagctgccaagccctctgtgaagggatgggatggcatgcgaggcctccccccttttatgcttcctcctccctcctttttgcaaatgcttcctttcctctaggcttcattgagctgttgattgcctggagtaggtgacattccccatcttgcctttgggagctcttccctctcctggtttcagctcagacacctatcctctctgcagcctgtgcagaggctgaccggggcaggggggccctttgactcccaagatccccctgcagcccactctctgcccattcacatgactttcctttgccaagatttgggattccctgtctcactcacactccatctgctccaacatctggcccaggccctggcacacaggacaggcctcaggaataccttctgaatgaatgaacagctggagagtagacgtttgaatctcggaagtgagcttcctggggcctgtgcttttacatccatttgggagaaagctgagcattaacattcaatctgctgctcttctggtccagaccttctgcctgggtctagggcctgtctgagggtaaacacttaggctgaacaagtagtccattttgtaggtgagcaattgaggctcagagactggaagcaacttgctcaagactaacaagatctaagcc

SEQ ID NO: 31538 - DNA, 2572 bp, Bovine  19866880683819
ccactatacttagcactcacatacttaggatgtctaattagccagtgcaccctaagcattaggaaagcttagttttaccgggttactaacaaggccacattattctctcatcctattaaatcatagcagtgtctcatcctccagtttgaaatcccttaatgtctgggcggtgcagccccatgagtcagaccactggctccgctgctgtgatcatggacaggagcagggccctgaggacctgtgagggaatacggctctaaatatggtcctgaccaggcccttttctaggcaccaggaggtattcttcctgaggaatgaggaacacttggagagagttcagaaagaagcagcctctctgatcacagggtgggaatcaaagaaaattacaatgctcagaaccagcttatcatcccctcatgacaccaaggagaagataggcccaggagggttaagacactcacctaaggccacacagggcattggtggcagacccaacactcttgcataagccatcactttaattttattgaaccataactgatttacaaagtcatcttaacttttgtcgtaccctgaagtgactcagttatgcatatatgtatatatactttttcacattcttttccattaaggtttgtgacaggatattccctgtgctatatggtaagaccttgtttatccatcttatatataacagtttgcatctgctaattgcaaattctcaatccctccctcccccttgactaccagaagtctgttctctatgtctatgagtttgtttctattttgcaaataagttcatttgtatcatattttagattccacatataaatgatatattaaatttgtctttgacttcacttagtatagtaatttctaggtccatcatgctgctacaaatggcgttatttttttgtatttgagtaatattctattgtatatgtatcacatcctttttatccattcttctgtcaatggacatttaggttgtttgcacaacttggctattgtaaatagtgataagccatcacatttttttccctcgggtataattctttcatttctcccattcagatccccacacttggacccccgtgcccctcatggagggctcccctgccaggaaggaagctgccttttgaggccccacctccttgaaagaggctgaaactcaggtggagtgcctgccaacccaccacaaaggcatccaaggccgtcaccacagaaaaaccttcactcttgacatcagcctttgggcaaaaataatagccaagaagaaaatctcagaagcctcaactaactactgaggctttatatgcctgcctccaggttagctggagatggacatatcaacctccaaactccatggtggccccaagggtttccttttaagagttaacatggattgggccagaccctctgtgctgcatctcacgtctattaccctcaccgtcacacttagtagccacattttaaagaccaagccactgagattcaaaacaaagaacacttgaaagttagggagtaagtgagatgggcggtcagacgagctttccgtgtctcatgttgcctctcacgcaggtcttccaaagttctcggaggatgggagagtgttgtagaaaaccattagccgccatcaccaatacggtcatcttaggattttccgctcccctttggacttcaattctgaatacacagacctcttcactgccagcttccagttgggagagcacctcaggttctcagatggaagaaggtagccctcatctgtttagttcaggagctggccaaggttttctgcaaagggccagatagtaaatattctaggctttggaggcacctgttgtcaccattcaacttttctgttgcagtaggaaggccgcgatgggcaatgtataaataagcagatgtagccgtgctccagcacaagtttatttgcaagaagaggcaacacattagtttgctgcctcctggcatagttggttccatatctagcaaacagactttttctgatttagctttgatgtagtcctcctctttgcctgaaactcatctcggcactgaagcacttgccttagtactcttttgtcttggggggagggtgaaggaggctgtcccagagcccactgagatcccctaaaccctcttctaaggaaaatgcaagtgtatgcaattctgcatgcaatttcagtggggcttgtagacacagattctctttatccttgagagaccagtgaatgcatcttggctttctggaaactgcaagtgttggggacagctgattggcatgagaacatcagtctgagaatgctgtagtctgaggaagatttagtggtgtgccaatgtgctggttcttgtggaattctatctcaaaacaagcccccctggctaatgcctatatgtcccagccctcctggtgggctaagtctagccacgtgatcttgttcataccattgggtgagagcagaagtgataggcaccactgccagccctggccctttaagactggctatgtgctttccaggctactttctccttctcactgattgaaggcaagtgagaatgacacaat

SEQ ID NO: 31539 - DNA, 1476 bp, Bovine  19866880794308
tggaggattgaggggattttcagtaatttcagcaacacaaggtttttatctattaatattagtgtatgtatttgacaaatatttactaagtgtccaaacttgtgctgaggatggtcagtgatacatgctgaagatggagcagtggaaaaggcacagtcccttccttcaaattttcacaatttattgcaggtaattaggaaagagcctggttatctgttcactagacctgtctgattttcctcctgggtgcacagctggacttggtttcccatcctgccttgcagctggggtgaggccacgtgaccaggttcagccagtggaatgtgagagagagagatctgtgccacttcaaagctcaccccatgaaatttcctgcatgcttctctaccccatctctttcactgtctgctgattgggtctctatacccaggatggtcctgggagccattgtgcagagggcagtacttttataagttgggtccttgaatgactgactgcatggagcaaatcaccctcccagccctggctgctgattcaattttacaagagtgaggagtgaattcctattgtgttaagcagtgagatttggaggtacttctgttgaagcgctcccttaacattagtattaacactacttttgttaatactctgggtctttccaggtggagctagtggtaaagagcctgcctaccagtgcagaagacctaagagatgcaggttcaatccctgggtcaggaagatcccctggagaggggcatggcagctcattgtagcattcttgcctggagaatctcatagacagagaaagcctgtgggctgcagtccatagggttgcaaagagttggacatgactgaagcgacttagcacagcacaaaaaatactctagacagttgcaatgcagttaggaaagtgttgtcatgtgggtatatgcaaaattttgtagaatactaagtggaattacctccttttgagaccaaaggatttgaaaatttttctgttaaatgaaggagttgttggtggagagggtgtgtcagagaagactcctcaaaagaaaagatgacatttaaaatgtactttgaagagggaattgtatagttccaggcagtgaccgggggaagggcattgtgagcagatggaacagtctttgaacagactttgtgtctgaaagtgcatggcatgttcatgaaatggcactctttcctgcaggactagaattaaatccgcccagttgagacaggagggaaagaggctagggaaagaggttgagactatataatgcagagtcatggatggcatggaaagtctatctgaaactaacgaggaggcagttaaaacaatgaagagggcaacaaataagactggtatttcatctcagtaagataatgctaatacttgggtattgtggattaaagtagaaagaagcatttaacgaaattaaattatcttaattcagcactttactttttccatgtcta

SEQ ID NO: 31540 - DNA, 738 bp, Bovine  19866880897860
tccagcaaagactctcacattgcccagtggaaagctgcccattcatttttgagcggcggcagcagcacaaacaaatttctcaagaatgatttctttactagctccaagtagagctcaaacacttagcccagatgaaacttatctttgatccagatttaatgacagcacagacatatgccattgggattggagacacactcagggaagtgttagcagagcaatttgctaagactaatgaatggcttttggcaaatgggttgtgagccagggtcagaatgagctctgtgagaggaaggggtgagcctgactgtaaaggatctatgcgaggtttctatgctatattcacgtatcagcccgtctccatcaccagacaagggatgtgggtgataagggctagatggaagccagcataggatgcaggcgctatgtggatacacaggaggcgctgagagtcagctgggtagtgagggaagcatcacaggggggcagatgaatgcgggtggctcgaacggaggcttaggtgtcctggcaaagaaagtgccagatagatgcactgggagccaggggtggagaaagacctcctcatctctctttatacccttttgcaacttagattctggatgctctgcatgcatgtgatatgcatgcataaatatacactgtgttgtgtgtttagtcactaagtcatgtcccactctttgtgaccccatggattgcagcaccctaggcttccctgtc

SEQ ID NO: 31541 - DNA, 1040 bp, Bovine  19866880946583
ctggcataaacacagcatagttgagagaaagagtgtgaatttacactgtttgtcaataaacagtcctcgttcaagagacttttgccacttctgggtcagtagcttgatctttgtctactgccataaataaaagtgattgcttaaatgtccttgtcaccagaacaaaatgactttccctacatttaaaaacaagtgctgacaactccaaaaacagattatttctaacaataatagttgagcttttccacatacgcactgtgtcctgggcactctgctacctacttaatcctcagtgttttcaatattcccattttatagatcagaaaactcagagcttgaatggcttgcctgaggagttgcaattagtctcttgtggagcaaagattagtgcccacgtctgtcttcaactacagtgaaagcttttaactatctcgctaaaccaagtctaaaaataaatcaattaatccaaatgaaggggctggagaacattaagaagttttccctgttctcaaattctaagattacttgaaaaacatgttctgaaatattatgtaatatattctgaagtcaaagaaccatgcctttgtttaacagccactgttctggaagctccattccttagcaccccatctagccagccaaatactcaaggttgcccatacagattacatgctactgagacaaaaacaaaagtccaaaatctatggttataccaaaagactgtgtgtccccgccatcgaagcacatgtgacttcctgctgttttctccttgccagatgtagaaatgaatgtcttaatcccaggaaatttttataattgctaaagatgactattgcagcttttttcagaaacatgggctcatttttagaaaagaaaaaataaaaaagattgcataatggctgagtggaaattcacaagcagatagtcaggcaagcatacgttggatacacattcctactgtagaaaaagagaaatgcatttcagcttaaatactagttttgttatgtttctaaatagagatatttttaaggagttaactt

SEQ ID NO: 31542 - DNA, 1401 bp, Bovine  19866880962638
cttagtaaatttcctggtcaatgtgctatgtaacccataaaacttggggcaataattgcctttgtcttttatgatagacagcattctaagatagtccccaaacttcccagcctatccccacccccatataatctcctttctcaacagtgtggacaggacccatgaatatgatggcacagtcactcccatgagtatgttatgctatctaaaactccatcagagcagactggagagagatgctccttctggccttcaagtaagtcaacatgttggagagggctatgcagccaatgcctgagggtggactctaggagctgaaaatgacccgggccgatagtaaggtcatgcaagaaaatggcacttcagtcctacaaccacaagtaactgaattctgccaataactggcatgagcttggaatagggccccaagcatcaggtaaaatgcagcccagctgaaaccttgacttcagaactgtgagaccctcctgagcagacaacccacctaaattgtgactggacttctgacctataaaaacctgtgaggtttctgacctgtgaggtgttaaatttgtattgttttgaagtactaaagctttggtaactggttacataaaaacagaaaaaccaaaattcctccccacattatcaagtccatctcaaccatctcttaactagacttgttcatttctagatccttagccatcagactcatctcaagcatcacacatcaaatttcaagaagtatttcctacttagtcttctcctctgcccttctattttatagatatctttctcaaaacttctcaaaatgttctagaccatttatatcagtccatttaatttaaaagacctcacgcagcagtcaacatgttgagacaggaacaaagctaaacaaatattactgctgaaataagacaatgaataaccattacaggcatatcattctgctataaatgccataataaatattttgtggttgtttctctagtatccattcccttcttcaatcaaaagcccctagtcctccttttaagagccctgtcctatgtaacagccatgtggtttggtggaattgttgccttccttgagggcagggatggtccctaattaagttaggccaatcagaacatactgttctattgatcacaaaatttgattgactcagagatgcacatgttacccaatttggatcaaagtatatgagacggttgggaacacggagccattggagtttattcaatggggttccagaccaggcaatggagcaggtaaatgagctcaacaagaagggcaacgaggtcctgagagctggcaacactgacgatgcgctacagtgctactctgaagccattaagttagacccccagaaccatgtgctccgcagcaatcgctcagcggcct

SEQ ID NO: 31543 - DNA, 1000 bp, Bovine  19866880974569
tctctggggacttaaaggtggaaaattgccctgggatagcttctcgaaggcgccttcctagtgtgaacagcgcgaatggagcaggagatcaaagtggggccaacctttggttacaaggagagtgacgggcagggtctgctcaggaccgagcagagggtgtgactgggccttgggggcgagcctgaccttgaaggctctccagaatccagcatcagaggactgtcggactcttctcacctgtccccctctttgaggaacccagaatctctggggcagggatgatgctgagtaagtgtttctcaccatgtcttctgagctcttggtcttttctttggctctcttaggcctcatcaggcacacccccgtctgaggaagaggaaccactcagtttgacctgctgggagcctgagattgcgtgagggcagggcagccagccaagtgctgaaaaatctcttcctcttgggaagcgccaggcagtgccccaaaaggggaagtgatctgtgggctgatctgctaatgatttatccccgggtctttagacctggcacctgtggcaccagctgcagccgaactgtctggaaaatcttcccagcgggcatcagggagcatgaggtaggaaatcaagctcccagggccagctgccagccactgctgcaccggcccctgccctccttgcccagaaagggctgcttttgttttttttcaaggcaagcacaggatgtgaagctgtggcctagcggaggctctggggatggaccagccctggacacgttggagtgatgtgctggcacttgactcggcctgtgtatcgctgtccccatgacctggaggcttagcccctgatctcctagaccaagagtaggaggccagcgctgacccctgctcatcgacttctcaccacccaggttccagtactaatgaaataattatttacaaaagggataagtgcccgtagtaaacatttcaaacaagctaagataaaaataatccccatttccaa

SEQ ID NO: 31544 - DNA, 841 bp, Bovine  19866880993798
ctctaggagtttagagggtgaaataataacccacaagaaagcaagtgctggaacttgcctcgtggtccagtggttcagactccaacttccactgcagaggacataggtttgatcctggtaggggaatgaagatccccacatgctgcatggaaaggccaaaatattaaatttaaaaaaaaaaaaaaaaaagcaagccagtgtataaagacaaaacaaaatcacagcacgtaattccccatgaatttcccccccacgaatcaaggagacttttggttcttattagactttagtatcggagaaggtgatggaacccaactccagtactcttgcctggaaaatctcatggatggaggagcctggtaggctgcagtccatggggttgcgaagagtcagacacgactgaaatgacttagcagcagcagcagcagactttagtactggcgtccaagcactagagacccccaggttatatctgggttacatgcctattatgttactatttctgatgcctgtttctgaaccacaaattacactgggctctctgacccaaactcttccaaaatttgggcccctaatccgtcggcggtcttctctctgagcgccgtcactttttgttaatctgcctcacactatagtcaatacaacccacgtgtaccagcccctttgggaaaagcaaagcttccaatattcttaaccttccagtgggaacttttcccaccttgcttgcagctgtttctcttatgcctccatgacatggctgctcttagactgttcagcattttgaaggtttcaatatagcctttcctaaggaaatgccttcctagcagaagttcccaacgtg

SEQ ID NO: 31545 - DNA, 1876 bp, Bovine  19866881063330
tatctgtgcaggtggctttagacatggccggccatctcaggatgcagcagtgaagagctggaagacactggactgtaccatctctaggttatttcctgctctaaagttttccaaagggactggtagaatcagtcacctggcctcttgcaggcctgtccaaccaactctgacaatgttcaaaacaacccccagtttttcactgactgctctgtgttatccaaaaactccactctgcactgtagctgccatgtgccacatagaagcagatccatgcttgggggaagagggaatgagcatgatccaggaagcctttttaaaccctttcaggtcctgcaagaatgtattgagcacttgctatatgctggtcgacatgccaaatccttgttcatgatctgtctctttcaaccctgtgaaattttacctgaatttttgtcactagtggggactttttccagtttttaggtactaggacccattttatcttcagtaaaatggagataatgaaacctgtgttgtgctcctcattggattagcatcaggatcaaaagagactgtgtatgggggccactttgggagctacaaagtcctgtccaaagagaaggaaaagatagacaacaacgacaaaagagaagccagaaaacctcttccttcttccttctcttctcttctttaacaaaacccactctgtgtcattagatcacccgtgaggtcctacgacatcatttgtcacaggtcttgtttctccagccccttctcagatgtaatcactggctcctgtgaccagtcagtaggcatttaagttctaacgccctaaggtctgataaactccagtttgaattccactctggaacttgtgagcactgttccctctgggcctatcctcctgctgataaatcaggggataatggccgttgttgcccagtggtctgttgggaagacgtgacgtgctgaactatgtaaagcactgggcacaaattcttggcttgcaacacgtggtaaacgtgtacagtcattgttattatctactctgtgaggtctgattgttattatttccatttaaaagacaaagaaactgaggctcagggaggtgaagctgcttgttcaaggctacacaatgagtaagcagtggggcagagacttgaggccacctgtgactcgggtcatgcttgtttgcaatgtgtcatgaggcttctctatgggaagggaaagtatgtgtgttagtcactcagtcgtgtccagctctttgtgaccccatggactgtagactgctgggcttctctgtccatggaattctccaggcaagattaccgggggcaggggggtgggtggttaccattctcttctccaggggatcttcccaacccagggattgaacccaggtgtcctgagttgcaggtggattctttactgtctgagccaccagggaagccctgggaagggaggtagtgttcttataagagagaagagagagagagaaagagaggtagagatagaggggtgcttttgatctggatcacatacagttctcttccttttatatgctgcttcctgatttcagtagcgttttcattcattatctcataaaacctggctgatgtgatcattgccaagcctgtattatacttgaggctcctatctctagaggctcagttctgcctaaaatgtccttcagtttcataatctgcagactgaaaattgggagccatcactcaacgcgtcgtttttgttacagaatatctgaaataagcctgtcgcagaaaacttgttttatttgatttctgcacagaaatagttcatctgcttgtaaatcatgccctcccatctccagcctgtcgtgaattctgagctggccacctgtgctggtctgtgatcctta

SEQ ID NO: 31546 - DNA, 879 bp, Bovine  19866881110986
ggtctgtttaccaagatcgagggcgaagcttttgttgttagtcaccttttcccttatttctatggcaactgtgatacaggaggcttgtttctatgtgggctgtgctgtttttaatctggcaccactttagagctattcagctagggttgaatttttgctgcaacaaaattcatgggatgaggaggaaattcaggaccagcaaaagcacagtagggaggaaaattcagttcacttcagtttcagcctcttggtgactcccaagcacgagggaaggagaacatttctctacttctttcccttaattttctgagacttagagatagaaaagaaccacaggatgtaagatattttgaaaacattcccaaccttagaagtatatctcagtcactctttatatatatatttatttacttacttacttacttattatggctattcagcgatgtgggtcttagctatggcatgcgaactcttagtagcagcatgtggaatccagtttcctgaccagggattgaaacacgggcaccctgcattgggagtgcagacttagtccctggacaaccagaaaagtccctctcagccactcttgaaagacagctggagaagtgattttggagtcagatatatataaaaaaaagaatgtcccttgtatgagcattttaggtgctgagcactgtgctaaggagccatgtatcagttagctattgctgcataagaagtcagtccaaagcatcacgccttaacacaatttatcatctcagtttctgtattcaggaattgcatggcttatcttggcctctacatcaaggtctctcacaggagcgatcaaggtgtcacccagggctgtagatattttgaggctctatggagaagcatcag

SEQ ID NO: 31547 - DNA, 913 bp, Bovine  19866881165832
ctgggttaggagcagagtcattatctggcatgaagagaatttgcatgtgagtgcttggtgggaaaaaaaaggctgcaagagtatttgatgtttattattgcacttctggctagggctttattgaaaatcagaacaaagatgcaagcctatgtttatggctgggtgctttctcctggcctcatgaaattgtactattggagtaaccttgagaaacatatattactgagaattgaaaagcgaatgtggcttatttttttttttttaacaaaacatttccctgggagagaaaacgtctgtggtgctgtctcaggcggaatgtgcgcagggtgtgaggctcgtgcaagccctggatgactcggtgacagctccactccagagcctcatgcctgggctgctgttattgccaggttgtcattctcattgattcaaacactggcacataaatgctttaatcaagcaaattacttgttagtaagtttggtatagaagactcctagaatttagtgaatattcttatttcctgtgggactcctgagggagttggctgatttaaagtctgcacaccagttgttaaactgttagaggtatgtaaccaagctttgggggaatatttataccatggcaatgagcaaacactaaatcatgcatcaccctcctttccgagcccagggcagttaaccagcacgcttgtgtgaagagcagtacagaaaaggggaattctgtgggttggaggtttggcactgtgggtttatacgaacgacagcgagtcatttcatgtctctgaacctgcatttcccaagctgtaaaataagacaatgctgtctgcaccataggcctggcctgaggacaaaatgagacaacataagccccacagaagctttaaaaatgtgaatctcctcctgtttcatttctg

SEQ ID NO: 31548 - DNA, 1527 bp, Bovine  19866881174447
cattatggtttattacaagacgtttaatatagatccctgttctatagagtaggtctctgctgtttatctattttatatgcagcagtgtgtatctgggcttccctggtagctcagttggtaaaagaatccgcctgcaattcgggagacctgggttcaatccttggattgggaagatcccctggaagagggcatgacagcccggctcccattattcttgcttggaaaaatcccacgggacaaagcaagcctagtgggctgcagtccacgggatgacacagagttggacacaactgagcaagctaagcccagcacagcacagtgtgcatctgctaatcccaatctcctaattcatctcctcccgcctcgagctaactgtaagtttgctctccacgtctgggagtctgttttgtttcataaacaagttcatctgtatttgtattttagattccgtatataagtgatatcatatatttgtctttctctgtcctacttacttcacttagtatgataatctttatgtccatccatgtttccacaaatgggattgttttgttctttttcatggctgagtagtattccattgtataccacatcttctttaccctttcatctgttgatggacacttaggctgcttccatgttttggtcattataaatagcgctgctatgaatgttggggtacaagggacctttttgaattagacttttctctgggtatatgtccatgagtgagattgctagatcatatgataactctatttctagttttttaaagaacctctatacctaaacataacttttatatgtgttgggaaaccagaaaatttgtgtgactcaatttattgcaatgatctggaaccaaatatacaatatctcctagatatgcctgtacacttttttgcacgaactcttggaaatctggtatcctgatagtacatctcaatggggacaatccacatttcaagtgctctttgagcatatgtggctgggagctgccatgttggacagtgtggtctggattctcaataaccagcaccaggttggagcagaagttcaagctggtatttgctgcctgtctgcaccttccccccaacatagaaaaccaaaaaatacccagaaaaataatctctggttaattaaagatgccagacaaatcatgtcaggttaacgctcacagaggagtgaataataacagtggttccactcaagcaagcaccaaataagcaaacattctttaaataaacagaaatggagtatatttcaggaatgaatttactctgtgggtcacagaggaggttaaacaaaaatttgttttaaaaacgtctcccaaaggacaccctgtgctgtgttcccaacacatgttgttaggagaaggggagggtcttggtggtgggagcctggtgggctggtggactgagaaattgagtttgtgtggatagcagggcctccagacacctctgtctgccattgccactcccagctcttacaatcaaacgccaacatcacatgcagatctgcaggaagagt

SEQ ID NO: 31549 - DNA, 1052 bp, Bovine  19866881213999
aactcagaggctttccaggacctcctccagggcccagggaagatagaatggacaaaaccccagttcctgccctggggttacttgcaggcctttgggcgctcctggggtccgtgttcactttgtctactgagagaaggagttatcttctgtggcgggaggagaggggatcccccccaacggtatctttactaaactcagcagtaggtcaccatcggagaccccaaaaccctccccatcaaagtctccacccatcactaccatgtggtccaggcaagtcatttccccatccgagcctcatttttctcatttgtaagtgatgatacataacatttccttcttagcgttgttggaaaaataatgaaataactcaggtgaagtttctggcatatagtagtcactccatatgtagttaactgctgtctatctatcatcattgccccttttatcctcactcttaccacagtgctccatctgagaagagcttcgtgttcagactctgatttccacaagggggctcctgggtcaccttctctgggacccagcttcagagcaggggtagggagactccagcccgcctcctttttctgtaaataaagctttactgaagcagagtcacttctgtttccctgtgtactgtctatgctacaataacagcacagagtttgtagttgtgacagaaactacgtgacccacaagacttatgtattcaccatcttgccatttacagaaaaagtttgctgacctctggcctagagctatatctaatacctaaaagagagatgctcatacatatttgtttggagaataaaaatgaatgaatgaattcatggttgcaatataactatgtcctacagtctgggcaccatggtaatagattagctcaactggaattttcctttagttaggttttttttttttttttttttttctttctttgcaagtaggttctcttcattgagctaactggtatttaaagctgacaccctgattattaacttcatcagaacgtggctgtgtggggtggtgaagccccagggagaagaaaacaagag

SEQ ID NO: 31550 - DNA, 651 bp, Bovine  19866881294543
ccaagactgcagctcatgccagcagcaagtgcaatgtccactgggaagggtggccttgtcctgggcaggcagagtgcagtcccaggagatagtctgggttccaagagcttcattcccagctctctctgtagacccaggcagtcaggcaagccctggtaaacctggtctccaacaaagaaaatgtaaactgcatctctgaaggaaaaaatgccatcattaggcaaaatctccctttctattttggtgtcaacaagttaggaacagtaggctctcagcccaagaaaactatgcttgtgctgctgctcctttatcgcaattcatctttcagcaaataattactctccctccaggctccgtcatctcaaccttctaattatactattgttggttttgatgtcaactgaacaataaatcaaatgtggagcagaatgtatgatggaaaaacatactggggagtaagttgcggggagcacagggcataagggaaggcacagagtgggggcttgttctctctttttctaagtttcgcttcagaacaagcttcccttttctctgttaattctgttaactttagggtcctgatctgggctatggaggtaactgcatttgtaatcatttccctccaaggggccttgagagaatttaattaat

SEQ ID NO: 31551 - DNA, 821 bp, Bovine  19866881384994
caaaaccacagttagaatggattttgtttcctgagccagcctcatttcctcagaaaagggcttcattttcccaggaagtggtttctttcattgaatctgaagatgagtgcagctttctcacacaccaggctttccctgtgcccagtcctgatacccacagctctcacttcctggccgaacaggcagacaactgcatggagcatcccagtcctgcccccgtgatttctagaccgtggatggaatgcagacgtgaggctggctatgccctggagcaattcgggggtccctaaaaccactggttttccaagaaggaatgcatagaggaggcatatggtttttataactgacaagacattctgattcattagaacgaccagaactgtgcatgagtgaaagctatgccgaggactccccctgaatttacagccatgaccacgctggcttcgggcgcctccagcaaatcatctagcttctccggctgagttatcaaatctctgaaactgaaatgaaattgactccgaggagccagtgagacaagggctgtgagatggcccagcacgttgcctggcacacagggaggggccacagttcccggtccccttgaaggactggagaaccagaggggcaactccccgctctctgccaacccatggcagtcgacagtcaaattgttctttacgcgccacttttcctttaatcaggctgttctttactcgggctgttttaattaagggtccgctgtcaacacaaaacatatgttctgaagtcttgctttggttactaatgaagcccgggattattaagtcggaaggaatttccag

SEQ ID NO: 31552 - DNA, 1112 bp, Bovine  19866881424003
gatgtcctggaaccaatgccccatggataccaaaggaagctgtatacacaaaaaaattgaaagaagggtcttgaagaggtatttgtacacccacactcatagcagcattatttaccatagccaaaggtgaaagctacccaagcgtccatcaacaaatgaatggataaagaaaatggtgtgtcgaaagaataacatttagtcttaaaaaaggaaagaaattctaacacttgctacgtcctggatgaacgtggaggacaggatgctaaatgaaataaatcagacacaaaagggaagaaattgtatgatctcacttctataaagcatctaaagtaattgaactcttagaaacagaaaatacagtggtggttgcctaggagctgggggaggggtgaaaaagaagttagtatttaattggtacggagtttagttttgcaagataaaaagagttctgtggatggatggtgggtgatggtggcaagaagtgtgaatgctcttaatatcgctgaacagtacacttagaaatggttaagacagtacattttatgtgatgtgtattttatcaccattaaaattttttaaaaaaactttctaaaccttccatccagaaaactagactctcagaatgttagcactggctggggcctactctgagaggagaagcgtcagcatttttttcccgacatgggccccttctactcacccctcccgcccctggagtgtaacagatgtccaggtgacagacatgttgtccccaccctgagatgctccgtctggcctcactaggctttgctctggcccctggctgctggataattgatgatgactcacagaacaggccagaaatggaagcagcaggctccagacactaattagatcttcctactccccaaaggttgtactggagcctccttcataagacatcaccagtgaagaagtgacatgggacaaatggaacgaccacctctactgagctcttgctgtgagccagatccttaatgcatgctgtcaccttgaatcccccagtcctatgtaacagatgtcagccttgtggcgtcttaggaatggagagcaaagcctcccggttgtcacggccagggccaggaccacgtgcg

SEQ ID NO: 31553 - DNA, 1223 bp, Bovine  19866881636074
tttctctaaaatccttttcatatctctcctgcatgatcaagtttagttagaatccaggtacccatttcagaaaaggttcccttgcctgtcggttgaagcatgtgtagtgggaaggcctggagatcgcatgctgccactaataaccttgactttatcatcgctgtttacaggtgtgaaccctgagtttaggagggagcatgccatttgctcaagcttaaccaactgttatctagttatagtagttttcaaacttctgagttttcttataagagaacttacctataaccctaatttgtaagttctcttacagcccaaaatacatccctttctaggaaggtgtctccttccagagtttcccaggcaatatgggaatcaagacagtgatatttaccccactgcctctaacataaatctgggggaaacactaagagcttgcaaagggggcaaacatataaaaatctctctgtttctttcaatctctctcacactaggagtcaaccaagcattttcattgttgaggaaaacccaaatgtcataaaagcgatctggatagaaaacaaaaactctagtttgggaaggaaagcaaatattcctcattaccaaagacaatgcctcttcagataaacatttacctaatccaattcttcttcctttctccccgttcctctgactttctcaggagccacagtggccctgttagaacagacggcgttcagcgtttccatcataaggcatgtttttctggggtttattactcagctgtaaaaatgtgctctaggcaaaaagttggcattaagtctcatctccgaggtaattggtggggatttaaaaaaaattttttttttctttttacagacagtcttggaaagggcaacaacaacaacaaatcaagaatttactgttggaaactatgaggtttcacccccatgggttttcctctttagtttggtttattcggtactaattttgttctcctctaaccagatacttgggggcaaatttataaaggctataacctcagacattcattgattcttctttctgcaaatatttacccagtgcctcctatagcccagacactgttctagactcaagatacaaaatatccatgcagtctaggcaatcatggggctggtgtacacacacattcatgcacaaacctcacgtgtttccagagtgggaaaaaaaaaattcaatttgcagtaagtggttggtgtggagga

SEQ ID NO: 31554 - DNA, 1460 bp, Bovine  19866880139047
tttcatcaagaggcttttgagttcctcttcactttctgccataaaggtggtgtcatctgcatatctgaggttattgatatttctcccggcaatcttgattccagcttgtgtttcttccagtccagcgtttctcatgatgtactctgcatataagttaaataagcagggtgacaatatacagccttgacgtactccttttcctatttggaagcagtctgttgttccatgtccagttctaactgttgcttcctgacctgcatacaaatttctgaagaggcaggtcaggtggtctggtatttccatctctttcagaattttccagtttattgtgatccacacagtcaaaggctttggcatagtcaataaagcagaaatagatgtttttctgggactctcttgcttttttgatgatccagcagatgttggcaatttgatctctggttcctctgccttttctaaaaccagcttgaacattaggaagttcacggttcacgtattgctgaaacctggcttggagaattttgagcattactttactagcatgtgagatgagtgcaattgtgcggtagtttagcacgagaaggcagtgatatcccttatggagaaaacacctgtgttaggtaagcttccttcccgcatgagttacagtgctgttggccccaagttcaaggttaatgaatcaaaatgcattttaaataaggtgtctttcaacagaataaaaagttccctattgatcagttgaggaaaatgtggcccgctggaggttggcaggacctaatgctgtgtgtctcccctgagtcctggttcagtattagctaattctgtatttgctaggacattatagaatagaagctggagaagggaatggcaacccactccagtattcttgcctgcagagtcccatggacagaagagcctggcaggctgtagtccacggggtcacaagagtcagcgactgagcgactaaaccaccaccatagaatagagcctccgcgaataacggggccaagtgcaaaagcacccacggtggctggtccagactcccagacggggtttcttgtggggtctcgggcctcttacgtggccagccggcctcgggtgcagtcagcctctctttgctaaccctgggcttccctgttctttcctgcagaggggcacagccgagcccttcctgaggctccacaacttgtaccccacccctcgctgtgcccggcaggccgccctgcccaggctgagccgtcgggtggtcagccagcactcctacccactcaaccgcttctcgtcggtgcccctggaccccatggagcgccccacgtcgcaggcggacctggagctggattacaacccgccgcgggtgcagctcagcgacgagatgtttgtcttccaggacgggcgctgggtcagcgagaactgccggctgcagtcgccctacttctccccgtcctcttccttccaccaca

SEQ ID NO: 31555 - DNA, 1858 bp, Bovine  19866880466718
tacgtagtgaatatacatacatttgaagagtctgtataatttgggatctggctgaaagataaaaacctttttcaaatggtccacccatcttcctcaagttggtatcagttgtaggctttgatcaaagcttccctagttgtgtttcagtattcagtagaaaaaatacttccagtcaaggaatctcatatgaattccagtgagttataccaggaatctcaggtatttaactatttgctatttcctttttattatccttttaatttttatgcccagaaatttccaaagtatggtttgtaggccaaatccagaaagttgcctgtttttatacagtcctagagctaataatcagagaaggcaatggcaccccactccaggactcttgcctggaaaatccccatggacggaggagcctggtaggctgcagtccatggggtcacgaagagtcggacacgactgagtgacttcactttcatttttcactttcatgcattggaggaggaaatggcagcccactccagtgttcttgcctggagaatcccatcgatggcagggcctggtgggctgctgtctatggggtcgcacagagttggacacaactgaagcgacttcgcaacagcagcctcagttttgcctcctggactgcaaagagtgaaatatttataaactggttcttcacagaagaagtgtgctgactgatctctactccagcctttagcacatttgcgtttaaatatttcattctccacagttctccactgtgctttggctattgtgcccttagcctgtcggggttcatttggtaaagggacaggagcacagcccataccagctgagggcagcagaaggaacgatcatgagaccctcacaaagacccctgccacctcagaggacaggcctatgccacagttctcttaacacaatcaatgcagcttacacacttgagcaaattctcttgcaccatcactttaaaatcataaatataaaattaattacacatgtcaaattgaaatcacgaggtaatctgtcagattgtctagagtatagctgctatttttactatggacacggtgcataaatagcagacacatgcagattgtcttacactttaaggctggtactaaaaatattagtactatgggtttgatttagttcaccatcgctatatttaattctaaaccttcttggggttatgtaatcatataaggtgcccaaataatagcaggtttactagctcacgtcagctgagcaatggcataatgaaaagaatcaggaccttgataacattatcttgaagtgctgtgagctacactccagctacgtgttccctttttatggagcagctgtgtctgatttgtagcagggacttcaagtctaagtctttcttttggaatttagtttctctaccctcatccctcctcactgtcccccaacaaacccaatttgtttgtgctccatttcaacttttagggactgattaggtggagagagagagaaacagacagacaaagagagaagcaagtgacatttaaagagaataatcgtaacttcacaacagcagtgcaggaaactagaaaacaacggagcaaggccttaaatttgagggaaaattattgccaaactgtaacatcatatctaacaaaaaaaacttttaaagctacagacaaaaaggtctcaaagaactggcctctcatgtatgtgtcttcagaaaagttaagagaggatatatttcctcaaaactaaggaataaacgtttaataaaggaaaatatgggggccaagaaataggggctctaacacaggaaggtgggggaaagggcttcctaagatgaccatgaaaatcaatctcaggacaacagcaa

SEQ ID NO: 31556 - DNA, 1799 bp, Bovine  19866880521050
tcattttattacagtaccaggaaagccataaatgtatttttaacatcactggactaggatcatagactctgaaaattagatttggagtaaataaaatataaatggccactcttttcaagactggtttagagggtacaagtagtatttcaacctttctacagttaaaggcataaacataacgcctcactgaatctgccctaaatttttattgttgagaacttctaagaacttaagtaaacaagccaagcacgagaatttagcgagtactaagagcctgccaaaggtgaagtgtttgatcagagcccagcaagtttagttgtagccccaggacaccacctattgcgtttatttttggcacctctgaaagtgtattacatttattctgaacaagtcagtagtgcctgacggaagaatgaagacaataacttgcttgtgtaatgaaccagctcaaccccacaaccaagagaaaatgtttcaagacagtactgaacattcaccaagtcggtccaagggaaaccgaagcacgcccgcaggaaaaaggaagtgagcatggaacgaccaccttccggtcgattaagtgagagcccctctccaccaatccacactgcccagcacccactccaaaaactgctcctcgtcaattccgagctaacttcttatcttttctcctgaattaataaaggggaattgaaaatatgcagttttatttataaatgactagtggataaaacagaatctgcaacaatattagtgtggagactgttcatctcattgtttaaacgatgatatgccaaaatgtagaagcaccaaaaagtacaatacagatgactaaataatgctctttagaagcatgagctcatttaacgcttttgaagtatcaccttcattattaattacaggtgataataccaaaattcaagagaatctgaactggatgatccctcaggtaacagaacaatacaacagccaggtcaaatttaaatcctggctacctgactctaaatcccaagtattaactagtgggctagaatatctcctacagatatataaagtcctctgaaaattaagtcatcctaccaaactctctctacggtcaagaataatgccaagaaatgtctttcagctacagcccatttctctgttccctttcatagcaaaaccccaactatttatataattcaccagggaagtcgcttgggcctgaaatttcctacaactatctgaccttctagaatctacttcaatctgtctttcaggctcaccacaccagtgaactttttcttccaaggtcaccggattcttctgtgttgccacgtctaaaggtcagttgctggtgttcatcttacttaacctagtgacaacatctgatagtgcgaccgacccttgaacaacgcaggcttgaagctcacaggtccacttacacacagctatttttcaatacgaaatactactgaaaccaacctgcaattagctgaatccatggattcagggctgtggatgcagaagaaccacattacacgaaaggcaaactacaggttagacccgagttttcaagcacgtggggggctggcgctcctaacccctgaaattgttcaaggtcaacgggagaccttcatgtgacttccagaaccctttcacttggctctcctttcccagaatttagtctccctactaaattctcttcattgaccaacttcaaaattcttgagttgtccctgggtccaatcctcagcaagctttccctctgtgcctctttctcctcttatgatttcactttatctcaaatcttaaagtactat

SEQ ID NO: 31557 - DNA, 5039 bp, Bovine  19866880638080
gattagtttgagcatgaagttgctttctgtttctgtttctgttaaaaaattctgctgtttatccttaatatagagctaaggaaatccatcttctgtctatagatatctttccagtacactttggcttttagaatcttgttgtttagtcgctcagtcatgtcctactctttttgcgaccccatagactgtagccccccaggctccttggtccatgggattctccaggcaagaatattggagtggttgccatttccttagaggaaagtaatgccctagatagtaatagactaagattcttgacctcctagatcaatgtcaagtgtgagatcatagctgatgcctgacatatataggaagcatttgataaatagtagttgtaccgtcatgactctggcaagtatcagaaactcagcacattgtgcaaaataaagaatttgttaaaacagggtatcttctagaaacccaaggcaggaatgcagcctattttgaaatgcccaccctgcctttgcctctctgtataatgtaaccattcattgtcattcattcagctcctacacaccacgcatagtgtttgcagctggaacacaataggaaacacaaatggatttttaaaaaatgtttttacagtgtaagtcccagagcttacagtctagtggagaggtacaaatcaatcacacaagtaaatataaaaccacaactttggcaatgctgagaaaggcaggtacatggtgtgagtatgtgaaaaaggaggacttgacctacttggggaggccagggaaggctttcctgaggaagtgagggctgagcagagatccaagtcaaagcaagcaataataagatgataggagaaagggaagaactttccaggcatggagaggagtaaaggcctcctggcaggaggaagcatggctggagagcagagagatcaggggccgaaggtcacaataaaaccaaggtcaaaaatggggaatttagcccagagccacacattccattctactaccaagccatcccagccaacaaacatcaccttctctccactcagaactttccacagagggagttccctggcagttcagtggttatgactctgtgcttccactgcagggggtgtgggttcgatccctggtgggggaactaagattccacagcctggccaaaaaccaaacaaaaaccacaaaatttttcatggagacaaagtttcatcagttaacactcacacaaaaggatacaaatgaccaagtagaacacaaactgagaaccttgccacagaactcaatttgttgtttccttgttgagtttgaccagtcggggactggggagccctggggagtagtctgtcagtggtactcaaagtgtggtccctgggccactagcagcagcagctcctgggaacttattagaactgcaaatcctcaggacccaccaacgggtttccctggtggctcagatggcaaagaaactgcctgcaatgagggagacccgagtctgatccccaggttggtattatcccttggagaagggaatggaaacccactccgatattcttgcctggagaatcccatggacaaaggagcctggcagactacagtccatggggttgtaaagagtcggacatgactgagcaactcacgcacacacaggacccaccaaagacctgtgagtcagaaacttgggaggtggatccagcaatctgtattggaacaagcaagacatcctgcaggggcttctaaaacacagaatggtctgcatgagatattttcaaacctgtccaatcatccaaatcatctgaggaacttgttaaaatattcctaggctacattcccatatctacaaaacccagaatctcagggtgggaacctgtattcaggtgatcagcctgatgtgggagccactggtcgacatcaaaagtcattcagcatctggcatggtgagcaattaatcttcatatgccacttttccttgctaggtggattaagggcagtaagtatcacaaactctacaagccaaactcagtacgtaatttgattcgtatcttctatcttctcagctctttgattttaaaacagtacctttcagagagcttcttctgatgctttttgatgaatgtctccttgtctgtctcatcatcatacccaccaaaaaccacatgagatctaataggcgcttaccaaattcaaacattgttaccttagttgtggtcaaaaaactatttcttgaaaacgtccccaacattccaaaatattcaaaagaaaagtgcccagcctagtaacacaagtatggatctaaatcagttttttctttttcctgcttctgtaaggaaatagatttctttcacagtgatttggcagtgttttaaacatacaaataaatatgggaagaattgagacgaagtctaaaaacaaaaactaaaaaaaatatttccagagttgaaaccataaatgtaatcctagatttattttcaagcaacagaatttttaagaattttcctatctttaaattcttccatatcctgggatttatgcagttcatctgccaataacattgactggtctattgtaggtaattttacatgtctcagaaactctcaaacaagataatgatatatgacttcagttcagttgctcagtcttgtccaactctttgcgaccccatgaatcgcagcacgccaggcctccctgtccatcaccaactcccagagttcacccaaactcatgtccatcaagtcagtgatgccatccagccatctcatcctctgtcatctcctcctcctcctgcccccaatccctcccagcatcagggtcttttccagtgagtcaactcttaacatgaggtgacttacttcactcaagatataaggccataggccagtgaaaagggacaaaaaaaaaatgagtggtcactaacgttaaaaaaaaaaggcctcaattattagttatcttcagatagtttaatggttaggggaagcaatctctgattgtgtaaaaccagaatttgtgaagtggctgctgctatcattcccaataaaacaaggaagtgggacttgcccagtccagtggttaagactccatgcttccactgcaaggggtgcgggtttgatccctggtcagggaactaagatcctgcatgccatgcagccaaagaaacccccccccaaaacaagaaatttcagtagttttaagaaattggagaaaagtgcataggaaggaaaaaaagggagccttgattaaataactgtgcctttgaagatattaattcaaataaagcctgtagtttggctttacaaattaaagcacaaaaataagcagaaaaacatgcggatactgaactgcaaatattgaacccaggaaatgatggtattccctcctaataaccagaaatcaagttgccagaaactggaatgtggaaaccttcatacaagggttgcaagatcctgaagcgaagatgtcatagtttttccaggatttgtacagacttaggtaagtcagctggatacagaggaccaattgaagagacttgctttttttaaattattatttatttctggctgtgctgggtcttcgttgctgcacaggaattctctagttgcgaggagtgggacctactctctagctgtggtgtggaggcttctcactgtggtggcttctcttgttccagaggacaagctctaggcgatcgggcttgagtagttgcaacacacaggctcagcagttgtggctcccaggctcgagagtacaggctcagtagttggagtgcaggggctcagttactctgtggcaggtggggtcttgccagactagagatagaacccgtgtcccctgcattggcaggcagattcgtatccagtgtaccaccagggaagtcccacttgatctctttatgagatgacccagcaagtgtcccaaacattagccacaccagtgcgtgtttcacaggacacactgcactgcacacacagtctctaggcgtacagctctaaagaacagaacttcgaggtggggtcttttgtctgtgcatcagagtatttgtcttctttattattccgtttaaccatacttactgattttcccctcttccaattttgagaaagaaagaatccttcgtttgctaggtcactcccaagctgcctccaggtctgctaacaagagactgttcaggagcaagtctgccctccagagctcagcttccattagaagtggcttctcttctggcgatctctcggtccatttcaggcttatacatcaagcagtcaccagacaaaggaagtgaataaggcaactttcaaatgctaattcagactgtgggctgtgaaaattagaaaaccctcagaagaaagactgccctggcctgtccatcagtgggggtcttgcctcccctctccctgaggactcactgaccctagcacccagcagtggggcagagctccacagagcaccaccatcttcacacttaaattcaaacacactgtcctcctcagaatttaactctcattttgtaatggaaaagaggaaggtgttagtaaatacaagaaataggttgagcttttaaatacatccaaaatatattttccacttctcatacacaaaatgaggcacaatatgaaatatacaggatgatctcaactatgttatcataaaaagttatagaagcttatctgattgtaaggagttaatttataaatgatagttttgttttttttttcaaatccctatcttctagggatgtatactaaaatatacagggataaaatagtaagattcttgagcataagcttcatattagcctccagtggggtggggtgacgtaaggtgggctggcatggctaaggcgtaactgaacatgaccggccacggacagatgaagtgctgacgctgcagggcgggtgggaagaagggcatcactacatcactctctttctatacgtcacatacttttacgtgtgcttgaaattttccaaaagaaaatgctttttaaaaaagccacagggacttccctggctgttccgtggttaaaactccatgcttccaatgcagagggtg

SEQ ID NO: 31558 - DNA, 1754 bp, Bovine  19866880656910
ctggatgactgagcatgatctcatcttaagatatttcaattacagcagcaaatcaggtaacattcacagatgccaggggttgggggccaccattcaaccatcacagagggcatcattcagagcatctctgggaagaacacgaactccttcgtgaatgaccatgatcccagtatctttcaagtcccatcacccactacttcccctgacttcaacgtgattagttgcttttatttccacaagtgatggatttcccatacctctatgcttttgtaaatgttgtttcctctttccattttaatgaatcaagttggatgctggaaggaaaatcaacaggatggaatggttgtagggagcaggtttagagggtaatgtgaacaggctccgtggttccaaatgttcatatttcattttttggctgcatgcacagcatgtaggattttagttccctgaccagggatcgaaccctcactccctgtagcagaagggtgggatcttaaccactggactgtcaggaagtccccaaatattcatatttcaacagtaaaagtttcctctggacaacctagctctgtcctggaggtccctttaccactttgtctggctttacgtaagttgcaattaaaaggtttatttgtgtgacatatgacaagttcctctctgaaatttgatttcatgtttactcatgaatagcagctgctctcaaaagtgattcacttttaagtaaattaaaagtttgtctctgaggatatacatatcctaaaggtttattttgttttgtgtctcaggagaagtaagtggggaagaatgagctggatattcataaggctgcaggtaacttgttttgaacactttcagtagactgagagaacagcagtcaaggggagaaatgtttgaatttcaatgggaattgtcaacatggagtgaatgataaggacaccagccacaagatcagtgtccttatatctttcttttattgcttcattgtaattaaagcctaaagtgaattatgaaaatatgcaatccaacagcttctgccttggatttatgcctggcacgctgtgaaactgtggtgtgatgattgctttgtattatgcatgttgtactataaaggagggactttaatatgtaatacggagtttccatatgatagaaatgtatctaccaacacaaaggcagtttaaaactgtattgcttatagaagatcataaatagatgaggagaaattaagaggcagggaggaaaagaagccattgtggggcagacacagaaaaggtgaagaatatctggtgcataattaaacacatattttgggcaggcaaaattctaagatgatgacccaatgaccttgtataatccctccctttgaaggtgggcaggatctgtgactatgataggtgtcattcctgtgatgaggttgtgtatttacagcaaaggttaagggatttttttcccatcagttgattttaaattaatcaaaagggaaattacctgggtggatctgaatcagaggaaactcttgaaagtgttgggttctcctactggacttgaagaagccatcatgggttctataactgcaaggaaatgaatcctgccagcaaccaggtgaggctggaagagcacttggagcctcaggtgagaccatctcatagcactgatgcctgactggagctttgtgagacctggaacagaggacccagctatgccacggctcctgatccagagaaactgggagctaatgaatatgtatatatata

SEQ ID NO: 31559 - DNA, 2474 bp, Bovine  19866880685931
tattttagtacaggccaaagtagaaacttaagaggaaaaatagtttagcaagttagggatcatttgttagttctcaagacatgtccaagtagctactcctgaaaattaccctaaactccaatggatgatgaatgacaaaaatatttgtttcatttcatttttaagaacttttatttctcttctccatactccaagaaaagtaaaaagcctaaatattttgctatgattcccggagtggtgggtaaaaaggacgaggaactgtatttataactcaatacagccggccttctgtagctgaggatgcaaatcgcgtggatagtaaggtccaactgtattaataccactttatttaagggacaggcacatctgtgaatttcattttgtataagggacatgcacatctggaattctgttgtctgcagggggtcctagaaccaacgtcccatggatgcccagggatgactgtattcaaaaaagcaacaaagaaatacctttttaattcagattcatcctgaataatttcccattaaaaataaaaatcaaagatgaaagcaaacctatggcacccagaatggctctgaacaatgcttagtttagagaatgtaccagacaccatgacacggcaggatctaaaaccagattctgcttttaaggtctagttctactactaagtgctaccgtggtcaagttagccggtctcttcaacaccttggcactctcatgagaaaaaaagataattatagcaacagaagtatgcgagataatctttaaacacttaaacgtggcttgtcccaaagtacaattcaatacattctattattattttccttactgtaatcattcaaatagtcacactaaacagaaatgtacggaagttatgtgaataagcacaacttttaataataatctgcttcaccaattagattttaaaactaagatttatggaaactaagttcatcctttatcctgataggggtatctagctacatcagataaaaagcactttctttcattgtctttgatgtcttcaaggataagaacatttctttctaaatgtcattcagctgcaggtaaaacatgtaatgttcataaaagtgctaattagaacaaattaaaattaaacagcatcaaaagacatattaaaaatatgggagcttacagttttgggtaactgtttatacataagaattttttttaatttactgaattttagatgcagtcaaagtatttttggagttaatccttagggtactcaaatcagtctctcatagatgactgtcaaccagcagtgaccagaacatgagtctgagtttaacaaaagtagaaaaatgcacttgagcagaacatcttaagttacacagataacacataaccatttaaaactaaatagtttttgaaaaatcttttcccgtcttcctcatataaaacatgattacagaaggttatatatttttcctcccaggagatggggagaccaactgtagagtggatacaactgaacgaagtaactgttcccctccttccctttatctatttctcttggccctcttttacactgcctggacatttttagttggttttctctagatttttttccatacagctttagattatttcacacgtattgtttcacttcattggccaaagaggctaatgctttcaggggacattaaacaataactcttgggcccctttctgcccataatgtctaatgactggcttagatttttttgtcctttaactgcttggcccaacacttatgcacactgaccctcatagacttctgtgtgaggtggatccacgtagataccgtgtagaggtcttgacaccatcacttcactcatgccactcagatgctgccatccacctcttctcccagaccactctcctctacagagggcaggtgttgcctcagtactgattcgaggaactcctgcctgagcttcccccacagctcaggaactgactgctgcctcctgcttcctggtggagcccccatgaacaacaagggctcatagaaccccacagggatgtgtgaccgagacgacgggaggagggaactgcgggctaagcagtcactgtggcagctcagagtggggtcctgggcaccgccaagcccttgaatattctcgaatcatatcatatacatcttgattaaaaacaccttaatagtcaagtatttaagaaacagaatacaaaagccttttcttctcattacgaactgaaatatattcattaatttaaagtaaacaccttaataatcaagtatttaagaaacggaatgcaaaagccttttcttttcattaagaattgaaatgtattcattaatttaaagttgaatttgcttttgagagcttaaaggctcacacaggttctacttttgtggatagaatgctttaaaaagtagaagagaaactgctagagatgaccgttcatataataaaactaactcagtttcctaacagaaacactaa

SEQ ID NO: 31560 - DNA, 3484 bp, Bovine  19866880697031
cccatggacagaggagtctggtgggctccagtccatggggtcacaaagagtcaagacacaactgaagtgattaacactttcactctcagatgtcacagcatctgttttatcagcacaaatggtttaactgcatccagggatggagagaaatttgcacagttttcctcccctggaaaaactgagagaagcaaatcttgtctcttaggaatctagaaatgtttgttcttcaaagtaaagctttactgtaatgaagggacaatgtgggtttcctgtaaaaattcttacttttgatccacagtcaagaggattcttagctataaggaccatagctttattatcttgcaccatcttcagactttgaagaaggacatggcaatccactccagtattcttacctggaaaattccttggaccaaggagcctggcgggctacagtccatgtgattacaaagagttggccacgactgagcgactgagcacatcctaagccttaagttctgttaaatctctgttaagggacttccatggtggtcctatggttaagaatctacctgccaatgcaggggacacaggttcaatccctggtctgggaactaagattacacgtgctgtgggacagctaagcctatgtgccacaaccttgagcccacaccctagaacccaggctccacaacaagacaagcaactgcaatgagaagcccgcaaattattattatttaaagaaaagccctattcaattgaggacagtctatggcagggctgagcgtggatctgagggtggtcttctcaaggtgggggcaaatggaaggcccttggaacctggttgttctgtctgtctacttgcttgttggtccacctgggtgaatagtgaaccgcagtgtaaaataaagagcctttgaattattatctcacaatgtgaacagtttttatagcccattctaggggatgatgaactcatcaagggaagaaagttgcctggctgtgagagagccgggctgtgattgggtgtctgtttcaatgatttatagtcccttttaatgcagttgggattgggagcaaaggtcagagtgggtctttcaggagacacaggagagtggattttagatataaattatgcaacccttaaagttcaacacagatacaaactgagcggctctttcatggtgtttggggttatgactgatttgtggtctgcttatgaatggagataggtcaccttccagttctgaaactattttttcacattaggacacccataattaattaggagttcatgcagtgaggtcatgaatgggattgcttggtgctttgacccactaaatctgtgttcctgcccacagggccccagtgatagatctctttcagagttcacagaggaattatgagggcttgtctctgagtccagcacgaaacacttttatggcaccattaaaactggagcctgttcaagttgcagccaggaagcttcttttgtctaagataaatcatacggcatattttatttcaatctgagatttaactttgagactcctgggtgaggcttttgtttttcaaatattttggatagaattggtttacttttccatgagagggtaagaaggaattctaagcagctcagccttcacccagtcgagctaatcaaatgaaggaagacttagattcatttgcttcatcgctgtgtgacagctggaaataattcacctcctggttactgatttgcacccctctctgatgatagcatggataccgcagagctttagcttgagatgtgtctgaaatctggaggaagccccaggagccagggttgttacttttaccttggttttgatgctaaacagtaaatactctgaggggctggggctctgggaaagtggagattttattttgaagccccagaggctggctttctacatcccattagagggaaagtcaccacaggggactctgccaacactcgttccctgctccaggcctgtggggtcggtgctgtcgcctcgtagagaaccctcgtttctagtctctgagtggcagtgcctacacgttccgaccatttgttcctgaaatgtgagatttcatactaaagttttccagagcagattggcgtaccccagggcataatcatcctgtaatgcagtggacgtcttgtgattttcagagtctaccgttaggatttgcaggttcagtgtgatctaaaggttttaaatcaaaatcctctcttcgtgtgggtgtcttccaggaaatgctgcaggatttttttttctcctcagcatcaaaggaatttctttgtctcttcttataacccacccgcacccacccctttcctcttcttgtccacttgctcccctttcttgcttcatgactctcgtgagcacttttttctccttcttctgtacaggagaaatggaccaagtcagggagagctggagggaaggagggacggggaataacagctcctgtctactgggtacttcaagctgagaggcactgcggtgtcctgtcactaaaatttgttgagcagaagtgaccgccatccctgtgttcaacagggaacttggactcctttgagggtaaggaaatggagagtgaactggctcaagcttggccaagagtgaccttgggtcagcctggggcacccagccgtatcgcaccacggcgccccctagtggatgcaagactgacctgagcggtaggaaaggaatgtctgttccttgagaatcaccctgcgcctatagcttgcgtgcgctcagtcactcagtcgagtccgactcttgaacagtatcccaccaggctcctttgtccatggcattctccagacaagagtcctggagtgggttgccatttccttcttggtgagatgttttcacttatgtgatctcagtcttcacagtatgttcaaagtgggtaatatttcttccattttactcatgagaaattggaaactaaggtaaaataagttgccagtggctaagctatggctacattttaaaaaaaaaaagtaaactctatgctctttttttttttttttttaattatttttactgctccagatctttgttgctttctccagttgcagtgagtggggcgccactctttgttgcagagcatggacttcagtagctgtggtgcacaggctgagttgccctgaggcacgtggaatgttcccggaccagggattgaacctgtgtaccctgcattggcaggtggattcttaaccactggacccctgaaaagtccctgtgaacacatttgaattgaggacactggtgcctctaaaccatggtgactggtcctcattctgggtgagtgaattctctgagaatttggtactttttgctggttttgggaatttctgctgtggcgaggtagagcatgtttataccaaaaccattcctaggcatcagctcctgatcctgttgtttcgtatcatctattcttatcctgaagtaggttctcatagacagaaaattaagatacgtaagtactt

SEQ ID NO: 31561 - DNA, 1506 bp, Bovine  19866880805945
aatttctgccaaaagtagaaattagtaaatgagtgaataagtaatcagacctctgtgtgagatgtggcccagcacttgagagaatagcatctcaggaactatgccccattttactggtgagtggagaaggaaatggcaacccactccagtattcttgcctggagaatcccagggacagaggagcctagtgggctgctgtctatggggtcacacagagtcggacacgactgaagcgacttagcagcagtagcagcagcagtggaaataaatggcttgcagcgacccccaagggattaaacgccagagcaaatttaggtcactgcttccagctctgtgttgagctcacatctttacccaaggcattggttgatttttaaagtacaatttatgtgtctgggaacttcattatcttttgtggaagaaattgctgccgaagactcttattattctctggagggaacaaagctggcaagagtttagttttttccaggaaatactatctgataagtcttattagttaggttgtgctggtatgtgaaatgttaaggaccagttacatgtctttggtaatcccctggaagatacgtctcctccacttgttttggcaaatagtagtattaacttccttggttcttcatgtttaaggaggctgaatctgttttcagcgactcgtaatacaattgccttttcttctttctaagaataatattcagcaagtcttccagaagttccacgtcttgttaaaggaagagtttagccctgaagatgttcaaatcattgcttgtccttcaatggaacaggtaggcgatccgtgttacttttataaccttttagttatctcacttgagtagatagggtcttttgagttaccatattttgttgtaatttttaaaattacaacacatttggcaatggtgttcaaagtttcagttgcttcttttttgttttttggccacactttgtggcacatggggtcttagttccccaaccagggatcaaacctggccccttgccatggaagcatggaggcttaaccactggaccgccagggaagtcccctcagttgctttttaatgctttctgataattgaaagttgctctgtttaaaataaactctttgtggaaaactcaaatagtggtatttaggttgctgcatagttttgtttgcagtatgtatgataagaggcccatgtttcaaagatgttagaaagaggtcctctttctctcttcttcctaaattaaaaaaacctgaatagagagctcagcctgtgtttactgtcatcatttattcagttctgtcggcaaactttgattgagtagaagtagactggcgccacagagggtattttgtttatggttttaagaatcattgaggagtttagtgtatggtaaggactagagaggagagcagtaaggttggtgagcgtctgattggtttgcgttgaatctgcagggagagagactggaggcagtgagtgtggtcagtctttgaagagttctgctgtg

SEQ ID NO: 31562 - DNA, 1321 bp, Bovine  19866880809393
acttaggaaatgcttttataggatcccattctttattttggaaaaaatacatatatgatgtccacatccatcaagctttcagggctttttatgacccttttaagaccacatcgtctggaaccccgcattatctatctcaaggagacatcgggctccgtaactttgtcacctgcctcctggtggggactgatcacccttctccgatctgacggttgtcactacatcattttgagatcggtcagaattccacaggcagattcttccttcggacagctccgattcctcctgtgatctgaaaactaccctttccagccggcggcattttaagagcatatttctaatagatatcttctgatttcttctcaagttcccctcttttgaatattttctttgaagtcttttctgaccctaaggaatgccaggacagatcctaaaatcagacatgatttacttgactccaaaaaaaacacatctgcctcctattttaaaagtccaagtgcagttctcatggtcatgttggagcagttgcttcactgtgctcagtcacgtctgactcttttcgaccccatggacagttgcccaccaggcctctctgtccatgagattctctatccgtggaattctccaggcaagaatactggagtgggtggccattttctcctccagggaatcttcctgacccagggatcgaacccacgtctcctgcatctcctgcattggcaggtggattctctaccactgtgccacctgggaagccatgttggagcaatagcactggctaaacagaagcttcaggaactaaatgagatgggatggtgtctgggtcaggggactggaaagccaaagcaagagaataactgaagaaagataacgcgaagatgtagttccaagactcattttgggtgcaaaagaaaaacatactctacttagcactctgctttcagtgtggcatcaatgaatgccaagaaagaaacaccatttcagaatatctgaaattcaactgcaaacttgcattaacacttagcaaaaaaggaggggaacacaaagtgacaaatttgcttggagtcttgtgggctctcttgtagccaaatcgctgcttcaagacagctcatcatctctgtaagagcagcaactgcagacttgtcacattccccgatctctgctaatacaagctgagtggttacgtccgctctccccggtcggcagcttgagtcccgttctctgcaacgcagctcgagacgaagagccctctcaggggactaatgaatgactgtcgtcagtgctctggactggagacggggaataagcgttaacgtaggaa

SEQ ID NO: 31563 - DNA, 1649 bp, Bovine  19866880875026
atttccccccagctttcatttggttctagttaatctcactttttaatttttcaaaggttgccaaaacagcgtgttaaaagttaccttatattttcggaaattctctctgaatcccagcccacactgatggccacatcctgccagatatccctcatctattattccagcatttatagtttcatggagtctctaatgaagtagccatttgcttgagttgcttagtctccatagcaacagtatcttggttcgtgtatgcctgggtagcttcttacagcttgacatgatatgcagctaatatttctgatttttcctcagaagcaactggaaatttgcagaacgatattttaaaatttgctgaatagaagttgtttgattccactgttgtattctcttggcacccatcacatagtcataggatcatagacactttaatttggaaaagtgattcatacttgcagtatatatcacagggactggctagagaaatgctgcgtctatcgtcataagcagcttacttaatccctgacctaaataattttaggagtaaaagaaagagagccgaggttagcaattggggctgcttgatgacttggatgcttagctttaaacatcttaaataattctggttataagtattcaagttgcagtataataaatatgaaaatggggaaagtacttatcacagtactttttccagtcttttattgtgagatttctgttaggtcagcctctttgaactgcattacctcatttatttcccctcctaaacacccactctaagttccttccatcactactgaagctaacagttacataaatctgttttcatttttaaaatgggttttcttcagatttcacatagtgaaaacatgcaccttgcagaaaatacacattctctaatacacattatttggacaagacagtgtagcctgttgtgatagaattcatggtttcaagaatctgatctcatcttaaatgataaaaaattattgctgtaccatctgttgtagaatatgtaaaagctcacttaaaaccaccaagttcatttcacacctcaattgcttttatcaaacacactccatactttaacccctacctcatatatgaatgaatgaaacccacagatgcccccttccctttagttatcatcttgatctgtatatatgcagcaaactcaacaaattctgactaatttctttcttggctctgaatattgaacctgaagaagcaccagcatattttagaatgtgttcattcaaatatatatatgtacatatacatacatactttttttttttttttcactttttcctgcccaactcaattactgaatgaattgcactaggagaccaaagttgctgtctgagagtgttaccttggatttttccgtggacactcacttcaccctcacctttagctagcagcactggagggacctaagggcttccctggtggctccatggtaaagaatccacctgccagtgcagatgggagatgtggattcaatccctgagtcagaagatcccctggagaagaaagtggcagcccactccagtctcttgcctggaaaattccatggacagagtagcctggcaggctacagtccgtggggtcgcaaagagtcagatgcgactgagcacagatgcaca

SEQ ID NO: 31564 - DNA, 1573 bp, Bovine  19866880916197
ttttctgacatttcactaaatgtgatctgtactaagacacatcagacaattcatatctgatatactgaaaatacttgatgtgacataagatggggttttttaaatttttttgatgtttactgaactcaacacttgatattgcattcagtttgacgatgtccctttaatatatctgttatatttctttgctaatttcatttcctccattttctctgttctctcttttttgatctattagaggttgattcctagattgattctttaagggtttaaccatttctctcaatttcctacattgcctttttatatatatataattattcatttggctgcgctgggtcttagctgtggcacgcagggtcttttagttgcagactgtgggatctagctccccgaccagcggtcgaacccaggcccctttcactgggagtgggggggtcttagccactggaccacctggaagatttcctcatctttattttacaatccttcaggataagattttttaatcacagtttttccatctctaaaaactctgaatattgtaattagcctccaattaaaataatttttaaaaaaacgtgatttttcatgtttctcagcatcttcttctttctcaggtgcgccccctttgtggctttctcttaggatgctaattagagggtattgttgctgtcgctcttttctataccctgaattacgtctgttttctgtttcttgtgaactacatctttctcttttgtgctaaaggttttcctaatgatgattgcttatttgttcacattttttgaacaagggaattgcatgtttgataggagctctgtgtgtgtgggcaggatctttgaactaacagacttccctttgtggcaagcaggtggaaacctggccatggttcttggagatcctgaaatgccagcatgtggagaacctaaatatggggcatcacctgttctcactgcccccgatgttccccagagtttattcagtttttttttaagagaaaaaatcctatataatgtcatgttatgtttcagacagtgagatcacaactacccaggaaagtaaatatcatctcagtgtttcagagggatacatttagccttgctgctgctactgctaagtcacttcagtcgtgtccgactctgtgtgaccccatagacggcagcctacaaggctccgccgtccctgggattctccaggcaagaacactggagtgggttgccatttcccttctccaatgcatgaaagtgaaaagtgaaagggaagtcactcagtcgtgtctgaccctcagcgaccccatggactgcagcctcccaggctcctccgtccatgggattttccaggcaggagtactggaatggggtgccgttgccttctccgacatttagccttagagaggttaaataaaacatccagggtctcgcagccaatgtgaagtgaagggagaattaaactcaagtctctctaactccaaaagtcatatgctcctaaccacgagaggtgggtggttttggtggagcttggcttacagccctcccccacagatcgatctttgttctggtcttatacagat

SEQ ID NO: 31565 - DNA, 1305 bp, Bovine  19866880987759
ctcttgcaacctctatccgtgagctgtgggatcctctgctacaatttgtgaaaaccagtcctcaggagaatgtgaaatttctccttttctctacagaaaacctttcttgatccatcattccagctgttgtgagcaggaaatcatttacaaaaaggaatgctaaacggaaaagcaattttaagaagaagtgtttaatagccttcaccagcagttccctgcctggccagtgagtgagggcagggaatatgagatgagccctgtggaatgttctggtgaatcctgtgaccttgaacacttagccatcccctcacataaaagccagcagagccaatctgaaagaagttgctgtcagccccagatgactgagaatttgaacatatgtgggaatcatgtaccaatgggtggaggagttaagtttgaccaattctaatagtatttcacctatattatatatatctcataacacgtatgtgcacagcttatacttaaacacagtgttttagcttttctaaagcagtttgatatctaattatatcattaaaatcagcacgaagacttactggtcactgcttaactgaaactttggtttagttttagcttgtaggtgaaaagagtttcattgattaatgacatcgtcatgctgatgtaataatgagtaataatgagttttgaagaacggacagtggaggcatatgttcccaggctccaggccgtagaggtgcaccacgggcactggttttgcaaatgccagcctggccgccacagtggtgggggagaggaacccacctcttgctgctgccctctgtgaaccaaaagcaaggatcaggaataaaacgcagagcgagttagaactatcaaaccccgtcacctttaaaggacattttgagacttatttagttttagtgttttgttttaggggcttcccttgtggctcagctggtagagaatccgcctgcaatgcgggagacccgggtttgacccctgggttgggaagatcccctggagaagggaaaggctacccactccagtattctggcctggagaatcccatggactgtatagtctgtgggggttgcaaagagttggacacgatgaagttttgttttactgtttatttttaaagaaaaaaaataccaccacaagtaagtaggacttgatacaccaaaaccaagtttcaagagttggtttgcagggatttccctggtgatccagcagttaagactttcgttgttccatttgcagtgcaccttggtttgattcctggtcagggaaataggatgccacatgccacatggccaaaataca

SEQ ID NO: 31566 - DNA, 1034 bp, Bovine  19866881018828
tttcctgttgtctttagtgccttcaactgatggggcacacttaagtttcgtcagttcatttcattccttctgtcttatcagcaacattgactttaaaatgggtttagtcttcaaaatgatctttgaaatctagtcttttctttcacactgaccatcatccttgccacatggtaattttattaggatttagcccatttttaaggtgctcttggccacgacatcaaaattgatgttacaataaaaatgtcataagcttttggataacatgctttgctgatgcctaaataatttctactggctatttcaatgagtccaagatactcagacacgcaaaaccagcaattaaaatttgcccggtggttttagtgatcggctcgaaactgaatatgttagctgtcttagaaaaacattgcttttaatctggcctttgatatctccacccgccacacctcccagtgataacagaagttaatagagtttgcacacttgttgtgtattagagaatgagaacactgtctcattggttgtttgttgttgtttagttgctaagtcaacatccgattcttttgcgaccccatagagggtggccctcttggttcctctgtctatgggatttcccaggccagaatactagagctggttgccttttccttctccaggggatcttgctgacccagggatgaaacagcatctcttgcatctccagctttgggaggaagattctttaccactgagccaccagggaagccctgctgtctcatttagctgtataaaaaatctataaggtgaacacgattattgtcctctttttacagaatacttttgcagtgattttgccctctgcccagtgtcccacactcatatgcaacacagctgggatgaggccctttctaagagcctctgctctcaggcactgtgctctgtggtcaggtggccttgaagtcataaaggagcaaaggaaggagaaattggattgctgaccagcagtcagcctggccagtgtgactcctaagggtgcaggatttgtctcctta

SEQ ID NO: 31567 - DNA, 2381 bp, Bovine  19866881021011
tcatgctgatcatgctcagccacctttccaatggactctgaactctgtttagtgcctatgaaaacaacaacagaaggataagaccccctccagacagagggaatcttaaagatcgtatctaggttactcatcgcctaagagaaaacatatactaatcaccccttcctccagagaggccataaatttttctgtatctatcggagtgtaacctcgggtttactgattattggctaattgtttgactgtctgagcacatgagcacatagcacgtgaatgatggggttattgggattgtattttccttggtttatgtaagtcttaaggaatctggagtggtgggttcagacacgtacacatggggtataaaagattttcacacatgctggtcggggtccttggctaagaggagactttgccttgggcccgctggtgtaacaaactgcactccactatctgcattgtccttctgagtgagtttgtttcccgaaacgcgtggctacaacaactgatcctcaagaaaaacaagacagagaggtgggaacctagcaaaaggctagtgctatgcttttgtattctcagtatggagccacagttgtaccgtattctttcttctcttccatcccagctttaatttatgctgaaagaagatggaaaaatttaaattcagggaataggaaacagaagttatggcaaattcagcttccactcttagccctctcttcctcatgtaaaatgactcgagaagctaggaagatgaacaggaaaaaggttttcaagtaacaaaacatgctggtaaagcaagataggacttccctggtggctcagatggtaaagcatctgcctgcaatgtgggagacctgggttccatccctgggtcaggaagatccctggagaaggaaatggcagccaactccagtactcttgcctggaaaatcccatggatggagagcctggtaggctacagtccatggggtagcaaagagttggacacgactgagcgactctactaccaaagcaagacagtccactttagagagggcatacagtccagtaggcagtagagaggaaaaacttaagcgtctgttatcaagttgtcccaaccctaaaagccataggtcagacccaaaaggactaaagataagaactgagaataaattagaaagaaacttcaaaatcaatactgaaggtattgattaagagtcagattaggttgtgatttgtaatgttaatgagcagtgagaaaagtaccaattctacacagaaaattttctttttaaatcttggtttacatgtttcaatctcaaaaacactgcatttaacattggtgctctcctcctttaaaatggggagaaaacacacaagacctgtatgcttatctttctgcattaaccacgcctatcaatggctcaataaaatttttgtagtactgcattatttaaatctttttttttttttaaataatgttcaagagagatccatcaccccaattctgctctgtggtatcaggtggttccaaagtacatataactataaaaagggactaaaatgatcccatgatcatgaaattattagcaacaaattatactcatgccaaaactaagatcccctgaggtaacttctcttttctaagctcatcagtgtacaaatggaagtcttaatgttgtacttataactctgtactaaaaattaatttcacaaataaacaacacacgatatgcaccattctaggaaaagactactgtttggatatactgctatttcttctcctcttagctctttttcctttgggcattttgttttgcactggcagtatcaggaaacgacactcaaagcaatcagatttctaacttgttcgcagccacaaaatactactaggctagttattagactagaaatagcttttgtgttatatgaattttaattactgatatctgcccccagtgaccattaactaaggcatcaccagctgcacagaaatgtcaattcagaaagaactttccatctccaggcacaaatttttataatcccccaattccatcatatacaattttactttcaaaatataaaaccaattattcaagaatgaactgcaaccaaatgttgaacacccattgtggatgtggtatagggctgttcaactgtcattactgaaacaataatccctgactaaaattataaatgccacccacttccaattaaaatattataatacagatgtctgtaaatttctagattgttgtttgcagaaatactttgattgctttgtcaagacagtctttgtggaggtttttaacttttaaagtgagcgtgacaggtttgaatatcatggtttgcattttaaatccttatgaaagattcccccaccccctatgcttcttttt

SEQ ID NO: 31568 - DNA, 1788 bp, Bovine  19866881024646
tgagctgaaagaattctgcttcttgtgcagaagttgattttctcgaaacccttcgggcagtagaagttctccatttcgtaggaagtttagaacatgcctgaagaggagtccatccctgtctatgaaataatgaccatcggcatcaaacgggcagagaatttttccattgactataccttcaaggaaagtgtctgggtacttggtcagtgtttgtttctgagtgatgtataagtatccaccaacgttgagggtcatcagagtggatttgcagttctttccctggtcagcatcttccaggctgttgtgtttcccttcatagtccttttctttttctctcctgtttattttatgctccatttttgaacacgctatttcagcttgttcttcttggcgttgagatttttaaaaaagaaacactaccacacaaacacgcctttattcagccccagcctggtgatggaatggaaatgctggcagcatcgcctgcgctgtcagctcggttttgcagtaggtggcgtatcagctatgtatgcaggagctttctggagtaagagggaaaagagataatttgcatttaaccgtatcagggaaggaacctgctgtgaaaaggttttcatagatattcttagacataaataaaagttactcagtgaattgaatttcctatgggcagttaagcagttatatatatttaattctccagctaagtgtgaatttttattcacttctcagtgtcaaaattaagtaggcaggcttaatattgaacaatactgtgacctttcagagaataatatatgtggaattgctatcatattttaaagtaaattataagtaggaaacccaaagagaaaggacctaggtgtatagaattttctctcctgtaaaaagtcacacattccacggtggtggtgtcattttagaaacaaaaatgagaatacttaaacccgttatttgtgacattgtacttaagtttaattggatttgcatgtgattctgatttggggaatcagtaagtgagaagaaattttcttaatgtctttcagcaaaaggttctgttattttggctttttaccctacaagtaaaacaagtcaaataaacaggctttacagtatttttttttttttttggttaagatttcttatgaaaaattcataagcttgtttcaccctaaacacactgaacaaagacttggactgctgtggaaaataccgtaaccgtgtgtctgtgtgtctgtgtgtttgtgtgtgtgtgcacgaacgagtgctccctcgagaagatgacagaggcagtttcaaaatacctgctataaaataatatcatgggccagattagttgggtttcttttgctgctgctgtttttttccccccagtgttcacaaaaagagagagaaaagaccaaagcctgttgccttttttttttttttttttgagctctaacagtgtgagtatggtgttttcccccgccccctttcttttttttccttcttccctcgtaaattgctttccaaaacatgttagggatctgagttttcatttcttgagtttaaagacccagtggtaagaaatgtgaacatggtccccagtacactattatttggctgatctacctgctaaattattctgaggaactacagaattagactttagattttgtcaaatttatttacattttttttacattaaaggtatttaaaaattttcaactttgatagaagtgggcttcccttgtggctcagctggtaaagaatccacctgcaatgtgggagacctgcgtttgatccctgaat

SEQ ID NO: 31569 - DNA, 1514 bp, Bovine  19866881078363
ctccagcagttccccgctgctgtcaataatggtaattataattatagagccagtcccctgaggagctcaaagcactttctggatgctgcggcattgatcctcataacacgagtggaacaggggaaggagcaagcgttgtcatcactttatagatggaaaacgtcaccaagggaggcagaaatgattgtctgttcacatggagcaggttacgatgttgaggttttatggattcagttgtgtgcactaattgctgggttaaaatgcagcaccgccccacccccgccccaatcagcctttgcccagaaggatgtcagcacaagcctatcacaaggactttgctctataagtgttagtgatagtagctcagtcgagtctgactctttgggatcccatggactgtaacccaccaggctctgtccatggatttctccaggcaagaatactggagtgggttgccattcccttctccaggggatcttcccaacccagggattgaatccaggtcttctgcattgcaggcagattctttaccatctgagccaccagggaatttgctccgcaatgcaaagtcattaaaagataagttagttctttttcttttatttgtatttttacctaacaagctatagggcagcttgttgtaaaagttatatccaagtaaagataaaagaacaaaggccaaatattatgtaatgggcatgggggtgggggcagcaatgggatgggggtaagagagtggtgctggaaggtatgtgtcaaaaccagttagtgccactgaacttagcatttagctgtgggattcctggctgctgctgctgctgctaagtcgattcagttgtgtccgactctgtgtgaccccatagatggcagcccactaggctccccggtccctgggattctccaggcaagaacactggagtgggttgccatttccttctccaatgcatgaaagtgaaaagtcaaagtgaagtcatgcccgactcttcgagaccccaaggactgcagcctaccaggctcctccgtccatgggattttccaggcaagagtactggagtggggtgccattggcttctcctggcagccaaggctaaaaagggaagctaaagatgtatgaaggttgtgtgcgtgcttgtgctcagttgccaagtcgtgtctcactctttgtgacttcatggactgtagcccgctaggctcctccatccatgggatttcccaggcaagaacagtggagtgggttgtcatttctttctccaggggatcttccccaaccatggatcaattcttcactgaaggcggattctttactgctgaaccactggagaagcccatgaaggtctctgtatgtgatgaaataccctgtgatgcgagaagaatttaggtgtgtgagctcaatcagataagttagcctaggaacaaaggtttcgttctgcatcttatgagggagcaccttgaggctagatcccaaagactggctgctcacacaccatgcacatgcacacacacgcccaccctca

SEQ ID NO: 31570 - DNA, 1711 bp, Bovine  19866881122194
ttttattttcaaagaatacataagagtgtgagaaataattcagtactatatgataaataataaaaaagattcagactatttctcacttaaactttttctttttaaagaaaatacttaggaaatacatcaaaacgataaaagtggttctgagtggtggaattataaatgatgggtgatttaaatatttttctttataaatgatggattatttaattttctctatttaggaactttattattgaatgcctcctaaatgcttggcattggactgggaactgtacagtagtgaaaggagataacaaggtccctgcccttgtggagcttatattcaggataaataatcagtaaaggaataaattaatcaattaaagattgtggtagatgctaggtggaaaattagctgagtgttaggttagaaaataagagtggagctagataggatggtcattgagcacatttctttcctaaaaaaaataaaaccttaaaggtaatacattttattttttaagcttactttataaaaatatggaatattttcttgagctttcagttcagagctactgatttttgtattgcatttcatcattcacattgctcttagcttacagaacagattgtatgatttttctattttgcaaaatttttaattttgaaaactatggtacttactatgtgttagtgctttatatctgagctctgtaaaacgtttgtgcatatgttttgtctccatttaatggatgccctgtatctcagagaggttaaataatttgaccaatgttctacagtccgtaaatgactgtgaatctgaattcagtcttttttactgccaaaattcttgacgcataggataaattttaattatgaaaaggagagagatgcagctccacacaattattttatatgtagcaataacaatatttagtctttctctctgtaagcttttggttggtatataggccaagcaggagtcatatgacatggtttgtgttatattttctgaataattttttgtttgctaattacctgccttctctgtcttccgccttgtgtctttaggatccttcatctgtacctaatgcagacaatgcctttacactattttatgtgaaatttcgagctgctgcccccaaagtcagagtaagtctattgacataaaaaagatactgctatgaaatttatttagccagccctttggaaacgctaatgtatgttaggtccattgcttataccagaaaaatgagcatgaatgaatggtaggctttgtccttccacattacagcagtatatgttgaggggctttaagcccacagagcaggaaacacctagctcttctgtgatgctcaaggaaggtttccagatgaagctgatatttgagcttaaaaagcttgaatttagagaagacttggggggattgataaggatgttttttacagagagagcaacaggtacagggaaggtactagaagcataaaagacatgtctttggggagaacctcatgtaatttgttgatgctagaacacagactttagtcgagtgtgatgataagtgagaatggtggcagagaccatctcaggaagggtgttccatgtcatgctagttcaggaaaagcagagaaccagtacaatattttaaaccagtgtcatcccagatacagccgactggagctgggttgtgtatctttttttttattgttgtaagtttctagaaaga

SEQ ID NO: 31571 - DNA, 972 bp, Bovine  19866881223734
gagggtgaacacagacagctctcctaccactcggcctggctgctcatcagaatgaattctgagaaacatccaacccaccgtgttctgccattatttcgaggattctgtttccacccttctttttacaacatctgcatcactgacgtgcacagctcagacaacatgaagctcatgggctgggcacattggaggataagaatggaaatgacattgagtaagcggtgaagtaattagaaaaaaaaagcaatgggtttcagcgaggacaggacaaagcaatctacccagccaagaaaaataaacttcataaataaaacatgattaatgtacaagctataaataaacataagaggaaaagaccaaggtcataggagataaaaatctgacagccagtcagcaccgaatgactccactttcagaaagcaaatacaaggactccagcgcaggtacaagtgtgaagtcctcctctcacgacactcaaaagtgatcagaaactctcagggagatacagccagctttgtactgctgaactgaaaaggaatgttgaggaaaaatcaaacttggaagggattcagaagggactcacagatgattaacaggatgaaaaataaaaacctccaaagaaagatgaaaggaactggaacaacttgcagcctttaaaaggagaagaagtgacaaaaacaccgcaatcttacagagaagacggccgacagctgttcgccatctgaagacaaactccacacaagcagcgatgatgagggaaaaggtgatgactttcacaggccccacagcgtctacacacgtaacgcacagctgctcaacacttctcacatctctgaaattcacttattcttactgcttgtatttccataacacttctcttctgagtactgcagaccaaccctgacttaacatcttgggctatatgctaaacccaaggacttggccctacagtgctgcctgaataagcaagca

SEQ ID NO: 31572 - DNA, 983 bp, Bovine  19866881231575
aaatgacgtctttataggggtacttggcaccacccccctgctttggccgtgctgcttggtttatgggatcttagttctctgatcaaggattgaacccatgccctcaacagggaaagcctggactcctaaccactggaccaccagggaattccctggcgcacatgcctttttaaaaaatcatgggccaaatgtggtattataatcctttttaaattaatatcatacttcgcaactgaccatgtatactcacactagtatttttgtgagagttctggtgtgttctctgatcctcagccctctctcttggagggtctgtgcatccaagagattttagaccctagtgtgtttcctggggacaccacacatgaagcagactccagtcggcccagatgtcccaaggctgaggttcaggaaggttttacccaggaagtcgaggtgcgctttctggccacatcagttttcccgtggctgtgtcactgcctctaatcaccgcctgtttctgctgctgtccccgtcagtgccggctgccagtctggccaccgtcgtctccctcgcctgcctctgctccaccagggtgacggtcacgctgctgttgcctccactcggcttctaccctatctccccgcaggccccggggattctgtgctgctcacccctgcccttctcttcaccgggactcttctacttcccctctgagctgtggttgtgatgctggtaaagtttgctcaggtgctgctgcctcgcctctgttttggatttcagcacccagtttttcatttatgcagtttctctgtattctccagctttttgaaataactacttcaaagccacagacctttcccattagaatataatttactcaggaagacagttgcaagggaaaaacaatacacagtatctcattatcggaaaaaaactatcatttgttggggacaattttatttcaagactgtacaattcagaaaagaattcaaataaataac

SEQ ID NO: 31573 - DNA, 1164 bp, Bovine  19866881287693
tgtttttatgagtgacatttgactgatctaatgtcctcagggtccatccatattgtatcgtgtgatagaatttccttccttcggaaggccaaacaataccttattgtatgtgtaaatattttatttattccccagtggacacttgggctgcttccacctttgggataatatttttaaatttgtttcccttgacttcttgactttttttttttaaagaaatttaagctcccacactagacttacagagccagtaaggactggcaaattatatctcccacataactttcactacacattcccaaagagtaaatatatgtttgaactactgtttttaaaatatttaccaatgttttctctctctagtgatttccttgcctctccttgctttctctgtttgaaaaggtcaggctgtgttcattgcccctggacaccacatttccaaggctctctctgatggctgttgttcaacaccgaggggcctaaggaaacagaaccaggcaggactctgggtatcttagcagagagcttcagggacagatgaaactcaaggcaaaataaccgccctcagcacttcctttccccgctctcctctctccaactataggcctttgcatgtgctcagttgtgtcagactctttgtgaccccatggactgaaacccatcaggctcctctgtccatgggactctccagccaagaatactggagtgggttgccatttcattctccaagagatcttcccaacccgatgatcatactcacagctcctgcattgcaggcagattctttatcgctgagccagcaaggaagccctatagccctttagcccttcagaactactgaaactttggggacccccaagttgactgcaactgtatttctaccaccatggttgaatgggatcttgaaatagacattaagtcatatttctggctcacttgagccgtggactatctctacacctatacacaatgaatgattaatttttttaaatttatctatttttacaactgtggctgccctggttctttgtttcggcgtgcaggattttctctagtcgcagtgcagaggcttctctagttgcgcctgtgcggggcccttagttttcagaccagggatccgtccgcagtcccctatattgcaaggtgggggttttaaccactgga

SEQ ID NO: 31574 - DNA, 1359 bp, Bovine  19866881397172
gcagttgcaaaggaaagccaatattgtacttacaaggcatttgactgtatttcctccagtcacccatggcagatatgctgtctcctgatatccttttctttgtggttgtagaatgttcacttgggatgtggccaccctggttaaaaaccacatctcccagactcctttgcactgaggtatggccatgagacaaagttctggccaataagatgtgaatggaaggtatgtacgagcttgtaacgtgagtgtctttccccttctttcttttttctggtctaaatacggatgaggcagtgaccctcatgcagatgagggcagtattccaaagatggcagaacaaaaaaagtggaaggcaattgggtcaatgactccaccactgccttgcaagccattagtgctttaggctcacgtgagagtttccatgtgacagaacacttcttatcttatttaactgactgttatttggggtctggctcacaaagatgacctgatagtctcacccgttcctaccttctccactaaaaatgtcagcagtaccatccccattttgccaaaggtaaagagcgggtatgcctacatcattcaataaaaccagcagaaatgctcgatttgagccagtacctcctgagacttgcttttctctgcctcctctgctacccaagcttctctctcctccctgttcttggccttttcttagctccttccaacctgatcttgctcatgagaattcatcaggaggtccaagatgatctgagtaaaggatattttgagggaccctgagaaggcttaccttcagtcagcagtgctctttatgttcccagagggaacccaccccattcccttttctcagcttccccggaggtttcatttactgcacccagacagagcaccattccttcggacttaagggtgcttccagaacttgtgatctgagcctgtcgctgtggtttgctttcagcttatcagagacccctgaagcatgaatactctttgccaatgtcaaagcgcattcagtggtctccactggccttctccctttcttcatttgttgaaaatagatgtccctagtgtcctgaaggctcccaacagaagcagccaagaaagaatgtgggcaagtcagctcattcagacaacacgtgtgtgtggagcacctgctcaggtaccttcccaggcactgaggatgcatcagagagcaagacaaacaagttccctacctcccagagcttccattttaggggagacagatgaggaagggaaacaggagcaaccaggaaggagagagagaggaaaggggacctagaacagggagaacagagagtagattcatattgggatgaaagcatgatgaagaaaatacaa

SEQ ID NO: 31575 - DNA, 830 bp, Bovine  19866881579707
gaattaaatgcatttcagaaatgattttttagacatgttcaaaaaaatcagtgacagatttcctagagtaatggtttccatcaataaaattttgttataacagttaaattttcttttgtgaactgatgcaaaagcctcacttataatacttctaaggagatttgtacaaactatatctcctgtaaaaaggtgtgtcagggctatttttattatctgaaatgaaaccttgttagagaaaatcttactttgacattaaatcattaccgtgtttttgtttttgtgttttacattacaaagtccaaatgccaaggaaaagtcagctcataagctggagaggtatgtagacagttcaattatagtgactgataaaatagattttagtattttttttctgttttcatagttcttttgaatcctgattaagcctttttaagtacataagggataatttgatgttataaactttttttcttgttatacaaaaagaaaattatgcagttgatgtagagatttttgtttttaacatggatttttaaaggacttttttgtacagtaggttttaaaatatttcttttagtatgtacagccaacttttgtattaccttagatgttgtaatgggaagtcagttacagttctgagtgaatattagctctcctgagtttttatgtataagcaaactttttgcatagatgctaacttctgtaacctcagttaagattttcagaaatattttgttaaagtttattaaagtcaatatttaatgaccagttttaatggttaaattttaaaggagtgaattaagatgttattgtacttagaagtcagagaa

SEQ ID NO: 31576 - DNA, 677 bp, Bovine  19866880416757
ctccccattggcccccaaaataaatggcatgctcttcagtatggtgtctctgagcaatctgactcctgcctgtgggggccccgcccagaccctggagggcacttctcatcattagtcacacagctctgggtggcgcacttgccctgcccctgcttccccacttaataaacgctttcataaaccacagtcgtgcccaccatctcatgaggcttacactagctctgtgagctctgccactattcctctttgaaagagaggacttggaggctctgagaaatttggagcattttcttggttcttgtctgtggtggaggcagaactgattggccttcacatctttttgagggttccttttttgcggggggctgtgagtgtgtctgtgtgcgtatgtcatataggtcctagcagtatgtcatgctgctggggtgtcatgaagcttaactctcagggtgcaggcctgaggcagggagaggtgaggtatgtctccaagggtttctcctcccagttcctctcaagcgatggccagcagactggctgtgttagcccccagcctaaccctgagcccaaagtatgaggagggagtgggctgggtaagcatgcagggctcacctgtggtattgtgtagcatcttgtagtagggcctctggcaggaatatctgatctcagacttgtatgtg

SEQ ID NO: 31577 - DNA, 1406 bp, Bovine  19866880437975
ttgttccatgaggagtaagatgagatgatccctaaagtcctgaaaattccagaattttaatcttaattctcctttccagggctttccagatgatctcactaaatcctcattatcctaggtaggataatgccagaaaataataatatggtacaacagccacttctccaagttccttggccataagcactctggtaagagaccacagtctgctggagttgccttagtgacacatcatttaaagagaacttgtaaatatatcattctagtgctgttctttttccacggaactgtgaatatcacacatttccttccagtgagataatactcctgtcctggggatctttcactctgtgactgaattcccctggcaggcctgggagtgggagtaaaggaccctccagttcacaggaatcctttcttcccagccacagttccacagactgcccttcccatcctggcccatcagggtcatgatgacggaattgctgacactgcacatcagcagcttgaagaagagcaggaccccaaggctgtggtccagatactctcactttatgaaaattcctctccagcctaatctcccacagtccttggtcttcaaggctcatgagcatctgcacgatagtatttgcctccttggaatgtggctgcaatgtagggactcctgcagtgcacaaacaagcgtaggagtcccatctggttaatgccacaggcgaggggcagagcacagacatggcccagggaacaggaggcctggattcttgtggccattctctataactaagaaaccctgggcaagggattcctctctcacataaaggagttaagccagatggtctctaaggctcatctagccctgatagtctatgtatcaaagaccccaggaatcatggttcaacttcatgatcatcacactgaagcccagggaagggcaattcttggaccaaggtcacactaggaccagaatttatatctcaaaacattcagtctttttttcctttaaaaatattaagtcatactgaaatcccccatcatatggatgcttacgcttttaagtgtaatgtaacacaagtgttgtatggatgtgagagttggactataaagaaagctgagtgccgaagaattgatgcttttgaactgtggtgttggagaagactcttgagagtcccttggactgcaaggagatccaagcagtccatcctaaaggaaatcagtcctgaatattcattggaaggactgatgctgaagctgaaactccaatactttggccacctgatgtgaagagctgactcatttgaaaagaccctgacgctgggaaagattgagggcaggaggagaaggggatgacagaggatgagatggtttggatggcatcaccgactcaagggacatgagtttggggtagg

SEQ ID NO: 31578 - DNA, 634 bp, Bovine  19866880444394
atgaggattctccaggtaagaatactggagtgtgttgccatgccctcctccaggggtttttgccaatccagagatcaaacccaggcctcctgtactgaaggcagattctttacaagctgagccaccagggaagccccagaggtgtcctaacaaggtcagacttgacctctgtctcaataataggaaaacttgttagaaaaaaaaaaaaaaaaaacaattgcaaatgaattgagagtgaattcttgcagtggagggatgggaaataatgaaaaacaaagtcattgtcatagctaaagaaaaaaaaatttgcaattttctgtggtcttgaagcctcaattactaataaaggcaaatgtttccactggcaaaatttctagatgtttgacatgtttgaaagtagataaaaagcagttaggaagttcacatctagccttgtctaaatccatggaatttactcttgtattaagcaatgtttggtcattttccttctgctaagttcactttccaacctaaatatctgagaatacaatggtggtacagccagcattagctaggggaatgggctgggggattccgctaaccaaatgccccttacccataatacatctgggatccggagttggttcttccagag

SEQ ID NO: 31579 - DNA, 3602 bp, Bovine  19866880452433
gaacactggagtgggctgccatttccttctccatgcatgaaagtgaaaagtgaaagtgaagtcgctcagttgtgtccgactcttagggacctcatggactgcagcctaccaggctcctccgtccacgggattttccaggcaagagtactggagtggggtgccattgccttctccgttaatatagtaggtgaaactgttattggggcattctttatatattaacaaaaatgcttctaaaatatttggtcaagttcctcaatgaagtttattcactcaaacattcaaccattcattcattaaactttcattgagcccttgctatgagcctgaaagtgtgctaggcattgaatccttgtctttaggaaagtcataatccatgaggtgatacagacctatgaataaacacataccctataaacactgttgggagaaatgaactaactgctaaggagcacagggctaggcctgaccaattgcctgggctgatgaaggaggacttcaagttggaggtgacattaacacttcttagaggagttttccaggcagtgcaggggaatgacggcacagcccctcatagttctcgccatccctataccccagactactcttagcctgacctccacacctgtaatgacaaaacacacaccacactaatagtttgagacaagcgaagagcagaatgtttcttcagatccaagatgccatgggattcaagacacagacattgctggaccaacgtgattatggggaagaaagggcgtgagtaggcagaactgaggatccatctgggcttcttgtatgagacagaaactccacccacgctttgtcagtcatgtgttcctctaacaatagaataaagcaaagtcttctatatcagagagaaggacagaggaccggtatggagaagactcagccaatgacttgttgactgatagatggtcagctgaccacttcctcttcctcttgactacagttcatacaatatggaactgatattgccaattgtgatgggattacagaaaaaaaccttttctttaaattatttttactttttctgtattttccatattttctgcaatgagaatgttttaatttaccttaaaatgttaacgtatttattaacctttaaaaaagtgaaaatgaagaggttgcagtaaatgacttctgagacccactccaactaaaaatctgattttaacctccaattaaaataaataaatttatattaaaaaaaagaaacttaaaaaaaaaacagtatggaaagcctcaataaagtcaccatgatacttaagataaaaaaaaaaaaaagagtagaaatagagaaaataagtagagactattgacttttggtggcagtaatacattatgctgatgatgcttctttatagcagctctcatttactgagtgccaagtcttatgtaaaacactttatgtacatattcaaatatatatctagaaatatgtagtatatactgctactgctgctaagtcgcttcagtcgtgtccgactctgtgcgaccccatagacggcagcccaccaggctctgccgtccctggaattctccaggcaagaacactggagtgggttgccattgccttctctattgtgtgaaagtgaaaagtgaaagtgaagtcgctcagtcgcgtctgacttgtagcgaccccatggactacagcctaccaggctcctccatccatgggattttctaggcaagagtactggagtggggtgccattgccttctccgatgtagtatatatatctagctatttatatatctgtagacatggcatatatctgtatatagatattcacataggtatctatatatatatatatcatatatctctagatagatatttatatatagatgtagatatattcttgggataagaagaagcaaaatagtgaagtgcctggggtcctttggacttggagttaagttctggctggatctacacagtccttatctgtctctgatcccagttctaataaaatttaaacacagaaacatttcctctttatgtgagcgtcagcagtatctcttccccaggtccagactgtctcaagacccactactggtatatcagtccctatctcctcccttcagtgctagagctgcaagctgcaagagtgaatgcctttagatcaggacacctctgagtgctggggctgcaaagaagggcagggtctgtgatattcaggagcaactgggagctcccacatccagaaatctggctacaggtgcagctcattgcctatagcacatccccaccctccactacaggactagagtcagattttggtaaagaaaaagcattctcagctggccttaaaggcaacctctaataaaaactgagcatgttactaagaattgctaaagatttaaggaaaacaaactgataagaaaggaacaaaactcaacagacagaaatactggcaccctaggaaagacaaagtggactagacgaaaatggaaaaatgtaattaatacttacatttatgaaacatgaatattatgaaaaatacaaattggagatttcaaaaatgattaaaaaaatgcatgttgaaaagaaaaagtgaataaatgaggtgcagagcacattagacataactgaacagaaacgagtgtgttgtaatacagagctgagctaactgcctgtttttatttaatttatttacttatacttttagtaggaagataattgctttacaatgttgtgttggtttcttccacacaacaactcaaatcagtcatgagtatatatatgtcccctccgtgttaagcctccctccccactcccatccaacccctctaggtcaccacagagtgccaggttgggctccctgtgttatacagcagtttttcactagctgtctattttacacatgattgtgtattatgtgccaatgctactttctcaactcgtcccaccctctccttcccccactgtgcccacaagtccattctctaggtctgcatctccattcctttcctgcaataggctcatcaggactatttttatagatttatttatatgtgttaatatacaacatttgtttttctctttatgacttatttcactctgtgtaacaggctctaggttcatccatatcacttcaactgacacaaatttgttcttttttatggctgattaatattccattgtatatatgtattcacagtgtttaaaatagaaggaccaagagccaaagcatacagagaaagtaaagatatgttgaggacaggttaaaagtccaatatatagataataaaagttgaaggtggagagaaaagacaaaacaaaagagagaaaaatcaaagtaacaatagcaaaaatatcccagttctggagaaatatgttttagatggaaagaatcacaccttgcttctgagtagaatgaaaaaaacaaaacaaaaattcaaccttagatacatcctgataaaattttggacactgaatggaaaaaggaatctaaaatcctcagaaaaaagtacctacaaagaaggaagaatcagataaacaactagcttctgattatcaataatgctacaagggatagtggaataatatcttcagtgttaggagaggaaataaat

SEQ ID NO: 31580 - DNA, 1319 bp, Bovine  19866880571794
caggctgtgctaactgcttcttgaggttttaccccatagcaggtatttgaaggtagttatcagtaactcctttttgcaggcgagggactgaggtttaagcagatttggtcacttggtccgaatcacgccgctctcaggggcagactcgcggctggaaccaggctgggcgaccacagtgtgcgtcctcagttgctcctctaatccgcctcccattgactggcttcccaaactgcagtgtgttcataaatgactggctttagtgatctcagcctgatgaggcttcaaagaagagagacctgtgagaacacgagatggagcagcatagattaaaattgtgtattttcgcaaatgtcttattctcagctaatgacctaaaaagttaggaatttttaactctgtaagcatgaaaaagtaaacattgaaagtgaatacagtgcaaaagagaagtgggcttttgaacatgcagacctaccattcgtttttccttagtgaggcttgttgaaaggaaaagttctgttcagttcagttcagtcagtcaggtccaactctttgcgaccccatgaatcacgcagcacaccaggcctccctgtccatcaccacctcccggagttcactcagactcacgtccatcgagtcagtgatgccatccagctatctcatcctctgtcgtccccttctcctcctgcccccaatccctcccagcatcagagtctttttccaacgagtcaactcttcgattgactctaatgatttttgttagatctcaggatcaaagtccttccatgaaatcacatatttgaaatgataactgcagtctatagaaaaagattattttaaagtttagttaaacccctccaatgttttatgaagtacataaaaataaagattctagttccaattcatggaagtattaggttctacctgaaacttcaaccacaattccagccaggcaggcaatggtgacttgaagaagaggatcagctaacacctggaatattctaaacattaccattaaaagaaaaattggggaaggaagaaagaaatctagttccattatagatgaaataaaaaccaattacatttagcttctagaaaacgaagtccaaaagaaaccaaaaaagcaaaagcaaagagttggggtggggttggttatcttggcagcttttattcctaagtgctgcccatttggggaagtataaaatatgatctcatcacttctttctgctctagagaatctaatttgggtctacttttcttcttttgagagcctatgctcggtttcagaccatttttcctggcagtcatatgaaggaaataaa

SEQ ID NO: 31581 - DNA, 1392 bp, Bovine  19866880583737
tccatggaatcccatggacagagtaccctagcagactacagtccatggggtcgcaaagagtcaggcacatcttagcgactaagcacacacacacgcacaccagctagcaaggtaagtgcagacacaagacagacgataaaatccctgttccaggctcgctgatctttcttctccaccactatttggcctcaacttcttccacatacacagtgagtgttaacatttttcagagaccacatactgcggtacaaagaggtaactcataacagtagctaacatttccagaacccttactgcatgcctggcgtagttctgaatgtgcctggcacagtgcctggcacaggcatatgatttggtccaagcaataagcctgtgggtgaggttcacgtttgttatcaccttcattgtatacatgataaacgagtcacagagagcttcagtaacttgcccaaggtcacacagccaggatttgaatccagagagtccaactcagacccacacatatagacactctgctttgctggctcaaaaagcaataggtcctactgctgattcctatgtgtccacaggggcttccctggtgactcagtggtaaagaatccacctgcagtgtgggagacacagaagatgtggctttgatctttggattgggaagacccctggaggaaagtgtggcaacccactccagtgttgcctagagaatcccatggacagaggagcccggctggctgcaggccatggggtcgcagagctggacacaagtgaagcagctgagcacacgcacacacacacgcgtcctcagacacagctaggatgcatctgtgatgcatgggatgacggggagaatgcacagggtaaaagatgcaggacatgtcctgccaggccctcgacatagtaggccctcagtaaatcacagctctgaatgttgctgagaagcatctctcagtgacagagcccagactggcaaaagcttttcatggtaatgaaagaattaggcaaacagaaacgtttaattagctgtttattttcagattacctgcaccgagttgagataaaaccttaagtgcatcactccagttgtgagaaagaggtaggcgagagtcaaagtttgacattggacttaaaagctcttaaataattacggcgttcagaataaacaaggccttcatgcttcattaggcgatgtgtattacgtctccattaacacactgtggcgcttttccatttcccattttgtgaaccatgctgagaggagagctgaagtcatcgatgttaattgatagctaacagaaacaaacttcctaaaaggggaatgattttttaggtcctaatttgattaattattaaagctcccagaacctatcttgatggggtgacaggaaaacaagataa

SEQ ID NO: 31582 - DNA, 1382 bp, Bovine  19866880587749
gctcttggcggtgtaccggcgcgccctcggatccccggctccgtcagtttctgcagaaatccctggctgctgccgctggcaagcaggtaaggagactcccttgacgtcttctttcccctcacccgaatcccctaactttccctcgccttgcccctgctcccttgggtgaatttgaggtgctcccacagtgctggtgcctttttgggtcccttagccaccaaagctctcgggaaaactttcaaagtccagaatacctttttacctttttttttttttctttcccgatcagcgcagtaggtcacagttcaggtgagttctgtggcattcaagacaattccaagaccttggttaactgagctcgaagggataatggcatctctcccgggtactgaccgcgggaggtgctgacccaggtgctgaaagcgcggacctctgaagcggctaggcagtacctccctcccatgcagcgggactaggggctaaaggacactgtacagccagaacacaacatgtttacggttgcgaaaggtctcattccctaaaaggtggcttagtaaaaacggtaagaacaattctagtttgtagctcatgatgtggacattgagctaatctattggcttatgtttcacctttgcaaaactaacaatctatttccttctttgtgtgtgttttaaacctacagaagcagaaaacttgcagaaacatttgagtttttaaagcttctttgtgtaattttgtggctgtagcaacagcccttgtttttttacatccttaactgattttaagtgttacaaaaagtccacagctgggaaaattggggtttggttgtggttaaacctgtatttcaagccaagctcttctggtttttcttcttcaccatcctcattttcatcctctttccttctgtcttccttccaccccatgcaggaactggccaagtacttcttggcagagctgctgtctgaacccaaccagacagagaatgatgccctggagcctgaagatttgtcccaggctgctgagcaggatgaaatgaggctggagctgcagagatctgctaactcaaacccggccatggcaccccgagaacgcaaagctggctgcaagaatttcttctggaagactttcacatcctgttaactttattaatgattgttgcccatataagacctctgattcctcttctccaaaccccttctcacctccctaatccctccaatcctcaataagaccctcgtgttagaaattgaagactgtaaatacaaaataaaattatggtgaaattatgaaaaataagattttggtttcttattgacttaaatatttctgttcaatgatatatgacttaatttgtgatttcagtcaagttatttaatatacat

SEQ ID NO: 31583 - DNA, 956 bp, Bovine  19866880676268
cccgaagtacctttttcctatgagcacattccgtggctgattgattaggggagaccttttaatgaaggcattaataaaagaagctccagtgccagaggggtcctgcactaattaggatggtgccactcaggagaacacccacacagacagctctgggtcttctccacggcgggggtgcagggagctgccggttgttgctgcccccctgccctctcctccccacctggggcctgtttgttaaaatctgcttcctacacagtcagccccctgagaatgtgtgggcttgccccgccccagccagaacctggggaggtggctctgttaaaccttctgggacaccactatccttacagaaagcatcgcagctgtgtatgtttccagggaagatggagagagggcagtacgagaccttcccgcctctcagttccctcagctgagcagagaagctttgctttcctcccttcactctgtcctttattttataaccttccaaagtgattgactttcccatctgtatccgtgttttccagagaatttatagatacatgcacacatatgtgcatatgaaaaacactggctgattgatttttagacattgtctggtgcaactgtgcatgcgtgctaagttgcttcggtcgtatccaactctctggtgaccctgtggactgtagcctgctaggcccctttgtccatggggtttcttcaggcaagaatactagaggggggttgtcattcttctccaggggatcttcccaacccagggattgaacccatgtctcttatgtctcctacattgacaggcagattctttaccactgtgccacctgcaactgtaggggatgacacatccagaatttggagagcaagccagcaggggaagctcaggctgcagtcctgagacaatttttcttctccagcaaacttttggtttttgttcctatagcctttcagcagat

SEQ ID NO: 31584 - DNA, 1562 bp, Bovine  19866880686029
ttgactcccctttctcttagaccccacatctgagtcatcaacaaaccctctcagctctaccttaaaatatagccagactcaatcccagttgctgccaccctgttacaggcccccaccctggaacaggccactatcccctctttgctggattgttgcaccagcctcctggctaatctttcctttttcattgttatccctctgtggtcattctcaacacagtgacagtaaactgaattacatcaccccactgctcaaaccctccaatggcatcttatcttgtttaagttaaaaatcgatgtcctgataatgacctatatggattctatgctctgaatccatcaccccattcccacttagtaatggctactaagcctgaactgcattccagccacgttggcctcctcatggttcagcattccaggctgctcccacctctgggccttcatatgcccttccccttccccttacagtttcttcatctttttttttccaaatgtcacctcttagtgagaccttccctagctacctaatctaaaactgtaactctgtcccctgcccttcctgtcccccttgcctctttgattcttcttagtcctttaactagtgtaccacacagcctacttatactgttttctgtctagttcctctactctccataaagtcagtgatttagtcactttgctcttccatgtatcccagcacctagaacaatgactggcacataatatatactcaacaaacattcattgagtgaatgaatcttgaaaatactgagtattttattatgtcctcaaaataaaattataggcctattaagatggaagtgaagaaaaactattgggcttattttagaagagagagaataagacacaggctgaaatttcatcactaccacacaagtatttgtataaggtgacacctttcaaaataactacctttcaaaatgtgaatacctttaaagagaggttgagtcaaagtaagacatataacagtttgctgccagaaaggaaaggaagatgctatgggcgttcagataagaaggtccaactccaagctgacctaagcagacagaaatcttggtgtaacaactagatgacctattagagggatcagggtcagggcaccatcccaaatgcctgaggacaaaataaggctaagcagaagtttttgagtgatgtcagagctagtagggactcttcagatcaccttacctttttacttgataagtgaggaaactgagagccagggaagagaaaagactaggtcacccaaggtcagcagcctagatgcctagataatggctaagccagggctgaaactcgggtttccggctctcaggtcaatgagttttctataccaccacccaccctcacaaggtcctgtcacaacaaagccataaaataggcagctttcattcccctgacgcatgcagcagtacccacgcaaacgccgaaaacgttcccaaaggacatttcttagctgggagtcctacagagaaccagaatgggacttggaaaagaactaaattccttcttggctatttcagccaatgggaatggagc

SEQ ID NO: 31585 - DNA, 714 bp, Bovine  19866881002940
ctggaaactgaagtgtggggcaagtaatattatggtaatattgtgtataggagagataataacaactgtgtatgcctgctactgctcatcagaaataattattacatgaacacagtccaccccagatggtgggaaatccagccactactactcctgatacagaccatagttgggagacaaatacatggcaatgcagggcgggcatggaaaacactggtataggacaggaattctcctgaacaactaatccaaaagtgaggtgccctgaaatggaaccagtcagccctcagggtggctaggtcaaccacaactttaaaaacccagtacatcagggaaatgtatagaaaacaggtgacccaatcccaatttcccatggacatccacttacctttgggatatctgaatggtaaacagatgggtcccacacaattaggattccttcattgtacaaactgtctttgaggaagcctgcttctgtggtgaccaactgcaggaagaaacagacaggctgtcacctggacatttacatgtgagtgttggcttgtagtactgtctgtcacatcgtaagtgccacctgagtgaggccctagagcccagtgaagtgtcttaagttttggggcagaacttgtgagaagaaggcaaagatgacagctggaactgtgtggaccttaaaggacatttttgtcataacccatcagccacatagcagaaaag

SEQ ID NO: 31586 - DNA, 1843 bp, Bovine  19866881055951
actcagaaaatcaccccagtatttcaatgtgctgacactttgttgcttactatgttactgtttcatgtacaactatagaaagcacatctattcaagtcagtatacaatgcagacaagcaagaaaaatatatgtttttccccaatttggttcttactgagtaagtcactgacaccaaatctaagcaaattctcaagagtttatgttccagaagattactgcaaatttcactaatgaattatttccgacactctgtaatgcaaccacgtccccatacttgtggagatccaccttctcttggaagccttcccttttccactctctcatttaccacctgctcttggtttgacttgacgaaaagagacaatcctactcctgcagaggtcaattttgagataaattagatctattttctgtgggttcctgagggcagttttccaaatgcattccaagcaaggatggtggggggccaacaagtggatctggttctttgtaactccaggcccagcataggaaccacccctgcccccacctgcgtgcttgtcagtaagtatggagtaaatggatggaaagactagattgcactcacctgggcatgaaatttctggattttttttttttttttcaaactaggtttatttaccttaaagtcacacacactgcacaaccacccaaagacccttttaacagtctggcagacatttcgccttgtttgtgaccaggctgggcctcttcctttgagcacagggctcacccaatggggttatcttcccatcatcattctctcccactaaaaagctgatgagcactcaaccctgctgggaggtctgaataagcatgcatcacatgatttactacccgccacacccctgggagatgcatacatgttcttcccttgacactgtgtggatgcagtccacaaggaacacaggagaggagggttgacccaaccggactctccacctctaaaggctgagcaacttccactccatccaaacagcctgtgcagagactgggcaggaaggactctcactgcacaaggaacactggaacccaagaagttaaatagcatgaagagctaaggagggtctctcttctgacttcccgctgcctttcattctgtgatcatactttaaagcacttccctactggaggagcaggaggcagaggaatgtggggaaacccagggcaagagtaaagagaaccacttagtaaacactaaagaaaaccaatccccaatgaaaactattaatataatactcctcactgaatctaccactgggatccatggttttgtttaataaccaaaaacctgtgtaagtccttaaggaattcactctctgacttaaaaaatgtgttgttgtaacaaccatcataactttgactgtacactggggtaccaacaaaaaactcatttgacataagtttcgctaaagcgcaaaaagggcactaacagcagacaccttgttgtgtgtccctgggcaagtgatttctcactgagcttcagttttttcatttagaaaaacaggccagctgatttctaagttccttacagggtgagcgctctgatgagaaccatattcaagtgttaagtggaattaccacaaaaatgaaaacaccctagaaaccttaagagaaaccagtgtagttaggaggtaagaggaacagggtgaaacagcactttggggaaacccagactcaaagtgatgtctttggttttccaatgtttcccctgacaaatacaaaattaaaaagctacttccgtgagactctcatctctaaaaacttaattaaataaaatcagtgaaaacaatgctttgttctcccacaagtgactcaggaata

SEQ ID NO: 31587 - DNA, 1065 bp, Bovine  19866881127382
tagacatcgtccatcatcactattctgtggatgaggtgaaggaggctcagagaggtcaatgattcagcccaagtggcttggacggcagacctggctctcctcatgccgccttgtggtgtgttctccagagaaacatagcaggagcagacccagtcatgcatgagcctctccaggaagaagcactaagatccttatcactcagccccatgccctcacccctgcgttaggcccctcttgcatgccgcctcaccagtgctccagggaggctgagttcctaggtacctagggcatttgatgaatgcctgcagccctaatcaccccattaagatgagagcaaacaaagagagggataaaataattgccaagtcaacaacctgaacagctggctagaataaggtcaacacggtgattgctctgctccaacaaagaaaagcgtggcgactaaggcttcccactatctctttttgatggatgtctccctgcctgtgaactgcagagcagctcatggaggccagtggttctcccacccctactgcctgcctcgttgcctcttgatagaagtgggccattactcttcactaaaattcattgtccacgcatttgacacttgacaacgctcgggaaattgatccactcaaatatttttggagctaaattaatgtaatttgtccttccagggctccacaccagcatcccgagagatagagtcagtggtaagaggatgattatgccttcctgggaagggagggaagtctcattggagggagataatccaaaatcttggtagtgtgggttataaaatgatttaaaaacatcaaatatcatttgcactgctctactgcttacacagaacactcatgtacattatctgtgagatatgaacctcacactgcctgtgaggaagctgggaaacatttgactctacattttacagaagacagaactcagaggtacatgactggcccaaggtcacacttcagttggttaaagatcaagtacttgaatccaggcttaacggccctaagtgatatgttgtgtgtcactgatatggtgtgtgtgtgtgtg

SEQ ID NO: 31588 - DNA, 900 bp, Bovine  19866881136306
cgtggtttcaagtgattcatacacaaacaatccaagcttcccttctcctttgtaaactggctgatggagttcagttcaccacatatttatgtcctgacattatgtcagatctaaagacacaagttcctgcccacaaggactgatagtctaataaaggaataaaatatgagcacaaagccccctaataaaatgcaggaagcagtaagttctgtaggagaggaacagggggagttcatagggaagagattcctaactgaagcgtctaactcaagaatctccgaggtttcacggaggaggcaacacattacccgggtacggaagggtgactatggtttggacatatggtaatgggccctggaatgagtattaattacaaggcgatgggatcagatcagattatgaagaaagatagaggttcgagcccaggacaatatgtggggaaaggcaaatggggagggatggcttaaaacaggtacgtgaagggcactgtaagggttagggctggaagcatgggctgcatggcaggggctggcagggaacaaggtgggactttatcctccaagcttcctatgccctcatgtctcacatgccttcttcttgcccaggcaagcttcggaggacccagtcagatgagaatgaacagagtctcagagtcaaacaagtcttcttccatcccctgtataaccccaacacgtacgagaatgatgttgctctgttggagctgtcgaggggcccggtgctaaatgactttgtgatgcccatctgtctaccccagaggccaccggaggaaggtaccgcacccacctgattccacctcggcagagcctccagggaggcttttactccagcgctggtcaggcttcagtgccagctgagtcagctgactgtgtctgcctgatt

SEQ ID NO: 31589 - DNA, 1416 bp, Bovine  19866881196477
tatacctacactgtccatgggctttgctagtagctcagctggtaaagaattgacctgcaatgcaggaaaccccagttcaattcttgggttgggaagatcccctggagaagggataagttacccactctagtactcttgggcttccctggtggctcagaccataagagaatctgcctgtaatgtgggatacctgggttccatccctgggttgggaagattcccctggaagagagcatggtcaaacactccagtattcttgcctggagaatccccatggacagaggagcctggtgggctacagtgcatggggtcgcaaagagttggacacaactgagtgactaagtacagtgcggcccagcattctgtcctcaacagttaccatgagccatgcttgatttctgagcacttagaacgtggctagagcagccaaggcaaagaggtttcaattttatttcattttaatcaatgctgattgtagctagtggctaccatgttggacagcacagaagtacagacaagaaagtggacagctcttcatggccatgtcagtttttagggggggaggcagctgaagatggctatggggaagagctctccctttgccccactgctcctccaggacatctgtcatcatctggttgtcctggagtgaacgtcaggaaactgagacacatagggctgggtcctttgaagtgtccctgaaccaacgtgataagtcagaccctccccacacctacatgtggctgccaccagcaatcctcccttctcttctgagtgatgaaattaatagattctggcaaggtgcagatttaaagaggagcaaatcctctgtgaaagagaagcaatgagttgtcaaaaaagccccaggcctcactagcaagttcgtgtggtggcctgaagggagcgtggagtggacataaagaaacctgtgatccagcccccacctgctgtgagcccaccccgtgaccctgagtagctattccttcttgctgggccttgatgtccttttctgtaacctgggggatgaattttctgatttgtcagccagctcaaagcttcagagaaaatcttattcccggagacagcaatttaacagtgaaggagagtctggggatgtattttccaatgtgaagcacaaggcaaaactaatttagcagaaaatgaaaaatgggagtagttgaaagtacatggtgttatcggtggtaagcgagtgctactcgtgaacttagcagcagtaagaagaaaaaaggccaagaagattgcagaggaggcgggggaagaccgatgaggaactcacaagaatagaggcaggagccacgggggcaggtaaataacaagagaatcaccagccgcgcagccagagacggggaaagaaggcagcaagcagacctccctgaactggaaaaagcaattcga

SEQ ID NO: 31590 - DNA, 729 bp, Bovine  19866881215949
cattataatatccaaatgggactttgcttatctttattttgagaggatttatgctttccagtgaacatttatctcacttgtagcagtaatatatttcaaagaggctgacattccgtataaatgaagggaaaatgtcttagttgaatgaacaaggaggctagatgagaaatacaccgcaagtgctacaagcgcagccgcagttgaaaggatattcttgtggattcattcctcagcaataaagaactctgaacccctagaaaagtggtgtgattacaagtgtctaggtattatctattatgccgagagactcaagattactctcatatcaagtatctggacttattttgcttaagaagtcttagataaatttcttttgttacactgtacaaatcaatggatattgcagacagtgttttccttcaagtttcaattttctgaatagaataggggtacttgaattatattgggcaatagggatctcgtgtaagtgggttgtgcataataaggaagacaggtgactagaacaagagcttgtttgggcattgtgaaagagtagggattcagacaattcagttttgaagttttgattggtagcatgttaaagtacagttgcttagacgttttccttgactcagaatataaaaggaaaaattaaaatggcaccccactccagtactcttgcctggaaaatcccatggacggaggagcctgataggctgcagtcaatgg

SEQ ID NO: 31591 - DNA, 1182 bp, Bovine  19866881361422
acacaccatcaaaagacaaaatgaaagatttgatgctaagggaatttggttctcatgctgtcatttcctaaatgactgatttggggtgattaaaatcatgaggagtccaaaagtagaagaattcgtcatatttgacgttggtgcattttaaccaatttaaaaaaaaattgcttccgcatcagcacatggccaatttacatgtgcttaggtaatgaagaagaaaatatgcagacactgaacgtgagaaggaagataaccatgggggagggcagggagggggaagggaggaaccgttccagaaaaaggaagagaaagaaatgagaaaaagagagaaggaaaatataataatttgagacacaaaaaccagaatgaataatgaaagagaagtcaacagcatagataaacattctccttattcaaatttagaatgttagagcccccagggaatcttacagcctgacgtgtgggagaagaagcaaaacctgaaggggaaacgcaggactgggggtcactgctggtgtcagggctggactgcgggtctcctggtgagcagggtgccgttccttcccccaaatcaggccgattccatggctatgtcgtcgttttcctttcagtgtgatcaactccctgtatataatgtgcacatcataattgtttgtggaaggcaggatacagtgcaacgtgcagacagagcctggaaccatttgtgttggtgttggcgtgctggcttttatttttcacagtgaagagcttggaagtgtgtgtgatttaatgcccctccatcgagcctctggttttgcctttccaggcactgccaccctgatccatatcacagccttcctagcttcccaaagcccttattcttcttttatatcttgcggtggtcacattttgcccctcgccccgctgttttttgctctgtcttgtcttccttactaagttataagttataagagatcagagatctcatcttgtctgtgacactgagtcaactgaaatgaattaggagactgggttgagagccagctcggaccctgttaacccttagggtcagtttcttcatctgtaaaacgctaataaggagtttcctgactctccacctcagaggatgcctgtgagactcattgcactgttgtgaactgttacaagagttcgctcgggtgtgatagaaatggcaggggt

SEQ ID NO: 31592 - DNA, 937 bp, Bovine  19866881489401
cttgcctcctggagacctgggaagcctgggtgagtgtggtccggggctcagccccctacccctgctcactgcccttgcatcactgcccagccctgcatccccagcctagctcagggccctgggactcccctttgggacttcccttcttccccagccccggcctcagctgccatggcaacaggtaccagggtgacaaaggaggttgctgggtcctgtttccttctggtcctgacaaggaagctttccaggcctcagagattgcactgctctgcaccacctggctgttttctgtgttctcgctcaggttgagctcaaactcccagctctgccaacaggaccatgtgcaccagcctgaccacttgtgaatggaagaaagtcttctatgagaagatggaggtggccaaaccagctgacagctgggagctcatcatagaccccaacctcaagcccaacgagctggctcctggctggaagcagtacctggagcagcatgcctcaggcaggtaagaggtggggtgtgaagggctgtggggagccctgtggcacagcccaggggcaccttccaagaggaggcagagatgcatggagcccaattctagggtcaactcaggttagaggttagaggccagagaaggaactgccaggtgggtcgaaccagctttgattctaatcccagctataccactaactccctgaatgctcctagcaagttgtattctgtctctaggtctgcattttccatagtaaagagctgtgattcttcaatgctcctgcagtctttgacattttaaatgttttcacatgttcctgatttcttaaagattggtaggaacaaagcagaggcagccatgtggtccattggggaaagccttagctctttctggtcctaggtctgtgcagtcaactcaataaatcagattgaatacaaaagcattta

SEQ ID NO: 31593 - DNA, 896 bp, Bovine  19866881546898
aacagggctgtgcttacttgttcactctgatattcttactccccctgctcccacagggctcaataagtacagttgaatgaatggatggatgaatgaactaatgagcagaagttctgcccagttcatgtggttagaagcacagtcttcctatgaaggagggtggcagcagtatgcctgggacactgcttctgcgacccacccaggcagtgccttgctgagggtaggagccctttgaacttgagatggatgggagagctccagactaagaggtccctggcatggggagatgactctttcaagtgttctgaatgtcagggcccagtggcagctttcctccatggcaatgacttattacattcctgaataagtgaagggaaattcaatccatatgttctggagttatttgcacaatactcagcaagatgctgctgttgtgtaagagccatttgacgtcggtggcatgactttcttctttctgttctgagaagagtccctgaagaaatgccaattctactctccccgaagagggaggggcaggagcaccgggggcaagtcatctagggccatcctgcaggcaactcagcccttgaggagactggcaagtctcagagaggaggccgaggagagggagactcttgtccagctgtacgcccacgtgggcgcagccagctgctgcgggaacagcatcagtggaggatggggtggaaacagcttaaggagttgctgaagaacagggaggaaaagccgatgcattggaaagatgggggcatcaggaagagcacctgggttgcattctgctgtaactttaggtaagttacttcctcccttccagcctcagtttccccttttgcaaagtatgaggctatactcatgttccaccatccttacgcatcccg

SEQ ID NO: 31594 - DNA, 1574 bp, Bovine  19866881761085
aacacagttccgccctgagggagctgcagtctaatagggaaggcaggtgggcagatgacagtgccagggggcatctggcagaaagtgcctgtggtccagctgaactcagtgagaggcagcgagcgaggggcagacaggccatgagggcagagagctgtggagtaagtccaagaagaagtctgcagccagcactaagggccctcagcactctgaccccggcccgcccccacatcggcacccacaactccatttgtgacccccaaactaagtgcagcttcaccactcagtcttctctcagggccacagatagggtggtcactaggtgaaattctgaatattattgattcttcctttttcttcagattctaatatggctcacgacaataatggcattattactgatcctttatctaaaattttaatattttgtctatcatgaaatttttcactgtgatttttttaaagacactattaagatatcatttatttctgaatttcatggcagctccttaaattgtacatctgaagtaggtgcctggctggcctcacccaagtcccagccctactcctcctgcctcatcttttctgtgcttccctttttactccacatgcacttgccaactctcccatttcccaggtctggtcctcttctccacaaagttctcaggctgtctccctagaaggggtcctctctcctatggcaccaagctggtcacgctttcctggcacaaactgaatgttgcctcagacacctgaccaaatgctcccactggacaccctgaagttaaagaagaagattctatcatattgatctctgtgtcttagttggaatttgcctcagcataaaaatatagcaaaaactagcaactgtttggtaaatgaacaaatgaatgagaccccagaagaaagctactctattgtagagacaagcaccagaaggtctttctcagacatggactcaccaagcatcccagaggatggggggtttggctggatcagctccgaggagatttcttgaatgatgtcccacagctcccaaggcatctggggcttgaggatgtaaaagggctgatcaggatgcagcttacgataactcttgaagttattgaagaaactgtagtcgggattcctgtaccactgaaaaagaagggaagaggtctcctcaaggagagcaatgggctggtctgctgccaccccggcgttcatcatcctctgaggactaggggaggtgggggagggaccactcatggcagactcctgagagacatcgcttcatcgagatagactccatgcttctccatatcacagctctcacctgatagcagggcacccagcacatagcctatgctcacagggacatttgctcttggtgaccatggaacagcttcagacctcaggatcacagactgggaaagagatcagagctgagaggggctcttggccctatctaatcccacctctcttttttaaaggggtgaaaactgggacccagattgccacagctgtggactcacagttcttgacctgacccaggcaaatttcagttctaagtgagatcagtgcaaaactgtaaa

SEQ ID NO: 31595 - DNA, 1786 bp, Bovine  19866880454313
cacccagctcccagactggtgggcagagactagacctggttactatcctgaagaaaaaccctcctgctccctctttgccacccctttctatgattgcccaatcatctggtgggaatgacacatttatacatctccgaagtgacgatgagaagcagaatgtgggagccagcctttggagcccaggcagcaatcgggattgggtgcaggatggggtgcgcaggcttctccattgctctcatgtgtcacacatcaaataagagaagatctattttttccccaggcagcatgcctacaacttcaattggcccaaaatacgcttggctaaatttacctatgtgatgctctaaatggtaccctgtgtttcataagaaggcatggtgagaaacctcagtacaaggtggcggggacaggaatccacacggtgagcacataaggagccaggcgcagggcgctcctcccagcaaatgacgtccccagctctgggccccacttctccggctggctgcagtccagaagtccttgtggccaccaggctgcttcccggcagcctcagcatcctgctgggccagagcgcatctccctcttgtccctggtggcttcctctctgggtacccaccccctgactcatcactcactgctgggcccagcatacagggggctgccagctcccagcacaagaagcctagagaaggagagagatcttcagcaccatctgccaagacatgaacgaggaaaacacccagagagcacacgagcccaggcatcccaagacgtcacctgagacccaggggtttttataccaggctacacccaggaatgcaggcctggggagtttacaacatcaattccaataagcagaaacctgatagagcaccagtggtttgaaatgtccttaaacacagagcatgtgatgagaggggctcaagatgcagaaagacaccccccacgtggccagcactcttcagagaggctgccctgatagaaggagatggccacagagcagtgtactctcgacccagataggactggactcaaaacctggctccctctgatcagctccatgacctgggcacacagttccacttgctgagctgcagctgcctcagctataggccagggatagtaatgggaccacctctccattgggaggcaacaggccataaagtgcatataaaacactcagtgcccggcacagagtaggtcctcaaaaacagggattatatcagttcccttgtgtctggactgtgtgatgtggggccagccctaatgtggagatggttgcatcccacctcattggtcactgatggggccatcgggtcaccagctctgataggaagaccagtcttctcattagaatcagcttcccctgtggagcgtccctacggtcagagttagtcatgggacgcgccaacgggcactaattatacctgccaagttcttttcgtatggtatttatttggttcccaccacaaccctgagagaggatctgttctcccctcattttacagagaaagcagacccttagagaaggtaagcgtctcccccagggatcccacacacagccaggaagtgccagggctaggttttgaatccagagaagaatctgatgcccatgccctggactgtgtcagcaagggcagtccatgttactcgaccaaggtgagactcttacccagctgacactgggttcctaactgcgaatgatccagtctcagcacttcagttaacctcgaaccgtgcctctgacccattcacggccctggtgtcgtcttccgacatttatcta

SEQ ID NO: 31596 - DNA, 1881 bp, Bovine  19866880570171
atgagctgagctccctgtgctgtacggcaggttctgtctcctttttttcctccttgttcccaatatgttattgagtttaagttcagttcagttgctcagtcgtgtccgactctttgcgaccccatggactatagcatgccaggcttccctgtccatcaccaactcccagagcctgttcaaactcctgtccatcgagtcagtgatgccatccaaccatctcatcctctgttgtccccttctcctcctgccttcaggctgcatccatctgcctctttgtgcccaagggttttttctggaacctcaaagactgtgctttgcttgcactcatagcaggcagaagctgctggggaattagcacacctggaaacggccctcctctgaagatggatggcagctggggtaaagacaccctgtcccctgtcccacaggtggtatgatcctcaggcctgcattgtgttcagatgttccccacaggaggaagctccagccattggtgggaagtttcctgataaaaccccattcctggctgacttcccttccctgtaccacttccctctgcctccggaattaacccctttcacatgaatctgtgtcttagagtttgcttctggggacccaaattcagacactttccaataaggtgatgctcactatctgagcactgctcctggtgtggtcaccagtgacctccatgggcccaagcctggctcattcccatggcttcatctgaccccacttcttgcagtctctggctctgccaattactttcttgtgctcagaatatatcctcacttggactttgggacactgtcttttttttatgtttacttttctggaccatcctttcatagtcctttgttggctgtttttcatcttcctgaccccagcactcactgccaggaagatcagccaaaatatacacaaaggaaataacacactgcaaacagggcaggggttaatttcatctgtgtcttttaagtcgaggagggaggtgactatggaggaccagtatatgggaggcactttgcatcattaagtcatttgatcctgacgacaacccatggtggaggtgctgtttattgctgtatacaaaggaggaaataaaggctcaggcagattgaagagaggcttggtcaaggcctgtcctccgggggtggtgctaggattcagaccatggactgtcccactccttcccccgtgaggaggcagatgtggcctgagacagccgtgcggaaagtgggccctgatttctttcccatctttctccccagcttcctggtctgatgattgcctttattccctccagcccagtgccccaagcccttgatttggttgagccgctgaataagccccagagaaaaacagttgattaactcatcaatggtgcggagccccagccactcgcaggaggcccttgcccctgctgtccagagcattcagcctccatcagggagattgaggctgacttagaaattcctttgcagaactgtgtttggagggtaatcagcccccatccaggccacttgttgaaacagggctgagtgattcagaggcgctccagacagtccctatgatttggtccacatcattgaggctgataatggggcttccccgaagtgacgggacctcatcccgacactcacttccttgaaatgttttcctgtgactggtgacggagcatgaggcattgagaagcagcagaaagaaggccctccacgccatgggaagggaaccacaactgctggcctgtcgcttggtttcttggggctgtgatgccatggaggcacctgcgccctggcagggggtctgggtcagatctgttgaccccccggaggtgccctgagtctacacagctcccaacacaacgcctgtccagtcagg

SEQ ID NO: 31597 - DNA, 1032 bp, Bovine  19866880578185
catacaataaaaggcagtttctggtctataaatatcaaatcattcttcagatgagttgtctaaaacagtaaagtgtaatctgtaacttctctgcccaaggggtcatgggtttctttgaaaatctattgaaatttcccagctccatccaggaaatacacacagaagatacaaaaagacatgctgcagaaagcaaaagggacacttttatgtgggagtgttaatatgtaaacacaagtacatttaatgaatttgccgggttttgtctactatgagcatttctgagtcctaatcctggtagtgatataagcctgtgtggactcagaagaaaaacatcctttatggtgtctatgaatggctgagggccagctaagacccttgtcctgtatcctcgttcccagaagcatcaggaccacatgcttcagcagagacaagagcattttgtgaatcatttgctcagttcggctttgggccattggtttcctttcatgtcagtgtccttccagaaaatgatttaggtcaagctggagcataaatgctgactggtttattccaagctctcaagtatgcaaaaaagagtgacagaaagtacaagaccagtttggagttacttaacccggctaagagatgttagtctttcatggaaaacataccaatctgctgacatctcggatctgaatattggctcgctctttttgaaaaaggaaacctctgcctgaaagtgatatagtatctaccacctttttacaatcaaattcctaaacttgacttgcttccctactatgctgcataagtaagaactataagcacagggacccataactgacctgatattgtcctgtgtcctcattttcatctctctttattccctcctgcaatattccaggacagagaattgtgtcctggagtttcaaaagtggagtcattctaaatctactttgtgccgaggggctcttccacgtaaaaatagactccgttccactcagactctgagtgaccaaagagggatcacttaaccgcgagttcactgcagag

SEQ ID NO: 31598 - DNA, 1596 bp, Bovine  19866880578425
cctgtgtgtttcggaaggagaagtgttccatgtggtaaacaggaaggattagaagtgaaggaaagtggggtgggcttgagaacccactttgggaacataaaatgtagggatggtggctggaggactaggtggggacggtcccacagagcatagagtcatgtttacaaggggtcactttgtttggaggagaatgggaagccaggaagttttgtccagacagcatcatggtcagaactcatcacagcctcctgctcagaagcttgtcacctggtatagcaggaagcaggctgcccacagtgcaaggtccagctctgtctggtcagccgagtttccccaccaggcctgaccacagagcagggctgcccagggctccattcgggcacaggaagatgtcccctctttctcaggggaccggtcccgtagtttaggagactggcattggatgtatggggagggaggagatctgggaaagtgatgggcagcaatgcgtggggctgggagagagctggggctccgcaggatgaccaacttttccctctgctcaatcactggtcttttcacaccatcgcttggcttgtgaagtccctcatccttgcatccgagcccttgcctacctcccctcattccagtatcctttcagtccttctctgtttgctccttccagcctggatgatcaaatccatggagggtgttttcagaaatgcctttagagagaggtgcaagaatcctcttgtttacctgatcagtgtatctggaatagaaggcaagaaaagcatggttgtggcagcagagatgtgtgcatagacatcattcacccactcaaccaaatggaaatgcactgtctcctgagtgactcttgtgatctgggcctagagatctaggtacagcctgatcctggaactctagggtctgactcccaggagacacaggaggtagctgtgaatgtagatagcttctgaacatggcaggagggaaacatttcagacagagccttgattttggcagacatagaaatctggagggctggcaggcacagggcaccccagctttgaacaacacagtcctttgagggttcccatgaaatgctttttctcttgacgatgacagccagcatcctcctaaaattcaccgtcaactctccctgttccactgaggaaggaattgggttccctttgggtttgtggctggtttttgtgcattttcttttatcccaaggcgccgtggggacaatattatgctgctaagagtcagggaagcccacagagacctgagtgaatgacactgaaggtggttaatttgctttgctccattgagtaggttctggcctcagccttggtgtgacttggagaccaaatcccatggtccctgcttctgggaaggtggctgccggcttcccacaggggcaaagcttctggcatccagtcaaactggattttaattgctagaagcctcttctttgtgggatcctccccatggtagtcctgagtccctatagacactgcaaaaagagaatccagttttcagacaaaatacccatgtttcagagaaaacagtccacggtgccgctacttgtcagaagagagaatcctaagtaag

SEQ ID NO: 31599 - DNA, 1821 bp, Bovine  19866880686437
cttattaagttgattttctattttcccaaattactgcaggtaacaattttgcttagtttgctgcaattatataacaagggtaccctttccctctaactcccagtaatatttgcctcactttcctttaaactcatgagcctcctcaaggttcactttgcttccattaaaagtctccttaaggtccttctagattccttctgctccacaggcccaaagtctattccacacattttacattttccccatcggaatgccaccatatttccagataccacattctgttcaagttattactacttaataacaaatgtcacagaacctgctgttttaaacaataatactgtatgtcaggtatcgtgcatgtcagaaatttgatcagggcttggcttggtgattcttttggcattaactgagattgcttgatgatactcagctgcctgatggattgattctaagagtctaatatggcctcactcacaagtctggtgctttggcagaggtggctggaaggctggattcatctggaactgttgactagaaaacctatgtgtggtttttccagcatggtagtctcagggatgctgaacgttttgtttggtagcaggcttctcttagataagtgattctacatggagcatgattctgtccctggcggaatatttggcaatgtctggagatatttctggtgggggcatggggatggggaagatgctgctcaacatcccacagtgcacagggcagacaccccaccccccaggtccacaacaaatacctggtcccaaatgtcagtgtggtcaaggctgaaaattcctttcctagaacgagcatcctaagagtcaagcagaagtttctgatctagacttgaagacaagcagcatcatattcagaccagattttaagagagaagggaattaaacatcacttcttgatagggggtggtgaagtcacattagagaagagaatgtgggatgggaaacattgccacaaccatctttagaaaatacaatctgctccaggagctgtcagggaactctgaatgcgatctgagccacagaaaaggggcaagcagaatgctttaaggatgcgggaggatctgcctcttctggttggagggataaaatgggatttccagaaaacatgacaattcagcaattttttttttcagtgataaattaaaccttgaaagaagtggagtattttgaaaaactcagttggagacacaaacattatagatagaaagaacaatagaaataaagatatttattcttaaggatcagcagactatgggttttggattaaatccagcttgttatttattttgtaagtaagattaattggcaccaagccatgtgtactctttgagtagttaaccacagggaccatgtggcccaaggagcctaaatatttactgcctggccctttatgggaaactttgctgatcccttagactaattcatgaatttatttggttttttcaacaaatacttcttaagtggatgctatatgccagaaatgtatcaaagcttgaatatagaatggtgagcaaaacaaagagtagaacagataaaagcaaaaagtagttattttggagggtgattttgactattaataatacaatatttgagagctgtaaagaaaataacaaagttctgtgcttaagcattttgagtacttgggaaaagtgagctgaaaagactttatatagaggataaaggtaagacctgccagatgagaaagagccagcgatgggatgtgaaggctggtgataagaattatcgggaaggtgaagagggtacacagagttcccaaggcaggaaatag

SEQ ID NO: 31600 - DNA, 1907 bp, Bovine  19866880731831
actgtttcatttcttccgaagtcacacagaattgggctgggatatagtaactttgtttttttgatgctgatctgcaagtatctttacatatatttatttaagctatttagtaactgtctgaagtgggattattgctgcattttatagatgaggagcatgaggctcagagagatttcttttgactttgatgcccatgcatttagccatggcaccatcttattactgtcatctggggcttgctaggctccagccttctcttatcaccagccaggcagagttgatgccaaggatggcatgtgtggaatggacttggcatgccctaggtttgtgcagtcagtcacttggataaatgtcatgtgtaagatcctacccctgcaaggtaaggactggtccttcctcctttgcccctcagccttcctttaaaccaaggaatgtcctgccttgggtggagcctgaggactgggcatctgggtcaagggtcagaaaggcaaaagcaagttctacgacagaatttggcagagtggtgggagaggagtttgtatgtttaaggtttacagaatgcagtgccatttggtaaaattccattgaaaatacttgtatgcttgttgtgacagcgaaaggaaaaataaaagagaagctgacatttgggagagaaaatctgtaacattaaaataccaaaagtttggactgaaccagaagagagaactttctgtcttgccacttggatttctgggctattcatgtgtgttctggggagggtgtgctagaagctgcagccacaatttctccccagtgagcacatttggatgagggatgtatttatggtgggatcttagaaaccactgactcattcattcaacaaatattcactgagtccctaccatgcacaactattttgctaggtactcattttagatgttgaaacagatggttggagtgtcttggctaaagttgcacagggctgggatgtgaagttaggaccccagggctccttcctccatagcatctttggggtgtgatgctccctgttagcctcttgaaccagcttgcaggcctgggatgagttggcagcagggattccacagaagcaaaagcttagggctctaaatgtgtgtccatttcctatttgtgcttgtttttaaattattttttaaaagttaaaagttgcacacttttacaatgtatatgtcaagttaaaagaatgataatgaagtgagctcccacgaacccagaccagtttaaaaaatgtacaggagaggagggttcaggagggggaacacatgtatacctgtggtggattcattttgatatttggcagaactaatacaattatgtaaagtttaaaaataaaataaaattaaaaaaaaaatgtacaggagccttaagtgtcctcatcgtatcatgtcatctacctaggggatctgaccagtatcatgattgtattctaatgagctccttgcttttctttatagcttatcatacaagtatgcatcctaaaatacttactgcctagtttggcctctccatgaaccttaaacatcttgagttaaactactgtacacttttgtgattgctttcttttcttaaatgtttatttatttttaattgattgatgattgtgattgctttattttttattaaatattgtgaactattgggcctatgcatgtttcactttgttagatcattccaaattactttccaaagcatttctacctattttcactgctatctgcaatgtaagagaattctcgaagctccccaacctcaccaacacctggcattgcttttagttttaagattttcatgtggaaggtgtctcactgtgattttgatttgcattgccatataaaagatgaagctgagcgtatctttatgtgctattttgttgctcttctaaataccca

SEQ ID NO: 31601 - DNA, 1421 bp, Bovine  19866880735697
tacgtgtctgactgtccactgtgccataaccactgtggaggcttgagagaggatcagacaaggagctcaatggaaacagacatgcaaggcttgaagctgtattgctgctgctgctgctaagtcacttcagtcgtgtctgactctgtgcgaccccatagacggcagcccaccaggctcccccaaccctgggattctccaggcaagaacactggagtggggtgccatttccttctccaatgcgtgaaagtgaaaagtgaaagtgaagtcgctcagtcgtgtccgactcttagtgaccccatggactgcagcctccaggctcctccatccatgggattttccaggcaagagtactggagtggggtgccattgccttctctgtgaagctgcgttaggacccatgaaaaatgcccaagaagcagtctgtttcctggggcagtgttgggggaggacgggtctccaggaaaccttcagagagctcagccctggagcccgtacgcctaggtggtctttcccacaaggagagacgtgtgctccaggccaagagaacatcaggaccaaggatctcctggaccctggagcctgcccagacctgctgatggctctgtgtggccgtgagggacaccgagcccgaagagctcctgagggggagagccacagcggcattcttgggactggccagaaagcagcaggacagaaggactggcatcagagggacccctgggtcagctgggactaggactgtggccccggtcacaccatctccaccctatggcttactccaagtctctgatgcagaggcaggactggggggcagcaaagtcagtcgctctggaggcagcccggatcccccctgtgtgcctgagtatccgccatgaccagagccaggcagcctgagcagctgcggcccaactcttgttggggcctttccaaagcagggctctggctcccaggcaggagagtcgggatttggagcctgacactaggagatgggctcatacatgttgtcatctatagcctgatcatgcctacttagctctcggagcctcagttgccacctctgtaaaatgggcagggtggggcctcctgtggggaccaccacagagagcacgcaggaggatggatacaagcgcctggactaaagtctgcatgtgggcagggctcggaacgatgggcctgtctccccagtgacactgccccctccatgccacctccagcaccaccctgcccctcctgctcctccacagccccggctcaggaaacctcagtcttcacagctctctgctgacctcatgacaaaatgttcttttacttatgcatttaatttacataatgaccccctgatatttactcagatttaatttgtttcctctggaacttgcctttgaagaggcagtgccaaccacggctaggagtgaagcgca

SEQ ID NO: 31602 - DNA, 1074 bp, Bovine  19866880796743
cctctgtccatgggattctccaggcaagaatactgagtgggttgccatttcctcctccaggggatcttcccgacccagggatggagcccacgtctctctcatcgcctgcattggcaggaggttctctaccactgacatcacctgtaggagacttctggctccccagccagaagggaagatgaaaacttgggtgctcccaggattaaaagcgtaacatttgaatctctgctctcagattgaatgtgaaggcagcagagtctaatttttaaaaatcaatatcaaatcaaggataatttttcctctgctagaaagaaacgaaagctaattttcctgcattcccgagtcataatatcatttgggaaagaacatttcccttcaaatattgagacacctctttatgcttcctctgtgccacgcaagtacttctggcaccaccagaaattaattctttgtcctcagaaatgcatagtgctatgcttttatagtgtgtctctgacaaatgaagaagctttgcttttgtaaattgtggcataggttttgtaaaactgaggatagaaactataatagaatggtgctcgactagtataaacacgggttcaggtgtgaaaatgctgtgacacagttaataggcaggtttctatgtttcggtttctatgtttcattttctagcctgagggttggactctggaaatgctgactcagtccctcaaacctcttgagtaaaacctgtatttaatgaacccctactacacgcctgaccttgtagtaggcattttacacaaaggagttatttaaaataagtctgtgaagtaaataccattttctccattttccagcaaagaaatagacatttattgtgcattaaaaactagttcaaagtatttttattatttcatctattgtgcattaaaaactagtttaaaaagtagttcaaagtagtttgcacacagtaagtggttggccttggatttgaaccccaaaatatttggcctcagaagccctgatcttaatcactaagccctgacagggtcgtttagactttgtggttattaaggaggccaggaattctcagtt

SEQ ID NO: 31603 - DNA, 2084 bp, Bovine  19866880814487
cctgccagatggtccagtcaaactctaccaaattgttgtgggcacatgttttctccagtgttcttttgcaaagtagcatcatgcgtcatttcttgagacttaaaaatttaacagcatgcctattcctacagtgggaaaacattttatatccctttccactgacttttcgctactttagaccttcaagatttctcttgtcaatagcactgggtcattgcaagccctgcccagttgcaaatgaacaaagtccaatctaagtttataaaacaagagtggatcccttagtgccgggtggaaatagtggaactaccaggcatttatttgatccttagatctggattcaaaaagaggcaagaaaaatgcacctcagagccagacaccaggaaacgagtgtagaagaacatgaagcaggactctaaatccagaccatgcaactggagaatcacgtaacagcactgtgactctgagaggtagagatggagaaacctaacagcgggaggcaaagggggttagaccaggtccagcctgtcctgtaatactagtaaaaagagttgctgttgtcttacaaatgttactctttttgtcttccaaatggatatttggtatatatttgtatacccacattaaagatgggaactttgagattcaaggaagttagattatctgtccaatggtctagagacaatgagaggacaagctttagatgttgatttgtctgatttcagaactcacactgattttccagagacactgtatctagggggctacacttcagtattatccatggaaattaagatggtctctaacttaatgagctgatgggacaggacattcctgatgtacagagtgctttaccatggtacttctcaggtgacggtggtcccttatagtccaaggagacaagactggtattgcaggagctcacacacgtggataatgggttagaactagagggcttgaccctggctgagatgttctattttgggccccttggacctggcaaatagcttctccttccttatttccccactttgacattttaccccccttccaggcttcctctctcatacccccataacatgtctgccatgattggagaaggttcatacgctttcccgtgtccctccaagcttgtaattccatggggcacgttctaaaaataaaatgaaactattctgaagtaagaatattcatttgctcagagctaagcttctggggagctccaggcagtcaccgacacatttgcagagacctgtcccatttctcacagccctgccacctactccccgaacctcgaaaccctgcagcctgcctctggagccccgagtgaccagtgcagattctatcagcctccatttcattaaagataaaatatactgagtgacaatcaaaacccagaaatctctaagcatccctagagcaacgatgggagcttgggagccagcagtgaatgatgggggtggaaggtgtagggcagggaggctgtgagaagaaattatagagaagtagattgtggtcataagaggacattctaatagtctgagctgcctgagtatgaaatgaaccattttggaaggcagagagtttcttgttaccgagagggctgcagaagtacttaaggtggcaggggaagggctcactatccacttccccaaaaacctgacccccaggtctgcacaatggggacagggttctgggaaataactacttcatgtacttgaccgtgaaggaagctgttaacccaatcagtcctgtcatctccactcaccattccaatctggactgcatgagagcaggggactgttggggactgcattccctagcatcagtgagctgggtggcggtattaatccagcttatgaggggcagaggaacgaatgaagctaagcagaatatttggcaggatttgaaagagtagggccagctctgctttctgagacgagtacaaggtcaagtcatagaccccactgagggggcgctgtcgtccaggtgggggtctggaactttgaaaaggaagaatgctgtgccctagacacagattgtgtgcaggagggtggaggaagtgttggcagtgggcagagttc

SEQ ID NO: 31604 - DNA, 1804 bp, Bovine  19866880825745
aagtctttgtttaatggataaacttattattttaccttgttttactattttcccatctttctgcatttctttcctttcttttttgcatttctccaattaaattttttctttgattgaagtttttctacagacaaaaggcagagagaagacatgagggtgcgatctgttctgggaagaccccataggatcctgcttggttaccatagcaattccagccaataacatgaggagaaaaagcactccacctaagctcatgtgatctgcagaattgtgagagatagtatttttaagctgtctgtgtgtgtgtggaggaggggtgtggttggtacacagcaataggcaactgacacaagagaaccatatacttggaaatgcatcaaaaacgtctagattataggatttagcctatgatctcagatgttcccaatgcacatccttctaaaagtctacttgcctcctcccctgtccaaagaaccaccttcctctaaaaggacagccacaactcaggcatttagaaggacgcattgaatttctgtttggactgatctcatcagtcctttggggagttttgctctcccatttcttacaacagcagagacaaagaaatattcttaaaagaaacaaaatatgtgaacatttctttggagattgatgctcctggatagagaagtagtgagcattctatgggttccagccattctgttctcattttgcttttaaattgctgctggcaaatctacatatcataaaagtatatctccacacttatgacaaaacttctacatttcccttatagattgatgcctctgaatgaagaggtaatgtggtttatccggttctagctgctctgttttcattttgctattgtactgctcttggcaaatttacatatcgtaagaaagatatttgtgtctacttgcctgaagcttgttaacatctttccagtgttgcctaaaacatgattaagattatacaggacagtcatcttgacatgggatccaaattaggccaacctaatctgactagtgcccttgagcccctaacgttgctcaaccaggtaaggcaaatggagagtcacgagatacacatgaaagtaggctgccagaattagtgaagcgcaatacagttcagcccattaaattaaaaattcagataagcaataaataatttttggtacaagtgtagcctatgccagtttggaagtacttaaaccaaaatcgtatttaactggatgccttgtattttacctgaaaaccctatcatcgtctcactaaggtataaggaggccaagtatgtctctagtagtcatacctccttttagaaatgtgtctctttgcctgctcttgtgggatccacagtaatgtggttatactttaacatggggcatggaaaagtgagatagacttctgggaacctagagccctcacatctattggacagttataatgcatccaatatttcacatatgttatttcatgtaaacttctcgacaactccaacagatttgagtgtcaccacttggagggaatactgggagaggacttgcccggggtcccccggctggtagaccgaagctcagttctctgatcagaactacctggctcccaagcccatgtgtgtatatctccacaatgttctgatcttgagggtgaggtgacaggaggtaggagggtgtgaagagggggtggagttcttgctattttcctgtcattttcgtgtacccttgttgcatgacatttgagaggcttattgacgactatatactttattgaggacaaataaggtaagagaaaacaggaaagat

SEQ ID NO: 31605 - DNA, 1735 bp, Bovine  19866880830118
cctggtgtgctgcgattcatggggtcacaaagagtcggacatgactgagcaactgaactaaactgaaataaagggcatactcagtttggttcccaagaccctaccgttttttgttttaacaaactatgtctccagacatatgcccaggtgggcaggtgattaagagaagttacaaatcaacactagggcaacatcagttctgtctctgtaatagcagccttcggactctgaccaggtagcaacaggttcaacatcttgattaaaagtttcctaagtgcttagacactacctcctccaataaatgcatcagcacaactgtggttggtcctaaatttttttacaactatctttaaaagttagactcaagatttagttgaaatagagaaacatcaggtacacatagcctgctgtcaatcaaaatctgcagtgaaggggatttacctggtggtctggtgggtaaggctctgcctgccaatacaggggacttgggctcaatcctaagtcggggaactaggatcctacatgctgtggagcaactaaagcccacacgccacaactagagagtcctgcacgcttcactgaagatcccgcatgcggcagctaagatcctatgcagccaaatacataaataattaaaaagagaaaaacctaccgtgtaactaaggaccatttgttgccaggatatcctattgccctgaactcaaatttcaccttcaggatactaaagattttagaatttatctacaccaagtaaacatccctttaccttcactgtaattacagcttgatgaatgctatagtagttcatcatataagcttagatttactaaatacttcacctggcataaagtagacatcccataagcatttcttaaattaataatattggtctctggcattttcttataaccccatgggttctgggaagcagtcaggcatactcttacccactctctgactcattaagtcattaaaactcttatgatcagctttgtcacatttatattcattttcctcattctcttgagtgattttttgagttcagttaagagttcagcatttgttgaatgatttctgtgtagcaaataagttccccccaaactatttattaattttgattcatgtcttatgcataatgatctatatggtggtagtaggagcctgagcataagtgcaaaccactaattcattcattcaacaaatgtttgctgagtgccagctgtttgtcacatgctggaatgcagatacagaggtgattcacaggtcttctgtccttgacagagctgccagtatatgtgagagaaaaagaagaaagtattaattataagaaaaagtagtaagcacttctttgttgacaacattgaagagacctaacacagatggaagaagagggtaagggatgatgaaagcttttctagaggagtgaaaaaatgagggggatggtgaaaaatgagtgggactcggcctggtggataagaaagaggtgcaggacaaagcatatccttttgagagtgatattctaaggggtgtattgagaagctcagacatgactgactgatgtgtggaaacaacccacaagaaggggatgggaagctcagcctaattccattgtgcttttggctgtgcttacacgcgggctgagcagataactgtgttgtccgacaaggtcctggctgagaagtaaagctgacagacgccggcttctgctcacagtagaacactgcccctataaggt

SEQ ID NO: 31606 - DNA, 1696 bp, Bovine  19866880844346
ccagagcacaaggcacttagatggattaagcctccttgatacaattggagtggctggaaatagctctgtgcagcctgcagccgctgcctcccaacaatcatccccaatcaacaccccacctgtccctgctgccagttaattccacatgacaccctggctgggaaactcagagcctccagatgtcagccccaaacgagggatcgcagggactgggcccactcagccaaggctgaagcaaagtcaccctcctgggtccccagtgtccaagagggacaacatgagctcatgcctatgagctgcaggcagagaagagcttggagatcgcaggagaccatgcacctccaagggagccgggtcaatctcaggaaatagacatatgggtcccctcctgccctcagctactctcctagactgttcaagactctcaagagttggcaccaggaggaaggacatttaagggcttcatgcctaagaataagcagtctcttcaacagcaaaaactgagtggcatcttggtcattattcgaggcagtgaagaggaggagcacatgccctccagatcctccacatgcccaagggtaccgccaaacaagggtggactatatgggggcaactggcaacccagtggtgaggggctactctggcccagatggaggctctctgttctacaaatgaagactctgtgcagctcagaaagagtttccacgtgatttcttctgggctttctactttgtgaacccctccttcccagccccctgcttcctcagtctctccagccatatactttccatgcctctctgatgcccccgggcactcagtcccagccagagcatggggccaacatggcctgtgccccgcctcccggggaagaagagagtcccccaaaaaaacacccaacaccatggaagagtgtaggattcagagtaaagacatgggaaccatgctgccctctcccagaagccactgggttacatgatatacaacgaagaggcagcatatagagcacatatagctccacctgatcaactccgagtcaccatcagcaacaagcccaaagcacggaaacaggcattccctactatctccacacctgaaataccattctcggaacaacctcacccttcagggttttgtacttttgcatgccttgttacctccatctgcagaactctcccctggctactataaactcctactcatacttgaagaatttgctcaactgttagctcctccaggaagtcttccctgatttctcccaggtccctcctctgagttcccagagttacctcctgctctggtctgtgagttcttccacagagggtcatatccaagccatctattgatcccctgccgagggctggcaggaaagagccctggcagatgggtcccttccacagatggtatgtgaatgatgtgctgtcacctctgccctgcagtgtggatggtgatgggccccaggcggccctgtaactgtccaagctgccaccccaggttccctgagactttgctgagcgctgggctctttccaggtctctaaacacaaccctggcctcagcaaacttagaaacctgcagtgatggctagggaaagaagaaacactgcctggccagccaggctttccagaaggggcctgtgatgcacgctttgcaaatggcaggagacatgcatgtcagaaaactgtccacgatcaatttca

SEQ ID NO: 31607 - DNA, 2845 bp, Bovine  19866880850176
tataaagatattctcccgcggaaaccttcctctctgctctgagagcagatgttgccctccagcctgagtgtccacagctaggtcctggctctgagtatgcctggatccctatggctagaccatctctccctgcagctatggcctgacattcttccctgacactgctttgctctgctgtggccatggaactgatcttatcttagtggtgactgcgcagcttgtggcatggtggttcaggagggcttcctgaaggaggtggcatgtacgcaagcctctaaaggacttgaagtaggaaataggcaagcagagggtactgggggcagataggaggaagagtgtgccaggcagaaggaaagcatgctggaaggcctgggggcaacagagagggaaaagatatggctggattgtgggcagtggccaagggtggggctggagctcggggccaagcaggccttagaggcctcactgatgagcacagaatctccagaaatccttgagagccatagctcgcctcctcaggtggtgcctctgggtcctattcattccacccagtccagaggcctgaagacagactcgggtcttcttttctggagggctctggtctttctgttgtctgtgtccagactcattggcttcctctgaaaggaaagatgctaatgcacaggaacaagctgaggacaaatcccagaccccgaggcaggccctgaacttcccaggtgaccaggcggcccagatgtctgtgagtcacagttcatgtttctccagcctcactccaagcagggcgccgtgcaagcactgtgcgtgctccagctcatggcatccttatagcaatccttcgaagtgggttcataccaccctcgttttacagatgaggaaactgtgactcagaaaactgagtgagtggctggtgagtagggggttggctaagtgtgattcccgaagcccaggtcaccacagctttgctcacagcctcttaatccttgtggcaaagctgtggggagcaaggcccgcaggtagactcttcacttaatgtacaagggtttactggagcactgttggtgaccacagatactgccaacaaccataatggttaaatatgttatgatacatacataatgggaaaccacgattcctaatgaaccaagaggccatggttccaacgcagggtactgttagctcatagcagcaaagtgagggtggtggtgttagtattgctctgggtagaagcaaggtcacatgtgtgtgtgagtacacgtacagtgtcaggggagagctgtgtcagggagggaagcacagtgacttgggacaaagatgggagatctgtttttttgtttaacgtctttaaagttttctatcaagtaccaaaaatagtaaatacaacagtgagggttgccatccttccttcccgctgatcgcccatggtgaattccctttttgtcatctaagaatagggatggtaatttctgagctgcagattaaaacccctggcacagttccggtacgtggcaaacggtctgtatgataataacaaatcatgagtgggaactaagagtggcagtggtcagtattcttccttcccagggctggatgttggcatagggcttggtagagtcttggcgtgagagctttggctgtttgtccctcctcaggattatcgttgagtacagtggttaggagcatggacttgggagcagtctgcttcagctgaatgctggctctgcctctatagctgtgtgacactggacaagtcactcaacctctctctgcaatggtttcctgatctgtctaaggggaataaagtaatcattcctatttgctgtgcttgctgtggggattaaatgcattaatacatgccaagggcttagttggcaccaccaaatcaatggatgtgagtttgagcatattctgggagatagtgaagcacagggaagcctggcatgctgcagtctatgggattgcaaagactcggacacgactgagtgattgaacaaccgtatgagcttagcacagcgcctagcacctgaagtgctcaggaagacttccttactcagaagctacaactgctggagccccctggcctctgagctggctcatctctgctatggcttgttctgcagtccaggaaacatcttgcttatgtccttggtgcttgcaggaagagagagagttcagggtcagctctctcacctgcaggggacactccaggcctgcctggtggtggaggtgagttgctaggagtccccaaagactcactgcgcagtcccaagtggctctgatgagtcatcacaccttctcagctggacagcctgacaggttcccttggtgaacatctgttggcagttggtcttcaccccgagtcctcctgataggaaactcctcagaagaaagagaattggacacctactattttaaccaatgcttcatgccaacaaagtctcctttctgacgtctggcataggaagtcagacaactgagctgctccggtgagccttcttattaataacacgtatcgtatcattatggcattagtttaaattgaagtaataaatactttttccaagagaaatgaataagtgagtttaattgctaggaaacctaccaagaagttcgacaataactttactgggacgagtgttttgggttttgttcttcgatctaattataaagcaactgcacttcagggcacgttaattgtagcatttgctggaagattaaagttcattaactctgaagttccatcacccttctgtcggattccatggtgcgtctgaggacgtaaggagatgccggatgaaggacaggaagacaggggtgccggccgccctcgccccagccccatgcacag

SEQ ID NO: 31608 - DNA, 1531 bp, Bovine  19866880883397
tatgagacagaactttctgactttccaggagttaatatggaatggtttgccaccccgggagcagcaaggtctcatcgaagaaatgattgaatggaaggcagatagttggacgatgaatggtaagtgaatatcagcatggaggttgaccatgggtgagggggtaacacccatcatcactggcattctgcagccatgaatctcagtctggctacatgtaagaacctcctagggagctttgtaaaatgcagaccctggggccctactccttggaatcctaattcactgggaatggtcatgtgcctaagatactgtgttctttcagagctctgaaccctgaatcttagcctccaaagctgggagctctgtagtctagaatgtgtagttttgtgaatttgaaggtgtaggcgcacctgtacaggtgagaggtcctccactgtccctgcaggagccagcagtgcagacctaactcagccgccaggacatcccatgcagcaggtgagagccccggctacactaaggcatcttcccaccaggtctcagactcatgtgtggaagataatgatggagagaattgatcagaaaacccacaggacaactggccaactttcctgtcctactttccctcaccaattagcaattagctaatttgttaagcctcttttccccacatggagataaatagcacttggctgcagcctttttcagagggtgcaactcacacagaagctgcgatggctggtgagaaggagatgcaactgcagatttagcgagaacaccctcccctcccccaatgactggagaactgctgccagctccctgggcagagccctaaatgctccaagcccagaggatggtgtccccttctaagtacccttccctcatcttctccaaccataagtgaggcaggtggaggcccctgagatctcccttttatctcagagccagcaaggtcaggacaaggcaggcaggcagagcatggtcaaatcccaggtccgcctctacttacctgagtgcccctgtgttagctactccacctctctgagcggcagccccatgcctgcagggtgttaagatgccggcagcacaatcgatgctgtgccctgggccccctcaaatcccattgggaattctgagcgcgctggctctccatgcgcatccattgccaatgcagacactgaccaactgtcggaactctccttggcactcatggaaatgtgcaccctcacgaaggactggggatgcccagctgccccgttccactatggggactgtttggagtgtaagctcaactgtttccaggttccttctgcaggaccagcccacacggcctcactgctggctgcctctacttccatgatccacattcccactcccttgctgggctcttcttaattcccctgggaaaacttcttaataaatcgtcatcacacaaactctcacatcaaagttggcttctgggaacccaacctgagacaagcaccccccatcttacaaatattgtgagaactaacatgaaattaagttgaagcct

SEQ ID NO: 31609 - DNA, 1656 bp, Bovine  19866880962078
aagaaaattgtctagcaatctgttgtatttgacttctcactctgccgtgttactgtgttgacttttgttcagcctcccaaccttgaagagatatcctcttcaagaacattcaagagaagacagaagaggaagcagagtagcaaacaatttttttttttttttttttctgtagaggtgtccctgtggcaggcagacattctaggaaaacactcaagattctacatccttctgcctggaacccgtgaacaggaagagatattattcctgtggctgtgttaagttacgtagcacacttgacccagaaaaggggagatgattcagatggagctaatctggtcacatgctcagtctctcagttctttcctctctttgcaaccctatgtactgagcccgccaagctccagtgtccgtgagcttttctgaacaagaataccggcatgggttgccatttcctcctccaggggatcttcctgaccttctgcgtctcctacatggcaggcagattttgtgaatcaaatcacaggtgcccctaaaacacagaagaaaacacagaaggaaaatacagagatgtgaagaataaggactgatgtgccccagctagtatgaagatgcagaggaccctgtcaaatgcaggggaatctaggtgtcttcctggggcagacagcacctcttactgatgttcaagaaggaatctggccaacaatgtaaatgaatttgggagtggagtctttccagaacctcccacaaaggccctagctgggtcacacctcgcttttgctttgtgagaaccagaatttagaacctaaaagaggcctccctgattgctgacctctagaagtgtgagctaacaaaaaacttttgttttatgttgctagtctgcggtaatttattacagcagcaaggggaggctaatacctactcctttgtgtgtaattaagttctaaacggaagaggtaaatggaattactgaaaagcaaactctcagaaacaaaattagaaagtaagctcgtttgcacaataaaagaattctttacattgcaaaaggatttagaggttcctttaagtagcacttatttaagtatttgtttacagatcattacttgcttaacagagggagaaactaaaagctgaagtgttccaagcttttgctgattaaatagcaatcaaaaatgaagataaagtatgagattataataataacaaatgtgcatttatgcaggcatttcaaatgttttcattttacataatcaaaagcaaaagtcccaggatttgcagttctctccaggacacttgtccttcttattcaagtcatatttagtgcaagcaagcaactgcgcagcactgaagaccttgggagtacaaagaggaggcaaggaattctcatcctcgggtcctttgctccaaactaactgatgctttctaactgtggtgctagagaagactcttgaaagttccttgaacagcaaggagatccaaccagtcaatcctaaaggaaatctgtcctgagtattcattggaaggactgatgcttaagatgaagctccaatactttgggcacctgatgcaaagagctgactcatggaaaagacccagatactgggaaagattgaagtcaggaggagaagcggagacaaaggattaggggtggaggcatca

SEQ ID NO: 31610 - DNA, 754 bp, Bovine  19866881017212
aaatttcttcttctccccataatctcatccgataagaccaccgtgatctataaacatctaggctcctcatagcagatttgttagctatctggtctccatttgacaagcttttgaacttaatatattaagcagcacagttctctcaggaggtctgaatgcctccattcccatgacagtcccagagttcttgtcaaaagaaatgcagatggaaaagaccgactccctagggcttgttctccatgaaaatccacctaaattaagggggaagatatctggacacatttatctataattagggctaaatactgaggaggaacttccagctggaaccccttcttggatcagtagcacctaaatgctctgatgggatcatactccatcctgtagacctgctttgaccctcaattcttcagtcattcatacatttttaaatttttcatttttcttacaggtgttcatattatagctcaaatttataataacaatgagataaactgctatttttattcgagtactcagttcacactaggtgatgggctcagaattttatatggcttaactcctggaatgctcactgcaactctgtgggtattttctatcatgatgtctattacacagataagaaaaatgaggtgcagacacatgataatacatcatgatacaacacagccaggatttcacctcagaaatggtgagtaaacatgctgaaaatgtacaaaagcctaatttctggtcagcagaatccagaaagcca

SEQ ID NO: 31611 - DNA, 1439 bp, Bovine  19866881086494
tccaaatataagtgagcccacacagttcaaatccctgctattcaggtcaattacacacacacacacacacacacacacacacacacacacatgagagtatgtatataaatatatacagtgaaagtcactcagtcgtgtctgactctttgtgaccccatggacttcatagtctattaaattctccaggccagagtgggttgccatgtcctcctccaggggaccttcccaactcagggaaggaacccaggtctcccacactgcagggagattctttaccagctgagccacaagggaagcccatatatataatttcttattttattttcccctttttctattaagttaagagatatatcaatataagtggtgttgacatttgcatttcagttcacagaacactagaagccacatcaagaggttaacgggaagatggtatgtcactggagatgtgaggcttccaggtgggtacagcgaataacaggacattgtgtcgtcacttctgtgtcatgaagttgctgccgtttgcaagttaaataaaggtagaagttgagactcaatagtgagtagcagaaaagtgggctatgctagtctaatatctggtttgcttccagatctattccctgaccagcgcccagaagcaatgggagggcatgggagcaggattagcaagaagccacacatggacagaggagaaaagtttacaacactaggaggaggactggataaaaatcagcaaattttggtaactttgtcagggttatagcagacagccaacagtgaatggagcatggtgagtatttcaagccaggtagatttagatccttctctaaaaccatctcagatgctctaatcagcacagattggcaacaccagaaagaagcatggtgcctgatataaaatggagaagacgggacacagtgagctatggccagagagggaccatcatagtgggatgggctgatttggaaacaatcactctgtaatggctcacacggatcttgacttctaatcaaatgagactgttgcgagttcaaaggagaatgtgaattcagtgccactgccagtttatggcatttaaacaaaggcgggagtttgcttgattagtaatggcagtgactggactgccttggcaagacacaggactcgtcctcttgaaatgcaagtgcttaagaacagaaagagagtgatagggagacagaagtgaaaatgagagaagctgaaggatgaacatgggctgacggaggaggatcaaagcagcaataaccaatggagagaattttagaagcaaagttagcttcatttacagattaactctagcctcagggcatgcactgatggaatgctaccaaatgatatcaaattcacagaaaacatcaaatcaaacgcttgggaggaaaaagaaacaaaaacaaaggaaactatcctactgttttgaaggc

SEQ ID NO: 31612 - DNA, 1110 bp, Bovine  19866881105426
taactttggattctgtttgtgtgtcttcagggaaggaaatggaaagaagccagcggaggaagaaagccgtgatgagggaagcccagtgcttggtgcccgcagctgcagtctccatcccagtaggtcacaagatacgcagaaggggacagggtaccaagacccaccccagtttaccttttcagtccattcaattatctggttaaatggttaaactgtggtttagatgaactgatattaaattgtccgtgacttgattgtgggttctcctgtgcccctaaggttatgttttattgttgttcaaagtcatgtgtcttagggcacatttccttgtggaagatacgagaatagcatgcgctgtatgggaggcgtaattctatatcacccagtagtatcccgtatcaccctggcattgccattttggagcagagccttgtctgtattgggcatgaggcagggcataatactaaggaccccagacagcccctggtctgcaaggaagaaggacacatgtaggagcggtcgtgggcacagtgacattgactgtcaactcagaggtgagtgagggagaggatggggagagaaatgagctccaggtctgcagagtaggctccaggtggtggaaggaaggtactgaagcacagatctgataagtacacagtttgatctgagcctggcctcagatgtagcccagtcccgagactaagcattggttacaaactgcatctgtcctcaggctcactaaaccctgaccaattctccatgttaattcagactcaggcacagagttaagctgtaacctggcaagtttctgagctgtagcctcaacctagaagaatcctgtttatccattcaaataatatgttttcagtgcttgcagatttcaggtcattctctgaccttgaagccccttcaccttttctcattattagtgtgaaggtaaataagataatacacgttccaggttagtgcagttcctgcacacagctatcaccatttcctaccctcaccacctcctgaatccctaccatttccctcactattgggaggacagtagtcttctttggatgcaaagaggggcttttacaaggtttccagtagttctcataaagg

SEQ ID NO: 31613 - DNA, 1415 bp, Bovine  19866881117228
gtagaaacttgaggaagttaaattttggcatgtttggttctagtctggtgggacactgttctatggtctaagggcatttctgtgcatcagttcagttcagtcactcagtcgtgtccaactctttgcgaccccatgaatcgcagcacaccaggcctccctgtccatcaccaactcccggagttcactcagactcacatctattgagtcagtgatgccatccaggcatctcatcctctgtcgtccccttctcctcctgcccccaatccctcccagcatcagaatcttttccaatgagtcaactcttcacatgaggtggccaaagtactggagtttcagcttcagctcattccctccaaagaaatcccagggctgatctcccatagttaacttctttccagctctcccaggaggcaatccaggatttctgtaagccacactgtccccttagctggcctcatgccaccaaggtgaggaggtgaggtcatgtcatggcaatataccctggcacaggaagtgttgtggcagcggaggagaaacaaggtttgaaataaaccatgtcagcagcaagctgtggaaaaatcttctaaatcttacaactcacatatggacatccaaatttgacaataatcaaatatacaagaccttaacaatgacgagaagcagaataaaacttttctaactgctaattaaaaaagctttcaatcaccatattagaggatagatttaattatctttctattcttcttctataaaattaaatgtcatatgaagagagggtcaaacagtagcccacagacacaggggaaagttatagaccatgtgccaggcagtctgcgtgtattatatgtgatttgttgtatttgacatccttttcatgttttttaaatgattggtgttacgatttatattctctgagaatacatattcattttcatgtctgatttcatattcacaatttcatattcttttccttaaaaatgctctgaaattgcatacacttcctgctcacaaaacctgtatgcatcctgcctgccaagctaaccagaattgaaagatcttcttcacagtgtaaagattcatctatgtccctctgattcctctgcaatcaaattcacacacatgattgtcaatcccaaagaggtctagaatttctttttaatgaacatttgagtcttttggagaacaaggccccaggacttgatatcagaagttagatttctcatgtgcagctccctatcttactgtaagggttgtaaccaatatttcccttttttgctttgcctgctagaaaacactgagccaaatcagcatttggtgcaaatgcagcaattgtaccaatacatctaagtcacacttttatgagcccgtcttcctttttaaccatcatccccaatgccccagactttagactttct

SEQ ID NO: 31614 - DNA, 1369 bp, Bovine  19866881137675
tctcccctactgtaaccaaaggaaaatgtctgaattcctagtaaaacagaagtaacctctgtggatgtacccagactatggccttcagaggtagggctcacttcacagcacagggaacccataaggtggccctccttgtaggagccactctcagcacagggccaacatccccagggtcccaggatggctgcttcgtgcatatgaagcccctggaacccatagtccctacctggttgatggggtgtttgcgcctctccccccatgctcctctgttccacccatctctctatctgcaggacctaatccagcatctccagacacagccccccatgacctcccagatttgacctgcccagtgggagagactatagtaggacaagtcagtgtcgtctgtctcccccacggtcgggttcacaaggggaaaagggcacaatctggccactcggtacaaattctgacaaatttttgaacaatggtttcatctcacaaagccttcatttactcccccagagaacaaaaataataatatctgcctcacagggacagagtggaaataaaaccagacactggaggctaaatgcccagcatagcgctcaataaatcactcatttaatggaattacgaaatacgaagcacgactaggagggaagctttgcatgcctcccaggtgtttttgaactcacggatagattgggcggatatctaaatgtatgctaagaagtccacgataagtcaggctccccaatttaatacagaacaatctgaaaggtaatgaagttgtctcagactgcctttgtcttaaaggcaatcgcctgcagatagcaagcccagaatattttcaaatgagatgccctgggagagcccttggtgggcgccaaagcagtcagtctgataggaaaaaagaaatcataataatacagattgttgtctgaggcatttgtctgtgcagtctgttgaagaaatagcattagctgcagagacaggcctgacagggcggccagctgcaaggagcatcggggagatacagcagcttggagaagcttgacatcactgccaaatcctgcctgcaacatcagtgcaccccattcgccaggcacactggaggaaggtaaaagtgtgagcaagcagaagcatgtcagcatcaatcccggagggtgagcgggcggacaaggatgccggcaccttctgagacttgccctgacccctcggtcaactcagtccacatctatatctaagtctaatgtctgtggaatatcatttcttcaacaagtgtttgctgagcacaaagaccaaagaatcactttggatactgaagacacagcaaaggacagctcagataaagctttcttctctctcagcgttcatgtga

SEQ ID NO: 31615 - DNA, 2386 bp, Bovine  19866881143673
cagaatgaaaccagattcccctggacataaagcattctgagtcattgcctcaggtcacaagggctgacaagagatcaatgtatgtctaaccccaagtggtccactttgccttcatgtggctgtaagagccgcaggaaggtgggctagcatggcccagggaagctgtgctcagaagggcacactaaatacacctattatccctgtggctttgtcaacaaaatatttcaacccctgatgaatctctctgtgttcctagatttatttttaggtgcagcacaacagattgtttctttgtttgcttttctgtttgctcatggttattacttcctcctgaacggttcatcatagcggcagtcatacagtaatcatctagcagtatattattatttattatgtatccagtaccataaaggctcataaagcttaccaggtgcccatgacaataccagccattgactgaagagcttaatgttgcattcgggcacttactggggagctggagctggaggctcagtgatgaggccgactgtcctgggaccaaactgttactcctacttcctcctggcagtgtaaagggatgcagagttctagaagctccatgcagtcaggacacagagaaggacatggacagggcagaaatcttgatatggatggaacaggagaaggaggtggtgcttgtaatagcatggttctcatgcttctgagaacgagaaacctgattctcatgtcttctgaaatggactctatagctgggaggattgttgctgtttttcagtcgctcagtcgtgtccgactctgcagccccatggactatagcccaccaggctcctctgtcatgggatttcccaggtgagaattacggaatgggttgcattcccttctccagggaccttcccaacccagcgatggaaccctcatctttcatgccttctgcaccagagctccttttgctgtgttgctcttcactctatcagggaagaacccaggttggtggcgctggccactttctccaagctcccaagcctgaggtcacgcattcaattattttcaaatactgcctattcagataaaaaaggaacggaggaggaagacagctggctgaggctgaggctggttgcagacttgcttcttgtcctcatggtggctggcgagtggagctctgtcagggatcccttgcctcccgtgtcagacagacttcagtctcaggaggacggctgtgcttcccttgtggctgtgctcactcttttccctccagtgctagattcaagataggattccacaaccagtcccccatcattcactcggcatctgcaaatcccaatcagacaagaagattttgtcagatttaatttttgaagtgtgtttatggaccagttctctcattgactctgccttatcagcctattcgatgcctctctagactttcaggcatgcctctttattttcccatggttgaaaataaggttgaatttagaaatccctcaagtttacttttcatttttgattgtaacccaagcctgattaaaaattttttttctcccttttcattatctatcaatctttctgatgaaatcaatggagatagaggcaagatacctttgctcaagtcactatcttacccaattcctatgcaagaccaaattttatatattttgactaatatatccctcaggtaagcctgcttgctgtcaataggttaagtcttcctgtttgattccatcatctttccagtgtagacacaggtgaagtctagagtttccaggagacaacaaaatacttctcatgcaaaacagggacactgagtgcctcagctgtaactgttactctgaacaaactctgtcacacgatcacatgatcttcagcacttgacacatgtctatcagaaatagaacttatgaaaagaaccccatttacaattgcatcaaaaagaataaaataccgaagaatttaaccaaggaggtaaaaaaacccctataatgtgaaaactataaaaaaccccaaaaactgttgaaagaaattgaagataacacaaataaatagaaagtatttcatgctagcagattggaaaaattaatattgttaaaatgtccatttagtaaccaaatcaatttacagattcaatgcagtccctatcaaaataccaatggggtttttcacagtactgaaaaaatataattgtaaaatttgtatggagtcagagaagatcccaaataacaaaagcaatcttaacaaagaagagcaaagctagagataatcatgtcccagatttcaaaccataccacaaagctattagtgatcacaactgtatggtactgggataaaatacttagttttaatcaagaactttcttattttatcagtcttttccatatctggttactctagt

SEQ ID NO: 31616 - DNA, 1060 bp, Bovine  19866881157626
attatctaagtagataagggttaaagatgggaaagtcacatcattagaagtttccatgactcacaaaatagactaccctgagaagacgcccagttacccacaggatgtcactaaccccttatctgttccataagagtgccatgtctcttcgtctatttgtatagtttttcttcttatcccattaacctcttctctctctaaatctgtgctcacctaaacacatctgtgagttccccaaaccatcttgccctgaaccattccagatggttctacccatgatctccccactttcacctcctacctcaaccctctactccttgcccacagagtagactcagcacaaacaccacctcctctgtgaaacctttcctgacctcaataagcagccttatgtccttccgctctgctatttctacccagcactactgagccttgatcatcatcagtcagcattagcaagtggtagaaaaaatagtgtcacaaaatatcctatctttatatgtacccaagtatacatcattaaggtttattgactcttggggatttcttttgtacatatggagaaactgagaaagtgtgctgttttatcctcaagaagttatgtaccatgggtatacaccttaagatgttcgagtgcctggcaatccttatttgtggatcaactatgatgagtgagcccaaaaagaattatatgagaaactgccatactggacacaaagcaacaccaaagccatgaatccatttaattcaattcaatacacaattatccatcccctactaggagcaggcactgtactgcctgctgggtggggatttacccagctctaagataaggtctggacattgtggagctacagattgaataagatcctagacaaggcaatgatatatcctctttggggtaaatgctaatattggagagatttttttttctccaatagttagaccaatggtgtttcttgtagtttccatccattatccctaggtctggtctctgatgagacctataaaaaattcagaggtctttatatacaacagtataactttcttttttaatgag

SEQ ID NO: 31617 - DNA, 1503 bp, Bovine  19866881158195
tagcgcacttgaatgactgcttctagagtcatttcttctccctgattctatagtttcattgtcccagacagggcaatggagggaagcaggtcgttggagcctgaagaaacagagttttctaacaggtttttcagctcggggatagagccggagatctcagagactagacgatgccctcagccaggacagcccctgccgtgggctggatgacaacctgagagcttccggtttggagcaggtgccaaagcaggacgtgaagtctcatgctgggtttcagccctgtctggcagactgtctgcggggtttaagacccagagacatcctttcactttggagcttcttctctggaggctgggagttacttatcccgcatcacaaaagtcacactgttctttctgtaagagccaaggcttcctcttacctgcacggacatggtccttttgatctatggtgggcactcgcatcccctgagcacgagtctgcccacctcagtacctctctccactcctccaacaggatgcttttacctgaaaacacaggcccacacccaagtgaatattctccccctacctggcttctcgcaccctccgcctcacctggtccacacaccagacctcacatcttccgatccccatggacgaagccaagcccacctctgctcagcctccctgaggcaatggtgggacccaccctcttcctcccagattccttgtggatgcttcttattaagaaaagaaagtcaaacacacacacacgcacacacacacaaggccaacaggataaccctagaacacgtcggcctccaagtcctcagagtcggctgcatcggcctgggtgcttctcttgggcccacggcacaccgcgatgtgaagtggggtgaccaagaggacagctccggtcccgggagcctcctcagtcccaggctgactggcacagtggatccccctacagcacagggacccaggggccaggccaacgctggctcgaggctcaccctttatctacgtgagaggagtaaatggaaaaaggccaggggcagaggaacacgcaggagccacgagacagggaaggaggcagcgccccgggctcctctaaagggactggctgggcaccttcccctctccaccagcagggggcgtccttttctgatcacccctcctgccctcgccctcggaaaggcccaggaacagggggcttctttggcacttcagaatgatcacaagtaatttgccattttattcatatagaacaaaatttacaaagtcattcatacaggttttgtttttttttttactgacttcgaaaattgggaatattcaaaatacacttttaccccactccattctgtcattatttacacgtatatacaagaaaaatgaaagagtctctgtgtgtgtgtgtgcgcgcgcacgcgcgcgtgtgtgtgtggtttgtgttgtagttttctggtattaaaaagctctgctggtcgggtgggtggatgggcgggcaggagggcaggcg

SEQ ID NO: 31618 - DNA, 756 bp, Bovine  19866881161814
cttctttgcctggacctctactatttgaggaaaccttatgcctctagtacatatggaagaatgcccccttttaaaaaagaagatatctttctgttttgcatgatttaaaaattctacatgaatacttttctatcataaaagatccacccactctaccacatccatactctatcctcaattgcagattgatatgtacctaatagaccttcttctgtgcatctacatcaagttaattaagtatcaagttgatgatagcctttgaattaaaaataacattttaatttgcttccaaataacacgaagagcatgagggtgaggttcaactgaaacagaataaactctgctgataattgttgaaacagtatgatgagtgcctgagaggctgtcactttgttctctatagtttgcatttttttatatacacaagtaaaataaaatcataaaataaatatatgtacagtgtaaagaatttttttaaataaaaatgagaaaataaaaacatcttctattatccagaatttaccacaattaataatagcatgttcttatattatatgtccttccaaatctttgtgatacacacacacacacacttacctgttatttttaaaacttagccaaaagtagataagagtatacatgtttagctaccttttttttttttttttccctgttgttagcttgtttcttatttgggaaaagtaatgtcatctttatgcttctaagtcaatattcaatattctttgtctcaataat

SEQ ID NO: 31619 - DNA, 2295 bp, Bovine  19866881194314
atcacccattgcagaagcagtttttaggaaaccctgtaactgatccaaaccatttcagatagttggaggagaggccatgcattgacaaccatgtatgaactaggaaaccctcctgattatcaggggacaggcttcaatgaaaaagcatgatagtcccatgagtcatattgccccgcagattacctgaaacgatttccacttttgactgtataccacatatgggtgaaatcaattaaagagatttgaacagaaaaagttatcaagttaaaaactacaaagtgaaaattgaactatttgggagctatgatccacagaaacaactcattattgaaaatcactatcattgaaaatcacaactctgactttgagaccatcaatgagcaatgtgtgcagcactgcagaacatttctggagaaggttcactgaccgggtccagtcctgcgaggcccaggcttatccccacaggccccttttctcggctcagtgtcacagttccctagctcaaggtcatagccctttcttcagttgactcactgtttcttactttaaagaaataattatagataaaaatcagttgtatttggcagaataatacataagcattttttattagacagtttatggggtgaagatgaatcagaaagcatggcctccactgtccttttggacgatgtgtggtgtttgcccgtctgctcagtgccaggcagcagcttgatgagtaagtgcataagtaagcgtgttgcttgtaatctgttcatggaacaagctggtgaccctggacccacagcagccttccctcccctccatcttcagaggagtgtagcttctcctccctggggccagcagccccaagacaggaccccatgtggagagctacatgaagacagctcttcttgactctctcttcaaccctgttcacagttggtgacccaaaatcctggaaggactctgagtcacggatcaaactgagtgacagtcgttcagaagctgagagagttgagaggaacagcttccaggacttagtatcataaggatccctggtgggagacgctgagtcataaacccacctgggcttgaaggatgagcaggcaagtttcccacccagggtagcaaaggcagaaacgctggggaggtcgtggcaagaagactgggcaaatgtgtctggctccctgtggaattgttccatgggattcttttcctgaagatttgaaaggttaagtgaattgagaatttgataactatgttcataaaaattaaagaattgagaaaaaatgtttaactgaaactagaacatagaaagtaaagcacttcaaaaattataccttaatgtcctaaccattcagtacttgtttcatacttcaaagtgatatctcactcttttctgttcgtttatgctcataaactaatttctagcttgttttctttcatatatatgtcttaaatatagattctcggacaaattctaggattttttaagttggctttgtctttacagctatttttccagaccaggggtcatgtgaatagagagactcattcctgaatccacttgtcttttaaaaattagattcagtcagattcattcaaaatatgtctacctttaaaaatctggagtttcttggaagtcttaaggtcccttttttagtttaatgtttccattacaaagtcacacaggaaatacaaatacaagcttatttgaaatattcactaccaaatcaagctgtatcttaagaaatatgttgccaatatagagtgatactctctttaaagaatactgatttaattgtcccttataagaatttatagccttctcattttatttacttatgccttttacattctgtgacattctgccagtatttcaatctcttcatagatttgggaatcacgaaatctcaatagtgaactttttcaaaagtaaagagtcacttagaagacttcattataacaatggcaacaaaaaaaacattcttacttttcatagaggactttattctacttttaggctggtggttaataaacatttgtccttaacaagcattctaactataccagagtatatcccagtgaacacattcttgaaatttcagctgccagtgcttattaaaaaacatttgagaaaaatatttttagtctttagcagcaaatattaccattgtagcactcatgtcatgtcttagtccttaatactattcctacttaaagaagtagttgattccaagactggggcagggatgagtacagatgatagtacaggtgacgtgtgtgatgatagacagcaagaagctgtcaaat

SEQ ID NO: 31620 - DNA, 988 bp, Bovine  19866881241825
tgggaaaaatttccttctgttatatggttcccaccaagcatcgaaagaaaattttcttagggaccatgttcctagtggagtttcatatgccagtctaccaacagacaatcttcaccgttacccccaaatatccaggaagaaaaccacctctcacaatgggtgcacagctccacatgcacctcccaggcctaagagaagctaacctcttctcttaggttgattgcacctatgtcaaagactagtgggggaactaatcatacacactctgtgtttctcatcttggaaggaagggaataggtgggcaagtaatgtttctaccttttgcgccctcctgctcagctaggattccagtagtgttctggttgacttaagacttagcattcagaagatgagctgagacgtttcccagttatttccatatttttgactttctacagagaagaacttaaaacaggttcaaaatcatgactctctacaggaaggctctgtccccagttctgacagatgaaatcattccccattaacacagccatcacagaaacttaagatacaggactctccttactccctaagtgtgcaacttttaaatacaagaggcacccagtgagctaatatgctgcatctgctgacatcggccataattgcctgctaatgtgcttagaggtattgcccagttgactggtttcaatttcagcacagagttctaataattacagttggtggggaagtgtgctcaactagagctgaggcacactgatgcacgaggcaggccaagggtatgggtgagactccctcctggaagaagtttaggaggccagcactgacctgcagcatctggaggtagccttcctgggggtcgcagagcaaggaggagatgcggtggttgttcctcatgcatttctggttgtcctttgcagaagggaagatctgccggaccacagtcatcctgccaagggcgctgtggaccagatccaggatctctgggtca

SEQ ID NO: 31621 - DNA, 3044 bp, Bovine  19866881259754
actctgtgcgaccccatagacggcagcccaccaggctcccccgtccctgggaggctccaggcaagaacactggagtgggctgccatttccttctccagtgcatgaaagtgaaaagtgaaagtgaagtcactcagtcgtgtccgactcagcgatctcatggactgcagcccaccaggctcctccgtccttgggattttccaggcaagagtaccatggcctttcttttttctgaggtgctacagaagtttgtttgggatggatacataggagtggaattgctgggtcagtgggtatgaaaaactccattttctaagagaatgacaatttgttttcaaagtggcaatactgagtacactcccaccagcaattaaccacctgctactcagtcctctccaccacctctcctttggggcaagtctagttgatacaaagtgatatatctttatggtcttgattttcattttctggaaacactaatgactgaacatctcttcacatgattactgaccatatgtggtacctcttctgtgaaagtcctgtacaagtcttttgctcatttttctattaaattgtttgaactttccttattcgtttgtaaaagtttttcatgtaatatccatataggatattaaccctttattggttgcatgcactgtagatactcactcccagtgtgtgacttgcctttttattttctttataaagtgtcttgtaacgcacagaagtttgataaagtcaaaagcggcatcttttcttttagaagttctttttgtagccttgttgcaatgaatcttcataagcatcccgtttggatgggcgtattggctctccatgagagacaaagaaagcagagaagggaaactcaaaggccatttggctcaagtcttacatttataaaaggccttaaatcaactttgtattcattatccgcaaatgaggtcacctacagccacaaagatccactgtcagggggtgaaagaagactcagcagctcgaggtgagagcaccgtatttctttgcacacgaggacataagaagttttaataaaccttgtgagcagaggactagcacatctatgctgcattctattatttttgttatgatatcccttgcttaaatataaacatttcaaatctaccacaacatgtccttctaaatgtttcaagtgtctaaagagaccccccaaacgggaaattgaccaggcttctcttaacacccagagatttgacaagaagaccgggtgctccatgtaaacatcactggtgagctgtggaactgggattcacacccacatgtgccaggctccagagcccagacactctctgctgcttcactttgctaaacgacggggaaaagccaccccaagctgactgccccgtgagcatgcagaccacagggactcctagaccacgcagagccctgcatcaagacaccatgccaggagccaggctgctgcttctgaagcaggcctcaggctctgcctctctccctggacccattcttgagaggggttggcaaactactgagggcttttctcatcatgaagagcaaggtgggtagactctagtggccttgaaactttctggagtctcccccttatacccactgccctctgcagtaaggccagggcatgtgtgtgctgctcagccatgccaaactctttgtgactccatggactgtagcccacctggctcctctgtcaatgatatttctcaggcaagaatactggaggggttgccatgtcctcatccaggggatcttccagacccaggaatcagacctgtgccttttgcatccccagcatttgcaggcagattctttacaaccgcaccaccgggaagcccacagtaaatccaaggttctgccaaatgaccagggatgtagaacacaggtgcgtgcatgcacatgtgcatatgtgtgagcattagtgtgtgtgtgtttgtgtagtgggagcacgggcatgagtgactatgtgtgagagcctgtaggaatgttctgcagaggtagcatcgatgggtagggaaatgtaagacacactgaggcaggctggatgcatgtgcgtgtgtgtgtgtgaatgcgtgtgaatgtgtgaagattctgcagaagtggtggggcaggttgaatagagaacagaagggaagagatgctgagcaagatgggctggatagaggtctacccagagagacaggagtgctgggcgctgtgcacatctttcttgtgttgttcactgatgaccaagagtaagtagcctctgtacgcgagggtcactgagaagaaggtgccaccacccgagacatccttacgatacctgccttcatcccaccatgaccccatgttctgcagcacgtggcggataaacaccaaacccctcagtctggaaccccaggcatgagaacctaatgaggagtgtgacccacgtctgattctcatctgcataatgggacaatcacgatgaatttgggtccctgtggaaactcattgaaataagttagcaacgtctagtcatctctgcagaacaggttcatctttcccacccatcctctctggcgtgggctcttctcacgcagtgctccctcagttccaccccgcccccattcagtctccatgctgggcttgctgtcctgacaactgtctcccaagcacacctctgctcacagtggtcccacatggtgcccacccttccctgaaccctggcctacctcctctccctctcccctggtcctctgcgtctgcttttactgagtgttcttacttgggtgggcagacccctctgtaccactatcctattagcccaggaagagggagatccaggtcttgggcttaacctccctgcccttccctgatcctttgaaaacttagaagggccttaagtttccctctgccagccccttggcatctcctgccaaaaattggcatctacctgaagaatgtgagcctttttacccatatgtctatgaaaaatgcctgttgacgctgctgaagatgggtcaccctgcaggtgacagggatactcaaaggagatgcctctaggagggtgtctccta

SEQ ID NO: 31622 - DNA, 651 bp, Bovine  19866881396305
tagcaatgcttgtttgagggtggaatgaataaccgtgctttaaactcattgttttgataggaagcatgcacttgtttcacaggggacaatattgtgttgtctgcattgacatggggttgtgaatacagacctagatgctgccagaatagaggtgctaagcaaagctgggtcaaggagctgctctctcacagtattttcatctgaaaagttcattttgcagaaaagaaagagatggtttctgacgataagctgtgctggaaaattgccactcgattgcattttcttcctatctggaattttttgttttgtttcatatttagtgcctatcactttctcttttttcttgaaaagtaccctgaatatttttcttctgcttatgaacttaagagacagttgtatcaacttcaatcatgatcaatccctatgcaaataaaagtgaacaaggcttgtctcccacccttgagagataatcaccatcaaaggttcaatgtatatctgcccatctttccccacaaatatagtgtatatataatatatatatattatatatatatatatacactatatatatagtgtatatataatatataattatagcttattcttttttttttttaagtttgggtcatagtatgcatttgcttgtttttt

SEQ ID NO: 31623 - DNA, 1149 bp, Bovine  19866881493717
ctgaacgagtgaaccgtctgggatcccataaagaaaacgttattaatgttaaactgctgtagagtaattgcacctggatcaatggctttccgttctggctgcacatcagaggtgatccatcctggagctttttagaaatacagatacctgggctccattctccaaagggttgtatcaggcagttgaggacaactgtaatttctagaagctgcccatgtgcttctgatagcctgccaaggaggaaaactactgctttacactgtcatgccaaggggaagttgagtggaaaacaactcaaggtttgaaaccaggcacacgtggctgtcatcctggtgctccatttatcacagaattgtgtatcctcggtaagtcccttcacgccatgtgtacctgctgctactacatatgatgggaggtgtctattgactccctcctttcacggtcctcctctacaaaatctgcaattaagctcaccagaattctttcctacaacattctgaaacaggggtccccaacctctgggatctgatgcctgatgttctgaggtggagctaaggtaataataatagaaataaagtacacagtacatgtaacgagcttgaatcgtcctgaaacgcttccccgcagatccatggaaaaattgtctttcatgaaaccaggccctggtgccaaaaaagttagggactgcccatcgtaccctgcggccacttcactgactcaaagtccagcttctttgcttttacccaatcattactctcaaacttccagccagtcctttaggcttgagcaatgctttggagcaatacttaagaagatcacaatgatgtgtgtctcccagtccgttgagtcttatttaccacctggttggtctgcggtaacaggagatcacctcctacaaccatccttgtcacgtgggaagtccctaatcccattttgttcctgcctaacttaaagtaggagctgttggactccaaataaagtcggttctaatgagtcccacgtgtaacctgctgttacatagatgatagtttagttaattaccgttttccagtacaatgttttatttccacattggtgaacagcggctcaattgcagaactttctgtctcttcaagacaatgcctgcgagagggtctccagtaacctctg

SEQ ID NO: 31624 - DNA, 1704 bp, Bovine  19866881524979
ctgtgctctattttgataccttgtctcttatttctgccttgggctgacctcgattcggagctcagcccctgtcccttcatttctcacagataccatttgtgcaggtggcttggctgtgcaaccacttttcctgaagaggcatgacagcatggcacagctaacagcctaaacccaagtgacagacagctcatccttgtgtcttctcagcagccttgaaggctctgccccacctacactgtctgcctggcagccaagtctggtcaacacagatcccctgctccctgccctcaccctctctcctggtcttccttgccctgcatctcccctgcctggtttactgttcatctcttccacttgttcctcctgaaattcccctattcctcagttcactctccttgttgcaccccaagcccattcctacaatgcccacagggcctccaggcatattctaagaggcccattaaaactcgtttttaaacaagcacaattctctccctgagtggaattctgctcccaatatctcaaataacattgtttccctcactcttgcacaggccactgaaggcagccaggccctcctgaagagttctgggagctctcctttagagctccatcccctggcacttccctccggacagcctccatgtgaactccacgttctccagatcaaaacacaggccctgcagggccctattcctttccacaggcctttccctctgcctggaataattgaccttctcagctgtcaaattccctctcgtccttctgaacacaactcaaatatcaccctctctgacttctctccagttctctggaccaagggagctagacgcgtcttcccctgagtttccgcagacatgcgttgtcatctgcaaaacactacctccctccccactgagtatcacagtgccctatttacccccattttccccttacaagtaggagagcctttcacggaggagccagggctctcctagtcctgtatctccgcatattttgcagctggcagattattgcctctttgaaagtatgatttaaatgggagtataaatggaaaataggtgacatatatttagtgcttactctctgccaggcagtgttctaagcaccaaacatgcatatctcatttcactacctgtgtgtacttcctcaccaggacgctataaatattatggagtactttacttacaggtgaacatcccgaggctcatccatgttaaagggcttatgcaagatcactcaggtagaaagtgctggagctgaaatctgaacccacccatggctcgtaataattatgttggactcaaacctatggcttttccggtagtcatgtacagatgtgagaggtggaccataaagaaggctgaatgctgaagaattgatgctttcaaactgtggtgctggagaagattctcaaaccagtcaatcctaaaggaaatcaactctgaatattcactggaaggactactgctgaaactgaagctccaattatggctacctgatgcaaagagccaactcaatgaaaacaccacagaaggcaaaaagagaagggagctacagaggatacgatggttagatagcatcactgacttagtggacatgaacctgagcaaactccaggagctggtggaggacagaagagcctggcatgctatagtccatgaggttgcaaagagctggacacgacttagtgactgaacaaca

SEQ ID NO: 31625 - DNA, 1547 bp, Bovine  19866881733845
tgtatgtagtatccccttgtgctgtactgagcttcctacttatgcccctgaccttcctcatactgagcaccagcaaatatccaggagtgtggacgcacccgttcattccttccatagacattttttccgaagttcgtcatctgccagggctgtgtggtgactacatcagacctcagccctggaggagctcacttcttggcgaggggctgaaggctgccttccatatacagaagccctgtggcaatcagaggatcacttgacccaggagttctggggaaggatggtggcaggaaactccagaatctgggacctgactttacagaagtctgtttagctccacatgccaggcctcaccactgtctgcatcgccttccagctccgctgtcgattttgcattaaacatctacaaaaagtgccgagtgagtgtgtctttgctcagttcccgagtctgcacaatatgctcaaaagcacacggactctggtgtctgaaaggctggattgtgctgcctcggccgcactgacttgctgggagacttccccacctacaggctcagaacctctgtcaatgagctgtcctgaggacccagggaggtttcacctgtaaagggcttagctccaggtcaggtggcagagttgttcagcaagtgtcagtcattggacccagtatgtaagtaaccctcacctccgtccagcctggcccagccagagtacttcctgcattcccaggctataggctcagatctccctcttcagtgtcccagagttacttttggaagctacacaagattaattctgccacaccttccccagatggccttgtgtggctgtgatacaggacccaagattcctcagtgagatctacgagtaaggatggagccagaaaagctaaggagtaagagtaaggaggagccatgggagatgtggggagggggaacagatgaggggaaatccaccagttttctggtgaaagcaaggccccaaggggttctggaggcaaggctggagtatagagggcgagtatctggaccagaagctcaggccttttcccgagaaggcagcccctgggaagcacggtgtggcatcatgcagctcagtgctaactgcccttaatgggtttcctcatggtagttctgggcatatcttctgaaacttgggcctcatggtgactgctttgctggtctccttgagctcctggggaccattccttgggctcccgggaccatccatagtcttgcaaccagctcctccccttccttgcaaagaggggcgttgcacttgatcatgctccaggggggtgacattgcatagacagaattgttcctaaatagcatgctgttgcaaagacagcagtgggtctttaaagttagctccatgtctgtccttgggaaaatgccaggccttgggctccagggggggactgttctgaaatgttagagttggggttttaaaaagatgcttatcgtcgacaagctttcattatctcaggctcccagtgttgggggagggggatggagacatggccaacaattaacacatacacaaatagt

SEQ ID NO: 31626 - DNA, 738 bp, Bovine  19866881760500
aattgaaaggtggtgcattttgttggaacttagtaactaagatggagagcatggcaggggtttagtttgaagagcaggcctgggacaggtcttggaaagttttataagccgtgaaaaggacacatgcttttaaatccaagtttaacagagaaccacttgagaattttgagaaggagagtgaaatagaacaataacaatttttattagaagaggaaaagaaagaaaattctggctgcagagtagggattaggtagcaggaggagaagaggctttgagagataggtaaagcagctcataaggattctagatcagaaatcatgatagcatgatctagaaattgtgcttctcagcacattaatctcgttaatatgcggaagctgactcaagaaacgtgggatggagccaagattgtttgctttaaatgaatttccaggtgatgtgatgccctggtccaagcaccacactttgtgcaaagagagtttagaggtaaagatgtaaaaaaaaagtgggtatttaaaatgccttttgaaacattcattttactaacactttcccatgaccagaagtcttaaagtaagtatgcaaaacaaaatcatgcaaaagagaaatccagcccaggcacttgcaaccattataaataaaccagaagtgagtgagaaagccttttacagagcttcagatatgagatgtatcctgggagctaagagtttgtgaagagcacacagtttcaactagtta

SEQ ID NO: 31627 - DNA, 1512 bp, Bovine  19866881917372
ctgactcaccttatgggcatgaggctacagctgtgcctgacagctccaccatccccacacaagtggttgccttgccccaccatcccccccgccccaatccaaaggaaacctacccatccatccagttacacactaaccatcactatgcttatttccatccagcttatggccagtgaatacctttccgtgctctgcactctgttgtgaatgtctgtctgtgtgtgtgtgagtaactctgccacatcaaaagaagatgatttgatttgatagtttatgagcataggaagagaggctaatgtccaagaagataatatgtttttaccattttgttttctactattttcattctactttatttcatattcattctaagttggacatagtctaatatattatttggaaaggtgacataatttctctttatgttgatttatcatgctctccatttgcttggttattggattgtttaccagtttttttttcccctcctattttcagttgtatttctgtgagtacctaaatttttgtttattgaatccaggggaatttctttgggatataaacacagaagtcgaatttctgggtcaaaactgtgaacagttttaaaggtcttattacatagcaacagatttcttcttagaaagatgaaaccaatttgctatgctaggagcaatgtacaattgtgcctgtttccccatggtcttgtcaacattgacttgaaacattttttttatcccttgtaccttgttttgctaatttagttatgttaggaggcacccgtggaaaatagcacaagggaaaaatcacagacgagtgtcatcatgttctagtgtgaagcactctcgcaattctagcaacttgattttatcagagcctgtgtcgttcagaatgctttcagcaacagaaagcagaaaagaaaatccatactggctaatatcatgaagcaggtatactgagttgggtgactgctctgctcatagggattgcggctcatatctctaccattctcttggcattgcttttctcttcatgtctacttactgttgcagggaaacctgctaagacagctccgagcctcacttctgcatctgacaacacacagctaaggaacggaacttaccttcttgtgactccttttacaattgaggaaacttttcaaaaataactcctcttccctcccagatactgtctcattggactgaagtgggtcccttgcttatttctgaactaattactacgtgacagcaataagcatgggtattatcttaggcttgcattccagtacttctttcacacaatccatgcatgcaggcagcaaaagtatggtgagaatccaattagactcagtcccctgggagcaggacttggaatgtggggtcaggaaaaggagaatgcaaggataaaacagaacaattaggaagggggaatagatgttggggaaacaatttttcgtcacttcatgacaaatagatggggaaacagtgggaaacagtggctgactttattttttgg

SEQ ID NO: 31628 - DNA, 703 bp, Bovine  19866880465847
tgagtcatgagataatgtctgaacaaactaccaaaggcctgcaatacataatagccatatttgactgcaaattcctgctctctacagggtgaaaatgggcatcagttgttcaatcagaggagctagcacaggctttcattcaaaccatccactgtgttccctccttccctacctgccatggaagatcaatgagataatgcatgtgtataattcccttgaaagtgcttgggaaagtataaagcactaccaaatgcaggttgtcattataatgcttattaggggtctgattcaatgctattaaaattcgacagcacggaggatgggaaaggcaggcagatttccaaatggataataacttttatcagcatcagactgtatccagagcatgttttgtccttctgatcagcaatgaaaagtgctgcaattaatttgacagccaagcaaagccatgaattaatgggaagtcattctctgaggaacgttcttccccatgaatggggaacaaatgactgaaataatcaagcagatatgctagtcttggaaactggtattagggcaaacttcgcttgtatgtataccatgatcacctccttctaatatgggaatatcaaaagcatgatgagatacagagagtaaatgctgttgggaagatcatcagaagagaggacacaaaatcaatcagggtgcgggagggaaacggaag

SEQ ID NO: 31629 - DNA, 1123 bp, Bovine  19866880758939
aatagaaaattctgctgcatagtatgacccactgagaaatgaggatggacttttatttactttctcagattatgtaagactatgtgcatttttaaagacagttatgttaatgattctttaaatgtattttatacctgttcagcccttaattcacaactccctgagaattaagtagggcaagacaacattttctacttctcagcttgggaacatacagtttagagatttttatcttggtcttataacgttcaatagagggagtcatgatttcaacccagtctcttagatcccaaagctcatgctttgccaactatttctttctgaggattttaacattatcaaatgatttgttactcagcattcttctggtttaactgttactgatgaacattctcatagtttcctctattttcaactcacatcctgttcatagcaagttactatggagacatgacatattactggtctctctgtaggatagtgacctggcatatttaacaatgctctgggtatcttagcaactcaaccaacattattggtctttgccttcacaatttgtacttttgctgcagtaaatgaaacctgggtcggggctagtttctaggggataacaacggagtttttagaaaggaagtgagtgttaaatgcatcaaatatagtctctattccaccaactacctgttccctttctattaaagcagttttgaaaatgattagcaatgaagaaatagaaagctaagggatttagtatttccttggtggtccagtggttaagactctgtgcttctgctgcaggagacatgggttcaatccctggtcagagaagttccatgtgctgttcagtgtggtcaaaagtgcacacacacacacacacaaacaaaaagaaccccaaactaagggatttaggcacccaaaacttcaatacctatcacttgctttatcattctcactttgaatgttattaaacaccccctgaaaccctgatgctgggaaagattgaaggtgcggaaaaggggatgacagatgatgagatggttggatggcatcaccgatgtgatgaacatgagtttgagtaggctctaggagttggtaaggacagggaagcctggcatgctgcagtcca

SEQ ID NO: 31630 - DNA, 1383 bp, Bovine  19866881468722
gaactctcttgctttttcctgatccgcagatgttggcaatttgatgctctggttcctctgcctttcctaaaactagcttgaacacccatacactactatacatcaaatagataaccaacagagacctactgtatagcacagggaattctacccaatactctgtaatgaccaatatgggaaaataatctaaaaaagaatatacgtatactgaaccacttagcagaaactaacacaacattgtaaatcaactatacgccaataaaaaaaattttttttaagagaacaaaactcagaaagatgaaggtgagtagatgagatgaaactcagccactgctgaccccaagtctgagttttagaagacactgtgctggtagttttccttgcccatcacacacaccttgagagcattaagttaaaaatgaactgatctcactctacagcaccaggaactatgctcaatatcctgtggcaaaccaaaatggaaaaggacgtgaaaaagaacacacctgactgactcactctgccgtatggtaggaactgctgctgctaagccgcttctgtcgtgtctgactctgtgcgaccccatagacggcagcccaccagcctcccccgtccctgggattctccaggcaggaacactggagtgggttgccatttccttctccagtgcatgaaagtgaaaagtcaaagtgaagtcacttagtcgtgtccgactcttagcaaccccatggactgcagcctaccaggttcccccacccaatgggactttccaggcaagagtactggagtggggtgccattgccttctcggaaaacttggcacagccgaataaataaaataaatattgaaaacaataataattctaaaaagtaaaaaagaaaagctctgttcagatggaagaggttactttcaaaagctgttcttagaggcatagggcgaaatgttgagaaatcttttctgatcagtatgcatttgtccagcagcaccagctgtgactaattcactcttatttcccagggattgacttcagagcttctttaatgaatggctacagtggctttaatgacagcactgcctggacaggatgaatgcccagcaggcagctctcaaacacagccaggggcaaatcccagatggccagtctctcaaggcccagaagcactttgcaccagtctcaccacagtaagtgccattatttagactgaaaccactgcacatgtcctacaattgccaagggacacactaataacaggattcctgattttagggtattgatgtatgcacccggtgacttgggaattatggtggtgtttgggaattatatttagggaccatggggtcaagggggaagtccttggctgagaaaggtcagcttgccaacat

SEQ ID NO: 31631 - DNA, 1612 bp, Bovine  19866880543414
ctggtgtgctgcagtcctggttccaaagaagcaggatatgactgagcaactgaactgaactgagaaggtaaatgtcctatatttaatactacaattgataattaaaacattcacatatactcataattctacatttatctaattattctggtgaatgtttgtttctgtgatcttgggtttctttctatgcttttcttctagttcatttccaggcaaccccttgcctcccaccgattgaagggttctgtcctcagtgctttatattgaaccatttttgcattcctgagatcatagtaagataaataaataaaattagcattactatgtgctggtctctgtgctaaagtacttttaaaagtaatatctgattatctccaggttacagatgaagggactgaaggcaccaagtgttaggaaagtcgccccagttccacagtggactacagtgttggggctgggatttcagcccacacagttggaagtctgtttcgttacaagcatgatattgtgttgcctcctggaatgatctgatttggttacgtaagctattttatattcttcctttgaataagacgggtataaaattaaaacaatttacaaaattaagaaagtaacattctggatgctttttggagtagaaaatagctgtttacattaagtaggcttaaaaaaatatgctatttaagatgggcaaaataatggtcccagagccaagaaaaaattcaattcaacaggaaaggcaactcaaagcagtcagaaaattctctgccatatttgtgtttccccccgtggacagaggagcctggtgggctacaatccatggggctgcaaagaggcagacacgactgaagcaactgggcacacacagaaagtgacgatcatacccgtctctactcctgaggcctcccagaggcctccacacgcctctgcctcctggttcagaacagggctggcctgcctgcgttcccgggatggagttacctttaaaaattctttgaagtctgcgtgttcgtctgtcttctgctgtaacagggctgctccattaagctgacagctgcagaagcggatgtaggcctgcatgtgggacagctcagcggccaggatgtccccgatcatgtgcacgggcatcttctcacccccggtcttcttccgcacccgcagcgccctgcaaccaacacactctctctcatttcttgtttaactgagtgtccgtcgccaatgaacagtgaatatcttgggagactaacagtaataacgaccagcgagttacctgaagatctctagcactatggggggaaaagtcaggaggaggaggcagttaggacctgaagctccgcctgcccagccaacctgggtgaactgtgagcaaagaagaaaaaatgaagactctgcgcttgggtgttcctcagtctttggaactcttttggtttcagcttagtttcttaaaaaagtttcttttgaaagttttctaacttgttttcagctgaaccaagaagaaagaaatttctattctctgcaggagaagtaagggagcaagagtccgcagaggccgggtgtggaggtgaaggtagtggtggacactgtgcccagagagctgctaaacctcaaggag

SEQ ID NO: 31632 - DNA, 1482 bp, Bovine  19866880562622
tgtcacactgtactctgatgactgaatcttcataacagaaggcagcactagtacctgagagcaccgcttaccttgaggccccaggcttgactcccagcatgtcccaactgtccttactacttcgaattctgcgaatggtgtccgcttgttctttggtgaaactagcactgctatttgtgttaggacgttttccgccgttttcacataaatcaactatggatagataaaaggtctgcaaaaacaaaacacatcccagaggagaaatgattaggggaaaataggaattctttctaggcatcaacttaaagaactttactataatccaataacttaaaattcacaataaagcaaacatacattttctcttttgtactaatcatatacgtagaacatatatgtatattatatatattttaagcacacaaaaagtataagaatttaaatggcttatgatcctactctcagatagtcatacttgaaattaaaaactagtatacaaatattattagaaaaattcaaatagtagaaaaagtgtaaaatgaaaactgtctccttgcccctcgagttcctctccttggggtaaaccattgttaatacattttttcagtatccttccagaataattttctctcagtaccaatacacgtatccaagcccaaagtatttacataagagagagcagattaaacacactgctgagcaccttgtaacttttttcacataataataaatcttagaatctttctctagctgcatatagatgctttcttcctcccttctaatgactgttcagtactccactgtgtgactgactgcactcataatttagtcaatcaactccctattcttggacaggtcaattgtttccagttttgtgtcacacactgtgtcacacagtgctttagggaatatttttttacgggcacatatctctgcacacttgtggggatactgtttcagaataaatttctgaaagcaaaactgctgaataaaagtgtatgtgcattttactttctgattttgacaactgtcatacaaaaaggctataccagtttatactcccatcacagtgaatggaaatgcctacttccccatactcttttcaggattgggcattatcatacatcttcatttttgccaatctgatgttatctcacagtttttatttccatttctttaattataagggaggttgcgtatcttttcatatgcttataggtcttttcttattctgtaaactgttattattttttcctattttatctttttcaaagtgaaaattattttgtgatcctgctcatatttcacgccttgtgcaccattgttgtcactgaataacttcactaaaaatactaatttaatacattacggctacttttaaattgctgactgtataaagcttctccatctttggctgcaaagaatataatcaatatgatttcagtatcaaccatctggtgatgtccatgtgtagagtcttct

SEQ ID NO: 31633 - DNA, 1658 bp, Bovine  19866880591020
aacagttggacaatctctctcttgagccaaatttaattattcttatttttgtaatcagtcattggcttcttatctggatgaagacttttggaggagaaccagaaggacgagttctaaggggaagatggcagctccagttcagctggctcagtcctgaccctgccagggaagaagggcccggtggggtttggcctgtgtccgtccaccaaaggctgtcacacgtctctgaatcaacaacccctccccttcccaaccaggcagcttgtgtgtacaatcagcttcttctagcaactctgtatctgatggcttcgagagaatattttgcctccacatatgtaccccttctcctttttttaaaagatggatttaaaccaagatgcctccaggaatgaggacgaaatgagtatattcacagaggaatccaaaaaaaatacaattttgggggaaaatgcaataatttttgatgagatgggtgaaggacaagaagtgagttatgtcaattattgtagataaaattctctgatttaaatctggaagaaaaaaaaggcagcctgttctttctgcttttattgtattaacagctgaggttagctaaagttatttaaaataaaaattaaatttatgattcaagtagcttatttttccctttaaatctcactgtacatatatatgatttcttgtagaaattgattttcttctgtttaattttatggtttttattatcatactcttgatttttctaaatttctgtgtgtgaaaatataacattgattgaattgcagttacctttggctagtaatatttcattattttaataaccatgatgccacgtatggatttactttgggtttcaaatcaaaatgtcactgccagaaagagccgttccagacgagcctagtgcctcctgtgccccggcgtgtccctggaatcagctgacttgagagtggtgcaaggaattctcaccagaagtgcacagaccacttgtacagagaaaaaagtaatactcaaaggaaaatcttctttttttttttagattgactttgggaatttgaattctcatcagtgcaaatataaatctctctatcctgctctgaggctaattggtaccatatcttccctttgtgtcttgtcactctaccacgtcttgtctcatcctggcctctgagtcaaggacccagtgaactgactttctagttctcgaagttccaactgaaaggccaggaaagcctgagaaaggggttgtggaagaagcgaagatagaccccccatccctcgcctttactgcccgccccgggcctgtgaacgatgacaacatctgacattgtgcaccagctacctctgcttccatggcagagaaaaggccataagaactaacaatggaagaggagcacagactcagacatcaaggaagaagccattttcccaggtcctcttttctgcatctcatcacccttagttataaataacattgaacagcatctattcagaacctatactgaataaaaagattgatggaagggctcaagtgggtagcaactatgaaacagaaataggacactcagttacaaacattcttttagtttttcagaaaaatgcatccctgatttcattcattcccagcttgaaagcccagccatattactctattccctctcaaa

SEQ ID NO: 31634 - DNA, 1002 bp, Bovine  19866880625661
acagtaggaaaatacttacattcctaaagcagttcagtttagctttaaaaagctctaatgggtataacgtttattcttttattcgtctggaatgttgcccttggtaacaagtcctcattttatcaatgtcctcttaaaaacctggaatctaaaattaaactcagtacttcacttacgtgtgtagtagtacaaagtatggttgactgataattttttgttttcccttttatttagtataacccataattaagctgtttttggtaaccatatcctctttggagctcctgttgagcttgtgaccaggtgaaacccctgtttaacaagagttgctaggctgcatgtcccattttttttgaaacaccagagttgttataaatgttgctttacagctccagatcatgtgggctcttctcttattggctctgtgaccatagccaagtcacccaatttctttgactttaatttttaaaatctgccaaatgggaataataccttcatttttgcagtgttattagggatataattagatggtttgtgcatatggctctcacactccctgatggaaataggtcttgtgaaaacagtcttctgtcataggctttactggctttacttactcttggtcaggtattaactctgttaaatagaatccacccagttcagatctctatatattctgaatggataagaagtatttcaaatattcagaaaagagtaaagaatagtagaaaaatcattccatgtactatccatccaacttataacttaactggttcttggatcttaacattttcctctatttgctttagattttttttttaaagaagtaaaacactgtgggggttgaaccctctgtgtacctgtttctttcccatcccccttcattcctcagaggtaaatactatcttgaagatgtttgttttcataaataatgtaattgttttgcgtatttttaaactttcgatatacactatactgcagtgcactcttgcagtatgattt

SEQ ID NO: 31635 - DNA, 767 bp, Bovine  19866880627401
ctggtgcatcagacatggagtcagaccatgtggcaggtggctggcatgcttggaggcttcctgaccatcagccttgaaggaccctgcttctccccactggacactcacgcttctgatgaggagtgggtagcgggtgatcctctgcatgggcttcagcaggaagctggaaaggggcatccctttacaccgagggtcagatgccaacttctgcaaaataattgagaggctcgtgaggaaatcagagcctaagaaaaacgagcgaacactggaactactcctcactttgacatctttcagattttgaatttcttttaaaaactcaggatccaaaatgatacccatcaatttaacagtaggaatatcccaccttgtgagccagaccccacgaatactttcagttctttcttaaggtggttttgacaggctgtgcgagccttccctccattactgagaaagaccatgctctctcagctgtcttccaagtccactgaccttctcagtcttcctcactccttttttctttccccccagtgtcccactgagtcccacagtgtaacccagaccatcaatggagccgaattattctccttttcatctgatgttccaaaggcacctcaatacctcagcatacctcaaaatgaagtcctcgtcttctgtcataaaagcatcgtcttctacctctattcctatcgggagttggtagcatcattctgcacccacccgcctccttcccacacacctaggagtcaccactgatgccaatctgt

SEQ ID NO: 31636 - DNA, 605 bp, Bovine  19866880646628
aaccccccaaggttctggttcctctttcctctgttcacaaactacctctggacagtcgtgttgttttttgttatgtgttttgttcttagacatccgtcgctgctgctgctaccagcgccaaatgtccatcctcattgcctcctgttctgcccacgtccccctcctccaagaagcccttaggggaaggggcctggagcaaagcaggctgggtaccaactcccccagtcccagggaaggtggggtcctgcccctaggatgctgcagcagagtgagggtggggaggggggggcccgtgttgactgtcaggtgtaggggccaccttctccacctgttctgtcagggaggaggtagccattatttgtcccagcctggggctcccctctggtttcctatttgcagttacttgaataaaaaaatatccttttctggactgtcttttctgtggtgggtgcctagaacagaggttagaaaccaaggatctctagtgagtgagtgaaaaagaaaaagcacagggaaggtaacgtaagccggtcttgatgaagtcaactacacccctagccacaaaacattttatttacaaaatatatatactgaatatacattag

SEQ ID NO: 31637 - DNA, 2636 bp, Bovine  19866880655581
atctttattcttatatactattcctaaattggagatggaaatggcaatccactccaattttcttgcctggataatcccttggacagaggagaaagtcaggctacagtccatgggtcacaaagagtaggacatgacttcagcaactgagcattcctaaattatttgtccaacattttagacaattattcaaataatctcttttcattgctattattgaacatattgtttgtttccaatattttacatataatggaataagctacaaagtgatctgtaaatgttcagagaatggaaaaaaacaatgaagaaagaccaggtctacaatgatttctactatgctcattttatttataagcctgcttaacatgtaggtttgaagtttataactaaacaatgtatttacaacaaattccttagtatgtggcatagaaattctcagatttgagtagagcacattattaccacaattattactctcattctaaacttacatttaacactcattaaggaaaaaaaattcattttaagaaatggtccatggcatcaaataatctttataatcccataccatttccagagaaggagcaatgctcacatctgaaaaggcaaaaaacaaaacaacaaaacccttatctcaagtccatccttaaatgacagcatcctaccacatattaaaatttatctttactttttatgaaaataattcatttttctaaaacttttctaaatgtcacaagagcaatccggagtcttaagatacacaacatatattttctttattaacaatgtactgatttggccctatgattgaaaacactaaaaaaaaaaaaggaattgatcaattggtaacattaacacaatcctatgtgaaggctgtggaattattggtggcttttccctcttttttcccctagtgttcttttcaattacagttttcagttctaatgttaaaagaattattgactggactctttattttcttatatttataattagctaataaaatctacctcataattaagaactcagcatctttgattaccttagtaatttaaaaacataatgcattttctcaatcataaatgatacacacagtaaaaaatacctactaaaggtgagtaatatatatctgagaaacaaaacttgaatcagaaaaaaaccttgaaaactttttattattgaaataacctaaacatgtcctctaaaatgtttcctattaagaaactgtgtgtataggtatacacataaccctttataaaagggaaaacaaactaattttatgtgtatattaataaatgaatctttactggtttaatcactttacaatcatctcatgctatcaaaaacatctttaatattctccacttatggcactatgctttctgtcttccagttttatgctttaaacacaatggatgtttaggttactcttaactgctcaaaggcaagcacacactccagatgatactgcagaccatgcttatattgagctttgggatttactgcataatattctaatagaagacacacgcagtgttttgatataaactatctaaattctttaaacaagaagtacttgaaattttgcatttataaatttaagggaaaatatctaaatgaatattttataacttctaccaaaatctcataaccactttatctcaccacaagcatgaagctacttaccattcattgctgtgggaaactgagccatcatggtcctgaattttccttgctaacgctcagccatctgcaacatgaaaacatggtgccattaataatacagcaagggcagatcacagcttagcacacctgctaagcaccaggaatgcctggccccttcagctcacacttccaccagaaaacagtgcagagcttcggctgctgctgaacaggcagaatttacatctggggaagagcagaagattttgctgggtaacggtgctgcctttaaaataaaaccatttaacagaaaatcagtcatatttaatggtaaatactgaataaagaacctttggcattaaaccaattttgtagaaactaatttgcgaaagaggagggttgctacaaccagccaagaatttattccggagaagtcaactctataaattaagtgtacaataacatgggaagtcataatactcttctccttcaaaaaataaacccccaaaaaaacaaaaaaaaaaaacctcgagcaagaaaaatatccaaaatatacgtagcatagctgtttaattcagctctacaggtttataaaaatggactaaaagtaactattaaaacatgtatgtttatttatacataacaaatgtactaaggaaatattctgcactaggaagagaagggaatttggaaattaacagctctgggttcaaatctcaactttatttttctagctgtgatcacgagttatttaatcttacagagtctcagatttctcatctgtaaaaataattggcatgagtttttatttttttaagtgttaaacataacccagtacactgcctgacacattgtgggtgtttttaaaatgacttaaaaatggtttcctgggtgtccaggaaggaagaatacaatataactttgaaccctgaattcatcatcttattacaaataaattcaaaatttgttccagg

SEQ ID NO: 31638 - DNA, 2625 bp, Bovine  19866880687676
cctgtttatcttagacttcagggcttccataacaaaataccaaagactaggtgcctcagacagcagaaatttattttctcacagttctggaggctagaagtccaagatcaaggtgttggctggtttgatttcttctgaggcctctttccttggtgtgtagatggccatcttctcattgtgtcctcagatggtctttcctctgtgtgcacagccctggtatctctttgggtgtccaaatttcctctgcttataagaaaatcaatcagataagaatagggcaccttgacagcctcattttaacttaatcatcggtttgaaggctctttctccaagtacagttacattctgatatactggggttaggatttcaacatacgagttggaggcggccacaatcctgttgaacacctttttggacgattgcctaatgataatcctgtggcgtaagcttcacttcccataggaggctaaacagctgtggcaagtgcctgtgagttattgattatcacaatcttggactttcaaaggcagtccaccaggtatgcttcctgggggtttacagcacaaaatacaatatgagacacaaagaagaccttatttccttaagcagtgactagaagtgtagcatttctatgtttggttttccatcttttgaagttagaggtggagtctctatgtgatctacaggaagctcaggagattataatcttctctcttgtatgatcatccatgtgcaacttctagaaactatcttcaagcattggtcctctatgttgtaaaattttctttgagtcttttctgtggttaagtcctgttaagaacttggtctattcaggcatgacaaggtagggtggtagatattggggataaccacaggctggtgaaggtgatcagcatacggattagttaagggcaggccttgtacatgtgtggctggctcagatattagatgagtcaatagagcagagattaaagcaagtgaccaggatcagggtttgctgaaagtctggaggacaaaattgaagaaacaatgagtacagttctttgttcctggatagagaaccttcaggctaagaatttgaggggaaaatgttgctctgagagcgtgcaagactctcctttctatccagtggaatggctttttaaaaacagcactattgttctctgagcatcatcaatataagcaatagtcacatgcagtcctgattgccagtgtgcactaatgcagcctcatgcgttgccgcaggctggtctgttagcttctgtgtcatatcagttgttaaatattttcagtaccacccttatgcagatgtataagttttctatcatttttggtaaaatttctgtcaagggcaccagctaatctgctctttagtgtcctcatacaaagatttacatgatagatttcacttggcattccaaattcaggatgatacataacattgtgctgtagtgtacagttccaattaacatcagcactgaagtcaccagtactgtcagtttctctatatggcagtgactactgacaatttgtcttggtttcctggatgtcatccagtacattggccaaagaggccaaagtaggcatctgtgttatatttcaacctccttcttgtctctctctctttttttcctcttcttattttatctgtacctaaacttttgctcctgagtctttggccacatgatgaaaagagccgactcactggaaagaccctgatgctgggaaagatcgagtgcaggaggagaagggggtgaaaaaggatgaaatggttagatagcatcatcgactcagtggacatgaatttgaacaaactccaggagatagtgaaggacagggaagtcttcatgctgcagtctgttgggttgcaaagagttggacacgactgtgtgattgaacaacaacaacacaggtactcattgggaggtgcctttattattcatttgtttattccttcaacaagacaaagttcctactctgtatcaggtactagacatgataatagtgaacaaaacctgatatggtccttgctctcatggagtttagagtcatatggatagcttaatggcaggataagccaagaagtcaagtccccacttttggttttaatctcatccttatttcacacccattaaaccttgcttggtaaattatttttatttttttgccacttcaatcttttcttataagtgatcttcccctctgagcagaaacatgtcttatctcccttctactgcaatgataatcctcttgtgttcatttaagttcttatttttatttttttagtttatttgtctgctgtgagtcttagatgaagcacactggatctttgttgcagcatgtggaatctagttctctgaccagggactgaacctgggtccctgcactgggagtgtggagtctcaaccactggactaccaaggaagtccctcatttaagttcttgattgccatcttctctgtccattaacggacttcacaagtgagttaatcttgacctcccagggcccactcctttaccacttgtaatcctgcatccatccctacctccctgggtggccggtgattttcctgctatctgagtcgcctcttttggtcatctgaggttctccttcctttccatgc

SEQ ID NO: 31639 - DNA, 1551 bp, Bovine  19866880689079
ttggaggaattagctggtagtgttgaagacagaagtagaagttcagagaaggtaaccctaaatgtcacatactaacaccctctcgtcgtcattattttttgagatttttttatattttaatattaaaaattagtgtctgaatgctgggttcagaaaacaaaattcagtgtgttgtgtctgtgctttctcacttaacatttaaggctcttatactcagaatggtacatttcctgctaataactcttgagttaacttggtattagacatttatcttaggggcttccctggtgactcagatggttaagaatctgcctgcaatgcaggagacctgggttcaatctctgggtcaggaagatcccctagagaagggaatggtaacactccagtgttcttgcctggagaactccatgaacagaagagtttcctgctacttactctcttgagttaacttggttttagacatttatcctagagtgaatataaatgacaaatgacatttacaatttaaataaaaatattattctcttgatgggagcatttcttattagcattttatataactgtatttatatggtcttcccgtagaatggcaaacatcagcagatctcaggcagacttcaagatgtccgactcagaaagcaaactcagaagactgacctggaagttctggataagcagtgtgacctggaaatcatggaaatcaagcagcttcaacaggagcttcaggtgagtgcttggctgctgaatcgtccttcactgtgagcagttactagtaactcttcctaatcctagcggttttttgctttttggggtcctgaaccccgtggagcctctagtgacctccttgtaaaagggtagtagacatacacaaccttgtggaatatcaggaatctcatggactccctaaaactctgcctgacacctggctaaattctgcttaatatttatgcattccctgagcatttgccactttgtgttttaagtctttaataaatacatacataaatatatattaaactaaggttattgtgactacttttaggaaatttttacctaatgttgttctttcagaaattgtggtgagaatataattactaaatatgccctcagggacctggtaattctgctctttatttgtgtagaaaagagaccctggaagcattttgcatctcaagtcctcttaaccaaatgtgtttttccataaggactaacagtaattaacataatgtttttactttctcacagcagatgtagacaagacgccaaataacatttcctgtctgatttacacctgctttcccagctatccctgagtttttggcccctctttgatcttcatcctggggtatcatagcccaggtatcatagcttccacacaccattcagagcagataccaaaggcacctcttaggctgtgcctgttctcatcctttaggacatgggaaattgtcaggcttctcgacataccctactagcaaagctttcttccccaccttttattttcagccagtcttttgtaaatggatttatgtgtaaatatttgtattttaa

SEQ ID NO: 31640 - DNA, 1493 bp, Bovine  19866880690186
ggtaggagggaaggcaagactggcacatggaattgcaaaatgtactgaggacgaagatcaagctagcaaactggggcatggccaggatcaagataaacatatcagagaggcagggctagttatgaggtaaccagagtgaactagaggtgctgtggaagagcaggctctgaaagggacatgggaagcactgcctggagcagctccccaaggcccaagaatgtagcaaaagagctttttggagacttcgtctaggagtagggagggtgacattaaaaggatggaagcattctggatgatggcttagatggtaaagagtttgcctgcaattcaggagacctgagtttgatccctgggttaggaagatcccctggagaagggaatggcaacccactccagtattcttgcctgggaaatccacggacagaggagcctggcaaactacagcccacagggtcaccaagagacggacatgactgagtgactaacactttcactgaagatttttgaccagagtgcaacaaaatggtattttagaaaaatgtattaaggaactgtagaactagaattagaaagcatagcacatcaagacatgagttgaaggttataaaaattattttgaaagcacccagtttcatatttctttgcttaccctagtacctaaaagtcagtccttagtaaataaatgctaaatatgaaatgtacaccctcttcaaaatgattgttttgtctttagactaagaaaatctcctagaataaagaaataaattaatatcgtcacttatatatgtcaaatttctatgagtttggtcaatgtgtatcacttttatgcagcataataattcctgaatgaactgatagaactcagtttataaaccttgcaggttctgatgctttattggttctttggttgaaaattacgagaataaacccttgctactgacgcaaaaattgattggaaggatacagggcagatgagggaatacaaagatcggttggatcatttgttctcaggaggccagaaccaaagcagcttcaaggatctgggaatcaggaactgtgagctgtctcatggcagcataggatcacagcttcaccaccttctgtgcctgcatttctcagctcaaagttcaacttcttcggataaaaagtgtgattggccaagcaaagatcaaacatcaacctctctgttgggggtagagtgttgtacttaacaacatatcagaaccacatattgaacatattgggacactagcagcccccaaggaagtaattctagacagaaaaaataaccagtgtctactctgggtacttatacttcaaaattcaccctcaaaatagtggggacagctgattaaacaagatgctacttaattggccttttcacccctgagaattaattggaattaatatttgtcactccagagaccaaatcctactgatgatgatgagtttgtgtactgcgaagcttacctacttaaggaggttctcatttc

SEQ ID NO: 31641 - DNA, 2124 bp, Bovine  19866880696942
tgtccttgccctttcaaaatacctgtatgtgtaatactggctttactgtgctgagtttgtttggaggaaactagggaaaagatacttgttctgcagagtcttaagtcctcccctccctctccattccagatggtacaggaaatctgttttagaatttctaagggtgtactcaatcattcattcaagacatagttataagagtacttgttcaaggtgctgtgttgtgaaaacatagaaaagttaaatgataagatatagatcctgtttttacagagattatgacctaagagaggtgataaaatgacacacaaatacctgtagtactaattaaatgtgatgagtgcgatgagagaggtactgaaatagtatactttgaggaatctggagagcaagcaattattttcatttaaaagagatcagagcaagtttcgtggagggcttgttgttggacgggaacattgaaggcaggggatgatttctctctgagtgaggaggaggagagcagtatattcaggaagattaaatagcaaagatgaaaggacagaaaagcttggggttattttgggagtaatgaagggggaaagtgtaagcaggaaggtggcaccagctgaagtgggagaaggaaccagatgttctgggtgcagttgtaagacattaaaggattttaatggagggaggtggtgaggaacagtgaagtttgtagatctggaagaaaatgaaaagtgtcagttttccaaatctacgtggatctttttttggcaggttttacaccccaaattttatattttcatagtttttgaaatgattccatatgtaaggcttaccacactgggaacttactcatttttatgtatatttgagaacagacttttttttcccttttcttggtagaagttagtacgaaatctttttcactggcttgtgcttttttttttccccccccagtagctatttctttaaacagtgtgttatcatttggcattcttaagatgatgcagcagacttgtttttcaagtgtaaaaatgtcatctccttatgtaaatatatgtcactgtataagttagattggtcatgcaagttgaaagcccctggctctcaatatagttcatgatttattttactgatttatttatgccctgccatgttccagaaaggatttaaagcaggatatgtcatgaaaagtcttggaccttgttcgagccctgtctattatttgactgaatcgctagccaacattacactgagggaacagtgttgaagacaactggtgtcacagaatgtgctgcagttgtgtcttttgccaactggtagtgattcagagatggatacaatataattagactacctttaaggataagtccttcgaactttgagagcatgtaaggaaaattggttggaaggaactcacggagggctttgacccttgggagcccaggcacatttagagcagtggtctctacagtagggtttatataaaattatctgggaaatgggagaaatactagaggtctgtttgaaagattctttattttcagtcagctgtgatgttttttagttcataggagcatgggtaattagatttttagatttattattttattttattttatttttttttagatttattattttaaatagtagactcttaacatgtattgttgcaataggaagtcaccatgcagatcttttataaaatatttcatccagtttagctggtcatcttgaggcaaaggacttaagtattgtctaatctgaagatgacttactaatttttctttcacgaaaacacaaatttcagatacaaatgtctgaaatttgctgacattttcctctcacagatgtctgtgaattatatactacctacctgatatttatgaaaattaacagacttaatctgttgctttgggatgataggtaaattcataacagtgacccgaaaagtaactacctttcaagacgaaatccactattatgaagagaggttatttggaatggatatttggatatttccaattctaaacatccaaaattgatatttggaattatttccatcattattggatttaattgctgaagatgatatgatcttaaaactttaagaatatttttatatgtacacttgaa

SEQ ID NO: 31642 - DNA, 2168 bp, Bovine  19866880775685
aatgttttagtcttacatttgcagtgagtattaacttgtaaattccttccaatctttttagagataaagttggattaaaaattataaataacgtagtctattattatcctagatatttcttttgctttcaaatcaaaatttcttttgcttttgagatacatacacttatcctggatcaaactatctcaatcgttaccacttaaaaatttcttttgtcccttgtactacaatacaacttgcgggtctggaccaagagaccacgttaaggaaaaacagacatccaaagaaattcaaacaggactacaatataaacagttaaaaataagttctaaaggatgcttcaaaagaaatacacaatacaagtaatgtagtttgtgtccctttaataaacacacttgcatagttatattacagttttgtaaaaatgaaaatgaatgacctcatgccaagcgtgcccagcatttgcacaatctcaatatctttgatactatagttttcaagacgcacaaaataaaaatttaaggcaaaaaaacagcactttgcaacaataatttattacattacagtagcatcacagcagcatccaataatgccactataggcaaaagtctctcagtctttccattagagtctatttacaagaatttataacttggtaaaattcatcctaagaaaacttggcaaataaagctttggactggaattggcatttctttctctacttttccttcccctactttattttaaactatcagaattcatattatatttttaaaacactaatgtagcagttatactgttttaatagctgtattattttaaaatgactccctaggataaagttttagaggaaactatacaacaggtaggattgatttagattttcaaattttcgaaaaaaaatcagctttggtcttagaactgatttttttcattgctggaaaacccatcaggtttaatcacatactgtagaaatgattacaacatactgcaattttaaaataaacaggtattttgattcttcacttcctacagggttcagatttgctcagttgtgctcccattttaaaaattctatcttcctgataaactccttctaatgtctctttctaagtaaactgaagctgcctcttatactgaatgaggaagagagcaaatatgtggctgaatatgaggtattgcaaaggactgcatgctcttttaagaaggacaagttattattatatgtcataccatttcctttacttttagcttcctgtcaaatgtatgacaaaatacctaaacagagagaggtatttctgtaaatacagtaaatttatttcccagacagacactcagtttaaatacgccattataagacttggtccatagtacctgaagaatatattcttttcaaattgatttacagacactaatctctaccagaatgtcattctttatagttatcagtgtaaaagtgaagcaatttgagctacaaagatacctttgaaataatttatcagtgtattaaataagcccaaattcaaaattataaagagagaatgttatactatatcatgtgattaattaagtggtcttatttctaacctcagggtttaagggtggatttaaagtaactgccctgaatttgaacccaactaacatgttcagaaaataaaaggcaagaccaagtaacccatacaatttagaagatcagctgaatttacaaggactcagtcttgacactgtaccctttagtgactgcaggcaaatctgttatgccacctgtaaaataatattattgctttccatttaatgtcatattttataaaagtatcatgatgatgccaaatgctaaaagttgaggtggtctagtaactagaaatccctgcctcaggaagcatacatgcctgtcaccatacattccaatgatgtgaagtattctggaacacagacatttatattttgtgaagttctaactacgggtttagttgattcttcctcaagtgttgtaaagttatgatttaggcaacatatgactaaaatcattcattcataatgtataggcacattaacacaaatattgcacaaaatatgcctcagagatataaaaacacatttcactcttcttaaagaactctgtgaggaaataagactctgtgattgtatgtacacttttcctgataata

SEQ ID NO: 31643 - DNA, 1204 bp, Bovine  19866880812667
aagcctagactctgcccgagaaatctagaaacctatgatgtgaaacctgcctcctaaaaacattttatcattttttcttgttattgtccattatgttacatttaacaacagaaatctcggccatagctaaaaaattcccattcagagaccggtctgtgcagagctaagggtatgccgacttgtcacatctatttggcttcacagtgaagcgaggctttcaccaccacagcgaccctatgacgcaacctcatcacctgtctaagaggggtttccaatgaaaacaaatcgtaagctgaaagaactctggtggtggtggactgagcaaaggagaaagaaaaagttggataattatgtttactacttaacaaagaggagaggaaaactgacagaaatagggcagatattattggtatcttttctgtatttttctgttcacagtacagaaacagaagataatatctcaacaggaccagctgatatagtctcactatttcactctgtttcaatcacgtgaataacacagagcatattataatttcttcctggaggcatccttcctcttaccttgagaagtaactgtgacgtcagttggaagggttgtcgtgaggtccttatacagcagtctagcacaaaaggggaaggactgaccttccggcttcactttgtaagtaaatgacagcaagttgcacaatgagtttctctgcaagggccccacaagaaaggctgtaaagtcactctaatggggatggggatcaaaagagacacaaagtatatgacaattacagctccaaggcaataagtggttatgatgcatcaaacatgtctaccaaaacagggcccattaattaaatctcagaaataaatgaaggatagagaaaggcctgaaaaaaggacaaatgagagagatttataagataattaagagttggtagcagcctagaaggcctgtaagaagcacttactaagtcaatggccagaggctggggagacactatttctgctaagaactcaggggatgtcacacgtttggctgaaatgcttcatgtctacattcacatgtcagtatctaactgataaccagaagcttcggtcattccaaatgcacagagaaattttaagtttgtaagagtcacttatttcctgcttgtattcatttccttttttttcccccctttttactgcaacccagctcagttcaacccta

SEQ ID NO: 31644 - DNA, 1212 bp, Bovine  19866880817312
gctttgttatccagtcccatggcctttagatcccacccaaattatagttccagtgcagactctcccatctgcctacttgcagtacaagctcgtatgtcttaatagtatctcaagattgccacctgcacaaatctgtgcctcgtcagtcttccccatctcaggaatagctcctcctagccttccagtcacccaccctaaaaccttaacatcatgcttctccctcatcctggatccccttctccatgccattagcatgtcctgtcagctccaattccaaaatatatctcccatctattttactctcttctctgctgccaacctctttaattcaagccatcattgattttctgtctggattattgcaacaggcgcctaactgtccatcctacacagaacagccagagtgatcttataaaatcttaattcagattatgtcattctcttgcttaaagccctcccatgccttcttgttgcacttaaagaatttgcagaattaaatccagctctgcaaggccctgtatgatctggctctttcccacttgtctccacctccttcccttctttccagtcatctaggctcctttcattctgtaaatgcattgatcctttcctgcttcacagtttatgcactgcctgctgcttcttcccgcagtgcttttcccagtgtgttcctcatccttcaagtctcagttcaaatgtcatgtcctctgagaggctgtcctggaccagccattctgaaatgacctgtcccactgtatctctctgcaattcatcattgtgtttattttctttagagaacttatcacaatctatattgtcttgtttattggagtattgtttgtctcccgccattagaatgtaaattccaaaagagtagcgatcttgtctggtctgtgtaactcactggtgtatcctgaaatcaggccttacacagtgcaggtattcagtaaatatttgtgaatgattctgtttattcagaatcatcgggcttccctgatagctcagttggtaaagaatccgcctccaatgcaggagaccctggttcaattcctgggtcaggaagatccgctggagaatggaaaggctacccactccagtattctcgcctggagaataccatggattgtatagtccatgtgatcgcaaagagtcggacatgactgagtgactttcactgtttattcatccttgtgcagtcatcaccctgcatta

SEQ ID NO: 31645 - DNA, 788 bp, Bovine  19866880832523
ccttttattaaaatcttgcaaattttaattagattccttctatactatgatatttattacttagatacattattatatttattgtataattatacattataatgtataattatacattattattacttacataaatccagtttggtcttcccattccatttgcatttgtcattgataccattttaaagcataacagtggaactgtgtatttgactcttgaatcttgttatgttcaaaattaatcgtgcacctcttattcttatgtgtggttccttcctacagggaaatgcatttatagagcattatgatccgaaagagtatgatcctttttacatgaacagagagaacccgaattttctgaaggtagatttctaattttaactttggcattatgtggtttatgtttttgaacagtcttaatatgtaagtagtccttcagtgattccctgtgaatgctgtaacatcttaatcatgtcccatctccacagctttgattatatggacctttgtcagcaaagtgatgtctctgctttttaatatgctgtctaggtttgccacagcttttcttctaagaagcaagtgtcttaatttcatggctgcagtcaccatcctcagtgattttggagcccaagaaaataaaatctgtcattgtctcttctttttccccgtctatttgctataaagtgatgggactggatgccatgaccttagtttttttgtatgttgagttttaagccagctttttcactttcctctacaccctcatcaagaggctcttagttcctctt

SEQ ID NO: 31646 - DNA, 1367 bp, Bovine  19866880874914
cagagatgatttgagatttttctttccaaatgcctagaaatcttggtaagctttcaggaattgtgtcatgatagctaaaagctgaggtatgactgaaataaacaagccccacatctggtcccatgagacgagggacaggcaaattttcaaagtgagctggttagtttcctttactttcaaggtcacacaatggaattatcaccactattatttcaacttcaaatctgacaggtgaaaataatataatagctctatcttcatgaactggaaatatactattcaaagtgtctcttaagtaggaaaatattaacatgggcgagagcagtcatgacctatttcaacacagttgtctccatgaaaaactcattctgtggggtaacacatattacttgacaaaaggaattccataatcaagaaaagtttggtaaatgttgggttaaagaaatatttaatttaaatcgtaagataggcaacaaggatgtattatacaacatggggaatatagtcaatattctataataattgtaaatggagtgtaaactttaaaacatgtgtaattttttaagaattaaaaaagaaactggcatgaagataaagcaaaaaaataaaaaaactaaactagtttctctaacacaggacttcataaaacctctaatatacactaaggaatgatatatatgtcatgaagcatttacccagtgtatgtcagcacaaaatacttttcttcacaatttatggagccagtattcaagaagacactttggaaacataatctgaccccacattatacttctgaaagtcctactatggaaaggttgggtaagaacgtaaaattactcaatatcaactgctcaccttaaaattacctattaaaaagtagaggttgtactataacttaaaatacacaagacgagtgacattcatatatctaaaatcaactatatactacttactgtggcattaatgaaaagatacttcactcccaataaacaaaaggtctgtgcaataattatgagggacaaagctctaatccatatcatcattaaacgtttaaaatgaagttctgtccccaacacatactgttcagcctggaagtgggcctggcagaggtggactgaagtgcagatggcaggatctccgatttgatggccacattgctgactgcgccatccatcctctctgtctcacataggcctggcaactgtggtgccttctccagcgtcggaagtaactgatcaaactggtcaaggtcagctgtaaactaagaacggaaatcaaagttagaggaaacacattctacactttcacctgaaagaaactagaaaacaagttgttcctttaaaatacatgaattgagtgtgactatg

SEQ ID NO: 31647 - DNA, 1942 bp, Bovine  19866880878551
tgctggtgtgtgtgcgtggaggggaccgccccggcctgagacctccaagaggagacagatgtgaatttcagaattttgcccaaccgtgatgggagtggaggtgaatctctaaatcctgaaccacggtccccagggaaaggcagtcccagcttctctccagccagtcctagaggaggatgctaacaatgggaaaccacccccttggacacacgcccaattcccagactcagcaaggtgctttgggggtgctgatgccacccagggccccccagaggccttgaggggacagccaggagcatcccccagggatgtccaagctcagggcagacaccgcagcgggaaagatcctggggacccagagctcactgccctcaaggcaggagcggagctctgagctcagaggccagggttccaggcccggctctgctgcacatcagtggtcactcccctgctgcactcggatttcctggttgaagagacaggcatggggatctctgaacttatctgtcctggggggtcatgatgaggaaacacagggagaagagatggggggacacttgggaggataataaagaaaatgtgaggtggaggcatttcgtgatgagggcacctcccagcagaacaaacagcatggcctgaggctggaaaagcctccgtcagaggctgcacccacgtcacaccccgacggaccttcctcaggggcctgggctgcacagggcccatcaaaacaggccagcttggaaggtgtgcttccccaaggggccgggacccatattctgggagcccccccatctcccgccagcggcaccccacttacgagatggcctccaccatggcgagccccatgaggatggagcagacggcgtggtcctcccggtagtcaggcagcccacagatgcagtagtaacagtcgcccaggatcttaatccgcagctggtggtatttctgaaagggaggggtgtggactggggtcctgaggcccccctcctcagcgaggaggggtgagaggcaaagattgctggggaaggctgggtgggaggaagtcgtggcagacagggaggatggggaggggaggcccaggccacgtgggtgccccctgccccgcaccgtggaaagccagccgaggggcagggtacttacagccgccagcttgtcgaagcgggcaaagagctcattaagcagcttcacaagctcctgggcgctgcaggctgaggacagactgggtgaagcccacgatatcagcaaagaggatgctgcaggggaggaaggcccagcggtgaggacgtggatagcaagccaggctccgtgctgcccaccgccagctcccactccagctcccaggcagccaggtcctcgtcaggccccaaagtggtgagaccctggcacatccagggcacatttcagggctctggcctctagcttagcttgtttgtggtgtctgtacaaagacgggcctagaccatatagcgcatctcagcccccaacgtccagcagcaaggcagctcctgcaggggctgaggttcatactgtggggagggagtgcgttgtttctagtccccaagaagactctcgaactccacagtcctcagttggccccccgaagcccccatccagtgcttggaacccaggtggccggcgcacctgacgttctcatggcggtacatgtacatggtgttgaactgctgctggtccttctggctctcatccttcttcatgtccttcagcatctcgtcggccacgtgcttgggcaggatggagagcataaggttctcctgtgggaggggagagggtgagcagggagggcagggccggtgtggacactctgggaagaaatgccccaatcctggtgacagacatgggccaggaaccaggtgaccttccatggagacctggcagggcagaccccacgctgggaagcagctggaggccaggacaggtcagt

SEQ ID NO: 31648 - DNA, 874 bp, Bovine  19866880882217
cagtctgttgtttgagcagtaagtatgttatatcctgggaaacagaaatgacagttgtcattgttttctgtttgtttctgattttgtggttttgtattcacagggacaggttgtagaaaacctgaaagcacaggccctttgttcttggactgcaaagaaagaaaaccacttgaacttctcaaaacatgatattattactgtcttagagcagcaagaaaattggtggtttggggaggttcacggaggaagaggatggtttccgaaatcttacgtcaaaatcatccctgggagtgaagttaagcgggaagagtaagcacttagttttgtgtgtttacatgagatgtggatgttgccagtttcactgatgagtcagccaaagtacaactggctgtgcaggaaaattagaagtttaaacttaagtctgaatatcagaatggtgattcctagagtgaaatacctaaggtatttgtaccagttttagaatatcttttattctagttatttcagattcctaaagttttcaaagtgcttaaaattttagatcgtttgctttctttgcaccagcaggttagagaagttattgttcatttcctttggagctttctcccttgtttactgtgaactgtcaatatttagataaacctttactgagggccttgcctctgcctctcccatctctggatctccagagttccttgcaggtcacctttcttggtgctcatgacacactgtgttgtagctatttcccttcttacctatattccttattagatcataagctctaggaggtgggattcatgtcttttttgtttgcattttagattttcgatacctagtgtgaccttaatgcctagtagctgctcaatcatacttg

SEQ ID NO: 31649 - DNA, 1944 bp, Bovine  19866880892314
cccgtataatccacactcctccagccccaatttcttctctgtaacacaacacggatgctcttttccagcaccaggaacctctgtccctgaagcgtatctgagagcaatgagacactggctaatcgtgaggacagaagaaatcacaggctgctaattaagcctttgtgtccttgttagtgaattacactgcattggtattccactttctatcaagaaaatcacaacaaggaagagttactgagcattgtggtgctcaggaaaacccagtttttcttcagccccgtccaccctcttgtcctccagcacctggtctgcaggcacagggcagcagagaccggtggtgaggctgaccagctcacggcagcctctgcagggcagcagagactggcggtgaggctgaccagctcacggcagcctctgcagggcagcagagaccggcagtgaggctgaccagctcatggcagcctctacagggccgagacccatctcagcacttgcctctgtcagtggctatactgaggaagctcttcagtaatggacggatcctggacaggatcctgaactcccaaagtggaccctggtctcagggggacagcctgttgattcctttggaaaccctccatctgagcacagcacttgcgggctttggacctagctagataggtgggcacagccctgaaggcccacttccaaaacagtccagtcctggagcagtgtccacttggtgtccccactgccctcagacctacagggttcgggacatcagagctggaccaggccgtggcagtgggcacatcttctgaccttagccaacccatccccagtaactgaagaggggcccgtgagaccaggtgggggggtgacctgccccatgttatgcagttccaaggatggagcccagctaggggccaggactgcccttcagctcaggactcttcaccttctgcctcctcatctctgcccacatcccagggctcagcccccacccatacctgggcatcttgctcctcgggctcctcagatatagagccgctggtgtgaatgctcccgttggactccttggtctcaatgagggcaggggagctgggctttgaggaaggcggcgctccgttcagcagggcctgcagcagaagggaggggccgtcagggccccccaggcactgccagctgcccacccaggcgaggggctggtctactctctggtttggaatctccccactagagttcagaggcctcatagccttagaaatctcactattcgtttcctcctccagaacatccatattagaatgctgtaattttctagtattaaatttctagtattaaaacttttccaagcagagaaagatcctattgttccaactcctatttctaagtaactcgggaacacagagcttcacagggatcatttttggggtagagagccctgtcaaacaccttccaaacatctgaataaattccataaaccagtttacccagggattagtacttttccttgacggaataaatgagatcctctacacaggaacacagtccactcattcatttactgagtatttattgagtagctactgtgtgacaggaactgttgtaacttctggggacacagacacaatgtcctgacctgggagcccaccttctagtgaggacaggcagacagccgtgaacaaagaataaatgattacaggaggtccgagagcagggcctggagaggcaggggaggcacgggacacaggggttcccggggaggtgactgtaaaggggaggctggagaggagtcactgtgaggatcacatttccgtaaacacatgagagagcatgttatgcagctctcgggttttggggagcaggaagcctggagtgggcatgcacccggcgtgggtgtgcagccagagtgggcgtgcacccggagggtctgagcagcagccaggaggctggcactgc

SEQ ID NO: 31650 - DNA, 1961 bp, Bovine  19866880907886
ctgcttcaagggcatttaaactcttccaagcattccttatgatctttactaaatgcattaagaagaaagtcaaccagtgcccctttgtgacctaggacatggagttacctcattaaaatagataacatgaatttctaactttaaaatgtatagatataaattctctgcctaaggtagggaaagtttcatatcttgtagtcaatgatgggagcctttcattcttcaaaaataatccatttttaggcaatcagtaaagaagtaacaactgactgtggcagcacattagcagtatcttcacgagcccagagaccccagtggactcccagggtacagggctcattttgggacagctgctatagataaaacccaccctgctctgcacatatggctgggtaaggcaggccgcttccctcttctatgtgtaagaagagttcctccaaagtgtcatcactcccacatcaaaatacacagaaaatagagaaaaggatatttccaattctcggccttttaacaaacttaaatattggtacttatagtggcatattagaaagtaatagaggaaaacagtgcctattgggggacaaatcgcatattgaaccaattaagggctcactgtgattaggattaggtcaaacataacagcaaaacataagcaattctgaattctgtaatgaatatacatgttgcagtaacattagaaaagcatggcagcccattccaaaccagcaagaacagtttgtgcaaatagtgggtctttgtgtgtttgaactcccaccatgtaagggcaaactcagtatgcatgctaatgacctacaattaccaaattaaaaaaggagaaaaatgctaaaggatgccagagtgaacagcagggaaagccacacaaagacccactatcctttaacttgttacaaataaattttaactgtaaattagaaacacagagaaataatcacaagtggctctaacatttgagaacgaagctaaggaattgtgtaggagatatttgatcagggctgcctgccctgtctccacgctagagtcaaacttggatagtgggtctctggggtgctttcacactggaaggcaacactgggtcctataaaaagaaaaacgagggataaaatgaacataaagcaaatcaagggggtgagaaaaattctactgattacatgcaacatcaacaagtttgaactatgaaaattctcaacctttagaaaatatcctacctacctagtaaaatgaaagtaatatttataaaggcttgagaaacacacacgatagtctaaaacttaactagttttcactgacgcgtatactcctgggctgttcttcctttagatcacttccattttttcttatatttcttattataaaagacttaaaagggaaaaatatgttccaccattggaaaacaagataacaacaaaacatttggaaaacgatcactttacattatagacactatgaaagtcaaatgcactgataaactagaatgcctccaaggatcacttagcccaagatcttccagaccttcctctctcaggcccaggaaagacccctcgggtatttttattaaccagacaaactggcaagccctgaaaactgccaaaaccatcagcagaatttaaaaatggtctttcatttaagtaatccaagttttataattttccttactatctcttctgaaaccctgaggtatttttaggaatattcaaagcataaaaaactggactccacatccagactgggaaattcagctgctctatctaaaggaccgtcttctccccaaatcacaatgatttttatgagctctaaagtgaaaataatgcactaataatttaaaatgatagatacagtacaaagtaaattaataatacttgcacttaattgtaaacacagctcagctttgactgggttaccatttatatgttcttagaagctaagttaaaagaaaggctaaa

SEQ ID NO: 31651 - DNA, 3012 bp, Bovine  19866880951274
agctggaggccggacaggtcagttcctgccctgaacaggctgagtgttgagacctgagcgtcttcagagcactgatggggctcagaaacccatggagagactgagtgactcgttaccatgaagcacttagagtggcgtctgcacacagcaggtatgccatataccttagctgctcttgtgtcgcttgacgtgaagtgtcactaaggcactgagacagaaagtgtccaagaaagacaaggtctacacttgtcccgggcttccaagctgaccacaggctgacagatgacaagctccagggggttttcaggtcagcaggagaccttctgtccctcggccaggtcctgtgagctctgtctggtccaggcatcatgatgaggggacacaaagaaggatcctgcctgccatgctcgtctcagcctttttctccccctgacatatgcatgcggggtgcacagtaatacaaggaatcagcaggtgtgtgaggggctggggaggacatgccaggctgggaagggtggagagggcccacaggacaccaaggatcgagaaagtccagagtgctgctgcccggctactgcaaactccgcagcccctgcccacacggtcaggcctcccccccaccctcggactctgccccaaactctgtcctccaaaaaaagactctctgggctccctgggagccttggggacatcaggatacaatctagtcctgtgcggtggccgctcctagcacagcctgggctctaggactgtcaaccagggccagacaaaggcagcagctgaaacacaaagctttgcagctctgatgccccaaacccgggtgccttgaagacaacagagtgaggaggtcggggctcatctctggggagtgccacgggggaaactgtcacattttgcatcatatgcttctgtagctttttgcaagagaatagatgagttctgaaagcagatcatcattcaacgtcaaattgtcaaataataagaaagaggctgtgttgtaaattacggctactgatcttcgtgtgccgtgtgaggcaacctcatggtcgaccagaaacggttaagcaggcagagtctactttaaggtagagtctgataaggggcctcccaactggcactggtggtaaagaacctgcctgccaatgcaggagacgtaagagacgtgaggttgatctctgagtcaggaagatcccctggaggagagcatggcaacccactccagtattcctgcctggagaattccatggcagggcctaccttaagtcactccgataaaacaggtcttaaataagaagtaggcatagtgtacacagaagaagggacaatttgttagatgagaaaaaatgcagcaaagggacttgacagaaaagaacattctagaaggtggagggcaggagcaggaaagcggctgagtgggcagtgaaggaggggctaggcccatgtcacaaccgcagttttgtgccggccaggctctgctctcctcctccctccccaccaccttccacatccaatttcacatccccggatggctcccacagtgctctgctctgtggtcccaaggcctcctccatgtgacccacttgctttcacggccccgactccccgacttccctagtggcccctcccagtagacaagctggacaccatctgcttttttctgcatgccttcctgccctctgctctcgtgtcactctttctagaacacccttcctcactgacctgccacctccccagagcccccagcccctggccaggtgtgttcaccctgctcctcacttatacccactttaccagcatctttgctgatgctgatcttgtttgcccttacatttcagagattctaaacccattcctgggtcctggcctcttttaagactgtgtgatgctaacgatggatctttctgataaatcctcacacacatagaaggttcctgacagtcactctcagagtccaggtaaaactccagcatttcttccacgtctccttggaggagggagaagctgggatccaagtgcacttgccaggtgggtctcacagagggcgcaggcgtggacaggacaggagccacccagggcagtctcaggggcccagagcagagagatatggcttggcctccccagcagagaggcagagcctcaccctgctcttcctaagatagcagttgctatatgttttgagagtcataagaatgttccaagcctctgacccattaatggctcctctgggaatttatccaacagaaataatccgaaagaaataaaaagatttatgtgcaagaagaacctcactgcagcatcacttacacttgtagaaaaaactctaagcagcccaaatgtccagaaaatggctcattagattgtgacacatcctctggatggaagattatgaaactttaaaaatgaccttgatgaaaactgttacaaggaaagaaagagaagcaagacacagaactgtattctgtgaaggtgacgctggatacacgtgcatcttaataacagcagaaggatatatgccagacagaaacgggcgattcaatgcaggagatctaattaggagaaaattccagatgtttttcgaaactgctaaatggtgtcatctagagaaggaggtggcaacccactccagtatttttgcctggagaattccacagacagaggagcctggcaggctacgagcctacggggttgccaagagtcagacacgactgagcaactaacccacctccatatggcgtcatactgctgcggcttttttaaattacgttttaaactggaaataaacacaaaacttcctgttgcctccagctgtgacctgaccccagcttgtctatagctaccacggttttcttcgaaaaggacaatcccggcaaggccactgagctagctccagactcctgtgtctgctcgggtctaacctgagaaagaagaccgacggccaggcacgaaacaagcgggagaccacagcctcgcagcaaagggaggagggaggaggcggtagccctccttaggagc

SEQ ID NO: 31652 - DNA, 1738 bp, Bovine  19866880955165
aatgtgttctagccatgcgcgttctgattatagttcttctcaaggttcacatttagggaggaagtttcccaatggcctgagtaagaatcccatgagactttattaaatggggaagaagtaactcctcaaaggaaatcagacattctctgaaagaggaaaaggtaattatagttaaaaacaaataagcaaaaaccaaatgatacgatatgtacctgtaagtcacacaggtatatctttagcccagctctctcttcacagcttccctttcattatatcctattgccttttcagcctatttcaggatatttctccatcagaaagttcctcagtcatttcaaaatataacattcctaaagctaaatttataatcgatcccctcattgcctaatttttttaaaaagtcaaaaaatttaaaacttggttttttccccccttgagtcccctttgtctaggaaaggcacctatctaccggatccctgaagtcattaatgaaggatcaccccttgtgcttgtttccacagctgctagaggtccccagatgctgtttgttctgcatttgtagatttctcttctgtcacttccactgcccattgccttgatccaggctcgcatttgacctggagtatcacaatagtattgcagtttgtctgcctacttccagtctacatgccacacccactgccagaaggatctttgttaaagcagatcatgtcactctcctgcttaaaaacactactttcaaaataatccccatggcttttttggggggaggggggaggtaatggtgctttactttgaagctttaaaaaaaataactttttattgttaagtataacacagatatgacaagtgtgtacaaggtgattttttttttttaacctctgagctgtttcctctgtttgaatgttctttccaccccttgtccacccgagttattgctctgtgtcctttaggcctcggctcaggtgtcattgagtctcctcccaggaaactttacccacaacagccattcctttgcccaattgggatctgtgcgtaacctttttgaacgcctctattgtactacactgtgactatgtgtacttgtctttttccctcagagactataaaattgttgagaatgtgtgttttattcccagaactttgtccagtgactgacacttagtgatactcagggaatcttgtgtaatcatttaaagcgagggctctgtgagaagccctggccagtgcaaacctgcgttgagacccagggtggtcctcttcaaaggctgatatcctgggaagagagaaaaacttttccagctgatgatgccatactgaatggagtggcatttgttatcatcccctgtgtgtagctcagtgtcagcccagctgtgagaacttggagaaataggaagatgccttcccagcagcatacttggaaattaattatatgcacaacacatgaaggaaacttgtagaataagaacaaatattagcaggttatattaattagatacacttttagaaattaaaaatgtttatatattcataggaatagtttcaaaggattccttgaaatgttaccaatctcttgggaataggattttggcagatcttatactatatacttaattgtcatatttttaaaaatttcaagtatatattttattttaatttagaaaacaaacaaacaaacaaaaaaacacacatatccagcccaggatagtctgtctgcatcctcaggagaaggtcagca

SEQ ID NO: 31653 - DNA, 2170 bp, Bovine  19866880980841
tgttactcggtagaatgctcgcaaggtcggctagaaattggtcatgagctttctttgaacattgctctgaaagcgggaacgctttctcataaagagtaacagaacggcccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagagcttggcctctaatactggcatagtcctttgtgtcagtcacttgtggggaccattatcttctggaaggacatgggagcacattcttctactgactgtagattttaaactccttggtccaggggatgtgtttattttgatgactactgaatgctcagtgcctcgtgcatggtaaaatcccaggatagcagcagtgttatttcacgagtacagctatttaagtttgcatgactttaagaggctaaagaatcttcttttatgtattttttttcccccactaaatcaggttttcaagctagaaatgctcttcttcagtcaaatctttctcaaactcagctagctactatatggtgagtttgcccgttaattatgatttttaactagacattctgtatgatttttaattagacataagaaagaagccatttctgtaaatgtttgtgactcaaaaatgttccacaaaagcaactgtgtgacagttaatgcaaacctgcaagcaaataaaattgctttgtaaaatgttacccttgagaatttggcatttaattatcttacaagtaaaacttgtttgcttttatgtaataccttctgtgaaggattagagagtatctcattttcagtgtagagcgtgaggtgatttgataagtgaattaaccacgaaccaagacaagctacctttttgaagggaatatttcccttttcatttcaaaatttcttccctctctggtgatatggaaattaaaggcaaaaattagctcacttttctgtatgtacttctcactaaaatatattaacccagctgtttttctgtcattactcttgctttcaaaataaaaagattgaactcttctgaaaatattttactctaaataggctttctaagttgagaaactttaccctttcttcaggactctggctgacatcgatggtgatggacagctgaaagctgaggagttcatccttgcgatgcacctcactgatatggccaaagctggacagccgttgccgctggctttacctcctgagcttgtccctccatcttttaggtgagtgtctctgaaggttaaggggtgttgtttcaatcatgtttggcagacaagatttttactctgggaattcctgaggtctctgctctacttttgtggaaaatcaagcatttacattgccatttgattttggtatttagtgagtaacactgataagagagtagatattagaagtacgtatgtgttttcaccacattatagataaggaaactaatgcctaaagagattcaaaataaatttacccaagaatagcaactggtcgaaccatgttctgaatccagatctgtctatcttgataatttgtatacctgatgttcagtgtaactatagaccataatgttttaaatatctttaatattatatgctaaatattaaattgctgtagtcattgatagtctatatagtctggtctaaaattttcagatctcataatgctaaatttattttgttgtttgcctttcttagaggaggaaagcaaattgattccattaatggaactctgccttcatatcagaaagcacaagaagaggaacctcagaaaaaataccaggtacatt

SEQ ID NO: 31654 - DNA, 1225 bp, Bovine  19866880995323
tcccctagagatggataataggttgttgcatgctctttatgcaatgaacatccttcacaaagctgctgttatacactgaggtgaactactctgggggattacagggccataaggattactttcaccaacttctcatggtaagattggattgttcttccaaatgaacgcactagtccacatgcctgttatattttcataagtgatttatatagaacacactgagtctcagaggggcttccttgatggatcagcagataaagaacccacctccaatgcaggagacacaggagatgagggttcaatccatgggtcgggaagatgccctggagagggaaacggcaatcgctccagtattcttgcctaaaaaatcccatggacagaggagactggtgggctacagcccagagatacatggtgaggcattcaaatagatagtaagtcccaggaccgagatccaaatcttctaatccagttctaagtctttctcaactggggaaaatgtctttctcaggaaggttaccctaacccacatggttgtgcacaatcacaaatgcgaagtttagctgaattagtccttataattactcttcactgtccctcattcaatgattatttgttgaatggtagctacagaaaacactgcttttctccttcaagaggtcacggttttatttcctttcatcactaaagtacctaccaacaggtatgtgccaggaatccaccccttcctttcctaaaagaacttgaaatcaaatttcccctcataaccacagtcaacattagtacagactttcaagaactttctgtggttctgttttcttgcatatgcatttcatgctctcagaatccctcaaaatcgaccattttacctggtccctgttcttcatttccagagaccacgaactcaaagttcaggtctcaaatatcaagtcagtaacgaagagagttaacaaggctagtggtcagtacccagtggatagcgccgtgattttgttgggagtacaatgttttatgagcaagtatggcagaaccataaactggatccattttagcagtggtcggttatgcccttgggtttgaaataattactttcctagacatgtggctcccagatgaaattcatgctgcgatttgaaatttttcatgcaaaaattttttttcgctagcagaaattcatcaccaatatgtcaaggaattgagactaaaaatagtctccctgtaaagg

SEQ ID NO: 31655 - DNA, 692 bp, Bovine  19866881004581
agctcctgcgtggattgaggaatcaattctactcagtggggatactaagcagatgtagaaagtatcttcccttcttatgtattcttgctccaaacaaagagaaaagctggacaaaataattatacaactaagaactcaagagcaatagagttgttgtgctgaggccaattcatctaccagtcccagaaattttacggtaatcaatcaaagcaaagtaagagatgaaaaataaagctgcatactatatcaatctcttggtaattaaaatatacactagtcttgcagtcatgcagtaaataaatctgtttgatttggtgtcctcccccatctttttcttttcattaaaccttcaccttccattaatatctataaaacaccaatacaaactggaatcttgtttgggaaaagcagttctttgctgtagaagatggtatctgttacttgataatacacaaaatgtactactcactcttctggcttattctgatttacagctgtcactgtattatttgcccatggaatctgatcaccagttcctggttgtccaaactggttatcaattgcttctaattccagttcaggtaatcctggttaaagaaagaaaggttagaagtcaggatgtattaaaacagaagatatgataatatttttcagaagtaatatattatatagtagagtgagatttcccctat

SEQ ID NO: 31656 - DNA, 679 bp, Bovine  19866881027197
cttactctaggctcttatcttaggcattacatgagttgtacgaatcacctccaatttacatattatagaagagccttacatggaaaagaataaatcattttcaaattagacattctgtctagagctgtcagtagctgattcccagcactgtcttttatttctgacatgcttttagatgagagtaatcttatacttgcagtaattctcaggataaaattttcttctcaaagctcatttcatgagagttgttttttttttttttaattttgaagaataaagcaattattcttgctttttgaaattgcacatcaagtctaggaacataaattattctttctttttgaaattgcataccaagtccagaaatatagactcttaaaattttaaatattaatgtcaagtgatggatgtaaacatctcccacttttaactctcattctctcagtgtgcccctctttctcggtagatcctcatttctactggatttccatcgcacaccaattatcccaggctacagctgtttactgtcagctgttctcttcactgcccaccacacagccagcctgctgctggtaactggactctcgctcccatctgtggaaatccctgcctccagtgtggttgctcaggctggggcttcacccctggctcaggcacagagtttgtgacctaaatcaat

SEQ ID NO: 31657 - DNA, 1284 bp, Bovine  19866881039964
gcttctgagggtccttctaccttgttagttgtggagtttgtgtttagtccctaaatgggactatcaggccagagagtcactgggcctgcataggtcaagcattcagacccagagtaggctacttccctttgccaaagcttccacttggcagaatcttcagtaacaaagatttgtgctgtttccagtgcccagagtctaatttgttggggtttaccagctagccctgctggtggaagtatttagtttagctagtactagtatgctgctgctgctgctcctaagtcacttcagtcgtgtccgactctgtgcgaccccatagacggcagcctaccaggctcccccgtccctgggattctccaggcaagaacactggaatgggttgccatttcctccattgcatgaaagtgaaaagtgaaagtgaagtcactcagtcatgtccaactcttcgagaccccatggactgcatgcagcctaccaggctcctccacccatgggattttccaggcaagagtactggagtggggtgccattgccttctccgagtagtagtatacctgtcctaatttatgtgttttgacaaatatactctggttatgtaaattgttaacttagtagaaattgggtgcaggctccatactatctttgcaactttcctataagtctaaaaggatttcaaataagaaggttactttaaaatgtatcagaggacactccataacttccagggtaaaggtcagctaaggatgctatttaagaccctttaaagctagtccttcctacctctttcttaacctctttcccacactcacgtggtgctttagctatcagtctactcaggggagtgtctggaacatgccttgactcctcatgctctgaccttgttttgtgaaatatccttatccctcctcttcacatggcaaaattcaagccaagcttcaaggctctgcctcagtcttacctttcctgttagctcatcactgatgcttctcagtcaggattagcacagctttttgtatatggtttctgttttaggatgcctcacaggttaacacttgtaagtgctgatagtcattttctagagtaagatttccttaaggatggaacaatactttattcatctttttatttccagtatttagcttgttgctcatttccagtgagtggaccacagcagttgttcaggtagatgttaattgggtaatgagtgaaaagcgtcaggaccatacttggtatggttatgaatagagctttcttctttgtgtcactccagtattaggactgtca

SEQ ID NO: 31658 - DNA, 990 bp, Bovine  19866881072399
tttaaaacttagccctttaaagtcctttatctcttactcattttcaggtcttataatcgttgaatctaggacaccatcagatttaagatacacagtaatttttacctgttgttaagaaaggagaaatgctgccacttgagacatacagttaactgaaagatgtattccagtttcaaagatataaaatttgtttagtaaaatatgtcaataccacatctattttcttatagcttccagtgccactaccctgaatcgggctctcattttcctcgtgggtgtcccactggtctgcccacctagtgtgtcctggtcacaagccagcagatgacctgccaccaggcttatgcaggatcactgagcacgcttgtcagtacagggtcctacttgcccatggaagaaagtcaggcttccttagatcagccctcaggccctccgtgtttatatttcctaactaactttttaggtgactcttcaattcccttattcaaacttgatgcatcagtaaagacactccagttgctgccctccagtctctggcctgggagtcgaatgttaggactctcctcctcccttgcctgcctctggacgtaagctgtttctggctccagtgctgccaccttcacagagcctaacccagccacaaatgatagcacccatctctgaatgtttatataatatagacagtgcttaaaaataggcagggtcaggggcataatggaggactggccttgaacagggagagagagagaaaacttaattttgagactagaggagagggagtggggaaaagtatgaatatatataagttcatagtggaagaaatacctgttgacttaattttcttctatgaagtgggaagcatatagtcttccagaacagtgaataaactttctgagcaccttattacatggcataacatagtggttaaagctcagactctggtgtcaaacagcctgagtccaaatcctggctttcgtacatttcagctgt

SEQ ID NO: 31659 - DNA, 827 bp, Bovine  19866881089495
ctttatttttcttatcttttgattcttcgccagtgtattagttccaattagatgaacttctctgtccaccaacaacagtcgaaggaagaaatgatgagaaggcccttcttgaacagctggtatccttcctcagtggaaaagatgaaactgagctagctgaactagacagagctttgggaattgacaagcttgttcaggtatgtactacagttggccttttttagatgatgcagccctgaaaagctagaagagtatttttaagcaagactttttcatatgactctcactgtatggtagctattttataatttacccttgtgaaagttatcaaaatatataataattaaataatgggcttttaaaacaaaaagcctgtcataataattacagagttatagccttttactatggaacataatcttagaagctttccctagaatagaatccagattttatattattcttattttaggacttaatttatccttcattcatgctagacttcagcctatatgttctataacattccaacttccaggttagtatttttgagactttggagttaaaaaatcaatttagtgcatcatgaccagcattttttttaatggatagaataatgtagaataaagactgtcagaatgcagaaaaagggaaagttgtgtttcatgaaactctgttttcagttacatacacaaacagtaggtcataatttaaattatatttctttcaataagtagtagtcaaaaagtttgaaagccgtagctgtatggcattctggtaggtcagctgtgaatttttttttttcaaacaagataaaagcatgaatt

SEQ ID NO: 31660 - DNA, 1558 bp, Bovine  19866881107366
ttgttttgtgccgggaattctgcccttagacaaaacccacagtcatgaatacataaataactgctttctgagccatctaacaaagactgggctctgctgcagagcagggaacagcagcctggggggaaaagtggcagagccagccatggcaagtgcttcacctcccagcggcactgcagaccccagctggggagcgtccaccttggaaaacagctcttgttagtaatggcctggtctgcgaggctgttcagcacatactctgctgacaagtatcagactacactgccagtatggtcagaagagccggtagtatctccgctttggggaatccatcactgaagactccaagagaaggactgctatcaaggctctgaggcagagtttcggaagtcatctgacctgccatctcttatgattatttcctgtgtggctgtgaaagttaaggggacgaagccttcactgtccgcacagagaaggatccagtgagagtctgcaaagtaaaataaacacacaggcaattctaaaataaacacacaagcaattctaaataaacatacaggcaattcaggatatcctgtcttactcaataaagaaaaatatcacaaatacaacctttttgagagaaagaatgtagtagttgataatcctgaacctgaccatcgcaagactttacagagatggaggggccgggtgaaacttagggtcaggttccatggcaggaatgggatattgacgacaggtgacaggtagagctaagggacacgtattaacgcctgggctaggcactaaagggtcagtgtcatgtatttgagcttgtgtgtgcatgtgtgcatgctgatgttaggggttgtgtatggcgtccctaccttttctaatgccatctaatagtttctccagaaactatgcgcagctggcaacagcaactctatggaggaaacctctatatttttgagatccataccagcctctagacacccaagaaggttgagctgactagtgccaggctagaagtgcccagataatcctaaatagtttgttctgcggtaacctaggaccactggtgtaacacatacctggactttctctggttcttttgagtctactgtgaccctgtaatttcacttctgaaaatctacactttccataaatgtataaaatacagaaaggtttttattagtgttattgatgataatgaaaaattggaaaccacttaaatgtcaaagaaaacaaggcaaactgaaatatggtattaagagtaaatactgctcatcacaaggaaaaattttttctatctatatgagatgatggctgttcactaacttacatgatgtatttaagtcaaattgctatgttgtacactttatagtgctgtatgtcaactgtaactcaataaaactggaaggaaaaaaaatatggtacatccaagatagaatgttaacccagtaaaaattacaattatcaagttgtatcataaatgcatgtatcaaaatagaaaaatgctgatgctataatgtttagcaggaaaaaaaaaaaggaatggaaaaaaaaaatttatgtt

SEQ ID NO: 31661 - DNA, 2876 bp, Bovine  19866881114738
tatatagaattcgtaaactggggacatgttaccaagtttggagggggaaaaaagcactttgtacctaaatcttttgggttttttttaacaaatgaaatttactttaaatttcaagtaatagcaaagaggaatcaattacttctatgactatcaaagagaaacctggttttgaagaactgaaaacgactagcttagataattaagctatgctggtaaatcaagcgttccagattaactgacacccttatgattatatctcaatctcaattctaatgaaccaactgtaacaaaaatatttacttaggaattccaaatttaaacaaataggtgttccttttgattttttatttggacaatccatttggagataggcctccaataaatatataaatgaaatacaaatatttaattgctaaaatggcttaaatttctgaaagattaaatagcagtcatgtattttgagtttaatggtttcatcacattataatttataattaagataggttaagtctattaagctgcaacttgaatttgctcattattttacattgctaagagaaaaaattaacttttccaatgtaaaaagaaagaaagtagaggggccagacttagcacacagaggggaaaaagaaacaattatacaattctgtaaagattaattaaatacatgcatctaatattggtgttaaggttttacaaatcatcttcagaataagccaaaaggatactaatatctgctcttacagcagaggttccaatgtagatttttgtgtgtgtgtgcatgctgctgttaggatttctcctgtctaaaatgggtccctggggaaccagcaagaagaaattcttttattattttctgatgcaataaagggagaggtttttccagtactgaatttaaggaaaatacgtaatgactctgctccagttgttatggcaatatccctatcaggaatataaaagtaaaatggctacaatttctggcatatttctttttgtgtttttagttaaacaatatttaattttcttaaggaagattttttcattagattatgaagtcataaattaaaacttttattataaattacagtttgtacaattcacaaaagaaaaacatttaaacacaattacatactccacttatagcaatagggattcttgcttctacaatgttttatttacaaattactgaggaattactgtgtttacttgaataacttgtatatttcccagcaaatatctggaacttaatttacagtcatccttacaagcctaatttatcttctagagtcttctgtttatcaaagattggtacacttactaaaaatgataaccagtagcagagttaaattagaatctagatttagcacttctctcctctttggttgtttctttagatttctaagaagatttcttggagctgcagataaataaatgggtgagggtagacttcatatgtaaattcctttatgcaagacagcaggaaattagtaaaaaaaatcagagctttattcccaggatttgcaactaacctgcttttgtgacatcaggtataagataacttcttaggaactcagtttctggagtctgtaaaataaggatatcggagcacatgatctccaagttcatttccaattaaaatagttaagtttacgtttatggaagtgtaggaaacagaattggagttaagttcatttgagactacagctatgtatgtaggaacagaagatggcaaagaaatgtcaaaaataaaatacaaagatcacatttaaagtttcctctcacaagttaggtttgggcttatgactaaaaatggccagaaagcccaccagttttatccaaatccccagcatcgtcccttcaagatgccgctattctaatgtccacaggagtgcagcctatgagtgtgttttctcccaatataacccttcctgtacctggtccaagaagaactgatccagctcatctagatcaggggttagcagatttttctataaaaggccagacagcaatacatcaggttttacaggctatccagtctctgtacaggatagcaagtactcaattctgccttcaacgtatagaagcaatcatagactacacaaaaatgaatgggcatggtggctatgttctaataaaactttactgaaaacagactgtaggcaggatctggctcacagactgtagtctgccaactcctgatctagatcacaccaagaaacaagatggtataaatcagctattctaaatttttcagagtcctttcacagcctagagtaagagacagcataatacagtagaaagtactatgcaggtacttcgtgtgtgtgtgtgtgtgtgtgtgtgcgcacacgtgtgtgcatgtgtgcacatgcacactcagttgtgttcgactctgcaatcccatggactatagcccgccaggcccctctgtccatgagattgccaggtaagaatactggaattggttgccatttccttagttcagtttctactccaggggatcttcccaattcagggactgaacccgtgtctcttgggtctcctgcattggcaggtggattctttactactgtaccacctgggaagctccagatgtgcatactagatgcttaataaatatagatttcctttctcttctgaataccaccatccctcaaaatttacttctagaaatcacttattctggccctctcacaagaggtggtccttggtcctgccaaatatgctcctggtaaaaagttggcttaaagctcaacattcagaaaacaaagatcatggcacccggtcccatcacttcatgggaaatagatggggaaacagtggaaacagtgtcagactttattttttgggggctccaaaatcactgcagatggtga

SEQ ID NO: 31662 - DNA, 1719 bp, Bovine  19866881123165
taggttttaatttttcttaatagcacattaacagaatttgcaattgtgtatttaatgtctctcttctctgttagatgttaagtttcataaaggcatctttattgtgatgtatccagttgtcttatacaatgcctgaaacatgatagacactgcatatttatgaattaattaacttgagaaggttgctaagaagtttgaaaagagaaacatttgatgaaaaccttttgactaatgaaagttaagaagaataagttgggcagctttatattaaagctataggtaccttcttagtctcaaatacttgtaaggaaccttatgcttttaatttgtttttcccaagtaaactgctctgctggaaagcaaattcactgacttcctggcaaggatattagttgagtttataagatactgttcattgtaaaggactaaatcagctttgggggaccactcttcataagataaactgatccattgaggtactcgatctgtggggctaagcgattaagcacctcaatagcagtcttgaggccgttgtccagccatcagtctatctatctcttgttactttacctagcttcatttaatgaaaatcaggaaaactgtttttctcctcaaattgctatcccctcctactttttttgtactgttttgaagcagtaaccatggttactagtaagctccttggagcttagaaaacattagtcagtttcacagctggaggtagagtgatctagataaaagcagaagaaaaaagctgactgggggtttttttccttctcttggaactgagttctttcaatggggagcacttcacataaagtgaaatgttctttattcccaccagtatgaccatgttttcatttaaattaacaggtaggctagcacctggctcctttttagagtcaggaaagggagataatgctaccactcacctgccctccacctgaatctcctccctctctaccctcttctctctcttctctatttctttacacctcccccgggccagtagtgagtgaagtaatactgacatttgaggcccagatggataaggttatgaagttgcagctttggattaacggggtgggtaaggggaggagtgaaggagcactaaaatcttggtataatggtaaagtgaaagtcgctcggttgtgtccgactcttcgccacctcatggactatacagtccatgggattctccgggccaggatactggagtgggtagcctttcccttctccacgggatcttcccaacccagagatcaaacccaggtctcctgcattgcaggcggattctttaccagctgacccacaaggaaagctcaagaatattgaagtgggtagcctatcccttctccagcggtatagtgttcagttcagttcagtccctcagtcgtgtcccactctttgcgaccccatgaatcgcagcatgccaggcctccctgtccatcaccaactcccggagttcactcaaactcatgtccatcgagttggtgatgccatccagccgtctcattctctgtcctccccttctcctcctgcccccaatccctcctagcatcagggtcttttccaatgagtcaactcttcgcatgaggtggtcaaagtattggagtttcagcttcagcatcagtccttccaatgaacccccaggactgatctcctttagaacggactggttggatctccttgcagtccaagggactctcaagaggtctt

SEQ ID NO: 31663 - DNA, 1764 bp, Bovine  19866881123352
tgaaaaaataagaattcccttgcctcattttttaaaacaagagatatatacaaatactatgctttcaaatgtgtatgaatgtcacagcttataaattatgttttagataataatggcaagttttaaaatgtagctaatgtaagacggtattgttaatgtattaaccaggatagactagttatgttgcagaattaaacaatcccaaactttcatatcatggtttcccagttggtaaagaatctgcctgcactgcaggagaccccggttcaattcctgggtcaggaagatccgctggagaagggataggctacccactccagtattctcgggcttcccttgtggctcagctggtaaagaatccacctgccatgtgggagacatgggttcgaaccctgggttgggaaggtcccctggggaagggaaaggctaccctctccaatattctggcctggagaattccatggaccatatagttcaagggatcacaaagaaccagacatgaccaagtgaatttcactttcaaacttccgttggtttagcccattacagtttatttttccctcacatgaagttagccataggtaccatggctcttctggacacctcccttccaagcatgcctgacatccaggctatctcccctatttttggttacaccatctcgacatctggcttcttctgctggggtggtaggaaaagagaggcatcaggaactaacaaacgctgtcttctctatgctttgtcccagaagtgacacacatcacttctcttcacatctcatttgtcacaactagtcacatagacccacttaactattaatacctgggagctgggaaatgcatgggagcacatagatactcagtgactaatacattataataaattacatcgctttagatgtgattgaacttaaaatgaactccttgaaatatttccaagtaagagttgttcccaaagcaataggaaaatcatggtgtaatttccaaagtttgaagaagcagatattctgctgtctgccccctgcagtggttaatttcttaaagaggttctgacagcttcaaaacataaaacacagcatggaattttgtttattcttggatagttgccttctatttaaaaggcagggattggattgaatgatcgctaatgtcacttaagaacccttgaaatgattgtttaaacaatcaaaacgaactattgtctatttcaacttggattcatttttatttcagaattctgatttttttttaaccaagatgaattatatactagaagtttcagtccctcagaaaaaaacatttgataagtgaactagagataaggtaaatcttatgcatctggtttgtgtcacacacgatttatatattaggaccttcacttttttaatgaaggccttttcttggcaacagaagttaaaaaacggaaaccccatttctcaggtgcaatggcagggggtaagatcagtctgggcttccaggtggctccatggtaaagaatctgctctgtgatgcagacaccttgagttcaattcctgggtaggaaagatcccctggaggaggaaatagcaacccactccagtattcttgcctggaaaattccatgaacagaggagccctggagggctacagtccagagtcaaaaaagagttgaacatgactgagcacgcacgctttagagatcagtttattcaaaaagttaacatgagcttacatcattaaaactttgctcttcatatataatttttgcgtgccctgagttttaaca

SEQ ID NO: 31664 - DNA, 1214 bp, Bovine  19866881136046
ttcttgaatgaaatcagatagggaaaatttcagtatatcctcagggtcacaggcaagatggcagagtagaaggacatgagctcatctcttcttaccgaaacaccagaatcacaactgctgaacacccattgacaaaaaaatactggaaccttctaataaaataccctacatccaaagacaaagaagaagccacaatgagatgataggagggacgcaagtgcaataaaatcaaatcccatacagggtgggtgggcgacccacaaactggaaagtatactggcagaagttctcccataggagtgaaagcgtgaagtctgcatgcaagtctcttagatagcctcatccaccaggctacaaccacaatcacagaaagacaaaatgagatggcagagaaatatgtcccagatgaaagaacaagacaaaacctcagaagaacaactaagtgaagacaggcaatctacctttaaaagaattcacagtaatgatagtaaagatgatccaagatgtccaaaatgaatggaagcatagatggagaaaacaacaagaaatgtttaacaaagacctagaagaactaaagaacaaacagatgaacaataactgaaataaaaaaatataccagaaggaatcaagtatatcacccaaacaagcaaacagtagcttcctattggcgaagggtctatcttcctacagttcttgactccagagcaaggatggttaccccatctcatctctctctgctgagtgggcataaggccaagataggggcagttatctttcttttatttcacaggctcaagatgccttatttagggagaagaaaatggcaatactagaaataaaaatgcttgtcccaccagtctgggccaagtagtacaaagtgatctgatccactgtatattttaaattaaaacactgttgctttcttgaacccagaataatgtggcctgtgtttctctatttaaaaggggaaagaaaatcacaaatctgcatgggaaaattcccaacaaaaggcttatgcctgactttacccctttttagtcataccaaccaaggttacataatcacaaacagaactttaccctacttcctaggattgttgttaagtattaaatgaaataaaattactctgtcaagtgcaaaatgccacataaatattagtcaggttattacatgaaggaaactggtatcattccaggtttgtgctggagatagca

SEQ ID NO: 31665 - DNA, 1287 bp, Bovine  19866881252583
tgggttcatccctggttggagaactaagatcccacaagccatttggcatggccaagaaaaaataaaaactaccagaatttaaaaggaagagggaattgtcattgaaaggagtacgcggtgcttagggatggacggcatgtagtttctggattcagctgatacgcaaacataacaaagcaatggataatgtcagtcatttgaacaatcggaacttcttcaaatactggctcacttcttccttggggtagggacggagcgcaatgcaagtgggtatattctctggctgctccatccacagcttgtggtcaatgttcttctgttgcagcgtctctgccagcaactttaaggtggtctcatccggggcctgaaaggagcagaacacaggctgaaaagcccacttaggaagtaacaaaaagcaaaagcaaaaaaaaaaaagtatgaagggggactcctcttaactgaaagtggagtaacagctctaccaaagaaggcgctgtagagaatgtctccagaagcaacagcttcatcgctccatttgccattcactctctgaaggggtgggagtgggggtaaaggtttaatattcctatgtataaaatggagctttatctctcccctcctgagatgctgaggggctctatcagtaattatgctctatgcattttctagttctggtgactaaacagccatcactaatcccacagccagctctgaccttaagagttgactactggaaggctttctaaaatcacatcacttccacctccctcctacttccaccccagtccacacaaaccaagaaggattttcttactgctgggatagttccgccttgttaactcaatggtgggcaaatgattctctcgtgtctttcagaaatcgtttctcatcatctttatcacccatgcgaatctcattacaggaaatagtaaagccatcactcagaaaataaagatcattagtgtgttatgttgcataaggtgtgtgtgtgtgtgtgtatatatatatatatatatacacacatatatattgcctagaaaagcagaagccactaagataaccagaggtttgtcttatcaaagtagaggatgctgggattgctactcttaatctattgagtcctttgggcatgctgaaggacttgcattgacttcccttccttcctttttcagcaccaggagcagcatagtaaagttagagtgagttcaaacccttgctgtaccactttctgggcttctctggtggctcagatggtaaagaacctacctgcaatgcaggagacctggg

SEQ ID NO: 31666 - DNA, 1650 bp, Bovine  19866881322584
tattagtctgtaggtattttgcagatatctcttctaggggaatgaagactggaactgaatggtgatgtatccaaagtggtttctccatgacaaggtccacaaagtaggaatccagcaggttcccctcgaaagcagtgctgatgcagacacagactcctcggctggtcagcttcccgctgatccctgggacaagacagtgccttaagggacatgaggcaaaggtttcatctgtgcatcccacgctcctcaactccacccagtacacacaccatgggctcaaatgctcactgaacgaatgtctagactctttcttctgactttgactcactgagtttgttttcttaaaaccacagaattgtggggggaaaaacattctaagtatcaaattattgaagaagagattttgaaattttcaatttacctatggctccttttttcctgagtgtcaagtaacttacagtagtactcaggtcttctcacaatcctcttatgatacagataataggtaagtaagtcctcattttaatggtcaaacagagacttgaggggttcaaactatttgaacagtggcatcaagcaaaccagctgtaaaggaagttctagcacacggtctagcacatgttgaatcactacaatgaatagtctaagccagtcaccaaccaatctgctgctgcacagggagccagttttgcaggtaaagctgcctatgaatagcatgccagttctgcatgtgtatgtcggggggggtggggggcaaaattcagtgttaatgaaataggtccaggactaataatacatcttgcaaactatctcactagacaggagactcagactgaaacaagtgagaaaaaattatacctgtaaaacgatatgcctgcagaatggctttcatgttttcctgttttctctccaaaatttcttgctcactaatctctaatatttggtcaggttctacattggcagtagatgctttaacctgcaagacatgtagcagatttatctgggtacagaggcataatagaagtcccatgccctcacctacatgggaaaaatgtaaatgcagagtattttttttattaggttatgaatcaagaaatgctactgtggccagccagctggtgctatgaattcacagcagaggaagaatcttgtgggttatatacagtaccaggaatcagaagtagaaactatgctggcctgaagaacaatgcatttggctgcagtatagtcttgtgagaggagaaagaaaaagaggtaaggaaagcctagggtaagcaaaaacagctgtaaagaggcaaagctggtaaagttgggtcagactgtgcaggcttttaagtgccaggatgagaaatactgattataagttgcacactgtgagctacaacccagtagatgctatcagactaactccttctgagacaactacccaagctgatgcaaataccaaaaagaaataagcaatcatgcaagtaaacaaacagaaaatggcccaaaggcatcagagaaccaccaaaatagccagactgaagactaaagatgaatgcggaagttagtttgggttttcctcctcatagtcctgttgatttttatcacatggcatacaggccaaatagaaagctgcaggctagattctgcagcagtctcgcagcg

SEQ ID NO: 31667 - DNA, 1465 bp, Bovine  19866881339010
ttcatatgttgaaacatataaacaaaattctgtgttatttttttttaaatcagccattgcctaaatgcactgtagtttgtgtttatgttaagtctcagtagcaaaatctttctgtagtggctcatcatgaaatctctatttgctctaagcacttgccagacgaaagctggggagtgagttagatagaagtataaagatagttgtacagaaaaggagaaaagaaagaaaaaggagagaaggactaggggaggattcaaggctctctgcattcagagagctgggatggagaaaatgagagaacaggaacacaggggaattgttaacacagagagagatgaaggccaaggttggagctctagagggaaaagagtaggaatgagaaattacagagaacaaaggtgggtggagggcacaggggcagctacagaacagactcagacagagagctggtgtatgttaggtacacacggaagagccccaaaaaagaagaaagccaaatgggagcctatgggaacaagaagcaaagtttgggaaatggggagagaggaggacaaggagagaaatgacactaatgtacatagagatttaattcatcagacacaaaaacactcggcccaggaaccatcagcgttatcccagagagtggagtagaggtgaaagtgaatcaagtgaatcgtgaggagaaaacatcaggcattggactgatgaagaaattggatagtcgcgagattggacagttggcctgttaaggttgatggaaagcagcttttattcaattaggatagaaaagttttcagaaatgctgagtatgattggcatgaatttagtggtgaaagacacccccaaaaaatctatcactaatctaaaatacttcctgaacctgttaaacacgcacaagtttgccaactgcggagacagacagatgcattgggtgccttaggaggcatctccactgttggtctggaacattcacaagtgtggtactggcctcatcagttctacaaatgactttctaataataaggctggttggtaaagactaactctggctttgttttcctgatagaaaatgttaaaactatgtaaccttagacttttcaaaggaatacgtgcattattactgaaagtattaagctcttatggaaaaactggaatgaactttttggccaacctgatagctaaagggaaaattcacactgttctcagctagtagtttagtgttattttcagctcatgcgtttggatggactgtctgtcaggaaaaataagttaagtataaaattgttctactaatattttgctgtaattctaaaggtaatatgtaaagaagctatgtaaaggtatattagatactacataaatcctctggacattaattttaataatactcatgtcctgttactgagttgtggtgggttttattttgctaatactgggttaaagcccttaattttctaacatcataa

SEQ ID NO: 31668 - DNA, 748 bp, Bovine  19866881388860
gatggtgtttataagctagctgaaggcgcccagctggccccagcgctcacagccactctctggtgcaggacgagaagtcagacaaggagcgctggcagcacctggcagatctggccgattttgcgctggccatgaaggacacgctcaccaacatcaacaaccaagtccttcaacaactttcatgctgcgcattggtaaggcctctcagcacgccctctcctgctgtgcgcctcctccccaagcaggggactctacacatcaggggaggggtcttggatagacctgatgcacttcgggtgggaagggtcacacttctcgagctgaagggaccttaagggtctttaggtcagtgatcaaaccgaaaatgtgatgctcagccattcctgtcccatgctgtttatgatgacctcccttctgaatctggctggggcttcagtttgtctccctttccttggaatcttctgtcacttcagtcctgcccactaggattaacatcacccatcatacacttctggggaggggagttctcaatcctgggcaaggtcacaggagacttgaagtaccaggtgggtggcaagagaaactggcaacttctgcactaaattatgtagcacagcagggtggctgacatctgctgagcacagtgaggatgagaagacttgatttctgtcctctgggaactcaagagtcaggcttgagatcaggttatataaccaggagctttgtggctggagtcaggcggaaattg

SEQ ID NO: 31669 - DNA, 739 bp, Bovine  19866881400891
tgaattagctatgtgatatgcattactgtttctatttttcagatggtaaaaactgaggttccaaaaggtaaagtgacttaaccaagttcatggtagatcaagataacccaggttgaactccaaagcctgtagttttcactaagggaacatttacaattggttactgtaaactcagtctgcaaaaggaggactaaacttctaaactttagaatctaattagcatcttaggataatgattttattccccttatatttttcatagtcaaactaaagatatgggcaacaaaaattagaattttagtagcaatatagtataataaatttatcaactacattaccttgtagcctcatcttctagtttctttttctgtattaactctgatctttttctttcaatttccctcagtttgtcacgtttgatcttataaagctgttcaatggctaactgctgtgtattgtaactttctctcagttcctaaggagaaaataaaaagttaatatggcatggatttaaatacttttgccttacataaaaatgtggcaactgtatttaaatataaaaatcataaagcaagttaaactaaagtaaaaaagattaaaagtcttaaaaaagatgattaaaaaaatcttaaatacattaagtactgaaggtatatagccactgaggacaaatttatgttaaaatcaactacttttatactaattcattcctaaggaacaaaaatcttttacaagccaa

SEQ ID NO: 31670 - DNA, 717 bp, Bovine  19866881499492
tgagacacactgtatgcaggtatcgtgcttgctctacatgttatattttataaggaaggttaagtggctgttatacgattgcacagcttgttggtattggggctgacatttgagtccaggtcttgagacctggaatctccaacatacctctacactggcttctctccaagcgtgttagccgcatgtggccacattgcacccctctgttcttgtctggactcctttctgtcgtcttcatgtgcagtagagacggctgtagtctccattgctttctgatgacccaggagccatgaagcagttacttaatgaaagtatcactttaagattttcatgctgtttctgatctcacctttgtacttagtaatgttgattctttggtgcttctggtctagcttatctttgaatggttggtttggagtcttagcaatacaattctgcctctcaagttttgttagtatttgaatagctagagcttagggtatttttttttcatttgaaataaattgcttggtcattctctgtgtttccacttgtattttgaatggttggtcttaatctgatagctttaatatattgcattgttagtttgcctatatggttaaaatatttacatgcttttattatcaagcacagattcaattgtttaacagaagatattctgttgtgagtgtgtttgtatatatacagataatcataccgtatttgaccaaatagttg

SEQ ID NO: 31671 - DNA, 1299 bp, Bovine  19866881771414
ttttggtgccttttagtagtttgaggaaattttcttctattgctactgtactgaaaggcttaatgaattttgaatgttttcagtttctttactgcatattttgatatttgataaacactattaactgtttcagttatgctaagtaccaatcatatcgaaatatgaacttctcttcccctggcaatgcttgcaatggaaagtagtagctgtatttcgtgactaaattcctcagcaaaaattttacaaaaatgttggcagactctgaggtagatggagtgtggtggaaaacagagtaacattctgctgaaattgcttgtaaaacaggcactgtccctgtgaaacatgatatgtacatggccccaccctttctaacttgagccaaaatacttccctccctcttgagattctcttattgttctgtgaggaatagtgacctcattactaattcagagcttaccgggcctgtctgctttctgcctttctttccaaaatttagctaccttatctatagctcatttagcaaactgtgaattaggtactagcttgtcagtgtaaggaaatatttaccaattgggaattgaatgcaaaacaaacaaacaaacaaaaaacccaccatactagagtgagtttcctgaggtaaatgtgaaccttaaagaatctacagatttatagcagtttatcttgggaaggagtacaataccttcaagtgtggactttacaagcactcatgtacatgaagaaataaaataacagtgctgaagtaaaagacactttactgacagctgagaatatcaatccaaaataagccatgaaagagaaacaaaatgaaggtatatttttacagttcttaggtaggttgaattattatttcaaaagcctccaagaatttctagcaagttttaagaccgttcattcttggtgactcacatgcaaaagaaatggctattcttgaataatacctgtttgaacttcttattcttttatgaaaaataagattatgcataaattttttttggctattgaaattattctgctagttgttactatcactgttgtagtgtgcagtcctaactggctgaagaattttattcaggcttccacatattattgagcagagttccctgcgcttatgcagctggacctttttggttatctgttctaaatatagtagggtgcacctgttcattcaaaacttctaatatcctttccccctatccttacccccagcaacaatagtttgttctctaaatctgtgagtttctgttttgcaaataaggtcatttgtatcatgtcttttca

SEQ ID NO: 31672 - DNA, 835 bp, Bovine  19866882054549
ctgtcaggcagggcaagaagccagcatacccagagaacaacttgagcaggcatcagcatagttcccgcttggggcggggactccccaaatcaaaagtatcctgttcctgttccttttccttctgaagccagagagcaagcctttgattcatgtggcgatgatatcatgtaacccgctgggtgtagctgggctctgggcgtgcatctgggaggcatctaatcccccgagcactccctgagcctgctgaaccccactggatacatttcatggtagagctgagatgatattttcccctttaagttcatacattcagctcagaagccattcagcttcccggaatttttgcaaagaataccctcggccatcattttcggccttcatagcctctgataaggaggaaagagcttgatattctggttctgtttctgtttgaagagcacatccccaaaggaattgtatgtgtcccagattcaacacagctgttaattagagctgagaacacttggttgacccctgtgcggctaattgctagaattgagaagtgtctctaagggcctcatatgataacaactgaaaattgtactgagcatcacctaatgcttctggaaccagttcaggacggaaagcaataggctccctgtggttcctggcgcgggagaagcagctatgtgctgaagcagcagtattaaggattctcttcagtgattaaaacacccacatttcactgtggatgtgtgactggaggcagtgtgctcggaagggcttatcagagaactcagaactgtgcagccgagcatctgtggcctacttcggaggacttccactactcctgtga

SEQ ID NO: 31673 - DNA, 695 bp, Bovine  19866882190247
cacctggttatttctgcctctttgcccagatcctttggcctcacacttcagagggactctctgtttggcatcccagctttgcccagggatgctatctttcccttggctccattagttacagtctgtgggccagtcttgcctcatctctgagcctagtcctggatcccagttctctaaaacagtatggttccctgggtacttgtttttgcaggaagagagctcaaacaatatcatgtctttgtcttttaacatatattttttccatgaaaagcatcctaggtttattctccttactttttcttattctatcttatttttctagccttgagctaatcgagtaagatttgtttattccatcgtcttccatcttctgagcctatcttcctgcttttcattcgtcccttatagactttttataatttttttttaaaccctagtattacctccttcttccaaaatgttctggttttcttgaaggtcttttatcatttcactcctgtatattgctctctcccacattattcctagctttgaattttaaaaaaaagtttaaacctcattgttattttttgacattggccaattctagctctttctcagaggtgtcttctcacaattcacaaatactgtttgggtgaggaccaggtatttttttttaaatttaattttattttattttttaactttacaatatt

SEQ ID NO: 31674 - DNA, 1625 bp, Bovine  19866880390606
aattgatgcttttgaactgtggtgttggagaagactcttaagagtcccttggactgcaaggagatccaaccagtccatcctaaaggaaatcagtcctgaatatttattggaaggactgatgctgaagcttaaacttcaatactttggctacctgatacaaagaactgactcatttgaaaagaccctgatgctgggaaagattgaaggcaggaggagagggggatgacagaggatgagatggttgcaggtcatcactgactcaatcgacatgagtttgagcaagctccaagagttggtaatggacagggaagcctggcgtgctgcagtccatggggttgcaaagagtcagacacaactgagcgactgaactgaatacaccaccttggatgaccagctgaatttctctttttttcttctgtaagtgatctaagtaggtcaaacctcttagtcactgaggtgtacagattttgtacagtggaaatggggaatggtcagagtggagattacagagaaaaatgatgttttcatgatatcagagaagtacaattttgataatgaaaatagaggggtcctcattttgatcccagagaaggcaatggcaccccactccagtactcctgcctgcagactcccatggacagaggagcctggtaggctgcagtccatgaggtcgctaagagtcggacacgactgagggacttcactttcattttcactttcatgcattggagaaggaaacagcaacccactccagtgttcttgcctggagaatcccagggacgggggagcctggtgggctgctgtctatggggtgctcacagagtcggacacgactgaagcgacttagcagcagcagcagcagttagaaaagaattgaatgacactttgttgtttctagtaaactctgattctggtatttaaaatatatacactcaaaaagtcaagaaataaactattgatgtcataacattattgtttctatttgttttgtaaatgaacttcttattaatgtgtctcacaaattcagttttaaaaaagtagggattctgtgggaaaagaggatggtagaattttagaatatgttaggatatgaatacaggcatttctttggttaaaaatttcatatacatgtatacacactaaactttagaaactcccactgactagaggaatgcagacagaaccagggcatgaagggggcggggacgggggctggtggagaagcattaggtcatctacttctccctgccacactgaaattatcccccatatggtggtttatgtttctgcggtttgctgaggacttgagctagttttaagtaattttcttcaaggtcctctaagccagtttaaaattattttgtgagcaattcattctatcacatgctttagcaaaatctaccacaatctaataagcatctggatatgttctttgagatgcagcccagagtctcctttcctcaaatttcaactttctacctcgttgcagcaaaatatatttacctccttgatgtttaaatgcttcccagacaccaagtgtttcgagccagtcttgctatacaatccacaagagactactctgagattcatggtctgtgtgtccaaccagaggtttcacaaaagga

SEQ ID NO: 31675 - DNA, 4216 bp, Bovine  19866880420890
accccaggaaatgagacgtcaacaggaaagtaatgtggttcacagctaagtataaccttcaacagaacaatgttgaaatttttctctgaagtcttgtgcatcaccttcgttaaaagcattttcaatatccaaagattctctccttcaggatctctgtgtcagtcaaactgcttctaaaatccaaacaaaggaaatcatgcagagcagttcataatgtgcttttcatgcatttctttgcaagagcacaaagtcgtttaacaaatgtaagctcaccgtttttcataatagtctttctgttcaattttaaaatatgttttctttccagaattacttcagggtgaaaggacaaagaattaacacatttaattttaataaaatctgaaaagtaacagaggtcagctcctgctaggaaatggaattttaacatctcctttctttcagggaaacccacattccctgaaggtggagaagtgaaggctccttttccactccatccaggataggctggtggtcagggaggaaagtctcccaccatgagggcaggacgtctgctttgatgatgacagaaaagcatgtctgtacttcagcaaacaccatacagaaacagagaaaacaatcagaatccaaaggccgagtatctcccacctcaactggctcccaggcttgttaacatccacccactaactttcatttacagaggacagagactagatttcagggaaatgactccttggtaaagacgtgtggttattcacagaaggacatgatgactgttccctgccagatacaactgtcctgggtttctagcttggggtaaaataggatgtctttaccttccaacattaagaaatgttaggctggaattacagaatgagtttaatgaacctagaataaaaataaatatataccatcttatgaacaattggtgaaatattctgtgaccctaatctgattactgaaatgtaggaaacacccagcaagcctaaagacaaatgaggaggctgagttgtgttcttaatggtttctcttttgaggtcaggcggagataattctgagcaggttgtcatcaagtatcctattattatgcatgtactgatctgtcccttgcaaggatttagggggatatggatgatgctaagatataaagcatcattcctgccattcaggagattttagaattacctgggagaagagatttttcacatgatgaaatagggctactgtcttcctgaacgtccaggctaccctctacagcaccactataaacatttgctatgacaactgtcatacttactcattactactcagctaatgatgtttcctgcaaaagccagacaacagagttactgatttcctagtccaggactcccagacttctattcttactccccaccctcaactcatcagtaagtctcaggtccctggagttgttgggtcaagtggggctgacaggtattttcagggagggatagggagttaaaagtctttgaatgaaaggcaggaagaaatataactgatcttgatgctttcatctctgccctttttctcctagaaattccagtaaatcacagtgatggagtatagtagcaaaaacaggccagaagatacagtacaaagaccctgatctgtaggttagtgtccctattaaactgagacacattacaagcctggggagggatatcagctacctgctctacttttcatattaagagaaatctacctaactggatgccaataagaatctaaatttattgaattctctaagaaaaatatcctccccttaatgtttctagaggtctcctatctcttaatgttgtaaagtgaagcaactcttaaaaaaaaaaaatccctcagattcagaaaaaggggaattctcatttgttttccagagctacaaactcactgttagtgaaatatttgcctctcattggggttgggatgcccagggttcccatatagtggctaccggacaaagctccctcctgggtgttgttttatacttctgtggcccagagtcaacagattggacaggttttcctttgagactcaaccaggctctaagagaagaaaaattttggatgcccacagaacattaattgtgcacgcctggcatccggcagttgccagccctgcatcagcccctccgtggctgtttgcatgcagcaggtggcagcaacgccccgcagaccaacgctgctagcctggtgatgggaattgcccccaccctgcttttcaatcccaggaatattttctaaaggccctttcagcataaggataggcattctctccacttaaaaataactcttcggtgaagtcatgtcaatctcttctattatcatccctgctcacaaatccccactgcagtgtttcttctgctttagattcgggtctgctgcatataccgagaaaacagaggcagccagttttacacacaaaaggaaatcttgaacttcttgaacttcagaggcaaattcaattattgacagacagaagtgggggcacccattatttctgctagaggcaagccataattgtgtgttttggacaaagtttttaaatgcttcgtctaaacactaaccctcaacgagataaggacattttcagaaataggaactgagcaaaagataatcttcctcttgtggttttcactgaggttaactcaaaatatgactgattagtcttagatttcaccctttaactacttacataaaaagaacaggaatgtgcagtgttctactgttgtacatgtttctttaccaaaatgcttagaacacagtctagttaatgcttcagttcatcaaaaaaacatatatttagtgccaactcttaagggattactactgaagaggcatagtcctaggtgattttaaaatacagatgataaaatgcagcccacgtctttaagacaactaatcattttgctggggagaaaacttccacactcaccaaagaagtcaagtaacataaagcacagaaatgaatgagtaggtggcacaggtctttagaaaagggagtgatctcttagagatcagtgggctaggaacatatcaagtgtgaatcttaacttggctttatattgtagaagtgaatctgggggaaagcatgaggtaagtcatcccagagagagaaaacaggaagagccaacacttgggagtattgaatttcaaggtcaatgcagtgagttagctgttatcatgaagcaaaggctttcttgggggtgttgaagcaaagtcatactaggatgagttttaagttctggagagctttgaattctaggttatagattttttccttcatgtcagagagagttactggattttcaacaaaagagtattgtacttaagagtaacattttagtaggataaatcaagtgaattagtaggtagacatgtgtagactgaaaaaagaaggcaaaaaaaaaaaaaaaaggcaggagatctcttaggaattttgtacttccttaggcacctcaggatgagcgctttcctcacagttgacttactaccgtgtgatgggggcgtggacattacaaagaaagaggaggtaaagcttggtatccaattgcacacggaataaaatctcctctgaattttcatgcacccgaatacaaggaaagaaaaaccagctacatttggattcctgctggaagaatgggtcctactcccttgccctccccaggagtaatcatcaagggatcactggacttccaactggaagtgaaccaattaggtacaggtagtggccctgcctccatgagaatgaaggtccttcttttggttttcactcaaattttttgaatcttgagaattatctaatagaggagaaagaatttcatgagacttttcacacaacaatctgttttatcaccatcatttctatcatgctcagtccatctgttgaggactagttttaatgcaatccgtttttctaatgacaactgctcattataagaaaacactttaaaaggataaaaataaatcaataaaaatcagttggcattctaagcacccaaagacagactgaagtacttatattttgtcttatattcttctagacaatcacataaatatgtatatatgaagaagatggatgctctctatgcactctaccacatgcactctaacctgtttacatcatactatattgcagacacagatatatggttatacaacaaaaataaacttattctttttaaaatagttgcataatatattat

SEQ ID NO: 31676 - DNA, 976 bp, Bovine  19866880443321
ttgttgctcccaacgcacagggaactacagacccagcagagaagagaaagccagtggctgggagggggattccattgctgactgtcctccttccctgctgagtgctcccaggtaaaatctgggagaggctgagttttctgggtgctgggctgcaggaatgcatttcccaccaagtgtttctctaaacatgctattaggctacagagttaccctctgactagtaacccttcagggatggttaggtgtttcaagaaattaataaagtcagaaagaaacaaataaatttgatcataagttctggggctaatcaacactccagctccaggaaactgatggcgatcagataggaaaatgctggggatgaaagcgctgagtggcttggcacatctggtttgagatgtgctgactgaagaagtgccaggactagaaatgtgagaagaaataccaggttctgggaaggggcactgctgtcagggtttggggtggttttcatggctttttttttactgttttcatcctttaaaaaaagctgaaataaagatgacttgaaataattttagtcatgtgtatatcctaactctgtcacatccttgatcatgttaacttctttttatttaaaagaatattcaatttactaggccaaaacttcatagtgtttttaatttaaacagaaaatcttgccaaagccagccctaagagaaatattttcattatctggctcttttatcaactccaaagcttgggtgtggtttcattccccagtgtgccttccctctgtgctgctgggaaaccaaacacgatagccacaaactggaaaaatactcctgatggattggcttccacctgcatctgatgtgagagacatggcatcaggagcgagttgcagaaatagggggactaaattaaaagttatgtttaataatgttatgtgagatataaggaaaaatacaaaggcttgttacaagaattcctaata

SEQ ID NO: 31677 - DNA, 5071 bp, Bovine  19866880454815
gactgatgcagagtaatctgtctccattccactcttcattttatagcaaaatgattcccagagtaatactctcttaaatactacaatgatttgttaaaaaaaaaaaaaaatgccaaggatttgtgcccagacacatgaaaataaagcaagggggaagaaaaaaaagctaaatactggttttaaaaggtacaatttacatgaattgtgcagaatttgcaggaaaatatcaaaacatgttctgcaaagtggttacacctgagttacatttttaatattaacagatctggatcatttggggagtaaatgttctgccacatttgcagtctgtgttttctgggtatatttttggcagtttgttttctcagcagtcttgacagtggtggctttgggagcacagcctcaaattgctaggaatggccataacgaaagaaccacatggctgcttttcccgtccaaacctgagcaccctctgttatttcttccatttatagtccctggtgctgcttccacaaaaccaaaggcttccagtggttaaaactttagctgctatttttcctgatacagcaattagattgaagctcccttagctttgtccacattcaaatgcccatttctgtacttgctctctgtcttcaggtgttcagaaggctcgtctgtcatctatctaccttccaactgatttggttcttggcaccactgatcttatgcagggcacaaggtaaagatactcaattcccctgcgtggaatccaggaaacacagtttctggagtggacatctgaccactcttgtctgtgctgtgttcatttgtctgcatgaattaattaaccgtgtaatttgtttggaagactgggagtggttctttctgctttccacagatatttggcaaaactaatacaatgatgtaaagtttaaaaaaaattaaattaaaaaaaactttaatattaagaaacttttcatagataaaaccagacataaaaaaaattgtttctgaattaagacatcattttttcacctatcaaagtgcataatgtttaaaataataattccatatgtgtgtgaagacatgggaatgcgtgttggagcaagaatgaatttggcctctagagcaagtaatctggcaataagccttaaaactggttgtatccctcttacagaaaaatagtgaaatatgaaagctatatacagttcacatatgttcacatagtctattatataaaacacacctgagctgtccacttgtctgctgaattgcctacttctgccagacctttctctttgactccatgggagaccacacctcacttactgctggccttttattaccttttgtgtggtatgtactatgggcttctgtgatagctcagttggtaaagaatccgcttgcaatgcaggagaccccagttcaactcctgggttgggaagatctgctgcagaagggataggctacccactccagtattcttggacttccctcatgactcagctggtaaagaatccgcccacaatgcgggagacctgggttcaatccctgggttgggaagatcctctggagaagggaaaggctacccactccagtattcaggcctggagaattccatgaactgtatagtccgtggggttgcaaagagttggatacgattgagtgactttcacaacaatgtggtgtgtactatagtcagcagtcttcacagggatacaaaaggcatgcttcacaccgtgtatagctcaggatttaccaactgggggatcttaaatggaatttcatataaaagcagcaaataattgtaaacttttcattaaattattttgtcgcatagtcaaagagaaataatctcgcatagtcatagattttttcaccctagaagttgaaactctagttttgatcccttttttactctctattctaaaagcagcaatttattcaaatctatgctctgcactcagcaaacctttaagaaaccccatcctaataacagctattcccctagaattttttgcaactatcaagagtgtacctcactaaaattggaattttgcagcacttggcggttccagtttgtatttgttgctatgcccgccttttcattcttgatgttgtagagcatatattctttttttctaattactctagtcattttatctgttattagtcttaaaaaaaacagattttggtgttttgattaagccagtattttgtgtactattttattaatttgtgcttttaactttattaattcactccttttatcaacttttggtgtgtgggaagtttgaatgcatgtaggtattcatttttcaatctttcctgtttcccaataaattaagttaggattaaatattcccacctgagaactgctttataagcctctacagattttaatatatgatattcttattgtcattcatagtgatttataatttttgttatgatttctggtgtaattaaggagacaaaagtatgtaaatttctaattttattgcattatggattgagttcaaagtcatttttttgtatactacttcaaatttaatttggggttatgtttcacatgtggtttgaaaagcatgtatgttttcttttgggtaaaggtttataaatacatgctcatatgcacatattacatgtacacgtatgaatatttgtttttaaagtcttctatgtccttgtatttgattttcttattttttaatagatggaaatgaaaattctgagagaacaatgaaaaattctcccattatgattatggatttatgcattttcctttgtagttctattagctttgtatatatttcagagttatgttgttaggcacatcaaggttcatgagggatataccttatttcagatttctccttttatcatttttaaaaatacatttttgtttcttagtgtttttgtcttccatttccccttctctttccttttaaaaatcttacttggactaatactgaaatatcagtctttcaatatttaatcttttctgtatttttaacccttccaattctggaagaattttatgatctggtcttcccacctactcatttagtcttcagtgatactcattctgctaaggcagccagattgtgaaaagagtttatatttctcattttatacatctctagtttctactatttacagtgctggttccttttcacacttaagatatcacatttgttcatgtaaaaatgtttatttattcatttgtagagtttattattcctctatcattgtgttagttgactcaagtgtttgtctatttgttactgtattgacatttcccattgagccatctgtcatatcaatatgagtagccagcattggagggggaagaaattattggcataccttatattcatgccatattcagtaaaaatgggggactgtgtagattgtaatttggttgtcaacgctctctggtactatcagcctcctggagcattgtcctgtacatctctctgtctatgttcctatatttaccactgcttcctgatggcagacgtcactactgctgccccttccttttcagatgtgtgtgtggaatgtatagggctgctgtaacttcttcacttaaactaatcactgcatattgtccattggccctttcttattcctagctattactgttccagacataaacccacttggtgatacttctatcctatctatcctatctggcattttccatcttcaacctcatttcacctaatttccagcctacagggattcttcatgtaagttctggtcactgggagtttgctttcttatttttctactctgctactcttaaagactgaacaaacatatttgaacttatagttctctggcaacaacaggaaggtaggtaaatgttgttttcttttttgtatttttctttctttataaatttgactttgaacatgcattttttaatcaaaaatgtatatttgtgtatgtactaaaatatataaatgttcttttatgattccatgatgaaagtggtgacccaggatgtaagagggctgctgaacacacctgcttctttaagatgctctctgaaaaatccccaggaagttttgattgtgacatggcaaaaaatcaaggctgtaagcccagaaaacatgatcacctacagcgagaaccacggggttgtagtccagcctgcctacaaggacaagataaacatcacccagctgggactcatgaactcaaccattaccttctggaataccaccttggaagatgaggcgtgttacaagtgcctctttaatacctttggttctggaaagatctcaggaatagcctgcctcactctctttggtgagagtctctgagaatacattgtctctagcttgaaatgttatcttgaagaatgtttgaaatgtagtggtagtagtaattagtctttcaggatcctagccccagaaaggttcattggaggacacttggcctttcatgtctactgtgtaactgtgctaatgattatttggagagttcatagaactatgttgaatctttgcctgaagttatctttgccttgaagaatactgttgtcaacaagagtaaactaaggaccatagtgaggataaattctccataagcagtgctatggttcagacctggcattgccattaggagtcatgtgaccctagaagagtcctgtccatggtgtaccagagtttatttatctgcaccaaaagtgtgaaatagatcatctctggttcctaagagctttcgtattttttaacctaagaacaaagccagattgggctaagctggagccagttatggggagtccctctcattttgcttcagcggagcttttgcaaaattgataaacagccatgcagcagaggttcttcatacccagtgcctggtagcgatttaactggtaaataagcattcttctaaaatctaagaggcttagtttgacaagattcctttcctgttaactgatgcttagctgggatcaagaactgagaattacgaataaggggtagctttggaggatgcacacttggtggtggttttagaagggaaagccaaacttagggttattgggaatgttaaaatgagagtttgaacacaccaa

SEQ ID NO: 31678 - DNA, 3502 bp, Bovine  19866880464760
ataatctctactggcttccccatcctccttttgacctagatgcttaaaggaacttaaagggaatacatctctctcttccacagggcaagccacatccaaacttacagggtttcacacacaatactgaggtcacttactcactaaacaaaagtcaagcccacagggatactgatgaatgctgcccttaggtcataaataacagtcctgttacattggctcttcactaacaatttccatctggtaacactcacggctgcatgtctgaccatgggtcagaggtgaaagggaggcagccgttcactgaaggcattgttttcattggtccataattaaagactcaagaaattgctcatcagcggccagagggctcctcaggctttttgtgaatctcttcctctggcaaatatgagactgggagttagtttgatggtatgctgaagcattccagacatgaatctgagcattgtctctgaggatctctgcacgtaggtccagcttaacaatgcaaagtaagctggcaaggcagagcaaactccaggaatacaggtggtttggagtgatgaaggtttgcaggaagacatttaaatccctggcagttttacagacctttattcagcaagagtcccttaacattgctgtggcagtgattcatgtatttgtggccagatcagagggtgtgggtgggggactgactgtctagctgatgggtagacatgccgctctccagatctcctctactgtccctgaattcttgtggctggtgagttccattgttttcattcatgcagtagctgttagtctaagagagggaagggtcctcttcaggtcatctttttagcaccagactctcaccaactgcctcttacactgtctttctctacaaatgcatcataagcttagtctgctgtttacagaaaataataacctgacttcaatgcagaaaaacatttgttacaaactacatatacacataggtaacttagctgttgaactcaggttaactcaacagggttggctttttaaaaaactgtttattttctattggagcatagttgattaacaacattgtgatagtttcaggtgtagagcaaaattattcagttatacatgtatctattctttttcaaattatttccccatttaggttgttacataatattgagcagagttccctgtgcctatagtaggtccttgttggttattcattttaaatatagtatggccagccccaactccctaactatcctttccccaaatttctcccctcaataagattttatgtttaaaatcttttagttctcctcaacaaatgtcatcactttgtaattctgccctgcagaaactctgttgtattcctgcaacccagtttccagtcacgattccctaaaactaaatgatataacttgcttgtacattagtcaggttagtaaaaatttatttaagtcctttctataacagaaaagtgtactcacttgctgctctctgctcttgttttttcctaattttcttttgggcactccccatcagatcagttatctctctttctgattctccttttctaatttaccttccaatcctcaccctttggggcttccctggtggctcagatggtaaagaatctgcctgcagggcaggagacccgggttcaatccctgggtcgggaagatcccctggagaagggaatggctacccactccagtattcttgcctggagaattccatggccagaggagcctagtgggatacagtctataggattgcacagagtaggacatgacagagagactaacacacaacacttcaccttttagcacatcccatcttcataaatttcatgaatgcttcctctatgaaactcaattcacatacctctcaatctggaacttagaaaatcaagcctaattcattacaaaaattaaaacctctacagacaaattggtagccacattgtaaaaaaaatgatattctggagaatagcagctacaacaaaacaaatatttcccattgctggtaaatgtaatggacctgtgacaatagctaaggatatagctattgagaatgggatcaatgataatcatgctggttaccatttgctgagctttcactgtgccaggcatagttttgagcactttacatcttatttaatctgacaacaactaaatgaagtcacaattatcatctacattttcagataagggaagtaagttttttatgtttcactgactgtaaagtggtagagtgattaaaacccttgactgcaagaatttagaacaaaacaaacaaaaaacaaaaacccctctgctcctagtgaaaatgcctgttttcgatcttgagttctatcaccagtaatatttgattcgctggtttagtagcaacaatctacaagaagtgaatgtggaaaaatagcaaatttttacaggtatcctttcactggcatgaggggttcagaccatgagaccagaagtatgaggaattgtgctttatcccaaactgaacacagctttcctccacttcaattcagttcagttcagttcagtccagtcgctcagtcttgtccgactctttgcgaccccatcaatcacagcatgccaggcctccctgtccatcaccaactcccggagttcacaaactgatgtccaccgagtcggtgatgccatccagccatctcatcctctgttgtccccttctcctgccccaaatccttcccagcatcagagtattttccagtgagtcaactcttctcatgaggtggccaaagtactggagtttcagcttcagtgtcagtccttccaatgaatacccagggctgatattttttaggatggactggttggatcatcttgcaggccacgggactctcaagagtcttctccaataccacagttcaaaaagcatcaattctttggcgctcagccttcttcacagtccaactctcacacccatacatgaccacaggaaaaaccatagccttgactagacagacctttgttgacaaagtaatgtctctgcttttgaatatgctgtctaggttggtcataactttctagatgactctaaatcatttatttactgaattacctgaaagtctctccaactgatccagatttagacagagcatttttgtttcttgtactttaagtccaagaggtttataataaaagaattatctgtagtaatgtgctatatagaacctttggcgtcgcctagtagggaaaccattttggaagcttctgtgtgtaaaatcatagaatggaaagtcttcccaggttcaggataaagtaaggtgaaccagcattctaaatcaaaaggcttggctttccctccatagttggccaaaagacatttgtggtgattcttctttgatttttacatgtcagaaacagagggatttaagataattcgttctgcttataaaaatttcatatgtctgacaccagtatatgtgtccaaagaatgaatgttgtttaagagtcaataaataaaggattgttcactgcctgac

SEQ ID NO: 31679 - DNA, 1056 bp, Bovine  19866880569118
atgttgtcccctaagatctgagcactggttactataagccttgtcctcctcgctgtgtctatctgattcccagtggccaagttccttagattccctcagtggtgtctgagatgagactttagggagttgtaggactcccaggacatgtcctacaacattggaagagcaatgcaaacttgggagactgcagagactgtagactcagagagggccagagattcagtgccagccaccggaaggagagatgtagccactccccttccccttctaatgtgggccttctaggttcctatgattcagggagatgcttcagtctcacctccatgtgctggagttttctcttgatatcttgtctgtggatagctgctagttggtcttcctgtgaggagggactgaagtcaggaataccttaaatactactttatagtatttaagaggtaaggtaatatgccctgctgattagaaatgaatcgtatttacagttagccccaattttgttacacggggtaaagtatgctccccaaaagtacctttgggaatatacactttcaaaattaatagcatagatattgtatcttgttcatttatatcacctttcttgggcacatgtatatttaaacccaagcctggtaccaccagataaactaaatggaaaaatttaagatgggaaatttataaagtactataattgcattctccccaacccagtattcccatctccaaattatagagagttccactggagtcctcactttagtttccctcatattcaatcatttgaataatctaacccttgggacttacctggtgatccgttggttaagactttgccttcttccactgcaggcgggtataggttcaatctctgatcaggctgctaagattccacattcctcagggccaaaaaaacaaaacataaaacagaaacaatattgtaaatttgataaaatggtccacatcaaaaaaaagaaaaaatccactccttaaatattttttcagcagtttttgagaaacaaggacttcagattacatcacaatttttcatctatttctttg

SEQ ID NO: 31680 - DNA, 1891 bp, Bovine  19866880628708
cctcctttctacagctccaaggtcaattttcccttgggagcagctaaggaactaaaggtcacaaaaagttggcaattcactgtgccttggaggacttcccagaaagcaaaatgaaaatgagattgttttcacataagatctctgtatttggaggataggattcaaactgtttgaatttgcagtttcactgtgcacttaggtaacccccacaaagtccagtgttgttttttttttccccctcaagccaaaacaatatcaaaaacacttcctgcagagaactctaactaggcagaattcttttctgtcattgctgggctgatgttttcaaggattcatttctcaagataagtcttatatggtacatttggatggagcccttgatgatttctgtataatgatggctgtcatccacagggcctgttttgtggtgatctcattagatttcatgagggaagcagctgaaaacccatggttagtacatgagcaggtagcaagaacagagaaaagccagaggctgccaagagatgttacagaaagcaggtttctttctgaccaaaggaaaacccatctctcaattccaaggagatgtaccctgcagttcaaacatatgtttttcacaaaatgtagctctgcttccttaataagaattccaaatacaggcaagaaccaatggctagactttcccaaatctgactgttctctaccaaaattcatctcttctttatcctctttgcataatggaagtattcttgagaagagataatattatagaacgtagttgtattggtaacttgaaagcccaacataggctttccggtcctgacagcaccaggtcatgctctgtgccttggtgccaatttctaaagtccttgctggtgtgtgcgtgctaagttgcttcagtcatgtctgactctttgcgaccccatgaacaatagcccgccaggctcctctgtccaatggaattctcccaggaaagaatactggaatggactgccaaggccctcctctcttgctggtgactcagtttcaattctttaccatctacatcctccctttgaagacccacaaacatttattaacagttcttcatcacttgtgtaaatgtcacccactctttcccagaaacacgttagagactatttttgaaacaagagtaagtcatcttgaaggttttaaaccttctacaggtcttaaatcaaaccacagcctccttagagtctcctgtttgggtctgtttgtgtggatatatatacttttaattaagtgtacagtcctctaaagattatgtgtgctcaataaatattcactggggatggtaaattagtaactgactgtaaatttagtagaaaaagtgatttattaaaaaaaaaaaaacactttggcatttccagagatgaccaaaaagtaaactagaagtattaattgtcttgcaggggtgggggagctggggaatggtgtcttgagggttactctctctcctgccatctgggaacagaatgtctgaacagattaaagatcctggttgtattcaattttgctgttattatttgctaatcatacgaccttgagcaagtcacttcagctctctcggcctcaatttctctttttcaaaagtagtttttatcattctgaatgtctcctctagttctaatattctgtcttctaagaaaaactggagaaattaagctggggatgctcttttaaaaatggacacagctggggaaaggaaggatgggacaaactgagacagtagcgctgacaatatccactaccatgtgtgaaacacatagctagtggataggtgctgtatagcacagggagctcagccccgtgctctgtgatgacctagaggaatggaatggggagggagtggggaaaggaagctcaagag

SEQ ID NO: 31681 - DNA, 1353 bp, Bovine  19866880687802
agtttcctgtgctgtacagtgagaccttgttggttatttactttaattatagaagtgtgtgccttcaagttagtttttaaaaggccaaatttggtcagtgcagttagagctcaccttgatgtgggatgtgcaaaactttatatggtgatggctgcaggtccctgacaggacaacacccacccagctttcagcttcatacatctgctgcctcaacccaggaaccaagatcaatgttccacatgatcacggaaacaaaaagatttgctaaaagctagtcacatctgtagatctgtcatcagtaaggttgtacaggctgcatggtgaatgcaggtctcatttctgattctctgatatgtcaaagaacaggaagatgacttaagaaaacgtctgactccagatagaccagagttctctactctttacataatcccttccaccaagaactgtgacgaaaactgggtcttctgttaatggaaaaacaaagctcacttttcataaggtcttgttttttgtttccaggcaagttgccatttagttaacatttacagaaagctttaattacacaataggttgcagcactattgctaacagtaaatttaatttccatgacctcaaattagcttaactgttgatttcaccgtcattgaaattgacataatcctgttgactgaggatctttcactgctatggtaactgtaaagcacacagattaaaatgcaaattactgagttattggcagaaatgagcacatcattcctgcaagttgttttataaacctagttcccctgaacattttgaaggctaaatttctccatttaaacagcccagcttcttagatgatgtagattcaaggccatgatctttcagggcttagtaataccttcatactgtgcacatggtgaagaagctaaaggccactacatgccctgtatgcatgccaagacacttcagttatgtccaactctttgcaaccccatgggctgtagccccccaggctttctgcacctaagcaatgtttaagaaccactttggtaggtgccaattttagatagtttctttacccatttcagctctacaaaataatctaatggtttgcttggatccagagtatagtcaagtccttttttttttttttaaaaaaagggcaaccttttcagaaattccctagtattcccttcatgcttccagtgctgaggtcacgggttcaatccctggtcaggaaactaagacctcatttgacaaaaggttaaaaaaaaaaaaaagaacaaactttctcctctctcaagttatagatctgcttaaaatgctatgattctttctaattacaagcagcagtgattaggcagaataaat

SEQ ID NO: 31682 - DNA, 828 bp, Bovine  19866880703893
aaaaatggacatactgtgctgtctattccatcatccagatgcatttggtcaggggtaaggcttctggttgtcctttcttgtcacactggctgctttagggaggaaaggggcctctggtcattgaaaatgccttgtgactactgctggaattgatcaccaaaggcagattgttactaaagttttcagttatgtatttaagtggcagctctcagagagatgtaaggatctagaaatgattacaaatgagcactaaaaacaagaaaggaatgggtggtttgtgccactgctctgagacattttcacccatttccttcctaagagggtctctggagtaactggaaaactatgcttcttgaaaatgaaatgctctccaagtggttgtcagaacaacgctggaacatttaaaaaaaaagaaaaaatcacaatgccatcaaggctcagagtttcttgttcaactttttctctctctcaaatactttctcttttggatttaacaagcattcctcctccaaatactcagatctttgggagttgaacatatgctgaattttaatgaggcatgtataggtatggacctggaagaaaaagtagactccttgtgacagcagggaccagcgcctaaagggcctgtttaaaatagcaggaagaaagattcattctgcattccataatatgagggtattactgtgagcctgagtgtcttaagaattaactgtgcttttcagatatagctacaaagattttaaaggaggatttctaaatcaaaggagacattggaatataatgctttagataggataaagaggtgtattatcaggcaaagctgag

SEQ ID NO: 31683 - DNA, 938 bp, Bovine  19866880706428
attaggcctgtaattatgggtttagttctgtgtgctgagtggtcctgccagggtagttatacgcctcaaatctgggaggttctggcaatataggagaattctttagtgtgcctttcctggaagagctctgaacctcactgcgttaagttcttatcgtttcaacaagtagccaatgggtgtacctcaaggccaagtacatagtagtatatttagaaatgattcagaagtgatgactttttaagaggtctgctctctgcaggtgttgcagtaaaggggcatagcatccttttcatgatcacttttcatctagtcattcttgttacttatttttcaggtgatgggacagaagatgaatgtgtgtttttgtttataatttcgactggaaatatttattggcatttgattcatatgatttcttgtcttttgaaagtgagtaaaaccaaaaaggttttactcaggttttcacaccccttcaaaataagtaaggcagaacttgtctctgccacccaggaataagaattcttctggaagttaatttgcacagttattttcatgatatttaggaatgtttctttgatgttgatgagaagctttgtgctgtatctgctttaaaggcaaggttgttatttatagcagctaatggtccacaggacaaacccaagtataaaaatcattttgttgagattcagtggaaaggctagggactggagacgctttccatacaaagaaacagataaataagacatagagcaacaggctaagttatagggagacttgttgagaggttttttttttaacaaaagatatttgttttgcttagtgtgagtgggttgatttattagaatatctttttccttactttgcaaattaaggggaaggaaaagttagttcattccaatatttaatattggtacctcaagtggggtcagctttttcta

SEQ ID NO: 31684 - DNA, 2477 bp, Bovine  19866880713272
aatggagagcagaaaagccctgatccatcctcctgatcttgaggcaataaggatataggaaaataaacaaccactatctgagaatgatgcagggaagatgggccctaatgggaaggcctggcttcaattaagaaagcaggaggagagagttatcattaaagaggacaactgatattgacaagagcttgaaatgcagcaaaactttaaaggcaaaatacaacatttgaaatattcccatgtattttaaaaatgtgctgttgataataaggagaatgttcatacctcatgacctattaattatacttctgagaatgtatcttaagtagctaaatggtcagaagaaagctattagtttaaggatgaaccttgctataaagattgtaatagtttaaataagttaaaaactgaaaaagcatatgattcaatacttgaaaattgctaaacaaattatgatgtatatatgtaatgtaatagaaatttcaaccacaggtagcttaagaatcatgcaaaatcttttaagtaaagctataggtaacacttgatggtaaataaaattgcaaagtatgaaaaaaatagctgcacacaaacaagatttgcataaatacaggaaaaaagaataagattttcaggatattaagatgatagaattgttgtcatttataagttattttctgatattatagtttactcacaaatgtatatatatgtatatataactttccccaaaagagagactataaaactatttatctcatatcactttaaaaatgaaaataattcattagacatgcttccttggagtttcctgatgtgtttttctgtgtgatttcttctttggagaaatatctgtaagctctaaaaagacaatcaggtataaaagcagtgaaaagatcagcatatgtcagaagtttggtgaaaggaagggatgaaaaggcagagcacaaagaatttttaggtcagtgaaactattctatatgatattacaagagtggatatatatcagactttggtcaaaattcatggaatgtacaacaccaaaagtgagccttatgtaaataaaatatggactttgggtgatgatgtgtttgatgtagtttcattgattgtaatgaaggcatcactgtggttagcgatgttaacgggggagattgtgcatgcatgagggcagggtatatatggaaactgtactttccactcaattttgctatgtacctaaaacttctctaaaaaaaattgtctactaaaaattttaaaagacaactgaggccagattataatgttttatattctacctgatccaggaaatatgatctaaagactaatgcaccaacttgaagttaaagcagaagaatgtactgaactgtgagttggattctgttaagggagtttccccatagttattcagtgatagacaaccctgtgcttctcagtgaccctgttacaccatttatacaatgaggactgtaggcggtggggtcctcttcataggtataccctgaagatagttgaatctctatactaaaactattctcgtttcttggattaaaaatactttatagaccaatcacagatccatgtctttccctccttatgttttgttacagttgcacaagaagaatggaaaaacaaccatacaatagaaatagagataaatgggactctggaaataccatgctttcaaaacacttccttagagatttcatctgtgctcacctttgcatggctggtggtaagtgttgcccttttcagtgaataatggccatgatctttaaatattaatgaagtgaagatgaataacaagtaataatagggaaggaagcacactggataagagacaagcattatgtgaaggttgagttaatgtctggaggaaggacgggagggcactatgggattccttccaactcggcaagcccccaggtctttgaatgcagtgacttagaaaagagttcctaaaggttagtttatatttcaagctgtatactcaacaatgataacagaaagaaaaaagtgtgatggtgccctggagaggagccacatccagcagaagcccctactcatccttatttgtttacacatagcacatgcaggggcatagactcccttttttcccagaaccctactaccacatcctggaaaataaacaacatttcttggacaggaaacacaaactcttaacgcacatcaaacacaaatagaaaacgcccatgagagaagcagtatgtctatacaaaacaccactgcccggctccatcacggccacaggtaacgacaggcctatggcagctatgtttcctgacttacaagaataaaacaaaacagacatatagatttttatgtgaaattttccaaggcaagtcaaccaaatggcatccagctattaaccaatatatagagtggactcctaatactactgttaaatcagttgataacacaagccttacataattatattaccataaacacaattttagaat

SEQ ID NO: 31685 - DNA, 1572 bp, Bovine  19866880715723
agcagcacaacagggggcaaaagacaggatctgttagctatttaacaatctagataagcaaatatcttacaggtggatctatgaagtagacaggacaatcatatctgggaggaaaatcccttttatttcattcctttttattttagcaatgtcagaagggaatttggaggtcacttaatcaattttttgaaatttaataaggaaatgtcttttattgaactcctgtccagggagaatcatctggaagtaccttgaacaaatatggctatcatttactgagggtgtactatagtttagtcattttacatatattgccacaaatcctcataaatacaaccttgagattttattctttttttatggatgaagggacagaggctcaaaggggtaatggtcaggcaatgaataggtgtctagtcaggattttagggcttcctaggcactagtggtaaagaactcgcctgccaatgtaggagatataagagatgcaggttccatccctggatcgggaagatcccctggaggagggcatggcaattgttccagtattcttgcctggagaatcccatggacacagaagcctcgcggactacagtacatagggtcgtggagagttgaacacgactgaagtgagttagtacacggcacacaagccattaagttggtggtaatttgttataatagcaatatgaaatgaatacagattctctcagaaatgctcttcacgatgctcactcgctcacttagcatcccattccacatacgaatgctttttatcaccatgatctacctgcttgaaatggcagctcatgagttctagttctttcctgcacattaggcactcaggggggccagttgaaaaatgatggaaaagggctcagagactagattctgctgccaactctgcccttaggccaggtggctctctctatggttttgttttctctcctgtaacattagcactgggacaaatgctctttggtcctttccacatctaaagtcataagattctaaaatctcagtcataaatatcatcgtcacatttctctcaatcttttctgatgtgtggcaagttatttctacacccactggctgctggtgggggatacttttgtaaaaggcaatctaatatcacatttcacagagaccatgaaatgaaactctctgggccctgattgagaaaacacccactggggatcagggaggaaagtctttaggccaaaaaagcagagatattctcaggttaaacaaagaagcactttcagtggcctccctgttcaccaagagctcggcttttcagggcctttctccacaggataaatcttgttcttgagaccccttagattaaagccatgtgctggcccaaggcttctctggatgggatgatgctactggatagaggctgacacttctgggtcctccttctccatccatcctatccccaaacactgcccagctgtgcaaacatcctggactgagtagcactttggtttactggcgctcatccaggccatctatcctgggtgaggtttgaggcacatgggttttggccatgatccctccattgcaacc

SEQ ID NO: 31686 - DNA, 2308 bp, Bovine  19866880719512
attttgaaagaagagaggaagtaatagcagcagctgcaataagcactgcagtcaaaagaactcgagcttagaactcctgtgagactggccttagcctgagccatcttgaagtgggaacgcagaacaaaataaaccattggtaaaaataatctagagtctaggggagaaaagaccaaagggaaccacaaatgacaaaaagggaaaataaagtttcctagatattggtaatattttgaaatccttgacaaggtgaccagctaagccaagaagtggtcttaggcaagcttggaaaaaaggaaggttttgaaggaaactactttgaggaggtaatagccagagcagataaggagctgctgacctagtgattatggtaaaaatattagtcataaatttagtgatcataaacttagattcatgagaaatcatgaattagtttgaaaaacactttaatattgaaaaacattacaaccatttttagaatggttaaaaaaattcctatatttgaggaatatataaaattgatctttgttaaccacttgaaattattttaaaatggggtgaaaaaggtaagttgatatggttttagagtataataatgtataaatagtcctttaaaaagtgattaaagacttagaaaaatgtgaagtgtaaaactaaattggaaagaaatgaagtttaattaacctttagtaatattactggaatggggaccagcccaatatatggtataaataattgcctcttatattcccagggggcttccctggtggctcagtggtaaagaactcacctgccaatgcaggagacataagagacataggttcgatccctgggtcgggaagatcccctggtaggagggcatggcaacccactccagttttcttggctggagaatctcatggacagagaggtctggcgggctacagcctgtggggtcacaaaccgtcagacgtgactgaagcaacttagcacgcacacacacgagcctttctttgtgaggatgaaatgctctcatttctaagtgaagtaggtgggtgagatcatctcagagccaaggggaggaaattggactagaagtttgaacagagggaaggtatgaaatagccatgccataaaacagtagagtaactttatttgagaaacagtgatgctgccaagaggtattcagtctctatgtgagtttggttgtcaagaatatgcagtaacatcatctaggccagtctgctttcacttccctcgttctcctctggaatctctcacccaaagccagtttctgtcatttttcataccatgtgatgacagacaataatcccaccttccgagaccaactaatcccctaacagctgtgtgagctggttctatacttcaagcccccactgtcccctctcttcaaaataataataggaaggatacaataaagaacaatatgtaagtagcctcctctttgtttgtttccacccatgttactagagttccatctccaccttagtctggagaatatcacacaactggccctgaaaagtgagatttagcactcactcaacttacttcacttttgtgtatggaatttataggctgtgtcatatgtgggttacacaaagacaaacaactacacggacggggaaggcagacaggttcacagagaatctgataccccattcctatgccccacaagctttccagtttgacataaacagtaaaatactagtaagcaccaaaacaaagacacctgatgcctccaacaaaagttccttgctgtatcagtgcagaatctttggaaaccataatattcctgtgcagcagaactagatgatcaatgatttcatatggttttgagcttttaaagaaaaatatgtccactactcaaatggattctttactgtttcaaagtctggagcccaaaggcacatacataaactttaccatgaaaaagatgtgcagttgaatcttgacaagcaggcaaccaagaaattgatatgtagcttttaatctgattttaatttctgacaatatctttttgagctcaccctctggcaccaagatcaaatgccattatttataggtttcaaacaaagagaagcctaaaaaggaagccacatgcagcagaaatcctctccacatattaccagtgcaatttactcaaactgaaattatttttctttttctcagtttagaggagaactcgatgatcaagaaagaatgtaagctcatttgtttttgttttcaaattgtaattttaatttttaatttaggctgaatttagctgtagctgacttagaatttaggatgacagtaaatgaagtatttt

SEQ ID NO: 31687 - DNA, 3524 bp, Bovine  19866880852601
acagctgctgggcagtaaagccaaagcaggttagggaagcggtgagtaatgcagcttgcctgaacccacagtacatggcaggaggcttgggagataagatctggggatctggggggaggtttgaggagagggaagagatgggaccttgaattttagattttatgtctaataccattttaattatgtcatttcctctctcctaaacttatactggctccttcttgcctgataaatacaggaagagccagcagcagtagtaagtgattatatagcagtaggatgaaagagaaagacaagttccagccacagaatttaaagaccaataaagtggtccaggttctgtgtcctaacatgtcaaacaaggttatcaatccaagaaaagttcgctcaactgaatatttactaagggcctagttaagatcctgagtctccttgccttctcctgactgccatcattttttaaatcttaggatgactccatagttacagattctgagttctcacagaagtacatgtgaaacaggtaacgtttggctattgtgttcagggattgaactggaaactcagtggcttaatattccaatgaaccagttgtgtcaccaggagcctaggactacttgcttgaccttttaagatgtttcacattatgggggtaattcctcccaggacagttgttaagagagcttgtaaaacattattacataccactcatctctgactagatatttagaatgagtactcaaaaaattctaaatggttgtttgaagcgtttatctctgagatatagatagtgatgcatatgactggtacagttcttttagattcatttgaatgtcttgctcttcataagaaccaggcagttctctgagttacaaatatgcctaaacaagatgatcaaaattcacttacgggttcctgaagatgggaacaaaatgaaattctattcagaacgtccttctcttatcattcaagaggtggatctccatggtataagcattgtatttataagattgacataagaatctccagaactttaacatagggagtagagacaccactacaccttcaatgttaatattaaaagtttgctttataaaaggtttatcaacccaagaactcacaagagaaaagttacaggtactgaaatggattggctagtcaagaaggcagatctggatgtgactaagagtgtgtttcctccctttctcccacacctgcttgcagaactttctgtggctctctctctgcttcctctccaagaagccctggtgaagtctgaggaccccaacaactgagtgctagtggagggcaatcacctacatgatcttcattcttctagtctgttgaatattgatagacattgttgtcaagacaagccctgatgtggtttaatgatttcctgtctcacaagctagttttggccctcatcctgcctggctcctgagttaatcaaagtgacaatccaggtgggaaattctttacaaattttgaaggttctgtgtgggtggagggcaacattacttctaatgaataattcacgggtaattagtgcccaaaagaaagttttttctcctgttggttattagcatccatgttaaattccctgtgacttgtaaatagttgaatgctttgatcctactggaaatattggtcccttgttttccatttgaactgtccccaccttcagtacaaggaaggtggggatgatgtatagggtagctgctgagggattctcatttttcgaagcttgcccttatgacgggtgtgatggcgaggaggacaggagtaggcagacattggaatgataagcttctaaaccaagcctctactctcaatggcactaatcagaatttgtacttactttttgtgtctttcccccctccccattccctcacctcccccaccgctataattctaaactttgtgaagtcagggaccttctacattgttcatcattatacacccaatgcctcccccatacaccataaattatttgtttaataattacataaattggtcttgaatactgaaaatctaatttcatcacttcagtgattaagaattcttcacggactcctccaagatgtgcagataaaataaatccagaatcactgcttttgcacttaaaaaaagtaagtcatctggttactttaggttattttcctatgtagtatctcactgtttcctctgccctctctctgaaaggaggggatgttttaatcataataaatgacttacatttaatcacatgtcatatttgttcacctctttcctcataaccagcaaaaatcagtgcaggaatcacgagttccagaaagcttttcccaactccatccctggtcgtggttggaggttggggtacttcatgttattggattacaggttttctgtttcattgtctatctctattcaagtcataaaactccctcaagtaagaggactgtgatggataattttatatagccaggctatggtgcccaatgtttggtcaaacatcagattagatgtcactgtgaaggtgtttttaggtatgattggcatttaaatcagcagacttagagtaaagcaaattacccttcaaaacatgactgggcctcctccaatagttgagaccttcagttcagtcactcagtcgtgtccgactccttgcgaccccatggacttcagtatgccaggcttccctgtccatcaccaactcccggagcctgctcaaattcatgtccatcgtgtcagtgataccttgagaccttaagagcatctagacagagggttcccaaagagaattctcaaaaaggaggaattctcaagaccataacatagaaacactatgtcagtttccagcctgtccaccagaacccagactcaagactacaacatcagctcttgtctgaatttccagtcctcaggcctaccctgaggatttcagccctgccagcccccgtcatgtgagacaagtcttaaaaatctccctctttttctctctgcttctcctctctctctccccgctctctctatgtctgtttttctatacacatacacatcttctgttggttctgtttctctggagaaccttcactattccagaagctttctagtttaactcttgtttttagaacacagcacaataaataaatgaaaaattaaatctagcttgaaatccccctcccttaacagaggagaactttgcagtgcagagatgtccatttagtcctgttgaggccaactaaacaggtccctagcacatccctgagcaacccctcccctgtcccctggtaacttggtcatctgacacataataaaaaaataatgaggaaaatacacattttatgaacctacttattttgttgaatgccaggaaatgcattacagagattccaaccagcaccacgtgccctgtgagtcagagtagctgagttggagcctcatcgcccctcaaaaggggacatcaggatcagcctctcttctggaatacttaaaacttcatgcctttctctctacatcccatctcacccctttttgtttgt

SEQ ID NO: 31688 - DNA, 1391 bp, Bovine  19866880865238
ttttattacagcttattttttatttctggtatgctggtaacttgaagttaatcatccagactggaaaatgagcgagtggttctaaaaacagaggggctatgttgcacacgggaggggataaagctcaaagtctcctcatggacatcgattcagaaaggaatggacactgctgatgtaatttttcacacatgatgggattcgagcaaatccttcatcctaaaaaggacagaaaccagaagggaatgactggggagagtgagtcactagcagctgttaagaatcagagacctctagtcctgatttaactctctcctttatctgccctggaggccagtggctctcagactttagctgcatcagaatcagcttgtggggttgttaaaacatgcattgctgagccccaccctgagggtttccaattcagcacatctgggcaggggcagacaatttacatttcctgccagtttcctggtgatgccgatgctgctggttagggatactgaacagccataagaagcactgctggaggcaatacccatttcagaattgagctcaagggaccaaaaccagtttatattcctggaaaaccaatccaacatttctttaaaatagggcttccatgttaacctgaaaggggcactgataaaaaataggatgtggggtgggggggcgctggtcaacataacacactgtcaattaagtgatgtcccctattgctcccacaagatttagcttgggaccagagcagtgtgggccaaggttggcctttccatgggaaggcaggataggtgtcaattcatagatgccagactaacatttgagactcaagctcaccacttaaagctatgagcttgttcaagtcaatctagcttttctaaactgtagtttcctcaggtacaaatttataaaaaataatatcactgatctcatcaagttgagagaattaaatgagataatgtttagaaagctttaacacagtggttcatgcattataagtaagtattgcttaataatactataactagcctatcataccactattcataccatttttactgctcccaacaaattttgaggtgtttgtctcgttttcaaatattggaaaccaagtcactgagaaattaactctcttgtattttagggagctctgtgaagtcaagctctgtgatgcagctggtatcatcatcactctaatcccagacttctgagtgagatccgatccagaccctctggacagccctcccccagaatctggacacactccttgggattaaaggaggaggcattatttcttcaggccctcctggagtctctctctgccttttttggcccacataccactgtatgtagtttgtgtctaaaggaaaatttctgtaacacaatacccagct

SEQ ID NO: 31689 - DNA, 2187 bp, Bovine  19866880873371
ccagccataggcaaccagtagtctattttctgtctgtacagatttgcctgttctggacatttcttatatattgaatcatactataagtgctttgtgactatcttctttcagttagcatgctttcaaagttcattcatgctatagtatcaatatttcatcctttttattgcttaataatattagtattccattgtgcaattacatcacattttatttatcagttcaacagctgatagacatgtgggttgtctcaactttttggctggtatgaataatgctgtttataatagtcaagacatggaagcaacctaaatgtccattgacagataaatggataaagatgatgcagcacatatacacaatggaatactatttagccataataagaagaaaatactcttatttgcagaaacatagatggacctagaggagcctcataacttgctaatgtgtcatagatacttcagtaaggagtcacctgagtaatataaatgtagattagtttctgtttttgcaaaaatttctcagtaaaccaggagtcagagatcacctctacatatatagaaagaagacacgatgggtgagggcaactgaggagtgagggaaataaaccattttcttagtatttaaagttttcctcacctgtttaacctgtttagaacttgcaatcttatcaattatagtcattatatctgcttcgccttggacatatccttttagtatagcatatctaaaggacagctgatgactcatccttttatctaatatttgcagcaaccttggtgttacaagctgaaaaaacaagactatatttaataaaatttgtacaaattatggttgattttatgttggctagtttaaaataggtagtaataagaaatgacattctctctggtaactatagcaacttgtcaagattcttagttattttatgcacagaatctctgtaactttgtggctagagctacttccccataactaataatattagatgcctatgtgaagttaagactttgttttccacttatttccattgtagagaattgcatgatattttaagtggttttattcttggaaaacaacgtggttgatcttctgggcttaggtcacaaaatgactgtctatgaagtattgccacttttaccgactaaacctcccactaaaattttcactagatgcttcatagttaattgagttagagctcaccacaactatggtccttatttgaccccacaattaacttctcattgtttctttgctgcgggtttaagtctccagcttatctgtcaccactgtactgtctgtctcctaacttcagcagaactggccaacccctacattttcctatctttgctccacagtgctccacactcatacagaaaacaattacttgttatattgctatagaaagacacattagacaattaaaggtcattttagatgctgtgatttcataatactgtaagtttatagaacacaaagtgtgtatttttcagttccttaatttgtatgaatatatactacttgcactgtcactacaaacatacatgatttgctttgctaattcctatcatttatttcaggtattcataagaataaatgttactttggggtttccatgtgctttctactaaaaggaaaggctgtgatgagtatttctttactttcgtgtgctaaatgaatttctaatataatttagatattcataatataatctgttatgagacttaacttgtcaaaagaatctaaatataaacatcagcccaacagaaagtggaaaccacaaaactagtaagctgattttcatccatatttcatgaagtagttaggagaaatttgaaactgtttgatttaatagttttttaccttcaaaatgcgtaggatgcgaagaaatctaacaattttcataatgatgactatttggaccaaatcaaaaatataatagttaatggaatttgtctcaatcagcattacatctatgatgccaactaacgtaattgttagctcaaatagattccaggcatggaaaaaatattccttcctcattgctgctatctgttgatttaaaaagaaattgtactaccttatttgtttttgctttcacaacattattttccataataacttaaacatgaatagttaaggtttttctctgatctacccttaagactctacttgtctgaaata

SEQ ID NO: 31690 - DNA, 632 bp, Bovine  19866880921362
ctctccatggaatttttcagtcaagaacactgaagtgggttgccatttccttctcccaaaagccatttggtgtggccaaaaaatataaaagaatataaagaaaataaggtcaagaaaggtagagtgactattccaaggtcccactgcttattgaggcctgaagacagttttccagcgtcaagtgcagggcatcttgaaccgccacatcactggcctctggcataaagatcttaggcctaccctggattcaagcagccttgtcttctctgcgtgagcgtgcttcaacagtctctccatttcctctattcgggcaatatttgaagtgctggcactgaagaaaacacaaaagccttttaagaatactgcttcatactgatgtctcatcagatgacacacacacacacacacacacacaccacgccccccaagatccattatgaaatgatgttgcttacaagaatcactggtctgatgaggcaagtcacttcaactctaacaactctaggtgaaagtaacttaactcagtttagaagacaaaatactggcaagggaaataccaccacacaaagtgctctactcacatataaggcaaaaccaaatcctacaaagtgtgttcccaatatgtttcctcc

SEQ ID NO: 31691 - DNA, 1775 bp, Bovine  19866880975335
ttaatgtaatcttattagcagcttgttcatagctcagttggtaaagaatctgcctgcaatgtgggagatcacgggtttgatccctgggttgggaagatcccctggagaagggaaaggctacccactccagtattctggcctggagaattccatggactgtatagagtccacggggtagcaaagagtcggacacgactgagcaacttctacttttcacttttcagccaggagtaaaatgataatttcatacattgctggtataaggtaaattaataaatacctttttggaaagttacttagaaaaatgtttgagaagagctttaaaatattcacaccatttaatctagtaatttcatttcagaaaattcattttcaataggaaatctattctgaagaactaaactaatgtttggaaaaataaagatttcttctgaagaatattcctaatagagacaaactagagtttgcttaagcgtacctcatagaagaatgtttaatggtggcgcattattcaatgctttattcaagcaggcattgaaagaaaagataagacaactctgtgtctatctcagtaatgctgggacaggcatttaaattctaagaaaggcagaattattttttaaactgccttcttacaattttgtatatactattttcatattgtaaaaataagtcagtgggaatgatttcttaacagatcatataaacattctgaagagccttggttagttatatgcccctctttctgaaatcatctcttaataagccaattattaaatgatcaaatgcatgttgtatttctcttccttaaagaaggtaaggatcctcctagacactgagatgatcttactgttataaagtctaaatgaccatgagagacacttttctaactacagtgagaaaatatttcagtagtaacttaagtaaaaattatctttaacaaatatcttccattttgtcatcagtttctatctggtgtcaaccatttttatttggttggcttggtgagtagctctgaccccaggggtctcctcacagggtgctgcactttgcaaacaaaatctaagagaaaagtgttgtgttctgccaatcttgtccttaatcactacgactcacaccagaatcaaaattcttatattcatatagaatactcttgactgtcaccagttatacttttcagtaagttttagagtaggtatttcatacataatgtaggattttatacaactctactgttttatgttttattatttccattttcttgaaaataaatcattctgggaatggtttttactgtttcatctttttagaaataaacccaaaaaacaacaaaaaaaatgtgacaagcaatgctttattgttatgtagtctctagaacatgaagggtattcagtaactattaagaaaaagcatagttatcaatcctcaggcaaagtgaattttgtgagcaaggaaattactagcatgtttcaggtaaaaaatggctgttactaatagaaatgtggagcgagtccctctggagttcccacactggttgtctctgctaatgagactcactggaaacttgccgaatgctctgcttccctgggctgcagcagaaataggagctctttatacctcttcactgagagatttattatgaatacattatgtatagatggaggacaaccagttctctcttctttttagattttatcagcagcccagctgtttgggattgagtgtgtaatatagtatgagttatgtattggacttaattcttccctgggtatcag

SEQ ID NO: 31692 - DNA, 2016 bp, Bovine  19866880979750
tcttatatgtaatggaaagataaagagtcagttgggaagttggtattatcacacatgccaacttcaaatcatttgtagagctgtctaaagggatgaatagaaagtgattctgaggcagtatcaggaaacagcgaaatggttatcattgtctgctgtgcctctgtgagaggggagttgtggtaaatggattagtaatgtgatagaatttttaatattagccttccttgatctgtaacttctatttttattaccttcttgatctaagagttaccaagacagtttttttttcaatttcaggtagttagaatattcatttttaaagatcttccttttgaagtaagcattaaattgcactgtggctgaataatgtttgaaattttattgatatgttcttctagtctagttgatttctgttaatgcctataggtatgtgtaaagaataagcactctgttttggaagataaaactctctatatatcttaggaaccaagcatttaagttttcatataaatcatagccatagtcatttttttaatccaattggttatgaaattatttaggaaaggcctgttaaagtttctccttgtaattacggttttgtcaagtttctcttattataattgcctttatgtaccttggtacattgtttcctattgtatacatattaatatttttaatgtcttttgataaattttttacaaaaatattccttctagatcagttgcatggtggttttttgtttttgtttttgctttttacctggtaaatatttcccacatctttatatctttaatttgaacctttttatattatttaattttaggcatagtccccttacttacaaatataaaagatgaggtacagaaatgaaaagctgagacttatatgattgacatcctctccaaaaacagtagacatccatagttgaatcagttttgaactaacaattccaaacgagaaacttactataagatgtaaccaaatttctctcatgatgatataggctgaaagaaaagggaataaattaaaaaataattaatagaatgtatgtgcttttaatttcaaatgataatctgggtcaacttttgtttctgacattatcttttaaaatagctcatagcctttgggatagatgtagggtattttcttattcttaagttgaaagagtttcttttcaaacgtcaaaagtcacaattaaattgataaaatttgaccagtttaatttaagagctttttaagtcccaattcaggaatatatatttatttagttccaaaatgtgtaatacattttggaaaaacaataatgaataagaagtagaagctctctaacttcatggaatttagaatccacgtctaaaattatatacacaagaaattaaaaaaaaaaaaaaaggaatgcctctgggtcacagctaagtgaatctcttgtattgtattggcctgccaaaccaatccgattggttccttactattggacatttcattgtttccagtttttctcctgataagcaatggtgtggtgtatatttctatacatacatttttgtacttctctgattacttccttaggccccagaagtggaattactacactaatggatagttgatcccatactgatactgttatgttttgccaaatttctttcaacagtcattatgatgcccttcccagataaacaggaagcctaaacccttgagggcattgatggctgcaatcaggcattttcagtggatgaggaagtccttctcatttttgtagggtgaggaagaaaggagaaaagttttaaatcacagatgaaagtgggtcttaggtgcagaaaagcctgaagggtcaacttcaatagaatatgagaagagcaagaacaaaaccaaaatgaaggatggccaacagaaaacagcaatagcaaccacatcaaaaaacaaggctaaatttggggaagtaaatcccagaacagtgctctgaggtggtgaaatgaagaagaaagaatccttttatgaatccttaatcatagatgt

SEQ ID NO: 31693 - DNA, 928 bp, Bovine  19866881075377
gaatgcacatctgcagtcctcacagtgcacactagcatggcagccccttgtacccacattcgaaaactttggagtcattttagtttactgtctacctcccctgaaggtggtaagttcattttcttattctgtgatacatttgggaaaaaaatcctggactatctaaggagcaggacatacttacataattgcattacaggaactagcttttcctcctcgtgaaaaaactgaagggaagggaggttgtgacacatgtcatcaccaaggagccgattcttgtgttttaaatgacacacgagggttaaagggttgtcctttagggatttggttttcatactaaaacaaggaaatgtcttccatgttattggtgccagcatgaagttctctttgccaacaagccttttttgaaagtgtaaagaaagatacatgtatgaccttttcaaataacctctggtattttttgtccctcccttttccataatgaataattggaaacaatttaaaaggagcagttagtaattccaaaagttcaagtgtcaaaggtaaatatttgtataatgaattttttgccatgtttaagattgaaaaaaaaaaaaggcacaagctccacatttatgaatgcgctggcttttgtgatgctttatgcattaatccttacaactgatgctgttctctctcaagcctcatggtgtgcttttatgttttgcatctttccttagcaaagtgatatgtagtttttacatacatgtgtgtatttataatttatgattacatcttacattaaggaaacttattttcccagaaatgtgttaacctgaactaacatattttaacttcagtatctaaaactgctctaaatacaagtggcatgaaaacccttcatggaactcaaatcattttacagatttagtttaggtctataatgttt

SEQ ID NO: 31694 - DNA, 1756 bp, Bovine  19866881219437
caaatttctcacatgaataaattaaaataattttttaaaaaagagaatgttgtaggaagatgaagaatattcaatatcaggtccagataggaagccaccaaatatatttcaaattctgaaactattaaatatttgaatcattcagctgaactataaaatgatagtttgttttaaaaaatcaatataccagccattgatgtctataatggtaccactaactgacactgcaccaagctccccagaaaaagaagtatatatttatgatttttgactttaagtaaattaactatatgtttgtgaacaaggggatataatttacaaaatgcttatcataaacctagacagcactgttgaggtaaggaaactcaacatcttctctcacattagctcaattgccaaagtgaaaagaaaaaaaataaaatagcaaaaaaatctcttgtcattacatctaccacattgaaaagaggattctaaagtcttccacagagaaacattttccaaactggttaccagtaaaaaaagaaaaatgttaagtagccctgggctattgtttttaatattttacagcaaatctgtagagacgaaattctgaaggcagtttactctttattagtggaagaatatcaaataggaaaatcaaataggaaaaggccaacataattccctggttttcattaaatacatccattaaatgacaaattagcatgaaatgacttttatctgtcttcttaagtactttccacactccaaaaatgcaataacttgatcaaaaggactattaaactggttgttataagccccacctccctttcactgcctgaacttctggactccagctgcagctccatcctcatggcctcagtctcatggaaggcactcggctacacaacctcatcgcaggagcttctgcaccctgtccatccaggagtcccgatgcttattttatctctgcagctgccaccagctgccaagtcctacccacctcagctttgtggggagggagcatgtgtatgcggggcggagttggtggggggtggcagtggcccagcattcactgccttattttaaacttctctaacaatccagcaaagtctgcatgggaatatgcaaaaacaactggaaggcataagtgaggaaggggataggaacaagatgttataatttacccattctcaagagcatctgcattagaggctaatctccaaggaaaagttctctttctgcagtgtaggtgaattaagtcaaagcatctaaacacagtctttgctattcttcatagaggacagtatgtatgccttgacattcattatgtttgggattataggaaagttgtcaatttctattaatcaagttgctaatgaacagtgcagtcctcaaaagcatgaaaggtacttctgcccagtctgtcactcatggcaaaattcctcctacctctccttcccaaaatagtctcttttgctgccagcgctattgcttaattccagagggaataaatgatcccagccttaagatgaatgctatttcagatggtgaaacagtattccaaggcgagtgcacaggaagtttggtctactgctatgtgcttctctctattcttatcaccccattcacagccaatctgttcagacttgaatctcacacgcatgcagcactgctgcccacgagtctaacagaaatccggactgcgccgagatgcactggccccgtcagaagctgcaccaaagaaaaataaactgatggtgaggagtgcgtcaga

SEQ ID NO: 31695 - DNA, 2388 bp, Bovine  19866881280738
ctgaatgggagaaaatatttgcaaatgatacgaccaataaagagttaatattcaaaatatacagctcatataattcaatatcagaaaaacaactgctttaaaaagggcagaagacctgaatagacagttttctgaagaagacatacagatggccaagaggcacatgaaaagatgctcaacattgccaatcatcagaataatgcaagtcataagcacagtgagatcacctcacacctgtcagaacggctatcctcaagaagttcacagataacatatgtcggtgagggtgtggagcaaagggaaccttagcacactactggcgggaatacaaactgcaaacctctatggaaaacagcatgcagctttctcaagaaaactaaaaacagaatcaccatatgatccagcaagtcccaatcctgggtatatatctgaagaaaacaaaaaaaaacccagtaatttgaaaagatatatgcacctcaatgtttatagcaacactatttataatagccaagaaatgaaagcaacctaagtgtaacaaatgaatggttaaagaggatgtggtaaatatggacaatgaaatattcataaaaagaatgaaaatttcctatttgcaacaacatggatggacctggaggatattatgcttagtgaaataagtcagccagagaaagacaaatactgcatattagcacttgcatgtggaacctaaaaaaaataaacataacaaaacagaaacagatttattgatacagatcaatatagatccagtgaggaggggactccccctggtggctcagacagtaaagaatctgcctacaatgcaggagaccctggttcaagccctgggttcggaagatcctctggagaagggaatggctacccactccagtattcttgctagttaaactggcaagcaaattaaaacataattaacttagcaaattgaaaattttgatgatacatactttggcaagtgtgtaaataacaaggtgcagggataaactcttctcaagagtcacctggaaatacacacagtctttgagattataagttggaaatattgtttaaaatgaataatacacaacctctttgacctaccaactccacagatacatttgcacaatttgtgctaatatatatattccagaatatttgctgcatatggattttattagtaaaatattggtaacaatttaaacagtatttccaaacaataaaatactagctgaccatcagtaagaatgaggtagaacggtctataataatattcaaagatgctcaagacattcaataggagaaaaacatcatgcagaacactatacttgtgtatatgtttatatatataatatatatattatatatataaattcaatatgcttatattgccacatgttcacagaaatattgggaaggtatggaagaccctctgtgtttatctctcaggtatgcaaccagaggggatagggaaaagtcaaactgtttctctttctctttctgtactgctacattttctagagtctaaatgtgttactttataggaaacactagaatttgctgcaccttgtttagctagcgttagtgttagtcgctcagtcatgtctgactctttgcgacccctatggactgtagcccaccaggttcctctgaccatggaatttcccaggcaagaatactggcgtggactgccatttcctcctccaccggatcttcccccatccaggaactgaacctggttctcctgcattgcagctagattctttactgtctgagccaccagagtagctgcttcactgcaaacattctggaaaacaagcagtaagacccctaatgtctaggccagggcagatgcacggtccgggccctgtatctaatctctgtgtgtggccggctttacctttggtaggatacttaggtaagcggactcgccggaagctttcagaaaggcagaggagggcggcgggggagtcctggcgaggtccccgagaagttcatcattcctggcgccccgtggcgggaggaagctggcactgctctgactgaggctcccaaagcctgccaggtccgcgtcgtggagagcacttttctggtggcacctgtacctggtgtccgggctcaccagggcttcttcaaacacagactcctcatccgagagctgcagtttctccagctctttattgattttctgcacatctgccacggtggtgccgggggacacacgactgtcaggctttgtgtactcagcacagaggctgaggatggtctccagacgctgtctctcctagaacacagaggacagaaggtcggtgagtttgtgagcagggagcaactccacatagagaagaggctgggaccactggtaaattcaacccacacatagtcccacagaca

SEQ ID NO: 31696 - DNA, 2536 bp, Bovine  19866881425279
ttaattgtattaatccatatattcctaaagtcataggtccttctgacatctgtaaattgttttaaactgctggtagaattattttacaatataacaatgaactttaaggaactgacctgaatgtattatcataaatgaaacaacatatatcagcttctctttcatcccagaaacccgcccctcacacatacacacacgagagagagagagagaaaaaaaagttgtagccaaataaaaattctatgaaaaaaaaaatagaaattttagtaagagcacaataatatcatcaatcttatgcccattgatgtcatgtccttttggagagctgtatcattgtttctactcttagtgataaaaaatttttttgtgggtctatggatttgtaaactatggttacttgccacatgcctcaaaacattgctgctataattgttttaccaggtcttggttaaatgcagtgttctccaggaagctttccctgacctctcagtgttggttggtgcccctccttgcattctcctggcatcttgcacttctgttgccgtagcactcagcacggtgcctggctacctacctatattctaagctgtatgctctttaaagacagtcctgtgtctttacctttcaccattttactccacttcctagcccatagcaagcaataatgatgacttttaatcaataatttcttagatgaataaataaaggtttggcgggaactaagttactattttatcttcctgccacagtattttgttcattaccagtgtctgtttgatccttccaggctcacttgaaccctccaatagattctccactcaatgctacagaatctacccttggcacccgaccttctctagccaacagcatatctcctacaggtaagaatgtttttatactgttttacttcccatgaactattaatcctttaagtagattgatagaaaaatttcagaaaatttgtatgattcatgccccattcttatctatggagattttaaataaatatattaagtactattttcatggattaaaagaattagcacaacttccaaagtccttcactttgctgctgctgctgctaagtcgcttcagtcatgtctgcctctgtgcgaccacatagacggaagcccaccaggctcccccgtccctgggattctccaagcaagaacactggaatgggttgtcatttctggcaaaaccagggtcaataaatactcaatgagaaatttaaattctatatttattattaaagacgttaataaattgacagtgctcctctacaactgtgctctcagtagggtgtttaagaaattgttgtaagtagggatcctgtgggccacaggtaggtagatagttttaaattcaaatctgttcttgttcaaattaattttgacaaaattgactgggatgaggacttgaattcagccttccaatggcattattaataatggagttcaggctgggtcagtgtttctatggcaaagggatagcagtgagtttcagaagttggcattgatgcaaacaaatcataaatttccatgtctgtggcctttgtgtttaataaagaaccaaggtgactttctctagcacagaaaaagtatgttctacatagagtagaagcatgctttttatttcttctttaattaaaactatcaattttagctcaaaaagagaactgaaaatggagtaaaacaaagcagtcactagaaatgaacaatttgtttagcctgtagcctttgacaggtagcctgcagtcactgtcacaggttgatggcgctcagagaatgaagcacgtggcagggtgagaaatgcctgcaaatcacccaatagacattttgcatccatctattttttcctagttcttaagactttgtaattttctctcttttatgcttctttttcttcctcttctagctcatcattcagcaataaaccatagtaaattatgatattcttcattcaacaagcattagcatattcaacagtaataccttaaatctctctagtactctatgtgttagttatccatcgctgtataacaaatcacccaaacaaaaataaactaggtttaacatatatattgtctcatgtggttttacacaagacaggagcagcttagctgagtgtgtggctcaggttctttcatgagggtggagtcaggctgttgggctcccatcatctgaaggcttgactgaagctgagggctctgcttccaaacttggacacgctggcaggaggtctcagctactcaccacatggacctctctacagggctgcctctctctatggcagctgtaatcccccagaccaagtagttcaagaaacagagtcaccaagataaaacccccctgactccttatgacccagtctacaaaactgtacaccattattattgctatattctatctgttaaaagcaagtcactacgtccagcttatactcaagaggaagagaattgagctccacctcttgaaggaaaaagtgtcaacgaatttgtgtacaaagtaaagcaaccacattttatcacttagaa

SEQ ID NO: 31697 - DNA, 902 bp, Bovine  19866881574702
aattttttaaaaatcttttaataacctaagtccaggaaatgaaaagggaatcatgaatagacacaactgttacttttcagagaaccttagctatttattcaaacaaatatttacacaattgagggcaatggtaccagggatatagccattctgttaaaacagtgggcaactctaaagatttatttatcccaaatcagactactctgttgctatcctaccaggaacgaagaattcaagtgctcccagggcaaaagtttaactaaccctctgaaattgtgaacttcatttagacctcacccagctgaattcagatgttagaatcctggagacaaatccaagggcttgttaagccaaactacgaagctaaaagttacaagtccaatacttgaaaattaatatctgtaattaacacattcatataatgcagggaaatgtgactgacatatattcaccctaaaagcaagccacatttttatgcctcttctcttcgttccactcccagctgcgtctggctgtgactagcgatgcattctagaattcttgagagcaactagagagcaggagaaggaagatttctagggaagacagcaggacaggcgagaggacttccagccgcgggcaagtggacccacataaaagccagcgggcgcagttcctgcttttacatgagaaaggtagatgggtagcaggttcgacttccgaagcgctttcaaacaggaaaccccaactttggaagggacagcctgtcagccttttaatttcctggcggtggcgggagttagccaggtcctcggcgctttagttaagagatgactgttgaagctaagttattcagtacaccagcaaacatttcagctgcgccttggcggtgccgggacttgggtaaacgggttcaaagcatt

SEQ ID NO: 31698 - DNA, 892 bp, Bovine  19866881802441
ctaatgtgattagctgacctacttaatacattgataccctaaaacctcagggtatcaggtagataggcatttatttgccagaatgtagcctgctggtcacattgtctctgatctcatctaaagagttctaccctcttcccaggtggctcagtgataaagaatccacctgccaatgcacaagacgcaggagatgcgggtttgaacccaggatggggaagattcccctggagggagaaatagcgacccactctagtattcttgcctggaaaatgccatggaaaaaggagcctggctggctgcagtccatggagttgcaaagagtcagaggtaaatgaacacaccctggaaaattaaaataattctgtaatatggctgtgagtgttcatcaggacacaggagcctccagtgggattttatttcctttcccagcaggctaagtgcttctgacttattgggatgattgctgccatcctctcactttctcgtcaagcataaagggcatatgaatggatgtctctgctaagtcatcactcagtgcatcagtttgctgcaatggaccggaaagggttttatcttaaaaagagtttttgcacttctttcgcaaattgtatgtcacctagaagtccttgacagtgccaattgatactgacctttatggctgccaaacctcctttcttgagatacagtctcttcagcctcactgataaaaatgccttagtttcttcagcaaagaatggagtccagcaaagaatggagtccgtccatggggctggcatcagattgggagagccactgctctccacatcatccagacccacgaggaaggaccactcaggtagggggcgctgcttcccgactctcccataagataaacccacatcagctgagggag

SEQ ID NO: 31699 - DNA, 655 bp, Bovine  19866881842933
ctttgtattaataattgcttcactgagttatcctgtcttctggcccagccaaggagggatcagcacgtatccgggtcatggagggaaagtacaggcgagccccaaaggccattttacttggctctgactcaccctgactctccagtgaagcagaaaggaggaaacatcacacctcccaggtgtggccagcctttgaccactattgcaaatccctgagagtcacccagtcccttcccaagtacacttttagctttagagacttctggctcaaggaaagctgtaaagtggagacaggatgaggcgggaagaagaggaagaggatggaaacaggatgaaggcaaaagggcgcttggaagtgaaggaggaggaggagatcagtgaggcgggagaacctgtagcccctttttgtcggtgccacgcccaccccgatgccccacaacaaggggactcggttttctgaggcctgggaatatttccacttggcccctgcccgtgccgggcaccaccccaaccaatatgccacctgccgcctgtgtggcaggcaggtgagccggggccctggggttaacgtgggcaccacagccctatggaagcatctgaaaagcatgcacaaagacgagctggagaagagcggccacggtcaagctgggcagcg

SEQ ID NO: 31700 - DNA, 708 bp, Bovine  19866881855187
taatcatctgatcaagttatctaaagcattgaaatgtgtgtatataaacttacaccgtgaaagaaaaacaacttgggagggtaaaaaaaaaactgttacaagattttagataagaataagtattcaagagatggaatttaggggcaggagtagtttaattgagcacagaataatatatacaggaagctcaaagtcaagtgtgtgactagctgaatgaaaattttaactaaacttctccactaaaagaatatgacaagtccttactggctgcaagttcaaaggccaggtgtgaaaggaaataaaacagatgtgttaaagaaaattcagtgaaagtcattttttcttcccaataacatttttgagaatgtgtagctagtggtaaagaacccgcctactaatacaggagacttaagagacgtggtttcgatccctgggtcaggaagatcccctggagaaggatatggcaacccactccaggattcttgcccggagaatcccatggacagagaagcctggcacgctacagtccatagggtcgcaaagagtcagacacaactgaagtgacttagcacgcagcatgcatggcagaagtttacctgcacaactttgttttctttgctttctttcagtagaggaactgaaagaagagactagatatggtatggccaggagatactacaatagttttatgactgctcaaggccaact

SEQ ID NO: 31701 - DNA, 788 bp, Bovine  19866880573424
acagatcataatagctgtttttcacagttgcttatgcgagtgtcagcacgactgaatgtaattttaattaaacaaatctgccattatgagtacaataactgccttgccatttttgcattatggcatgagctaaaagaaaaaaaaatctcccttgtattgcaacaagcagaaaacctatttagtaagtaaaagtattgttaaaaatagtgtaacagtatgattacaatatatcaacgtgtaaagtgggtcctacgttacagagtcggacttcaccctgcacctggtccagccactgggcaagcagagtggcctgcagggggacgtccagccaggaaggggggctccatgctaggagtggggcatgaaggacgcattaccacccccctgggggaaccccactgaaacctctaagacatgtctgtttcctgaggaacacttgctctgcttcgaaggttggagggaccttgaattttggtttcctactattaggatttttccatcttgcatatctgtattgatctcctttacttaaacaaggccaagaatagcttctgttcagactaggcttctcgaaggcttggtctgtttaatactgccagctatattcctgcggcagatgtgagatgacatgatttgggattcatatttaaacaggttttcttgccggaggaatcgtgaaagggagaggttgaatatataggtatccattgattgaatctaggtcaaaaacaatcacatcctaaatataaccgagtcttccccgcttttcctgccatatgtccctccca

SEQ ID NO: 31702 - DNA, 1145 bp, Bovine  19866880599422
ggtgcggagcgtgggactgagccccaaggaaaggatcttcctctgcccattccaggccacagggtccccttgggcagggcaggccccagccaaggcctgagggcgggaggcaaggtgccctcccacctccacagtgcgccccccagcaccgaacctcgcgcaacagagaggacacttacgtgcacacggtcttgatgttcgtcttgtcgtccaggccctgcgggtagttggccatgctgtcgcccagcttgagcaaacagtctgaaaagcccttaaagaccgcatcgcacttgcccgctgctctcacggcctgcaccaggtacgctgcggggagcaggggacactggtcagcggtgccaccacccggccctggagccccgcagcctgacccccaggacccagtgagcatcgccccatccagctgtgtccagtggcgcccaggctcggggcgcaccagggccaaaggtgaatgaacggtggggcccgagaacgactgagctgcaggcaacccagcgtcttctgcaggtggcccgtgcgcgcgcgtgtggggttgggggagtccaggcctttcctatttcctaccgtgcgacccctgcctgcatcgctctctgcatctttttcggtttccttcgctctgtcatctcacctcccccgcctttttatttctttctcctggctctctgcttcgcttccccaacacacccttagccggcccatcaaggctctcgaagtgcggtttcccttttgtgaggtgatggaggggtgtgacagcacagtgcaggggtgaggaaggggctgggaggctcagagctgggagccgccgagggccaagtctgtgaacaatccctgggcttggggcccgctgcttagcgggtgctgggcaagcactgctgaacgaataaataaattctctggaagcccccagcagccactgacttggattgtttcactataacagggatcgtctaccgtggagttcctagtgaggccctcgtctgcaagccctacacccctagactgggaggggaaagggtggtcccgggcagttagggccggcagggtcaggatgtgtctgagctcgagaccccgggtcacgtcccggaggccagatccccgaggccggtcccttgcttccctctgccttg

SEQ ID NO: 31703 - DNA, 882 bp, Bovine  19866880625022
acagagaaaaacacgcacagcagccacaagtcggcagcaggcaacgcggaggaaagagcttgggggcaagaaggcaccttacagtctcagccagagagcgccagtgcccctgggctacctaagaaatccactggtgtccaacaccaagtacgggtgacctctgctcactgggaactggagcaacccaaccagaggtctcagccctgcatctccagccctctgcaatggaggataagtgtgagccaccgactgctcactcatcaggagaaacgcagaggcaggcacgtggggaccggaaggcaaaagtcagacaagaggcagtaaaggcctgccagttcctgcgttactaacacagcacgctggccaggatgtccagagccccgcctgcaccaagcaccccaccaaagacggatgccacagggccccgcgcggctcgctgggaccgaccgggaagccccgcgccgcggggcccggctcacctggtggcgggagaagaggcgcacggcctccagctggtggaacacggggtagtgctgcgcgtcgatctggtcgcgccggtacacgtcgcccaccaccaggaaggcgtccagccccgcgcgcagcaggtcccactggtgcgccgacgtgtgcgcgcgcagcatgtgcgtggcgttcaggaagtagttgtcgcccttcttccggctggggtggtcggccgggatgagcaggctgtcgaagttctgccaggtggtgaccaccggggacaggtcgtcgtacacggagaagagcggggtccccgcgcggcccgggtactgcgcgtagaagtgctgcttcacgcgctccttgagcagccagagcgggtgctgcggctgttgtgcaggttccggcccacctggacaggac

SEQ ID NO: 31704 - DNA, 1131 bp, Bovine  19866880639065
ccagtcacgtcttcagagggctctctgcatcctcgcgacagtcgctctcagcagcctggacaggcgcgttcaccctgaccttgcttgggtctcaccctgcagagcatctcaacctaagcttgacttcctcccagggagatggtactgaaggcaatgccgttatgagctcagagcataggctttaggggaaaaggcttgatgaatggctttttagagaaatattttagactaatgaatgaaacaaatagctccactctaagaaaaactctcagctcccttatgatctaccttcatgcacacacaaattttcttccaggaatggggagcaagtgtccatgggtgagacaaagaaccgaagtaataacccagctttgatcaaaactcttgtgttacagcgttccctctgaaaatgatttctaatcagtgagcacttccacagcgtgctcaggagtaattaccttacatgtgtttcctctgagctctgattagaagcaagatgtgagatcagaggggcagaagaggaaggtaagaagggaaaatctcacccaggtgctgaaatgcccaggttgagggctgtttcataagctcgtgccccgcgtagggatgtcaacctccattcaccctcgtcccgctgccagtgaacacatgcccactctttggggcagtgttgatgatgtaacgatggccactgaggcagggcgaccagctggctccagtgaaagcgtttgttctggcagcacacagacgtgtgggctgctaaaccctcttctcgccctgtgtcctggtggtcagggctcagttttcagcacggactgctaggtgcagactctctagcccacacggtagttgaacctgggcttcgttagtccaagaagggacccaggggcccgggaagggaggtcaaagactgggaacgattctgcctatgaaagaaaggcacagcaagaggtggcgagggccagtgggtggttggggtcactggggtggcgaggactacatagggtctgtgcaggcaagaggaggtctgtgacccccagcgcttgctggatgggaacgagttcctagactcttgaggatgtgtgacgaggggcttccctggggtccgatgttgaagacttcgcccttccggtg

SEQ ID NO: 31705 - DNA, 2776 bp, Bovine  19866880687935
acaaccccccgcacaaaacctcaatttccaataaagaaaaagaacagaaaaggaaaatggataagaattaaagatataataaaaattaaccccaagaatatcccatgtaatatactgagtgtaacaaagagtcaacaccccaattaaatatgggtttacaaaagacccagatgtttacaagagacatgcttttaatataaagacagaaactgaaaataaaatgatgaaaaaaatgcacatttcaaacactaatcgtaagaaaatcaatgtgtctagattagcattaaaaaaaaaaaaaaactgaactgtaaaagtatcatcagtgataaagatggatatttcatgaaaaacagacattaatgaacccaaagttggttccctgcttagactaacaggcttgataaatccccttttatcagtatataattttagaaggtccatggatctcgtgtgtttatgaatctctattgaaaacactttccaaggtcacattacctttaaactcactggtactctttacggcgcgtgacccgtcactgtgctcacgggacgcccgccgcactcacctggaacgtcaccttctggttgatgtccggcacgcggaactgcttcaggaagcgctcatcctgactccagaagaggcggatgtcggggatgtcgtagaggatcatggccagccgctccagccccagcccgaaggcccagccgatccggtcctgagctccggctgcagtggggagaggagaccagaaagagggtttaagggcacgaggggccgcaggtccatcccactcctgacacccggacaggacctcagcgggtggcgaccagaggcaaggtgcgtttacacagtgaatgtttatcatgagcttattaaaaatgtctatctgaaaatgagtatgtactatgataccactctttaatatagggacaaataaggcttgtaatgtaaaataaaaataatgatgataaagtgtgatgttcaaagattatgaggttaatagttttaaaatatgtttaaaacatgtttctgaactgtcttcgcaaattaatcaaagataggtggaatattaatgttgctctgtgagttagactttttccttaattattaaatcctttacattttattataaaatttttagataaagccaaccatctgagcccagcacccacagctgaaagaacagtaggtttagtgtatttgaatctatttaacatgcagcagtttttagttcttagctctgcttctttcattcattaccctccccagcttccttatccgctgaaactttcctagagcaagataagaacgacatgcagcccccaacggtaggtaagaaaaagaaaaacaacctcattattcagacaggcaaagaataggaagatgtgcacaaaaagggagaaaaaaaatgattcttaagcaaatgaaaagtttacttaagaaaaacaaaagtgcaccagattaccattttttatttatttgactggcaaaaataaaaacacctcatcgcatacttgacaccaaagccaagggaaaccacggcctttcatatgctgagagcaggcgcgtgtgggggcttttcacccccagacccaaggagcatcaccctgttgccgtcctcagtcacagacacaccactctgccactttgaccaccaggctgcttcccacgcacaggaagccacggatgtataaggctgtttactggagcattgtttataacaagacagtaaacaacccaagcgtccatgaaggacgcggcttgaataaaccccactatatccatacagtggaatattatggatagaaaaaaaaaaaagcagtagccgtctgtccttttaggggaagtaactgggcgaatggagaacaggcttttatatacgccttttatataacgcgtgagaagaaacatttcagataaaaattctcacggctgaatgaaataacttctgtctattccggtgaggttataagaacaaagggcctcccctgtgaagctagtggtaaagaacccacctgttaatgcaggagacctaagagaggcaggttcaatccctgggttgggaagatgccctggaggaggccacagtaacccaccccaggattcttgcctggaggatcccatggacagaggaacctggagggctatagtccatggggtcgcaaagagtcggacacgactgaagggactaagcaggcccgcatcgtatttgaaaagtaaccaagagatgcatttaggacacgactgaggcgactaagcaggcccacatcatatttgaaaggtaaccaagagatgcatttaggaagatcacaatatacaaaaagtcagggtgggtgtgacgcgggggcctcctggctgccaatgaggacaggcctgagaggaccccggacgcagagcagcgaggggccatcccgtcggcacctaagaccgcagcacctcgtacgtggacgctcaaggacgaggccctcaggaggagcagcctccagcttcctccactgcccaccacctctgactcacactcattcttactgcaaagcctgctgctgacggccaatcaccaggaagggctgcaaggaaggacgtctatgggctgagctgcatcaaattctatttttgaaacactttgctttggtcccattgagatctgcctcttctgaattgcacccctgcaaaatggcaacccactccaggattcttacctggagaatcccatggacagaggagcctggcgggctgcagtccatagggtcgcaagagttggacacgactgagcaa

SEQ ID NO: 31706 - DNA, 1470 bp, Bovine  19866880780606
ctggtgtcttgttgtcttgaagttagacaccacctttggagcgggaactgcactgctctctgacccagcgtccctgcgccccccccggagggccgttgtcaggcatcgacgtgcgggcggcccctccccgaggagctggacttgcaggggtcatggctcagcaggaaaacggcttcctacaaacgacccgcatccttttccttctaaagtgatgagctttcctaggaagttagaaaccttttcctctcatcagccagaaagttacagggagcccctcataaatgtcaagttaaacattgtgaaaatatttccatagaacttcccttcagttactgagtgaattcaggtgactacgtctgtcttgaacacagagacagtttaataacaacataactggttctaagtttttaaaggagtaatttttttttgcctttaaaaaatgtatttattgaagtaacgtggacttaaaacgtgttagtttcaagtgtacaccatagtgactctttttttttttagatttgtacagggtcttagaaaaatgaatttgttattccatggaaggagtactttccatttaggtgcacctcttgcctggaaagtcccatggacgggggagcctggtgggctgcagtccatggggtcaagaagagtcgtcacaaccgagcaacttcactttcaattttcactttcatgcattggagaaggaaatggcagcccactccagtgttcctgcctggagaatcccagggacgggggagcctggtgggctgctgtctatggggtcacacagagtcggacacgactgaagtgacttagcgtagcatagcttaggtaatattctgagccatatcctgtgagcgtgtcatagagactaaaacactagggtgaaaaatcaattacatgaccagactgtacccatgacataagctgccacaattccaagaactggcctcaaagaaatgggaacaaatggaccctggatctgaagattaactgtacctaaaattactaagatgatgctaggtaggtcaccagtgaccaatttaaagataactgtcaaaactgactgctatttctatatgtagctgtcccccacttttgtctaaaaaaagctcctgcctcactagtttccaggacatctgtctcccccaaccctagttgctggcatctgaaataaagcaaattttcctttccactagccaggcctgcttattggctttttagtaaagagcagccagaccccgcatttggtgatactataatattatgatgtcattgttcataaggacctgcctgatcagggtcctgataaggatgtaaatgtgccatgattttaaaccagtttaagttggggtttgcaaccaagaattccaagaaatgggaccctgcccttagggtgacatatcatgactaaatcggattactctaataattcacaactgcagaaaatataccccacaagagactgac

SEQ ID NO: 31707 - DNA, 1011 bp, Bovine  19866880863211
ctttttttataaggggcctgtccagtgagagtcttcagaccctttgcaactttgggcaggttcccactgctatttttagtactttgttcacatttgtaaaagataggtcatattttagtatttcagatttgaagcttattagacttatcaaaatttaccagtttatggcaaaggatcaaaatgagtttcctgtgaatgtttaataattcttgacatttgatagggaaaagcttattatcaaaaagtagtcttaaagacctaattccagaatgccaaaatgttctaattgcatcactgatagaagtacaggttaacttatttgtggtaactagctgttttccagaatccttaaaataaaacatcctgatagtatagagaagacagaactgatcttccaaagaccatattcaagtctaacaaaactaaactgaatgtattttccccctgaccatgtcaagattttgtcgtgcttcaagttggaaattatgaacatttgttaacttagcattagagatatgtagaaaaagccccctaataatagagattgtttacttattacgacagagagcttgagggcaacgcgtaagctaagttgacttggtttgcacgttgtccagaagtttccagaaacgggtcctgtgaccacacacagcatcttcactcacaaaaaggtccatgtgggtggtgttggaaatgatattaaatatcatttattctaattcacttattttattttgcagaggaagaaactggggactgggaaatggagtggtcatgattgccgttggccctcaacttcaagggtgtgagtcaactgctaggtggattttttcagtagtaaacaccacaataccatgtggtctggtgttggtagagtctgtgggtgctgcgctgtggataccagggccttctagaatttgcatgcagagttttgacagcatggggggtcggcacctctaagtttggcagtgttcaaaggtcaactgtatacatttaaaaaacgtgtagcag

SEQ ID NO: 31708 - DNA, 2202 bp, Bovine  19866880868944
tcatcatccccataatcattttgattattgggaaagtcttgaggtggagagacacgctggtggattaagacaggtgttgtggaaggaaacaagggagcttctctgggaagaaaggaggctctgtgcataagggcagagtagtagcagaggaggagatactttcctcagtgccccttgggtgaagttaggacagaagcttatttgtgctcagcattaaagacgtcctcatattcaaagtgccaaccattaaagagactgtgtcgagaggaagtgagctcctggtgtctgaagagaagtgaaatccggatgatcacccgccggggatgttgttgttgttgttcagctgctcagtcgtgtccgactctttgcaactccatggactgcagcatgccaggcttccccgtcctctaccatctcccggagtttgctcaaactcatgtttgttgagttcatgatgccagcctaccatctcatcctctgttgccttctcctcctgccccaagtctttcccagcatcaggctcttcgcatcaggtggccaaagtattggtgcttcagcttcagccctcagtccttccaatggtgggaatgttacaggggctttaataaacatgtggaagagaggagtcatttcctttgagatctcttcctgctgaaagattgaggatttgtacacctttagagcatgggccaagttagtagcaaataaaatggcacagagaggtcgtggtctgcaccagtggttctcaattgtgggccctttcatccccagggaacacttagcaatggctggagacatttttggatcattaaaactcagaggaaggtgctattggcaactagtgagtagaagtcaaggaagctgttaaacgctataatgcacaggtcagcctccctccaacaaaggactatctggctccaatttcgctattggcgaggttgaggaacgctggcctgtagtttaacttctttctgttgaagagtggtgagagttgctgaatggataaacgctgactctcattcaccgggtagtattttcctaagcgatgagccagaaatgctgccaaatatgccctttctgttgtggttttcacacacatctcaaaggttcttcttttttcttcaaaagcttctttgaagtcagtgaaactggttaagaaatgcagtgggcaataaggacaaatgctctgtaagaacttgtttgaaacctaattctggctcccatccaggaggctctgtggagtgcagtcttgtattcatcatactttctggagggtaaatgacttccctgaaggctgaagatgaataaagaaggttcaggtttcacagatttttttcttggtaacctggtcatttcttcattttgtacatggctcacaaatggctgtggtgaccataggtccagatttgctgtaaacagtcatggtttgcccataatgtattggggtgattattaatagtacctttttttttaatcaacaagtgtcctagtttagataataaattaatattaatattataaacaatattatttgaccaatgggtattttaagcatgcatccacaccatttatataatatgcgttactcaacttcagtgctaccagtttaaaaataactcctcagtaatggctagtttgattatcaccatcatcatgatagctacttttaattacttgtctcaaatggtgatgacctctgtccttcaagccacatcccagcccacttcccgctgtgacccactacccacatttatgacttgcttgggcagaccatgggcccgaaatcagtggccactgggaaaggtgagtcacttgcagaaggtcagctgatcttgctttgatcaacccaggaacacgtttctatacgacacacagcccttctctaagctgttaagcaaatcctttctaaatatgacccctctgtgttaattttaaatccgcttttgtcttttatgtccacttctcagatccatttcctaaaccactggcttttcctcaactctcatttccaaagagctggttctgaaatgcggtttcatcggtttcctgaagaaggtaaaaacgataggtttgatcaggcaaatctgtgttttacaaacacagtgcacagagtctcagcactgaatacctaaacagagagtgatttctgctccatgaagcttttctggccagaaagccacaaactcccttctacttggctaa

SEQ ID NO: 31709 - DNA, 1577 bp, Bovine  19866880930456
atggaaatcaaggatggggaaaatctaagagtaaagtgaatctaggaaagccccagatatgttttgatttttagaaaattctgtgtgttacagattcacaaatactcagccaaactcttaaatgaagcacaagtaatctgccaaccatctagttaaaacaaattgtgtgaattataatgaaattctttccaaccaaatacacatttttaatgggaggaaatgtactccagaggaacattaaaaagacaccaatccgggtcatctcggagatgtgcagcattccttgcataggtattctgtaatgtttgctgttgttagttgctaagtcatgtccagctcttttctgacccccatggacccccaccagactcctccgtccatgggatttcccagacaagaacactggagttgggttgctgttttccttctccagggaatcttcccgacccagagcttgaactcctgtctcctgcattgcaggtggattctttaccactgacctacctgggaagtccctattctgtaattgtatttggggattacctagctcaggccattgtttagaaagggctggtggcatttaaaagtctaaacatctctgaaaatctgttctaagtgtctaaaagtttttcagtgtgaatgtaaaaattcagacattcagagtattcaccctacaattggctgaagctcttctggctgaaacacaaggtaatcatgcgttcggtttgcaaaatgactgcatattgctgtgagcagctctgcatggcgaagagtattttccctgaaatttggtgccaactctcaactctttccaaatgttttgatacagtcttgcactgacatccttttatgtacagttaggagattcaaactgtacttcgttaattcagcccccaagccccccttggcattccatgacactgttgctgatatgaattccttgtggaccgatagtccgtatggaaagaacaccccggtcctagccccagagagtgaccttggccgatgtagccgcttcacgagaatgtttatggcccgttttggatacagtaattggttctaagacccggtccagcagtgggtttttgtgtttcccacgttgacaattgtgtgtctctaaccatatcttacacctgatacgtcttcatttaaggtaagtttaatgtgtcataaaataaaaatagtagcagagaatattttaaagtggattcacatctagtaatttagtgctcaatgccaagtcgcttcagctgtgtccgactctttgcaaccttagaactgtagcccaccagactcctcagtccatgggcctctccaggtgagaagactggagtaggttgccatgccctcttctaggggatcttcccaacccagggatcaaacctgagtattacagctacctgccttggcaggtgggttctttaccactagtgccgcctgggaagccctttcagtaattttagaataatgttaattacatttgccgaagcactcaatttcaaggtacaggctcttagatctgtaatttagttttctgttggatattattcaggataattaagcaggagctgctgcca

SEQ ID NO: 31710 - DNA, 1332 bp, Bovine  19866881397888
cttctttgctgctgcttagttgcccagccgtgtgcgcctctctgcgaccccgtggacgcctctctgcgaccctgtggactgtggcccgctagggtcctccgtccacggaattctccaagcaagaataccagagtgggttgctatttccttctccaggagatcttcccaacccaggggtcgaacccatgtctcctgcattgcaagcagaccctttcccatctgagccacaagggaagccctgaagcttcttagccagagttttaaagccatctccctgcagatcaggcagcctccggacagctccccattggacctcttatacctggagcatacactcagcatcctttgttaaaagaggagacataatgaacacccccaccagtaacacgtgtgtccttcaccacctagaacagggtccctgcccttcacctgccagacgctactcatgctgaagatcgaggtgtaagtgcatctccccgccagtcttttctcagcccgaagtcacctacagcctgtggttgcgtccaacactcagcgtaacagccgtgcctgggggggccacgccacgcacccacgtctcagccccgacacaggtggtaatctcccaccttgtatgtcttgttttggggtgcctcttcccctcacctgccactgtgtcatgcacagaacggccactgcgtgagtattgatgtatcaacagccactgcgtgatgtgttgatgaagcaatgctattccccattctgtatctcctgcagtttctgcctcaacgcagaatacatcattgcaggtcaactgactgagttgaaaatgtagcacgtcacctaccaaaaatcttgtgttttgtgacccagctcatccactgggatgccagctcgttcaggaagccaccatgtgccaacctggagttaaagttagctgtgtcgacttgggctgggcagacgcagccagggaggaaaagaaaacctcttccaaatcttccccacaaaggacgagcacggagctttggaaatctgtgccacatgagacgttacttcaagtttgttagagatgtaggagggcggcttggaagacaatggaaatgtcgcaaagaatttttcaaatgtggtaaaccctgtgacagcatggtgagcttcgaaaccacttgtgtgaaaggcagggcagcctggttgctaagttagtgacgccaagaagctgagccgtctgggcaggcggaagccaagcacaccattctcttaggatggtcctgcccctgctgagcaggggcctggtgggggttttcatcattgttttcaatttctactgtttttagtataaatttaattcccaatttc

SEQ ID NO: 31711 - DNA, 1060 bp, Bovine  19866880350304
gcctccttagtccttcgataaaccttggtaggtttatggatcctgctggaatccgcaggtattactgcaaaactaactgagcggctttggacctggtgagtgccaagtcagggaagacagtctgtggccgtctgcagacaagaggacgcggttcccagagcagggacggccgctgctgcgggttcgccgcttcctgccaccggcccacggactgagtcacagcgctaagtgctaatgaaggacaacggaaagacagagcgagagagaaaggagagagagaaggagagaccagcgccgggcatgtgtggagatgtggcaagtacgagcctgttcgggatattctaacagcccatctgggcagcatcaactttcctgacacccacaaattggcccatgagattccaaggcaggttatggctcgaaaaagcaatcccacttcatgtttgcaaacactaccccccagcctggttttaaaggcggaaacggtagcaacgagggccggcactccagagccttccattacgcaagctgtgtttgtctcattaaattatttccaatctctctccctgggcagggcggggctgggggggatggacccatccccctcggcactctcaatcagtcctgaagagcagcgagacaacggacatcagcacactcagctattctttatcccgccagaatgaatcagcccccaactggcaatgccagacagtgccgtggggaaggagcctttcataaccgacccggaagggcagctgagtgccactcggaaagcaaggctgggcgggaggaggctgggttctgggaagcatggtctcccatccatgcagaaacagatgaacgccagaaacaggaaaatctcccgttctgaggctaaccaggagtcaaagcctgcctcccaaagaggagtccacaacaggcctctcctggagatgggcccccagctggccatcactgcgggcaaggaacgaaagcacagaactttcaggccggccggtgggcagcagtgcctttctgccacccagggcacgcgtgacgggtgtcatgggggaaagga

SEQ ID NO: 31712 - DNA, 2643 bp, Bovine  19866880355929
tccattgtgttggtgatgccatccaaccatctcatcctctgtcatccccttctcctgccctcaatctttcccagcatcagggtcttttcaaatgagtcagctcttcgcatcaggtggccaaagtactggagtttcagattcaacatcagtccttccagtgaacacccagggctgatctcctttaggatggactggttggatctccttgcagtccaagggactctcaagagtcttctccaacaccacagttcaaaagcatcaattcttcagctctcagctttctttatagtccaactctcacatccatacatgaccactggaaaaaccagtcttaatggatattaaaagacaaaaatttttaaagacatttttaaaaattaaaaaaaaaagagaaccaccataacatcaggtgtctagctgtgtccaatatggaaatggaaaaggaaagaaggaaaatttttgactaaacacattcctctgcctccattaaagagctttttttgcatatcccttcccagtttggaaaaaaataatgaaacaaaactaattttctccatctattaaataaagggaactttaatgcctctaaatatatcaaacaaataaatttagttaggactaaataaattacagataaagatatttgtgttagatcagtaaagactgtttgaaaaatataattttcctttctctcagtctcataccgtctgtcttttttcatgtttttctgatactatatgcctccagcgtgacagtcggaaggaaactatcttggctttcccacattatgctcaattgcgtctgaatcttttgcaaccccatggactgtcgcccatcaggctccctctgtctatgggattttctgggcaagagtactggagcggtttgccatttccttctccaggagatcttccccacccagggatggaacccatgtctcttgtgtctcctgcactgcaggcagattcttaatcactgagtcacctgggaagcctttctcatattatacatttctagaagaaagactgatttaggatctgacgcacatgcttattttttatttcctggaagaaaacaaactagccctgaatttaagcatgctcaaaagtcacaacacttgagaaaagaagctatttatttatttaagggagctacaaagagcccattactttcagacaagtaatttatgcttggtggaattttcataaataaaaattcacttttactaaatattttctcgtgaaaagtaaggttttcttctttggtgcaaagtctgccatgtctattcttaagagtaaggcttgtgaagctacagggagacagataaagtgaacaaactctttaatcagagaggcgcttggcctgcctgtgaaatgcaataccagaaagtaaacaaagagacttttgcggaaaaagagtgagtttaaatggatcttgcttttccaatttgaaaacatgctcacggttgttagtaactgagtcaagacatttaaatcgtacctataattttatatcttgacaatgaccttttacaagtgtgcagtggggataagcagatgagcaaagcgatgctccagaaagagcattgcaggtaattgaacataaaatgtgttgcaatctgataacattaataatatgcaatcccttctttatatctagtgcacagttcatttggtcagagtctaactaaagcactctgtaaacgttagcgcacgaatcttgcagcaaacctatgaggtaagcagctctattttcatgcgttttttaagtatctctgtgaagtgaagtgaaagtcgctcagtcacgtctgattctttgtgaccccatggactacagagtccatggaattctccaggccagaatactggagtgggtagctttcccttctccaggggatcttcccaacccagggattgaacccaggtctcccacattgcaggtggattcttcaccagctgagccacaagggaaactcaagaatattggagtgggtagcctatctcttctccaagggatatcttcccaaccaggaatcgaactggggtctcttgcattgcaggtgggttcttcaccaactgagctatcagggaaacccaagaatctctgtattagtcatttattctgtgtaacagactagtccaaaacttagtagtttcaaacaagtattaaatgtctctgaggggcaggaattgggtgtggcttagctggaaagttctggctccaggtttctagggaagttcctgttgagtgtgagctggggcagctatcatctgaaggctggggtggggctggcagatgctgctttaaggtggtctcacaattctggcaggctagttcaggttgccgacaggaaactgcaagtcttctccacgtggggctgtctatcaggctctttgagcatcttgacggcatgaaagctggctttccctagagtgacctgagagatggagccaggcgggagccaggtgcctttactgatccagccttggagttcatccaccatcatttcctccacattctattcatcagaacccagtgactaagtacagcccacgctgggggacccggggtgggggtgggaagatcaggctccacctcttgcaggaggaccaagatactttaaaaccatagtgacccacagtt

SEQ ID NO: 31713 - DNA, 1712 bp, Bovine  19866880356571
aaacgttactcatctgccatgtttgtggctagggtggagttttatgctgctttttaattaattaatttgagtcacaagcatttgaaatgagactgttttatggagttgaaatttacatttatctccctttttaaagcccatttagcaaattaacaagaaaggagcaacacccaggaagttactgcgcccactcccatgtgtcacatataaaacagcatctgcagaagccgccgtgagggtcagggagattgtctggtgaagaacctggtgggagggcactctctgcaatagtgaaacactattaatatccttaaagtcaggctgcttggggactctgacacagagctgcttaacccttagtgaggccacatctgagctctccacataaggctccctgggactgggtgtggatccagcatctctgtgttaaaggtccgtaacgttcccagcatgatccaagataagttcaagttagaaacacagttcacagaagggaaatcaatgcagctggctgctgatgagttgtagctataatcaaagtgtattcagcagggtctccctctacttaaaacaaacgtaccagaaacagctggtggccaactggtcctcccagaggtttcactgcagagcagacttgtcttagcgccaaatcctgacaacacccagcccagtgcctttggacagaaaggagcaacggaggcagggggtgggacactagccttgagtcaaacatcggaagccaaaaggattttaaaagggggacctttctcccctaggctctttcctggtggcccagatggtaaagaatctgcctgcagtgcaggaaacccaggttcgatccctgggtcagggagatgccctggaaaagggactagcagcccactccagtagtcttgcctggagaattccatggacagagagccttgcgagctgtagtccatggggttgcaaagagatggacacaactgagtgactagcacttcattttctcccaaggactctgttttattgcaaaacttctgtttggaaagatgtatgtaatccaccgcctacctgattcaagctgtccttctccacaatctatctgaatttgtgaagtctgccaacatgtttaagatacttcaacgaagaatgaaaatggcagcaacaataatgaccttggatgccaaggcaggccctaacaggaaagggcacacagatttcccttcttccaatggcggctttcaccgctaccccaactgagagcttgaaattaactcccttggttaataattcaaacccatgggctgggcaagttttaatgtctcaatgttggttcacaattaacccagcaaccgtgttttaaaggtgtttgatttttaattagtctattgattcaccagtctggttaacgatactttattctgtgcttttattcggttgtctactcttacacagaaagaatggcggttactcaggttctgctgtcctctgcacacctccagactagggcccctgccctccccagggacacagggtacataagaacaggagacagaaagcctgaaaaagcccggattctgtgtggccttgggcaagttacaagaacctgtctgtgcctctgtttcttcatctacaaaatgggacggcagcatttacaggaccagagtgaccatctagtgagatgacccatagaaacccctcagatcagcgtctgacacagagtaagcccc

SEQ ID NO: 31714 - DNA, 1603 bp, Bovine  19866880362750
ggagatcctgtgtccactgagttttacatttttttaatttgatgttaaagagaaaccaaacaaacaaaacaacccccaaacccacgtagcctaacttagttttcagaataacgttcattttgtcgtctttcactcttccgtgtaaggtttttggtcccgctctgaagagctgacatcactgaccttccgcctccttttgctttgggcctggtgggattttgaagggggaccattcggaagttcatttgtttttgtatccagcaaactgcaggtgtgggcttctgtgtgcctggccctgtatttgaactgcagggcatcctgagaggagtcaggagacggtctgggggaggaggtaaggagggcaggattatcactcactttagcaccaagtggaaagtagcgagtgtgtgagaggcagaggggcacggcgttagggggctcagaagtgagaggcgcagcttctgggtggggcggccatataggtatttggcattttggagaagagcgttgcatcttggagggtagtcagcttggcatgggaggtacaggcgtggagaggtctcccaaggagaacctgcgtggacagaggtggggaggcctggggaccagctgggcttgactgagtgtaggacacgtcaaggggaatggtgagaaaccccgagggacaggagccctgggggtgggcacggggggctgaccctcccagtgcctgtcctgttggcagacacaagccagcacctggaatggctccgtgcaggcagtctgcacagagttttgaattacatgtgagtttcttattgacacatctgtgggtactttctgggcagcatgtctttatacacatagttctcctttgttcgcgtctcttcggtttaaaatagctctgacgtgtgacttcacatcacaatgaagctgtgtgttatggccagtgaggctttgaagtccactctccatctgcatgaaatgccagctttcaggttgcggcctgaaggcctaaggtattcctcgtgactgtctctggcatcctgagacgtctgaagggcctgctctgagcagctgagatagtcctcacatcgccttcctctctggagaagtatgcagagaggcttgttcaacagctcggtgagtgtggcttcagataaccaagttaacccgtcttcctcttgtcgtttcttgcagatggtcacaagaacaaagaaaatctttgtaggaggactgtctgcgaacaccgtggtggaagatgtgaagcagtatttcgagcagttcggcaaggtaaggggcgtgtggggctggggcagcctcctctgtccttcagagtggctgctatggcccctgcctttgccacaaccgtctcctccagagcctcgtccttggacttggctgtcgagatgtgaatgggattcggcaggagccgagatggaagagcctggcttgtggtgggcacggagccccgtgcgccgacaggaacagacagagcggcctttgagtgcggtttcaccggccttagctggtcgtgtggggcctgggccgggagctgacaggggcagcgccggctagggaagggactctgagctgggagtcacagggcaggagctcccgcaga

SEQ ID NO: 31715 - DNA, 964 bp, Bovine  19866880447843
tgcctcgcgtctctgacccagccagagaagctctaggttgtgaagggaggctccgagcccatccgcgtgttcctgccccctcgacccctgctgcactccacaggtgggcttgccgacccggccagacccccacacccccgcccaagtccctgagggtcaaacgtgggccgagcctggccccggggagtgaagccactcttcccgcagctcccgtaccgtcccagactcgcttcttagcacagacccagaactcctggcactccggctgcaaggaaactggggcttttcctcccacaaggctgcccaagtcactgggtctccaaatcccacctctgacggtgtctggaaaccccagggtgaggcaggaacctctccccggcggccctgtgggctcaggccagagctgggccgtcgccccttgcccccagaccctctgccttcctgagcaggcagggcttctgctgtgcgctgggccccacgaggtctccaggcctcccccagctccccccagccccctagaggaccccacacctcctagacccaggagccatggttcgtagctctgttctcacaccctgtggccagggagctggagaacccaagggagttcagtttgatgtaacagagctcggaggagggtggggccgagggagatgctggtgagggtaccatgaaacagggcattaaaagcctagagggcaaaggccgcaaagacccagaccctcgctggtaagagactggcacagtgaggccctttggaaacgtcagtaaaaaaatccgttccatgcaaactggcactgcctcgagctacaaaggatcccctcccctgagccgcccactgggggttgtttgcaagggccgggggattctcggggctgttgagggccagttagccagagagttgggccggggcgccgggcacctttccttggcttcccgctgcccagccagcctccagagcccc

SEQ ID NO: 31716 - DNA, 1409 bp, Bovine  19866880453077
cattttcttttaaaaagtttttaatgaaatccccccagttaagccacatgggcctagagttttctttgtgggtaagttttaaatgatcaattcaatttctttaacagatattgggtgattcatatttttcactcctttcttgagtcggtcttaggaagttttgtttttcaaagaatttttcaatttcctctggtcactgaatttactactataaactagagtcaaaatgaattgctcactgtatttaaatatcgatttatttttgtctgtgttgggtcttggttgcagcatgtgggacctctcattgagcatctttggttgtgctgtgcgggcttctctcgagttgtgatgagtgggctctgtagttacagcaagcaggcttagtggtccctccacaggtgggatcttagctcccagatcagggatcaaacctgcatcatctgtgttggagggtggattctgaaccaccagatcaccagggaagtcttggattgttcactttaaaatattaatgtgacctttacctcgataaaaatgaacaaataaaaatacatcatggattttctagttctagccatgactcagtagccgttatcagccttaacttcccactctaagtaactataaagacaaacagtgatttcaggccttgggcaagggcttagctgctaccctgacaagacaggtagcacaagaggcaaaccccatattcatcccagctttcttccaaggaaggtggcttccaagcttcagctagggtaggtgcagcccaagcacagaggcgcagctgcactgggtagaaaagcaggggttttgtggaggaaactgaccagagttcagagctgcagagatggtggaaactcaagggtatggagcagagaaaactatagaaagggatcccagaaatctataaagtggttctcttcagggacccagacaactgctatgctaagctgcctatccccagggtgaccattcgcaaggctgctgggggctgagagtcagagctttccgagacttgagaatcctggaggaccccagtattggagtgctgactcagctagagtggagaaacacggggcattcaatggggagcccaggaagactgtttcagggataaggaccatggcccaggagtaatcaaaatactgtaggattaagggaaaggccaaaatagacccaccttagcaaagacccaaaccaagcgtcaacaaggccaaggtgacccatcaaaaatgtaacagcctgctaaaataaaatttaacactctgtagcaaaagacttgaaaaccctatgttacatcgatcgtaataccaagaatgtaatgaaaaattactacccatttttctatgcctataaatattcttgacctttgttctgggattggggttaagttacttagacccagt

SEQ ID NO: 31717 - DNA, 1846 bp, Bovine  19866880465309
tgtatgtaattgtttcaatgactgaactctgccattgcagaatgaaagcagccatagccagtatgtaaacaaatgggcatgaaggcgttccaccaaaactttaaacaggcagtgggttagatttggcttgtggattgcagtttgccaatccctagctttgatgatagattcacataatccaacattcctaaagtacaaacagtgaaaattattcctcccattcctgttcccacaccactgggttccctccttagaagcaattactattaagaggttttgtatcccctttcagagacagttgataaagagcatatttttaagtgactgtgtagcattccaatgtgttacagatagtttaataaatatgaaaggacttaacatatctgaagccatgccctgaaaaaatactaggagtgttgccctgacctgcccaattgactcctccgttagaataatcctttgaactcctgggatttccccaggaattttaggggacatgcctgatgaatatgttgggtgatcccttttggatgtaaaacaagctctgactctcaagggatgcaagattttccaccacagaggagatagagatgcaacctgtggatatctattctctctctcctgtctatcaatcgtcttatctattcatctgtatttattgcaaggaattggcttttgcagtggtaggggtcaggttggcaagtctggaatctgtagtgcaggccataaggaaggacaagctggaaacacttgggtaggagtggaatttcttcgaggaaacctctaggcctttcagctggttggatcaggtccgcccagattatccaggaattttttttttacataaagttaactgattgtagatgttacaacatctacaaagtatcttaacaacaacatctggattagtgtttgaatatctaggtactagagcctagtcaactgatcacacataaaactgatgatcacagattatatccagtcaacctgacaccaatacacatctccttaaaccacatttaatctccttataaagacagtaaaaaagtcatgcttccacctaacatgatacatttatcctgtgtatgactgaaaatatactaacacttcccccaaaagaggaggccaagtccttggatgatgttaataatcctgtaacttcactctgatgctgggagggattgggggcaggaggagaagggggacaacagaggatgagatggctggatggcatcactgactcgatggacgtgagtttgagtgaactccgggagttggtgatggacagggaggcctggcatgctgggattcatggggtcgagaagagttggacatgactgagcgactgaactgaactgaactgaacttcactaatgtaaagttagcttttattaatacattttatattagatggcaaggagataagagagggaagaaaaaatacacagacgtattcacgataaaataaggaataaatactcatacagtcctcatttctgaaattggttaggtggtcataactggtatttacaactactgtcttctgctgtccactctgtatttcctttaccctcagcaagcacctcattactggttgtgtgttttgtttttgtttttgtttttttcctggtgggatgcccccaaacatccattcttgaagggtttgtgccattagaaatcttgacttatggattgttacagtattccattgactttagtcacaggttatgatagtgctaagagatgccctaaggggtctcctgtattccagacatgctttcccttatctctattatgtggtcgcagccccctttcccctggagccagtatcaatccccccagccag

SEQ ID NO: 31718 - DNA, 875 bp, Bovine  19866880520146
tgactgcacacgctctgagcccagggcagaggctgcaggactggaaagtcttcctggggagatggaggcaaaccatggcctcctctttggatgttactggttccctccctcccctcctcatgaagctgtgccaataacctccataccaggaatgccacctctctcaccccacctgccctgcacccccttctccctttaccttcaccaaccagaaggacaaatgccaaccttcaccaggaccaaacgtaccccctcatctgcagaccgaggatctcaaggtccgaatccctttccataccatatttcatttcccctctggccatgcagatagggctgccacatgaacctgtatccctgaaggtgagctggaaaaggactctaataagagtagtgggcttggagaagcccggctgttagaccttttgaagtgaggaaagacctgatctattcaagaaccatgaagaagacgaggacaaggaagaactgtaagactcctttcaacctggattctatcctcgttcgctacagttggacactatcgagagagatctccgtcgggaaggttacagctgagtgtggtgacccagttccgggctaggggagcgaggagtgtgaggggaggtggtggtggcggatggcgagaacatggatccaagcccttcggcaacattgaaaatatggagccccttctctccctggcccccaggctatctatcctgcagacagtcgtgctgtgccgagccgtccgaggccctgtaatatcaactcaacaatgcatgttctacaactacggctacggctaccaggacatctactacagtgcatgcatttagttcagtcccacagaaacatacagtctaagaacaggcaggggg

SEQ ID NO: 31719 - DNA, 1772 bp, Bovine  19866880542135
ggagaccccagttggattcctgggttgggaagatcccctggagaggggataggctaccaactccagtagtcttgggcttccctggtggttcagctggtaaagaatctgcctgcaatgtgggagacctgggttcaatccctgggttgggaagatcccctagagaagagaaaggctacccactccaggattttggcctggagaactccatggactgtatagtccatgggatcacaaagagtcgggcacaactgagcgacttgcgctttcccttcactttcctcctggctgagggctctctgcccctctcagctattctcttggtaggatctctgactattctaggcatccctctttcactcactcacaagctctcatgtttaccccaacaactctgtgagtatagttactttccaaaagtaaactctaccctgccatctttcttgctgttttggtttcgcagtccctccctgctttctagcatctccagggtgtggtatgaggtggtgggagcagatttcttcaagaacggactgagacatcactggggactcctgcaggatgaggcaagtgccaaagaaatttggaaacttggactgtatgtggtcttgagcaatttacctctctgagtcttggtttctacatctgtagaatgagaacaggaagccctatgttccttatagctgagatcctatgaagtgctttttgagaaatgggtcataagggtcaggaattggggactgttgagtcccccccaccctggactgtgtggaccttgacgtcagacactgagtcatgttgtttttctcctatctcaaggcgagtacagtttattaggtggaatggtagtgctgctgcctgtgtctctttggaacacctgcggtgtggatttgctttgcagagttgcctgtttatttcacatgtgctctctgtcaggccaaatccagagaaagtgagggcaggaccggtgcttctccaacttcatcacatccgagatatcctacaccaaagccctttcgtattgatgtggttacctggtttcattttccaaggtatttttttccaagatgtcgaacccagttctctttacttctgcttttgctgtggcaccagttctcatttctgaaagttttcttgcttttcccctcactccttcaataatgttgttttcatcttcacttgcctctgggtttttggtgtgccctgtgaactgtattcacttgctcagacaggggtgtggaggaagcgtaggccaggaaaccctagcaacctccagctaacatgcgggagcctttcactttgtgattactgcaattgttgcctagtggaacagtgagccattagctgggttctcacccccctattagcgttaccctgtaatttaatcacaattagactcccagagacatagacataggaaaccagtaggcaaaggaggtagatggcagaaagtaacagcagccagggcttttcatcaaaggcactgttttccgaaggtgcagggctaaggaagagtgaggtcggagcttggcaggaggcgactgggtaaacggtttaaaggacttgagttttactttctggctttgaggttgggagtctgtgaacattgatctcatgtgctgggctgaaccaatttgtttaatagcaatcgaaaaaacatcttgaaagatgaccccctgcacccttcaccttctctccttgtggtctgtgagaggaaggtctcagatgaggcctttcttcatctcacctggtttttctccccttgtgtcccaaag

SEQ ID NO: 31720 - DNA, 701 bp, Bovine  19866880579973
ctattgtgataattaaatgagctttgcaaattgcctattaagctccagtaaatggtagctattacagtcatcattatttcagggggaagacatttcatagcctagactctgatatttacgtgtggaatcagaatccctgagcaagatgtcctgcctgcctttatgtaagtaaactgcatctccaggatagacaccccacaccctttaacgcctatggcaagtgtccattttatgaattcacaactgctctctgatgaacacgggggtttgttttaagttaaatgggaaaatgaattaaaggattcgtttaaagtgaattaaaacataattaaaagtagaaaaaaatagggccagtaaaagagtcttgctaatggggaaagaacattctggtcatagtaggacttaggagccttcctgaagagtttaagaaatgtccttaatgccactgaattgtttatcaaaaaaagtggttaaaatggcaaatgcaatttctattttattaccaaagaaagaattggggagaaattaagcaggctgtcttgttgcttatttaaggcatgggcttgagtcaacatagagaaaccttcaggtggatgcaaactagaattttctgagtcttggaatgaaggaagtgcctagcccactcagcacctcgctggctgcagcctcccaggagtcagtggaccaagcaggggtttggg

SEQ ID NO: 31721 - DNA, 2201 bp, Bovine  19866880590053
tgctaaccgttcatagcaaaattaaaaaaaaaattatctggactgtttctaattccttacctcctgttctctgtcacataccccatcagtgagactcgtgtccctaccatgacagtaaaaccacatttttcaaggtctccagggacttctgggattcagtggtcaattctctgttctcatttaactcatcagcaacaattcaagtcatttgatcattcacttcatgaaacagtttctcagttgcttccaaacaccagagtttttcaatcttcctcctacttcaccagctgttccttttccattttccttcctggattccctttcccccttttcacaagctctaagactggagtgctccagggcccagtgtcctactcccctcctctctttaatgccttgcctttctcttctcctcttagtccttcctcctgggtgcttatctagccccacggctttaacaccatccatgtgctccgggagttggtgatggacagggaggcctggcgtgctgcaattcatggggtcgtaaagagttggacacgactgagcgactgaactgaactgactgatatgctgcagaccccttatttatgtttctaatccagagcctctccccagagcccagtatgaataaaggcaacttcctctctttttagcatatttctctccacctctctgcagtttcaccttcttctcctggtatttggcttattcctactcaagggtgactggtaggattaaaacattcaatagcgttcagcagtgccttgcacagaatttggaaatattcatcaaatataactaaatgactcctttcagggcaatatttccatttggcctaaaggcaaagttgtaagtcttcaatgatgaaatttcagatatgagcagatatgattttattctaatcaggcctgggatggaaatgggggatgtgggtagatttttttggagtgagaagctttttcagaatagctcagatcatgctgattgctggctcagtcttccggtggcgtgtactgggtatttctctatcttttttggtcttgtggtcagagtaaggtaaactggccacacagtgcagcagagtcccaccctgaattttagcgcttcctgtctggttggggttgtccctcagttaggtcacagtagtgacaactggtgtattcattgtcactgagcttttcagagagacactgttctttagccactgactaaatccttaacttggcccaaaatggtattaataggtgttccagaccaaaggtacaagttagaccttgacatctggctgaatcactattgaaagttttacatgccagaacctccataaaataagagtgtaatcctccttcacctctccagtccatagcgatgagagtccatgaggtgataaagctatataagacaggggccctgaatcgtccaggtgctgtcactccaggcaatgaggagagctggatgaaggagctgtttataggctgcagagaagcaacaagggtaaggaagccaggaaaggtggtaagacactcagggaccggcaacaacaggaactcactagcacctccaggctgcaggggaaagtggggagtagtgaccagagcccgccggaggagagtagttgggagagggcctagggttggagcctgggccaaccatcaatccagcaatgggggagctggcagaataaacatcccaacctctgccttcccatctcttgtcaatggctcccactggccaagcccaacaaggaaccagagggcaagggatgctcttgatacagacccccacaggtcagcctcctggacctcacatgctgtggggcaactaagtctatgtgctacaactaaagagcctgcatgcctgtccaaaaaaagagcaaaagacagatggaatgtgtgatggttaattttatgtgtcagtttgattgggataaaggatgcccagatagccagtaaaacattatttctggatgtgtctgtgaggatgtttctggaagagattagcatttagaatcaatagactgagtaaagaagatctgctttcaccagtgtaggtgggcatcacccagttcaactgaaaagtgaaaaagtggaggaagggcgaattccccgtctctttttgagctgggacgtccaccttctcctgcccttggacatagtaactcctggttcttgagcctttggactccaggagtcatccag

SEQ ID NO: 31722 - DNA, 1707 bp, Bovine  19866880626512
gtctggaagtctgaagaactccgctctgcctttaaccgcagtgtgaccttggcaggtaccagcctccctggcctttcagtcctgatttgcacggaggcaagaagattcgaccagttcacaaatctcaggcgtggggcccaaactggacctgccgacaggttttgtttagtgtgtgcactggttttctatttgaatgcattgccaacgcttaaaatagggagcgtttgggtgaaaacccaggtctccagaattacatgaaaaacgggaagatctgatggatttggacttcccttcttatagggcaacgtgagcaagggctggggccttgatgcccttgggcaagcttgtgccccccacgagggctcacattcagcgtgctaccctggttcacatcttttcttggcccctccgggtaggttccatgtcaccaaagcctccatccatctgacgtgatgcgagtgtttcatcgcttgcctgttcgccactctttgaaagggctggaaagcaccgcttgcattatgactccctacagcagccgctgtgggtgggcttccgaagtaccgagtgtctgagtcggacatggaaccgtgagaagaggggagctggtgctttgcgttgctgtgccctggctgtttggtcttgtcttgttgcttctgctgctactggtaggcagaaagtttggagacagcttgcaagacgttctttttcattctttttcagcatcagttgaccctcctgtgaaagaggacagaagcctcggggatggatggaccctggtgtggatttccagaattccttttggacacatctctgcctgttccttttgacaaagtccttgcttttcagagattaattgttgtcagatgcaacttattttctaatccttttgggctccattttaaaccttctgctttattttaccttttctgataaagtcgctgagattcggtctttcttttctcttacggatttgccaatgattgtctgctttgacaaattggattcttaaagccgattctttgaagaaaaggatgtcgtgtgacaagacaagaaacagctcatcctcaaatcgggaggataaataaaaaaataaaagcaaccccattctctggcttcccagtgactcaaagggtgtctcagctgtcactgataatctaatctttctatgataggtgaggaagaggacaatggtgacccagccaggctgtgagtgtgataggcctctgattaatagcactgtccaatacctccccagcccccaggaaggtgattaatgacatttgacgtgaactctgacctcccccggcaagaacagagggagaagacagagctgctcagacaggagggggtcctgccgagcctgattgattcctggaggctttgactctgagggggagaagggggtgccgggggtggtctggacacccttgctccctgttcctgggctccggcaggcaccctagcctagcagctttcacaatgaccatctctcccgtggcccagacttttcactgcccctataacactgcgtctcacaagcaattccctgcgaagccttggccgacctccactgacctgtcatccctaacccatgaggtcatttcgacccatccccgacccaggtgccatgaatcaaaccaaggaggatttttgtttttaatttctgctctatttttaaaaagaatacttatttttaaatttaattta

SEQ ID NO: 31723 - DNA, 3837 bp, Bovine  19866880636065
gaggtggcagaaagagccggccttcctgaccccccaccctcccccaactcaactctgattgcccccagcagccagaaagagatgcttaaaacactaacatgatcccgccaccctcgtgcttgaacccctgggtgcaggataaggtcagagctccttggaggacccacgagggcttcctctgtctgccggcctctcagactcaccaggccttttcacacttcctggagttctctcggatgggcccccgtctcctgcctccaggccttgctttgcatgtgctgttgcctttgcctggaatgccctcctgtcctccgcttcggcagattatagcttggacctcagctcctctaggctgccttccctgcaccctgccctgtgtctatacctgcccccagactctgatctccttgggaggtcagggtagcagggtcctcgtttctgtatcacacacggttcagcacctgtctgcttcaggtggctcctaaatgctagaaatgtacgtctcggatggagagactgcatgaggccctgggggtgtgggtggggggtgggaatctgggccatctgggcctagcagggccagcccagagcaaagcgacaggtgttcagaggtggggcctgcctcttctgcacaccagcctctgagagcagccttaaccctggtctcggtgttcaccgtcagagctgacttcagaggcccactgtgcagctggggtgggacgtctgctgacacgtctggttcatacctgggcctgtgctaagtcccccagcacagcatctcattcaaccctcaccagagtgccgagacggggatgagtgttcccacttcacagatgaggcaaatggagcccagagagggtaggcagtgagccaaaggcacctcaagaatcagaagttagacggctgagggagggggaggtgggggaacacggcctctgtctgactccacaactcataggctctctttcctggatccacccccagcccagcaaaagccttcctttccagatcaggcccctgaacctcaggcaagggcagtagctcgtccacagtcacggggtgtgagtgaggcttctggagccttggtctagtgtggaggtctcttcgtccccaccggggctcctatcatgaggctgcatggcctctgccctcctccacccacaataccgggggagggggagaaggatgcagctgggatatccatgcccagtttacagtgggatactgtccctgatgggctaagttttccattctgaaaaataggtagaactattctgcccaatagaaactgaacttttttttttttttgcaaaaccatcttggaatattaaaaaaatgtcaaaggaaaatcatttagccctggtcatcgtgacccatcctgggctgcaagtcctacgaagatttcacccagactatccacttatgcctccctcattacagcctcagctctgcttctgtccctgacttcaaacaatactccccaccccaacaacttcacaggccactatccgctccctgagctacaatcacagaggtttttctcattaggggatgacaggacacaaccgaggatggcattcattggctctggagtcagaatgacctgggttcaggttcgagctctgtggtcttagggaagttacgaaacctctctggggctcagtctcctcatctataaaatggggatgacaccagtgcctgcctcacagctgttagatggtttgaatgccatcatataggtaaagaaccttgccattttctggcattcgaagggtgcttaataatggtagttgttattgttagctatgcctgaatgatcacaaagttttccaccactactgcctaggactcccaagatccccagaaggcaagatcagtccccaaggactgtcccatcagtccccctacccctccccatcccaggcctcagtcattctcaggacgagcagctccaggacaaagagaagcctgggctccaacagccacctcaaacgcttgttgttgctatttagtcgctaactcatatccaactctgcaaccccatgggctgtagcccgccaggctcctctgtccatggggttttccaggcaagaatactgcagtgcgttgccatttccttctccaggggatcttcctgacccagggatcgaacccgagtcttctgcattggcaggcggattctttaccacctgagccaccagggaaagtgtgttagtcggtcagtcgtgtccgactctttgtgaccccgtggactgtaggctgccaggctcctctgtccgtgggatttcccaggcaaggataccggaagccccacctcaaatgcagagcccagaaaaacaagcacttcagagaccagcttcatgttaaacttctaaattacagagtccctgacctggaaaaagtctccaggcacctagcagtctactgttctgcttctgcttatcaaattaccctagaaaaagagacttacttgctcatccccacaatctccctagaaccccaaatcattgattactgacgactgtctgggagtgagcgctgtgttgcagaggattctgaggttccggcttacctgagccggcaagagcacggtgatcagttagtgatgtctgccacgggcacaggaggggaagcgtcagtacacctccagctgtctgtcatccccactctgtgcctccctcgactacagactcccagaaagtgaaggctgagctttgtttaactccatgtcctgccgaatgttcagcacagccccagcccagagtaggaatgcagtggctgtctgttcttagactccttagagcttgaaaattcttcttgggttctagctaaagtgtgttttgctgcagtagaagcctgttctgggtggaatacggagggaaccagccaaggtgccctctgggcttgttgtactcaatcccaaccctgatcttcctcccccttgccctgcactctcgggggagattcttaccggggaggtggagttgggggagccagggggtaaggcctgtccaacacgtgcatgtggtaggcaggtggggagtacacaggcgggggctcctcgtcagagctatcgggttccaaggtcctctccaaaacctgcatcagagacaacaaagaaagaaatattaacaccccttccttgaactgaaataacatgtagacaaaaaatcaagtgtgggcgaggatgtgtagtcagggaactccactactgctggtgggggtggaaagtgatacaactactgctctgcaaaactgtctggcttcctgcactggcactcagcacatgggctaccttgggagcccacgattccaacacacacagcagacgcgaatgcacacgtccccggaggaatgctcagagccatccaaaaaaggttcaaaaccaggcaaaacaacttcacagggatggcaggtggagcagtgtgacctctggggatggggaggctgagagggggcatgagggggattccaggctctgctgatgcttcttgacccgggtgctgatgaaccttcactgcccacttgtgccttgtgaaaatgcttctgttcatgtgttacttttcgtaaatagctttaacatcattcctatcttctctcaaagaatttccacatcgattaactcaccttaagctcaaacaacttggcaaagtaggttatggatcacccccattttacagatgaggaaactgaggcacaggctgactgatgaacacggcaaaagctacacactgtttctagaactgagtctctaacttggatgtggtgtctacagcaggagtctctccttcaaacacaatgcggcatgcccaggtggattctcagggcagagaacag

SEQ ID NO: 31724 - DNA, 700 bp, Bovine  19866880668962
atcgacacgcgtctctgtatccccgcacaggctgcatcgggaggggaaggggctcggcgagccagctcgcacacctgagcctccgggggccaggggagtgggggcggagcagggagcgatctcaagtgtgggggtgacaatgtgacagaaacgacactctccctccaaactagtgccgaggagctgctcaagaccggacgctctaaattaatatcaagccacatgggtgccacttgccagaggggagccaatttctcaactggaaaggtgcttttctttctcgttctgcctgaggatgctctagccaatgcctgaccttgaaatgtgagcatcaaccttctaaaggtcggatgctgaccgtgaaccagcaagcatttcattaaggcttcggtacaagtaggcttttcatccggccaccataggctcaggaccatctatggaggtcccgagaccataaaccaaactgggggtgaaagtgaacggtgctcctaacccagtgtttctcagtgtggccctcgtggtctcctgctgggtgagggggtttgttagaaatgcaggcccccaggctctgtctgcctccaaatgggggcgctgtgggtgtggcccgggaatctgcatcttaactggctctctggggattctgatgctcccccaagtctgactctgctttatgcttccccattcaggatgagccaagtgg

SEQ ID NO: 31725 - DNA, 1664 bp, Bovine  19866880674132
ctgccctgattggatttcccgagggcctctcccagcaaatgttttagaagcagagtcgactccaccccctgtgccttccccgcaggaattttgtcatcttgtctaaaccgactttcagctggcgcttagtctcttctccgccccagaggagtaaataaagaaacaaagcaatgctccttgtgcaccttgggatctggccctttcaaggaatctctttgtcaagcaaagaatccttttgtaaagtgaataatgactcactttggacttcggttgggattttttgttgttgttcagggtctttctcaagagtgggggccaggctaatttgtaggcttgggggcgggcggggcggggtggggtgggggcagggccaccgagtcctcacagcagctgaaagcgctctcggtttggctgctgatcttctgattacccttctttcttccagtgtcttcctgtcagggctctggcccatcgacatcgatcacgcaagcccggaaggtggtgacggtttgtgtttcttgctctgttttgttcctttgcttcactgatcgcgtctccatggaaacaggcgcagcctttgtgttcctcttgctttgggcaaatcaatgccaactggggatttttctttgctctccaccttctttgggatcaaagggaaaggtgggggccaggcaggaggacctgcagcgtcctggagctcctggagtgggggactcctcccccagggaccatagggtcagtcctccagtcggggacccctgcctggcctgacctgtgttgggggtgcagtgagtgtcatgaggtcctgggtggagcatgtacgctgtggtttatggacactcaacaccccaccccgggccccctcgacttcagaggtggctactggccactgggaacaggaggctggtaggaaggccgctcctgctggcaggtactttgggtgagggctttaatctttccagggcttggtttctcgcgagagggtggagaggttttgaacccctttggtcctgggaccccttaaggaagccccacgtctaggtaaactgcaaaatcactgtcatatgattgttcgatggtgaatagtaaattctgtgtttgattcaaaccagtaagttgtgtagtttgacatgaaacttcagaatcaggaacccctctctagactagactgaacatcccgtgtgtgatccaggccccccggccccccgcccccagggtgtccggcgttccaggactgatcgtgacctactaggggagacttctgttccaggccaaggcaaaagcgttggcctgagcaaccagggaacaacaacagatgggctctgtgtcctcggagacctcccagtgggcgtgcccacacaggacggggcttcctgagcgggttgcctaccacactcccatggtcatctcggtcactgctggcttgacgaactatgttattcaacaggcgaaacaggaggcttctatccatcagtaccacactcgtgccaactttatactcactgactaaaactgccaactccacacgtcatttcaatatcagaactttctaccccatctgtttgtcaaatttcgcaaagcgttttttgaaaaaagtatttatttattttggctgtgccgagtcttagctgtggcatgcgagctcttcattgtggcacatgggg

SEQ ID NO: 31726 - DNA, 1798 bp, Bovine  19866880688733
cgtctgtggttgtttttggctgcttggcacttgaaacctctctctgtgtttgagtctcgaaaggcctccctcctgctcctgctgagcctggctgctgggacagaccgtgaacctgggctgggccagtggaagtctgccccaggggccaggagggcagagaaggagggcagttcagaatctgttctggagtcagcagcacacagagcccagggtccactaataccaacagctgccccctgaccacatcattcttcagctgtcccttggttggactgtggctgaccgcctagctcctcagttccttcctgtcccccagccttcctggcagttctgtgcattgcccaagccccttccaataatctcctttactgctgacaacagtcagaggtatttctgttgctttgtcaccaaaatgctggtagaaagctgctctgatgggcgggtttaggacagtctccactccctccagccataaggatgatagtgacaggtttccacatgtatccccgtggctccaaacagcaacgtaaataccctagacaggatctggggggacatcatctgcctttaaggtggcttctcacaagttacaagcattttctgaccctgtaggtgatggctgaagaccaggaccattcatgaaattccagcttgggagcctcaacatgagttagggttggcaggtcttcctgctgcctgctctgagtgcttttatgcctcatgtgtgcatgctaagtcgcttcagtcgtctccaactctttgcaacccagtggactatagcctgccaggctcctctgtccatgggactctccagacaagaatacccgagtgggttgccatgccgtcctccaggggatcttcttgacccagggatcgcacttgcatttcctgcattacaggtggattctttaccgccgagccactggggaagcccctcggaggttcagaagtgggcctcacccttcctcacttctctgcttattggagtcacagcttctgccttgaccggaggatctgtcaagagccgggacagaagcttactggactgcacatcaggaggcgggttctccagccctgcctctggcccagggccatgccatggggggtgaccccctttccttggggtgactgagtcgtgccatctgtagggacctttgcaggtcccctgcggtgctaattctcaccagagaccccaattctcaacagaaaccagtggtggctcctttcctttgctttggccagagcctttctaaatctgccatcgcaactcactggccaatcgatcaaaacctgtttacaccccaaaagggtcttattgcttgctctttccccatgaggtttttctcccagcacctggttcctggttggcagccggctgcccagaccagccagggtgacctggcagctttaccctgactacagaggaacagaccccagtgagtccgctgagctctggcacccgacgggcaaagggtgacagagatggggacttgggtgcctcaagtggacacacacacactggctccttccttggtatctatttcatgggtggtctgcccaagtctcctccaaattaatcacctgctatcaaatcagatcattcagcactagatttcttaccattatttcaacaatattgataagtggattatatgcaaacagccaaatcaccactgctgaggggttttcctagtgaaaaatggctcctctgcctctaactttagcactggggtcttacatatttcagtgttaacatgatggcaaattacaagcctatgtgtgaccgctgagactccct

SEQ ID NO: 31727 - DNA, 1074 bp, Bovine  19866880703738
gccccacgcccttccctgcaaaaccggggtgccctggggccataaaacacctcctcaggctcggagccgggcagcagggcttctgcgggtgtcggcacccccagtcctgtccccgtctcggggactgcatctgggtaacactcttcagctcacaggaagccaaccctggggcagccagaacccagggcccactgggccagctcagtgctacccagagacgcccccaaagggaccagccaaagggaagcatgggacagctttttggtccacaaagtgtctgcccgtgagctgctgcgtctgggaagaagcggcatcagttttccaatgccaaggtcggttgtctggctgttctggcccagatgatgggatagcatctgcccaacggaggcagggggagaagacatgcaatgcttttgtgcccttacacttgctgatcccttgatgtggaatacccttccttcatctcctgcctggcaaacttctactcatacctgaaaacccatccagatggtactccttcccgacagctttccagcagttactcctcctgcgcccccgcccagtcagaccccagagggatacgtctggccacttgtgtgacacccctgcagactctgacttcctcactgggcttaggatcccttcctgacccccagagtgggtcctgatgtcacggtctagcccaccgcacagactgccctctgctgttccacccccagctgaaggcgcaggagcgcaggtggtgactgacaccattggttgcggcttctcaggggcaggggatccaagcggacgcggactcagggcaaagttctccaggcaggactctgcgctgccttttcaggctggggggaggggacagcgcccctcctggccaccctggcttggaggcacgagctgcccacccctcaggcctggcactgccgtctgcccacaacctcacactctgtaatttgttgttgctgttgttttgggtttttttaagctgcagtctttcattggcttttgctgatggaaattaaaactgaagggcttgaagaaaggtgattatgttcctgctggcgggcttactgg

SEQ ID NO: 31728 - DNA, 1015 bp, Bovine  19866880707492
cccccccccaccccccacacacacacccagaggtgaggagttccagccacaggtgcccagggcaaggtcatggtccagagaagatttgcagatgttttccctgctaccactgagggcagatgggcccagggcagagggaaatgccaaggataggtaggagggagaaggctgttgtgaggagcaccccctggaattcaaggaagtgcatggaacccgtattgtctggttcttcaagatggacgagttgtagtccagaactggccagccccagattcaccttgaacttcaaaagtcaatgagaaattacttttacagtataaaaaatgttttttgttgttgttgttctatcatggaaaataaaagatttaagctactaaaggggactgaagaagagacacagttaacctggttgacaagctgtggtcctcgctggggcgggaacgatggaacttggggagagtagaggcaggggcctgcggcagtgtctcctcaccctgccccctccccaccaccaatccctgaggaacatgtgggtgtgaagtctcgtttccttgtagcaaaggcccagtcctcgttcttctttctgatagtctggagtctatctgaagataaccagcagaacgcaggcttttcggtcagatacgctttcgtggtaatttggttcagtcagtatgctctgaattcatacttctttgtctttttttttttaaacaaaaggaaaaaaaaaaagtttaaatccccccctttccttctactgcaggaggtgagtgtgtgggtgtcctgtagcgtcattggcgttcaccagctttggcccagaacctccagattctccatccccaccccatccctccctccatcccctgctctccaccccaaaagggaaccctctgccaccatcattacggttatgttaagatgcccaagtcttccatgacatatcccatcctccgaccacgctcagtattgacgactttcattcagggatataaacgggaggggtggggagggagggaat

SEQ ID NO: 31729 - DNA, 1284 bp, Bovine  19866880714721
gtgatgtgtgggcatgtaaaaagctgaggaatgcctgctagaagactgttctgcgaggaggcacctgggagagtgtcctcttttgagcagcataggtgctgtgtttgtagagggctttaggacagtgtttctcaaactgaggtgaaggaccggtggcttatttcatttatctggggacggatatgtgccccaatgaacacgaccatcacaagtctgacatgtccaggctgatctgtatgctttctctattcagagagacaagtctgccgtgacacgcttgagtgtgtaactatcaaattgctggaacttctctaaagccttctttactctctcttcctgtacttatctctccaaggacctacaacaaacagtttggtctgcagatctgctttaagtgatcttggtctcaggtcccatcttcagggtcagacagacttgaatcctggttctgttacttcctcgctgtgtgtttttgggcagctgtttaacctctctgagtcttaattttgttgtctgtaagtcagagataataatccccatgcctcatagggttggagttaggattaaatgagaaagcgtgggtgaagcatggaaggtgtacttgataatgtgctgtgctgtgctgtgcttagtcgctcagtcgtgtctgactctttgtgaccccatggactgtagcccgccaggctcctctgttcatggggattctccaggcaagaatactggagtgagttgcagttgccatgccctcctccagggaatcttctcaacccagggatcaaacccaggtcttccgccctgcaggtggaatctttaccgtctgagccactagtgaagccaaagaatactggagtgggttgccatctcttcctcaagggaatgttcccaaaccagagactgaacccaggtctcccgcattgcaggcatattctttaccatctgagccaccagggaagcccaagaatactggagtgggtagcctatcctttctccaggggatctttccgacccaggaattgaaccagggtctcctgcattgcaggcggtttctttaccagctgagctaccaggggagctcatgcttgacaatattggctgtcaaatgtgggcaacagcaccattgttattggttgctgtcttggagcatctgaaaatgaggacagtggccccagttaaggggtaccattggttttaaaaatatgtatttattttctttggctgggctgggccattatttgtggtatgcaggatctttttagctgcggcatgtggggatctagttcccag

SEQ ID NO: 31730 - DNA, 754 bp, Bovine  19866880716654
agcctactgttcctgctgaagtcactcaggtccccaagcacctctgctctggggagggtgcccctgagctcctctgtgtgtgggccctccctctccaggcttctggaatgacctccctttccattgcctagaaacccccactcattttagagggtcctctcacacgtctcttcccctgtcttggagcctctctcacgtcttcctttttttcgagcagtatcagctctcacgtttccctccgtgaccctccactggttgctttatgattgttgacatgtcatttcccgggtccttcttggaccggtcccgtgtgctctgctggaggtttagacactgaggacaggactatatatgtcactgctgtcctgtagaactttgtacaatgaaatatacattccgtgccgtccgatgcgtatggcccctgagcatttgaaatggagctcgagcagctgaattgttaatgacaaataatttaagtgtaagtaaccacatgtggctagtggctgtcgtgttggacgttgcacatgtgtggttgtttatctgtattttcagaaaccctaggactgtgctctgcatgcaaaacaagcctcgtaagtactgctgaaggaaacaggaatcactgaggtgtggagttatattagctgtgtgttctttgcccattttccatgcagtttgatttttaagttggattcggtggtttatatacttgagcaccaccaatgctttggggcatacaaagatgaataaacatggt

SEQ ID NO: 31731 - DNA, 1125 bp, Bovine  19866880727942
ccactctcatcagcaaggtgcgccaaggcagcctcccaggcggcactgtttggggagaaagctgatggtggcagcagcagctgttcttctcatttctgggaacctgcaagggcatttcaaagtgaagagaaacctcagcctccagcacgtgccccaattctgccacaagctaggtgtttatcctcgttggtgtgtgtgttgggggggtgctctgccagagacgggggctgggcccagcttcatttctcaattcaagaaaagcaaagcaaagcgcggcttgagcgtcggctcacgcgtccccgggaagccgggcagagcaggtgagcagagtccaaggaagggagcagcctcctccaggctgcgggccctccccctgcacccatgggtggcgtgtgcaggaaggcggggccagcgcgcacggataagccggaggctctgggcacctagacaccaagaagctgctccgcgctcccccgcccctcttcagtgacctccccagaggacacatcaagggcaaaggagccagaactcaggcaacgggacgccacctccctgcaggaaaaatcacttctgcctaaacagggacgaacatttcccacccaaccaccatggccctccccgccgcccccacctccctcgacacagagcgccctctgctcgcgtcaacagagctggtgcacaaacagcgtatgcggatgggtcgcgcgcatgcgtgatgggctggagggttgggggctggggggaggaccgctccctctccagcgtaaacacaagattcatttattaagtgcctctctggcatttcctgttgttgtttttttttgccttcatcctgcttgtttaatattgcatttgacattctcattttataaatggtaacagaagcagaatggatagctaaaattagcttacgagtgaggacgatgctgcaaatagggtagtgaacacagaagcccagttaattccatccgcccctcctctccctccccctcatgctggggctggttcccagtggagctcagtcctcaggctgagggcgggcagctggagggaggcgatggtctgggtctctgcagcaccctggcagggtcagcgcccaccccggcctggggcctcctcggattc

SEQ ID NO: 31732 - DNA, 1506 bp, Bovine  19866880738229
cataactaagcaaaactagttatctaatttagttttaattcgtctgaggataattccttcatatgtgaagaataaacgtattccctttcccatctaaagaataaatcagtgacaggtagagagtgtgtgtattgcaaccccccaggattcttatttctgggactgccttttacctgatgctttggacgcattttcactggcttgaattgagtacttgccatctgctgtcagcattcactgctgaataaaaggggaggaagggggagagaaagtgaaatgagagattgtggggtgggtgaggagtgaggaagctggaaaaataagaggaaacagctgggagctaggaagttgtggagggacttaatgtaaggtcagtaaaacagcttgcagaggacagggtcaggcctaggggtaaaaggctaattaacttctgtcaactagttgagtagagccttgtgtgctttgttttggagactaaaattacttcagaggaaacatctagattctctgaatctgatccattttccctgtgtatcatagtaaattattcaccaagtcagaatctatcctgctctctaggaattgtcctctttaggtctagcaaagagcttgctgccacagttcaggcaatcaagggtgaaatgcttcacatagtattagtggatagcaggtaagctttatgttttagtacacaacttaaggattaaatgctgactacaactgttgtttcagttcagttcagtcgctcagtcgtgtccgactttgcgaccccatgaatcgcagcacaccaggcctccctgtccattaccaactcctggagttcactcagactcacgtcagtgatgccatagtttaaagagcagcttgccaggttccctgcacctgcttatatactgggccagatgactgactgtagaactttaggcagcttctgtaatagttcagagacttctcagagtcaagaaacatccttaaagaagcaaatctagagctcatgccagatcttaacgctgttctggccttgtgttgccatctcggtattgctgtctagagtggagcaacctacctaaagcttagtctaagttttgtgatgccacctcagtgtcttaggtcaccactgctcatgtccctcactgagggaacatactgaataggttcctcaaaacctgcgtcattatttcctgtttctttcactgtgaagaatagagggatcctcagctgaagatcaaattgacccaatgaggcttttttttaatctaggccaatgaaaggaagaggaaggagcccgaattcagaaagagggagtcataatataagatctgcaatgtattaacatggtaactctttgaagactaagagaaacagaatcctatttgaattctgaactatggagtctgagatgaagacgaaattgagatgtttctattggaatttgggtaaagagcgtttactcagtatgtatgttcttgctctgccccagtgttcacaagagcatctggacaggca

SEQ ID NO: 31733 - DNA, 1320 bp, Bovine  19866880748419
taaggagacatatgtctgttcttatgaagaaataaagtaaaaaacctaaatacagtataataaatgctaatttgtgagcaactaatgtgttcttgtgttcactgataagctgtgtgcttaaaagaaatttataaaaggagacaagtcgtttgtcggcaaaaactctcaatccagtaaactttatatatctgacttactttgtgctcctgtggaacaggaatcctatctaagttacctccctccacaaaactaccacctcctgcccacccagtcatggtgggtggtttagaaccttctctgttgcctttttttcccccttctctcttgagatccattttagagatttggaatgaaatgtacactttggctaggttcgacaaaggttttgcaaacttttattgtaaagagcccaataataagtcatttgggctttgcaggccgttctggtctctgtgacaactaaacagcttagcctctgaagcccaaagatgatcttccgcaatatgtaaatgaacggacggggatgtgttccagtaaaactttatttatagacactgaaattagatttttatgtaattttcatatgtcagagcatattctttttttatatgtcagagaatattcttttttcttctaatgatttaaatattttttcatatgtcagagaatattcttttttcttctaatgatttaaatattttttccaataatcgaaggtttttttatagctcaaagacagtagccagaattggctacctctggggcaggcccttctttcgttttgtgtgtccatttctcctcctgatctctcttcttttcagctttctaaacacaaacccagaacagtccccaggatcttggcgggggggggggggggcgggtgggttctgggattgtgtggaggcctagaccagggtttgttttgtttcccatggcattgggagaagggatgggtgaacctcttttgtttgtaagagtagggagaacagcagcagtgatttatactgctctgctaagagtgcaaagtttaatcacattgactgatgctgtttctgtggttattttttttaatgttaccacaaagtaggtttatttcaagtatgcaagggtagctttatttcaccatgttgacagaaactagaagaatcatatgaccattttgatggataacacacttcttgactaacagaaggggcaccttttaaaaactctgcctctctctccaccctcctatccttgcattgttatctatgcacatatcccttcagccatatacggagcagtttgtacttcctgaatcctgtgtatttcgtgcctctg

SEQ ID NO: 31734 - DNA, 741 bp, Bovine  19866880758002
cagcacccaggagctcgtattatcctggatgctagagacagaaggctgaagggctgtgacccctgcatccgtgtccagatccacaacacccaacatgagctctgcgaatgcagacctctctaggcccaaagacctttgtttgtttggccaagatacatgtggcatcttacctccctgactagggatcgaacctgcacccttgcattggaaggtgaagtcgtagcccctggactgccggggaagcccctaggcccagagaccttgcagacactgggtggctggaagcagtgagtgtgtggcacagtggcatccaggcccagaggcgaggggtgagccaaggcctggctgagaggggagctagagggctgggcctctgtgctggaggcagctggaagcttgggcacatgggtgccattctgagtaggatcccggggtgatgggctgggacacctgtgtgtgggcctgactgttccctcctcatcctcacttgtcgccctccagcatcgacgtgctgggctctgcacccccttccagccagaggcgttaccgaaactggaaccccccactgttgggaaacctccccgaagactttctccgcatcctgccccagcagctggacagcatacaggtaacaggggtcctcccgctcccagcctgtgcagcgtctctgtgttagcgccagtcactgaccctccctgacgtttaagccctggggtggtaagggaaagaaggctgaaccaa

SEQ ID NO: 31735 - DNA, 945 bp, Bovine  19866880770196
gtcgtttgggggcagtcagcatattcagagtgagagaatgatctatttttaagggctgggatcggcagtcatgggctacagttcacagatgtttcccactggggaagccggctcttcactcttgcctttcctgtcagtcttttctctctggtttgcacatgcacacaggtttcccctacacagaggtcgcttgagtctgaaatcatcccgtgtctgtgggctgcagctctgataagccccatggctcctcggtcaaggattcagaaacctcgaaggctgacgcagtcatgcctgccaccggccagcagtgcctgagcactggctgaacaactcgtggtgtttccacagcgcgcatcgaggagccatgggactaggggatgtccagctgcttttgaaaggtcccagcgattgctggacttgccccactgtcgcctcgcacccttaaagtctggctgactcgcaacccacctgtaggctggggccattctggctacgccctctctcccacccagccctcacacccatcctctgctgggagaaagggtccacgcgtctccggctctcagctcctcaggaaggacagagcggctgcgagtttgggcttgtggggtgattcggcagagcctttgtttgatgactgttgatcgagcccaggtgtgcggacctaatgtttacagaatcctggttgactcaggctggaatgaagaaaatggatattcaggggagtagggaggtggcactgggtaatccaaaagccatttgtttagggcttggagccagagataagtaaggtatttttgcagatctccctaaatcagccaggcaggaattctttttaatgtgttcccacagtgtacattggtggctccagggactgaacagtccatgaaactcagctcaacagtccatgaaactcaggaccatctggagactcagggcagacac

SEQ ID NO: 31736 - DNA, 1286 bp, Bovine  19866880774910
cacatggaaagtggggtccacaggccaacagctggtgcttgttagaaatgcaaacgctgcttcctgaatcagacagcctggggctgaagcccaggggagtctgtgttttaaccagttctctgggtgattctgaaagggagggggtttgagacgccctgcgcaatccccatgccacagagacagtgtggcttcccagaactgcctctcagatggcgcggggtgtacatggggcacctctgaggaggtcacagtgtggtctgagcctttcgagggtcaagattacaggtccatgaccccgtggtgtcggacgacaacaggggcattcccacgcagctcccttaagagttacttgccctgctttgtcatttgcaaagatacaccgtcaaggaagtcagggctgtgttttatacctgcctgaagttattggaagacagatctcaaggttggaacacttttctcctccccagacagatcaggcaggtgccaggacatgggacagacacgctcaggttcagacaccgcctcccctgatccccaccccaggatcccacaggaccactaggcctgtgggcacccgcttctggtatatacagagaaatctgtacggaccggtgagggcaccgtcaacgcagaaccgactctagtgctgatcgtgacgaggagcatggggcctttgaagctgtattccaccagggatagtggtgttttctccctgaagtcagagaaatgcccgtgtccacccgcctgccaactcccttgtgttcttccactccgtgaacgaggcctggcttccaggctgaactctgcacaggcaggcagtctacctctgtgtgtgagagcaagagggagaaggagagacagacagacacagttaccggtttgctgtctctggggctgaataccagctcccttgaccgtatccgtcccgtccttgtgtgatggagactcacacaagccgcttctgtttgattcacatagaaccgtgagaaacagccccgtacgtgaggccgtgtttttcattctattcagtctttgtatattcaaattcttccagtttcagctcttgctgttctgccagatttctatcgcattgatggcttctctgaattaataagtgttttgcaatcgctgaaaagttttcttcccccaagcatggggacttattcatattgattttttttttttttccctttctctttcctctctagctactccttagatgttctgttttgtaaagtgttaatagaatttttcttgccccccgccgctttatctgttcaggaggt

SEQ ID NO: 31737 - DNA, 2083 bp, Bovine  19866880779241
cgacacccaacgggctcagggcgatcagggctcctgtggggctcccgggtgggccctgagccgcccttcccatccgctgatagctgtctcccctccagaagccatggaaacctctgtctcgttcactcagtatttcaggggcataataattcaggtcccaaataatataggttgaacaaatgaaagaccaggcgtccagagggacataaaaacactgtcgggggaggcgcctggagaagaaatcccggggccagatgcacctggggcagacaggggcggtgggccaggcgccctggctgtcagaggccactgggcggagcaggaccctccggctagcggcacccgcagcgtgcacaggcgtgggctgcaggcagaggggacccgcagcgagcaatcctgcccctgctgctgactgcccctccccaaggcaggcagccccctgggaactccacaccaaggcctcctcctccgcaggcctgcagagcaggtccacagctccgcaggcttctcagggaacctggcagaggggccgatgaccccaagaataccgggaacttctgcccagtcagcaaaggtcacagggacggggcggtttgctccagcagacagacagagtgactggggggcaggccgcaaagacgcacagtcagaaaggtcagttctcaccacggacttgactaaaacactgcccttctccccttcggactgacgccaaggctttaattatagcttgtcactcacgcgccttccccaggagatggccgggccggacaacgacggaaatgaaactcttgcttcagatggctcattctgtctgtcaggaaatttcaggctcaccaaacaacagaatatcttgaactgtggcctcgcagcgcctctggaggtctcagcctgctccccagccccctccgggcccagccagtgagctgactcctgcaatggggtggaaaagccgtctcacagatggagacgctcgtcccagcaaggcgacgtgactggctcaaggtcactggcagacggtcggtgggacaggggcacccacgagcttcgctgtgttgggctctgctctggccctttgaggaggtcccagaaagaagactcccaagccctagtaacactgacacttgagtgtcacctcctggtgccaagacctaaggccctgtcagcccacccctctttgatcaccgatgcggtccccatgaataataattcatcgttactatcctgactcttcacaaggaagcaccaaggctagagagcttgttccagctcacgcagctgggaataggacctgaatccagaccgcccagcagcaggcccgtgctcctaaccccacgctctctccttcctctcatccacagatacgaagacggaagatctggagttctttcctctcgcctctgccaggaaacgcaaagtgtttctggaagcattcaacaaaggacatcccccacatggtggaggaaggctgtcctgagccctggggggccagctgcggactcggatttggggggagggggtcctttgcactggtcccgccaggttcccctgatgaagtgctggcactcaggggggccgtgggttcaggtctggctcctggcagctgggttgtgagtccctgtgttctcatggggtatctccacgtccctcagcccctggctctcaacctagacattcagaatgcagtagggttcggcccttagagctctctgaagccgttgggacccagaggagtggagcacgtgacctgccatcagatctctcccgagccgcccaagcgaacgcggaagcgagagtcgctcagtggtgtcccactctgagaccccatggactgcagcctgccaggctcctctgtctgtggaattctctaggtcggaatactggagtgggcagctgttcccttctccaggggatcttcccaaaccagggatcgaaccaagccccctagattgcccacagcgggcttagagccacacaggtgcaagctgctttggattacctgtgtggccaaagtatccagccggtttgggaagagagcagaatttcaggtgaacatgctccagggtgaagggaagccccaggg

SEQ ID NO: 31738 - DNA, 1108 bp, Bovine  19866880787864
ctctcctcctgacagcgcgagtgataggcgcgcagaaactgaccccagctgacacactcatcttaaaatatctctgtttccctccggcccagataaaagagctgtcgcaccaaaaataaggactccacttggggagatcctggcttctccaaggactggtgatggaggagtctgggatgttggggttcagctgaagtccaagtcaaaaggaccctaagaaaccagccctggatgaatcgtcatctggggagcagccccgtgttcagcctctcatcactgggccagatgcatgagatacatcatcaacatcgtgaataagcatcgtttattcagcatgtattggcatgtggtactaggttccgctcagatcaaagagaacaatctagacccaaccctgtcccaactgtaccttacaacacgcacagaataataatgatctccagtgctgtggtcctttctggcttacaaagagccttcagcaactcagtgaattaggtatagcaggtatgaaaattattcccattttagaggtgaagtgacctcggagaggtgaagtgtattgcccaaggtcacacataagctcataagggtcaaagatccatttcagagcaggaatcacacacttcatgggggtaatgaagaaggttcaaagaaaggattctttaaagagctaggggcagggctaaggaaactgactgtggactaggaagcagcctgagtgttttgggttgaactgggtccctcagagaaggtaggtggaagccctagcctccaggacctcagaatgtcaacttatttggaaatagatttcattacagttatcattagcaaagatgaggttatcctggagaagggtggacttaatccaacgtgactggtgtccttctatgaagaagagagtcaccgagacacaagaggataatgccctgtggccagggaggcagagaggtgccaggactgccgaccagctgccagaacctggaaggagggaaggacagccttgcctccatggatcagagggagctctgccttgacgccactttaattgtggacttctggcctccagaactgtgagagagtacattgctattgttctaagacacccagt

SEQ ID NO: 31739 - DNA, 615 bp, Bovine  19866880794135
ttggacctaaatgttgccgacagctaccttaaaaaaaaaaaaattcaataaagaaaagaggaaatgagagtatagtgagaaaaatgcagacacttatgagttcaagaccctgtgggacactcctgaatattttaaatatcttgggaaaaaaaaaaaatgaaaacagtttctcccaacttaaaccagagaagggagtctctttctagtctgaaaatcctttgaggcaattctttaaattatttactagctttttgattatattttatggtgaggtgggtggcaggggaggaggaggagaggaaaaaagagggctgggcaagaagtaagtgggagaaagctgctgctgacattttcaatatctgtctggaatattttaaaagccgtgtgtctgtttgaaatcgcagagccccggcaacaatggactgctgcctcccacacttctttaggtcatatttgcatacaaaagaccagctgctgagcagctattatgctgtgaagccacagtgggcctgggagaggtgaggttaccagcaagtgcagagaacccacagagactccattaatttttcacgaattctcaggccctggccttttaaaggccagtggggagaaatc

SEQ ID NO: 31740 - DNA, 909 bp, Bovine  19866880804893
ccaattatacttttacatcaaagaatcaaaatgctggtgctgcagacttcaggcccatcattcacaaacccttttatcctgtaattaagccagacctgctgctgggttaattcttcccctgaatgccaccaccctttgagccagcccgtatgtcggcagaagacttcactctgatgatctattataccaatacatcaccgcggtgagctgcctccttaatgacttatccataacacatcatcggagtgagacacactcgtaatatactgctcaatacgtctgcattgaccaaggtggggagccgccaaccgcagccgagttcatgcccttacatggtcggtgtcagcacatggggcccacgctgggctctcccttcctaaagaaatgtgtatacaggtgggagggcttccacgccaataggcttgtagaacctgaagcactaagaccctaagaaattcctatatatccagaccagaaaagcccctcagtgggtcacgtgcctaccctcctaagcctatcagataggtcggaagcattttccttaagctcttacttagtagaaggccagggctatggcactggacacctccagggggcgctgttcacacggcagtctatgcaaattgtgcctgagtcaccccagctgggcagccccctcagtggccttgattaagagcacagactccggcatcactgcctccttcgaatcaaggttctttgactctaatggtcctatatcatggggttgctgtaagactgaacaagataacgtagccagggcacctatgacatagtgaacactcagtactcatatcagccgtaacatagcaacctctccaaacgccgagagccagggcgcctgcaggtccagggtgggggcagcggcagcccctgtattatacctccatt

SEQ ID NO: 31741 - DNA, 2650 bp, Bovine  19866880814983
ccttgaggatacggtgagaacagacccgctacgccttcgaggggggagggacacacaccccctcgcccccatccccttgatgagcggcctgcacagactgttacaggaacgaatggccctggagaatggccttccagaagatcagcccatctctctctgtacatacagttttccccccaaaggtcaaatcaagaccagagacgttcaggagcagaccaagttttaagcaaagaagaggacagtgcaccagggcctccttttccaatttctacctacagcctgatccctgagcacacagtctgctcagccccaagtctgtggtgcagaggagtaagaaatcaggagagagaggaggaaggaagtcaattccagaacccctgggcctggccatctcacttctctggaaaagcccagttgcaaacacttgggtaaaagtgtccatttcttcaggcaggcgcattgggaagggctgacagtgattgaaggctgaggctggagcatactctttgctcccgctgacccaccacaccggctgagtcaagtctgcttctgccgttccacaagcaagacaagatattttagcatctcgggctaagtggtgccgcaggaaccacaagccagacaaagccctggatcaatctccggttcactgtctcccatgaatgagctgcctggggatgggggaggaggggtggtcaccagccaccaggcggccaggacagcaatctactcccgttgggacacttttttacaacgaaaggcagcacttcggtctctctgaaggctgggagagctgtctgccctatttatcggagactgtgaaccagaagctccgaggtacttggtggaagacagaaggccggtgctgggatagaacccacactcagacggacaaccatgccccacccactgtcagctggcacagctgcacctagaacagcgtgccctgctcgacggtcctgcaaccagcctttccttccaaggtggcaaccttccaggatgggcaggggaggagtgctgggaagaggacccggaacgttcttcatctgggtcaggagactggcccgtgggctggccccctgggcagtagcccagagccaccccttccccgtgcgggacggcccctactcaacaacctgtactgaggttcatgggagccttgccttctgggtcttcattcctggctctccgccagccggaaggaataatggattcgcttattttatttcattggcttgtaaaggaacataaccaaatcgtgatggggaaagaagctggcagtggcagaggccagcaaaggctggggcgatgccaggagttaagcaatgcttggccattcgctctccctgaagaccagcagcactgcggggccaggatggatgattcgagcgctggggctggggaagcccagaggcacaggggctggaggtttacttcccaccccgggaccaaacgaccccagcccaccaaggcaggggcagagctgtccgctgacctgctctgctctaggatgagccacggtccttacccaacctggctgttcctttttattgggtcattgtcattatcatcactaccatttatttagcacctaagtcttaaccctttcagattatctccaatctttccgtctgccctcaaggcaggtaatattatcccaattcgacaaatgcagaatctaagattcggcccagtgaagtcaattgccatggcctctgcatcagcgagtagctgagctgggatgcgagtccaggtccatctgcctccctcaaagcctagactttcctctccatcagcccctggaagggcaaccaggctaatgtaagatttagcgcgaacacagccctggataagcctccagacaagggaggccaaacgattgatgggttatccttgctgctaagtgtgggggtctgggatattcagagagtctgcagtgaggagggggttgatgtctagctccatcctcatgagcttcatcctcttgagtgactcacgtgacctctacagtcccagcttcctcactgaggcctgagatttcagtctgcctttctcactaccagattccctgtacctagaacctgcagtccaaaaagagacttgtcaaatgaatgaacgaacagtggaaatcccagtggtatcttccctatccatcttattagtgagataacacagagcgctttgcacagagcaagacacatttcaagtggaccaacaagcaggagttcctggttattatcacttcttaattatttatttagttggttacttagtgttagctgtgttgggtgtgcagtgtggtgcgggcttttctctagttgtggcgagcaggggctactctccagttgcagtatgcgggcttctcattgcaacggcttctcttctgaagcacaggtctaaggcacgtgggctcaggagttgcagctcccgggttctagggcacaggctcaacagctatggtgcgtgggcttagctgctccatggcatgtgggatcttcccggactagagatcgaacccatgtctcctgcattggcaggcaggttctttcccactgagccaccagggaagccctcctgactattatgcattttattattataacactattactgcttcacaagggtattacaaggatcgatgcacttacaa

SEQ ID NO: 31742 - DNA, 693 bp, Bovine  19866880848164
gaggtactgttgtctcatttcttacacacacacacagtatacagaacacactacacacacacacacacacacacatgcacacacgcacttcacagttactgctctctcctttctccttctaatcccagctcttgccggctcttgtctttctccccacccctccctttacacatcagttcatttctcttttgtctgttacgggggctcctgtcttgggcaggacagttctcccctcactccaaatctgcacagctgagacccagactggcaaagatgccacgctccttggagggtgtgggaacaggcaggcactcagaagaaaggctagctttttatacggtcattcattgaccgtggtgacgtcaacctcaatcgggttagacttcctatgacaccacgtttccacagaccctggacacacaccaaccttcctatgccctcacagaaatagccacacatgctgctttccataatccccttcacctaagtctctcgtgggcatttttacatttcttcaatatcaagtactgatattcatagccatgactctgattagtgcaagacgtcaaagcaccttttgaatcattaaagaaagattaaattacattcaggatagtttcagcatgaagtgtagctgaactaattcagattctctgaaaattggcaatatgataaattgcaactttacacaag

SEQ ID NO: 31743 - DNA, 796 bp, Bovine  19866880861898
tatcgcggggtgtaatctaattagtatgaagtcaattcagtcgctccttttgtatctcgtgattaaataagtggggaaaatggcttgaaaattaggtgctagaacgaacccaattacatttctgtagctttttgtattcaatttcataaacaattttgctcttcgctggttaatcagtgaatgcctttttccagtttgaaaagcacttttgaaattataatgcaattaaattgtgtgtggatgttctggcatagcgagtgtgaaagctgggggcttggcaggctgccgtgttgtaccttgactgtaatgagtccccaggctggcagcttgctggtgtcattcataatattgtccgtgctgggtcactgtaaagtacagctgccttaaccggcagctaaccagcgaccgccagtcccctctgtcgagcagggcacgcatgccttgtgtgatagggctatgctctggagatgacagaatggcagggctcctctggaggcttccccagggcactggacagtaaggcggcgtcttgatcgatgaggtcagcgcctctgagataatccacgtacctgtgcccagcaacgtgtgggatggatttgtttctcttccacatggccatcctgttttctctgccggcagcttgcttcttggaagaaaagctatgacaaacctaggcagcgtgttaaaaagcagagacatcactttgacgacaaaggaccgtatcatcaaagctatggtttttccagtagtcgtgtacaaatgtgagagttggaccgtaaagaaagctgagcgccaa

SEQ ID NO: 31744 - DNA, 1077 bp, Bovine  19866880886859
tagcccttcccttctccggggatcttccccaacccagggatcgaacccaggtctcctgcattgcaggcagatgctttaccagctaagccaacagggaagcccaaggatactggagtgggttgccatttccttttccaggggatcttccctaggggtcgaacccacgtctcccgcattgcaggcagactccttaccctctgagccaccacagcagccaaagcagaacagaaagaaagttgtccccagagatgagagccgggtgagagagtcagggcctggctactcagttgacctccataaaaggagcctgtgggaggtattggggcattgtcaggggataaggctggtatgagggaggcctccttagctctggctgggaggtagaaggccaaggccagggccagggagtggggaggcctgggagccccaaagcagtgcccaccgacccctgggacagttttcctgaacggcccggcaggctgggggctgcggcatcaacagccaatctcctggatgatgtggagggccatgcttatggtaaggtagagagggcagggaggctagagctttgagttgccatgatgggtagtcctccaagagtagggcctgggtgtttcacaggtgaacccaacctgttagggcaggggctcctaactacgggacacgtatcagggttggtgggtagctgacccaaagaaatcggtccccccaacttggtcccactttatcgactacaccaaagcctttgactgtgtggatcacagcaaactggaaaattcttcaagagatgggaataccagaccacctgacctgcctcctgagaaacctctttgcaagtcaagaagcaacagttagaactggacatggaacaacagactggttccaaattgggaaaggagtacgtcaaggctgtatattgtcaccctgcttatttaacttatatgcagagtacatcatgagaaacgctgggctggaggaagcacaagctggaatccagatttccgaaagaaatatcaataacctcagatatgcagatggcaccacccttatggcagaaagcaaagaagaactaaaaag

SEQ ID NO: 31745 - DNA, 1263 bp, Bovine  19866880923114
tagtagctggttttttttggagtgctttgattccttttaattctccaatgtttctagccttattttggagttggaggaaatgaatttgaagatgttaaagtgacagaacttgagtccatgtcttctagtgacaagttcttgtttattttattactatattgctttttaaaaacggcctttttccagtggagaggttgcggggaaagagaagtcttcgacccaagtgatcactatctgtaatacccacctgatgccaccagggtgccctgtggtgctgtctttgatccatgttcttagccaggttgatggggctgttttcaaagtgttcatcttgtcacagtggccatcgcccagagcccaacagtacaaagtggggtacttagctccctggctttccagtgtgcagtgcacagccaacatcagagaagcccttgccctcttttgaccccttctggtcacactggcccacagaaaacagatcagtgaccagagcctggctagctacttttaccaagctacagtctcagaggatagtagcacgaaaaagatcctgagaatgggtaaatgtaaacatgcacttgttttgttagctaagtgtacacttaaattcatattagcaaaatagatgtgatacacaaaaccagattgaattgctttatcagctttaaaagcaatgtgtgatgactttcagtttgcggtaacagtctgctttatacttggtcctgagtgtacagcctattaggcattagttgtgatattcaaccctagatgacagcccagtgtcaaagctgccagttatgtgagaaccaatgaagtgaagtctcatttagcagggaaagtagcccctttactattttgttttcttcccagtgctcttataatcattttgtataaacatttaactagtctatagttatttccagttttgatttctctattggaggagattcttaaacatataccagtgactgactagtacagttcctggccttaaatagatgcttcataaatatttgcttactgaaaaagcatgatagttatggcatagttctacacatgagccatttttctaaggagagaatccacattaggaggtctttgttttgtccaatacattatgaactgaaaagttagtacctagggtgtcttggctagcctttcaaaacctagaatatatcattctaggttggagatagcacagcctgaattttgggctgaagctgagctgattatctttagatggcatccatgcagtatctctag

SEQ ID NO: 31746 - DNA, 1190 bp, Bovine  19866880987921
accagggagttttttaaaattttattttgtatcatgaaactgagaaagatgcaaagttttctgctcttgctggagatgaaaacacctgaagtcagctgcttatcagtgctaagtagagagaatcgtaagagggggatgttggtatccttaatctacccgagttttcaagagtaaggcagtgcttttattttgtcaggaaccttagatggtgtcggcaagcgtttcaaggcaggcttgttcctttgacctccaagtggtgcctggactcactggctgaatggttgaagaggtttggggaatgtttagaaggaaggaataacttcagggaaagacaggctcccaactgtgaccaaggacggttgagagggagggaaaacattagtatcggggtggtgttaccttctcacagagccttttacctgaggactcggagtaagaggttttgatccacaaacccatgggtcccgtcatgtgtatacgtgatgggaaagtcactcagtcatgtccgacactttctgagcccgtggaccaaggaattctccaggccagaatactggagtgggcagcctttcccttctccaggggatcttcccaacccagggatcgaacccaggtctcccaccttgcaggcggattctttcccagctgagtcctgagggcagcccatcatgtgagtgggcgtctgtgagcagagctccaggacacactcccagcccttgcctggtaggtccctgcctttggattttctgctgcgggagcccccagcatctcagggcatctaccggttgcccaccttgatctctttgttcatttccagatttgtcccctcagcttcgtatctgtcgggtggagtcaactggctgggtgttgtcggagacagggggtgagattctgactcttaagtggatcgtggtggaggcggggagacacggggtgtgtgtgagtattagtgtgcagaggatgggaaggggtggcccggaggggcaagctcgttgtagattacattgactaattatagggaaaaagccatatttgctgctccattaagtgatcactaggctatgaagcagtttattgtaattaatgcagaaacagcaaataaatgttgggtttggagtgggagggtctccagacacccctcccccttcggtgctctgcgttggctgcccccatggttatcctgcaggtaa

SEQ ID NO: 31747 - DNA, 1215 bp, Bovine  19866881060686
tgttgtcggacaaatgaggtttgactgggcagatttttcttcctggagggaaggagctagattttatgaagcgcttgccaggtgcagggtaatttccctgtagaagaccctggtcttccaggcagaagtgcccttcagagagaccggtgccatttgtcgggccgcgtggctgacttgacagccctccagggtgaactgcaaaacgagcctgccaccatttggccggcggctccaggtccctggttacctctctgccttcataaacagccggcccagcccagttagctggggtgggcaccttgggggacgtagcttttccttctctctttctcgtggttaggttggccgagcgcaagtgttttaaatagaacagagctcacagctataacacatctgtaacactgcacatttagtcaggttcctggtggaccgacttctgtttgatgggcgatgtttttgctgcgactgttgtttccttttcctcccgtatttatccctctggaaaataaagttttcttttatgtgaggatttatagaactatgttcccggcatgaggtgtgcacaggcatgttaggatatcggtgtcgtggagaaatactacctccgaggcacgtacagcttttacctcttatggagaatgaccttctaacgtggagcagtctgtgactctttgcagggtgaggggctgcctgggttaaggcggatgaagacgctgctttacactgagatggcacccttttctgagcatcatcagtccttggaggaccttgattgcccaggactgctgctgggggtgggctgattcagggtggtgtctgggaaatccaaagaaagtcgactctgtcacgattcgttcttaaatttgcgatgagcctctcccagatgctttgccttttcttttgtctaggggacaggcttggaagcttggattcccactcccagccaaaccgagagagctcaagtggctggtggggcagggcaggtggcgggcaagaaggacttcgcgtgccgtctctccagccccgtgctaagcgtgcttcatgtgttcgcctttttcattctgtttcggacccctgtcagggtcccctggtgtatctttgtcagggtcaagattcctgggttcctcgtcctgctctatcactgctcggagtgctggggttggaacccggccctcccatctccagaatctccaagtcggatgctcttttcacccc

SEQ ID NO: 31748 - DNA, 1138 bp, Bovine  19866881066828
cagagccgctttctctcatttctctcctgctcctttggccattgtttagggtttccagaagatgttgggattcctccctgcttttactctaccctctcatctcgtttactctcacggttttagtggccactaaaatggtgtattcagtctgggtcacctggctcagtctttctgctgagctcccagacagacacacaagttgtcctgtggacactgcacgtttaatatgtccacactgaacacatttatcgttcctatgcaaaccccttatcttggctggtgttaataccctcattgcctcagccacccagtaaattcaaaactccttcctctgtctcatctctgcatctggccatttacccagttctgatagttttgactcctcctccttcttaaatctcttcctgctttgttatgcaaaatatccttgctttagttcagggccccttcatcttggactgttaagataagcttctaactgttcttacagtgtctatttttgagcccttcgatctgtcctctacagagtgacttattctaaaacacagagctggtcttggtaatcctgtccttcataactttgacctcttgtcttcaagatgaagttcagtctcctttgtcatggtctataagactccagagtctccattctgtatctcccatcaaactttgctctccacttgattcgtcgtggtgctggataagcaagggtatttcatgctattatgactgtgcctgcccttctgacttgtcttcctgggaaattcctacttacccttgaaaactctagtcgggagtctccgttgtgaagccttttctgactcttctgacgtggttcattgtatttccctctgtgtgggttgtgcacactcttgtccttgtgtgtttttgttagacctctaggagatcttcaagggcagagaactaaatcttttcatttaggctcccagggcctgatggagaccaggtagtcactactgtctgatgtcagacagaatcatgagccagtgacacagaacttgggttgttgtcactgaatctgtgactgccagggttccaggcccctcccttgactttttaaagtggtttcttatcagggggtcacgaattgtcctttttatatatcaagatgactcta

SEQ ID NO: 31749 - DNA, 921 bp, Bovine  19866881074336
aaaaggttgttggattgggttattattgttgccttttagaacaaaatctgcggagaaaaacctaacgtaaacacatagccagactctctcttagaaaatacttccttctcagtcacttcctacatggacaccatgcaaaaccactcccattgatcaagctgtcagaatgaactgcaaaattcttaacagtctctctcacacaaaatgtccacgtaatccaacgcatctggggggcctggccctagttttctaaatgcaggcacattcagatggcctttgggcttcccagataactcagttagtaaagaatccgcctacaatgcaggagaccctggttcgtttcctgggtcaggaagatctcggagaagggataggctacccacacagtattcttgggcttcccttgtggctaagtcggtaaagaatctgcctgcaaagcaggagacctgggttgggaagatcccgtggagaagggaaaggctacccactccagtattctggcctggagaattccatggactatacagtccatggagttgcagagtcagacacgactagcgtctttcactttcactttcagatggccttcagaagtcctcatagcagcactgctgttggcaaacaggggacagatacaagtaacaggcccagagtctcgggatgtcagaggagaagggaccacccaaatggctcagcccaaacccctcacgcttcagatgaggatgttgagaccccagagatgaacagacttctccaagtcaaaggatcaccccaacatcccaggcaacaccaagtttcataactcccctccccaaacaccctcccactccgtcaaatttgagtgacagggccggccatgcatgctctctttcctaagctcaatagtttaacaagcagcaaggaaaccacagtgtaaatggg

SEQ ID NO: 31750 - DNA, 3555 bp, Bovine  19866881076987
tccctttgcctgtccccgctgcatcctgaattcttctgcacacttgtctgccgttgagagacaagccctcctcctcgactcctgagctggagaacccaatgggccacagacctggtaggagcctcgctgcttcctgccaggagggcagggggccgccctggcacagcagatgcgaggggtgaggggctgtggaaaaggcaggttggccgcagcctggcacgagggagcattgcattggagactggacttccaccacgggtagaagtcaggttcgtgaagctgaccagttgctgtgttgagtcaattggtccccaaatgcacctgtgggtcacgcgtgtgcccaggggcccattcttagaccctcccttcccccactcgctgctgaaatagctttcaagtgcaggtgtagaggttaatgacaagacatttcccagttggccctttgctagagaaaatagtctcgctaggctccaaaggagaggcaaggatttagaggaaccacaggcatcaaagctggaaacagtggcgtcctctgctggggcaggggttggccgggaggtgattttacacgcagctgcgtcctgttgaagagagcagcccaagcagcaggtgggcccttcctatcccacccaagccacctctcaccatctctcaccgtctggcggtggcagtacccacactgcagtccttcagcttctggggggactgaccctctcgctctgctgcctgagagccttactggatggtgctcgggacacagcctcggtgggtctacctgcactgccccaggactggctccgccctggggtgctgtcccccacttcctcgctggaccataccacggagaaaccctcataacccgcggaggagttgccgcactttaattacagttcagagtcctgtctcccggcctgtgattcctcactccctttctgagagggtcctgggaagcccagcatggctctctgcctgctccgtgtcactgagcgtgaagactggccagcacccccatccggccccctaacccggctccctgctgcctgcagacccagggtcttttgcctctgggcgctctgagcctaagcctgaaggaatcaggcccgacgctccaggtcaccaacctgatcctgctcggtctctggaggtcttgatcggcatcactgagccctgcgtctccacttttaaaaacctattgcccggtgacagctctctaggttagagacagtctcacatgcttcctcaggtgcacagaggaacttggtgtttccagagtcaggagcagttgcagaccttcggctcctccagcccaccctccagcctgcccgctctgagccccgacgtgggacgtggttgacccttgttcttgtctggagagcacctccagtgcagcttggattcatgtttttcttgtccagtgttgaacgtgcttgagcgttgtaaggctcctcaagtacttttagaaagcccggggaagacatcaagtaaaaataactcgatgatcccgtgactgctgaactgctcagaattcgcagggtcgaggagacgggctgttccaagtttttagtgctgacacagcttggcgctggggggtccttgctttggagaggaccgctgctgatctttgagagagtgctttaacccaccaaggaaaggagaaggatccaaatgacttactgtttgcgtcttaagaattttgagcatccctgggaataataggagattcctggtatgttcaaaagtggcatcagaaactgccaggttggaaaccgggcctttggtcatctgtccccagccagcacacccccaccccccaggccaagttcttgatggctcctgggtctcagttaagcagctctggttgaaccagactgatgggcacagaaccctgaacggagaccggggagaatgccaaggcacggccagcgaaagctgtttacgaagccagaaagaatgttggtatcatctttcacttgtatagttaaatcagccacaggtttttctggagccttagctggggtttgattttctaggctgggacgaagatgaaagagacgtttatttggtaggaggaggattgggacactgaactgcttttaaacgatgtgaggaaactctttcttctccctgctttgccacttctgctctggcgctgactttgaaaccccttcctagggaggcgagaggtggggcgctctcccgagctgctttctgagtctggctttttgaaataggctggagatctatctcagctctgaatcatctgctggttctcatcacggagggcaggagaggggggtgtccggggggctctgccggtgggcctttgaaagataacggcgcttgaaagtctgtgtttatcgctggagagcagcgtggtcagagaggcgtagagggaagggctggtggcctggctctgatggatggggagaaaacttgccttgtgaagcacaggccgcccaggagtttgtctttttcaagagcggaaaagaaatttaaagtgaggctccagtgagataagttttttcggtctggtgcttcatggaggcttaacgtttctcgtagggccctgaaaatggcagagacctcaatttccccccttccgggctccctaactagagaggtttgcaaagcttaaggggattaatgctctttaaacctctgcactgcttcctggtcctcctgggatctgggtgctaataaagatgtaccagcttggaaaggctggtaaatactgctttgttgccatggcaacaggcgaaacaagaaggacgcggagtattgctaacaagagtccttgtgatcgagagtttaaggagggggacaaaaaaggttcttaaaaatgcagagagtcttggcgaggtaattagacttggtgctctccaagtaaatttatagttttacggagcattactggagtgccttgctgctcgcaatgtcaccctccatcaagcggcgaggcggcgtcactgctaagagccgccagcgtcttgctgccgttgctccactgaggccggggcggcgtcccgagacaccttcccttcttctcctcctcctcagcgaggagtcacggcatgcgttcccttacttggggaaggttaaacagctccgtctcctgcctccgtggtgtggacagatacgagggaaggttctacacctgccttccaggttactgttactgttgctagcaaggatgggaggtgaaaggggaatcgctttccctgctttggtttgttgcacctgctgcctgaccctgtgaggcgcggttgttgctgacccagcttttccggtggagaaacagaggggtcgaggaactcgaaccctggagacaccgccagcccagggggactgagctctggggagtctgtaaagcctgggctttcagcccctggactgtgtctttacggcactgctcacagcccactgccgtcatccccattcctgggtcatgagcagcccctgctgggatctccttcccagacgtgctgaggcttcccaggcaaccgagggcttgctctcgcgtttcttccctgccgtgagatccgtccactgtgcaga

SEQ ID NO: 31751 - DNA, 891 bp, Bovine  19866881106498
cttgcttaattttgattaatacccattggtgtaaaggaggatgggtttgaattgcctctgtgtgttagtaatccatttgaaccctggagagtctctggggccttctgtgtactgaacccctccactctgtagccagtgctgggggccaggggctctgagaaggatggaggcagcacctgcggatgcagagcagctcggtccctgggatgagggtgtgatggccagccgaccacctccttcattcagcatcggatgatgcacgggtcatgaaccttaatttcctgtgctttccaaggcagcactccatctctgtacctctctctgttaccccccagcaccccccgtctgagtgccactggcgaggatattactgtctgataccaatctgtggacaggtcaccctctctggctgcagctgttcccctaagggtaagaggaagtagtattttttaaattagcctgggagggagccgggcgaggtctccgagaggactggggagtgagctccctgctgaagcaggcgggctcatcatttcattacaagatcacgctcttttaggtgagttacgttgttttaatcagaggtagggttgtaacccggctatgtcgcctaattgtgtgtgaattgtattctagccccatatagacgaaggctatttttttccttccacttttaaagttacttagagtaaatgccaaattgtagcctgaaccctaatgctgtctggctaatagctatagatggggagagagtgctctgaggaacatttggggttatgaatgtgattagtttcctctgatgttagattaatttctgcagttgacaacatcacatattgttacaccctttgtccagtggtcagggtgggtgagtcaaagtacacagaatta

SEQ ID NO: 31752 - DNA, 1010 bp, Bovine  19866881110628
cagactggaatcctcctggagaaaaatgcccaaaggagtcattctggttttacaggtacaacatgctctccataaagaaaaaaaaaaaagaaaaacccataaagatgttctcttcttccctctgacctcaatttttcactgattttttcaggggcaaagagctgccatcatccatcactgagagccttggaatctccttttgaagccaagtccaccaggttctgggctcttagaacagcaactaccatcagctacctcctgcagggggtcacatggaagcaatcaagaaagcaagaaaactgaccccagagaggagatggggatggacaagaatcctgactgagttatcatgtcagccaaggtcaaaggtgtgtgtgtgtgttagtcgctcagtcttgtccgactcttgcgatcccatggactatagcccgccaggctcctctatccatgagattctccgggcaggaacaccggggtgggctgccatttcctatgccagggaaggtcaaaggtaagatcaaaaaaaaacacagtcaaaagaaacagcaaagtgcctttggctgatccaaaatttaaaaaaaaaatgtattaatctggacagcaagcatttctccctgagcattttctctccatgtttgctgatcaaacctttgtaaatgagagcacaaccctcttactggataaagaaagacatacacaaagcccctcaactgaaaaatctcgtcgggcagatcgtgatgtcacctttgcgtgaacaggacgcggccacaaagggcttggatggggagcgggtggcacggctcccactggcgtcatcgtgaataaggaagcggcagcgcctgcacccagctcgcccggcctgaccagcatgccgcctgggcacaccccgcggtgccagggaaggacagggtctggggctgagcgggagcatggaggtgctctggtgactccagggggctccaccctgctctgaaccgaagtccttcaccagccccacctcggccacccat

SEQ ID NO: 31753 - DNA, 1794 bp, Bovine  19866881134111
tcacgtgcgacaatgaggcaggcaataaaaaggttcccggcgatgtttccaccacatctcccaccccaattaatccgtaacgctttgtccagagagaccaaagcctttccaggcatccgctagcacagtcctgcatgtgggcaaaggctgggatggaaacgtgtgtgtgtgtgtgtgtctctgcacgtgttggggaaggggcaaatacaaagtttccccgacatcaggcagaagatcagcatgtggcagggtctgctgagtgctcaggctgccctgattctcagaacacaaggggaggcgatgatgcaagctcggcccccaccccggctccccacgctgacccagctctcctgctgggccaggccccatctcatcacatctctcaagaacatctctgtttgctttggactcgctctacacaaaaaaacttacacactcgacgggcacgaggagagaaaactgctggtgtccagtcgatttctttttaacagttgtgatcttcagtccctaacggccccaagaaccaggcaggcagtggacacggctgagggccaccccctttcttgggtgtgggggggtttaaacacaagcggccatacaggaagttggttttcacaaaagaaaaaaggagagaaaaacatgctcatttacaagcaacagcttcaagctccccgtctctagtcttgttattgttgccaaggggtccaaccatgaccgtgaccacagctccctgcatatgaggttgcggcgagggcagaggcatcactgtatctaattcaggggtgagcacaaaatcatcttttctgcaaagttaccagagagaggggctttcctggtagctcagatggtaaaggatctgcctgcagtgcaggagacccaggttctatccctgggttgggaagaccccctggagaagagaatggctacccactccagtattcccgcctggagaattccatggacagaggagcctggtgggccacagtccatggggtcacaaagaatcggacacgactgagcaactaacacacacacacacacgcaaaccatagagagatagtttcacatatgaggggcaatatagacagctgtctgaacttgaaaaggaagttcttttcacacacaggcccagagccacaggacggaactcacagtcacggggcggctctcacgcgcctgagcgcatgcccggtgccttacgggactttctcaggtgagcgggggaatcccaggctctcagaagttagctgacagcctcaaggtcgtgaaactaacaacagcaggagcagggttccaaccaggccctctgatcccgcggcaggagacggggtgggacccccagatggagccatgccagcaccacagccccagggcggcgggggccggactagcagctctgcaggttttagcctcatcacagagcttgagggccacacgggctacttggctatgaaaacctgcttggttccacggccacggtccaaagcacagacccaggatgactcgggcctctaacaaacacaccgctggcaacgacaagcagagcaaggcgggctggaaccacaggaccgccctggaggatgctcaatggacgcacgtggccaccacatgccagcagccgcgtctggacacgaaggaggggcggccttgggtcttcgtggctgctggtcttgggggccgatgaacatgcgctgatcgtcgctcagcccgaggctccctcgggtcgacggcacacccagggaacgcgctcaggatccacccaggactccaaggggaggcggccctctccatcag

SEQ ID NO: 31754 - DNA, 1027 bp, Bovine  19866881140841
catccccaggagaaggcaatggcaccccactccagtactcttgcctggaaaatcccatggatggaggagcctggtaggctgcagtccatggggtcgctaagagtcggacacgactgagtgacttcactttcactttcatgcattggaggaggaaatggcaacccactccagtgtttttgcctggagaatcccagggacagcggggcctggtgggctgccgtctatggggtcgcacagagttggacacgactgaagcgacttagcagcagcagcagcagcaggagcatcccccaccacccccaacaccttccctctcaattcttactctttcatagaaaaatgattgagatgaggccgggggtggaagacatctgcagtgtggatttaatcaggcagacacagagggacacgtgtgtgcaaacgtcctaatcccgctcgaagccttcctggaaaaaggaaacaggcctcaaatctccctcttccctaggctgacatttccacagtttcccagccagagcttcaaatctatcagacaagagagatgaaaacaggaagagaagggaagtaagaagaaaggatagagaaagaattcggatttctgcttaattttcaattctacctcctaaattccttctggaatagaaaaggtaaaaagaaagaggcaaaaaaaaaaaaaaaaaaaaaggcaagaaagagaagggagggaaagagacatcatgttctttccctatgacccaaaaaaatcccaaccttgctattttaaacaatgaaaagcacagtgtgtgaggaacagcttgcagacagctgaagccggcattatttacctcgggttcttacactaacttttacttcttaacgcactttttacaacaaatgagaagaaagaggaaaacgccccgagtaggtgcatatccaggagatggtgcttgaacgggctctgaagattgccaggatgacctcctgcccaggctgcacgtggggccctgccagctacagccagtcaccaaatccaggtctaaagtcaggt

SEQ ID NO: 31755 - DNA, 1571 bp, Bovine  19866881151160
cctgcgccttgcacgaggaggggagactgccgaggaaggtggaggccccaggggagcctgggcgggggtgtgagaggctcccaggtccgggggctgccggagtgtgaggcagggactttctggctgggcctgaagccaccaaccagcctagcccccagagggaggacagagatccacctttgttcccgctgtggttggaagaggtttccaaacaggaatggactcgaggtggggaggtggggagctggggagctggtacctgtgctgtcaatcagacggacctggggcaagtcaatggactttgagcctcagggatgaatatctacttcaaagctttgtgtcggctccaacacgcagtaatagcaataacttatctactgctgactccatggcagacactgtttgaagagctgtatgtgtgtgaatgcacttaatcttccaatgacttcattaggtgggtgctattattactcccattttattaatgaagtaactgaggcccagagaagttaagtgacttgcccaagatcacagagctggtatcaaagcggggtttgaacccactcttgtgccctttagaccatgttcccatccctcacacgaactgccttcacattgcaacagagtttgcagtgccaggcctggcacagagcaagtgtttcatggatgtgagctcttaccatgacacccccagagcagctccagacaggggacctaggctccgacatcctccccagggatgccatggggccctaaggtggtcttccctcccatctttggtccgtatgaccttgcttatcctaggaggaaagattcctgctttggcatgagagaggctggccttccctctcccctcctcctgcccgccggctgcctgtctgctggaggcagagcggagcagaacagcggaattctcagcttcctctagttaccatcagtctgcaaagaaaacatagtctgctgtgtctgctgccagctcctctctggtgacagccacaacccatttgctcagcgccagcccaggctgtgctgtgaggagagctggcagctgggctctagtctcctgcaggagaaccccgggccggtcactgcaaggctgggcctcggggactgatgaaagggggaggcctgggccaaatgacttcttgagacctttatggctctaagagctatgcctgaagctggttgtgctgctgtgtggcctcctcctagggtaggtagtctgtctcataaacacattccccacacttgacacagggggagctcattaatgcccccttgcaaattagtaaccagctttccaagaccaccaagctctgctactggccacccttgcctcttaggagatacggggaatgaatcctttgccactttctgggaggccagatgagcctccagtcagctgtgaggtggttaagctagagccaggagcctggaatactgactacctccaaggcctgagttccccccacatcccatctttcacccccatccccgctccccagatgattaagtccgaggtatcatggagggaaagaacctcagagcagatgtctcagaacaacactgtc

SEQ ID NO: 31756 - DNA, 1082 bp, Bovine  19866881163427
tgatcggggctctgcagagccgcagggagagcccttgagcaatgacaaagcggtgctgagctgctccggatgcatctgggaaatgaaggaggccaccagccaccttcatcacatctctctacgtacggatacatacggaaaattacagactcctctcatctaccaaagggacttccctggtggctcagaggataaagcatctgcctgcaatgtaggagacctgggttcgatccctgggttgggaagatcccctggagaaggaaatggcaacccactccagtattcttgtctggagaatcccatggacagaggagcctggcgggctacagtccgtggggtcgcaaagagtcggacacgactgagtgacttcactcactcatctaacaaatgagccataataccacacacggtttccccactcgccgccacctgctgcccaataccaggagacagaacacctttcaaaggtgggaacggggactcaggacgtggcaacccaccccgccagggtctcacccaggacagacccaggtggggatgtctccaaagaaaacatcgaacttttcctgaccacggtgccacctgaggcttgcccaccatccttttttgtgaacacctgctgggtacatgtggagataagacgagtattacattatgatgcttcctcatgcatgaaagtctattttaaagagaagtctggaggaggggaggggcccagcagcaggaaagcggggggctgctgaggaggggagggtaaaaggaaggctcctttactttgcaagtctcagctacagaaaaaaactgtgccttccctgtaaagcaaaaactcattactgtttctctgcttgcagagaaagaaacccacaggtacaggaatttcagagaaacggatccgatttcctcatctgcttccctcgcatcgtcctcccaccctgacttctgggctaactcttggataaatgcacaacaccccccaaccgtacccaacagggatgaacacaagtcttcacctgcaatttcattctgaaatttcaccttccgtttccttccctcccaggcagagtagcacacaagctgcgaag

SEQ ID NO: 31757 - DNA, 1732 bp, Bovine  19866881174283
tatgtgtaaataaatttgtctatatttactgtgtttataacattataacttatagtattatacattatgtagtacatatcacatagtatatatatatattacatattaaaaaattatatacttatttgtatatgtgtatatatgcacacacacaaataaataagcatgcacacatgcatgtgtgctaagtcacttcagttgtatccaactcttttcaaccccatggactatagtcagccagattcttctctccatgggattttgcaggcaggaatactggagtgggctgccatgccctcctccaggggattttcctgacccagggattgaacctaggtctcctgcattgcagatggattctttaccactgagccattggggaagcccaatatataaatatgtatgtatgcaaaaatatatcgagttgatattttttatttaaataacacatttatatatgcaatatgatatcaagttgatatagatgtatctgattttgaatctatcaagtcaaaattcatctgactcctcaatactgtttgatttttaagagagaaaaataattttaaaacaaggtgttagagaacactctaacaactcctatcacttcacagctgaggactctgaagatctaaaaggggcagtgttcttagaaactttctcaaggaatattccaggagatattagtccccttaaaataagttcaaagggccaaataagtccaggtaacagcatctaccttaacctaatcttagaaaaccagacttgttagcaaagtaaaggctctgagaagtcttgcatttagggaatggagcagttgctaaactttttataaataaatttatttggccacacaatcctgtgtctcctaacataaccatgtacagatgtgagaggtggaccataaagcaagctgagtgccgaagaattgatgcttttgaactgtggtgttggagaagactcttggactgcaaggacatcaaaccagtcaaccctatagggaatcagtcctgaatattcattggaaggactgatgttgaagctgaaactccaatactttggccacctgatgcaaagaactgactcactggagaagaccctgatgctgggaaagattgacggggggagaaggggatgacagaggatgagatggctggatggcatcaccgactcgacggacatgagtttgagcaagctctggcagttggtgatggacagggaagcctggcgtgctgcagtccacagggtcgcaacgagtgggacacagctgagggactgaactgaactaactgaacgttttacacgcctcgggggaaacgtagccctaggagaaatgtccaatcttccatctagagtccaagtctgcttccaagaaatggcgaacatggcaggagtggtcagtctgaccacacatgaacactctgggccttgggacatgacactgaccaacttcccatccccgcccctcccaacagccaggaactttccagacgagatgccaataaaaacacagggccccagggtgcacggaaactgggtggggaaacatcgcaccatgctccctcctcaaggagccttggaaggctcacgtaagcctcctgccaagcatacttaaatggttgagaatgacctagaaggcaatcatctgcctaaaataaactctgagatggtgcagcgctgggaaggccatcaacattctgcagtcaggatgtgctgagccacaggcggcagg

SEQ ID NO: 31758 - DNA, 1721 bp, Bovine  19866881208035
cctcttgcctgcaaaatcccatggatggaggagcctggtaggcttcagaccatggggtcacgaagagtcggacacgactgagcgacttcactttcacttttccctttcatgcattggagaaggaaatggcaacccactccagtgttcttgcctggagactcccagggacgggggagcctggtgggccgccatctatggggtcgcacagagtcggacccgactgaagcgacttagcagcagcagcagcagactaccatgagggctgtgattgagagtgatgaaaatgctcccaggggcctggggttggaggagagcaattgaccagcctagaagagtcagggaacagaagagctggcatttaaggtaagtcctgaagcatgacaggatttgtagggggagggaaggaaggaaggttcttcagtccagagaagcacacgtgccaaggcagggagtggtaggaagccaggcctggcgtggacagactgtgctggggaaaggacaggccggacagaaaagctagggccagactttggaggagcctgaaggatgtgctgggcttccttggtggctcagagatttaaaaaaaaaaaaaaaatcctcctgccagtgcaggagacagcttcaatccctggatcaggaaatgacaacccactccagtattcttgcctggaaatcccatggacagaggagtctagcaggccacagtccatggggtcgagaaagagtcggacacaacttagcaactaaacgccaacaacaacaaaggatgtgctccagaaactagaactgtgtctttaagctgcatggagcccactgaagggtatcgcgctgaaggatgacatgtccagcctttattgaagctggagaccgcagcagacatctaggttggtttatttgggctctctgatgccttcctcacctggaggggcaagcagagacggcggtctttacccgtgttggtcaccccatcctggggattctctcctccctatgcttccatacagcagctcttccctgattttcttcctacctgtctggtggctccttttcagtctcctcagcaggctcctcttcctctgcccatcctaagtgctggtgttcctcaaagttctgttctagaacttttcttcatctcacaagaccattcttccttggagatctcataggttaccatggcttcaaggaccaaatatggattgggcgatttctcaggtctctctgcttatttagacccatcagatctgtccattggacatctccatttagttattttcattaaaattagctccagccatgagtagagggaaaactctaagtaaaatggcccaaacaagatagtttatttctctttcagataaaaggagtccagagcctggtatatttccaagcctggtataacaacctgggagtcacatctctgaaatctctccctttgtctctatccccaagccagcatcctcccccttggtcacttgcaccaacttccctgttcttgctcctctcaaatgcattgtccacatctacactgctcagcatggtggccaacaaacacatgtggttattcctaagtactcaaaaggtggctagtccaaatggagatgcactgtaagtgcaaaaggcacactggatttcaaaggtttaatatgaaaaaaaatgtaaaatattatggtttctctactgattatatgataaatgataatagctttgatatattagagtag

SEQ ID NO: 31759 - DNA, 866 bp, Bovine  19866881235334
tgaacgcccagtcccccccagattcgggtcaccagtacaatgccgttgtgtctgctttctccctggcacaggaaggacgaaaaatggtcaagttcaccccaatctggggcctcaccccaatcttcccggacatgtcaaaatcgtctcctatacaacaaagatgagaatttggcatctgcctgagtgggggatcttatctccaccccccatcgccgaacatcctctgggtcaagcagatgaaatcataaatttataatacaacattacttcaattttcctcttcatttacttctgtgcagcccagctctgctccagcggctcacagccccggccacacgggggaaattggctggctgcatatcaatagcacattacagcagccccatgcagacgctccatcaagccacattatggtgagatgacccagccaccacttccattaggagccaggccccgcccgcactggccaccgcacaatttatttgctccagtactctggatgcctgatcaatcccacagtaattatctcttgtcactaaagaaaaaaaccaaaccttctgcctggatgaccacctttcgtgcagacgggctttccattgtgtgtgtgggtgggggaatcagaaatcaacaagagattttgaatttgccagtccgatcatttgggtgatgctggaaaaattctcagaattgtggctctagatatttgctccaaccctaaaagatgtctgtgttttaaatgggcacatgacgaattctcttccaggctctgtgactcagctaactcagagtcaaggaaaactgctccaccgaggtacccgactggaagagacaagagacaagggctgtttatccagggagctgccagt

SEQ ID NO: 31760 - DNA, 744 bp, Bovine  19866881292152
ggtgtgcgctgggggccaggtgcagctctagagtaattttcaagcaagtgtgggtccagcccagacgtcccccctggtgcttgagaaaggcattctcacaactggtgtgctgtgcattgagatggtgaatgttttcttgcagttgaatgtgtaattcatttggtatcgggctatgaaaaatcctttctgagttttctgccttttatttcagccccaagactcttttatgatgagtgggcctcccccagtctctctgtctcacccatctgtccctgtctctctctctctgtgtccttctctgtcagtctctgtctcattctgtctacatttgtccccaccccctctcctacagtgacttggaagcattaagacccgtgctttttccacaaatgcaatgtgtcgtcttcaaagtgggagtctgtgtacttcttccaaggatctcgcctttgctctgaacattttcaaagctttcactgtgaactcatgctccgactctgtggcattttcctctgaatatcctcactggtgataaatctttggcctttgaaagtggatgtgatttttggaaaccgtcaccagccccagctccaaataacttgtggccaagattgattatgctgtttttggatcagaactcagcaggactataaaataataagactagttgtctcgcgtgagttgggaaatgcctggaagggaattcctaccccacccccacccaaatctcaaaaacacatttgaagt

SEQ ID NO: 31761 - DNA, 775 bp, Bovine  19866881353193
gaatttctgcagcagcagctccggatcggcctgtggtccagctctcattgagggtgtgaggggggaagggcaggtaaggccagggtagacaggacccggctcctgcagggtgacactggctatggtttgaatctccaggatccaacaatgccagagggtgtgagggccagaattcagatgcaggctgtccccagatgacccccagccacacttatgttttaaaattatattcttactgtgaaaacatgttgtgaaaacagcatgagggtgactttccaagaatgtgtttcaattgcctgtgattctccccaggcctgtgcacaataattgcttacaccttttctgtgatcccttctggtctttgtctacattacgcataaattggtcatagctctgatcctcctgtccgtatcactctgtaagcgctctgcctctcctaaatggtgttgcttgtttctacatagcgtgcataattatccatgttaatagctgcatattatgtaggatcatttttaattaacaacagcaccctgggttaacagttcatcgttctgccaagaattactttatttcctaatctcggttttgtataatgctgttcctttatgagaactctttcttaacaacctcaaagtgtgtagcagggggagatgttattgtcctggcttcatatatggggaaattgtgacctggagaggcaaacctgcccaaagtcgtactgccagcagggttgggccgagaggaaaccttcttctgagtcttttcgagttgagag

SEQ ID NO: 31762 - DNA, 1242 bp, Bovine  19866881380316
cggtggtgagggtgtggaccagtaagctccgaaaagaaatccgtgtgatttggtgggtgaaaaggcactggcataagggcagccagctgcagaaggccggcccagggctgggtgtggccacagctttagaagctgatgcgaatgagtcaccacgggctgcagtcacaccaggggacagagagagctggaaaggcagagaaaagcaaccccgggggcttgaggctgtgtcagccctaaacaaggcctggccagctcgctgggcaagaacaacttccaaatgccaaccaggggctcctccttgagtcagaggactcagccctgcaagtccttgagctttgccagggaaggacactcctgggtttgtggcttttcctgcgtctagatcaccagctagagcgtgagccttcatttgttcattctgagcccaagcaaacactgcaagcttgagacagcaatgtaaagggaagcagcattgaagagaggccacctcaggaagcctagtgcaaatccctgccctgctgcttcctagcatctgactcaaggaaagttactctcggagcccccagttataagggggaggctagtggtgccaactctattgccaacctcaaaagggaagtcgttgcattgcagtaaatggtgtgtgtcaagccctccacaaagtacctggcacataggaagtccttcccccaatggctgctgcatgcaggccatctggaattgccagcatcatccacttgaccttgaagctgcaggtggtcaactggccgagaaacaggacgatgagaggcctactgatgtgcccacagtcccacagctgacacctggcttcccctctcccacccagcacaccttccatgactagttagaggacatctctgcagagtgtataaggtgggattcttcttgctttctttttagtttttcagtcttggttgttgctgtttgatttggcttctaaccaagagttaaggcagggctttcagaagctgatatctccccatctcttctgttgctcaaggtcgctctcagagggacccagacttgttttggggatcctgtgagattacagaagccctgctcttcctaacaccctatccagagcagggcaggggcctcacttgcaggaacaggaagcaggcaggccacaggcagtgaggccactacagcagagcctgaagggcctggacgaatgtatcttccccatgaatctgtgtactgggaagcagcccgggaagtcat

SEQ ID NO: 31763 - DNA, 1135 bp, Bovine  19866881414906
gccctggtctcttaagtaaggggtctccctcaaacccttctaaaagacgactctggtcctcccgtcgttcacaagccttagggattccagcctagcttcgggtacaggtaccgcatcttggatggagtgcaacatccttcctgctcttgcccccagaccacctgtccagcctccgctcccacccaaaccctgaccccactctccagccccctttcccagaggccgctgcctgactgctctctcttgggctctgaaagtgaagtgaaatgaaagccgctgtgtcctgtccaactctgcgccacccatggactgtaccgtccatggaattctccaggccagaatactggagtgggtagccattcccttctccaggggatcttcccaacccagggatcgaacccaggtttcccgccttgcaggcagattctttaccagctgagccaccagggaagccctctcaggtgccccgatccagtccctataagtgcacccctccacagggatccatctcctcctctgttctcctgcccccgcccccaccacagcattctcccagccccatggagcgtggaggctcttgcactttgtcttcagccctgtctctccatctccagcgcggtgcttggatggcggcggggaggaggcctcaatctgtgcagttaccagccctgtcccgcctgcctcagttctgagaatcgggtgctagcgaggctgggtcctgggttccaccaccctgggcaaccttgccctccatttgggagaagtcagttcaaggaccagccacctgatcggcagtcctaagaggggtgaggccggagcgtacaggcagcgcgacaggacccatgcccagggcagcgagaaccgcgccagcgtgtgccctgctgatgacaggtcaggtgcgtcagctccgcacataagaaaaagcagcagtggatccatctttcagcatcctctaatggtactaagcagcgtgtttagctgttatttcaataagccttattaagacccaattttcttgggtcttctttcagattctgcggcattaaaagcctcgctgcttaattacattaggagcacctgtatatattatgtgcaataaatcaactttaatttaccaccgcacaaggctattcat

SEQ ID NO: 31764 - DNA, 1924 bp, Bovine  19866881610128
aacagattctgactcaaacccttgagacagttgggccccttcccaagaaacgctggcctctgtgagatatctctttcagttctctccagtagatctccttggaatttgccagataaagaggcaatttatcatgtggccgaaggttatacgtaatgcattatctgccttccaccaggattagcgcatccatgtaagaaccctggttgggcctccatcttgaggtgccatagcaacatgaaatcaacaaggagaggactcttaaatgaataatttactgatttcataagaacctgtcttgcaatttatagttctattatctttcctacccgtgtcttaatgtctctgtgtaacagctgcaatcagactgaataatatttgagaatctaataagcatatacaaccctggactcaaactgacaggtggagactggttctgagggtagtaacgttccttggaggccaaattcgaccactgctgtcttttccttacctcttgcgcaaaagcgtaaaagttagggagcaaatgtcctccagtaagctttatattttcaaatgaaatgtttttcttccttgggatatctggagccaatcaaggcagcgtcgaatggcattcagaaaggaagaaatatcactggctacaatttaccaattgtcacttttaaaattccccagagacctagttactagcaaaggagagaggaaaaaaaaagtatagtttcaatgacaattgcgatattttaaaagctctttcagtatcatcagtgatgccattttagtggcaaaagcacatcttgtcactcagcctcaatttaaaggatatttatgaagaagacgatacaatgaaagcagatttatttgctggcttatttatttgggtggaataggttacagattattttggttctgtgctgaagcagaacggatgtacactttttgaaacacattacccgctacctgcttctctgtagtcttctccaaaaaatcaacccaagagaagaccactgactccggggagatgcagacgtctagtggtcacagcctcagggaggtcgctgcagaaatgcgcactgaccacgagcctggaggagacggtctccccttctccaatgccctgggtccactttcctagcattcctagtgagccaccggcatcctgaaaggccatcagtgtccctaccaatgtcctttcctgcctccaaagcctaatggccacgagcaatacaaacccactcctctgtcttattttatacagctgatttatgacactgtgctaatttctgcggtataaagtgactcaattatatatattatttttcatactctttcccattatgatttattacaggatattgaatttagttcctggtgctatactgtaggagcttgctgtttatccatcctatatataatggtttgcatctgctaattccaaacctcccccctctcttcactggctggcaagaagctctgtcctgtcttcaggacactgaggctaaggctgaagtcacctctcattaagtgactggagtgtgagctggcagggaaacaaactcatgcgagtcactttgcaaacctcatgtccccaagacgaggacagtctggccccaaaggtagaatgtggcagttctgagaacacaggatttttgtgctgaatctcttcccctcgcctatttatagcgcctcgtctctacagctgaggtctgaaacccagccaaacacaggcagaggtagacctgttaagtcctgctcaatgattcaatctcaaaattctgaatatattactccagggctgaggcagatactcagatgaaagcgacaagaaatctcctctccagcttcagaaactctcgctcttctggccggagcctgaacctcggctaatgtcaatgagggtcccgcagactggcttcagaaacactgagga

SEQ ID NO: 31765 - DNA, 1826 bp, Bovine  19866881611669
ggtacccactgagatggcgcctggaaggaccatgcttgctgggaaatgccggcgaggctttgcgttgatgctcgtggtgcacgtttacagccgggagctccccgttctcccagggccttgggaagacgcggtggcgtctccctgcctgacacggcctggtccccgcgtctcccgggccgtgtctcactgggcccactgtttttccagaagcacggggtcaaccctgagtttgcccccagactgtaaaccccacccccgtcagttatgctctgtccatggtgctggtgctgccgcctcagaaggaggcattacaagaactttaatctcctactgtcaatagctttaaggtaaagtatattcagggtaagctctgcaaatgtcagcaccagtagcgggcccagggtctggggctaacgcatggcatttactctgcaggttcaagaaagtatgtgggttttaggggtcgcggggcaggtacgcgcgctagcagctcgctcccggagacaggcagtggcggagcggactcccgggatctagggagcctggtggggcggggcgggagaaagtggtagtcgggtggacatcggcatttatgcgtggcggagcggaagagtttggcttttcttgcgcgcctttgaaaaccgcgcctgcttgtgagttgagaggtccgtccgaagccaagctcgcggacctgagcagcgtgggcgatgtaggaagcgcgctctactcgcgccccgcgcccggaaccacccccgccccacccacgagtgcccatggttacgcacgtgctgaccatgagcgcccgcctgggacccgtgccccagccgccggccccgcaggacgagcaggtgttcgcgcagctcaagcccttgctgggcgctgcgaacccggcccgcgacgcggccgtcttcccccgcgactagctgaagcagccgaaccaccacccgcaggcgcagcccgctccgccgcccgccgcaggaccgcggctgcccgccaaggagctggtccagacaagatgtgaaatggagaagtacctgacacctagcttcctccagtttctgtaattcgagaacataaaaagtatagacgagacagtgcctcagtcccagagaacagtgcccagttcttcactgacagtgaagggttgccttacagtatcaacatgaacgtcttcctccctgacatcactcacctgagatctggcctctacaaatcccagagaccgtgtgtaacacacatcaagacagaacctgttaccattttcagccaccagagtgagacgacagcccctcctgcggccccaacccaggccctccccgagttcaccagcatattcagctcccaccagaccgcagctccagaggtgatgaatattttcatcaagcaagaactttctacaccagaccttcatctttctgtccctctccagcagggccatctgtaccagctcctgaatacaccggatctagatatgcccagttctaccaagcagatagcaataatggacactcttaacgtttccgtttcggccgccatggcaggccttaatgctcacacctgcgccgtccctccaaccgccatgaaggaattccagagcatgcccccttgcacatacaccatgccaagtcagtttcttctccagcaggccacttacctcgcccccgcccccgtcaccaccaagctcagagcctggaaatccagatagacaagcagagatgcttcagaatttaaccccacctccatcctgtgctgctggcaattcataatccaaatttacctgccatcctgccagttacttcacaaaacatccagcctgtcagatacaa

SEQ ID NO: 31766 - DNA, 1021 bp, Bovine  19866881678791
tttccctcaccactgagactaggctccagaatggatggtagcatggccacctcatcctgggctatcctcctaaagcccacctgggagcagatggccatagggcaagcagtgtctaggccagatggctgaaggggggtgatacccatactcacccccaaaacagatgccccagaggttaacataggtccacttatctacccatataccggagagattccacagtcctgcccctccctcccctctaccccaaaccaagatacacacacacattcacacacatatacacagaggaaaatcaagggaaacattgatttggtttgattgctaagacctaactaagaactagtcatcagaaattcccttgccagccaactaacaggggctgctctaagagaactccagaggaatgagaaaaccaagggctaagcagggagcagacaggagggaagaatgaaaacaaacaaaaaaaatcgagctaatcctaccctcaacatcctccaagcatgagctctggctggaagaataaaagaagataatccacaaagacacagcccttacttacaaactcttctgacaaagacagcaagacaagtctgctccccactcccacacaccacagacaaacacgtctcagggccccttaaagaatccagccccactccctgccccaagccgtggaatcacagttcagtggaatattctccctggtactagatcatccccctaccctccgtcctatccctctctccttgtcaatcctcactgtccctcccacagccttcctggccctcctaaagcagcatccaccaccagaaaaggcagcttgcagttttagttccacctccagaaacctatttcttttccccagccctcctagtcttacaggctttttgagggctttttatttgtatagggagagaaagagaaaagggaggagtgggagagatttcctagtgcaatacaaccaaaaaaaaaaaatttaagtcttgaaaaataaacataaagcagccttcttccccag

SEQ ID NO: 31767 - DNA, 1693 bp, Bovine  19866881679053
cacccccctgaaagcctgctactccctaaccttgaaaacgagagtgtgttctggtccctccggcaaccctctgagctgggctggacaaccgcattgaggagccctctctgaaaaggtgagtcctagcagagggaagcaaatcattttttaaaagttggaaagaaaaaacttctgggaaaccaaagctaatctatgcactaaacctactctcccttcctcctacggaagctccgagaaaggggagggtttaaggcagaaacaaacccaaaacctgatccctgctcagctcacagcttcaaaaaatggttaccaagttgcctccccgcaaggcacaaaacagaggcagttttaattctccacctctccgctcccattccgaccaagctgcctccccacagcgggggcaggagatgccatccatcctttagcacttcccctccattcttctcatctccatggtgaccaaaaaactccttcacccagataaacaagaatcccaaagtctaaaactttcttattcccagtaactgtctttgaccgtattttaattaaacgctttctttaaaaacgggggtcagagggcgtccatggcaggcctgtggttacaactccgcacttccactacacggaacacaggttcaatccctggtctgggaactaagatcccacaggccacgtcgagcagccaaaaataaatagataaattggggtcagagtttttatgtgtgattacagtcaaaccacaccacccccatctcctccttcaaccagctttacgcccatttacaaatatgtatatttttcaaatttcaaagccagctgtggctgcacacctgtaggcaacaaacccgtcaagagaaaaaaacacacatacacacctctgaaatacatacctagagcacacaggtttattttttgtttggagtgagagacacgtgtgagtgtgagttctgcgccagcagctgaactgcaacaccctggggggagggggagggaccagctcagggctgagccttaaggacaactgaagccagggcccgcataaacctcccagccagaacaaaccccggggtggagagctggaggggccatcagagcaccttcattaaggagaggcaagcagacaaggaggaaaagaaaccaacaccccaaaaccactcaactccgcaggccccttttctgaatcaaaacgctgggctgtgctgatccagaacatcagagccacaggcttccccagtgagagccaccacgaacaccctcgaatcgctcgaagctgcctgcttctgttggcaccatgtccctttaaagactgtttacaaatagacagcgatcggtatttcctaactcgagggtctcctgaatagaacagggccccgctgggcacactgtgaatgcgaccccagtccccagtgacctgccacctcggctgggagcccctgggctcggggaacacccccccacacacacacaaagatcactccgctggggcagccaccgtgtccgatacctgcacatcctccacctactctgccgcccctggagccccatctcctcttcccctccactgcctctccagctctggatggagctttgtcgctggtgccgtctgtcgtcctttgcagacgtttttggtctgggggcgtgggaagaagctatttctttcccctttctctgccttttttttttttcttcc

SEQ ID NO: 31768 - DNA, 771 bp, Bovine  19866881692424
ctcttccctgtctgactcccctttagattacaaacttcatgagagcacagagctggctgtctcattcatgtctacacctacaatgcccgggaccatgctcaacacaaaggggacagccctgaacagctgtcacgaatgagggacattcatgctgtcgtagaacaaagtgtggtctcccaagcccctggaaaaggctgtgtattctagaaagtggcctggttcaactgaggccaggccaggcaacatggagggaatgggaggacttgggaatttggggagacacccccagggtgggaaacactcggcatgaatgaacaaaaactagttgcacgttaatatgtgctgccttctcctatgaacactgtaattttcttcactaaaacactgtctaacagaaccaactcccctaattacagacgtttgtatgcattataatctttatacaattaaacctacttaaaagaataaatgattaaatgccccccttgccctgtcactaacccatccctcccctacccaccaccaccaaaaaacaaacaaaaaacaactaacacagcaaccaaatataaaacaaagcgaaaaaaaaaaaaaggatgctaaattagaatgccaagttaagttgcagacacacaaagatcccaggaaattgaaattcaggctgacacagaactttgtagctacaggggggatagtcaactttcgacttcaaacccagcatctgacagctcaacatctgactgcaatgtcaaattaaaggcttgtatggatcgt

SEQ ID NO: 31769 - DNA, 1598 bp, Bovine  19866881722496
gagctgctgtttccccgctgtgcataccctctctcacttcgatttccgtggaccccaggcctgagctctgggagggaggcagaggggccctggatctgcctgctgtctccctcccactggaaccctggcctgctcagttcctctgatagattgttttccatgtggagtgctaagcccgtattgagaggctgtggactgcagggtgatggactcagcgctgtgtttagagaggtgggcttggctggccgagtagggagaggctttgtctgagtcgcaccagtagttctgaaatgacttgaaaaagtttgaccttggggaatttccattgtgagtaaaacctagaagattctcagagttttgagaaagccactagtttctgtctgcaccatctaccccctcagctgctgtctttgcttccttgcgaggctgtctctagttcaggtcctgatcgcccatcacgccagggcttttgccccagcctccagctggtgtggtctcctcccctgcagatactctgcttctcctcgaaccctgccttcacagacgttccagtaaattctctcacctggccttccagccagaaaaggagtcccactgcttttccaccttcttctctgttgatgccacagtgagaactctctgctccaggccgctggtctgcccggggtcccaggcagcgtgtctgatgtgcccagttcggagtggtcccccacctccatctcggctaacttggcccacccttcaaagccagttctgttcactcacctgccatattatccaaacaggacacccttctttgcatttattgggcacttacttcttagagtggaatattccatactgggtagatttttgttctgaatatcttctattttcgtcacctccgcagtgtccccacattgtcacttgggctaaatctggttcagtctaacaaactcacaatggtccatgaatattttctggtctttttagttgatattggggatggggcaggaagctgagtgaggaaagagccctgaatgattcccgttccttcctcttaccctgaggttggtccagcgggcatcctgcagggcctcctgcttcagcatggcaggaggacatctggagcttgctgaaaggtcctgggttcagagctgaatcggtccctgttccatcgtcaggtaccacggaggcctgtgaacactgcccagcgagtctgaggcctggtggggaagctttgcagcttccctcttaagtggtgtggcgtctttgcttcctaacctaatctacccgaaagatgcccccatcttggaccatgggagtgtttctctagaaagaagaagttagtttttttgaagaagcaacctggaatcgttttaagcgtgtgatattatgatgatcattttcattgccgtcatatttctgttgaacgtgatttggtgccttttttcggaaatctatggagaaggcaatggcaccccactccagtactcttgcctggaaaatcccatggatggcagagtctggtaggctgcagtccatggggtcgctaagagttggacacgactgagtgacttcactttcggaaatctaaataaagcatggaggaagtgtag

SEQ ID NO: 31770 - DNA, 743 bp, Bovine  19866881747702
ctgacctgcaagcttgtgttgctaatatcactgctttattatttatcaaatcaatttcttcatggaatgactaataacccagccgcagctgctcttcctctccctcccgaccccagctgctaccgcccttgcagcggcaagatctgcggggctacctgcagtgcctcaagccccacagctcgaaaaagaaccttattatttatttatttttaaacagaccctcgaggtgccacttaggattcaaaccactttgtggcggctgcttatactatccaggaaaagttaatacaaggccaggacacgagcctttatcttaccaggggattttaattgtagtctcataacaaaggaaccacaaaccgaaaataaagtaaaaaacagagacaggtatctacttttctattttgatcctttataacatctttgattccagtctattttttttttaaaaccaaccaaacgaaagtgtcagtcgctcagtcgtgtctgactcttgcgaccccatggactgtagcccgctaggctcctctgtccatgaggattctccaggcaagaatattggactgggttgccatttccttctccagaggattgtcctgactcagggatcgaacctgggtcccctgtactgcagtcagattctttactgtctgagccaccagggtagcctaaaccaaccaagggccacaaccaattcaaatgtgcactgatatgatgcaacccaaggcaggtaatcccagaaa

SEQ ID NO: 31771 - DNA, 1211 bp, Bovine  19866882050419
caagtggggaggaggtcggggcctcctctcttataagtccagcttggattgtttgctcggtagaacattccagttggggtgctgtttgagcatctggctttgagtttttaagtactggcaggtgcagggggctctgccagatgagtgttggggtgcgttgtgggcgaaggcacggctgagtcttttctcggacagatgggctctctcgctgacatccccaagtctgccacactgagaccagctctgggggcttgtggtcctggggaagtgagctggactggtaacatctccagggtgctgccagctgtgggatgggcgtggccccccttccctgcggcttgcggcccccttcaaggcgggccgtctcgtctttggaccggcggatgtcggccacaagtcagttgaccccttctctgtgctcccgaaggacttggcaacttggctaacaaggagatggttgttagttcatttcttcattcattattcatgcagcgagcggtgattagcatttaggaatgtggtttctgggggttcgctgagttgtgttcattcactgaacaaacatttgttgatcctgggctctggactgggtgcagggcatggcgctggggttacgattttgaggaaggggtctccttggcccgtgagttgcagtgtttgagaaggcaggttatcagcaggtgtaggtgctacagcccacaggtgaaggatgctgaaagaggtacaggacctgcgaggggggcgtagggggagagctgggaaggcttcacggggggagagacactggacttgggtcttgcagagtcaatgggaaagacttggactgtgggaaggtgctcacctttcggggcaaacgggattcttggcattttgtttcccatgagggatggccacgtgccttcctatccttccaggtcttcctctgtcactcaggaattaacactggggtcctgccaccgtggggcttggtgtggaggctcatggagacggagagaggtgcagcgagtcctgcaggtgcccgtggctgaaaagaaggctggcttcagagcctcgggcatgtcaaagatgcacgcccgtggagcgctttccacaaacgagaacccagattctgactctgccccccaaagttggtctgctttggcggcatcttgtttccttgaccaacaggggaggttgagatgcgtcactcagagcagtgggctggactggta

SEQ ID NO: 31772 - DNA, 1409 bp, Bovine  19866880615553
ctttctattatttttaatcattccccagttttacctataccgttgttaatgacagcaaccatcccataaatttagtatagatatccagatggttctgagggagatattcaaatattctgaatcttgaatgtttcaattccattcattcaaattggcttattttctactggttccttcatgaaccccactagcagaaagcactatgcctgacgccctgtggccgatgagaagacagaattcttactcccaaattcaccaactggcagagtgaggacgctttaaccagcttcaccaatttaaccaactggagtgtgttgtttttctttaaaaaaaaaaaaattttgaaaatcaccatcctgaaaaggaatattttattcatgctggtctaagtaatgagggggaaaatattcagtactcaaatggaataaaaaaaaaaaaaaaagtcagcatgaatttccaaagacatctggaaaactggcagaagaattaaaaatacgaaagcaccggtaatcccagctgggctgaaattgccttcctgtggaaaccctgaatagaaaataagcttctaaaaaggcccgctcaatgcattttctttatatgcgttaccagacctaagactgctttaggaattcccaaagacaatcctctggaaagttcatttacacagtgattccgatttaatcaggggaaggcaaacctacaacgtgtccccagggccccatacgggctttcagttcacgaacgtattcgattctgcattgagaacaagaatccaggcagagatctgacctagaacagaagtcaaatctcaccctcccccaacccctttacccacgacagtcaaagactgagcctcttagcacaccacacctgagaatagggcttcctcactctaagaagagagtgatggctcaacccacccatctggaggcggccagaactgaccctcaatcattccctccatctccatgccagattttgagcccgcactgaaccccatcaatttaagacaaactcaacactacgtatgacagcattccattgtcacacacactgagtccattcagaatctatgggctgggaggaccacccaggtggtaaggctggacccacacgtcataccaggatcagcagctcactggctgtgtgacccaggggaagtcacttaacccttctggatttctgtttcctgatgtgtcacttacatactggacaagatgctcttgctctcatgtaacctgagtgtcaggggacaaagagcctgttaatatgtgtcttcagaagtgcttctggaggcgtgatggccctggccttgccctcttaccccatttcattcctgcatgttgggctctgttctgttcctgactagttgtatattcccgagagacagggttcccttttttgtgccg

SEQ ID NO: 31773 - DNA, 955 bp, Bovine  19866880654119
atttatttttaaacaagtggggggaaactgagtattttgaatgtcatgtgcaaaactgatccacgtcaccatctcaccgtcatgactgaacatggcaaggcgggtacactggtttccagcatcacaggcaacactgcatgtatgtattttaatgagtaatgtaaacttcagtgttaaggcagctggtactaacgctgcacacaggcttagctccgtgcccacctcaggaatgggatggtcagcacttgaaaacaaactgagagagaaggaaaggggagccagcattatctgacaaaaacaatgcatccaaatatttttcctttcacacacacaaaaagaaatattggaacacttagaaaaacaaagcacccatcccaccaacttcagcctgttccttaacaaatatttcaaaatactgataaataatagtgactgcaagcagaattccagtgccagagccgatggccccgaggaagtcggccaacactgacagggcgccgatgcataagcccccaaatgcagctgctgtggggatgtacctggaagacaaaaaccctgagtcaggcggagcagcggaagggtgagcaactaaagggagctgtccgcagtactgacggctgtctggggccacccagttaacatgctgatgaaaactgatgaagggcatgatcgggctcccttatttcaagaaaccagttaacagccaagaaaggcaatacatgattttcatgccagaagaggagaatcctcaactgtcacttcagtattggaatatttaatattgtttgtaagtgagtaaccttttacctccctcttttagataaacagtgaatttcaaaatgttttcctaagtagcaaatttatgtgataagatttggatgatcttaattcacccctggcaacatgttggaatcacctggagaactgttaaaaataatgggactggggacttccc

SEQ ID NO: 31774 - DNA, 3504 bp, Bovine  19866880664284
ttttctgaatgttgagctttaagccactttttcactctccactttcactttctcaagaggctttttagttcctcttcactttctgccataagggtggtgtcatctgcatatctgaagttattgatatttctcccagcaatcttgattccagcttgtgcttcttccagcccagcgtttcccatgatgtactctgcatgtaagttaaataagcagggtgacaatatacagccttgacgtactccttttcctatttggaaccagtctgttgtttcatgtccagttctaactgttgcttcctgacctgcatacagatttctcaagaggcagatcaggtggtctggtattcccatctctttcagaattttccacagtttattgcgatccacacagtcaaaggctttggcatagtgtctattacataaaaaacattgcgaatatactaacaaaagagcaattttttaaaaaacattgtaatacaactatgacaagacttccttctcttcctgaagacaggaatatggttacatttacatcaatctctgataacatttagaatatgaaattttctgaattatgtaagagtacacacacatttcttcacttcaccatgaagaatggaatcaaatgaaatattaacacaagactaaaacattgctgcctaaactctgatattataaagaagtcttttaataaatatctgtaattgaattttgttatctacacatttatgaattcttacagtcaaagaaatgggattaacatatatttgtttatattaaattaaagttctgggcatacagggtgggcaagcaatttttggatgcaatgattaaaatgtcttgttcctgaaattacaatttccaaatgactcctttactgtgcccctagaatcactaattccaaatcaaatggcctgtatagacaaattaaacttcccaatcatctctttaaagaaaatctcactgagatcacaacacaatctatacaactgagtagttgtatagatttattactgtgaaattatcacagtagtaactactgccaaagtttatcctaggtggcgctagtggtaaagacccctcctgcaatgcaggagacataatgagacatgcgttcagcccctggtcgggaagatctggagaagggcctggcaacccactccaggattcttgcctgaagaatcccatggacagaggagccaggcaggctacagtccataggtcgcagagtcagacatgactgaagttacttagtacgcacatcaactcttaaggggagggacagccctttcccccaccacagataatccaatttctgtaaaatgagtgaaaaaggagtctagttgacccttgaacagttgcaggggttgtggcactgaccctccacgcaggcaaaatccatgtataagttatggttactcttctgtgtacatggctcctctgcatcgcaggattcggcctgctgcaggcggtgcagtactgaagcatttattactgaaaaaaatctgagtctaagtggacacttgaagcccaaactgtttaagggtcaactgtattatgggtgaaggcaatcctatttctttcaactggcagtcaagttacagtctcatcctattaaattttatattttaaaaaatggctttcagcaaaagcagaaagttgtgtcactacaacttataatgcaaaagtagcacattaagacaaatgcacagaataagcaccatacttcaggaatgactaaaaaaaaataattcttcaggggaatacaaattctagaattacatactctgaaaacaataaaggatcttactcttctctaattctatagttttaagagggaaaaatactccttggtcagttgaaaattttaactagtcaaaattcaatctacaataactcacatcttgatcacgatgtggctggagtgcttcagaaggagctatgatgaagaggaaggcagaatttactggattccatttctagcaactctgttctttcttcactagtaattacatacctttctccagctaatcacagactagtttactgccattcggactacgaaaaaccgcaggggaggcaggaaaggacgattttagactcccatataatcagcaaattgtttctttgaaaaaaacattatttgagacaggagtggagtaagattacaaaacagggaatcattttcataagagcaactgtaatcttaacctaaaaggtcacttaaatgagatgtgaaaatgcttcttagatgtaaaataatacaaagtacttggccagtcttagtttcacaatgcttacaagcttacaagttccaaataaatgataaactgtgctatagataagtgaacctgaaaatgttacagcaagtgcttcaattatggctcacctcttccaggtaaaaatatacgcacgaaatgcaaattacaataaatctgaatacttaagaataaataatgaaatactcacggcccactgtcctagtaaatttactagaaagttgccgctgaatcgaactgagagcatctgggaaatcacgtacaggttggacaccagggcggactgcaggatgatagggatgttggacgtgtagaagagcttgatggggtagctgctgtactgcccgcggtaccgggctgacttgatgggcaggtccacacggaatccctgaaaaaggaagctcaggagtgagtcagggactgcacacagcacgaatctggacagtcacagaaggaaatctgcaaagacagtgctagcaaactcccttccacacagacacacagaaatagaaacccttctctacttcataaccatggatactttgcagctcagcgtctactgaacaatggaccttttgcctaactagattctgaaatgctgacttgttagctactaatattcaaatggcatactcctcctttaagagcagaataaaaatccacaccccacttacttcaacaaagatggtatacgtacctgaaaatatataacaacagcgaacacgaaaactgtggcaatgaggttcatgagattgggcaaattctgacgatagaaagcctccctcagggctcggactttgtctgtcctggtggccagtaaatgaaagagagctatgactgcgccctcaaactccgtacctgatgaatcaagatagaaatcagctgcagcctcatcacccaaagttgtcccaaagtcaacaagcaaccctaaagctccagtacagggcagaaaacagcagtcaaaataattcaactaagttttctttatgatacagccatgtgtggagcttctaaaaaatactgacatccctgaggcaaatgtaccttttgttagcgtaaatttgaagttttctcaagagactattcttgatgaaaacagtcaaagaagaataaaccaaagcaaatatttagttcataatggttggcctcgcctttactttgggggagggggatgggagatgggggaaaagcagcagcgaagcagcaaacagatgtcagaacgaaaa

SEQ ID NO: 31775 - DNA, 2913 bp, Bovine  19866880773501
tgttgccctcttctcctcctgcactcaatgcttgcaccagtactttggctacctaatgtgaagagccaactcattggaaaagaccctcatgctcggaaagatttattaatgaaaaccatgttttagaagggtgccaggtccctcactgaagagtcagcacaatatcccaccgcctttatctctactagactatgtaacgatcatgcacgccacatccttatggtgtggattgcttcattcataccagcttctaagctacttgtggatgaactggacacctttttcagtccctgagacaggatgttgcatatgaaatactttgaaatgaaagatgtacctgccttccctggtggctcagatggtaaagaatctgcctgcaatacgggagaccttgggttcgattccctgggttgggaagatccgctggagaagggaacagctacccactccagtattctggcctggagaattccatggactgtatagtctatggggttgcaaagaatcgacacgactgagcaactttcacttcacttcacttcacctgtctgtctactgtaatacagagagacgaacaacagtaatattgttgagaaggatttttcagccacaaaagtttgaaaaccagaaatcagaatggattggaatattccatttcgtgaacagtttaattaagaaatactactactaccactagtaataatggcatctactgtttccaggtgctttatgagtaatatgtcatgtaatcgtcacaacctccctgcagaaaagtttttgttcttaaaaaattcttagtagtctgcacatagaggataagtatcttgcccaaaatgtaaagctaagaattgaaagatctggaatttgagtccaggtcctttaaagtccagctgttttcccctgtacctctgtctgtgtccaggctaaccaagatgttgctctcatgtaatttgtttagaggtcaaactgggtaatctaggtttcagggtgatgtttttaatctaaagtatttggtatgactaaataatcaaattaagtaactgtcaaatccctctttgttcagggatttacagatttaaatacaattagaacagatctttccaagtgccttttttttagccttttgtggtagaactaattttggtgagcagcagaatgagaactcagggaacattcaagcaaggaaattgacataatttcagaacatgctcagaataaagtcttcctttctacagggaattgagtggctgacaactccaggaaacgtcaaattgactttaacttcatgcccactgcttgggctttatattagcatgtgtttatttgaccagacacaagtgttgaatttcattaaatctgtccatttcaagtctcctttaacttgagaattacttgagattttcttttatcttatcactatccttttcctacctagtacaagtacagagaatgttgaaatatgtttagggaaataaatattgaagatgttgcatattaggaagtggatgcatctagtatctcttatgaatgggtgttatactgaaatagcctttttattttggcacaacaaatacatttaaggattatgctctcagaactagcatcatacttagtggtgagagaatgaaagctttcctctccatcaggaatgaagcaaggatgtttccccttgccacttccacttaactctgcactggaggctctaaccaggacagttaggcaaaaaaaaaaaaagaaataaaagacatccagattgtagtggaagaagtagctctgtcttgatttgcagatgataaggtcttgtagagggagacccttgcctgcacgcatgctaagttgcatcagttgtgtctgactttgtgaccctatgggctgtagcccgccaggctcctctgtccatgggattctccaggcaagaatatgaagtgggttgccatgcccttctccagggaatcttcctgaccccagggatcaaacccatgtctcttacatttcctgcattggtagtaggcaggttcttttccactagtgccatctgggaagcccaggcaaacccttaggaatccactaaaaatctattagaactaatgtgtgaattcaccatggctgtaggatacaagatcagtatatggaaattattgtatatatgtattgtggcaatgaatcatctgaaaatgaaattaagaaaccagtgccatttatgatagcatcaaaaggaataaaataggaataaatttattatactaaagaagtagaagactcatatgctgcagattaagaaatattgttgaaagaaatgaccagagaggactaaataaatggaaagacatcctgtattaatgtattgggagacttagtggtgctctgatagcagaagtccccaaatttatctacagattcaacatagtatctatcaaaatgtcagcccagctcttttgcagaaattgatgagctgatcctaaagttcatatggaaatgcaaaggacctaaactggccgaggcaatcttgaaagagaatgatcttggaatatgtacatttcttaattttagaatttactgcaaagatacaataaccaagatagtgtggtactggcataaattatgacaggcatatgtagattgatgaattaagagtccagaaggaaaccctcacatttatggtctattgacttttgacacaggtgctaagacaattttatagaggagagaatagtcttctcaacaaatagcattgggataactggataccacatgcaaaagaatgaatgtagatggttccctcataccgtatacaaaattaacttaaaatggatccatgacctaaatatcagagctaaagctatgttaacaacttagaaggaaacataggtgtatgtcttcatattggagtaagcagttttttttaggacacag

SEQ ID NO: 31776 - DNA, 1085 bp, Bovine  19866880780691
atgtctgcaccaaataagagttgtaaaggcgatgcacgccaggcccgccctcagactccactgtgagcgggggctcgaaacccaaaacttaacagctccacaccccacactgtctgcaaccacatctcctgcacggtgctggctgagggggaataaaaatgccatctgcatctcactgctcatctgccagacacctagctactggtctgcaccccctcaggcccttcctggaactggcactccaccttataatggctcaagtcatgtcatagatcaacaagaggaggttatgaaaatgtatcaaacacacacacacacacaatgtgatactaaaatgatttaactttcttttttcatttgtcacagtcttgaaaagtctgcttaaaaatagaaactggatccacaaattgttttcaccattaaatcagatccacttcttgagcagcagcaaaatgaactcccttcctccaaccctggctgtcttcctttcttctccaggaacaaatcactgtgtctcaaccatcttaaatgacaggagagcagaatggaagagatcaactgtcaggaggcctcagtgccagcattctcccgagggtaaatatcagggacgattagaatggccttacttgatttttcaaacaaaatctttacttgatttttcaaacaaaaataccaatccagaacttcctcctaagtgggagcaaccatcggctggctgtgcctttctccctctccgagagcttcatagcatttgaatgggaaagatcaaagtgttgtcttgaaagagaaaaagatgagaacacatgtcatggcatcgttcttcagcagagcatttgatacagcatccaagccaatgctatttagtcagtaagttcccaggccttagccaggctgtatttacatatcaagaaaacctgcattgcttaaaattcccagttaaaaaaaaaaaaaaaacagaactggtggaaatgctttaagaaaaaagaattagaaggtatgcgtaagtcaacatttttaagcagggcacaaaatgacaaaaaaatctactccagaacagaaaatgttcaagtcttatgaattaaaaa

SEQ ID NO: 31777 - DNA, 1241 bp, Bovine  19866881038804
tctggtaggtgtgtgcgtgcacacatacacgcatgtttacatctggtgtgtgtgtgcatgcacatatatgcatgtttacgtctggtgtgtgtgtgttcgcgcgtgcatatgtgcatgtttatgtctggtgtgtgtgtgcgtgtgtatgtgcacatatatgcatgtttacacatttctccatactgctgggcacatgaagagcatctttcatccccccggcaggtgagaccatgaggccaaagcctttgagcagctcttctcaacactgacttggctgcatgtaagagtcctgagacggagatggggtgctttttaaaatttcccagtagccaccataacctccaattctatctcaattggtcaggctggagcctgggcgtcaggatgtttgcaaaagattcctgggtgattttaaagtgccatcagggttgagaaacactgatttagagggaaaaaggcagagaccctgagctgagactccccagtgtatccacgatgaagtacttgcagtttaaaagcaattcctacccaggcgagaattctcccccaggaaagatcatctcggcagccaataaagtaaccattagaacagcatggaatcctggggccatgtttcatgagtacagtaactcttgaaacagtccaagccttggtaaccccaactattaggaaaagggttactctgaagacatcggttttgcttctctcgtctcctatattccatctctatgcattcccttcatccgtcatttcagtgcaggctgttcgtatattttcctttctacttctccataaatgctttatgtgttgccttgaaattagatttgagcactgcctgccctctaagtaaataataccacggaaacgataagctccataatccagtggtaacactaacattgtgatattccataatgcagagaacacgcccttcacaggacctgagctaaccattcctccagggaaggctggtgctgagccatacagaccctgcctcctgccggtcagacagaatccctcgatgtcacatagcaactgcctaccatgacgcctgcctctttttatcccctctgagcttggtttaacatccacttatcaagtaggagattcattttgggactattttcagggcaagaatagagacatccttaaggatatattagctacgttactttaatccaatgaaaaacataaatctctcaccctgcaataaactcagcacagaggagggcaagcagtct

SEQ ID NO: 31778 - DNA, 1391 bp, Bovine  19866881073426
cttgaattaatacactgtgaaaaatgcatgcttgcaaggcttttgaggggctcatcagcagctctagaattgctcagggctagaggttccaaccatttttcagataagctgtgccagcgtggaggtctgtctgctatgaaaaggagaatctcacgcctgagaaagtcccaagctctggcatgaatggagtgtattaccatgcttctaggctctcctgaaaactgttgttggaagaaaatgggtaatgagccccaaggaaggtgaggattgtgaagccaattgcaaagattttcattaagttgatgtgatttacatgccagggagacccggctgcatttccactgaaggggcttctggtctgtgtggtttccttctgcaggatctggccgaggaggcaagatcatctggctggagaaggggctcttatttgttgcattcagctcccatgctgacgattgcatcactcactgtgtggtcctggagtgagttgaggctttgggtggaagggaggctgccgcatgcgtgtttcatgtcacgtcagtccttgatgtgtgtttagacctccagctacattctgcacactgctctaaagacaggctctttaagatatggagaaatgtcatgatattactcacctggggagggtgtggccagaggctccttcctcaggcttccccaagagatgctgagcgtgacagacccagctttgcccggcaccactaagcagccgccgagtggcttcatccacacccgagtgggaacgtgacctagttactgtgccttccagtgctttggcacaataaccagacctccttctcccctccccactgcaagaatcattctgctgagcctcttggaggctggagggccagttttagtaacatgccctttcctggtcggctcctgtccagttattttgggtgagtgttaatggccgtgagtttgaaagttttatttataaggaaactgtccttcttgaccctggagtccttgtcaactgttattctgtctgaagccctttccttcttggggaagagcctgagagcacagtggtcacaaaatctttctggctttgaattgtcccctgtggtcttctgctttttttcaatgctttccatgtggagggggttgaattcagcatctgtgttggtaatagatctcccagagccccagtgaggaggacatgtttcttacaggttttttttttttaatcttttggccataccacagcagcatgtgggatcttagttccctgaccacggattgaacccaggccccctgcattggcagcttggagtctttaccactagactgctaaggaaagtccctctttttcaagagggaccgtgggatgcaccctgctgaggtccatggtgacttgatcttggggg

SEQ ID NO: 31779 - DNA, 1813 bp, Bovine  19866881207313
tttttaaaggaaaatggaaagtgttagtcattcagtcatgtccgactctttgcgacccccatggactgtagcctaccaggccgctctttccatgaaattttccgggcaagaatactggagtgtgttgccattcacttctcccagggatcttcccaaaccagggattgaactcaagtctcctgtgtctcctgcattagcaggcggagtctttaccactgcgccaatgagttgatacattttttaaaggcctacacaagaaagaagaaaaagcacaaagtattctatcatattaagaaaaagaaacccaattatgtgtggagaaaatgaagatttttttttttctctccgaggaaaattttaattgttcactagaacacccagggagagcatgatcaagtggaaatgatcagctggcctggtcaaagctctccactgggtagcatttggaacattccctattgcaaagacttggaatagggatctgttacaaatgacctaggaaagagctcctggattataattctttgtaattagagacagaaaatctcctttgagtttgctatcaattccctggcctcagttactagaccccaactcatcagttagttatttaccacatcaagcgccccatgaggaaagccagcaaaagtcattttttagtttatgacagacacagacagaacattatgagaacacaatcaccaggaaacaaagaaagcaaatgtcaggcgagaccaagtcttgtttcagttataattacactgcattcaatagttcgttgtttcatgctattttgtgcaaaatgggtttggtttgattcagtttggttcagttctgatgactcctggttgtctctcctgctccatggctgttcacaatgacgacactggagccactgtttttatcattaggaatctggttccaaataaccggactgtgcttgctgacaatctgtttaagccattgtgatgcatacaggtgaggaagggccaaggcacaaggaaacttctgaggttggtaatttccacacatccccagcaatgatatctcatttcagcacaaggtggacaaggatgaatgcactcaaggcaggctggggagagagctttgcttttttgcctgagtggtggtggtggtttagtcgctaagtcgtgtccaactcttgcgaccccatggactgtagcctgccaggctcttctgtccacgagattctccaggcaagaatactagagtgggttgcgatgcccttgcctgagtgggtccctaatatacactacatcctcctgaaaaaaagtatcaccagctcatcattaaattgtgatggtccagattaagaatactgacatgaatgtaaacttcatacatcttctacttcctgttctatttgccaagaagaagcttgacagtgagggtcctttaagcctgtgctctaattgtttgatcctggataatctcagaattcttaacacctcagtctccaaaagtaatggaaacgaagggaggaagcttggaattataatgtggaaggatggaaggggtccacaaaagtaatgcacaaaaatggcccctggcagaaaatacatgagaatccctgccatcttaccctcaaggccatgaggaccctcttcctgtaaactcttccaagtcctatataaaccacaacaggaccttcaggcctcttcatttgtaatacactattatcatgcaaattagcaagctacattttccaaccagaatgtctactatgctgaatggggaccccaatcaatttcagatgacaaactattagatgaatggggtgtgtgtgtgtgtg

SEQ ID NO: 31780 - DNA, 993 bp, Bovine  19866880200960
ctagaaacatctaaatccatgggaattggaaggtggctgtcaccacataatttctgtactcagttctctttactttttaatcatttcatattttaatgccaccaatctaacatgagaacttaactgattgactctttagttacaaaactcttctttacaaaaataaatatttacaaagctttaaactcttgagagtcccttggactgcaaggagatccaaccagtccattctgaaggagatcagccctgggatttctttgaaaggaatgatgctaaagctgaaactccagtactttggccacctcatgcgaagagttgactcattggaaaagactctgatgctgggagggattgggggcaggaggagaaggggacgccagaggatgagatggctggatggcatcactgactcgatggatgtgagtttgagtgaactccgggagttggtgatggacagggaggcctggcgtgctgtgattcatggggttgcaaagagtcggacacgactgagcgactgatctgatctgatctgatctgaaactgagttatgtttgcccagtgtcattgatttctaagatttggggaggggaggcgagggaagaagaagagctggtcacaataattctaacacacacagaagcctgaagatatgattacatcttctctccacttatgtacaaagaatctacagtatgtgatcctgacaacacatgtttcctattttgtcagttcaataaaagcataccatgtcaatggtttttagcttgtgatttggtgattgtttcagcactgattgtcaatgacctatatgtcagctgatacagttgacacagttaaatcagaaattagcatgcagtctcctaaaatgccagacacatggaccctctgcaccagagagatataatgaaacccacatgatacccccattaaacaatgaaacatgtgacattaactaaaaacaggaacacatcagcaaatgtgcctgaggaagtt

SEQ ID NO: 31781 - DNA, 2174 bp, Bovine  19866880216454
cttggttttccagtggtcatgtatggatgtgagagttggactgtgaagaaagctgaatgccgaagaattgatgtttttgaactgtggtgttggagaagactcttgagagtcccttggactgcaaggagatccaaccagtccattctaaaggagatcagtcctgggtgttctttggaaggactgatgctaaagctgaaacttgaatactttggccacctcatgcgaagagttgactcattggaaaagactctgatgctgggagggattgagggcaggaggagaagcggacgacagaagatgagatggctggacggcatcactgactcgatgcacgtgagtttgagtgaactcttggtgttggtgatggacagggaggcctggcatgctgcaatccatggggtcacaaagagtcggacacaactgagcgactgaactgaactgaactgaaacttcaattccctcatctcaccagaataatacctaaatgcatagtggatgtaaagataaatgagataataaatcttaagagtctcaaacatggatgcaaacattcaataaatgtcagtactcttcttcagtgtttaaactggaacagtccatttccaacacagtattttttccattaaggtaatcaaagatcacatttagtgaggaaaacaaaagctataggacaatattgttatatttctgtaaaagcacatccctatgtcaatctggattgagtgagtcaactacttttcaataccaatactgaggcttacacagggaactagatccactgagacttccaggttgctatatttaactctttggaaaataaaataaattttatatatattccatggaagcaaagagcgccaggtgctacatatgtacatgcttgcttattgccatgaaaaatgaagcaaccaaccctcaatccaagaagactgtttaaaggatgatagcataattttaaccctacttgcttacctaagcctaggaacatgtctcatttgttattggtgctcagtcgctaagttgtctctgactctttgtgaccccacagactgcagcacacctggcttccctgtctttcactatctcccagagtttgcacaaactcatgtgcactgagttggtgatgtcattcaaccatctcatcctctgctgcccccttttcctcttgccctcagttagtaacacaataacacagcactctcattcttttagacaaaataattttgggttatcaccagacagtttctttgaaaaaaagagtgcatccagctacatgaagcatgaaggcatttcagaatccttcttgatcttcctataagatttaggcattttactatatcacatattattaacctaaaaagtgcatatccttttaggaacaatgaaacaaaatagaaagattcactcagacaaaagaaagacatgtacccagatgctgaagtaaaaatggacctgaaattcagtggctgcatgttagaagatattgtggtggtctggaaatagcctctactatctagaggcttgagtttaaaactcagtaaatgtcataagaagagaggaatctttgagcatatttgactaagaaggtagaaatgagaaccctctgaggcagaaccatcaatggctccatcctctggaacgagctgctagaaacacacacattgagccagggaaatggcaggaaattctgccattgcctgggaatatgagtcaaaaagaaaaaaaaaatcagcatggaaagtgagaggcttgattttacatgttttatgggataaaagaatgatcaaaccaataaatttgtagaaaaaattgctatcagtcaacttgcatcagtacgtgctaagttgcttcagtcgtgtctgattctttgtgaccctatggactgtagccggacaggctcttctgtccatgggattttccaggcaagaatactggagtgggttgccatttccttctctaggggatcttccctacccagggatcaaacttgcatctcttaagtctcctgccctgggaggcaggttctttaccactagcaccacctaggaagcctaatcagcacattcaaactcaaaacccttttggggaaaaacaactaaagcttatttagtactctctctatcatacacacacgcacacacacacacacacacagcctggttctaatgacttca

SEQ ID NO: 31782 - DNA, 714 bp, Bovine  19866880361702
tatggtgcatacacagactttagttaaaagctccctaagcacagacaaatacattattgtatgcttattatactttagaaacacaagataagaacataccaatgtgtgacgtaatcctaatatccacacatttctatatctatcaacctgctaaacaccgaactacctgacatctaacccttaattgctcctgggaatcagtcgggttgcctgctaagtcttcaggacagtcctccagggtgagtgtgatagaactacagtttgtccactgcttcacgcaggctgtattccaaactaatatcttagctaagttagctggcaaattattgggatagtaatcaaaatctgtaatcagttgtagttaccttttcctctacaaagtaatagtgaatcaataaaatgaacaaaggcaaatatcagaacatcctgaaaatatactatcaaacttaaataggtttacaggtgccattaggtgacagaacgtgaggggaaaactttcctttgattcacacctaggggttacctgctaacttgaatgtatttatcactaatgagtacaatgggtttaaaaaaaaagaggctgcaattaacctctatgaatctgtccctggtaataagtattttattactctggccaaactttcgggtaaagtactgctaatgtcagaaatattcttgcagcccattaatgggtaatttttcacagtaattata

SEQ ID NO: 31783 - DNA, 922 bp, Bovine  19866880381060
gtaatctaccccgtggtgctagtggtaaagagcctgccaatgtaggagacacaagagactaaggttcaatccctgggttgggaagatcccctgaaggaggaaatggcaacctgctccagtttcttgtctggagaattctctggacagaggagccaggcaggctactgtccatggggtcccaaagagttggacatgactgagaaactaagcagcatcaaacccaaagactagacataaaaatcaaaaccagtatcatctttttctgtttttacatttctctgatggtcactgaaaattcatgtctggggttaatctgattataaattgggcagaatagatattgctgtaagtcacttatcatttctggaaacccctctggcatttcacacctagtgccctttacctgttctctaatccccgtgtctcccctggtaccccttacacatcactgtttattctgcaactaatgtagccaatactcaggcactgggtttcttatcctctttttaaccctcaccacatcctactctgcatttgtcatagaataaaacagtgctgtttctaaagaaatgccaagctagtcagtctatgctgaaagggatggagctttctaattcgattggcctttttgtgcttgtgctgagctacacctgttgggcaggtggcattccagccgctcttcactgaaatagatagtgtatgaagtcctttgtgcagctctgcaggtgcattaattatagactacctggatgcatctagaacacttggcagtagcaagacagtagtgaacgttctgttaaacagtgtttccaatggcatgttctgtgggcagttatgaggcagtcagataatggctcagtataattcaggagtcactggatcaccccaattgaacctctactcaattttgttgcaaaataaa

SEQ ID NO: 31784 - DNA, 1896 bp, Bovine  19866880455091
ttccttctgtattcctttgcatcagactttgtgtaaatggtgaaaggaaaatcaggcatggtccctaacatcccctgtatttatgaattccttctgaggagacagaaatctgttgattaaaacaaaccatgaaatataacatcatagaatgtattaagtaggtagaggatgttataagaaggaataatagggagagggtggggggattgtggtaatatggcttagaaaacacttaagatgaccacattgagggccagttctagagtttagttttgaatctgttgaatttggagtgcttttgagaatgtttgttagataaatgggtctaacacttacagcaaagatcaggccagagaaacaaatttgtaatcacttgacatatgtgtggacatatagaaggaaaggaatagagtctaaaattgagcctacaacattgaatgactgaagagagccactgatggtctctgagaaggatcagactcagaggtaggagtaaaaccaggaaaatgtgatgacagagaagccaagggagaaagttcaggcaagggaaagcacttgagtattgaattctgatgaaaagtcaagttgtggggactaggaaacacttcagaatttaacaaattggaagtgactggtgactttattaagaatccatttagtagaaagtggggccagagaccagaattgaatgtactgaagactcgggagttaggggtttgtgggaggcaaaaatgacgatattcaccaagacacagaaatgtaccaacacctcactaaagaatacagcatcttttaatacttggtgccactctggactctgtttcataaacaggaggatgtgtgacattattttcgttttctaagggctgaagatgtcagagactgtacctccttactagattgccggaaagcgggattttggaaactctagcatttcaaattggattggaccactgttgtcttagacttcatttgttttaggcctaaagaaatgtaactgttcccaaagtcgaaatatcttgtttgatcctacttaaggatgaattgctggtcctgtaggggcgtgaacacgtctattttcatgagcttaattgatgtcctatcaaactttgtgacacagaacactgggaatttccccctgggactgcaatacactcttaaattttctgtgtgccgtttctccacagatcgcaagacaacagcagcagcttctgcagcaacaacacaaaatcaatttgcttcagcagcagatccaggtcagaaatcataatttcatacggacttccaattaggaagtagattttgtttctcagatgacctcattgaagtgagctgcagaattaaatctgctttcagcccagtcatgacatgtggcccccctgtgtcgggagaatcttactgtcacgggagtggcagaatcttgcttgtgttgaggagtgtcagggatagcaagctggtggcaatttttatcttacactgaaaggaaacttttgtggagaaatgtttccttttctttattctttaatgttgaaaacaggcatgtaaatgttgttaatgagggatgctcccaggaaccaaagcagagaggcatcgcaggttttctgttagccgtggcagagagaactttttccattaggctgaagagccacacgaatttaaggtgaaaatcagtgaaggtaatgatttgtgttcaactcaaatttcacccttatactgcctggagaaaccaggactgactgagggctctgtaacttccgtatttttcttctatgaaaatttgcagtgatgagaagcaaagctgcttggggtagcctcgtgccaccacttgcttatgacacacactttgacacaatctgtttccctttctgaatactccttttctgaaagcacttattt

SEQ ID NO: 31785 - DNA, 996 bp, Bovine  19866880463309
aagcaaattttatcagtcatttggtgtacagacatataaattatcttacagcttagagaaaaaaaaaaagactttatgaacaaggactaaagccagagggatgggttggtgggatatgggagggtggttcaagagggaggggatatataaatacgtgtgtgtctgtatatacatgtataatatatatacacacacacacacatatataatatatttatggctgatttatgttgtatgacagaaacaaatcaacacaatattgtaaagccattatacaattaactaaaattaaattttaaatatatgtaaacaatgttaaaaaaaaaaacaggtactgaaaaaatgagagaactagacaacagagaataaaatttgtaatgcacctgaagaaaaagtgagagccttttgtcacaatcaaagacacaactggagaaaatattctgacctaaaaaagattcatgttagcaaatgtataggaaattccctcatttttttatgttaaattactgggagaaaggcatgtcattaaacactttgagaaaaaatatttaaaatatgaggcatatgaacatctcctcaagcattgtgactaaatcacaatgtcatataactttcctacacaatattaataaaaggtaatatagctaaatatacagaaatctgaggaaaaacctttgtagagtaagatgccagaaaaattttctttcatatgtgaaatatattttatatgtaaaatatattctcaaatattcaagaacatggaacataccctgccttctatataatttgcaatccaagacagaaaaaacagacataaggtaagataaaaaaatgtgaaatgtaagcatatgcaataagtaatgaaaccagttaaattttattttaaataattattttatacaattcataatttcttaaaaataaaagatctcaaactctcagacttggagagagagtactgatataaattgatataaccatttgtaggattgtttt

SEQ ID NO: 31786 - DNA, 1887 bp, Bovine  19866880491322
gtgtctatttagatctccaattgctacaggctatgtgcttctatttttttctattttttagaaaggagtattcagtgtcgttacttctttgtctcactattgcaagcctttgaggcaatataggtttcagaatacagaaagctcaggatttcggaaaggttatttggtgcatgcaccattcgttaagcaatacctccaaacagcatttggagcaggactcaatagttaaatttcagcaaccaaaggtgtggatgttcacagtaaatgagacaaaccttgaaagtagctttacatcacttcaatcaccaaatggataaaaaattaaaattttggatttccagaagattctggacttgagaactgtggagagagttgtggacctagaaaaaccccatgcacatgataggcaattgacatattaatgagctcattggatcccttgcccattgcagctgcagaaatctgtctcagctttacaagttgacagaagtaaatcacacactatattttccatactatggtccgtttcactggctctgtgttggtacagctggagtatagcagattcagattcttatgaatgcatgtgtaatgcttgtttccctgaaccatgccagcagtttctgatcatacccatgagtatgaaggatactaacaattttctctagtccatcaccccactattacaccgttattcctgggtttctaccttctccctccccatctccatgcacgttcccaacgtggggacacccacagctcagaatctaccctgaaaatgtgttgtggagcttgaccgctgccaaaagccctgctggtgctgggcctcctgggcttcatcattcctgtcacttagtcactccttagctgttgtttttattcccagtcactttttcagatgcagccactaccatcagtgctgagcagtggaagtggaattgaagttccattgttcatctcatcccttaggtgttttagcctaaacaaattaaagcaatctctctttatgtctctctctgtctctctatgtctccacacatataaatctttcaagtctaaaatctctgctatagaaaaaatgagtggttactgtttatatgggtggcactagtggtaaagaatctgcctgacattgcaggggacagaagagacacgggcccaatccctgggtgagaaagatcccctggaggagggcatggaaacccactccagtattcttgcctggagaatcccatggacagaggagcctggtgggctatagtccatagggttgcaaagagctggacacaactgaagtgacttacacacacacacgcacacacacacacacacactcacagtacaaattaaccttaaggactttagtattccataaacaaaatgattaaaaattttctacctcaatacagttttcccttcatcatacatttcccctggaatttgcaaaaagtctctgtatcaaaaacagccagttatgtatctgttttctcttttgtcttccaatacaagaagcaccttggcttagtgcagaattgaatgtagtgagaaataatatcaaaggcacagacaagattgcagtaattgtagaaatagataaccttacttggactggagtgatggctgtgaatatggagagcagtggatgggtatgagagatttttaaggatttcaaaacataggtattgaaaagagaatatatatggggtgaagagtgaaagatattgaggagttcaggatggatcttgattcccggcttgacaaggctttggcaatgttccagtgtttccaatccagtattcttatatgtaatataaggcctacgaatttaagagaaaactttttctagctttgtgttttcattcatacaaaatatctttgttttctttc

SEQ ID NO: 31787 - DNA, 1365 bp, Bovine  19866880499490
ctatgtatatggactttttttttttttttttaaaccatagaacaatataatgtaagcagaaagaaaattctgcaggtttttaaacatagatttaaagtgatttcctgagagtagtcaacatagagaacttgtgatccaaggacctggaatatcttcaagaatcagtacgttcaaggatgagtgggtgaattaacagctttagagagacaggactgttcattcatttattcattctctcattcactcagtaaataaatatattctttgtagacactggtgactcagaaatgaatcatttgtttataggttgacaataaccagttgttcatctacagttttgcctttatggaagatatttatccccaactagaatggtcccttgtcactggtgttaaaaccaggctactgttctaggttgtcctaacccaacatgacttttctctttggtttttactaaaaacaaatgtgtactgacaaaaggaccttggcatacagacatccactttctaaatgcttgtgaagaagtccttgaagtaaataagatctaatggacaaggggcaaatttgtaaatgctgctgcttgataagtgtgtgtaataaaaattactgtcatttgtgcttgtaaaataataatcactttttaaaactagttttcagtaagttctctaaatccttaactaaataagtctcatgtaaatcaatatcctttctgaaaatctattttacctttccgttttaaaaggcctatccgttccattgttcaacttaggaagctgggctgccagtttgataagactctgagtgtggtctgaatgctctatgctaatctactctacatcaggctggaagcttatcttgacaggaaaacttggagcgggccttgtggaaggattttggcatcacacattggagtggaaaatattcacaggctgtaacaaagtctggcttgggctgctgtaggaaaggcagccactggctgggagacaattcgtgtaggaaagtcctgggagcctctgtgagaggcctacaggatggtgttatccaccgagagggggcaggatcagggaatcatgtgtgttttcatgagaattgagaggaacggcagctaacacaagccaagttagaaaaagaacacaaccactgagcacttccatcacagccttttggatccaaaacgcttcatgtgcaaaaataatgtgccagctgaagaaagaatacttcaggggttttaaaaagaatgaagtctagaaaaaccctcaggcacaggtgtaccttgtttgtgtgaaggatgtcaaaccaaaacggcataaagcagccctccatttctctcaaaaaggttttgaatctattcctgacctttctggt

SEQ ID NO: 31788 - DNA, 1557 bp, Bovine  19866880553605
tccaagggattctccgggacaagaatactggcgtgggttgccatgccctccttgaggggatcctgctgacggcagggatcaaacccatttctttttatgtcgcaggcaggttctttaccattaatgctgcctgggaagcgcaccaattcatactggagtgcatgtatatgtgtaaatccctgttagcactaacagacaacacttatcatattaaaagacttcttcctatagatttccgccttatattttccctcatttacttcattataaacctttaacattaagaaaatattgcatattattattagtgttggttgagtacctacattaagatgaattagcttaaatttcaaaagaaatctacatacagaatgataatagcagcagcaaaaataatcataatagctagcgtttataggaagcttacagtgtgccaggcccaggccatgtctctctgaactttctcaacggccttaggaaatacattactgttttgtagaggacactaaagtacacagaaaataaaagttgtttgtccaaagtcacataggtaagctgaggttaaaatccaaattttttattagcacctataatgcttaacctctgtgccttatgaagctcttttctggtcatttaaacacagtagttggctctgaggctttggagtaaagagatgaacaagcctggggaagacaattctaacagtacttctgacagagatggggctcttctgctggtaactacattggtacagatatagggagggaagggagtggagaagtcccagaggacattttccctagcattttcatcctcttccttccacttggccagtgaatattaacactgcttcagtttggttttctacttaattaataggggagaatgaatttaagagacagggaaagaggagaacatttaagaaacagctatagtatgatcagacagaccaagaaagtcttccctttaaatatgattccttggagatcagaaggatgctatggtgtgactacatacatggagcagaaaaaagtactggccgaagaaccttgtggtaggagagagaaagacaagtacatggaaggtcagtgaaactccagtgtcagggaaggagtgtttggaaaggtgggaatttggaacagtttaggaagaggaatgacgtaactagatttgcatttccaggaggttagtctgtgtacaatatgaagaattgactggaaggttttgattcacccataccccacttttaactaaaacgacatttacctaattgcttttttacatgatttaaaattgattcaaaatatagaataaattttgatataaaattttcaactttctgagtctcatccttatttaaatacttgctctttcctgtataatttatgtcgttattgtttaatcattaagtcatgtccaactcttaggaccccaaggactgtagcctgccaggctcctctggccatgggatttcccaggcaagaatactcgagtgggttgccatttccttctccaggggatcgtctcaacctgggatcaaacccatgtctcctgaat

SEQ ID NO: 31789 - DNA, 1324 bp, Bovine  19866880561992
attaattaatgatttatggatggcttttggagatgttgcctttggctaaaagaattagagaagtcaaattagagctagacattccagtggtaagaggaaaaactccctcttaccactgaaatgaaggaggaaggaggaagccatgttagggaaatcgttcaggagggaatgagatagatcattccaacagtgggacaaaataggaggtttttcttggggtgtgcatgggtgtttgtcaagatgtcccttgacttttcaaaccttctgattagaatttacttaggaacaaattaaaataatacaaatgattaagattttgtctttataaaaataagagtatatattatttttatttctacatgtaattatttatttggtaactttaattaaaagctacatgaaatctgaaattgaatatttgcctttttattattggattctctctaaatatgtatgtaaaatggatagagaactgctttctaggcaactgattattaggaaatctagaccagctttttatatgcaagttggcatttgatccttaggttttcttttcttttgtttttctttcataaaatcttcttaattctgagtgtcttagctagggaacacttcttatgggacaggaggggagaggaaaaccccttggtgaatattatcagcacagagcagccagttttcacagaccatgacaaaaaggcaaataggtattatgtcatcacccatccatcactctatatgtcagcctttcaataattccaatcgacattctcgacaggctgatgcaagttaaaggggctgtttgtttctagaaattgagtataggctgtctatagccttttgttccagatggttttcttctgtgtcttttcatttctttctttttctttcttttctttttgggggtatttaattgaaatacatgccgagtttgcagactgcaaagatcagagctgttttcgtccagcagtggtaactatgcattaaacattttgatttgtttgagcttgaagtttagtccttttttgccatttgcttcatggagtttgtgtatatttacagcctctgcatttaatggccacatgccttattttcacagatggccagtggaagactttttctttctcttagtatagcctgctttcagctttgctacatttgtcacagtgccactacttgcagctagcaagtgcccacgcttggtggggagcaattatggtgtgagtttttaaggagctttttaaaggttttttttttttttctccagtaaactttttatggtttaattttcaagcctagaaaagctgggcatgttttcaaacag

SEQ ID NO: 31790 - DNA, 1948 bp, Bovine  19866880585086
tataacctgtaatggaaaagaatctgaataagtttatgttttgaatattcactttgctgtacacccaagatgttgtaattcagctcaacttcaataaaaaataaaaacaaaagtctccccccaccaaaatgttgtctagtgtaatgaatagaaccctggatgagatattgtgattggattctacttcctgtcatggggctaaatttctgtgcaactttagttccgactatccttctcctatctaagtttttgcttttataatctgagagatgagagtgtctctaatgaagactatcagcataaactccaatagcaaaccccacgtgtcagtcatatcagccagaaaatatctgcttctttctcccaacagatcctttgttaacctcagggcttagacactgcccagcagggagaacattgaagtgtcccagtctgttgctgttctggctttgtgctaccatgtggtatcacatgtgacaggtgatagcagtccacctggggcttcccaggtggctcaatggtaaagaatccacctgccaatgcagaagatatgggttcgatcccttggtcaggaagatcccctgcagaaggaaatggcaacctactctggaattcttgcctggaaaatcctgtggacagaagagcctggctggctacagtcaatggagtcacaaaggagccggacatgacttagctactaaacacaacaacaaccagtccacacagtgatgatgctctcagctctcacagctcacacttctgctgtagttctacagggagggagggtaattaacaatcacttgagtcagcttgggcagctcttaggttgcaacagtgagttctcaactctttgaatcttaaacctaactgactcccaggatgcccaaccaggatgagggcataatttattacactatttgccatccttctgaaccagaatcaccactttctttctttcacagccttcactactaaggagaatgggctgctttcttttaaactttcagatcagatgaattttctgatcatcctatctgttgactataatacattcctattgtaatgcatttaagtactgctctccactctcctccagtttgtgtctatttacactgtctttcaccaccccaggggactgtcagatagtcaagaaggccacctacaatttccttggtgtcaaagtctgacactctcttttatcagggaaggtgggagagtaattgagatcaatgctgattagatatttgggagcagctggaagcatattggttcagagggtataattatattttatactctggcaaatatggtaacaaaatctttcctcaggcaatgggcactttgccagccttttaagaaaaaatatctcatgatgcttccagagattccaaaacctaccttctggaagggactctgcttctttccaaaggtaatttaccattttagaaattagaatagtaatatacccttgtaatccatccctaggcagtgtgaatggagaaaaacaaagcattattcacagcattggcaagctatgacatgtctgaatttaattttgagtctcattgtcaaagccaatttaaggaaaaattatgaaacaggtagagactagacattaacacctcaccctctacctcatcagctctcttttccattcaatttatcctataccctacaattttaacaatcaagccccctaggaaggccctcgcataggtatgtttctctctgtcttttagtgaattatcaactaattcctggataagatcatggcatctgatcccttcatggcaaataatggggaaacagtggaaaccgtgacagactttattttcttggactccaaaatcactgtagatggtgactgcagccatgaaattacaagacacttgctccttggaagaaaatctatgaccaatctagacagtatattaaaaaagcagagaca

SEQ ID NO: 31791 - DNA, 1073 bp, Bovine  19866880590404
tgggccttttttttttttgaggagttaggctttgtagaaattgtgtgaacagttcatacaccatcatgtgacgttagtcaagtggaagacttgggagcagaaagctgtagaaatgaacaaaatgcaccctttgcaatttagagtcctgtttcctttctctgtcttttttttttccttttcccaaccataattttttcacatcagtctttgctctgcactcttagtatttttcatctatgtcaagataccatggttaagggatgcaaagcacctaaacagggaggtagcagttttgagagcagttccctgacaataggagggtgggttctcagccttcccttacaggaccgcactccagactccccagagaagtcacgtccaacagcaaagttaaacagaccagaattggacacctgcttgcacttcacctccccgacgctttcgtttagctctgtgtgttccgtgttgccggagcacggtcaccgtgctgttgtgcttagtttttcctccctccagctcattcccattagaaggaaccaagagaactggcgataaattgaagttgtatgtctttttttaagtgcctgtttttcacttaaagaatattgtccatgcatgtgctaagtcacttcagtcatgtctgactctttgcaaccctatgaactatagccttccaggcttctctgtccatgggattctccaggcaagaacactggagtgggttgccctgtcctcctccaagggatcttcctgacccaggggtcaaacctgagtctcttatgtcccctgcattggcaagcgagttctttaccactggcaccacctgggaagcccaaagaataatgtaattagaggttaatgaagaacattaagtcaaaaagcatagtagacctgagagtccttcagttgtctctgcaggattttttcttttgttttctgaatttaaaatattcagattaagaatatttgtaagtttcaaagtatattccattagatagggaaatattgctttttgaaatggtttatttaaattccaaacaatgtgaactctttctgaaataatgtctaataat

SEQ ID NO: 31792 - DNA, 2575 bp, Bovine  19866880607883
gctgatacaacctaaatactaacttccccacatccgatccccctgtatccctacccctcctaagtaaaacctgtcagtgccaagccccgcaaaacagcacaagcgtgcacttgattctgactgactgctctgcagaagcaaaatagtgcattaaagaactcctatttagaaacagacccacaaggaaaattgcttctcttttcaaaactgcctgtcacattttctttttctaattccccttttcctcctcctccctgtcaccaaagggcccctgggccctatgagtttagatgatacaaactcaatttgtataaagaaggcaagaagcagcaccactgagaggtggggatagtttgggaggatagagaaataatccagtcaagacacagtgcaattttctttccaaactactactacaataatacctccactttatttccttcagggcaactgtcatttctttttaaccagattgctactagatatgatagaaactaaaatattatatggtcactgactcttcctttcaatggctcatttcactattacatttttacttttgcatgatgtgtttattattggcattgttactaggatacgaccactttcaaatgatgcagaattaagacctctgtcactaagaggcgatgaaatttcatccttaatattatgcaagtttgacttaaatgttctccttgtctaatagaagcctttattttcaaaacttaaatgttacattcttataaagagccattttcatgtattaaactcctgtcaaccaaaatgatgatacttactgtacaaataatacatgcttaaacaaagtatgtctgttgacttcaggaaagaataaatctattttaaaagtggcaaaaccaatacaatattataaagtttaaaaataaaataaaattaacacacacacacacacacacaaagttgggaatcaaagaaacttaagggtggcaaatatagcattcattaagaaagcaattgtgagagtatggtaaaaacagggctattttatttgccaagggaaattttaagctgaataaaagtattttaagaggcaatgattaaaatatcttaaaggatgtattatttaggattaggttatcatttgtttcttaaaggtcatattttacagggcttccttggtggctcagtgataaggaatccagctgcaaatgcaggagatgtgggtttgattctttggttgggaagatcccctggagaagagagtggcaacccactccattattcttgcctggaaaatttcatagacagagaaggctaggggctacaatccatgggttcataagagttgcacacaatttagtgactaaacaacaacaacatattttacatagcttgatagtaggttacatgataaaaatggaagtctttatactgcaattctgtttcttcaaatgtgtgtgactgtttgtattatttaatatggtttttgataataaaacaggctggttcctatcagtatgcatggttctctgttcacatggacagaattaggctttgcagtaccaatacaatcttattttacatcacgcattgctatgccaattgtcatttacacacaaatgaaaggcaacacaaaatagaatggtcaacatgaaatatagtattgtttcaattacatttctcaggagtccatgattagaaaacttaataaaattcactaggtattgatttctaatttatgacattttgctcaatggcctataatacattattagtggggttttttctcatgccatataaatctcagctcaacagaagttctttaaaatattatgcctcaaaaatcaccactttatagagaagcttgaattaggagtgactgctaatgggtacacggtttctttttagagtgaagaaaacattctagaattagtaatgatggttacaaaacattgtgagtatactaaaacccactgaatcgtacacacgcaaaaagggtaaattgtatggcatgtgaactatatctcaaattaaaaattaaccaaagtaaaaactaaatattatcttaaaatatatcacttcactactgccagaagtaaaactgaatttgctttgaaacactcatgtcttatattagaaagatgtttgtatttgtataaagcacttctacatgtgttagttcatttctgctttatccagtctcttggagatcagcatgtcagatattgtcatttccaattttaattaatgagcaaaactgacaaaaaaataagtaatttggaaacttacacacgatcatacagctagccaaaacaataagcctaggacataaattcttcaattcttctgaataaattatataacttcctaaaataaaaatactgatttatataatgactacagaaacattgtgacaaaatccacatatattttatcagcataaaaatgagtcacatttaaattatttctaaaaaataaagttctattataatttaaaacatttttatagcaagggtggcatttgaccttgatttacacctttatgttacattttattttatgttttctgtacaaaagcttttcaaattttcaatgt

SEQ ID NO: 31793 - DNA, 2682 bp, Bovine  19866880610926
tccttccctcctcccctcctcccttctccctttctccgctataagctttataaaagtcacaatttttgtcgtataaacatgcagtgccacccacttaaaaacaactttcataaagtttatgtaaaacttctataaataatgtgattattttcttgttaaaaatcattaaatgacctatttaagcatgatgcacttaaaatcctatgttgtacttatactgagtttacatacaaaattctaatgtatctattttattgtattatattcaataaactaaggttcctttttaattatacttcttttcacattttctcaggcacatacaatatggtagtggtattgaacaaagttaacgtaaggagaaatagggactattttaatccaaagtataagaagttataaaatagtggatttctccatcgtcattcttatagtttcttatttcttctaataatcaactaaagaacaccagtcattcttaagtatagttttttgaataaagaccagaaaaaatgtataacttgactagtattaagcgtgggaaaaaaataccttcttcagatgcacagtgagtagtataattcacactgactatgaattattgtctagagtctgattaatataatcaaagaagtttgcaaccacatagtccttatctccgtatctttgtttgggacagagggaatacagaataggattcaaaatataaaacaactttctttttcttttgaaatggggaatcatcttttaattatcttattttacctaaaaatatatttgaaattttttatatagtgaaataagacttttgctcataaaaattttaatcataaatattacatttgaaaagtacattattaatggctcagaatattgaacattcctaagaacttgtttaacagaatgcttcttggaaagcagcatgcctaaaaatgcaagtgaaatatgaaaagctggcaattttccttaacctgaatcatgtcctagcgtgtcctcaggttctcatgggaagaatgtacccctttcctagtcctggatatccttgtagataattagatgcttcttaaaattctacctccgcctccccccaccctggcccgcatgtgcttcaggacttagaattgcaatgtcccacaactttcagctcttggacttccactgtagactagatgaaaacattgggttgacttttttagaacccagacattcatcctttatgatttggggttttcaaaagaataaggattatatctctaaatttcgagaaaattaaagatcagaattctcattttagattttattttaccaagtaatataaaaggaaaaaaatgtatacttaaattttaaaaaatacatgttccccaaaattgtttatggataacagaaaagactgaaaaccttacattttcataaaaccacaaaatatttttattaaagctcttttagagttgtttgcaagactaattatcaatgagattctgtatgagactttcatttaaattgaatctctcaatagccaaaaagtcttgttttttctattttagtgtataatctgagctgttatggtttgttgtacaattttgatgacttttggcagtgtagagatttggtaaataggaaaaaaagaaatggagactaaaaatagaaaggatgaaatactgcaagaaaaaaatttgtcttgtggtatttccagtaatgcttaacataaggaaaaaaatttgttttgtgaagtatgtacaaaagcattatgacagcagtaggaatgtctttaaataggtacagatttttattttctgtacttccccatgcaactcttttgaggatcagagtttcattttaagtctgcaggagctcaacagtcaggtcaaccctatataaatacagggcaggacaaaaattttgggtcaaacaatggaatttttagtgccagttttcatgcaaatagtgctatcatttatctaaaaaatgatagttctcattcaattttaagagaacctctggggtattcttgtttgatttgattttgcttgtctttttctattagcatacatatgaattgcagcgagcccaaattctgatctgttatacctgagactataattcacaaacttgcaacaaactaagtgaaggaaatataaattccaaaagattaattgttttagaaacactctctttacccattgagttttaagtgattgatccataatgtacactcaataaatgtttactagattaaatgtttataatgtaacccaatcttaataagaattgaaatcttagttatcactatttgtgatatagtattcactatatgtcagattttgcaattaaaagtattagtatgttatctaagataatatatttgtgttagttttttttttttttaatttagttacatattctgtagctattgtcattttgggctattttgggcttttgttataaccaagttattttctagaattctagacatataaaaacattaagaaatttaatgagacaaaaatattaactttttaaaaaatgttctttcaaaatgtatttaaatcctggttttaaaaacaagatccacttagaatgcatagatagtaaaatatggtttatcctagatgaaatatcttctagtgggaaaataggaatgggaatatgttccttggaaagagacatactccaagcaataga

SEQ ID NO: 31794 - DNA, 1427 bp, Bovine  19866880627007
aataattcacttgttaacagtgaacggagctgtggcagcccaccatgaaatgtggcaaaacaattgaaaaaactattcctgtagtcacctggaatgatgtgtacagggagggaaaaggaccattccctacaacactatcaaagccaggaggcatgctgaggcttcagagttggaagagtcttcaaactgcactagagaatagaaggaaagagaatgactatctcagactactaaactccaggctcaagatgtgatcagaccaagagaatgctccaaaataaatcttttgactaattcattgggaaaagattatcttctaacattgtttctcttgatatcataaagatactgaccactagtgatatcataaataaactcattgatgttcataatattctcactctcagctacaaccttgcagtaggaattatttttaagatacatgtctgcctcagtctaacaagaactaaaaaagtttacaaaattagactttgtttcaagattgctgtcttctttccttttttcttaaagtctatttttgcagaaggtagacatgccaagttatttcttcattggcataaaacttaataatataacaagagaagaaagcttttaattaaataggtgtctgctttggtggtgcttcccaggtgacagagtggtaaagaatctacctgcaatgttagagacacaagagacatgggtttgatccctgagttgggaagatttcctacactagaaagtggtaacccatttcagtattcttgcctgaaaactctcatggacagagaagcctggtgagctacagtccatggggacataaagagtcagactcgagtgagcaatcaacccacacacacacacacccattgctctggtaagtgccaaatggtcaaactgtctccttttaaagaaaatactgatatgacctattagtctcaattgacaatatggactaattattgacttttttttctacacagcttttttttgactcttcaaatgaatatttttaaagccctaaatggtttcttacttttgtgtttctgctttgtgtctttacttttaagggggaatgtttttacccttaatgaaataacagagtcacttattagcgtttaggaggaagaatgccaaaaagtggcaatgatctattaatctgaacctgaagccttatggagctctcaagtttctatactatttataaaatagtctacatgatgtaattttacattctatttatatcattattctttatacaacataaacatagagctctgtgatgttattacatgtcataaatgtcatcataaattgtctttacacatcataaatatcttagtttgtgacattattacaccttcgggtgtctctttcccatattatatggtaattacatcaaagtatttactataattatgtcattt

SEQ ID NO: 31795 - DNA, 1300 bp, Bovine  19866880632448
ctgctctcgtcggcttttaatggaaataccattcagaaacctaaggttctataacccaaaccctaaaaactactggtaaggaaagtctgatagagaatatgatcatgaccttaaatatggctgtgaaaatgtggaattctgtggaatccaaaaataaaactaagttttcccaatcctaactccaaaatgatgatgttattttgcaattcaattcatctaaaatgtcttcttttatacttttttcaaattgccctcaccatcatagggccctaagaactcagcatctcaaatggtgtgattaatattggttgttaaaagtcaagatcagagatttctctccaagccttcactccctgcttcagcggcttcttggctttacaggaggctcattaataggccaactcgcccagtttgtcatctatttcattatgcaaaatatatacttttcaattacttttcctgtgtgaaaatctcttaactctaacctgatataatgatttctttgggtttcttctcaacctctgaatggcacagctttcctaaaatctcaactgggggtagaatacttggaaaccctgatgggaattaattttaatgtaatgatctttatgtgcccattaaaatagaagtgaaataacttacaaagctgaccactgggcaaacctagtgttgacctcaaaggacaggaaaaaaatgtctaaagcgttctgatcattttgtttaatctatttaacatggaatgtaaggaagttatccctaagataaagctttggtttgcaacactgattttatttcagtgaataaagtagaaaaagttagaataggattctctcatcttcaatggtctcatccaaagttaaacttttaacatcagtagtaattggaatcacacacaaaaaataagaaactgtaacagttattacaataataggtatttggtgaacaaccttgctttttaatttgccatgtatagtctttttcctgtataagaatcaggatacctcaagagttgtccaaatgtagatccttttgtctgccttctaggtagacccagaccaatatacacacccatcactccaggcccccataatatatgggtgcattaatcttgttatcttggtgcacttgattcaaaaatattttacttcccaaagctctgctgcacaatacatttttaaaacgtactaatacccacaaaattgtctaatttttaagaggaggcatgaaaagcaagcctgaagaccttcctgtattaccatgattcttcattcggaaataagcaggcagtgcggcctaaaag

SEQ ID NO: 31796 - DNA, 833 bp, Bovine  19866880640959
ccttcaggcctgcttcaattctattctgacacaccctgaaataaatttgctcttcaagacataatggttttatgacatgaattcatcaacaagtagaacaagagggtatcctaaatatcctctaatgcaacctgctgtttttctgtccattagtataaacaaggcaaactaaaaggggtgagaaacctttatgacacagtcagacaaaaacatccaagaagtgacggttattgtaattatttcaattaacaaatatttgggccatagggaataataatattttggactagattctgaccttttgggtttatgtccagcttgacacccactgtgttaattatgttttattatgcaatgctttttgcctcggagaaggcagtggcaccccactcctgtactcttgcctggaaaatcctatggatgaagaagcctggtaggctgcagtccatggggtcgctaagagtcagacctgactgaatgacttcactttcacttttcactttcatgcgttggagaaggaaatgacaacccactccagtgttcttgcctggagaatcccagggacgggggagcctggtgggctgccgtctatggggtcacacagagtcggacacgactgaagtgacttaacagcagcagcagcagcattctatttctagtcgcacttagtcttatagcacggcccctgatgagtcctatgtgggggctagaagtattttctggtatcttcttcttggtgggctctcatctttattttcttaatcccctgagacccctgaattctctgttgaactctactcagctttttgacctttgagttgcttcctctttga

SEQ ID NO: 31797 - DNA, 1207 bp, Bovine  19866880664695
tcattataatagcattttctagtttggagttaacaaaacaggaaaaaaatgcaacaaatttttattattcttgtttctgcctctctcagatgaaggaaaaaattgagaaagttttgcaaaaacatgatttggttcagtatctaagtgtttaattttggccatgttatccaaaatttttaccttaatgctgctccatggcttcaagtctgtttctgcattaatgctgcatttgtaaccatatcttggtaggagtgttagcttgaagggattagaagtaagatatggaatctggtctccttaggtcatttgtttgtatccagctgaagtcagcagtggctaaaattcattaccatctggcagtttttccatggcctctgtgacagaacctgcggttctagcctagtacatactagacagatgtccgggtcataaaaatcacaacgattcttggcattgtgtcacccccttgttgacagtaccatcacacaggcgagagatcgaagtggaataaagaatgagctgtcttcatcccatccagtggtccattggcaaacagatactcagaccttatgtattctgtgtgggggaataatgctcttggctatagtcaaagggaatggaaataatgctaatggatacagcatctcagagcacaacatgatcaggtattctgatttatctccttgcaccagtacaaaattagataaactggttaagctttcaaatatttccttttcaatggcaagtgatgtttcatgtactcatgttgtcttaaggcttcccagttattggatgaagtgtggatagcgaggtacatctgtaaacttgagcaagccatacacattgaatgtctttacaagtcagtactgtaagccccccttacctacacattccatatccaaggagtcaaccaaggaagctcagactgtgttgttgttattcagttgctaaattgtgtccgactctctgtgaccctgtggactgcagcacgccaggctcctctgttcaccatctcccagagtttgctcaaattcacgtacgttgagtcgggagatgttctaatggtctcatcctctgccatctccttcttttgccttcagtctttcccagcatcagggtcttttccaatgaattggcttttttttttgtttaactttacaatattggattgggtttgccatatatcaacatgaatctgccacaggta

SEQ ID NO: 31798 - DNA, 1963 bp, Bovine  19866880684847
cttgcctggagaatcccatggacagaggagcctggcaagctacagtccatagggttgcaaagagtcagacacaggttaaagtgactgaccactcacgcatgtattctagccctacagtaaggatttctacagacctattctaacaaaagagttaaccagtgttgcatccagcaaatgatatataaaaaaaaaatagacctgtaaagaagcaggaaaatcaagaaccaaaaaactcaatagatgcacactcaaagatgacacagatgctaaaattagccaagaatttagaagtgctataatgaatatattaaagggtttaaaggaaaagctgaaaacaatatgaagaaccttataaataaattaaaataaataaataaataaataaataaataaaccaaataaaaattctaagacctaaagatacaatatctgaaatgaaaatttctccggaaggacttaagagaagattaagcactgtaaaaggaatgattgtcaggcttaagtacatagcagtaaaaactggacaaattgaaacagaagaaaaaagtcttaaactttaaagagcttcagggacctatgggacaatgttaggagatactatgaacatataaatgaaatcccccaaaagggggcatgcagaaaacatttttgaagaaataatggctgaaaagtttccaaatttgatgaaaactataaactgatattataacctgtaagatatactttatgaaccaagaagcaggactaatcccaagtgtgaaagagacaaagaaaactgcactcagatgtaatttaatcaaaatttttaaaaaatcacaatgagaaaatctataaagtagagagaggaaaaaaaaatacattgcctaaattactgatataggtaatataccgtgaaacttggaagagattttgctgggtgaaagaaactagaattggaagaatatatactctatgattccatttatatgaacatctagatcatgttgttatttatggtaacagacatcaaaacaggagctacctttagcagaagtggagagttttcagggaaaaggcacaagagaactttctagaatgatatgttcagtatcttgatagatgcgtttgtcttcattcattaaattgcacatttgttgttgttcatcagggtttttccaacgaatcggctccttgcatcaggtggccaaagtactggagcttcagcttcagcatcagtcctttcaatgaatattgaaaggttgatttcctttaggattgactggtttgatctccttgctctccaagggactctcaagagtcttctccagcacaattcgaagccatcagttcttcagcacccagccttctttatggtcaactctcacatctgtagatgactactggaaaaaccatagctgttactttacagacctttgttggcaaagtgatgtctttgctttttaatatgctgtctaggtctgtcatagctttccttccaaggagcaaatgtcttttaattttgtggctgtagtcatcatccacagtgattttggaactcaaaaaataaaatttgtcaccttttccacttttcccccatctatttgccctgaattgaagctacgatactttggccacctgatacaaagatgaaaagaccccgaagctgggaaggattgaaggcaggaggagaagagaacgacagaggatgaaatggttggatggcatcacagacttgacggacacaagtttgagcaaactccaggagagagtgaaggacagggaagcctggcgtgctgcagtccatgaggtcacagagtcagatacggcttagcaactgaatgataacaatggggccagatgccataattctagttttctgaatgttgagtgatctctataatacacgacatattattcaccaacaaaaagtaatccaaggtgggaaaaggggggttagaatgctgcaaggacctggaggagagaa

SEQ ID NO: 31799 - DNA, 1798 bp, Bovine  19866880686614
ctttaaaaatacttctcataaaatgtttatgaaaatgtttctatatgaaagcacccaaacacagtatgtaacatataaagaagaaaaaaagatggaatagaaatcttcaaatggaagttactgggagaactaaaaaaaattattttctaaaagatgtgaagaaaaatacctcaaactgtattgcacttttcccttacactcagttctatcttaaagtaaaaattacacattttcagaacatctaactgtatttctcaagcgttaagttccaattttggggggtttcttttttggtttgtttttctgttttacagtcatttcaaagtttttggtctattgggaatacaaacagtaattgttgatctattcagcctaatgatagattggtccactttgtataaaataaaggacaatttcttctctgctttttatctttttacacaactcagagactcaaagaagataattacaaacaatgcctgaagaacggttcagttaatgttaatttatacaacaaactaattactaccaaatggtaaaaatcacatgtggaagtccctttctcccacgcacacaactaaaccagcagccatctgtctcagcctgggtagagctcagggacaccccaagaaggataaggaaaagaaagggtacaaaaacgtcggctcattcacctacgtaaaaattacagaatttttctgaacattattttcaggaaatccaaaagcagagatatagaaataagttgtttcaaatgtcttttaataaaaacacatgttgttctgtaatcgtcattgcaggtagaaacccaccttcagcaagtaaatgcttactttgttttagacacaaactacatattttttaaactctcattactcattcatataccagcttgctaagaagaaagaacatgtatccctgaattttctgaaggaagttaagaatttctaagttctcaaaaaggtatgtctatatacttaacaattagcaaaataatctccttgcatattatgaatgtaacctgagagatgactgctaaattattcttactgaaataggttcatacattttaacaaatagtgttactaatattttgacatttatatgccataattatatcacatgaagcacaatacggcaaatatttttttcatttagaatcacaaggtgaatcttgacatttaagcaataatagattttcagatgaaaaaaaaatccaaatgggaatgtaagagtattgagatcctttttatttttttaattaaaagaatacttatttatagatgtgtttcaactatgttttaaggacattcagaattccaaatagagaaatcagcacttggcaaatatttgagtgaaaaatggaatgagaaaacttcaagtagtggcaataacactaatttcccctaacatatatcccctgtagaattaagaatgctttacatatagcatgttctgatctcactgaaatccgttctcttgaactgccctttatatacttcctagtagctgacctgattgaatgacagaccataaagcaaagactgaagcaagtggattgataggaaatgtttaccctcttccacaaggagatgtcccacactgaaggactgcagtgcttcactatgagattcctatagaaggcaatggaaaaagactctacaaagcagtaggaccgtaatactacaagtgaggagactatgcaaaattacttatttattatctcttgaggttatgtcacagaagtcggcacagaacttctacaaaagatttttttcctgaagttcttcacggatat

SEQ ID NO: 31800 - DNA, 662 bp, Bovine  19866880715288
catccttctaagtcctccgtttgtgtgtttatgagaagagttctacttgcttcctgctcatacatgagtttatctaccaacaggactttgtcagtcactgcaaacatgtctttactcaaatttctaatatttcaaaagcctttcagataaatgaagtacccctgtttcccttgtccacacatataaccctctcagttccagagctggagttttaatgcatggagcacttgaaaaagacccattgacccaggttgaatatggacattagccaacagtgccagcccttcttgttgctctagtccccgtagcttttggagatgtcacttattcaagagtcaagagccagccacctgttccatcagcctcttccccctcacattagaagttcaggcccttgctgaatagtaacgctctaatctggggaacacatacagcatttttctgaagctgatttgtcaggctcagctagctggaagattctgtgtgtttgcacgagtgtgtgtttttcagctacccttgaggcacttgtcacgaccgtgcatattaaaattaatcagacctcctcggcccgagtgtctgtgtgtttaacacgaagaagtgggtatcaagcaaatgctctaattaaatgggcctgcttggttttgctctagtggatccttggt

SEQ ID NO: 31801 - DNA, 1144 bp, Bovine  19866880779533
ttgttttgtaaatacttcatgagatacttacttagtaaaaaactggataatggaaaattctgacttttaaagtttaaccatgtgtaagttattcaaattgactttcacctaaagtaatttcttctactctttcctaggtttttaaccatttaaagtttttccttgagcctttccaaacttgtgtcttcttttgagccaagtatggaaaattctagctcaaaactaaaatttttcaaaaagttgaaaaatacactgaggcatgttaatcaatagtttccaaaatacaatctagcttagagtatctattgatataaatgatatatctaatagtaaataacccaataacccctcagaaatcatattacatatgttagtagtaaaaagtaatgaatatttagaaaataattctttccagtgatactattgaagagactctttttttttttttcctatatacagagtaagaaaaacaacagagttatttaggttgaggaagattgtcaaagagcttccctggtggctcagtggtaaaaaatccacctgccaatgaaggagactcaggtttgattcctggactgggaagatcccttggagatggaaacagcaacccacttcagtatccttgtctgggtaatcccatggacagaggaagaggagcctggcaggcactagtcttgtggagtcacaaaaaagttgaacactacttgatgactgaataacaataacaagattgccaaaagcaagaatgcttttgctcagggtcaccttcacaaaccctttcatccactgaactaacataaatgatctggaaagtctatggcattataaaaattaaaacgtatacacaaatgcaaacacacacacacacacacaatccctgccctagaagagttcctaaaaaagttacagaaatgaacatgtaaacaaaccattccagggatacaatgagaaaagtagaacagtgcaaaaggcactctggaaacttccagaaaagaagaaggtagggtagattagcctggaaagagcattgaggaaggttatttgttaaactatctcaaaaaatggcacttcaccacaaattatctctcaggatccttttaccacctactttccatgtcttctaaaagtcacacaatagcctcca

SEQ ID NO: 31802 - DNA, 1638 bp, Bovine  19866880813813
ataaataaattttttaaaagacacaggaattaacagaaattttttttttaaaaagaatttcctgtgttgttcaaggggttgaggagttggtaaaataattctctaggctgatgaagtttggtgcttgctggctacactgttttgtttatttattggctcaaatgtggctcttggcttttgaggacttcgtatgaattggatagaattctttctaaaggacattcctaaatggttgaaattaataaatgaatgaggttagtgataaccaaatagaggtgggaagagacaagatcttgttccttggatatatactcaataataagacaggcatttttctcctctaatgctatagatagcattttgtgatatggtatttcatcttagccagtgcttcatcatcaactcaacttttttccttctagtcctattttgcatttgaatatacataggtatagtcttccgagtaaaaagtatgaaaaccaaacttccatgtttacatacaaaaatatactggttcattaagaacaacttgtgtttccacaaggagatttctagaatttgggggtagactacagatgagaataatcaatggtctacaataagtgtcatgtagtttagggcatgaaattcataaaaatggccttgattcatgaagaaagtttcatataatgtttaagctacactaagcaaaacctggatatgcttctccattttaaaaaatcctttcttcaaaaaaaaatccatttcaaagagaatgttttagttatctggaaaattcagggatataaacatggatatttcaacagatctctctacatctgtaaaatcagtgtagacatttggatttgtgaacagtatcagaaataatagagtgccatgaaaagattaattactgtatgccaggaactatactggacattctgtggtgctacatatgcataaggccacactcttcttcttatctagctagttagccagcttaattctcacataaaactaatttgtggcaatgtttgtgcttcagtctttgattcggtttctagaaacgaggtgttctcatatccaatgtgttgtgatcaatacatgatattcacattctactttttgtgatttatattgtgaaaagaactacagccaggacagtgcagctatatctgtttaaagtatgatgcacatttattcagatatagagtttatttcattcatttaataaaaagtgataggcatgatagtatgtaggacaagttcccacaagacagatgaaaaagtgtaaacaaattcctgtaatgtatatggtgaaatctcatatctgcttaaaaactctacagtattctgtttaaatatttttaatgaccattccactaagcttagttttgtaactccaaatactttcaggaactgagtatgtgattggctaagggatttgctcccatggacagtggagcctggtaggctgcagtccatggggtcgtgaagagttcacttttcactttcatgcattggagaaggaaatggcaaccgactccagtgttcctgcttggagaatcccagggatgggggagcctggtgggctgccatctatggggtcgcacagagtcagacatgactgaaggacttaacagcagcagcaagggattt

SEQ ID NO: 31803 - DNA, 1675 bp, Bovine  19866880815701
cctataccttctgaaattgtgaggagacaaagatggaaaagatggtaccacagaagtgtagacttgggaggccatactgttgtgacaatggggaagacacttaacgctgggtagaacacttgactggactttttctcgaattgtggttattagcaggggaggggtaggtaggtaggaaagagagttagctacagactgagctcaaaaatgttcttggagaagccaaatggcttcaggttagaaaatctatgacacactttggctgtttttctaaaggataagccaatggctgatctagccagatcacagaccatcctataacacgggtagaaacataggttcccttggaaagctcttctttggtcttttaatgaatcctgattccatattaattgctatgcaaagaaataggtttttcctgaatcctcctctcccatcccatattctttttttttttttttcaatatttttccatatttctaatttcctgtatgttaactcactcattgtcagcattttctcgtgacacttgtaagctccctaaagacagagattcccgaataaagcttagtctcatctacggtacccagtagaaagctaaaaaaaatgtttgatgacaatatatcaatacattaatcatttcagcaaaaacggtgaggaagacatggttctattctagtttaatggagcccagcttctggtacccaggcctgactgctccatacgtgttaaacggtgactagaacttactggagatgttatatgagatgcattacagacaggagtcctgtcttcagcatgttaatgatctagaaggacccaggtcgaacaaatctctcatgaatgcatgcttggtatgaattatctgtgctgtgtttctgaactgctttggggaaagtgtgaaagcttggtctcattgatctgcataatctgtaaataagtcccttatgacaaagatctgctgcagcaaattattcctttccctagagtctgttgtgtttttccatacaagtatatgaaaaggttcaagcatcaaacaaagcccaatttcacaatgtcttgtagattaaacaaaaaaagaacaacaaatcaatcctattctattacaaccaggaatgggaagtaattactaaatcattccctcaaggtatttttattttgttgactcatgagagttggccctgtctcctccaaaacactctgaagccatatttggagaattttgagttggtgagtttactcatgtgcagaaaatattgagaatttttcatacattctttgctaaatcattttggttttcttaaacaattggtattcctcccactttttcttgcatttatgcatgtaactaaagaaagatgtagctgcatttgtcagtgaactgaaacccacatcatgcttgtcttttaaaaaatcatgactttccatctcaactctgatcagctaagactttttgagagtaaataattacccgagtcttgttatttaaagatgttggaattctgacaagaaagttgttacataaataaaaatgatatcatttatattaacaattaataacacaatgacagtgaagatgaatattcatttggaggaacacaaaaaccctaactagtattgggtattcccaagtcacatcgagtaatacccatacaaacttgttaacatattaaat

SEQ ID NO: 31804 - DNA, 2384 bp, Bovine  19866880820519
agtgttctttcctctgtggtttctgtatttctttgttctcactcaacatatctctctcccccaacttttctctttttcctatgccaccctgaggcagaatggcaagtgggcaccagacagctagctacttcaaggcaggagacactctcatgcaataggtgcattgctctgtccatggaatcctccaggcaagatcactggaggggcttcccttggtggctcagatggtaaagaatctacctccaatgcaggagacccaggttgggaaaatcccctagagaagggactggctacccactccagtattcttgcctgggaaatcccacggacagaggagcctggcaggtccatggggtcacaaagagtcagaaagtgattaagcaactaaaactttcgctttttcataggtgcattcattcatgttatgatataataaaattctgaaacatacaaacaagattgagctttaattttgtatcaggtggcatctagctacagtctcttttctcaccctgggcttcagtccatgccctccgcttggccagtgtcagtcagttccctgcctttacacagtgcttgaccttgtcagcctaggatccccacagcaggtgcactatattccccccagtttgccaagtgcttcatttgatttctttacgtaaagagttattcaagctccagctctgtgataagactttttctccttaactaataatgaagatctttcgcagtgaatgatataacagtgattttttttttcatatcctaatctgttgtatgggctaccctgatggctcagtggtaaagaatctgcctgccgatgcaggatacaggagacaggagacgcagatctgatctctgggtcgggaagatcctccagaggagaaaatggcaacccacgccagtattcttgcctggaaaattccatggacggaggaacctagcaggctacagtccttggggtcacaaagtcggacacagctgagcacgtacacacgcacacacacacacaatacgttgtacattacaactcaatttttcctttctgtttgctccatgctttaatttcagtacacgatcttacagtgttatgagttgtgtcagcccattgtcatctgttctcaattgtaaacttgaaagagcagcggggagcgtgtctgtgtactgctctctatggtgtccaacacagcactgtgcagaggtcagtgtgaacctggatgttcattaatgacagtgtccaggaggttctgatctcccagttccctcttttattgaactgtccactagtgaaaaagcattttgcaaaatacctttgttagagtctaatcagaataccataggactgtttcactctctgtgtcatgccctacagtggccctggtatttgagtgagggacaaagagagagagaacagcaatgtttcacataggctgtgttagggaaggtttaggacatagcgttttattggtatggaattgtgatttttatttgaatctcatcaaactctctcctgaaaaggatctttcattcattatttcttctcttctctttctttctcttttctttctttctctttctagacccgttcagctctgaacacttacaatggagaagattttattatcaccaaagacacaattacatggtgaatgtacgaaataacagtttggtttctatagaaaatgtatttcgcattgttatttcaaaacctttccttgtcttaccttgaaagaaaagctctttcaaagaagcatttggctttttctcatctatctgtttagccatcgctccttagtccatgcatacgtgagcgaacagaaacaaccctttttgtttctcttgaagatatctaagtaaagtttcaagtagccaattagctttttgacctaagctttgttggctgcagaaagcctgtatcccaggaacatttggttctcaaggcatttggatctcataagaaagcctcggtgccagcaccaatcagaatggctgccagctgttattcttcttcacaactggcggccatttccagcactgttacggagctgtgatcaatctctgcacctgtctatcagtggatgttcatagagagaactgtgtgggctgcatctgcagataccacatgtaaccaaaagggagaggggagagaggagagtgcaacccctccccccgccatatataaagtgagaaaagctacagggagaggaaaaacataggaaaatacgcaagggctaggtataagttagaagaaaagagcaaacgaatgttttataatgggatgtttatggtgggaatgcatagttttcacctcatctgtgagttgaggtctcagtttaacacttgcacgggttttctcattctttcttggatagtccttgtctttg

SEQ ID NO: 31805 - DNA, 1209 bp, Bovine  19866880820703
aggcattgtaaacagacatatataagcaagaaaagcatggtagctgcaaaggcacgggcaattcagcattactagaacaagtcataaagaatgatgctacgaatgctaggaaatgagaaatgaggctggagagtacgacaggaagtgaactcactgcagctgcaggcgaaccgacccacccagtctaataaaggtctctgggagacccaataaaatacataagatggcacaagtaccatatcacatgccaactgaggctctttttccactcttgagaagaaattaaatgtctacttccatattcctgagtctgttccaccattttttctttgggaaaataattttaaaaatatgcactgcattttattaactgccagcatgatatgtgagtatgtcagggaaaatgtattaatactttgttccatatgtacctgttatatacttgtatgtattagaattaagcagttttgtttaaaattgaggttatataaatgctggagagggtgtaggaaataggaaaccctcctacactgtaggtgggactatgagttggtgcagccactgtggaaaatagtacagaggttcctcagaaaagtaaaaatataattaccatatgatccagcactcccactcctgagcatatattcagacaaaaactacaattcaaaaagatacttgcatcccaacgttcacagcagcactattcacacgagccaagacatggaagcaacctgaatgtccaccaacagatgaacagataaagaagatgtggtacatataacaatggaatattactcagtcataaaaaagaagaaaacaatgccatttgcataaacatggatgcaaccagaaattatcaaactaagtaaagtaagtcagaaagtaaaagacaaataccacatgaaaaaagtgaaaggcaaatatcacttatatgtagaatctaaaatacgatacaaatgaacccacctatgagacagaaacagaatcagggaagtagagaagagactcgtggttgccaagcaggaggggcatgggaggcggatggattgcgagtttgggattagcatatgtaaactggtatatacagactgaatgaacaacaaggtcctactgtatagcatagcgcattatactcaatatcctataataagccataatggaaaggcatatggaaattaatatatgtatatgcacaactgagttgctctg

SEQ ID NO: 31806 - DNA, 1210 bp, Bovine  19866880885423
ttgttactttaattattacatttagtgcatagaaaaaagaattgaatgatctatcatgaactaagaaattgttgacattatctctttttcccctgggagggttttgtgttttggtagtttttaatgtttgttttcactttatgagttaatagatgtatgaggattagataatatctataaatgtcttgagattccccaatataatttgaatatacatagctacgagatatatacaccaaaggaaagagcaactacatgttcattttggagggggaggggtacttagacttacagtcttgactttagaatcatagttaccttttatcgaaattcatccttctttggtcacaagaagggtaattcagaaaaattgaaatgttttgaagacaacgccctcattgatcttgatgatttagggagactggctgatccttcctttcatgcaggattacttctaatgttttccaggggaacccgagtgcatccatgcactggccccctaaatcttttgctttgcaaaataaccagccaaagttctcgggatgggctaggaaagaggcaaagacattaggattctccaatgcactaattgatttagcagcagtttaaaacaatgttgagcattgtcagagacgttccttggaggtattaaatcaagtttcccaagatggattgcatgctaaccacatactatctaaaaatctcaagggctgtttattgttctgcaatttatgatcgtcttgttagaggattgcacatcagcttccctcgagcccaggaagaaacagagacaaatagcatgcaaactatattgaacaattcattatattatattgtagaaacctaagcacagtgtggagataacccttttatgcgtgctgccttattgaacagtaatcactctgtaatgctttagatatttaaatcatatttataataacacatattaatgtaacatccctcataaagttctcaaggcattttatggggtatataaaccatggaaaaatacaaaattttaaaattcagatatacctaccctggggtcttggagacaacctaatgaggaatatatacaaaatcccaggctgacagtttaactatttaagtagcatatagaataactcaaagacattttaagatattggctggttacgaactcattctttatctaaatatttggccagggtggataagtgcttactttcag

SEQ ID NO: 31807 - DNA, 1889 bp, Bovine  19866880886362
taaactataggagaactgaggactaagctctctcactcactatgtacttctgtttcctacatggaagcctggcatatattagtcacacgtgaaagtaactgtcgaatggataaatgagtataggaatttctgccagattcttagagatcttctttgctttaagatgactcaagtttacgtatgatttggaagttattgccccgtgggaagaccatttttcaagttactgataattaaggcataaaatgataaatatgcattatcctagtttcttaattatctcccatagatgctatacatcaaaagagttatactgtagatataggcaggactatatttattatctctaattaaatacattaagtaaagaagtacagaacagcataggttacagaaaactaatactcatttaatttctgtgtcctttaaatgattttgtgcttatattttccctaattttgaatgaatttaggttctttttgaatgcatccattatgtcacagagatataacctgtaaccataaatctacttctgtatccaaattgcattatatatgtacatatacttataaatacgtaacttcttattgcagtgtacatttaacatatctacagtgtgcagtattctctgaaggagtttataaaactatgacaattattcagataaattgagtaaaaaattccctttcttttccttcttatggagtcttgttatataaatatttaattcatctataaaagaacagtaagttaaaagtaacagtttaggtagggcagatgataccgtttgtcactgctgtcaataaactgcactgagtaaggtgacacatgacagatgactggagactgctgatgccttagctggtctcagctcctgtttgcctctcccagtttgagcatctccttctgccaaacattggtttcatgtttaaaggcaaaaacttttcattcaatacaaaactcaagtcaacaacttcatttgaggctcaaccaaagaaacagcaacatgctgcagtggtttggtggactgaccacatgatgatggggggatggtcctcattgtggcaagttccgaggtatttccaagtgtaattccatccttcctactgacttagaatctgaacccagtttaaacgtaactctccttatcaatttcaagtaaaagaccaattgcacattgtatactatgcacatataggtgagagtaagtaatttttctacttgctttcatttctctaaaaaaattgggggcgtaatattgcaaatttttataatctcttcaaaaatcgacatgagttaggaactgagagcaggaatacctgctgttcactaacttaacttacataacaaatactcattttatgcccactgtgtactagtactctcctaggtactgtggatacaaagacaaaaagatatattcctcattgtaaaaatgcttataagttagaaacataaattatcactgtactagaagcagtgacggaagaatggtcacaaaatgagactgttcagctcagggaagaaaggatattaaggcaaggaggtctacaaaggaaaactagtttacctgagctaagttttgagaactaagaggagtgtttcatgtgactgaagagaatactatcatccaagcaggggaggcaatctggtaaaggggagggtaacgagagctcagcatgctcagttaaccaaaagaagtgtgatatgtttagggcataagatggatatcaaaaagtggagagagctaaaactagaaaggcagaccataaagaatcatgaataccttctgcatagtcgttcagtcgtgtccaactctttgcgactccatggaccatagactgtagcctgccaggcttcactgtccatggcgattctccaggcaagaa

SEQ ID NO: 31808 - DNA, 1976 bp, Bovine  19866880937145
gggaaggaagatgagcaggtcagtccatggttagaccacccaataagcaacctaatcccagccttacaccaaggaagatagggctgtgtggaaatgtaacctaaagtggggtccagctgctcccattcaagaagtcaataaagaaacaaggttggtgaaaaggaaagtttattttattttggatgccagtgggagaagaggggagagactcctctccaaaggctgactccaccccctcaaccccccccactctgacaatcaatgggctagagtctttatagacagacaacgtgaattactcgcagaaacagcacagtcagctctgacagtcatcttgaaattggtcatcagtggtctgactgatcagtgtcatcttgattattttaagtacaattaatcttcagtgccagggtcagtttgtttccatttcttgaggccagttctcaaaattgtggcaacttatgtcatggttacagtctagtcctcatatagttaacgtcttccacctgatagggatttcagtatctgtaagacagcgcacaggatatggctcagaatattatctgtagtccttgagaaggaactaaagatccttaattatgtttaatgactaatctattattatttggtctccttcgactcttttctgtttgtttctacatgttctcacttttctgattaaacttattctttggctaaaatttttccacagacgaaaggcaggctgaggacatgggggacaaggaccatacggtcctgctctatgtcagaaataaataaataaagaacagtttgacattaaaaagcttcatagcgctaatcagaatgctgtgttattttgaatgatacagccaagtggtttggcactgtaaacattttaatccttaggaatagtaaagattttaaaataggaagctattttcaaaaacctacctcttttcctcttggaaatctctctctctcttacttttatatcttcctgtttccctctctttcttatcttttctgctgtatatttttagttgccacccctctgttagtccttctctacctgtcttccccttttctctgtccttcagttttttcctcctctctcttgttcgtcaagatctgagacactagttacccttttattctcccacaattgtgaaaaatggagctgccatctcctttagaactatttgcttgttagctaaacaactataataataatctgctgagtcaagagttttcattttgaatagcaaatggcaaggatggaggctatcagagcaaaatgtatctgggctgattttttcactctaaatggaagatctcctggagaaggaaatggcaaaccactccagcattcttacctggagaactccatgggcagaggagcccaataggctatagtccatgggattacaaagagtcggacactactgagctgttggaggcatagctgataacattctaaatgattgtagaagatactagcctagagataccttcatccataattcatcttttgttataaaagccatgaacacatcaatgatggaggcttccgtttagacgataacaccaactcttccgagattagggaaaaactgtggattctcttggaaaacaaaagtatagtgatggaaacacagctcgttatttttatgctaagaaagtactgaacaattggtttcttagcatcagctgaaatggaaagaattatttttcactttgtttatttaatagtcttctatcagtactttataatagttatctcagatggtgggtggtgacctctggctacctgctctcctgcacactcacaccatttattattcattatttatgcacatgtggatatatgaaagatagagattaagtctaagggttgtagtgtttttaaaaatctttataatctatgaaagaaagagttagttgctcagttatgtctaactctttacaaccccaggactgtaggccactaggctcct

SEQ ID NO: 31809 - DNA, 841 bp, Bovine  19866880991776
caggatcactcagccagcagtaatagttattatttttatttattagcactgtagccctgttctccagcatagccaattcaccccaacctccaagacaggaaaagcatttttacttttaataaaaatgggagtgtgcagcactcctgtgtcaggctctttgggtaaagtgcacatctaatgaatattgtccatctgtatccaaataatttatagtatcagcagagtgtgggtggtgaaatgtgaattaagttctaaccattaggcacaattagagggggtaagagtggaaggtaggaggaagtagcagggttactaaggcaggagggatagaacaggaaagcaaaggtaacgagagaaaattgggaggaaggtggtcatgatggcatcaattaacagtcaattataacagttaaaatattcctcataaaagattttcaagactatttcatacagcaataaccaactttctcagagaccaactgtaatgtacctgttttttccatctattttatttgaaatagtaccatttcaactctttctctctctctctctatatatatatatatatgatagaagaagaaaaatagaagacagacaagccataagaactcaattatagtaaacggtatataagaatgcggcatacttaaaagtcttaacttcagaagacaaatttataaacaaacaggaaacgtttgattgcttaaccatatcacagtttagtaaagaagcatagttctaagcaaattctaaatgcctactggtatattttcagaattacctaaatatgtgtttgaattataaatgaagcaattaccctactcttagagtgtgttcggat

SEQ ID NO: 31810 - DNA, 1253 bp, Bovine  19866881008943
ttggcatgttgattgttttctatgtgtctgatttggggagggcttccttacattttgtaaatttatcaacttcattcctacaaaccaggaaactgaataatcattttgataattaatagaatatatcacaatatatcttcatgcaggagtccataaagtgtggttatatatatctgtattttatgtttgtgagtgttgtaattctttcttgagatttgaaacatgaaatactaaatgatctagcaagataatttaaaagctttgcttatttgttatctccgcagatgtatatatttatgtcttttatacactagcacaatctgcaatgtatgattcctgaagcccttccattctgtgttgaaagctgggttcacattgcatgaaatttctgtttaattgccctgcaatgaacttagcccctcagtgcttctctctgaatgagtttagaatgctttgcatagtcaatcaataaagttaacaatttaatgtccctgatcttatttcataatgctgttttataagtattcttttcaacttctgtgtttaataaaattcccttgaataaatggattcatgttagtttaaaaatggaagaggaaaaagcgctttctaaaattttaaacctagcaagacgtttgataccgttgaaagatcaaacagtctgaaagaaagagtgaaaatacagaaatatttcaaacctaacaaaacattaaaaaatactccacatctgtccaaggaactcagccttttcccaataccagttacaccagatcaagcaatagacattttagaaataaaaggtaaatataggggaaattatatctatgtctatcaatctatatttcttgagatcatgactgtatggatttctacaggaaaaattgtggaaaaaacattatgaaactctagcaaatagaatattcagactaattatatgcagataaattattttatttaatttccaatatctgtagactcttctctacaaatccaggctcagatataaatattactctcaagccagcctacagctcacttcttcttttgataatacttggtccaaaaagatagtaagttttatatctttcaaagttcagttatgattttcttctggaataacatttgcttttatcagtgcaaatggaggcagaattttccttaataaaatctcaccacttacagaatattttgatttttttttttttttagtgacaaataaaccaagatttctgaggattcaaaatagagaaaat

SEQ ID NO: 31811 - DNA, 1010 bp, Bovine  19866881016066
gggtaaatagctgtacctgagctaagtgttagcttcagtacagattttgcctggctagctgattcataagttaaaactgttacagaaaagattaatatttgtggtatatattttagctttcttacctaacctatttcaagagctaagttatgcactgagagcctcaattttttaattatcatgttagaaccaattaccttcatagtagtagtaacacatagagaactaacctagatctccgaaagctaatttcctagtgtgctaatatactcagagttaccatttaattctcaggataatttatttgccaaataaataaactttccaaagacctaggaaagaaaatcatatttacaaatgtgtcaacttcaatttcaaggtctgcaaggagataaaagaaaaaggtaatagaacacagaataacttttactattgtttggatataaataaaatcaactctccttgatctgactattactagatatatatgaggaggaaaattaaaatacacacacacacacacacacatatatatatacacacaaaggaccactgagatgttccaaacttttcaaaatcaaatctgtgcttttcagtgaaatataacacttcagctttatcaagatcaaccttcatcattcttagaatgaattatatggtaactatcccatgatatattctacaagcattcttaagagaactaaccatgtaaaataaaccagtgataaatctttaatttgtgtataagaacatcaaatatagaaatagattcatataaaatgtgtctaccagttgggctcagtaagttaatcactctaactataaaactggaaaacaaatgtatgtaattgaataacatttgttttaattttcccagtttatgtgttctacttaattgcgagaagatgctatttttcttcatttaaatattcttttccatgtttatatgagttttattatttcataatcacatcttcagcatcatgatttgcaaatatacataagcattt

SEQ ID NO: 31812 - DNA, 1088 bp, Bovine  19866881034019
tttagtcgctctgttgtgtctgactcttttgcgaccccatggaatacagaccccaggctcctctgtctatgggattctccaggcaagaatacaggagagggttgccattcccttccccagaggatcttcctgacccagggatcaaacccacatctcctgcactggcacgtgagccaccaggaagccctagttaaaggtgtataattttaaaataaacagtgagaaaacaaactaaaatgctttgataaaagttgaaagttatacacagcaaaggttggaaagggcagtaaaggaaagataacatctggccaaaagattctaaaattatccatcattcttctgaagtattcatgctttttaaggagctttcaatggtgctgcctatcatttgcatatcatacaaaagtattcttatagaatgcagtgtaatactgctcaccaacctcaaaaactcacactctttatttgtagctaatagatatatagcaaagagccccatgtcattaatgataacttaagttatctttcaatccacagttttccctggcttattaagggcataacacattaatttttctttcaggggtgacctttacaacaccattaatgctcacagcttttatcccactacattattactcattatagtttcagctttcaacatctgcatttgttgaaaagagaaaagtaaattgtagtggcatcgaatcctcagaaaatgtgagggatgtgtatgtggtgaagggccttctcaggaaaagaaaatacaagtttcagtagtggaaaaagtcagatgataaatgtcattaaatacattcttgcctttctaaaatattttgtcatacttaatcctcagaatgctgaaataaaaactcctcacatgacaaaatgcaaatatatcagttattcccttagttaaagattccagttctgaggctattacaaaagtatctcatacaccaacagtgtcatatttatgagctttcatgtctattatggaagtgaatcctttttgccaaacaaaatatttttccttttacatgctttggacatgaaagcaaatcttatcttggtgtctactttgggat

SEQ ID NO: 31813 - DNA, 780 bp, Bovine  19866881063351
aatctgaggagtagagtcattaactgggaagacatttataaattagaaataaatttgagagttaattccttttgctgatgccctggatactttgtggagttgacatgtgacttctttaagaacagtgggatggaattgtccatatcatggcctacatgaagggccagtttatatgccaaatatcgttaccctttattttttcaccttaaggggcagagctcggggttggagaaagagagaagtcagtcatattcatcagggaaaagattaagtgcagataagtcataaaatccctaccctgttaaattcccatatccttaggcaattaatattctgccaataactttctatggcttacattaacaattcttggtctgatataaattctcatgataatgtcgtctttttgtgtccatatagcattttccttttctggaatcatagcatcaatgacaggattttgttgacacatcaggcctttattttgcctacttcttgatcataatatctctctgtgacattgtttggcatttgctcatgtactaatcttccatgcaatttttaattatttcatccagatctctaaatgttttgacaagttaagctgctctgattcatttgcaacaacctcagctctgagagagaatgccttcaattaaaattataagtgaacagttcaaggaaaatattatagaaaaaaaaaagaaaggaagacgtaattctattgtctatggctcattgttgaacaaaagctttttcccatagagatgtaactttttg

SEQ ID NO: 31814 - DNA, 1274 bp, Bovine  19866881079296
aggtagcacaaagaaatctactctgttactgcctacgttgactaacatgaagcttactcaaaaggttaataaaaaggttaatagagtggttaataaagtctttcatcttcaagtcaggataaaacatatagtattaattttttctaaactttttgaagcattactatcataggtacacttacatatgggtggaaaaatataatttaacagtaaaaatagttttttaagaaacactaaattcatacattatatgtggctattctaattgtagtttaattaaatatttaaatgccattgaaataataaattgccttctttttaaaatatggctttttaattgaaagaaaaatgtacaaagacattgaaatattttattaatggccatccaatttcattggaagtttagagccttagttcttatttctaactttcctcagctcaggaagatgtagattttcttggcaacagttgctgtgtaaaatattctgagatagaattttttatcataattaataatagatgaaaatttctaagtttttgatgttctaaactctatgctgtttgatttacggtgtctttatagttgtttttctggtaatgctcagcctcttcctgttggaataagggttagtcattttttttttccctagatgggtctgatttatttttccttttccccatatcttcatgttttactttatgtaacttactgaaaaaccaattctgttgtaacgagattagattacaagttttctaagtttcaggtggaatttttagcacatccctctaaagtttccaaagtactcctactgtctgcatccttgtaatggaaacacttcatgggggcatcacaacttttaaaacttagttccaaaacagacagcagctcttgtggcaattatcagagctaatatataagtcttattcattatgaaaagttcagtacaagcgcttgcacggtattatcactatatcattctcattaattttttttttttttagttctttggggtcatttaaaatgaaaagctgtcacatagtttcaattcatgaaatgcagacaggaatttttcaaaaaatgctttccatagagagcaatcagagagaatgtaatccctagaatgtcttctgttttttcctgtggtatttctctcttttttgaaatataggttcttgagtaggttgcaacaatataagtttctatcatggactccagctctatcgtcttctccctcgctagtatctgcctccgactactaatttgcacccagcaa

SEQ ID NO: 31815 - DNA, 1268 bp, Bovine  19866881108616
accactgagcaactgaacaacaacccagctcctagaggcttcaacagtccttggcgttccttgacttatagatacatagctccagtgtctgcctccatgctcctgtaacctccttccctgagactgtatgtcaaatctttccctcctttctcttagaagaacacaaatcattgaatttaaggcccatcataaatccagcgtgatctcacttcaggatccttaatttacacgtctgcagagactcaatttccagataaggatgccattcaccaatactaggggttaggacacagactagctttttgagagacaattcaacccattacaagtagtttgctgtttttccttctaccttttaacaggctcttcccttgtggaacagccattcattcactctttctgtttatcccctctagattggactttccagttagtcctttctttggccccttaaaatatataatgtatgtgtatacactcagtcatgtccaactctttgtgaccccatggactgtagcacgccaggatcctctctccatggaattctccaggcaagaatactggagtgggtagccatttactcctccaggggatcttcctaacccagggatcgaacccaggtgtcctgtattgcaggaggattcgttaccgctaagccactagggaagccccaaaaatatataataggtacctttttaattttgagaattttgttggtggttatggttaagaaggaactccaaggtatgaaaaatcaaactgttgtaagtgtaacacagtcacagactctcacacctttcttacattaatgattcctaacctgcatttcccaaatatcatttgaggtgctaactggaagccatattggtctttgccgtcccatttgcctcataagaagcttaccaaacctctcctaaacacttacccttccttctgatcctgtcttgagatgcacttactgctcaagtatataattaaggcagaataaaatgtatcaagtgatcattcagggtcttttgaactctaatgggtgactccatatctccctgaacctcagtatcaacaacaaaggatatcccctcaaaagattttatcatagtggtcaaagctgtgcaacaggactgctaaggatgagcatatagggaaaaatgagagaggaaaaaaatacaagaacatttttttactgcctcctcaggtgtaccaaatgttatctactccttcacgtggtatgtcattgattcctccgttagccttatgttcattttaca

SEQ ID NO: 31816 - DNA, 2818 bp, Bovine  19866881126681
atgcctggaagtgggctggaattggtaccccacatggaagataaaacccaaacacagatgcagtggctgtgaagaaagacagtggaggatggattttgagggatcgaggaagaaataccattaaatttggactgtacagtctctgacgtcattttcagtcctgaaattctaggaccaatgtattaactcctgtttgggtctcagaatgtcagtgaaatatattcttaaaatgtttctgtctttccaaaattaaacacaaaaaatttacatcacttagccaaaaacacaacttaactatgcattatacaaaagtatagttttcctgggatgcagtcagactgagaaaagtgctctgattgggtcaccttgaatagagcagcaaagtggatgagttgtgtagacctcagactaaaatatcctaataagcttttcctgctctgtcctcatgacatggccttagatgaatacactggaagttaaaaaatggcccacccttaatttgggcccacatttagtttgagaggaattgatactagtatttccatgcatgctaagtcgctcagttgtgtctgattctttgtgaccgtgtagttgtagcctgctaggctcctctgttcatgggattctccaggcaagaatactggagagggttgctatcccctccttcaggggatcttccaaacccaggaactgagcccatgtttcttaggtcacccacattggcaggcggattctttaccaccagtgccacccaggaagccaatatttccatattcctccttttttcatggtcaccaatgtatatgtttttgacatatcatttattaggactttaatagcaataaataaacaaatgctgatgtagcagaactatgaattgccagaaggctaggatggagtaatgggtaatataaaccaagggctagttggtattaagcctggatgaaacagaaccacagaaaggacagatataaggaatactaattgaattaaccaatctttgagtgagatgagcatacatgaatttgcagaaactgtttagaccagtgtttattaggtctgtgtaaattcctttcctaattatctttaacgtatgtcatcagaaaacaccgaagacggaagaaattccttcccagtcccaagggatgatccctttgggaaactgtcaagcagtggccagaagacaagaagggggagagtgtgacctgccaaactataactattcagtggcttcaaagaaaatttccatgtccttgccaatgtggtatttttctttttgcagtgaaaattagtggaaaaaatatccaaagccataacaagtcatttgaaaaacttgagggaaagggattattcacatgctttaaatagtaatttgttgatttatttcactttcaaaagaagaaacagttccatgaatagttttccttatttccagaagagtctttatatatacttcaagtgtctcaaggaccttatcttgcacccccaacacaaacatcgtattaaaaatagtttcaaaactatttagttacttcaagtttgtagcacatgatcctcagaggaacatttctcatttctatgcagagatttttagctaaaatagatacaaaataacagattaatcccattaccgagattctgacctcagaatgatggcctcctggacaagtttaacctgtgccatatgtccagtccctccagctaattaattattagctattcattgctagcaatttctacacttaattcaagtgccagctcccctgggttgagccgtttaatataaagatcttagtcttcctcatccacaaaacagaatttatattacagcttccacacaatttgttttgtaaagagttaactaaaaataaaaattatttttattttgtttttcaatgtgtgtgtgtgtatgtacgttagtgtgtgtgtgagtgtgtgtgataatagcactgccaattatttttaagatggctaacttgccctttccctaagccatcctcctagaggtaaattactactgaaaaatttgctaatttacaaagtgtcacacgaacaattcaagggtacatactgtactttcaaaacactttcacgtctttgtaatcactaagttcagatcttcatctattgagggagccaaaggtcatttttcctagtacagcaccacagttaaggcttctccactcgctagttctatgtatcctaacaggttgtaacctcactgtcttagttgcctcctctgaaaaatgggaataatcacaggactgttatcatagcattgctatgactcactgactggtagatgttgttaacaagaagtttcaagagtgatttccagatttctaacaaggataactgggagtatagagctccatcatttgaaatatgatctccagggcaaggggatgatataaaaggaaagtcacaattaaggtgtattcagtttgagctgcctgccaattctgtggacacgaggaatgttcagtacggctttgaaaataaggctaaaattatgttggattttgaagtccattttcctgaaatatactgtgctgaaaaaaatggctcagggaactttgttctattaaaggtacacttgaatctagtacaacctcttcatttgacagttgaggaaacaattctttaggtcacactacttatgataaagtagcgtgttatgttggtggtacctcatgaaccacagctcctgacagtcacatgcttgtgcaatctctgcccagtgaatctatgattcctcctgatgaatggaatttggcaaaaggtgatggaattccagtcgagttatttaaaatcctaa

SEQ ID NO: 31817 - DNA, 3289 bp, Bovine  19866881126683
gaaaaggtgagtttttattccaatcccaaagaagtgcaatgccaaagaatgaacaaactactgtacagttttgctcattttgcatgcttatgaggttatgctcaaaatctttcaagctaggcttcagcagtacatgaatagagaacctccatatgtataaactgagtttaaaaaagacagaggaaccagaggtcaaatttccaacattcactggatcatagagaaagcaaggaaattccagaaaaaaattctgtttcattgattacactatagccttttactgtatggatcacaacaaactgtggaaaattcttaaagagatgggaatccgaccactttacctgtctcctgagaaacttgtatgcaggccaagaagcaacaattagaatcttacttggaacaactggctggtttaaaattggcaaagggatatgacaaggctgtatattagcaccttatttatttaacttgtatgcagagtatatcatgtgaaatcctgggctggtggaatctcaagctggaattaaggttgctgggagaaatatcaacaatctcagatatgcagatgactaaagagtatcttgcctggaaaatcccatgggcggaggagcctggtaggctgcagtccatggggacgcgaagagtcagacacaactgagcgacttcagtttaacttttcactttcatgcattggagaaggaaatggcaacccactccagtgttcttgcctggagaatcccagggatgggggagcctggtgggctgtcgtctatggggttgcacagagtcggacacgactgaagcgacttagcagcagcagcagcagcagcagcaaagagcctcttcatgagggtgaacgaggagagtgaaaaagttggcttaaaactcaacatacataaaacaaagatcatggcatctggtcccatcgcttcatggcaaatatttttattttcttgggctccaaaatcactgcagacatgagtgcagccaagaaattaaaagacacttgttccttggaaagaaagctatgacaaacctagatggcgtattaaaaagcagagacatcactttaccaataaaggtccatatagacaaagctatgatatttttcagtagtcatctatggatgtgagttggaccataaagaaggctgaacactgaagaaccgatgctttcaaattgtggctctggagaagactcttgagatttacttggactgcgaggagttcaaaccagtcaaccctaaaggaaatagaccctgaatattcattggaaatgctgatgctgaatctgaagctccaatatttcacccacctgatgtagagagttaactcattggaaaagacccacttgctgggaaaaactgaaggtaaaaggagaaggaggaggcagaggatgagatgattagctagcaccactaactcaatggacatgaatctaaaactctgggagacagtgaaggacagggataagccggatacgacttagcaactaaacagcaacaacaatagttaatttacaacattgtgttagtttcaggtgtacaagaaagtgattcgattacacatatacatatgtctattctttttcaattcttttcccatttaggttattacagaatactgagcagaattccctgtacaatacagtaggtccttgttggttttctgttttaacacagggcaatactctgaggtgtaaagcttgagatgacttgcgtgcttctgtttttgtgctgttggaatccgtaagttcccctgagaagtctggcttttctgtaggagcagtgacaaggagagggcgatgacctaagatggaggagaaagtccagctgacccagtgtctttacaccaggtgacctcttcttcttccctggccccagctgaatgcagctttggctgatcactctcaagactcaagactgggtttggctgagtccagccaacacacagaatcataagagagagactttttttagcttctaaattgtagggtgatgtgttatgtatcaatagaaaatcagaacaacccccagaaccaggacaagaatctaggtcttccgagttccaaaactaaggtcatctagggcaagaaattcttactatgagattttcctcttaactttccaaaaaacttagtaaagaatgcagggtgaataactctattgtctggtttgctcaagtggaaaatgtatataataattaacttcttgattaaaacatactatatatcctgagatgaatgagttacctgttatttaactatgagatagatttatcttgccattattccttttgtccatccatccatctaccccttatccatctattatgaattaatctatatcaaagaactagactacaattctatatcaaacatctgttttactctatgactttctgagctaccagaaaatacagcagaggttgaataaaaaagccaaaatttggtctttcttgtcacctcagttttaagtatttctaattctgattagaggaataccagtggatacagcttttactttgactgtcaaatgtctcaaactattattgaattttaattctttgtgaaatgtggttgattgagaaaaatcatcagaattcaatagtcacaatcttccaaaaaaacctgctttccaaataagtgcatatctggcatgcatctttaaaaggaaggaaatcactttctcctttttattttattttttagcatgcagtccaatagtttgtgggttcaatattagatattacttttgaacaacaggaatcctattcatttctatattagaattatatttgtttggaaactgctcagaagtcagtctgacagcttgacaaggcttgttgccatggaaaacgtttgtgatgttatataaatatattcccaggtcatgagttgccatgtattttttggacattgatgctaagaggaaaatgactgaacattttttttagaaaggaagaataacatagtaaacaaacaataataacaagtaataaatatgtgtatccaataaactgaggttctgtttttttaagaattagacttatgttctcacagccattttagttataaaagttcatttatggccaaggctccccccccccttaaaatattcttattaccagtcattttgcaatattaatagccccactattaatagactaagagacaagggagccattatttttgctctctatctgttattccattaagtaagactgccaacctgtgactgctagcagctctataacgaaccatgtgctcaagccacggggtatatcctaag

SEQ ID NO: 31818 - DNA, 1643 bp, Bovine  19866881129030
ttttgcctaaccgcccattccctggcctcttgccaccaactaccacttcttcaagcatctcaacaactttttgcaagaaaagtgcttctacaaccagcaggaggcagaaaatgctttccaagagctcgctgaatcctgaagcatggatttttacgctacagaaataaacaaacttatttctctttggcaaaaatgtgttgattgtaatggtttctgttttgattaataaggatgtgtttgagcctagtcataatgatttaaaattcatggtccgaaacaacaattacttttgtactaacctaatgactccatgcagtactctttgtgcaggaactctggtgaagaatgttttttctccaggggcttggtaaaatcccaggaatatttcagtactccttgtggatttaagtctctggctgcggctcagttacctatccttgaatttggctttgggagttagagaaggcttcacacagaggaggtggcatttgaacttggctttgaaggattagtaggattttgccagaagtaatggaagaattctcactggcaagaaagataattactggtagcactttttttttcctgcttcataatattcaggaaaatttagacctctagtcctatatacttatacatcatgtgtttatggctgaaagtaaatatgattaactagataaaacccaactttacaaatcctcttttatgtgcaaagtatttcaaggaggaggtttgatttatttacatttttaattaaatgaaaattacagataaaagatgctataccactcatcttcctaggaaaagaaaatattgcaatgtaattaaaaggatgcctcaaattataattagattggaaatttaattatgactagaatactttatccttatgcacactgacaccttgttgatacacaacctttaaagtatttttattatatttactctaagatcttaatctgtggactaaataaaatccttaggttcctaagaagagctagaatttagcatagaatccaaactgcagttttttacctggaaacaaaaaaagtattgtgtttcagaattcctgttctgattattactggatttttattacaacttaatactgcaaaaaattctaaaaatctctagcagatatcagttagtataatattaataacaaatttcttagctagagagaacatcctttggttcatacctgatagagttactcacttccaaatgaaaggactgaaggaattcatatatatacactcaggaatcacattttccagaaagaatactcttcctatggaatgtcagctgtacatatagaaatgtatcatagcaatttggtggaatttcttctgcagatgagctctggttaaatacatttgctataattaacttcctgtggcaccatttgacacttcttgcagcttaggaaacaataactttcacagtaaaaatgatttagttacagcataatgtgctctgatagaaatgttttgagataaagatcctcaatatgcaattattattagcttgatatggaaaatactgtgtgataaaaactgtttgaagaattgccactttaacttatctggggttgaagaatgcacttaataataaatcgaaggtctttattcatgagtcaaagt

SEQ ID NO: 31819 - DNA, 620 bp, Bovine  19866881133840
aaacataaaaaacagaaacaatattgtaacaagttcaaaaaagactttaaaaatggtccacatcacacaaaaaaaaacttaaaaaaattttttttctgactttaggtcagtcacccccttagcagttatgccacaaactgcagctttccagttccctttattgcacttggtttgattctattgttgtacataccttattcagtggctaggaacacatcaagtgttccaggaaaggaagagaataaatgcaggataaccaactcccaagttgttcagtagtgtttctagggtcagaaccctttcttgacaacatcatctgcaacacattaatacaacttcgaacgtttcatgtgaaggccatattccagtgtgaatgaatggtttcatttttgttgaacccagcaggaattagttattagcattgatgctcaattgtttaaacataatgaaaattttctcagtggtatcctgcaggctgtctgggtcggtgttcttaatttttaagaaagatgttaaatcgagaattctgctccctagcattgccatctcctgtttaagttgcagtggatacaaacctctttttatgaaagtagggctttctggaaacacaactaagctca

SEQ ID NO: 31820 - DNA, 1036 bp, Bovine  19866881141484
ttttttccctttaattttacagtaatggaatactattggctgagcatttattattcttaatgttctaatctggggcctgatggaaataaaaagaggtttaaagcacagttcttggctttaagtagttttttaaatcaaattaaagagtcaagagaaaaacctgaaaacataataacttaagttattaagataccaagttatcattatcagagatatctccttttcttaaaatgagaattttgaaaaatcagaattaaggaatcctacatttaaaaagaaaaaaaaaaaaaaaacaaaaactattaacccatcaagttttagacagttttctcaaatgccactcagaggctttcttcaaagatagaatagagctagcagaaaaaatattcaagtttgagaatataaatttatgttatcatgaaataatgaaacatagctgtaaaactaacattatggcctctcaaggttacagttaaatccaagatttggagaacaaatcacacaataatttaaaataagcagtacgtttgagatatttaaaccacgccagtgaatcttctaagtcaggttaaaatactgatttgttacaccagaaatgtgagcggttcactgaaatagaaacaatatcacttttaattgttcttttaagattcatcagatagacaagacccctatggtaaagaactagcagtacgagagaacacactttctaattacggttttcaattcaaacctaagacactaagcactacctcaataatgtatttgccacctgtatatgtgaattagatagaaagatctattataactcagtcaccatttcccatctcactacatttcccttcatcaatttatgatgaaaaaacacgtgcttttaggaagtagtagctataagcttctaattttcatgtgcccatttgaaatggaaataaaatttcaaatataatttacataggctatagaacagatatccagaaaggaagttctgagtggaacagaaggcaagaaacatatcatatactccttattatcaatt

SEQ ID NO: 31821 - DNA, 680 bp, Bovine  19866881152556
aacgacattgtttatgctaattatctttgtttatgccacaattctgtttgtttacgacattcttttaaaataccatatccctataaacagttctcaccagaattcttctaaatcttgtttcggtctggtccttctcggcagcccactgagcagaaatgcagctctacaatgaaggcgcaagaactgagaacaactttgagtctctgactcctcaggctggcaaaggcagggagtaccgctgaggttttactctcaggctccgagggaaaaggatactgattgtggagaaatacaacatccccctattggacaagcagaaccacacgccacagtatctccagggatgtatggactctcaactagtaagtgaagagaagaatagataatgctaaagagaaggaagagcagcctccaaactacaggagaaaacacagaagtcagaaaggatgaaaaggtcacctcctgcaccattattagttcctgattgaaatgaagaattagggggcattctcttaaagaatgtccaaataaatgctgtttattgaagcaaaatattatcagtctttatttttttttttcttctccaggaatatcacttgattatgttcatctatgtaacattcaaaccttatattcagtataaatgacaaagctctcaatcagtgaaaagaaaaaaaaaa

SEQ ID NO: 31822 - DNA, 1010 bp, Bovine  19866881171277
tgaggaggccgtatgactgcagaagaacagagagaagggtactttgaaattaggccagaaagttgtgtgggatggaaaggggcagaccatatagggatttacaggccatttaagagctttgggttttactttaattgcattaatggtttccagggataaggagagaatatgacaggcatgatgaaatgctgatgctgggaggttggcaagactcagttatgagttaggcaaaccagcgcgcagtgattgaaacgcatgcctcaacaaaaagcatggatgattacatattatgagacctgcgggaatactcatagatccgcagaatcatgaatggttaatctccacatgcacggatctcctgcatttaaattttttacttacggaggatgtcaatggaaagttatgctccaaaagacctgtttgccttcacatatgttgtttctgcctgaattcaatgtccgattcttaaaagcaaattttacatcttggaaactcattttcatggtagttctttgaaaggaattaataactttcaccagtactaaatatttaggctgttgaaagtgtatagattttgtgtctttttatagtcttattgaatggtcttcaagataaaagttcaagttctacatatatgaagctagttaaagacacattgaaagttttaattttacttcttttaaaagtagttcaaagttttaattttacttcttttaaaatgccttcaaatagtaacttaatgtacctctaaaacaaaataatgttatgtatattagtaaatgtacaggaaagcagatcattttactccatttctacagagaataggaataaactttcgaaactgcacagatataataggaggagatggtggctaagtgttaaagaatccacctgccaatgcaggagacacaagagactcatgttccatccctgagtcggaaaaatcccctagagggataaataacagccaactccagtattctgcctaaaaatcccaaggacaaaggagc

SEQ ID NO: 31823 - DNA, 1254 bp, Bovine  19866881179141
catataaaagtttagtaagtttagtaatccaaatactaataaattttaaaaataagttgaatacttttatatctgttcatttttaaacatgcttttctaatattattcaatttacaccctgacatctaaactttatgttacaaaaacatcctcatatattttgtcttatttcaagtctcccagcaagagtgtgagacattatcaatcttacttcacagacaaagaaattgaagttagagttattcaaagatttgccaacagccataactttattaaacttgggactcaaatccaagttactggcctgtaagtctaggcaggttttcagagtttcatctttatcagctaaatgccaatggggaaaaagttgttaacaataacttctttgaagaatcagactaataactgaaatcttgcaatttcttcataattctgaagaaattcttataccacattattataggggccattatgagctcaatttaggtaatattaatctgggttcttgcaaaaagtttataatatcaaaacttgaaatattttaataaaatagctataagtaatcatataactaaattacattctttttacaaaagagtaaatatttcaaataaatgcataaacatcctcaacactgttatttaagtggacttgtttcaacataaaacatatgtcaatttatgtatatatccaaatgctctccattcatttagagaggaactaacattgcaagaaatgaagcacagtttggaaaagacctttagctcacctactggcttgaccaaaggctatgactccatcccaggtttatttcaagtgagttatgtcaagggttacccacaggccattttatagtgatttatagctgatatctccaaatcttcttttattttaatgataacctcaatagaatcatgaaggccttctttgtcttcatggcagtgaccaggaggaaactgatgtctttaaaaaattctaagggatgaggagtatttatacagaatggcagttaaggccagtttttaatgttgcaccctggagacgaaccattttttctcaacgtattgaagatgcttggcttgattatatattctgcctattcttgttataatattaaattcaaggtatcttccaaagaaaattcaaaagagatgaaaagacttagaattgagcatgcggtttgagtctgattttaattataatgatcttaaatttgtattaagctctcacagcataggattctaaagtgtctgt

SEQ ID NO: 31824 - DNA, 672 bp, Bovine  19866881192252
ctacagttcccttttgtttctttgtcacacactcactccagacaagcagattctattattttagcttactcagtggctcttagattgttcattgagaagatcacatcacatctcaccacagctgctggcaatatgtcttgtatgaaataaacagattttatttcttcaatatagagttcagctaatttattttatcagcaaactcaaatgtcctttggaaaatctgaaaggttttgaatttaagatacgaaactatgccagtctctaaggtcttcttttaggatgagaaaaggaacctgaatatccataatactatctacgtataagaagctacattttttaaagtaatgaatactccacattccatttttaattactaagttttcactatgaaaattgttataccaagtggaaaccttgaagtgttttcattttcagtccctgtgcttggagtcaggctcccttctcagtttcaggagggactatagtgttccaccctgtttgcctgattggtgcaatgctgggcacatgacatagcaatgccactccaagggactttactagaactaaaaaggtctgtataatcaaagctatggtttttccagtagtcacatatggatgtgagagctggaccataaagaaagctgatcaccaaagaattgatgctttcaa

SEQ ID NO: 31825 - DNA, 2546 bp, Bovine  19866881213727
tatatgagcatatgtatttcattatgaatatgagcacatcaagaagagaacataggatatttggacactttcactgtatgccatcgcttctccaaccctgtcaaaacccctgaagtctcaggaaatttggatgctaatcacctgtgaatcttctcacataaaatttccagtagttcctgaagttaatatgaccaaaaatgccaatagaacagactttgctatattacagaacatctggttctgatcctggcaagagaaaatgaaaagtaatggaaaccaatattttgccagaatctgtttttttcaaggttcttttttagaaatgggcagagattcaatgggcatcaattccaggaatcgctggttccctccccattttcgtttctatagctctttcaattatgcacacaccccagatttatatgcagccatatcttcttttatttgtagagcaaatcttcacttcactagaaatttctgatctataaggtggtacacttgcagtaaagtcaacatgataaatctttcaagtaacaggattatagctactaattagaatgtgttttgcatttactatttaaaaaacaagtggtgggtgttcacgatatgtcagtgacattggcctcttttattgtattcatatttctcaaagcttataaatcttcaagagatctcatgtttcacagaaacaatactgttctaaagacaaaatatgctattatgtttgccattagaaatgaatatttaaaatgctacatttaaacacagaaaaataatagtctaaatatatatatatgtatccacatgtaacaaatttaatttcatacagaagaaaacatctctcttttgaatcctttaatgaagaggaataaatttgtccatgaatttaaaatcataggaatacttatccataagccacattcctagaaaagtatgaagagatgtaacaaggcataataaggtgtttgtcttgggaggctttacaattcattttatttgaatacaatgacaaagaacagtcagatgtttatgactctgctgggaaaaaaaaagaggtcattttcattttcccatctctgtatatccccacttgccctgtaatcaaagtaaatttcctgtgaaaagttgaattttagatactttgaacagggaaggacaagtcagtggaaacaatggggttataagaaagaagtcaggtaggacgtacgggcaaaatagggatggagagaaggttggaattcagaaaattagcactaagtccttgaaagcaatctatggcattgcaaatgttttgttgttaaactaaaaattatatttatatcgcatttatataatttcactgtttcatgattcatgctactaaagattcttacagagtcaatcttaattcctaaatcatctctctttagtatttctattcaacttctagttttagaacatatctggaaaatattaggaaaaaaaaaattgggagtcaagtttgcttacagtgttgcaataaatctgtgaactatgccctcctctgtttctttcagattcctgttagtaaaatggatctacagtgctgcctttctcccaaagcttgtatttattcaagaacaaacacaattctatttttctcatatcagcaaattccctaggattggagaaaaatctgcactaaatccttcaaaacattaagtcctatgtaaccaaaattaaacctacataaaatatttttcagttttcagcaccccctgttatccttccatatgtttagtgtttgtttttcgtgctgaacaaataaaaatgaaacttgtgttaagagaagtatgttagagttactttagtgaagtactgtctatctatcaaagccgttcccagtttcagtgcaaaactggtgcaaaacttaattaatctaattaacttgtatatttaagggaaaatgtgtgcacctcaaaggtttaggcaggccatgatctctcaggtaaatacaggttttgatccgtgtccaaaccccaaataaaattttgaaaccatttgggaaggtctcaagtaaatgttcttgatatttaaaatatgctctgccttaccatatgtttgtagaattatgaatattggccagtttctctttgtgaacagttgcagtgctaggactgacttttagaaattcctcactacagtagagtgtctcaaggatcctgtgagttctgtgcatatgaactgtatgaatttttaagtttggaaggatttgtagcagggcaatggggttggttgaaattaaaggacttggaggcaaaatagattgccaagaaggatgttgtaccctttggaaatggtggcagaataggctctgggcagcaacacagggacggtttcctttgtgagcagcttggcaaggtcttgtgtctctggaccactagcaaatggctggaggcaaagtgaggaggtgagtgctatggacacaggcctcagtggcaatggaaggccatcagctccagatcataaggaaattgagaggagtatccactgagaatagagtaagagctttcagacccaatggactg

SEQ ID NO: 31826 - DNA, 899 bp, Bovine  19866881247220
ttgaaagcatgcagtgcttgatttgaattctgagaacatggcatcacaaagtaaattattttcaagaaaaatataatgcttaatctaaaccacatgagatttttaaactatttccaagttaagtaattgggtgattttaagcacagaaaagcatacaataaaaggtttacaactttctctagcactctccatcattgatctgagggtgatatggttccagaacagctttcagaaaagcacctattggatttcataaaatttgcccaggtttctttttaattatgcacttcattttctcaggaacacagtcatgaattacacaaatgaatcacatttactgcagaacagctataaaatgacacaataaaatgttcacagaaaataatcaactatttaaggtaattattacagggaagggacccaacgaatgtttctatcaagaaccaacaggatattgaaattcttcatacagtatgtactttatctctacaaaatctctgacagtagtacaactatactagatgaaaaattctcttaatttagtggctttggaatccatgtctctgttcatcaaagctggataaatgatttaatagacaaaatattttaaattttcgattgatataaaatacaataggggaactggaaacaaaagagtttatatcaattttagttctataagattatatactactgacattgaaataaattatatatttaaaaacatacagccttgcccaatttattttggggatgaaaacagtactttcagctgctttgtatgttctgaattttttttgctgaaagtctgctgtatatatattcagccaagcccaggagcaccaaggacaccagcttaacaggctatctttatagtaaatgtagctgcctaaaataga

SEQ ID NO: 31827 - DNA, 1050 bp, Bovine  19866881248888
ttctgtgtattcttgccacctcttcttaatatcttctgcttctgttagtccataccatttttgtcctttattgtgcccgtctttgcatgaaaagttaccttggtatctctaatttttttgaagagattgaactgtggtgttggagaagactcttgagagtcccttggactgcaaagagatccaaccagtccattctgaaggagatcagccctgggatttctttggaaggaatgatgctaaagctgaaactccagtactttggccacctgatgcgaagagttgactcattggaaaagactctgatgctgggagggattgggggcaagaggagaaggggacgacagaggatgagatggctggatggcatcactgactctatggacgtgagtctgagtgaactccaggagttggtgatggacagggaggcctggtgtgctgcgattcatggggtctcaaagagtggacacgactgagtgactgaactgaactgaactgattttcctaactacttgtcccaatggcttaagagataaagatctgcctgcaattcaggagatgcaggagacacaggtttgatccctgggtggaggagatctcctggagaaggaaatggcaacctacttcagtattcttgcctggaaaatcccatggacagaggagcctgatgggctatggtccatagtgtcgcaaagagttgaacatgactgagcacacacacacacacacacacatatacatgcagattgtcctaactaacctattcataaagtcttcccattcagatatcttttaattaaagatggtctaaagaaagtggagctttcaatcaaaactccaaaacagttgggtgctataaaactaatttaaaatgggataaagtggaaaataaatgagctggttacaattacactacttaggttttaaaaggcaagtaattctagtgattaagaaactattgatttaatgaggttttaaaaaaaagcatagagcaaaacggagctgaaattgagattggatcacttttcacatctgtccgggaacattagtagg

SEQ ID NO: 31828 - DNA, 1688 bp, Bovine  19866881256384
ataatgaggctgtcacaacacaaaatgttctttgtttttataggttctattagttaatatattagaattctctaaatgccacttttgcttattaagtggttttgagagcacatgaaaacatacattttattcttgaacacagcatttctgagattgttagtaaatgtgattctggaaaaacagccattagacacttctgcccatgtagcatccagatgcaaatgaagagatattctgaaactgtttttcctgtttctacaatctcttattaaatcagaaaatttgcctttaaatttctgtttcactcactggtattgaattagatggcaaatatgatgctgctttaaaaatcaaaagaaatatactcttattgttttatttttattttataaatgagattaaactgttaacaaattcaaaccaaatttttagtacatttctaaaaatagtctatttcctcaatgaaatagacataaatctaattctttaacctgtacaattagtatgaaatcagcaaatcctcctcagtttcagtatatttcagtatttcaacatggctattaaaaaaagtcagcatcatttttctccaaaaatgatgttcagtcacgtctggctctttgcgccccagggtttgaacccaggggatcttcctgacccagggattgaacctgggtctcctacattgcaggcagactctttacctgtctgagccaccagagagggtttgctaataaatcttccctgcccctcaggctcatctcccctctgggatatagtacctctgagctcacctctcagtctgtaactttatgattgctttcatcaccactgtagcttttaatcatctccctttttcattctctccctctttttctcttttatcacttacaaattttcctatatcagtagttctctaactttaaggtgtaccagtctcccctggaagtcttgttaaaatacattttgaggcttcacctttggagttgcggattcagaaagtctgggataaggcccgagaagaatgtgttaagtattcccatgtgtgcgttaatcattcagtggtgtccgactctttgcaaccccatggactatagcctgccaggcttctccatgaaattctccaagcaaatactggagtgagtagccattctcttctccagggaatcttcctgatccaggggatcgaacccaggtcttctgcattgcaggcagattctgtactgtctgagctaccagggaagcccaaagtattcccaggtcatgctaataatgacactgctcactgaccagagtgtgaaagttacatttgtacgcatcacctgtcatcttctgttgttgagtaccatttgaatgcatcttaagagagaattcacttttaaatgtttagtcttctgatcagtaattgagtgtgaatcataggtaatgtttcatcttaatgtttggtaaaaaaaaaatgcaaactgagttagacttttacttaatgccaatctattgtgcaggaaaggaatttttaaaagattttatatttttaggcttggaaaaaacatcaaatagctttcacttctttcgacattgtccaaaatacattaaaaatacttgaaatatggactggattatatattttaaagtataatggagccctttttataaaataattatcttttacctaaacttgatgaagccggtca

SEQ ID NO: 31829 - DNA, 1074 bp, Bovine  19866881268027
tgatgattttgttatacctaaaaatgaaattagggtcagtgaactcatgtgaactttctagcatacacatatgtttaactataatagaggtaaactaatgagctaattttgatattgtagacatataattagagatttctattatagtatctacatctatacatatacataagtgtctgtacatacatctttttgaatcattcttttcccttcatttcttctatttaatgcccaaatatgtattaaaatatttcttctcccataaccaccatctagtcctgaatacatgttttgctctctttatcttctttttcacaactttgccagtacctgtatccatacctgctgcttgactgtctgatatagctattagttatcttctttactattttttatttttttctcccccaaagatcttttttctggctaacttctctcctgtttcttctcattactgaattaggttttctgtttctattgaataaatatttgttcacaaataagccaggtgagtctaaaagattgttttgctttaatttttaaagtaacttatttgaattacaacagggtgactcaagaaggagagaacacaagaaaacgtatatacaggctcaaatagaggttgcactggatgttagtataatatattgttgcagtctttcatgatagagggtgtgttgtcctgagcacttgtgtcaagcagccagaaaaagaggaggaatggtgttgccataaggtaaatcaagagataacaataaaatttttctgttgcctggtggaggtgttcaggatgtgttttctttatatcttcatccgcccctaattgagaatgctttaaaattgaatgactagcagtcaaaacgtgtttgcttcaagctgagaagaaaaatgctggtgtctccgcttccaaactgattgcgctttgtacacaactgacagctacagtcactttgagtgactgataagtgggaagctttgccacttatcaaggaatgcaggctgagaagaaaagactagagccgtttagatgctttggcatgttcaaaataacatcttacatcagtcagactcaga

SEQ ID NO: 31830 - DNA, 1119 bp, Bovine  19866881293868
ctgcattgcaggtggagtctttaccagctgagccaccagggcagtccaatattagttataagtcaataaaatgaaagagaaaaatattaataggaacccaaaataactccaatcagaaagcagaacaggaaggcttttaaaacaccatattgataaataattttcctaacacaataaggcacatctggctcttacttcaggatgaaataaaacaaatcactttcctggaaatcccatgtcttatcatcatcatcatcatcatcatcctcaccacatagatcatatcattttctttttaactaccattactttcttttaactaccatttctgataatattttactttcaactaccatttatcaagcaccttctgttagctgggtattaactaaattggtgctttatttataataattataacaaaatactagtgctatatcacatgtattttagacatgaggagagagagtgaatagctccaatcacactactagtgacaaggggccacttaaactctgttctatgtgactgatgagtccttgcaattctccccacgccactcctgtgatataacaaagtgagaacagtgccaataccccaggcaccactgttaactcaagaaaacttagtcaatcctcatcttttggttaaaaatctgagtgattttatcaagtatgttggcatcataggagtcacagcccaaacgtaatacataattctctttccagatggtcaggagtctagcctatgatgatttgaataaagaaaaatatgtagaactggtattttaaaatttcttaatgatgaaggcaatttgtacagatttcatcggctgaacaaatgtggattaggtacaaatgacccttaggctacgtccacatgctcagcaattgagctatacgacttgtctattggttgtaacctcaggacaaaccaggcagccagagtccacctggaggaaacatatgattacaataaccatcattaattatgaactttctcacatgctactattacctaaaatttacaaatgaataaattggaacttaaaaaagattaaacagctttctaagttcatgcaatcactaagtgacagagccaagatttaaacaaagtcca

SEQ ID NO: 31831 - DNA, 1244 bp, Bovine  19866881314507
tgtgacctgtctgctcatctctaactatttccccataaagacctgatgctttcatttcctttaatacgccatgttctttcatgcctccatttgcaacactgtttcttccgcttggaatgttcttccctttgaacccctagtcatccactgggacactggccaaggactatgtagtctggcatcctccatttccccatttgactcatagcatctgagtttccttgtcccccttcccactagtcaagggtatcttatgagcaaggcccactcattatttatctcagtatccctaatactgagctcacaggtttatcaaataaaaaaagaatgttttacctttattgacacagacttaataactatctgtacccaaaacaaagctaaagataacaaacctccatagcaagaagaggaatggaacttaaggtcagaacgtacatctgttgtctttcaggcaatgatgactgtgaagggtaagattctgcatcattttcctaagcttatagaatgatagaaccaccccccaaatgtatacctttcatattgataaagtcctagtaccaaaaattcaggacctaaaactgatatatcagaagtgcatagatatttatgagttctgcaaaaaggcagaaacagctgcttaattctaagcctttaacagacacccttataaatgttttttcacaaaggaactatatacaagggaaagaattcagccagcacttgtgaaagggtgaggtcactaactagcttggctactctcttttgagtcacattttcatggttctggggtgtggtcagtaaaaagagaacttgactacaatcagaaaactggacaagcacagtttcttaaagatgtttctctctccttctttgatgccaactttttagggatgtactataattaagttaaaattgcttatttcccctgtctaaacagggcaggtggttccctaatattgtatgtcaatcctaattcaattgattgtattataagtaaaacggcaggtaaaaaattcaaagtggattgctaatgtttattttaattcttggtttaacattattaaaaattaaattctagaattatatgaagtgattcccaatgctgaaatcctagcctaagtagctgaaacaagtttataaacaaatatgccttaggaagatagctagaagttcaacatctaatttcatctaatataaatgaaagtatatctttcacgtatataaatacaagttcatcctta

SEQ ID NO: 31832 - DNA, 1069 bp, Bovine  19866881318614
cacgtacacaagtaacaacaacccaagttggaccaagatcagctctaacggagacatgcagagtgaaatgactgaggaatagagtttcaacaggcagaatgtgaggaaaagcattcgaagcaactgtgacaacatgagcacaagcaaagcaagaagagttggtgaatatattcagagaaatgaaagtgatctgtacacggagtggatggtagggtgtggtcagagatgaggacagacagctcaggcacgtcctctatccacacagatcacccactgggatctttccttgactctgttctttttacatgttttctcttattcctgttgccagagaagatttttcagttagtttatctcttcatgtatgatctgtttataactagattataaaggcttaaggaaagaaaccacgtcttctgtgtttgcttgtatatcccaaacaagaacaagtattatacacaaaaagcagtcttagtgattctgtgttgcactgagcacattcctccagtgcccgtggttttacagacaattttctgcacagagactccaaaggagaggtcaaaatccttaggaagcattgctagtgaccaagatgaggggaggggggaaccccatttttgttaaataagaaggaggcctgacaaatgataacattcatgattccctgattactaggaaaaggggaagctcttaaaaggctgacatttcttctgcctctttcaacaactatctgaaactagaaacaatggattagaaagtccaatttgaagatctactgaaaatcatcagcctgagacattttattctttttttatctcctcctacaacaatatttcacagttcaagttttgtctttacttgtcctttttacaatctttttcacaattttaaagaatgtaacatgcattctgtggcagggaaaaaaaaagacaggatagcaccagatttactctgacctttttaaggttccaaatttagttagttagccatttctatcctccaagcttttcagaagctcatgtgcggagagaactaaaaatggcaaacccctccaaattaccagcattta

SEQ ID NO: 31833 - DNA, 1137 bp, Bovine  19866881333182
cctggcatgctgcaatccatggggtcacaaagagttggacatgacttagtgactgaacaacaacaacagcaaagaacagggttctctctctctccctcttcccctgaagcaaaaggtactaaagaaataaacaaataagtaaaagtaatcttaaaactaacaagtaccatctttaccaatgcatgcacaggcctgtgtgacaaggaagtcaacctgcaaaaaagcaaagccagagatggaaatggctgtgccccaatgacaccatttcatcagccagatctcctgggcttgagctagaaatagactccgacttccacttttacatgctctggatttctgccactcgccaacaaaatgactcctgtaagtgtttgcagacaacaaaaatagatgaagtgtagtccctcattatatacgctattcatacaaagttacttaaatcgaaaatgtgaacttgatctatctgcctgcagcctcccatcatgatcttttctctgctgcacctcctctcacacacatgcccactgcccttctcctgttctctctgatccaccttgccctttcccaaatccaatcctgttcataagcaaagtgctgatagaaatcagttacatcttagtgtaaacatattcacgtaactaaccttcttaggggcatttacatgttaagatagatctccaattgcagactagaagtcatattagagtttctcatgttatcctattttctttctgctcacaccacactccatctcccaggctagaaatctctaacatttcactcatcttctccagtcaatctaatgtcaagtcctaattattaaaatttcttttgcattattttaaaaatgtgcccttttatctcactcaatttcttctcattttagcctgaagcaatttctactgactcctaactagtctccctgcctgtcctttggagatgttttctcccagtctgtggcttgccttatcattctctaagtgttgtctattgtggagcaatttttaattttaataaagttgagctttatcaattatatctttcatgaatcatgcattttatattgtatcaaaaaagtcatcaccatatccaaaagcgtctaggtttgatcctatgttgtattctaggaattttaca

SEQ ID NO: 31834 - DNA, 2610 bp, Bovine  19866881337506
attgtaaagtaattatcctccattaaaatatatacataaattttaaaaaagaacttttctaagtttaccctgacctccactccacttaatagaagatggagaatttgattctacatttgtgatgtgttttcttttttcttctctaagactgctcaaaactggcatgaatttttgatgggaagaataatgtggttagcatgtttataaattaacagtcaaggaggtgtacaaacccaaaattattcccacaggaagcaagttgctggctctgacattctttctctttcttagcttgccagaagcagatgttgacagttctctcatttggggaatatatccagaaggatgaatattacccttgagaaacacaatatactgtacataacttcatataagcaaagacgtagtttgtttaaacttagagaaagtacatactgacaacctgggcatggaaaagaaagccattgaagcaatcaaaaagctaggcccgccctcaacttcatgggaagtttctaagctagttgaaaggggtgcttgatagcgttagagggttgcagatggaatcagacctaagagaccaaagtcttctccacacaatgccagaattctctgaaaagtgaaaactatcaccttccagctggcagttttgcccacatttcacaaagacattcaatttcttttaacacataaaaaactataattaaccctgttttcacttaaagcaaagggtatttataaggagctgctcatataccaaacaccatacatgctaatatgtttgcacgtatgcataaaaattgcatatgacagctcctgttcccaaagacttcaaaatataaattgttagacttctgaaaagtaaaaagtctggtgggaaaaaagaaaactaacttatttgtctcagagtgcccagaaaaatctagcctacattttaagtgttaggcattctcagcatacatattttttctttttttaatgaagcatgcctgattttgctcgggttcaaaactgacatgcaactcacagaagtgtgtctgccctgtggcatgaatggatccatagactgggaaagaaatggaatagctcagagattccagtagatgaggaaaatattgaagccaccagagcccagtggtgtgtggcaatcagagatggatgactccttttgaacagaaatgtcacgctgacctggtagagaagatggcaggaggcaaaccctgcaaataagatctggcagctgctatcaaaagaacagagtcaatgtataatcaaggtgacccgaaaccgccaatcacataccactgtctttcaggggcacaaggctccagcactttctaatatgcagcagtcccgtctgctcatcaggcaggaaacactgatgcatctggggtttatagaattcttcccacagccagttcagggacactgagctgcagactttgatgagtgtggacagagtcctacctggtatttggtttcaacattaaatggtcgttaaaatatgtatcatattctaatgatacttattgaagtttcaaggtcctcttaggaccagaagttttgacaactttattggtttacagtgaattgagactgatttaagagtagaacctacctaatatttttagcttggcgatgattcagttcaggatcagtgctgttggccatgcttgtcaaaatacctgagaagaggaaagcttattttataaaataatagatacgatttgacacaaaatttctatttctgtgtatctgctgtgaggatgtaatcataatgcagcagaaatttacattaaataagtttgtgaaaaaattaaatcaatgattacattacaaaaaagtaaatggttctatatattagaaacatttgtaatgaagtataagaaaatgtttaaaaattgaacttgattgtcaggaaaacattcctaaaattgaatgttaaatgataaaagcagattataaaacattcattcaacaaacatttgttgagtgctgaccttgtaacgagcactgttataagtctagaggtattattgtgtatatgtgtttgcaagctcacacagttgtgactgactctctgcgagcccacagactgtagcctgccaggttcatctgtccatagaatttttcaggcaagaacactggagtgggttgtcatttcctcctccaggggatcccttccacccagggatggaacccgggtcccctgcgtctcctgccctggtaggtggattctttaccactgctctacctgggaagcttgggaagcccagaggtatttttaggaaccaaaaaaagaaaaaaaaatctcttctttggtgggctaatacattctggtgtatcttataatgtccttccaactatgtaaacagacagctatgcaaagaaaagaagcaagcatagaaaagacagcggaagagaaacgtggtggacaccacccacacccgtattcctaggatttctctgtgcacagtgtctcccatgtgcttacactcccaaagtcagcctctgcatctctgttgaaatgcttctgtctggcttgctatagagactgatttgccagaggtaccggaatataccagtcaccaggggaagccattaaccacgact

SEQ ID NO: 31835 - DNA, 1342 bp, Bovine  19866881375661
ctacagtgataaacttgcaccttttatgactgagtaatattccattgtatatatgtaccacattttcttcatccattatatatatatatatataatatatgtatattgtattacttagtcataataaataatgaaattttgccatttgagacaacacagatagaccctgagggcttcccttgtagctcagctggtaaagaatctgcctgcaatgcaggggaccctggtttgactcctgggtcaggaagatcccctggataagggataggctccataatcttaggtttccctggtagctcagaaagtaaagaatttgcctgaaatgcaggagacctgggttcgatccctgggttgggaagattccctggaggagggcatggcaacccactccagtattcttgcctgtagaatcccatgtatagaggaacctggcaggttacagtccatggggtcgcaaacagtcagacacaactgaagagactaagcatggcacagcacagatgcacctcgaacatatcatactaagagtaataagtcagagaaagacaaataatgtacaaatgaaattacttttgcggaaacaaagattcaagtggtatgtaattgcagctgcctcccaagaaatagcacccacaggtgcaagactcagtatccttcactcaataaactggaagtaaatgttgatgcctactatatgcaaaggtctggaagtgggtatagtgaattcagagagtaagatgaattgtattagcgtctaatgacagaggctggcatgggtagttattttaaaagtaagtttgagaaaataatgtgagtgttagctaaaaaaacaaaacaaaacaactcacactctgtttttctttttcctggactgtagtattttatgtgaccatggtagtttgttaagaagcacttctgcacatgtgtatatttctagggacaaagcagactaacttaaaagagtaaacaaacataagcacaaatttccgaaagtctcaagcatttaaggctaacctttgtttaaggtttatcatctaattcctatttgcttttatgtgtctattaagtgctgttccattgaatattttatcactgagacatgttggatagaataatttgcctgctagctaagaatagacaaattggaagatctaattgtttgcttttgtattaacaaaacatttttgccttttgactgagaaatatgcttactccactaatttgatcatgatataagcttttagtttcaatatttttatatttatgtatacttatttaggatttaagaaaggaaattaaccaaaactcagctaaagttgtttcgataagcaaaaattctttt

SEQ ID NO: 31836 - DNA, 1164 bp, Bovine  19866881385599
ctggggtgggaagatcccctgaagaagaaatggcaacccactccagcactcttgcttaaaaaatcccatggagggaagaacctggtaggctacagtccatggggtcacaaagacacgactgagtgacttcactttcacttttcatcttcttttcttagaatcgtgcttgcagcaggaatctgatgccatatggaggtacgcttccttaccgtcaggatatggacctgtggtggtgtacaaaactcccttttccttattaaaggtatacaaaagtctaaaaataaatcttctgttctttcattcttcactttttagcaaacctctgggaacaactgccacccaggcagttccagggaggaaagcaaagctgaagtgttcagagggtaaagcggggaggcaggtacttttgctatgggattggaattaaagccaggtgggaggcccagaactcattagtaaactattgaccatcatgattacattatgttagttttggaggctcttccttccctaaactctaagaagaaagagacagttggtgagtcaactgggctgttgctgttgtaaaaggacttaccattacagcaaaagcaataggtgggaagtggtgagaatgggcattcttgcttgtcctcaaggcctagcatctgtgcaaaagctgtgactccttgaaagagtggtcctccttattgttctgattttattattttatttatttatttttaatttttgactgtgctgggtcttcattgctacacagactttctctagcagcagtgagcaagggtgactttttagttgcggtgtgtggccttcttgttgctgtggcttctctggttgcagagcacaggctcattcgttgtagtacctgggctctagggcacagctcagtagttgtggctcatgggtttagttgctctgtggtatgtgggatcttcctggacccggagtcaaacctgtatttcctgcattggcaggcggattctttatcactacgccactgaaactttaacccccaaaagccctcacttgttttgccattatcccaaaacctccgtgatacttatcttctttctgtaataggcaggtcatctgggaagaacatcagataaaaccacttcaaaccactcagattttaaatccagttaattatcagtttagttt

SEQ ID NO: 31837 - DNA, 1044 bp, Bovine  19866881421156
attatatagcattataattatctttttatatgctaacttccacaagatagggccccctggcaaggagtagacactcagtaaatattaaatgaatgagtgaatagttcagcctctgtcctctaaaaccacatgatataaaatccaaaaattatttctgccacagcagaaggttacctttcaataattttctttgatctgtatagagagctgtatgtgcccataaatagcatgcaaaaagaatccatgtataaaattctagaagttaatacttctttagatactcaaaaatccatgatagaaatccccgtaagcagaaattgccacccggcttggtaaaaatgtttaaaatctaaactttagtcattactccaggaatgatgcccatgttaacaccgaagtgggaattctaacaatacattccttgataatactctggtttcaagaatcaggaattctacatggattatttattagaaaacatactttacccagggtttgtcattaaaacaacattgctaatattaaagttcaacaagcgatataatttaaatgtaatttcccttagaatataattctttactgttttttatatttgctcacagtaccccataatatgaaagagagtttacatttcttgacagtactatgacatcagatcagatcagtcttgtccgactctttgcgaccccatggatcacagcacgccaggcctccctgtccatcaccaactcccggagttcactgagactccttaagactatgacatcagtgcttattaattctgagtagtttctaaatactccatgagctgaggggatatagtccatatggcaggtaattggtgatgtttaaacttatctggatggctttcccatgtggctcagtggtagagaatctgcttgccaatgcagaaaatgcaagggatgcaggttttatccctgagttaggaagatcccctgaagcagaaaatgtcaacccactccagtattcttgcctggaaaatcccatggacagaggagtcctagcggattacagttcatgggg

SEQ ID NO: 31838 - DNA, 1340 bp, Bovine  19866881450288
attcaaaagataagctgcttggcctaaatattgagagtttagtttgtttaaagtaaaattaagtttagttaaattctttttataataacattttaaatttgctgaggacttggtgtgctcatatcaagattatcaggtgtgatgcgtgtgtgtgtgtgtgtgtgtgtgtgtgtgcatgcatgtgtgttataaagtgcagccctctgatcaatgcgcactttttcctcccattttcctaaatacatcatgaaaaaaggatgaggtttccgccttaattgcttgtgccttttattcacattcctctctcagccagaattgtgaaaagagtgttagtaaaaagctgcacaatagagcttttcattaggcctaggcaaggcacacaaaagaaggcttttggaaagagtgaatgcatgagtttaatttgcaggtggagagtagataaaaggtgctgacgcctctattattctcttacgtaggtgacccttaccctgtacagctgatcccaactaccatggcagctgctgccgcggcaacaccaggcttaggcccactccaactgcaggtaagtcaggagacaatacactggagacaaaggttaagtaaatatcgaaaacagctattatcctgttaatgcagaatataactgactacggatatttgcctcacacttttttgtttttgaatttatgtgtactgattctcaacccaaagttggttttttttaatttttagtcctgttttctgtattaaagataacttgtaatttttttttttattgcctggtatgatttaacaaaatgagctgtagttttactttgattactgtatgtcataatttcatcacagaacgttcttcatcaagataaaaagaaggcaaaagctacaaaagatattcagatacttacagatcaagacagcttaacaaaaattacatttaaaattattcaagatgctcagtatttttgaagcactctgtagatctctttattttcttgctgatgccagctcagttggataagcaagaataagtagaccaaataagtagatgcctaaatgagcacaactttatcccaacatccactttttttggcccagcagaagctatattcccctatatccttgaatgtcagtgataactctgtcagatgcccaagtgattttagaaattttgtctctgaagttggaaagaatatcaattaaattatattaaaggtaactttcattaactgtttaaatctttcagtcagcatcctaccacccttgtttctgttgtttgggactttatagttttacacagttaatgggaataacaaatcatctaataataggattaatctccc

SEQ ID NO: 31839 - DNA, 2098 bp, Bovine  19866881492424
catgttagctgatctacaggaagcctgtgaaatttagctaacccagccccgcttgccatatctaagctgcccctacagctccatgtctagtctggccctgaaagcagcccccacatgactctgcctggtaatttggagctatcagtaacagagttcttcctttcatctatatgaacctcagtctgcaagtctgctatgtcccaccatcataagagtctttaaattgtaaagtatgaaggcagagcttccatccttgtttcctaccataggcaggcaagtacatggtgccgccagggagttgttctctcctccttcccttctccttctcactgtgtcttccataaacaaacttggccacgtggttccaggattcatatacagggaggaatgtgtgagagaaaaatgggtgagatggcagagctgttcaggccagtggtgcttgaactgtcttcacctgaagtcttctggtgcatttttaaaatataaccaaatctgagaccctaatctggaccaattaaatgagaatctctgggatggaaccagtgcttcaggattttttacaagttccactaggtgattccaatgtgcagccagattttgtgaactgtggatttaaactttgattcaaaagcccgttcatgtagctaaatgttagttgagtctggcttcctcagttcaaaacctcagagggctaattgacagggcagagttcacacatacctcattcactggctttgtcccactgtaatgccattgggcttccttggtggctcagatggtaaagaacctgcctgcattgtgggagacctgggttcgatccctgggttgggaatataccctggaggagggcgtggcaacccactccagtattctcgcctggagaatccccatggacagagcagcctgctgggctacagtccatggagtcacaaagagtcggacacgactgagcgactaagcacagcacaatgcaactgaaacctcacctggacactcagcaccttcgaactataataattctatcaagacaatagtagataatcaccttgtcgttttccttaattgattcctttatggactcatttttaaagtgtaacacgtgactgtgttagttgcttagtcatcttcaactctttgggatcacaagaactgtaagccaccagacttgattatccatgggattcttcagtcaagaatactggagtgggtagccattcccttctccaggagttcctcctgactcaggtatcgaatcaaggtctcctgcatcacaagcagattctttaccatctgagccaccagggaagccaccacaaaaaagcatgaagcatagtttcaactttgtgtcatttttccttcttgtttgaaaaataaaaagaacagggcaaagctgaattttacaaatgtactgatagaatacaccctattccaaattcaggttttattactcttgctttttaaatattgaggttactagtagatgtaaattgtagcattcttcagttatttgaggtgacattttactaatgtaccccaacagatttctttaactacatatgcttccaatcagataacttccaggcagttgtctacttggcaattttagtggatctggaattgtcctttgtagtctttcctgttgttaactgacattgttttgtgtgaagatggttgtagtgggttgtataaaagaccctgattcaaggatcttcctatactcatgctatgtgccatctgacttatcatgtttatctgtggcagtgagggtttgcctgttctgagactgagctttaagaggaatatttctacttgttctcttgtgctgtctgccattgccatgagggtagcctcctccagttagctgctgccctgtcattacgggtccaagaataaacacacattaagtaggtctaagcacacatccatagaaggggctgaatctaacttgaagatgaggaatccaactgagcccagccaagagcagctaactccccatacaaccacaagtgttctgtttaaataaatgcttttataacagtgtgtttatttattatgcagtcctactgggcaatagctagctaatacagctgtaaacgca

SEQ ID NO: 31840 - DNA, 1064 bp, Bovine  19866881518043
ccaggagcgtcacacattgtttcagctagcatgaaattccattacactgaagggtcattgctttggcacttcacctgaggacagtatctggggatccatggcagctttggctaatctaaacagatcatttgttttgcaacaaagtcattgcaaaatgtgtgttttactgagttcaatttatttgtagaattataacaaaaatatctgcatgcaaaaattctcttaaatatttctgttttggtcaggttctaaaagcagggcattgtttgagaggtgttctggctagatcactcagaaaagcctaaatcagtctctttacctgccttgtttgaagaattctttactcgcgttctttaccattgatatccctgtagacgcttctcaccctgctcaggatacattaatttaggtcaaccaactgttgtatatgatactcaggaaaatgccagctgcagttggtataatgaaaaatggctcttttggaaaactgtactttttttttttttcctaaaagatgggacataaaagcaaatgcaccaaacagctctagaatgccgataataagttcaaggaaattatttagcaatactgtggtctatcagaactcatgaattacagacatgctatgtagtttcaacatgccaattaaagtagaccctctcttaggtgacataaaattttgaaaattaagagatatgtagatttagtatatgacttgtaagagacaattctctttaaatagcattagagaatttgaagataagcaggcttgaaccagaatcaggtcttaggtcatctagtaaaaggtatccttgggtttttgtgaatttaaaacaaggaaactaaaaatctcagcatttagatacgttaggatttgtacaacttttggaagttgttttaaacccactcttaaaaatccagtaactatttaagaaacacatgttttgctaattaccttgtgactatttcatttgtgcataaaatatatacatatatatatgtatatttatatatgtcttcacattttttcagaggggttggaaatgctgattattttctgaggg

SEQ ID NO: 31841 - DNA, 1373 bp, Bovine  19866881592376
tggtgctttgctggctgccgctggagttacaggggtaattgggcccgtgtctcttatctccatcaagccagcctaggcttgttcacaaagtggtggcagaactccaagaaaacaagcaaaagctcagagtcctgttgaggcctaggatcagaattggcacatttttacttctcttctattttattggccaaaataagtcacaaggtcaattcacattcaatgataagagaacagaattacccccttgatggaggggttctaaagtcatgatgcaaatggtgtgggtataggtaagggtggagcactgggccatttttgcaaatcgtgaggctatgaatatgtgaagctaagagataagattctaacgggagttggttcacttcctttatttataaagaaagaaaataaaacctaggactagggatcacctcacccaagtcattcttgctaggtagcacagccctggagttacttactaattgtgtgtacaactaggaggttatggttttcctgaccccttagaatgtctatatagggccttcagtgttcctaacacaattctgaagtttcttttctacacacaaatcccagtcaggtaacctctacctcaaagtccccaattctagtaaaggtacacttaggatgggaaatacttattatctaccaagatcccttaaaaatccctcttatattcagaaagtccttattatatgtttagaatcttaactcctaagttagcatatcttccagcctaaaatgcctccaaatatctgtatcatttggtcacatgccatgaatgtggagtagactggtaataacaggtccagtgagaatgactcttactcaaacagttgagccaagacttgctgtaaacacacttagaatgagatgactacaggctacaaattactcaccagctgccacagttataggcaaaatccctactagtcagttcataatccatagggacttatgagaatgttcaagctaaatccttcccttctattctcaattgctatgctgttggaaaaacagaagaattatctttcccaccctgacttaatggcttctggtaaggatacagccctatattaagtgcaatcttctattcacaatttaataggttataaaaataaagttcttctgcctagctttaccccatggaccagattgacttaagccagagcatatgtaagaagaagctgggtccctgactccaggatcttacattacaatttgtcctagaatctggactatacccaacctagctgctgcaagtcattaagttaataagttactctgatgtctatgtttttggactcaaaaaattctaacattcctttgggctacttgtaagtcagcattctttccag

SEQ ID NO: 31842 - DNA, 1537 bp, Bovine  19866881917926
tttcatgatggttataatggaattaccatttcaagtttgtagggggtgcaggagaaacatgataggaatagcaggaaggaatggctcactcatgaacaatctcctgaaattttgaattgattaggtttgagttgctaaaagggagagtgggggaaatgtaccctagttttctttccctccagtttcctgttgcattatgtggcttcttgaatgttgcatgatataaatcatcttaccactagaagacaagctttcatttgcagactcagcagatttacttaatttcatttttccagttgggtatcttcaccaattcaggccaagagagtatctcgtgtcatctaacgcaacaaataggtcctggagcattcacagcaaaatccacaatattggcagactgagatttcctttcctctgccaagcaccatcaacgttatttttgggtgggtctgaatccgaatagcccagagtttccattacatcgtcctaattgttaaaaaggggggcctgctgtaattcttgaaaactagtctgtttagttgtagtcgttaccataacatcaggttgaaatactgcctctctccattggtttggccacagcatagcagtcagcctcatagcgtcaaggcattaggaaggcaaagcaatccacagtcaacagtatgaatggaacaattcacactgttgtacatagatatagaggttaaacccaaacacatgaaaaagtgatgctggaagcacttgggaacagctgggccagatgaataactcaattggatgccatgaggaacaaattaaacaactgactggagaccaggctgctcctgtgacagacactttaatcaggaagtcaaaagctgattgacaagatgaaaagctggatgacatgaaaaatggaaacagaaggaacaacacaagaaaagggcaccccgggtcagcatgctgacaaaaataatcaagtacgacaggccataatccaatcttcgaatgtttggcatggtgctagttatgagaatctgcagccaagaggaaagaaaactattattaagcaaagaaattatctggctttctagaactcactattacatgctcactagaggattttcttctccttttttttttaaacaagcatgtaatagcttttgttgagttttataagatcaattaaaaagtgctaacattactgtaaataaagctttaggaagatgatgtttaatagtgttttaaattcacagttaaaaaggtaatatgcatattgattgcctcaaatcacaaagaacagggccttctcatactcttctattcaaggcacagaggaagaagaggtagcaattactggaggaggtttttttgtggcccagttaataactcttatactggattcttattgctgagttactgttggaatccaagcaaagcttcctgccagagaagaaatttgtctgtgctacttgaattatttctgatatgcctcaggataccacctgcatccccaaacatacattttgagatgtactatctgaagaatgggaataat

SEQ ID NO: 31843 - DNA, 2958 bp, Bovine  19866880387930
taaaaaatacaaatcaagctgttagaaaagcaaatatgatggcttatggattaatatgcttaatacataaagaattcagatttattggcaggaaaactgttcaaccataggtaaatgagccaagggcatataaagacaattcacaaattgggaaataattattattagttaactgaccaaatacagggcaaatcccagtctacaaataacagaatgtgtggattaaaacagtacatttttttgctagaaaaattggtgatattttttaaaataataatactctgttgagtgacactagggtgagatggctacttttttttctattgccagaaatattgtaaattgtttgtctttctggaaaggaatttttcaatatgaattgatacactatttgatctaataattctaaggatttccccaagaaaaacaattcaatccagggacaaagtttatatccattgatattcatcactgaattatttattatggcaaacttggaaattactcaatgttttagaattgggtacagtactctagggattcagaatgagtctccaaaaaatgtttcactcctgcatgaggatttttttgagccaaagaccctgtgggttaagataacctaatctcctcctttaactacctagaagaatttaaactgggaatttttctcaggaaaaaaaaaaagttattactggagataaattttagctaagttgctgcatctatattgcagggcaaatgtctaattgccaaacatctgctcttattgtcttgaaataagacaattcctatctttggacgccccaggcctctatcccattccttagctcaggatgacatgtatacctcattttatcctttctgtctttgaaccttctcatgtatgtcaggttcctgtatgtatgaaattaaattagactttttctggctaatctgtcttatgtcagtttaattcttagactaatcagaagaatctataagtgtaaaggaaagttttgttttcctttctgacagtactaattaaataggttgtaatcacataatgagatattttatatatttatatattccaccctttagaaagtccatggatagttcttagtgtcttgataaatcttcttatttaaggtcaaggaaaatcattaagatacaaaattgtatgtgtatttttcctccatacttttagataaaagtatggaggaaaaaaagcctgaagaaactgttaaatgctataaaagttggctagtgaatgctgaaattctagatgatttccttcattattacacttttcaacatttttcagtgtagcaagcatggtggtttataatcagaaccacaaggaaatatatattatttaaaaatgagtttcaggctcatttccttatttgcatgggatttggtcccatctctaaaaaaaggaagttgcaaggcacataattaaaaactcacaaaattcaaaggactaattttcccataagcataaatataaagaatgtgggatgtattttttgggtgaataactctttagccactgtgttatgtatttgtacttttaattttttcagcattatgtctagtatttctcatgttgcttgtttccacattaacagcacagcatgcagcatgtgatggcagttgtttggctttatttagagttttgttcatttacttctaagtttcttgtcaaagtaattgactttgagcatgttttcagtactgcttctagcacccccatttaataatgcttgcattacattgttatagaatataaaaactattttaaattgtaatgacagtgaatggttaagtaatagcagaatagtgactgaactcagacttagaagataccattcacataaaaaaatatatgattcataaaatactgacaaaataaagagaatattttttacttgctagagacctcaccatgtggcctttacataaacacaactcaccattcactcagtctatcacttttgcaattatgcagtttctggagaaatcttaaaatattttgatttgtattatctcaaattttatgcatgaattgaggctttataaatttttatattgttgtctcttacatttgcttaattcacatttgcataaagtaggatggaattataagaagtcttgaagtgaagtgaagttgctcagttgtgtccgactctttgtgaccccatggacagtagcctaccaggctccaccatccatgggattttccagacaagaatactggatgggctgccatttctttctccaggggatcttcccaatccagggatcgaacctgggtctcctgcattacagacagacactttaccgtctgagccaccagggaagccctaagaagtcttaagggaatccaaataatctccctatatgaattaataaatccaaaatattaggaagctatgaaattatttctaaggagagaaaagaaagagaattgcaagtttcttcttcagaattccacttcctaaagggggtatttaatttcaatgaaagataccttctcttaaaatctttcctatccgtctcccaaagaaccaaaataaaggaaaagtcacagagatattacatcagaagattggtctaagactggatgtttgtagggtacatgaatcttttagacaaaggacaagtgaggatagggtaatggtggagagtcaactgaacacacttaggattagtaaggaaaataattatttcaggcatggactagcaaactcaggaagttgaggagtagggaattaaaaaaaagaacaagcatggcaatagtgaaggagtgagagagctaaaagaattagaggtagtgagtgaaggggatgtactggaatttattgatatttctgatttagaacaatctgggggaatcacagatcccaagatgtggtcatgggaatgaggtgttataaggaatctaagccatgacttagaaggtaaaaaaggtaagta

SEQ ID NO: 31844 - DNA, 1407 bp, Bovine  19866880394753
acttgcatgcagataattgagaccagattctataaaaaattgatttcttatatttaggatagagtttgcctagctctggctctgggaagtctctgctggcacccccacaccaccagccctgccattctcaaggctgggttcactgtccccactgtttgtaccacctccaacagcctggactttgcccttcgtggcactcatcacgtggagggcaaatgcttgtttgctaatctgtgacctggacctgactgaaaaatctttgaaagcagggtctactgaggtcaccagtgtatccctagctgctacaacagtgccaggctcatagtaggtgcttaataaatagtcgttgagttgttatgattctgaacacatcacaacagagtttatttaaggttttcaaaatcaactgcacaaacaggaaaactctggtgcttccaaaaagaactccacccagacaagagctccagcaggaaataccaaaaagtcagtatctagcaccgaaatcactgtgtgtgtttcagggcaaactctcgtgagctgatctctgagaggctgtggaacagtctggaaagtccaaagctttagaaactctacataagaattctccaaagcaagtgacactctccaagtgggggcaaggtagggggtgggaggggaggctccaaggaaaacgccctggggctctggagaaaccctgaacttggtgacagtggacaggctgggcacgtagactctcagaacctctgtaaatgacattaatgacacctcccacagagtcccgtctgtcagtgcatgaggatgataacacattttagctgcctgtatcatcaggaaaaacaacaaaatacaccgactttaactttgatacacaagaagacaaagaatgaggaaattctaaataaaaatcataagttactcctcatttttcacacattgacttccaagataaaaaccaccccagttctttcttccccatggcctcctgggtgctcacattgggctcatttattccgcatgagtgaaaagagagcacaaagcgcttaattcactcattgtccctacgtattatccacattagaattgggaaagagacggtttaaatgagcatatgatctgaatcccagcgttcataaattcatcctggtgggcacctaggcctcaatataaaaagaacaaaattagttccttgattcatggtgcctctttcactaaaatgctaagaagcgacctcttgaacttcacagagtactgtggcctagacccatcaggtaaattaccttgaatttagataatgaatcatgccagtatttggggaaaagtaaaaaactgcagattatcaaccatcaggtcaactgctagagaacatgtaactggtgcctatcatgatgtcaccagtcatccattcat

SEQ ID NO: 31845 - DNA, 1009 bp, Bovine  19866880418881
cagttctacatcattatttcatattatttctaatgcccaacttatttcaagctttaaaatattgtatgacccaaatgcttattaacaattttaagttatgcattgacagtacatcgatgagatctcatcataaaaatgcaactgggagggggcaattaaaatcatttatgagttttaataaaagcgcttcccaggtggctcaatgctaaagaatgcctgcctcccaatacaagagacttggggttcaatcccaggatctcgaagattcccaagagaaggaaatggcaacccactccagtattcttgcctgggaaatcccatgaacagaggagcctagcaggctacagtccatggggttgcaaagagtctgacacaacttagcgactagaacaagaagcttcaataaattatgatccagaagaattgggatgtgttccaaactgcattgtgtcaacctgccaggccaatgaacactcaatctcaggtttttcaaactaagatgaatactgtacattagaattctttctaacctcctccttaatttatttaagaaattaattctttaagaaaaataaccccaaatgataagaaaacaggcccttcgtttgtccaattttttttcttgaggatgtctcttatttgcaataaagctctcattctcaaaaaggaactgaaagactgatatacaacaaggcatcaaagcattctttagaaggcccagtaccctctatggttactgccaggaaatgattccaaacactctcattctgaaaaaaggcaccagtcacaaggggaaaggaagtggatgctgtcagaggtggcaggtgtgttttgaggccagcagtgtcctgtttttaatgaggcacagctgcacgtctccaattgtgtgccccaagggagcaagacatctgagagcatcaccttgaaggaaaagaacatttcatttagatgaaaggtttggcatctcttttaagcagaaaaactgaaggagttagaatgcttaaaaaga

SEQ ID NO: 31846 - DNA, 1922 bp, Bovine  19866880512455
ataaactaggacttagatactatactgaaactactctgagttcagatgaagaaacacagactgaaataactataaaacaagatagaaaatgttaagtgccaatgaaaggtaaagaaacaacccatggtagtcaaaggaggaatagctggaaggagagagtcaggggaaggtgaggtgggtttgatagaggtagcatttgacctggggcaggcaggatcagtgcatacagatgatgatgctgggatgttcattgtatacctatattcaattatgtatattatatattaatatgctacgtgcatacatagctatacttgatttccctggaacaatattcatgcactattcattctgtcagtaggtattattggatgcctacatgaaggtactattctagatgctaaagacagaaccatgaacaagcaaagtctctaccattatcaaatttatatttcagggagtaatgtacatgattgttaagaagaaaaatattctgaatggcatgtgcaatatgatacatttttacatatatttgaatatataaattaatacattaaaaaatgagatcaagtgtgtataattacacttaaagagaaagtgagagagctagagcaacagaaatctggaaagagagatatagaatgttaactgtgattgtatttcagtgccagaattatcttttctcattttgtttatctgtattttccaagtttagggacaataaacttatgttttatacataatatttggaaagttgtgtataatgtgtgcagttaaacaactaagtactaaaagttagaacttaacaaaaattgcaaagagcccttccctacttccatctcctagatagttgtcacatctctaacctgaaggcttggttgttgttgttattcttgtttccacctgagggcctcttgatgttcaactttcccgaatggctgctaccacccacctaccacttgcttgtggtcaataaatctttttattccataaaataaaatcttcagcttgagggtattgctttccccaaacaacattgtgctcaaactctgaagcttcaggcttttaccagctgagcctcaagagaagccctttagaaggaaaaatactcaataaatgtaaattattgctgtttctatttgctttatagatcttaagtacataaaagatgttcaagcaaagctgacaagaaagtagctcatgtattttatcaagagaaacaaagcccacagtatttggaggtacctttgaacagtacaagtctcctattcacaagagggcttctgatgtaaaagcctggtgcccttccaggcccccatatgcgtaggagatggaccccgactcaccagctctctgcccaggacctagccattgagtgcataggcagagcctgtttctaggctgaggttcaggaaaagttggtcatggcatcacttctggcaaacccaagtaagtctttttttccactgaagccccgatttggtttatccagcaaagttagttagtggtggtgtagctttccagagctgcccatatcccgtaaatagggtgggtgtggcaattttaataagctcacagcttagagtgtattttcacatttccttttgcttatttactctggttttttaccctagttgctcttgtcttttctccttatatcaaatgctggaaattttaactataattttacaatgcatgtatttatcccatattcttttaaccttattagtcacttgtgattgtggtcactgctatcattttgagtaaaatcaatcaaatttgcttatgttatttattttaaagatgtaggcctggtggggggtggttattatttgaataatgatttatatagattctgggcaaaagagaatgagctatttaaatattgaaatgagcatgcataaggtatgttcatgccactg

SEQ ID NO: 31847 - DNA, 2216 bp, Bovine  19866880547786
ttttgcctaccaagtctgtaacctcccaatcaacctcctttctgggagctctgaagcttactctcaggaccagatttagaagtcttgagtctccccagtagggcagtctaagtacaccactgaactgcccactccaagctggactcttgctcctttcatgtctgttttatctaaataactaggtgttgggtatagtacatgcactcactctctacatgtctatgtaagtaaccacattcttattggctgagaagtcctcatttgccaaatagactctactgagtttgagggccatcatgctctacactccttctaagtcaggcattctcaactgtggtacatcttgaaatcaccgaaggaggccttggtctgcagtgcagacttgacatcagtccacattctcaggaatccctccaaactagatgaattggcctgactggtcaccctactaatggcagagttttcagaatccctccccaggtgatctaaagtcaagccaggcttgagagaaacactcatcttacctatcaaccttcttttttgggcctaccatggctgaatctcagccagcccatgcattcaaggaaggcaggatctaggtctgtttcctcactcctttcctctaacacctgccacatactggcaggtgttagatatatgctaactgaattaagtcgtacactatgccactcaacttagggtaaaggtggtttaaaataaaggcaaaaattttaagtccccaaacaataataaagtccctgttaacgtattttagaaatctttcttgcacctaatgaacagccaggttctggctcccactaggataaatgaaatgtataactaaatgcctgtggcttagaagaaatcacagcaaaactggcagaaaacaaaacactgagtttcaataagttgtctaccatggagactagggttttgataacaataacatagaaagcagctgtgttcattctttataattttagaacacttagttattcaacaagcactggggtatatttaatcctcaaaacaaccccatgataaagctggagagttattatccttcatttcacagctcacgaaaggcaggctcagagaatacacgcagactgatgagcatctgggttctggatcccactcaaactgccagattaagcaattaaaaatacttattgtgtcccaaattctgcaggggacatacttatgctaaaaaaaaattacctttttatttgaaattcagactgaacctggatttcctctatttacctagtaaccctaggctccaggccaattttttttttttctgtgaaaatagaatatttgattgggagggtcactgtggaccctctcagataaaagggctcaactgtggctctttcctctcccattctgactcctctggtattaggccttcctgagggttccgtgcctgctggcctgagacgtgtgccttactccagtgcggcagggagccagagcaggcaaaaaggacacgaacaatgctcaggactccagggccacactctccatgtggactcaatgctttattattatttgaaaaggtgatactgaatggtgtaaaacttaaagatatacgacagtgaagggaatcttctttcttactctcagtttctgggacatccttccagagactttattaatatattaatacatgtatgtatatttaaacatagctttttgagttcttatacaaatggttaacaaaaatattcctctaacatgctttttctttttacttaatagaccttgaagatgattatgattatattattaatatctatcaatctatctttatatatctaaagctgcctcatatttttaaactgttccacagctttccactgtatgtgcgtatgtgctaagtcacttcagtcatatccgactctttccaaccctatggggtatagcctgccaggctcctctgtccatgggattctccaggctagaatactggagtgggttgccatgtcctcctccaggggatcttcccgacccagggatcaaaccacttctcttctgtctcctccattggcaggtgggttctttaccactagagccatttgggattccattgtatagctatgtcattaattattggtgccctagtgatatacattcacatccctccaatctttagctattaaagcaatgtggcaataaatctccttgaacctacgactaatgcacatttctag

SEQ ID NO: 31848 - DNA, 1567 bp, Bovine  19866880554691
aatcctggaggttttctagtcctgatttcagcagtctctgaaactcaacccttcagtgcactttcccagggttccgtgaggtacttgagtgctgttttcaatgaactcccttttgggcccaaggtaattttaattgtgccttctcttacgtacagccaaagggtcctattacaatcaggcattcaaagtctgaggccattgatcactgtaatcatatagctaatccccttcactctgattccaaacagactggcagccttctgactagagtttggctttttatacagctttttttttttttaatgagagagaatgcttttattagtctgacatgactggaatgcttgaagattttatttctcattataaattaactaattagaattctggcttttcttgtaagtttaatgtgcacaactcaatttccatgagtcagataaattctgaagcacagaaaaaattgtctttctgggaatgtaaaactgaagaccagatgctggtaaattcaccaagatatgccatgctgaaaggacacttggaaattcactagctggctttaatccagcaccacccacagtttgccactcatgccctcttcaacctttaacagttgtaaggtagagaacaactaaaagtgttttgtaagatgagaaaggaaaaggagtctgttatgacagttaccattaaagccatgtatcatttaaaacaccaacaccaagtaacatcagtggtaacatgtatgactctataagatgatgcaccaaaacctaggatgagatgatgcaccatggaatcacagcttcttaagtctggaagaattttaaaggttaaccgcttcttttcttttttgtcaagaagaggggcagattttttctcaccccgcttcccaacagccagaaaagtgacatgcgacatctattcaactaatcagatggtcccacctaagaacctaagttaccaactcaattaacgaattaatttggaattaatccaatcactgacagcagtagaagcagcatccatttttagaacgagtatagccacagagggccttgaattctacttgacactgtgtgatacaagggaagggaaatcttatagccactctgggaaatctgtctcactctggacaagcaaccatcattttaaaaaatctcctatcaagctaaaatggatatccctgtcatttcctcctcctatttactgaggaagctgtgaagacaaatctgatagttcttccacaactgctgaatgccaagactatttttcagaaaccaaccttgaaaaaactagtgagtaagagatggggaagaaagaaaaagtggaggataatttgaatctgcttttactcctgatccaacccaagctgtggtttagttccgtagcagcttagaagcagtattcccctctcatgaagaacacagaactgaaccccaaaattctaatctccgcttttacaagcaagtagtcatggggattttggcaagcaacttaagccttctgcatcttaatttcctttattagtatctgatccatatgtatttatagaatggatggattaataagg

SEQ ID NO: 31849 - DNA, 2085 bp, Bovine  19866880558534
agtcgctcttttctaatgagtcgctcttccatcaggtgaccaagtcttggagcttcagcatcagtccttccaatgaatattcagggttgatttcctttaagattgattggtttgatctccttaaagttaatcattcatctatttttcaaaaggaatcattagagtggatttatcaaaaccctgtatgcttttgaactcctattttggtgcctcattcttcattttaatgtgtatcttttgtggggggggattcattatataaatttaaaatctgtgcagtaaacatttttctggactgttttgctagaagctgccatgttggagatgaaaggccagttgatgaatcacaacgccgggatgttagtcccaactctgcctctagttgtgtggcctcagatgagttatttaacctctcagatcttaatttccacatccaaaaattagaggtcaggctatataattttccaaagcccccttgacatcctaaagtatctatattgctttgaaatttatccaaatctccaactgatatccggcatcaaggttagtaactcttttaaataggcttgctgagttcaaaatgaaatagaaaagagaaagctttagaagtgcaagcctgctagcaagatttatttttttccagtcctgtacgcatttaaaattgttttaaattttcagtggaaaataggaattagaccacactcaggtggatcatttcaaaccctttattgttggtgatactttctccagatggaaattaagtgtgtaaaagtaatactggctaatactaacatttattgcttttactaaatgtcagacattttgctaattgctttatatgactcttctcatcaatcctaacagcagcactatgacacagatattatgatgtttattttacagacaaaaatgaatataataaggtcttagatggctcaactaataagtggcaggaccagaatttgaattcatgctgacttttaatgtccagaggatataaactctgtaatgcacagacattaagattttatatgtgtgtgtgttatacattcttcatgtgtctcaaaatatgtcatagtctcctgtacagtggtccttctatgcacgcctgatctcagtgaaaagcaccacactcatcaataaacaacaagatagaaacttgggaattaacttctcattctcttatttccactccttacaaatgcagcccatcaccaagtccattccattttatttattaaatagctctcacagtggatttatgggtcagggtcccaaagcaagcctggcaaatttgaagtgtttcgcctaagagactttaatgaagatactatagtggtgtgagaaagctcaagacaacctacaagcaagtcacctatgagcaggacctagggactagcaacagtggaatgccgttagcatgtgctatgaaatgaattgtgtccccccagaaaaggtatattggtgtctaacctccaatgctcaccctcttgcttaagactttaactgggtcctcattgctcttaaggtaaaatacaaatttaaaactgagctgcaaggccatgtggggtctggcccctcacaaaagacttctttctcactcttgctgtgtgtgtgtgtgtgtagcctcacggacttcctctcattacctctaatgtgttgtgctctctcccaccagggaaacttggtatgtggatgcttttccttcagcctgggtacagtccccacctttgttcctattgtgttagtctagatttttcttcagcaaacggaacactccagtcatcagtcctaatttttgagtcatctcaggctccagactatgagtgaccaaatcttcagctggtttcagtctccagcatcaagtcagagatttttcctgaataaccaactgagctcagaacattgcagaataggacaagtcatcctcattattccctatctagagttccaacctataggacccctgagttgaaaaaaaaaatgattttttttagccacagaattttgagataacttttaaaactcagtgatgcatatgtgcatagaaaatgtttgggatatatattttaaaatattaaggat

SEQ ID NO: 31850 - DNA, 1336 bp, Bovine  19866880637724
tttcaagatgaattagtcatagttaatgcattgggtggaagaattattaaaaatctccctaaaagtatgctgcttcccaaaacggaaaaaaaacgaaattgatgctttctcatttgtgtttattcttgggcaacttggcctgataatatttagttgttttctttatttatagactcactttgcattattcatcacccccctgccctcccaatacatatctccattttactatcagcaacacaaagtacaaggatatattcagtttcactacagctcttcccgtttacaagtgtggagcgcttgtcttcggaacgcccttctgattggctaagccaatgtcagtgacatcaaccaacttacttttgattggaaggctggttgctgggactgtagcgtttgcaggaagtcacttaactgtttgcgagctggaaaatcgaaacggacgttatctttttgtcataagaaagaacgcagctgagtagggaaggtgtatcctacaactccgccagctggaacgtgagccaggaggcctggaccggctaagggattgaggggcacttccaaagacgtccggctgctcctttccagcctcccggctgttacccttttaaatgtcagcgttcgaggctgtaggggtagcacgaggcatcgaaacggaacagtcggattggccgcgcgcctcagttctagacgcacctctccaccgaaaggccgttctgactggcagcgggagaaagtaaacagagttgaatcaccctccccactggccaattggagggggttcggattgtgacgtgatgggattctgcgaaattgttactgtgcgagagaatgccggcacggtgcggaccggcaagagcaggggctcagaagctgtcagtggactgggggaaaagtgtctcttagacctggcgcttcgtccggcgcttgccacccgcgtccaggtggttgggtgaatgtcttggggctttggctcgacggagaggcggccgagggcgtgtacctctcttgcagtttcctctctcagcgcctcgggggcgttttcggtcgaataaacttgcgaccgccacgtgtggcatctttccaagggaacgagctcggagtggcgggcgcgcccgtcggtggggatcgcgcccggctctggccatcggcggcggcgagaggcggcagcgcggcggagcccggggccgtggatgctgcgtgcggaggcgctgccggttacgtaaagatgaggggctgaggtcgcctcgcgctctgcgagtcggaagcgccccgcgcccccgcccccttgccaccgcgcggcgcagcgctcgagtccgaggccagggcacggcga

SEQ ID NO: 31851 - DNA, 1123 bp, Bovine  19866880664753
tcctgtccaactcttagtgaccccatgggactgcagcctaccaggctcctctgcccatgggaatttccatgcaagagtactggagttgggtgccattgccttctccgatatagagtataccagttcttaaaccacgagcaccttgggaaggccatcagccattcacaacttaatatggattcctctccctgggtttgctttcctcctccccgtgagttgagatcaatcacatttggagaagaatgaggcaaaggaaaagaagaatcatgggccaggagttggaatggggagcgtggcctcactgcacagagtgaggacagggagaaggaaggtagaataagaatttaaaagattgatgagagtagcaaacagcgcctacttcacaagtttgcttacagctgatactgctagattcgaatgtgagggaaatgggcttacttttagatgattcattatcaagctcagtataaattctttggaagaaatttgaccctgtcttttaaaggtcaaagatttaaagatttggtctttaatctaagaatcctttccctcctgcagtcatcactgcccacgctttctctctccccatgcccctctttctctctttttcccctcaccaccctttccctctccctctctctctctccatactgggagaaacagattctcccaattgtcactggcgccaggtatcgtcagttaaatctcaatcatttcaacagcattgcctgtagttcacacatcattgggcctgccagaggcagcatttcaaacacatgtccttattcagggggagtcgggaataggagtgctctgaactgcacttttcaaaacctgttgtccacttgtgccaacagaacaggggaaatttcctttcagcactgccatgaagagcatccagatgttcccactgagctgaagtgcacctgcagtagaggctgcttgtaaccgcagctgcaggatcccttgggaaggcaagccagactgagagccacgaaatggtgtcatggacaacttggggccaagtctcaggggaaaggatgctggattttggatctgactttaacttctcatgctactctttcctggagaaggaaatggcaacccacgccagtattcttgc

SEQ ID NO: 31852 - DNA, 4839 bp, Bovine  19866880676501
tgagatggttggatggccttgccgactcatgtgcatgagtgtgagtaaactccaggaattggtgatggacagggaagcctggtgtggtctacgtgcatggtgtcacagagtcagacatgactgaacgactaaactgagatgtaagataatgtaacactgacattgaatctgtgaatgcattgatcttgcatatcctaaccttcagatatctgagaaatgtatgtttaagccacctactctgtgggacttttgttacaaaatcccagactaaggcaaggacctttttcattcttactaatgattccaaaacctttttctgtgagttatatctattgattagaattaataataaacttagaaataattagcagtttagaaataagaactgagaaccccctaaaaatgttgtataacagaaatgagttgcattttctgtgttcactgacagtgaacagtaaatgcaattaaaatggatattatagcaacaaaggtataagttacatagccgcacataaaagatagtatgcagagattatagtttttattttaaaatgttaatgtttgatacatgtcatgttaagtgtcattccagtcagaatcctgctaccgtctataaaaattacaagctggtactaaaatttggatgaaaatacagagggccaaaaatagctaagctccttctaaagaaataggataaaatggaaaaacttgtctactggatatcaagatgatacaatatttggtaaattaagacattgtggtgttgatgtagggtagactagtgtgatgtgacagaataaagagctaagatacaaagcttagtaaaaacttgatttatgacagaactgacattgtaggtgagtgaggaagagacggaaaatggtactgagacaactgggtattggtataggaaaagatgaaattgagtcctttcctcatactttaacaaaaattagttccaggtggattaaatatctaaatgtgattgcccaggaagtttttagaagacatcagtagtagaagataatatttttgtgacttcgggttaagaaaatgtcttcaagtatagacctaaagggaaaagttgataatttcaactataataaaactaaggaacttctgttcatctaaaagacaccttgtagagaaaagactagtcacaaattgggagcatgtatatatagcacatataacaagattgatatacagactatataataagcaaaataatgacaactcataagacatgtgagcaaaagatccgctttaatgtctcacagtcaagaggcaacccagacaaccagtacattcctacagacatgaaaagatgctcaacttcattagttattagagaaatgcacattagccctagcaaggtatatctatcagacccaccagaattccattggtgccatgtgcttataaggatataaaacagtggaaactctgatgcattcttggtgggaatatgaatttgtacaacccccttggaaagtgctatggtattacctagtaaatctgtaaatgcttatatccagtgcctcaaaaattctgctttctaggtaccctagtcagcttttgtgcatttatactaggtgaaatcatggaaatacttacagaagtattgtttgcagtgaattctggaatagtcaaatacaattgaatattatatgacaatagaaacaaactttggctcactggttaaatatcaaaaacataattttaaggaaaaataccatcttggaaaaatacacgtaatgtgagtttgtttctagaacagtcaaaaacatttggactctcatacagtacaaaacaaaagtaaaggaattatcagtttgcttgcttgcttgctaagtcgcttcagtcatgtccgactctgtgcaaccccatagacggcatcccaccaggctcccctgtccctgggattctccaggcaagaacactggggtgggttgccatttaattaaatcagtttagagattacatttgttgtttcattttttaaactttttattttatattggagtatagccgattaacaatgttgtgatagtttcagctggacagcaaaagatactcagccatgcatatacatgtatccattctcccccaaactcccctcccatccaggctgccaaataacattgagtagagttccctgtgctatacagtaggaccttattggttatctatttaaaatatataacagtgtgtacatgttgatcccaaactcctaactattcctttccctctttcttccccattagttgagagaaaaaggatgcaattagtatgaattaaggaatgtcagatacactgttagtgaccagttccttaaactggtagatatatggttgttttattatttctaaacagttcatgaagtttgtatatactgttggtatatatttcacatgaaaacatgttttaaaaagaaagtctaaaagttgagttacttgactgtaaaatatttttaaaacttgaaatgattgttttatttttctaaactactgtaaatattataatcaaagtgatattacaggtttttaagcaaggcttaatatttaatgtgccggcttacatggtgtctccatgataaagaatctacctgccaacgcaggggatgcaggttgaataccctgggtcagaaaaatcttctgtagaagaaaatgacaacccaatccagtatgcttgcctggagaatctcatgaacagaaggagctgggctggctacagtccatagtgttgcaaaagagtcagacacaacttagcgaataaacaacaggcaaaatttaatgtaggttacaagattgatttctataccccttaacattataaataacctattcaaaacaaaatttttaatgccataagaggggcatttatgagatagaaaagatactgatttattaatgattaattttgtaacctgaaccagttacttgtctggaattcagtttttatttcagagaacagggtttggagtagataatttccaaggacatactcagatttttattaatattatgttgtgtttgtttttttggccacactgcacagcttgtgggattttagttccccaaccaggaatctaacgcaggcctttggcagtgaaagtgccaattctaaccactggactgccagggaattccctatatgtagttttttaaattgtcagaaactgtttattaaatcattctctctctgtaatggtctggattgtattccaagggctgccttagtcagaatggattgggctgtaacaattttcaccaaccttcttatttatttttgtcatgaagatacatctgtccttacccttgagtggtaggctttttaaaggaagctgtgaagtgcagttttcttagatgacagcttgcagacatttgtgtatccacagatatgttcaggggatgtccaaattcttagcaaaaaaattttaatgttgtatttttatttaaatgcaatataaaaatttagtataagcatttctgcaccactggtacaaatactttataataactgccttctaattttttaatttcttccatttggtaacaagtatttcagttattacaacctaatgagcagatgccccactcctaaaaaaatgccattgttttccttatttatgaaaaaactgaaaccagagaacgttaagtaacccagtcaaggtgaaacagcttgtatatggcagagctgagatttgaactagacatggtctatgttgaagcctgtactcttgatcattaaactgtactttcttgttacaggaatagactttctttttcatcttcctggttctcagtttcatcatctgtaaaatggttataatacatatctcataaatttgctcatgagtattaaatgagaaaattgtgtatcaagtgcttggaacataaacatagtaatgcttaataaatgttaactgttgtggttataattgtcatcatcattgtcattaccactattaaaaaaacaattatttgcaaggtgtatttcccaccttttttgagtattacttaattatagcctgattcaagatccaatctgatttttttaggtccagggtcttttttcatactttacactcacatacatatagaaagtagcttaaatacatctattttatgatataaattgtgctcacttaaatcgtatttactgtatttattggattatttaaaaagtgcttggtgataggtgtatactaattaatagcaggatgggtgctattagagtgattattaatatttaatctgtgcagctccatagaagtactcagtctggagctcgataacttggcctcagatttttgctctgcactacttattgttaatagctttgtcatgaagtttgtaagaggctcttaaatgcatagaaagatcaataactcttagaatattaaaatactggtagcttagaatattatcatctgtgagtggaaacagtggaggagcctaaatctggaaagggtacagttagaaagtgaagtaagtgaatgtacagaatagttattgaaagaatcttgatctgacaaataataatgacttttgctatatctcacctgggaatgtcaccacacagctcactttgtctttttttatatcttaggttggcttttttgtgaagagaggatgttccaaaggcatggttgaaattgaattgtaagtgttaaaagtactgaaaccacttttttctgcataatttcttagtttatgtttatgcattcctgatgactttagtcaagagtaataacacagtgtttacagtttgttgttcagtcgctaagtcatatctgactggttgcagccccatggactgcagcactccaggctt

SEQ ID NO: 31853 - DNA, 767 bp, Bovine  19866880682970
ttattttacgttctgtctatattgaagcatagaaatactaattcttaaatgttttgatatttacatacaatttaaaacttagaccaatgttgccctcataggacatgatttctgtttaaaggtagttaagttttggaaccctttttcagaataatcattcctatttttctttggataatctaccaaatgttgctacattaaaaatttcctatgaatgcataataacctaaaatatttttagagcagttttttgtttttttgtttgttcatttttttgaccatgccatgcggcatgtaggatcttagtttcctgaccagggatcagatctgctgcccctgcagtggaagcatggagtcttaaccactggactgaaagggaagtcccatcctaaaatatttttatcaagaaatacatatatgagacaaggggaaagggagatcagaatgggaaacaggtgacataaggctgctacttagaaataacataatttccaagccctgagactaaaattagaacacttactcatggatcatatctatggcacttggcagaggacagaaaagtgggtgcttgaggatggtatttaatctctctgtgtgtatctctgtctccctcctgaattctcacataatgcattttatgcaattacaaataaaaggctcatttctgggaaactagacatacatgaagaatctctgaaaagaaatgacaagaagttaagttaaatggtgtgtgcagaagagaaagtggaacaaaacgatgtgtt

SEQ ID NO: 31854 - DNA, 3464 bp, Bovine  19866880834088
ttgcttcccatatcttggctactaggcatgcatgtttcatttttaatcttgcacttgtgaaaataggatttatttgctttcccatacacataaacctctaaagagtgttctgtaagatgagactctgaaagctatagagcataaatcccaggtttttaaaccccccccccattataaaaaagcatatcagtaactatcaatgatgtcacgttcaattttgatccaaatgggcctcttgtctgtcaagtatgtcattaagcaacttttgggagaggataaaggcaacctatttgcttcataacagctgaaaacggacagcttagttgtcaaaaagtttctcggtctctcagaatatctctcatgcctcttgcctttctacgaactcagctactcacaataaaaattgctaggagatgaaaagggtgtgaaatggtttatatttttaattaatcccattcatttgtcattttggcgagcaggaagtcattcacaagtttgcgacaatattctgtcataaaataagtttggacacattaatgggtgatctcttgctgagcataatattagcctagtagtctaagatttcttagaaaattaatgggtcttggaaaaatagataacattcaccatcattctatccaaatgtgcagtgactcatggcatgcacagtagccactgaatttgagactcaagtgatttaagaacctttcgttagaaacattggacaaaggagagtaaacagcagagactcagagttccaatctcttagccttgatcaccagtcaccagctgaatgacttgccatcaaggtttccctagccaggcactgaggatgatgactggtgtattttatttaaatattttgaagaatggactcatcaatgatcattttttttaatgtttacccatagatctcttttcaaaaggagtttctaaaactcaaagaccatttgcaagcatttactgagcactgggtgaatgtgttggcattgagccagaagacccagtagatgaataatgacaactattttatccaacacttattgggcagttcttatataccaagcaccttgctagataccttgcatgtataatctcactgaattcttacagtgacccaatgaggagatactcagtgcagatgaagaaactgggatttagagggtttttttttttaaacattcccaaagtcacagagcaggtaaatgatggagcctggattttaacctacatttccctccaaagactgggaaaagaatcattctgccagtttatttccacactctcccttaacatggagcctcacaggatctttgggatagaaataataatgatacttataaatagctaactcttaaatactcatctatatactattctatgtttgatgttattaactaatttaattgtcccaacagcttaatgagttgagtcttattttcattctcattttagggttaagggaagtgaggcatccacaggtaacatacctgtggtcacagggatcccaggtggcaacactatattttgtaacaggtcttctggctccagtctgtgttctgtgaaggatatagcaattataatattcttttttttcccactgcactttgaagtgagaagcttttctccttaagttctgatgtgaatgactaagagaaccacataaggatattctttcagattctttcatacacaagggccctatcaccaaataaattctaatctgaagaaatttttaatcagttcttttctttagaaatggcatgggaccctgggacaacagaagaattcctgcctggttccaagttctaaatgaggttacgatgggaactcctgtgagagtctcatactccaagcacccccatgactgccctgcattctctggacaaattccagtagaacttatgttccttgataatcttatggtcttgttttgaaaatatgtcaagtagcctcatacaaaaaaaaaaaaagaaatagaagtgtaatatttgtcttgggttatggaacaaggagcccaaatcaatagggatataagcaggagacaccatatcagcagaaagacaatggaaatccctcatccttggaacaaaggcaacaaatggccccctgataaaacttactttgtaacttagctaaagaaatacatgcatctcagtctcgaggttttctgtttttctttttagtcatgactacatatttatttgtttactttttaatgtctaattactttttaaaaaattttattgaagtacagttgatttacaatgttgtgttaatttcttctgtacagccaagtactcagttatacatatatatgtagagaaagatacatagattctttttcatattcttttccactatggtttgtcacaggatattgtatacagttgcctgtgctatccagtaggatactggtgtttatccatcctgtatataacagtttgcctctgctactcccaaactcccactccttccctctgctcccccacctgctgccgttccttggcaaccgcaagtctgttctctatatctgtgagtctgttactgtttcatagatatgttgatttgtgttgtattctagattccacatacaagtgatattcagttttgagttttgactgaaaatataaaaacttatgagtagtcagcagtgaaagcatagccctagacagttgatcaatgagtttatatctgtctataaaatgcaagggcctgatggacattatactaagaggctcagtattcaattcttggatgattggtcagttatttatgtggtgctataatatatagtatggaaaattacttgtcaatgagatcctcaggcatgaaataataataatgcccatttagtctctatgctgacgatactatggccatgttatctccaaatcctattataattttatatgatccgtgtggccatctccattttaaagacccagctgctgagaaccagcaagatgactcagcgtgccccagatcccacagccagagcaggatagggtccaggtccgtctgtgccaaagccagtgtctgttccattgccttgccattgggtgtctggcactggatttgatgctgcaggggcttccaaagaagggcaacacctaacttctgtcttctagaaggagcaggattccagcctctccgaggttgactgttttgacaacttcttctcccaaaccagcctctctacctcttggcctttgccatcatccatcatgaacgtctctcccaaactccactaggaccagggattgctttgtgctccctagtacctgacctcatcatggttagacatttagggagggcttattagactcaacggtgaaagtgaaagtcgctcagttgtgtccgactctttgtgaccccatggactatacagtccatggaattctgtaggccagaatactggagtgggtagcgtttctcttcttcagggattttcccaacccagg

SEQ ID NO: 31855 - DNA, 2092 bp, Bovine  19866880858515
tggctttgtgtgacatcttgtatatttaatctgataaataatgaagccttgaatttaaattagaattgtaccactggaataagaaatatgactcaaagtctgggcccagagaaaaaatgctaaaacataaaaaagaaaaaggggacactaaaaggtatcaaatccttaagtttaaaaaaaaatgactcacgggtttaagaaatatcaaaaaagttcaagttgtggagggaaaaggagaagcataaaatgactacttatgcatagatacagatcaacaaatctttgaaatcagtttcctcagataccccaaaagtggctctggctctatgggcaagatctgtcccccaacatcataaatgaatagaaagtagtgttcttaatgaaaatggtcttcattcttctatgaatttttaatatatattaaagtacagttaactgatattatacagctgcatttcttggctgggatttaacaagcataaacaaagtagttcaatgaagaaaaaaatctaaattaacttattctatatgcaatagctgctcctaagtatcatgaaggcagaatacatcattcattgacaattcagtgctctactccatcaatttctcaatcataactcactctatgcatcctgcatgattaattttcccatcttcagttaatcattcataaatttaataaatatttaataagtccttacaatatgcaaggcagacagaatctgggaacacattaccaaaataggtacacttaaaaaagtaaaagattggggaggagtgattgtacagatattttatctgtaagatatttacagatcttattgctttttttttaacttgtcagtagtattcttgacctaggatggtctacaattcttccagtaaaagttggatgaaatgtgtgttaatctaaatcatcttttcttttaacagtgacatatttatcgaaaagtaagtgaagactaatgagtctctaaaaatagacacatcctttccactgcatgagctcattcagtccaagagatattatcatgctacagctagtgagctggatgtccaccactcagagtaaagcacacaactacacagggcaatattatgtttttctgtgaatgaacacttgaaaattacaaattttagaaataaagtagcacacaagagtcagatacaaactgtatcctttggatatttgtatttttacttggtacttaaaactattaggaagacaggagaccaaggtatattaaaggactgcatggctttgtgcaggggtgagttaagagacttaaaacacaagaagacagttaacatcaaagaagggcaagaaactttgtggaagatataaaaaagtgtggaacattataaaatttagctgatgtttcacaggagattgtctatactcatgtcttgacactctcacactcacacaccaaagcataagaagccctatcagtcaggatacttaaaatgattcttggaagaaaactaacagagaggccaaaatctggcaacgtacattagaggaactgactggatctccacgtcatctgtgtgtagtttaccccttaatccctgcagctgctaaaaatcataaagtaatagttttatccagaggtctaggtagaccttgaggtatttgattcaaaatatgctttgtacataaaaggttataaaattatgctcataatgccaatcattttctcacctaaatactacaaaaagttataaaagggtaatttttgctctaggagagaagagcagcttctgtctataagtaccagcctagacaagctttttggtattcttaagtctcacttgatagtttgccactcaacaaaatcatgatacacaagtaaagtacctattcttttcccttaaggcaacgttcctcactcaagtctagagtctccataacagtgagatagaagaggtctgttttccctacatgtcttcttaccctacaggcagcctagcataaaaagaggaaaacaggcaaagcatgggtggtcacactgttccagccactactacattttatacacacaggataattaaactgccccccttaaaagttacccaataacattattag

SEQ ID NO: 31856 - DNA, 1527 bp, Bovine  19866880868652
aaattactatgctatacacctgaaactaatataacactgctaaagcaattatacttcaatttaaaaaagttccttctcacagagccttgcctggtactgatatcctccagccactcagagtacactgggagattctatgctgctcatgctggcaccttggtgcaaacagttggctttgcatcactgcacatgataagagatgatcctctgcggtttgatatgacaggcatatcataaggcatatctcaaaaggagatgaaatcctcatattgaacaagagttacagtaatatgcttctaagtctatactgggtttataagctataagtgatggtaataatgtgacaatagagaaaggaaacttaagagtacttttctttttagtaaagcctatgggtgagtggtagctattgagtgcaggttttaccagaagtgaagtgaagtgaaagtcactcagtcatgtccgactctttgcaaccccatggactatactgtcatggaattctccaggccggaatactggagtgggtagcctttcccttctccagcggatctacccaacccagggatcgaacccaggtctcccacattgcgggtggagtctttaccagttgagccacaagggaaacccaagaatactggagtgggtagcctatcccttctccatgggctgctcatgatccaggaatcgaactggggactcctgcattgcaggagttatcagggaagttatcagggaagcctgatacatttttgtaagtcaatcagttgctgtatatatttaacaggcaccaactgggattagagaccaaacccttttagtcatcttgcacagttgttaagccagcagctgcttaataatacttctggtgattaatagtgctttgcggccttcacgtcatatagagataatgactgaacaaatagtgaacaacttcttggttccaacatagagctcctctccactcctggggcaagaaatgatcaaatatttctgagtgagtggtaggaatagtttccctgcctccaatatttagcctctgattcttggaatattgtcagtctcaaaagtcagagcctggggaacacttcaaaatgctttaaacagaacagcttatgccttgaactaaatcactgcctcaccttaaatgcccctatgctgtccgagctgacctccagtgcctgcatttagattctggccaaggccacaggtgaacacatacttggtccagccccaggttggagcatttccagctgaaggtgtccctcttgcttaagtgcttctgcctggtaaatacttggaacattcagagtgccctctttggccccttttagtgaaagccctctgcagtaaaatcataataagttaatataaaataattttataataaataatttcagtgaccttctgctaaggagccttattcacagcctctgttagaggtactttcagaggtatgactggccactcatctgcatgtgagatacgtgggtaatgggccatcttacaagagagtatggtttaatt

SEQ ID NO: 31857 - DNA, 3400 bp, Bovine  19866880901837
tcctgtggccctgttgggttttctaaatttgctggcatattgagtgcagcactttcacagcatcatctttcaggatttggaatagctcaactggaattccatcacctccactagctttgttcgtagtgatgctttctaaggcccccttgacttcacattccaggatatctggctctaggtgagtgatcacaccatcgtgattatctgggttgtgaagatcttttttgtacagttcttctgtgtatttttgccacctcttcttaatatcttctgcttctgttaggtccataccatttcggtcctttatcgagcccatctttgcatgaaatgttcccttggtatgtctaattttcttgaagagatctctagtaacattttattattttgagatgaccctattgtcatttaaaatactcatgcagattcctgaattaatctgtcataacagctgatcattcactgtatacataacactcattataggtgtggctcctacagtggccacaagtagagaggggttgtgtgtctctaggaccaaaatatgtgtatacatttggaaacctgaaacttttgtgcaacacctaagagcaaagagaacagtaaggacaggatgaagactgtccaaggccaagataagtaacaagatggacacttaaaaaagttggagatgtggttaaaaatattcacatgaagaggaactacagtgaatgagaaatgatgtaaagttgccataaacagttgccatgttttcaggcagctcaaggggacacagtgtcatcatcagctatttattgtcactgagcagatcacctaaatatccacatggcaaagcattaaaaggggaaatggtactgtttgtagcagaatcaacattcctattctgtccctgatggaaagctagtcaccagaaccttctctctggtcaacaagaacttggagttgacaaaacgaatgtgttgcaaccgtgaggagacctaggttttcatgaagccaccaaggtccaggtgagagctgccataatccacaaggaagcaggcccttgccaggtctccctgtgtagggtctttctcccccaagcccgtcgatcactgataccctctcctctccattttccctgcagagaaccagctcacttggccactagggggccctgttgctcaccacatttcaggactgatcatcagtactggctcacctccctgccaagagagaagttcttaccgtctgcttcgcatcattcaatctatttttagtgaaaagtaacctagggttattccagccttgtccttagaaaatgctgaatgataaacagaaaagaaaataaagcgtagtatggaaatgtgaaaatagcaaagcccagtcacagggcaagaagagccttgaactgggtggcattctcggttacagcgatcgtgtctgcagtttgtctctgtctcaaggcttactcttccctactctactgccaggtctctcagtgcctactcaccctcctctcactgcctccttttctgttgacagagccatgggtaggtcaatatagtggggagatggcaaacacagttatcctggaaaaaggtgtccccagctcacccagttcactctttaaggtgtgatcctgcgggagactagagttggagttccgagtatttcctcctccaacaaaccagttcacgttggggttccagtggttcacaaagccacagagatggttttcttcaaagtcacattctggcagaagagaaataaaaacagacttgatggagatgtagttgtgcctgcagctgcccagactcactgcagtttgctcttaatccggtatgtttcacactcccttctaccaccggggcctttgtaccatgagccctggacaaagtcaatcaagaggagagatcctgtaatgaacagagattataattcatcattgcttctttggattgtggcccatgtggctggaatgtgacctctcctagtctccatgtcttcctatgcaaaatggggagatactcccaccacgcagggctgtgataagggtggacagctgccagcacagtgccaggcacgtggttagtgcttggtagatcagccaattctgtgtcaaagcactatttagagctacacttttagctccagaaattttatccaccacctttctgggaacccattctttcattcccttctctcttgatgatagacaaggtactaagatgagggctaaggcgcatgtttcctatgatgctagagttctctgcttttcttataaataagattttagaatagtcgagacaggaatatcttaggcactgggccctttggcagctactgagtagagaaaacaagagaagacaaagagaccctctctcccctttttagtagcattgagatgctcgcacagataaattgttcccagtcaacagactcctttgggggagcaagaaactcacaaggctattcctctgttgacccccataaacaacagttaaaaatacgaagttgtgattgtgctggtcatctcctattggctcctccagacccatccacctttcttccaccctgctccatcctccagaggttgatgtgtatggacctgtatgggcttccttgcctgttggcttctaaaatggattcaaccaatggaagataagaggagaacaaaggttggggttgtttattcctgcagttccctttcttccaggatgccatgagttggctgtgcccctctaccgagggaccacacagctctatgttctggtaaaccctcctctcttgccccttcagacctccaatgctgatggttcatgagtcatcactctgactagtcttggattactgcattttgacaggcttccttcacccgcccacacctttgtagtccctttggtgagttttcctcaaattactaagggttgagtgtaatctgtttccactttcttgccagggtcctgactgatacagttatcagtgtgcttttgcattagcaagcactcaacatttttaagattttcattttcaacttttctactacaggagccactaacctatgcccaacagtcagtgccaaaggctgctgcagagtaaaagaaaaaagcaaaatattcttcaatgcaccaggcactaatctgagtactttatgtgaattaaattatctaatcctcaaaacaaccccacaaggtatgtactattattaacctcactttacagatgaggaaacaagagaggcaaaaggagtgtacagaaagaaagatgaggtgagagtaagatcatacagttcaacaagataaaatatcagggctccttttgtgttttttttttttttttttttaaaacagaagccatcaagtgatctgaagaaaggaaattaacagttttgactgccaagcacgggaccatccccttcatatcc

SEQ ID NO: 31858 - DNA, 1486 bp, Bovine  19866880997302
tgaaaattttggatacaggagaataggtccaggttacaaaattaaaaaaaaaaatttaagcctctatctatatagataaccatccataaagcaaatgaatttattgatctcattgaaactctggcaaaagagatcctagggaactagggaaatttctagggaactacagtttaaagactgtaaagggtcatgatcattcttcgggctggtgtgctggttttactcttctttcaggtatatgtgaaaaacatctataagaacttcacaaataattctgagtaagaagtaaatccagcccatctgaagaaaatatcaaatcgttgctagtagacacggcacacagatatggcaacagctgtgaaagccagatggaactgaacagtggctgggaagccctgcatggccaaccccacattatgtgagacccaagtggctgtctgattttctaataagggcccgtctagcactcaacacacaaagtaaacagttcctctcaaaaccatcacgaaatgaatgggcaggaagaagactttggaaaggacattggagggtttttacaattcagggccggaggcccagggcaaataaggagtcatggtccgcttgtgagtgaaatcacatgatgaaaataaaattattttaaagaaatgattatcattattatgaaaatccagtatcactaaacataagtggaatggaccatgaaaatatatggctagtaaaaaaaatgcttatcctttagccaaacttgaaatgatgtgactcagcacagttgaggaaattttaatttaggctccttatatttcagatgagaaaaatactgtctagagaggtgcagtgacttgacccagttcacacagttggaatccacgtctttggacttctccactatgacacccctggtgtagcagcagcccaggcagtcaccagaactggcccagctggagaaatcctcgtgtcccaagtgactctgtaaatactctcctctgagcctctaagctgatctaaagtgaagtgcctcagatctgctgtgccgaaggtaactgctaaaggagtctagaggcaaattagaaaacatcaatagtactttcttcctctagaatgaggaattaaatcaaccaagtaaaattagagcatctcagtggcagagtcaagggagcccctggcaaggcccagcacagcacgagaagcagagaggaagccctatagcctggaacacagaatccaaccactaggtcctcatagatgctactgctctaagccaggacatgcctgggcacccagcggctttctttgtgatcctgtgctgattgtgcatagaagcctagggcgactagggtcaagattttaatcatcttttgaggattcaattcacagaccattccctgtcttctcaccttcactgatttctcctttccctaaattctacccagaatttctggatggaaggggctttgaggagacaatcaggttgaaagtaagtaca

SEQ ID NO: 31859 - DNA, 1228 bp, Bovine  19866880999391
aaaggaagatgaactttgtgtgaagggtaaaaatccgatgccagtgttcatggacaaccgtcctggcctgtgttaacaaatcctattggcagtgattagaatcctattatcccagaaaagctgtaaattcctcctcctagtgggatgacattatctgattggctaggaccctgagtgaagttcaactatggcacagttattttttgccctaggaaacctgctgacaggagtcctttgaaaaaccaaaagcgtgaaatgcattttagtccactgaatgggtgttccacatgacacatactggctgagcctacagaatcctgcgggctatataaagtaccttcggctccccaccaacacacttcacagatttctcttcatgtcaccttggcagcttcatggtgttgttgtcaagcagttaaataaaatgaagccccattaggagctgaatagttgtccctaaactgaacacttgaattgcttttccagattcctgatgggtatcttgacctggatccatctttgacaagcctctgagcctctgatagtttatgtaattgatagtcactcatttcctagcagcaggtgacaaagatcaaagaaggccccgatcagagacaccactgaagtgccctgaagatggcatcatctccaggtaccctttcctggagttggaatttcctaagccatctgactgaaatcaaattcaggttcgcaacaggccacataaatagtatcggtcaaaggaagagtgtcaaaatgcattttcccctcacccggtctgcagtttcctcatcttgggataatatgttagcatggccacagttattattcttgctgcaagcaaaaataagatctgccagtaagactcactgagaaaacatccctgacatttcccttagtgtatccaaaagtttaactcatcacagttctttggggtcaggaaaaaaaaaacaaacaaaaagaagaattctgactccttcaatgatataaggcagcagtctctaaccttcttggcatgagggacccatttaataaaatacaatttttctcacagactgggagaggggggttgggtttgggggatgacctcaagttcatgacatttattatgcattttatttctattattatcacatcagctttacctcagatcttcagacattagatccatgaggttggggacccctgatataaggggttaggaaaatatacagtctgcaggtgcatg

SEQ ID NO: 31860 - DNA, 1676 bp, Bovine  19866881075748
tggctgcattgtagagaatgttctagaaaagagcagggacaggaaagaaaacagtgaggggctaacctgtggcctagatgacagtggacattgtgggaacggggcagagtgctggatttgaacagcatgtaggagatgaagcgagaggactgggcaaattattggatgcgtagggcaaggaagagagatgaactgtcaaaagtgccaggtgctgctctggaagtggtgggcgtcagaactgttgatcaagataaatgatacgatacggagaagaaatgtgatgggagagaaagacaatcagttactccttggtctttttaagacagctccagggatgttctggtaggaaactccacagagcatccttgggagaattagcatgcaggtagtcagggtcatgggaatggatcgctcagggagagtgttaccgtgtgtgtgtgtgtgtgtgtgtaattcatgaacacccatatttgagaccacccaaggactctcatcagatgtctatttaaagtctcagacccatcacagctctcacagtagcactggctctgggcacagcggaggctgtgcagcagtgtgcattctgcgactgcagagcagggcaggcacctggcaatagggtcctggtaaaggttgcctcaggatgataaatgagctcaggtctccacctgacaagtgcctcccatcaccttttcatttcagctatttggaggcttttgcaggcgaataatcagttttattttctgtttcttacttcaggattagaaagagtattttagaatgttttcttttcttggccacatccccatcctgtatgaggaacaacaaagaaagatgtgcattttttttctttcttacagacttgagctgtggcttttcactaaattcacatcagcaagatttcgggatggctgaaggtagtccaaaaatactgacttccagttataaaatgaatagattctggggatgtgaggcacagcatagtgactctagttaacattagtgtatatctgaaaactgctaaaagagtagttcttaaaagttcccaccacacacacacacactcacacacagagattgtaattttgtgaggtgatgggtatgctgaccttattgtggtctaaaatcattttatagtatatgcatttatcaaatcagtatgttggtacaccttaaacgtatataatattatgtatcaattatatcccaataaagctggagaaaaatatttcatacaacttcaaaagggttactaagtgtaacagagagttgagatttcagaggtgtagccatgaaaaagcaaacatctagtgaaccatatttggccaaagcagaattgatcattcttggtaaatcttgattgtggggatattttttattctgattgctcagaatgagaattggttcattccttatttccacccataataaaatcaatgtggactttcatgctgctgctgctgctgctaagtcgcttaagtcgtgtccgactctgtgcgaccccatagacggcagcccaccaggctcccccatccctgggattctccaggcaagaacactggagtgggttgccatttccttctccaatgcatgaaagtgaaaagtgaaagtgaagtcgctcagtagtgtccaactcttcgtaatcccaggactgcagcctaccaggctcctctgtc

SEQ ID NO: 31861 - DNA, 1463 bp, Bovine  19866881126938
tatggtgccttctaaagtaaatgctgagcataagaggagtgggtattatgtgctcatcagagttctaagtgctttacatggttttcctcattttgtcctcacagttctatgaggtcattagtattattattctcattttacaaattaagaaaccatggcctccagagtgatttgcctgtttaattgaagtaaatggtaagagagagaatttaagcccatgaagaccaagtcttagtgttttgagtagataaactggtcttagattcgggaggcactgagcatgtcatttgattgtgtcacagaaggagtaagatacaatgtttattgaggtgcttgaatctgaattcactctcattatcccaggaatgagactcttctctggctaatggatcctaaaccattactttcagaagccatggggcagcacacaatttatagatcctaatttcttaaattaaaatttagtaatacagctaaataggtttgtggatggcactgtgttaactgattggaagccactagattaaaaaaatagaggcaataatcttggcttctaatttctcctaaatgtttattctctctcactgcaaagtactgtttacaactttgcattactctaaattcagcactttcgtagcttgcctgacatcttctattgttgtctgggaaaagaatgaaacagttgcactaatctaatcttggtatttactccaaggttttagtaaataaatccctgttctcaaagggaacaatgcccttttgatatgcttcgcatatttcttttccaagggcatcccaaatgagttgactacaaatatttctgctaatgagactgccttgaaatatcactgctgtgattatatgcataaatagtgaatttcattaggttgcttgagtcccacttttgatggcatagtaaatctcagaacaaccgtgggcggtagatagatgaagagcttttttggatataattaacttatttgagtgcaactactagctatcttagcatagcaattgtaacttagtcttaggctgctttaagtacataaaacaatttggcactgttataggaattctacatgagcctgaaagattaataaatttaaaaaagactctagtttgagagaagcataaagatattgattaaattctctctttattttacaaatattcacagtagctaagttataatctaggcactaataccttctaccgcaagtgatattacatggtatacttgaaataaatttaatttcatcaaatatttaatgttttgtcctaaatgacatctgctttgtcagttcttagatgattattcctcttgttgtatatcctgatgaacacaaattttatttgtgaatgtgtgttggcatttagggtggatagagggatttttctaagccagggatgtatgtacatggccttggagataaatctagagttacaacaataatgcataagaa

SEQ ID NO: 31862 - DNA, 687 bp, Bovine  19866881136094
actttctgtgttagtgttagtgttgaagcagcactgaggggatctcctgcctgaaatgaataatggttgcctatttcttaaactgataaaaaaaaaggactggttatcagaattttctcaatcattattaaaattagtaaagtggcaaaaagatataaatctatagcaaacacatattaagagaaaatttttctgaaattgctgagcacttaatttcccaacttcttatttttaagtaaatacactcctggttgcaatgttatattttatctagaacacatggtcatattttcttccagtaaaattgttcccagtgtgtatgatgaattaaatatgtcaatattttatgctgctccaaccagatgaccataatattcagctgtcttactactgacataacatgggaaacaacaagtgcataagcagatgttaaacagaatgagcaaacaatttgatcaatttttgtctacttatatcctgacatttcaaagacgcggtaaggctcccagtgcttcaaacaaacgctcagatagtaaggtacatcaatgatagcaacacagtctgaaaacattttcttcaagtatgtggtatttgaaataagcctgaaggataaatcaaatttggaaaactgctttagaaatgcaaagtgacccaatagttattttgggatgtcactaggcatctggt

SEQ ID NO: 31863 - DNA, 1307 bp, Bovine  19866881153990
cagcacttttttcttaagccatggtttctaaacatgcaccagaccacctggagtgattttttaaaatatagaattctggttctcatattagtatttttcgtttcagtaggagaggctcaagaatctggtttgcttttaactctttcactaattcccttgtaaagtaaaaattcaggaccacccctgacaactttcctttttaggtgctttccaacctggaggttctgtgcttaaatgtcatatggaatctctcacttctgatttactggcaatcagccatcattcctaaaaaagaggaaaggaaaagagaaaaaggaaagatacgataggaagtatgggtttgttgtccagactttgagcaataaaatgagcatccagaagagaatgtgaaagtcgctcaaggtcacccatggcctgcctctatccgtaggagagcccaggggttttaactcactgaccacgaggtgatgctgtcctgtagaataagcagcaaaaaggagacctgtgaccctgaatgactcaaccattgccctgcaaggtgaaagtcataatgtctgtgcaccatctcttcatccatgacatgagagtgataatgcttgcctccatttgacagagatgcttataaaaacaccgaaagtataaaagtgttaagagaagacagactgtctttttaaaataactcacacgctattccctcttaagtggctgtgtcaagtaaaatttccatttagatccagcatggaaatatgaactatgagaacactggtttaattaacactaattaaaccactggtcatataacttgggctgcataggtgacctcgcttagtgtggctactccagtttataatttattgaaatcagtctaacaccaagataaaactttatcaggtcaggtgactcttttagtctccagtcaaatccaaaaccccctttatagagcttgcgatatggaaggtacctccaaggcaaaagtcataaacccttcagctacaaactctgggctaagaagttagaaactaagaactggctgaagaccacttcttactgatccaaagaaggttcctataagcattgcagatccctggcagaacctctgtattaaccatctactccatctttgtcccaactcccactaatctgatgaggtgatgggaaacacttaggcctgaccagtagaatgccttaaatagaatcaaaagcttaagaaagccttgaagaacttctctggtagctcagtcgttaagaatctatacttccactgcagagggcacaggttcaatccctactggggaactaagatcccg

SEQ ID NO: 31864 - DNA, 824 bp, Bovine  19866881247984
agagagagagagagaaaagtgtgtgtgtgtgtgtgtgtgtgtgttaatagggttgctcctgggagtcaaggacttaggttttagcatctgacttccctccctccctgagccttgagggttcactcttctactttatgaatttaccaaaagcaaaaggaatattccctctcacttggtatataaaccagaggagagtattcctgttaacctgtgagggttcttgttagaactggcagagaaaactatctcagtcagagatggctcagtggagtcccactccatggctcttgccctcaccttcctgctactgtggcatcattattcagggcttggagtgaagctaagaaacaaagatggcattctgatggtgaggtgaaatatatttataatccttgaccctaccctgtctgccagctttttgtttgtgtcagttttaaagcttctgcagaattggaaagccatcattaaaatgccccctgctcacttattccttggtcaataaaaagttaaatacaattgctttgtcatgtctattagctagcaaggatggcacaatgaattcaactcatgactgcactttaaatcatggatgtgtaggattaaccattttggcttactcattcattagcatcagattctggttaattgatattccatttctaaagacctccttttactttttaacactacccttttcaacagttttcaccagtgcacttaaagaaaccaattgtggttggttaataaatacatgtctatacctttatgagtgtatgaaatttttgaagaatattaggaagcactgggcttgaatctgcctgcca

SEQ ID NO: 31865 - DNA, 2159 bp, Bovine  19866881262562
tttaatcactaattctctttttcacttactcctaaatatagatctacgtttgagttttcacaattgggacatgtttatgaagaaaaggtatggtgatatacatgtactggttggtagcaaatctcttagggataccagcaagtttttcatagaaatggtggggattgttaagtttggaacagtgattgtctgagcttcagcaaaactttgtgaaatgtgaactgatcaggacttttcacatccaggaagtcaaatcctgcaaatcctattatagtgaacttctaggacctaaacacactcctcaaaaattaaaagtgaattgtttcattgtgtcctgcctttaaaaaagcatctcattgcctgggtcaggctcagaaattaaggttggaacctgctattttggatgataatcctacctttgtcagaaggttttaaggtcttaagctggtttgggggttcaattggtggtttgtggtgtagggcacatggacacaagatgaggaaagacctttgggcgttctggagccaactgtccaatctgaccatggttcagaatgtgcttcacctcctgcttcttgctcttgagctgtttccctttgattcttgcaaccctctcagaggaccagaaggaagaaagaaggggaagcttctacacatcagttttctcaaaaaggtcattgatagaaaaaaaatgtttgaatctgttttgcgtattttcatggtatgcatgtgtgtatatgtgtgtttgggttttcttttttatcagactgagaatatactattttcttgcttgtatttccttctcactaatatatattgcttttaatttggtgaaatgcatgtagtcactataaaaaaagttccatttagaggaaacttgtggcctattttattcaccagtctgtcccccctgtgcctaaaacagcaccaagtactgagaaaatgctcaaaaataataacaaatgaccaacgcaatactgtaaagcaactaacctttaactaaaaataaataaaatttcacaaatagtaatgaatgaatgaatgaatcatagacagagattgacttgcgtcaggggctgaggtagagagagagaaatgagaatgattgctaatgaatgtatggtttttggagggtgatgataaattgctggaattagatagtggtgatggtacccaaccttgtgaatgtactaaaaaccactgaattgtgcatttttaagagatttagtttatggaatgttaactatatttcagggcttccctggtggctcagtggtaaagaatccacctgccaatgcaggagatgcagatttgatccctgggttgggagaatctcctggagaaggaaatggcaacccactgcagtattcttgcctggaaaatccctggatagaggagtctggtggactacagtccatggggttgcaaaagagtcagacatgacttagcaactaaataataacaacgaaagtttgcctccaaagccttcgtcttagtcaagaagtgatgttttgagagaaggatgactcagaagtttgaagcatggcctggcagtgggggagacaccattgactcacataggtcatcagataatgctaatggaaagagtaagatatgaggatgagacttggcaagatcatagcgaaatgagtacctggagtcatgagagacagaaagattactgagagagaagatatagggggaaaaaagcgagagggtgcacacggggtctttgactcttaagacatagtgactcaggtcaaggatgttggcggcagataatctgtgtatcttgactttgccactttgtcacatgggcaaatcagggaacctttctgagacagcattctcatgttggcaacacggaggcaaggatgctgaaagtacaggatgttgtaaggattaaaggagagactgaatgcctgtgtgaatccatgctcatgaagtcaattgtgcacgagggggcatatttctgtgttgttttcaaataaaagtcattttattcccatcctcatttccacttcatgggcaggaactataatctttatgaagcaaagggtccagactctcacatggttagaggtgaggaagagagggatacatttcctgaacatcactgtgcttatcttctcaacacacagatgcatttcttcagggca

SEQ ID NO: 31866 - DNA, 1339 bp, Bovine  19866881297720
ccctttggaataaatagccctgacaccaactcttggttttattttggttttaaaccaactaggacactttattacaaatagtcagtgctgctcaggtacaagatgtacaagtactacaaattaaaacaaacttggcttgtcaaaagtacagccttctcccttctaagccacatatttgcacatacttaagcttggaaatgagagcttcacccttttttagccgatttttcattcccttacataaatctctgttgcatcttaaatagagataataaaaatgttatcatctttccccttaaaatgtgcccctcttgacttcaatatttagtgtacattttttttattctttgtttcccccatcctgaactccctcctagctccctccccatagtgtacatttttatctcagacttgtccattataatatggcagagataggaaaaaatactatcttttattctcccaatatttcaaaagtttgggaatgcatctatttagagacaatagtctataggtcaagaactcagttgcctagattcaaatcgagtttagtataatcaggttatttaactttttcactgtgcctcaatttcctcatctataagtgggaatactaacagtaccaatatttagctcatggatttgttgtgaggattaaatcagttatagctggtatgtagaacatgtttggtaagtatgaaactaccactattattctagcacatatataattctaaaatgaagacaatttataatctacattggaagggactagaattcagggttttttattgagagcttatcctgagaaagggggcctcagctaaaaacagacatttttccctgggaacttgggatccaggcagatgagtcacacaacggtggggccagtaaaactgtaagccagacttctttgagattggttgtatatggagatggggctgctgggcaggtaatcttgataccttgttcctctcaagagaattaaaaacaagacaaactagatgagtgtcaatatcttctaccctctccaacttaccacagcactaaagacttcctaataataaatgattcttaagctattatcatcagtcataatattgatggcatctacttaatgggcagccaatctgtaatatactctataaggttttaatcccaagcagttcctaaaatagttgaaatgagggctcttttaaatattccacatttatattttaaattcaagcttacaatatgacctccttcatattgcataagttctctttgaaatgtatccctgggaattttggcaaattaaaagaaaaagtgtcaatttatttgatcccttctttggcct

SEQ ID NO: 31867 - DNA, 1242 bp, Bovine  19866881341298
acctacagactgaggaagggaaactcagcacaaatttcccaccccttccagggtgtatcaccaagaaattttaaagatgtcaacccttaattagaattttaaattgggagaaatgtgtgcgggcattttaggtgcaattagtgcagtagattaaaatcattttgaagtgacctcattcactccccaaactgtttaaattgattttacaattttctgtccatgtaagtggccagatgatatacagatagctggggaactactaaaatattttaatgagattacccttgtcaatcaagaaaaaaaaggtaaaaactattatagcttgtctttttactgcatcaataaaaaaggagaaggggggcttcatactttttcaatgggcttttacagtattttcaataaacctggaatgccgaaattctgttgtatttcatcacaacaaagcagcccttatctctgctgagtggcaccactaaataaaaattttgtttctctataaaaagagaaactatacatccagtcaaaaggctaataatacattaggagaagatatttgcaacagtatgacagtcaaaaggttaatattcttcactcttttttaaaaatcctcttccaagtgggtaagaaaaggacttgatagaaaagcaggcagttcacagaaaaagaaatgcaatggccaataagcctgtggaaaagaggccactctgttagttgtgagggaaactcaaggtaaaacaggacatatcagattggcaaaagtgaaatatattgataacaactattgttttgttattcagtcactaagtcgtgtccaactctttacaaccccatgagcttcagcatgccagtctcctctgtccttcaccatctcttggactttgctcaaactcatgtccattgagtcagtgatgccatccaaccatctcatcctctgttgcccccttctccactagccctcaatctctcgcagcttcaggatcttttccagtgaatcagctcttcgcatcaggtggccaaactattggagcttcagcttcagcatcagtccttccaatgaatattcaggactgatttcctttagggttgactggtttgatctcctggctatccaagggactctcaagagtcttctccagcaccacaactggaaaacatcatttcttcagtgctcagccttctttatggtcaactctcccatccatacatgactattgaaaaaaccatagctttgactatatggac

SEQ ID NO: 31868 - DNA, 617 bp, Bovine  19866881365251
ttgggtaacccctgcatcctgtatcttcctccgcttgcatattcacaaggaaagtcaacttaagtcagcatctcccaaacttacttgagcagggagcctttttactctgcgtaatagctgttaacatcctgctgcaggaaatgagtccagtctcatggtggaggttccgaaaattaaaccacttaagggtaggtgacacagccagtaatgccaggatgagaacccattgatggctgaagcctccctcagaatggctgcataattatactgacagcagtggattcaaaacatcccaaggctttttttcctcctcctccctggccccgcagcatgcaggatcctagatcccccaccaaggattgaaccctttccccctgcagtgaaagctcggagtcctaaccacaggatcaccaggaaagtccttttttcccttgaaatttatttttaaaatcgtttctaaagtgtctaggatcctagtttaatttagagagatttatctcttagcagatggaaaatgtgtcaattggctcattcaatgtggtagtactctctattcatatgcatcagaaacagaacctgaatagtaagcacggtggggaacttaaaggctcagaagg

SEQ ID NO: 31869 - DNA, 1392 bp, Bovine  19866881403409
taggttttataactgtagtatttcctttgatccttctggaaattacttttacattatgaagtgatttatccttctatttccccaataactaaccaactattttaagagctcactaaatagtccaatattattccaatgatttgaaaaatcaccatcatatactaagaatgccaccatctgttcctgggcctagattttgcctttttagacttaagaagagatcctaaaagggaataatacagcctgtaacaaatatatttgtgtgaaagagagataatttaaatatatttaataagagataaatgatgactcaatattcaaaaaaacagcttagttctaatactattttaagacttacttcaggtcattcaaagatcttgaaggcgctttgtctgcgtatgaattcttaggagcaataacagcatttactcttaattttttattgtcacgaaccttaatacaaggaaaataaaatactactttaattaccacatactttcaatgaagatttctaaagttatgatattattcttactggcattcatgggataatcaaaaaattgaacactcactagatatttaatggtactcataaaaaaaactttttagtgtggtgatattaatagctatgtgttttcacagaaagtacatttcttttattattttcactgataaagtctatcgaacagataaggaagcagtaacaccaagactccttttcagaacacagaaggacgggatacttcccaagtcattttatgattccagtataatcctgacaaaaacactacaatatccctcctgaacacatacacaaaaatccttaacaaaatattagtaaacagaatctagcaatatataaacactatacacgacccagtcaagtttatcccaggaatatgagattggttgactctgaatgctacatcagtctaacttactgtattgtcagaatacagtacaaaagccataagattatctcagaattttcagctaactaggaacagaaggaaacttcctcaatgtgataaagggcatctatgataagcatacagcagacatagtacttaattgtggattattaagtgcttcccccctacgcttgggaacaagtagagatatcaaatcttaccacttttttttcagcattgtcctagaagagctagacaatgtagtgaagcacaataaagaggtaaaagattgaaaaagaacaaaaagatctgtcaactacttttctgtttgtaatttatgtatgtggagagactaaaaatactctgttgctcatggaactacctaataggtttaagaaccattaatgattctaattgttctttctgtatttattaggttggtattctactatatgagggaagtgctttttcttctttcatg

SEQ ID NO: 31870 - DNA, 1649 bp, Bovine  19866881421339
acacattacccgcgccaaagttgctgcaagaccagaattacaggacaatcaactataggaaatgctattgcaaatacaatggcgggcagaatacacatgagagccttgtcaaattcctcttacaaaacttcctcttgcaaacatcctcttataaccgtggtgtgataaccactcgccaaaggacaagggacaagatggagagccccctgttctcattataattaattggttgtaagacagacttgaaacaatcgggatcgtgatgcaattccaacacaggcttcctctgatgaaatcttccctgggctgcaggaaatacctcagtggggaaggatgcatgcaccagtcacacaagatagaccgaaatgacgagtttgtagtttctacaccccatgccaactttttctgctgcattcccattctaaagggaattaacaactgatttccatgaaaaataagcacaaatcttttttaattgcgaacgttttgttttatagacccctgtctgatagggtagaaccaagactttctggttcaggtatcctttcagagaaaactcagctgcctgccaactcttcctgtgctgtgtttctgtgctgctttatttgaggttgcaagtacctggaaaagagaagcagatgtttttctttttttttttaatccgagcgcgccaggcactccccatgctcatcttcttcctgctgctgctgctgctgcccaggctgggcgcgagggtcctcgacggcgcggcggcgccgggggcgacccgcatagtgctgctgctgctgctgctcctcctccacttcggggtgctccaggtcggcctccaccgactcgttcacctccccgcctgccgcctcgtccgtcacctccacctccgctgccccctccaagtggttcatggtgggcgtcggggacggctgggagagaggctgggccggctcactgcgctctcattttgctccacccggctggaaaaacaagaagggggaggggctattacgtggttcagactgtagggagaagccgagtcagatgtttttcaagaatgtttatgaaacttctgtttttaaggtgcacattaacgggacccaaactctcttgcatttgcagctcacttcttgaaattacgtacatgtcctctagaatttgcttgggcaaatctttatccaatgggcattggaaaccccttggtttctgcattgaagccgttcctgttttgtcaatggcaccccactccagtactcttgcctggaaaatcccacagacggaggagcctggtaggctgcagtccgtggggttgccaagagtctgacacgactgagcgacttcactttcacttcctatagccatttaacaatgctgtgatagtttcaggtggacaacaaagggactcagccatatgtatacatgtatccattctcccccaaagtctcctcccatccaggctggcacatgacattgagcagagtttcctaaagcacagatcttttcaaaagcacataacatgatttcactcaggacttaaagccaagcttccaggatcccagggacctctcccagaaactgtttcagatctggtgtttggagcccttggtgaccatcaacactggttgctcttttttttctctcctttctttggaccagca

SEQ ID NO: 31871 - DNA, 1362 bp, Bovine  19866881495764
tatataaaggattgttaaaatgcataatcctttgcctttctagaatgcagagtttatgagacacattcaggaaatgtttcagtgtgtacatttctagattaaagagagctataattttattagcttcacatttcaaggagttccgtaagtgcagggttcagcaatacatcaggaagtgatgaggtcagcattgctcagatgtcttgaatgccattttggtttcccgtgacaacggggaaattattcttataccctgactaacactgcaaaagtagtcttaaaagattacagagcattaagcctagcaaaaagaaaacaaatgccaggaggcaatctgcagtgtaaacagtacacccacatttgaaaccactagagcagatgttcacttctctggttttcacagggtttgggaagggcatagctttgaaccctgttggccccagtggcagttttagaagaaaagtttaccttagcaactaccaatgcaaaagcaagtgataagtccacagtgaaaggtcatggggtatttggaaagggagctacactttacatagtatttaacaaactatgaaaattttaaaaaaaaggctgcattaccagatagtgtttattttaccaaagaccagttctcagaacatagtttccactacatgaactgccaggtggggaagatatttcttggaaacttgaaagtgtccctcagtttaagataaacaatgcagaggatgatgacatcaggggatggttatgcataggtaactgaattctctcttcagtttccctgggtgtacctggagggaaacaagtactgttcttccatggaatatgcattcattcacaaggaaattttctttttttgacttagaagagaccctaactctctatcttaccagttttgctaataacaccactgagagcacagctgaatatttttgcttatgcattatgcaaggcacttctgtcaaacaaaaggagttatacacatttcagcttcaccagcttcattcaaatcagaataaagtaggagtgcctatgaaaatttcaccatggcacaggtaaataaataaatctgaatttaaacaaacatttatacacatgtatatatgtgtgtgtatagatatatatatattacatttatttgcaaattctcatttcaaattctgcattttatgcctattatacagtataaaagctagtaggaacaagaatgttcaacttgaaaatttatctagagagataaacacattttattttgttgccttacagagaagatataacttttaacggtgtgagcataataatagaaagaggagtttagataaaagtaaaccccataaaatctgtaaaatgacggtctagatt

SEQ ID NO: 31872 - DNA, 1177 bp, Bovine  19866881819666
actcaacatacactctgccagatagcgatttttacttgaattaccacatctgaaacctggcctaaggactcgtcaacatatcttgggagccctctatattcacaggccaatgggatcacactgcttcctaggttgaccctggaaaagtatatcctccagaactttcctaggataatttcactcttttatccacaaaacacctttcaagcaacttctatagtcaggtactgtaatagattggtagcctgaaaagtctattaacagggtggttggatttacaggccaacaacaatagggtattaacagatctagctactccacagagtatctgctagaagaagagattatactatttgataaaaactgaatttcagataggatctccaatgaaatttcttaaaaaaaatctgattacattaataaaaacatctttgattgctatacagcagtttcataattgacccatagcacaagaggtaacaaaagaaaatttcccattgtaatggttctgtaaaggtaagtctgttttttatgtgaatagaagattttgaggatatttaggatttcctctgggctaggacagagcaaaacaggcctttctgaggaaatgaggaggaccagtgctttctgtcatttttcagtgctaagagaggaagttccctagaggaagaataaatgccaaaaaagcagaggaactctcagctctagaacataatgctatgcctgctacttccttcctctagtgataagctttctgattaagtatgttattggaacttgtccccctttactataatctattttgggactgttctgctcatatttacacatactgggccaaaatctacatgttttagccataagggacttccaagtacgtgaatatttttagattacttattacctacctttggtgtaataaaaaagtactgagatgtgttttctttacaagcagtatttacaaccatttcaaacactcttcgttcattgattgggtccattccctaaaaaaagacaataataatgattagatttattgggtttcactctatcttgtaatagatttaaaagaataagcaatacctgattgatttcatcaactactcggaacggacatctattaagctcctgaagtgccatcaagtataacatagtagaaacacttctttcaccccca

SEQ ID NO: 31873 - DNA, 945 bp, Bovine  19866882030686
ccagggatcgaacccaggtctcctgcattgcaggcggattctttaccacttcacccaccagggaagcccccttcctagtacataatatttcaattttactaaaagatcttttttggggggcgggggagaagctattttttaattaaagcgaaaaagagatttatggaatagaatggaaacgtgaattttaaagctaaaaccaagactttgataatgcttttctggaggcattcggcttaatatggaaacagtgtgataaaagaaagaaccctttcccaagaaatctggataaccagagcttatcttcattttaccagataagaacatatgtatgaagatggctttgtgcaaatatcatttcttattattactgagtattcggtgaaaaaggaaatgatttcactcatattacactgccaattacaggtgaggccggcactggaacccaggtctcctgaggcctgtccatcccactgcttttcattaacgcacagcacctgccacctggtccctgctgccaaggtccccgccttcctccttcccaggcatatctgggctgataccctaagccaggctcaactacactcccggcatcataatccagaggctttcttctcttcccgcaggactgggcagttcccctcaagggctgcacacgcggtcagcgccgctccggtccgaacccgagtggctcactccctagtggcgaaatcgcaggccggcagccagctccagacatatcagcaaccctcttttcttagggggccttgtgtgcctgccaggcagtgcagtacaggcatcattttaggggctggaggagcgggaaagctcggcagtaactcagttaagggaatacccctcaggagccaacgcggcggccgggattttgaggtccggcagcgcggcctgtttctgcgcgcagacattggctgcagctgctgctga

SEQ ID NO: 31874 - DNA, 976 bp, Bovine  19866880352372
atggagctctttcccgttatccaggcctgggcatccctgcatttcttagcgtagtggggctggtcccctgactctcaaccccctcaccaggactctgggacagccccatcatcctcccggagtgccctcctccaacccgtgaacccccagtgagctccccgacatgcccagcctcccagaagaacactggtctcacctgcgggtatgcagagctggccactgggaagacggcaggccggggcatatgaggcatggggtgggcggggtgagctgggtgggtgaggtattgagggctgcagggcaggtggggctgtagagcagtgtaggggtgcaggccaggggaatgaccatgccccagtcctggacctggatataaactggaccccaccgagatgactggcaccaccgtggctgctgtcactgctgccgccgccactgtaaccggctcagtccctgggccccccctgccctcaggcagcccccgcccagcctccccagctgccctgatcccactggcactacagcttgtagccccttcacgggctgtggatgagccacctgctgtttgctcatatagccagaaccactggtgagcaacctcaaacaacacttcggggtatacgcccccacccttagccgcctcttccactgccatgcaggccttctccaacatcaggttatcctgaaagggaggggcaaagagggttaaggatgaagggctttactcagggacagttttagatgacaaatgctgatgtcttcttcagagttggctggttctggggaggcagccaaggtcagagccaatgttcagagtcagtgtcagagcagtgaatgcttcacacagacaatgaacaaatctctgttgaccagcagaagtcaagacccaagttgcagtcccagttctaacctaatgtagctactcccagccaagttcatcatctccctcaggccttccccaaggactccaccccca

SEQ ID NO: 31875 - DNA, 1495 bp, Bovine  19866880428001
tgggaatacagtgtcagcctctactcttgagtgtgatgaggaaggtctgagcattctgatggctctaagggtaagattcaccctcttcctgggagaaggaacttccccacattgcccttaaaattgtagatcacttttctccatccacacagcagaagactagcaaacaaaagtatcgaaggctttctcctaaaacactatccaggtagaggcagaaagagtccagagaggctttccttttctcaccagtaacaccagagattccccaccagctctaaccattaagaagactgctatcctatcctactagatcttagaggacaacacctggacacggccagtactccacagaagagcagaggctaccaggctctgtcccggtggtgacagaacactgcactcaacccagagctctgtgacactgctgatcactcctggcctcccttcctttcctgcccagctatgaagtaagaatacccctaaaatacttctgggacgtcaagttctatttagagagtcaaaaattacatgtaggctctacacctgcaacatgacaaacaaaagggaaaaataatcaggaaaggctaggcaaacatctcatctaggttgactcacttatctggtagccacaagctccttccccaggaccatataagtatctacttacagggctcgggatggcatcagggtccaggcgcttaggaggcaatggctgaggaggcccaggctgactgccaaaagtggctgctcctgggtagggacttccataattggactgagggccccgggctggtccaaaggaacctgggagacaagggcaaggttgatgaacaaaatattccttccctatctcttcttaaggcctcacggaaatgactaaagtattataaacatagaattgagaggtacagtaataacctttcagagaaagcctatgttatctgaactatgagaaaaaaaaaatcttataaatcccacatctgagtaccacatcttaataccctgaagctgtctatctagttcaccacttagcaagtaatactagaagcaaataacaacaacaacgaaaacacctgaatagctgaagcttttggctcctaggtagtccttgggaaaaactcaccattttgctgcagctgatagcctggctgctgggaggagtgcataggtggtgggtggtcctgggggcccagtcatttgggtaccagggggcagagcttgaggaggaggtgaggacacatggttgggctggctcactgggggccccccaaaactctgtccaggcaagagtggaccagtcatcgaaggcatccgaggaccccctgaggcagggggtgtgaagctggaggcctgtggtgggacagatcgctggggaggctgggcccctggatgaccctggccaaggggaggagcttggccctgaggataggagccatacagaccagaattagggaaacttcctgaggctgaggccagtgatgttggtgagcctgag

SEQ ID NO: 31876 - DNA, 886 bp, Bovine  19866880584141
tgcttctttgtcttgttctgtctttttctctttctctttcctgggtctcattgaggatggctggacacttgcctgctggtctcttatctgtagggtaccactctgcctggggtgtcagtaggtatcacagaaatccagggattggggaggacaagtgtcacagatacttgggtgggaaaggaagcaggggtcaagatcctagggcaggaacgaaggggattgaagattgggccagaaatgagaatcctgggtaatcttcgactttttcctcatgcacccatgtcagcccctggattgtttgggccaggtccactgttgctcttctctttgaagaagtgaaattctagagatgaggagtaaggagagggactctagtccttagacctttagggacatttgtcctcataccccttctctctgctccctccgcaggcagactgtctgagccatgtccttctccctccaggttgttcctcctcatctgttcccacatatcactctagcttccttctgtgtctgagcccctcccctttgctccttaggcttcaccgtatgttgtcgaccatggggaatctggccctttgcgctgcaatcgttgcaaagcatacatgtgcccctttatgcagttcgttgagggagggagacgcttccagtgctgcttctgcagctgtatcaacgatggtacgttcacagagcctggggctgggggatctggactgcatcttcattattctctctctagttagatagatgaggctctgttgtttaggcgatggggacgtgaagtgcctctggggctgtggggcattacagtgagctcagccaggaccagatgaggaccgaaagcggacccatgagtaacactctgccctactccccacagttc

SEQ ID NO: 31877 - DNA, 2323 bp, Bovine  19866880589958
aagaacttggagagcaaacatgatttttcttacttcctctaagtagtcttagtaaaacaaaaggtgatctttggcatagattcatactttaaaggcattaatattgcatttatatcagttaagcaactatacaaagatgctgagggccttgaaaatcatcagttaaaaggtaatagaggaagcctgagtgtacagtaccaacttaagacaagttttacacattcgatgttaggatctaacacacatttgaggtggggagacattcaggcaagggtcttactcctttactcatccagttctggctttgggaagaaatacagtttcatgtgctggggaatgcttagacagcagtgaaaagtacaggaaaggaaaagctcccttctctcactttgctaataggaaccttacggtgataattaaatattatacctattactcccttgaacagctgtacttgggagggaggggaggttgccagggacttggttggtgttggctgagggaggtaggaatttctgaggactgtttcccattgactcatcccccagggtgccagaattccagtctgcaagtaccacctcccttaggtaggaagcgtccttcagacaggattgcctttgcattaaacactgctgggggcaagcaccaattctcaggactgaatttcaaaaggataaaaaggatcttccaaagttacaaaacaaacatttatctttaaaatcttgtctaggaagggtttgagggaagaatacaaaagccaggacaggagacatgattcggttaaaaataaaatgcagcatttcagctcagaaagaacagtaagagctaagaatgaatgaataaggcctcagcgtagacctctgcaggcagtgacaaagcgtggagtggccccgccaggagggtgggcagagccacgccccggctactctgcctctccagtggcagagagcaccagggcacacagtgtgttctgggggatgctgccttggcgggccaaggcagggtgtgggacggaaaggttccctagcacagacactgctctggggtgaggtaaagacagaaccacatgatacagtgatttcctcctgacaaagtgaaatttggctgtgtactgtgggaaactagaaggattgaactagggaaaggaaggaagtgagttcaggccccacaagctggggctccccagaggccaccttcccctgccgcagtgaagctcacatctgaaaaagacccaggaagcacagccaggagaggcaggcagggtcagcagcaacatggaaagcccaaaatgttggaggcacagtgatttccttaactgacttgcctgggccctgggtcttgggagcctagtggaaaaaatgagggggtggaggcggaaagggagctgtcctctaaggaacaagggcagagcagggtgtcaggctagtgttcactcttggattttgagcttatgtgaagtccatgggctagaaacccagtctgcctattgggatagagtgtgcataagtaaaaccgtgtttgagaatacaggccttatacggagacacatttcagtgtccataacaagagtataaatgttttctaatttgtatgtcaggccaggatggtggctttcaaccccccagcaatcttgggtggctcctgggaccacatcattttcgttctgtgcagcaggggcttgcttctgtgttagccaggttcaaccaggtgtctactggtaccagggagtctttctaacccagcgcagagtaaacccagcatctgttcgaattttgattgaagctgcttctgcttctcgaacagtctccttcacagactgcatgaggttctgggcattgtgaaccagcatctctgtggcctgcaaggaaagaggagctctccattactcagagtccctgatggagccctgcctctgaaacaggcttaagccaggaacggaatgcggtttaccctacctgcgcctggcgtcactggtggtttatagctggatcgccaaaaagaaccccaaactggaccatcgatgattgtggactgcactctcagatggcatctagtgtacactcctttgccgatctttgaacaagcccctgccttgggctccccctctgcctagaatgctcttccctcaggtatcccaatggctcacttctcacctccttcagatctctctgcccagttatcaccttattgaggcttttcctgctcaccttattttaagtcacaaaccaccttcccaactcccagtgtgcctcacccttcgagttctgtcttcatttttctctacagaactcgtcatcgctagctgataaactatatgttttat

SEQ ID NO: 31878 - DNA, 934 bp, Bovine  19866880665770
ctgtttgtgccaattgttgatgctgtaattttatatcttgatttgtatacttactgctcagaaattgtataatttctagcacagtggttccacaacactgtgctatattcaactgccctggctcagatactgaacctgcagttctgcaggtattagatattgtatactagggttttcatgccacctccagagctcacactattaattatatgttttttgtggttgtgtctttctttctctttttagtctagtggcaataccagtgtatgtgaaacatagcatcagtttcaaggagaacagttcttgtggtagatttgatattacaattggaccaaagcagaacatggggaaaactattgaaggaatcacagtgacagttcacatgccaaaagttgtgttgaatatgaacctgacaccaacacaaggcagctatacatttgatccagttaccaaggtacagtcacctaaaatcaggagtgagcaagtgtttctgcaatcctcattttgtgatctggggacatgggaggacagagggaagggtctaatatcttggttgaaattaaagctcttaacaacgtagaatgcagactgtgctgtgctctgccacaggagagaatcctgcatctgctgctaagtcgatgaacagaaaagtgagacattccttcttccttcagagtctgccttttcttatccattgataatccagaggttcactcactcttcaatgaggaagatgtaaaaactttttaaaaagagaaaagcattatgtgcatataataatctattaatggttaatagatattacaacatatcaattgttaagaagttaagacctttctcttcctttttaattttaaagcattatttcatactcttccacagaggatgctcactaggaaagttgccttctcaccctccatacatttgcctctag

SEQ ID NO: 31879 - DNA, 1361 bp, Bovine  19866880708110
ctctgtggctgagacaagaaaacagatggtttagttcctctagagtcaccaaagttgcttggatttgactcccaagacctcccttgtcccccagcttggtccggaggcgctagacctgaggtgggctaacactcccgtgacactctggggtgggagcagtggctggacagatgatcagagattatttggagggacccagagacctagccctggaggcatcctcaaggtggaaggagcccaaagactcgtttgaaaagcatctctccagaaatctttgctgatgctaggtgccctgtcattgtacaatcatacttcacgcagagaaattcagattttctcactttatagggggaaagaaatgtagtgtatgagaaagcagaacaacattcagaaactctgggtccctgtgggcagcctcctgctgccctttccatctgccacctgcatttccttccccttacaacactagattgaagcctgatctgaagaggaacaagaagagaaagaaaacctggtcgaggagacagtatccacagaggaaaggggtggaatttgactctggatacaaaaggcaaccactgacccgggggagcagacacagggctgtgctgttggcctttttgtctgactgatcttagacgtgatcagctgggaataagggcagaactccaaagagcagcaggtgggtccaggtgggagctgtgtcagcagtcccagtcctcaggaaacagcaggctgtctagcaggccaacagcagcaggccactaggctatctccttgcctttcagaatatcacgctgagtggcacagcaagggaggcaggaagaggacggcgaggaaggaaggaggccgatctccagggcaaggagctgtattgatgctccctgcctcttacaatcccctaaccaataaatacactgagtctcactgggagtccgtgtggaaccaggagccactaaggagcagcctgatgcctgtgagctcttcaacatgcagacacacaaatgtccagcgaccatcaatgtgcggggtgccgaggagggcacactggcagcgaggacgtgctttttctcccccagaacacatccaggaagctctctagactgccctacttcttcttgcccggaagcctcttttgtggctccttggaccacacctgaagctgttacttgctatcagtggttgagacgttcccaaatctggggctcggcgtggaacctcaagccaggtaccaggtgctttaagactctgctgaactctgcaggctggagaagggggccccaggaatagacagaatgtgggcctaatctcacaaaagctctgctctcttccatatcccccaaaaaagtgcagagccctcc

SEQ ID NO: 31880 - DNA, 1230 bp, Bovine  19866880971028
ctaaagggaaagggattggtgcccacgaattactgcataaagaagtcacccggcgtttgtgagtgccagaggtgtgagcagaagtagactcctcaggaagcgaggagacagacttgaggggtcagtaagacaagtggacaaaagggccgggcccgcggagctctgggaaggggtggtgggtgaggcaggtttcaaggtgaggggcagaagtatcagaagggagaacaacgtggctcctatttaagaatccctggaaggagaggcagggagtcagtagaggaacccgccagcccagaggccaggctggggaggcctaaaaaggagctgagagcaaagctgtcaacgggaggggcgacacccagcttaaggaaaggggctatcagacaacctaacacctagcatttactgagcgcttactacaggtcataagctgggctaagcactttataaataccacctcactgaatgttcacaagaaacccgcaaggcaggcattattaggattgtccccattttatagatgaggagactgaagctcagagaggcccgagggctcgctcaaggtcagagagcgggggagtcaatattcaaacctgaggcgatctggctcccgagtccacgcgcaaactcacaggcagtgaccgggaaccgtgaggcgagccaggaccccaggaacgtctcccgcccccgatccccatcccaggcccagcgcactcacccgaacgaggttgctgaccgccgcctgcacggcggccacaggcgcggtgaggtcagggatggctttgccgtccacctcgccttcctcgtgcataatcaccaggtgcgagatctgctgcgccaccggctccagaatgctctcaatcgtgcgcgtatgaaacaccggcatcgcggcggcgagcggggcggcgaaccgcgggctacagagaactgagaaccgggggccggggacccgcacagagacggactcggagcagcgactacagagtcggggcttccctcagtgtaaccagcctcaccggcgctccgcccacttcgcgtcgccgcgcccaatggaagcgccgctcagacccaggactccactcctattggtctctctttgatattgctccgcccccgcaaccgcgccgccaagaccccgccccgcccccattcccaaagggaggggcctgggactgggggctgcgccgcaaggattgcgaccggattcccgagccttaacgccgggcgctc

SEQ ID NO: 31881 - DNA, 998 bp, Bovine  19866880999468
tggggacttttcaggccccactgggctgttttcacagccctcagctagtccccaggtatatggatatgaaggaattagaagctgtggcccctgctcttatgtgatacacagacttttgctcttaattggggactttgcacctttagagtgagattcaaagaggaagggctgtggcatcacaatgtcagggtgaggtcaatgggattgtagcttgggattcccaaggctaggggctgtttataagcagctggggaatgtggattatgacaccaaatcccggtgctgcccttgtttctactcctccgagcgatgcctcagagggccagaagggggaagcaagaggagacgcccacacagagcatctgaactgggtgggctgtgggaagcttttcctgatccacgctgggaccacaggcacagaccttcgaaataactccgaaaagtcgaggatgtcattgagatcagaacttggggagggtccccctagccagagcagggctctgtgtcttttcccgcttagagtgggctgtatgtttagatgtcagcaggatcttagttgaagtccatgctagcgttcatggttttagagacgtcactgaatcagcccgtgtgtttctgcagggctgtggagaacctggctggctctccctgcgctccatcctgctggggcaggagtgtgagtttggagtaggcatcatccctcggggtgctaggggagaggtgtttcgaggtctcctcactgtctgcttcctctgctctgtatctggtcacgcctttgcttccttctcttcaagggtattcagcctttgtggtgccctgaccccagtcttaagctcttgttcagaaggcgggggaggcaagggatcctggtgtccagggcctggccctcacctgagggtgctatcaggacggcctgaagggggatcttgataacggccgcttctgctttctgctcctgttaccacctagctacttgagggggaaatccttgcagaggg

SEQ ID NO: 31882 - DNA, 2476 bp, Bovine  19866881022788
ctgagtttataggacaaccctgcagctggagaagatgctctgcaaacctgacttgttcctgaaacattgctgctgcttgtacggagccctgtgcttcttcccagacacacagtggagaacaggacaggaagtgagggggaaagggatgggagacagcagctgcagaggttggggtgctggccgcctgagtgaggatcctcctgaggagcagggagagcgtggtaggcagaaaccacacggctcattgagcagagtttcaggatggcagggtgccacagcccgtaaggctggggccgaggatgaccagggctcccacagacagtggctttaactgggccgtcctctctcggaggttaccctgctggtagccttcccctgcaggctgaagacaccaatgggccccacccaaatgggaggcctgttatggggccaggtcgagggcttggttagtgttccaagaccccgtgactgcccaggctgatggagagtgggtccaactctctcctgtctctggtgatggccgtgggcacaggcccagcctgggagacctcgtctgtcttactgctggacccttgcaaaggaggctctccctgagtgccaggcactctgcggagcatttacccaaaaacgtcatttaagccacagatacccctgccttcattttagaagtgaggaaactttttcccaagctatgtacctggctcgctctgtcacctccgttccatcacatgtcactctgtgccgaggctgtccttgaccatgcagtttaagtgtgcactctcccactgccctgctttatttttctttattgcacttgccatgacatctaacatgccatccagttcttacggactgtcccctaaccaagctccactagcgtatcagcttgctgagggtggggactgttgtctgttctgttcactgctgcatccccagcatctgaaacagcacctgtcgcatagtaggcctcagtaagtatattctgaatgaataaatgagtctcagatgggtttgggactcacagctctaggactccatctggggctgtctgactcaaaaccagtgggttaatagccagactccatgactgagggtcagaccaaggaccacggcacagcctggggttcaaagaagacttgtgcagaatgtggtactcagctccgtggagttagggtcaaactgcgtgactgtctaggaccctctggaccctgggcagctccttcgaggagctgggcgtgtgactgtctcttctcttcccactctgagtcactgataaagccagagctcccttatttttagtgccgttgctgttgtggaactggaaccattagccagtaagagacttaagggaggagataaacattaatcttctgggccttcccctcagctgccacctccgcatcgcaagatactgctctcctgcacctgcccgggcagcccagcccgagagttgcgggttggagggtgtgaggtgagtggtgagagagagggctggggggtcttcagctttagtggcttgcttggtaccaccatcccacgaccagggctggggaggaaggtggggttgccctgacatcccccagtcagggctggaagaagcaagccccctgtcaccaggcaaggctagtgccgcttcctcaactgcgctgccttctggaggtcccggccccgaggggtcgcaggcagtgtgggactacctggggctttcttggctgcatcccggtcagtcaccataccgaactcaagggtgggagagaaggcctgacccagatctctgggcagctgggatagattagctgggcagcaggaactaatctctgcctgcccctacctccttcttccacagagcagagccatccctagagggaacgtttaggatagagctgagggtgcttggtgagacagtaaatatgagttccttctcgtctgtaatccgtatgttatctcaggcaggcctgggtttgaattcacacttctctcccattcctgctataggaccttgggtgaattatttaacttctctgggcctgttttatcatctgtgaaatgcggacagtcagtgtcctgcctggtaggatggttgtgagggtcatgggaggctttacagaggctctttgctgtttaggtagaggtgggggtgggcacaagccactaccaagggactcaggactcgcttggcaggtatggaagggacagtacccgcctagacctgttggagttggggtgaactggactgtgcccctaaagtctggtgtcttgacttgatgctctcatttttcctgatcctgtcatcatagcacagcgatggagaaagagggctctaggctcagaccacctgcctctggtgcctgtttgtgtgaccttgggcaggttacttgaaacttttaagtctcagtttcctcctttgcaatgtaactgagctaatcagatcctccgtttcactgggtttctgtgaggataaataagatgtctgtgc

SEQ ID NO: 31883 - DNA, 1508 bp, Bovine  19866881177810
aaacgtgcatattgtaagtaaaagttgcaacatcaaatcatatgttaggtgtagaactatctccactgctgccaaaagtgcaaagaagaaaaattaacctttcctaaccattttggcaaatgccatccccacatccccgaccccactcccgcaaagcctcggaggcggggtcttggttcctggtagaggatttgcaaaggtaccagcattcagatccacctaagtactaaaaggaaggtcaaagcgcccttccgcgacctttacgaaaaataccccaaaattctgtctttgcctcagggtaggccagtcgctgggcattctcctcatcatcccccagggaagagcaagtggccgcgattgactcggctcagatcgggtccggtccggtcctcccgggtctcacagccaagcgggggcgggctcccacgtggcgcccgcagcctacccaaagccgtctccgcaccccggccggcgctctgattggtcaagggcggcggagcgtctccggagcctgaggcgactgggccaaactgggtggacagcgggcaaagggtcgcagccaggcgggcaactaccagagctacccgtcccgtgcgttggccccataccgggggtttgaggttaccacccagcgcctcggtcgcgcaaccctacgtggcccctggctagcggcagctcgtcgccctccaccctatgtcaggtagggctcacctcagcgctggaggctcttccaccttcagctttttgggctttggctcctcctctgccgctgccatcttcgcgctcccacctcacttacgctccagggctcgccccaccccttcggctccctctccccgccccctcgccgcatcaccgcctccttgtcactaaaccccgccccctttggctcctcccagtttgtgcctctcccagccctagtcttttggccctacctcttggccttacccattggctagtacacagctcttccagaccccgcgcgctcgactccagggacaccccagactggtttaggctgcagatgagcgcctgagtccaaaagaggtgaaagctctcattcttctagacctggatgattcagaagatgatatcctaaaattcaaaagacgtcttctcattcagcgtcttcccgctcgtttactcttcctaaaactattggttatattgacgctgttagtcaggcaatctactgggcatcccaactgcagggtcctcacggctttctcagctgtctcagcttcggtccggagaggaccccgcgtctaatcactgacaggcccaggagccggggtgagtgttgaggggcggggaaaggggggggtggtctacggacaggggacatcacgaaagctgggaagtagactgactagttagacctccgcttccaaccaggggtgtggaagcgcctccggtgctgtggaccggagccgcgccttcctcccggccttccggtctttcttgccagctaggccgggaagggaacggtacacctacagcccagtgtt

SEQ ID NO: 31884 - DNA, 1775 bp, Bovine  19866881205785
cttaattttttctccttctccgccgagtggctcctgccacccctgcttcagggaagccaggcgggtgggcagcttgctttcctggctccggggaatacgaatgggagcgccatggaaacccccagagtgcacaggacaccgcagcaaggaacaaaactctttcaaggccagaaacaaagtgcagaccctttgctgatggccgcggaaggcccccggcgaggggcgctggcaggccactcgccccgagcctcacacgccgaagacccagccctcagcccagagacggaaggagaggggaagaaagggagcctgaaacacattccgatgcctcactcccagcgctgagatggcaccacaggaagggagacgctcaggtctctaaactagaacaccccagaattccaagctgcgatcctgcttgggtaaaaaaaggcaccaggcagacgcccagggacagaagtggttccccacacaaaaacagtggatctctgttctcgccaccttctacaaaatgcccaagacatgctctatataagggcacttaccgatgtttggatgtttcaaaagtcggcatatccgggcctcacgttctagtttctggtgatctaaaagtggaagagagaaaacgaaagctatcagacatccattctatttgcggccacttggctattcatatgccttcaattcttaggcacctactatggccctctttattttttttttaaacaatttgctgaattaacatagcaggtcacagcaattctggagacaggtattaatgacaaccttttgccatgaagcagtgtcttaggaaagcttcccaagctagtgagcggcagagccaggatttgaatccaagtcttaaaactctggtgctctttccaccacagcagggattttactgggccagggtgtccagaatttcttccttgttgaaaatactaataataatggctaagttttattgaacacctactacatgaacatatattgtgctaggagttttgcatatattctctaatgcagtcttcatggcaatcctgaaacataaccatgctgacaatggagactgataatttgaaaaaaaaaaaaagctaatgtttattgagtgcttacttctacaccaggcagatacatcttttaatttagtctcaaaacaactcttggaggttggtagtattacgatgcccattttgcagaaatcctgcttcttcccaggacccgcttggctgcccactgctgggagctctggcctattgccatgcatgttctggggtcacgctgctttggtgaaatgaccagaatccaagagcccacaaatctaagcaagatgtggtagttgattccttccagaggaaggcagagctccaggcacagaaagagaggctgctactgcttaaaacaaggtagcctagaagccccagccactctacccccatctctacttgctgaactccacaaaaccacctccttcacaaagtcttccctgttcctcccagtagactgtgacttctctcctcatgacccagctctgtctcccacagcacctcttataattctcacatcacacatttaaatcacgtatctttcggtcacaagctcttcagagtggcacctccctgtgtgatgcttcctagagttccttccacatcagaggcttaataatggtttatcaataacattgacagtactagtaaaaactattctttattaagtatttactatacgctgggcagaggcacagacaatcttatttcatcctcacagaaacccag

SEQ ID NO: 31885 - DNA, 1312 bp, Bovine  19866881218771
ctcccatagggagtgggggcggctgtggaccctggttgcccaccatagctggattgatgatacccctgggtagacgggctgtggctgcccaaatggcggcacaggtggagctgactggttaacattcattatgagagcatccccgacttggtctcacctattagatgggagagaagatagaaattagtcaaaatcaactttctaaagtgaaagcactattcatggtaggaagcagagctagaaaaggactgaccttatcaggcagtgattagcctaatcattctcatactattacaggatctttgtaattttcttccccagacagtagacagactgcctcctcaaagcaaggattttgttactctgaaccctatgctttgtcactgccaagagggtataaatttcaacttcagagaggcccagtggaatggagcagcagcctccattccctagtggtatgatttctagtgtctagtcatacaaggagtcctgccactgatgaactattgtgatattacaggtaaatgaaacaatgttcccactttctgttcattcactctagcatccattcattccacaaaactgaataccctgcagtgtgctagtcatttttaatcattcaaactgcatgtctaaaacagatcaactaaatcccctccccctcaaaaagacaaattttagagtgaccatttagaaaaacgacattcttaggataaactgcagtaaatcaggtgcttactccatcctcagtcttcccaccaaaagagtgtatggaccttagtactgaagcattaaaatcactaaatgtaaaggacagctgaaaactctagcaagataccagattagaactgagtgcaggtttggcacaaaaacctcacacaataacccagagaaacagttcaaagatcaatagcaaagttggatttcatgggaaaagatcattcaccttatccttcaagcagaaggactgtaattattctaaatctcaaggcactcctccaactctgtttctgctctccttataggcttgtcatgaatctaggccacatccaaaattattacaatcttgcccaacaacagaggaatgaattggagggtctttccaggatccttccaagaacaggactatctgatcacatctactctacacaacctgatcattccaactatcctacagaagaaggaacccaggaagcaaaagagctcatagctgctgcagtggaacaacgggcctctcgcctgtgctaggaagggccatcttaactacagaaaagctgagctgcacttgcactagaactttttaaattcaaag

SEQ ID NO: 31886 - DNA, 822 bp, Bovine  19866881246484
agctgctcctgtcgctgctacagtgtgatatcccagatcagggacatcttgagtccccgcagaggtggcctgcagacgtcatgagccattaataaggtcaccagtgatcccagtttcccgggcactaaggtaactccccaggatgtagaactttgggctctaaaactagaacagtcctggacgcgttggggttggtgggtcactctcgtcacaaagccttggcatgagtgacggagtcagagccacatttggccctgccccagtggtcccgtgagaacaccagcttaagtttgggcctggccagagtgccaggggacatgggaaggcatggcaggccagaccactgtgaatctctgtccggctctttggtttggcctcctgggattgctccctttgccttcagtaagagaccttaggccaggttctcagaaaagtcggaggaatgttgcagctcacagctgagcgagcacacccgaggcaataagggagcaagcaaacctttggtaatcaagaaaagaagagaaagcagaaatatataaggcagcaaagaacagtgccttcagggctgccgggattgagatcaggtcatttcagttctggtgatactggcagagtaagcggctccttcactgctgggctctcgaccctgtagccctggtccctagaacatcttccctgggagcagcgctccttgtacaggctgttggaaggctcctctggaagccgcaaacccaggtctgtgccccttcctggggctttcagctgggaggcctctccgccagcgtggacgtggtcccaggtccacagcaacccgaggcatcg

SEQ ID NO: 31887 - DNA, 2229 bp, Bovine  19866881288117
tcatgttacaggccccagacgtggcttccaatgcctactgtgaaacagtatcttcccccttagcattaaacatgcagagagacccaacatgtcttcagacccaaggaaattatgcgaccagcattcagtacctccttcccagaactgcagaggaatctgtctgtcccacgagtgtgaaagaaagaagagtttcaggtcacggacaactaaagaggagaaggagagagtgggagtcagcgctgtgggggtgagcagcgcacacagctggccggttgctgggaactgttggctaaggacatagcattgccacttgactggaagcctgggatgaagtcccaggaatagcctggacttctgaagccaggacagtcatagacaggaaggcaagacaagcatttgaggtaggaattatagtttacaaatttcatccgtgaatctctagcatctagaaccgtacctgacgcacacaaggcccatgataaatactgagtgatttaataaaggaatgaacaaatgatttcacacacgactatgacctcattcaaagtgaggcacagtcagggcaggcgttgcctctttttgtacgtggtcaactgagacccaaagaattaactgtcttgcctgaggtcattcgacttggacgtggctgacctgtggctagacactgtactttatacatagtaccaagttgaatattcttggtacagcatcccaggaaaacatcctgtgactctacatgaacttccctttgggtcctgctagtcagaaaatagcccttcagtgggccagcttcctagacacagtctcagggccaatttcggcatccgggtcctccttgcacatttggcctccgcctgcttttttatgagtctctccaggaaacagcgcctctccattagtctcttttgccacatctaacttgaggggtctggactgctgagatgtggaagcaggaggttggtgggtttattctgagagtcaggaacagaatgaaaccacatatattcagttccttattttctcacacttgatagaaacctcagataccctagaccactaagttagtttcaggaattcaggcaagagactaactcataatatagccggggcctcccgggagctcaaagtccatggtccaaggtgtgtttccagaaggaggtctccaaagccagcaagagggctcccctaagcaggaacatcttacatctgatccttctcttcagagtcttctgttctgaatccttctctttggaggcagtgaggtatagagcacaggaccaaggatgagaaaatctggattctagtgcttgctttcccacttatcagttatgtctcttctctccacctcattttcctcatttacagaatgggaaaaacaatttccaactatgtaaggcagctctgagtttaaagaggaatggtttgtatcaaggtgctttttagcaaaagacagaaattatgtcagtactatttttttatggcaaggcaaaaaagaaaagacaaaaaggaggagggaaacttctagggcgccccagaatgctttgttctcacttgttcatggattccttcataataaagcaccaaggtgcatcaggtgctgagggagagaaagatacttaagatgtagtgtctgccctaaaagaattaaaagatgactgtgcaccaaaagatgaacacagatttcagagagcaccccaaaggtcacagagtggaaaagaaattctatcttcacagaagctctaggattgttcaaccaggtgaagaggccacaacaggaaggagggggaagaggagtgtcatggtgcataacggtctccaagtctctttgtccgggaggaaatgaggtcatcctgctctcagaatcagcatgacagcctccagccaagtaatctgaagtcatgagagctgccgggagagtgttgtgaatcacaagagtcagctgggaatttcctgataactaacctacaagtttcggggtaagtcctcaggctgcaacatctctgtttacattttgatcacgtttatttacaattagtgggttctaactccaaacaaagcataccacgatcttctagaggaagtagcaaaactggttcggagggctctagcattctgactcagtacgtgaggctggcagctcagagctgggcacagagaatccctccagaggacgatgggtcaccggcctcacaagctggatagtgagcttgtactttccccaggcagagg

SEQ ID NO: 31888 - DNA, 1010 bp, Bovine  19866881293814
ctatgggaaaatgtttatgatgttataattcattctaaaggataaataaaaaataataagtacactatgattaaaacaaacccctaaatcattattataaggccaaaaccctgaaagaatataaaacaaaatgtgtttattaatgcttgcaaaattttgagtgaatctgtatctgtatgctctgtcttctaattttctgaaatgtgaatataaaatttttatcttttaaaaagtaatattaacatattactctgggttacttaggtgcagttatttcctatcaaatgattttagtaattatctgtcattttatactaaaatctttccaaaaagtaatggttaaaaatttttttttaatttaaaatactgtcacattaaccagattgtgtgtatctttatatgtttttactatactacaaatggtatgtatacttaccctttcttcaaaatcattcctatgtagggctttggatgtcaatttttctttaactatatcatattacaaagtaatataaaagaagcaaacttttatataaggggtagtgaaatttaccctattatcaatataaaactatttaggagtgttaaatcacaaatatgaaccagatttcaatgcagaaatttatgaaatttttaaaacccagaatggaaattttctcaatcctattatttaactttttattgagttttaagaagaaaaactagtttaaaaaatcccaaatgcacagtaaagcagctacaataaataatacaataaataattctcaagaattaccagtcaggcatgagttaatgaatacaagtttttttctctcaagttaatagctcagaaaaaagcaagacacatataccactgtgtaatagccagtgcttttgtagacaatagacagtctgtatcataataaaagcctttcagatcagcagctagttctctagagtttctcagatcaaaacatgacagaatatttccagatgtattgttcaccagagtttccaacaaaacttagcca

SEQ ID NO: 31889 - DNA, 759 bp, Bovine  19866881352129
ccccaacttcccactcaggtctctccagatccccttcccgccagctatcatcattgagcagatgagggttttccactcaccaatatcattgtggtgagcaaggctctccgcactatagtcctcatgcaagatgagcttttccacctcaaactgcatctccccacgtgtgtcggagttaagccgtgactgacccaagtagacaatgtagttctccttctttgggtgatcactgtggggagatcagtcagacaatctgatcttgtgagagcctgtcactctcccctccccaccacaatgacctgagagcatcacctctccccaaggccatgggccatgtagagagaggctgagggatcagaaataaggagaatcttttgctgggaaggaggaagggattcctttgggcagaagggtcagggccaagaaagaaggaacatacatgaagcagtgtgtggcgctgaccacccagcagggactgatgaggctgccaccacacaagtaggtgatggagcctcctcgatgcctcctgtagatggctgcaaaccaaggctggttctcggtgttggtgacctgtcccccaacaatcttaaagcgaggcctcagagccttctggccacattggaactcttctttctccctaggagaggagggactttttcctggagaagaaagaaagggatgtcttgggcagggaggtaggataaagtgttttgctcctggtcctctgaccacccagttttcagggccaggcaggcctcc

SEQ ID NO: 31890 - DNA, 1053 bp, Bovine  19866881365680
tatttgatgagagggcagctaactttgaaaaccattcaggaaggcttggggccacagcagagaaggcggctgctgttggaactgctaataatcaacagtggaaggcattcaggcctcagtgaagacagcccgagaacttacccccccaggtgagtttcgctccctttttatcatgtaagttcacaccgtagtgagtaaaggaggttaactacagaacagtttctatacatttttgaacacttattattataaaatatcatgaagaaaccccacatttacccttagtgtcaataaaatcatttttatattgtttgaattttttttacaatgatatgattagttttgaaagtagaagaaactagtaaagtaccccccctcccatacagaattagagaaaaatttgataatcttgagaggttagttggttttgattttagagtttatgcctttccatacatctctttgaggctatttaaacatttttagttgttttatacttagttttcttttctctttaattatataaccaagatataccagactgtgaacagaatattggaagagtgggaacaaaagaaaacaaatcggacaggaattaaaattctagtacatgatagacgttctttaaaaaaaatcagttcaatgtcatttagtgtgatgtttgtgcattttttttctttcagttgaattatagaaactttattattttttcacttatttactcagcatatatttcttaaatgcctgtgatacattagaaactgtcttggctttacagatttgtgatactagatgtggtgggagcttgtaagcagagacaggggacatttagcatgtcccttcattgttcagcttttatccatgtggcatgttaaaagttagattctcttgaaaaatcaaacatgtccgtaaaacatgagtgtatctaactttcgtgaaaaagttccataaaacatgaagaataaaatatagaatttctgtataaaaccgagattcctaaaacacagaaacacagcagtaggcttaacacaccaactgtaaaaagaaccagga

SEQ ID NO: 31891 - DNA, 1396 bp, Bovine  19866881382713
cccttggtcttaatatggatgaagaaataagctctctttccctatagtagaaggttaagatcggttttaaagctgcgcactttgaaagctgcaggtactatgcttccatctcagcgctcaggacaacagcagtaaatccagatggtggtttgacttactctattcttctgagacctggacggtgccaataaaaacagctttggtggaaacttttcctggaaagaatttttcaccagcttaagacgacaagtaggaatctggcccttcaaataaagaaactacgaagtcacttattcaacagcagcttttttagggtatattgtaagagtaaagtagcaaagatccatgcgaactatactttctttaggataaataggtgaagataactgtcagctctctcaaacataatgtctgctgtacgtaatttattagaatacatttggcttctaactaaacaagaaacatatccttcaactcattctcttaaattttaagttcaaacagcacatttgctgtccagtccaatatgataaccattagctccgtgtagttatttaaatttgattaaaattaaaacttcagtacatcagttgcattagccacatttcaagtgttcacatgtgaccagtggctgctatatgagacagcagaggtagagaacatggccatcagtacaggaaatattactggacactactgcagtagagtgtgttcatgataattagcttctgggaggcaagtaagaacaggagctcaagattcaactggatgtgggtttgaatcctagctctgatacttactgtatgaccttagataattatcataattatcatttccagacattcttgtctaatctgaaaaatggggataagtatttatagcgttgattatgaggattaaagaagataatgtaagtaaagtgcctaggatagtgcctggcccacagtaagtattcagttttagatattattaattcattcatctttaatgagtaaaacactttgaagctgaaaattagttattgtgaaagatgctatattccatagatggctcgcctgaagtcctcaaacctgggtctcattgcgttcattacaaaagttccactttaatccgtactttatatttcaggtgaaaattttattccacaaaaggtatataaatcgcagatcttatttctggatagccctgttcctttttttttttttaacatgtcagagagcagaggtaatagttaaaaatcagtaggttctgaatagtaagtctctgtatcccagtggtgctattttaacactcaaatggaaactgacacaaagcaaacttactaaacaagatatctgactagataaagtggaaaaatttagcaggttccagatatttatctggaaatggctaccca

SEQ ID NO: 31892 - DNA, 791 bp, Bovine  19866881395626
agcagctgccagtctgggctactggggaactgagtggggatgatctgtccagccaagactcattaccccttggtgaggggcccccatagccacaggcctgtgtccccgtatagggccctatgggggtcagactcagggggagaaggtggtcatctcgagtgagacccgctgccacagctccttggtctgtttgctgcgcttgagattctgcaggatgtcgttgaactgcatcatacccatgggtgtcaggcagaaggcgctgcgagcgctgcggatggcattcacaaagtcgtcgtagtcggcaggggtcaggtgaatcaggcggtggtggatgtactggacgaggtgaggaggatcagccactgagcacaggatcaggcccctccccctgcctgcccaagtgtttcaccctgctccgtactgcccaggtggtcacctgcatgtatgcctgctggcagcgctgcaccagctggtggaaggccggggcacgcaggtggttgtgggcgtgagcagggctcagccgctgcagcgtctccatgacgatctcctgcagcacaaacgggctcagcacccccttggctgcccccacacagaactggtgcacgtagttcactcctggggggcaggggaggggcatgagacgggggtggccacctctgccctagggacccagctttactctctcagctctggcctggcagagagcctccctccaccccaggagctgaggtcaccccccgccccccgcgcacgcacacatacccgaccaaggcctcaactctgagcaagag

SEQ ID NO: 31893 - DNA, 1751 bp, Bovine  19866881459192
acttaggctgctagaagctcgcagagcaaaatttaatttatttattctcttcacatttgtgctggggcctccctttctctgggacaatgaaggtcaaaaagtgaaaagtcacttagtcgtgtgggactctgcgaccccatggactatacggtccatggaattctccagaccagaatactggagtgggtagccattcccttctctaggggatcttcccaacccagggagagaaactaggtctcccacgttgcaggtggattccttcccagctgagccaccagcgaagcccatgaaggccaaggtctactttaaaagaggctgttcagaacactgggtaaataaggcaatttatctctctctcttttagatttatctcattttataaatagttgcattagcataaggtaaccatttggtcaatgctacccacagacactggaccgggccattaacaataaagaaccttccaaactctggaagagcaactgaggtgaagtttttcgtttattgctctcattgtatactatgaaactcattctgctggaactcagataaaagtaggtaaacagatggtaccttgggaaccagagtcctaattccagtcataagcaaacattgtgaggacaatttcaaaacttgggggcaatctacctgcatcgaagggccaacactgcaggtctgcactgggccaccaacgaagttgtcagaaggcaagacacgcgggcaaggacacgcccggtgcacgtcacacttccccaggcctcaggccattcggggggtggggggaagacagctacattttcctaagaaatccactagactcatcagcaagcttcaaatcctggaatctgggcgagagtcacctcagctatgcggctactcaaaggtctccgccacgtgcctcagcccccaaaacttctgaggaaggcataaacgaccaaatgaaaagtgcagaaagcctccacatgagggggactggtggcaccgggaggctccagaacacccaagagaaggggcgggcggcagttctcagcagccgagaggctaatgcctacctagcgcgcaattcaggctgccgcccagattaattacctgatggccgtcatagcttcaccttccagccccaagcgacagcgctcgcgtccgatgctctgcgttcgcacgggtggcagcagcaggtaccacagccacggcttctgggctcaagcactccgcgacccgggagcgcgtcctcacacaccccgcgcgcgggcggcccccgcctagccggtcgctcacgctgattggccgcgcccggaaggggcgggcgctccgccccgggctggcggcccaaggacctagccagggcgccgccggccacggcaagccgcctgtgcgtctcgtgccggcatgcgggctagcgggctggctagcgggctcggtggccatcttgagtcctggtaactgcctatccccactcccggcttacggtgcacgaggttgggtgcccgcctcaaaaatggccgccccgaaaggcaaccggtttatcagtcacatggcgcggtctacctcggccagcccaggtcactctaacagggcttgggacgggggcgatgtcagggcagtcttcggagagggggtttaacagcctaaaaacccatctgcagaaaaaccgcaaccgcctggcaacctcagtccggggagagtggatcgcgtggcaatagcagcacgatgtgttaaattagaactcgcagccttctaagagtcaagtg

SEQ ID NO: 31894 - DNA, 1251 bp, Bovine  19866881903988
ccgccaagaaaagaaagaagagcatcccggggcaggaggtgggtgggttgcagccgaaccttatccggctcgtaggggtcacgcagggtcacgcacggcgcccgagagcctgccgggagctccgtgcgcaatggcgacgccaagcctccggggtcggctagcacggcttgggaatccgcggaagcctatactgaagcccaataagcctctcatcctagctaaccatgtcggggaacggcgccgggagaagggcggtgagtcctcagccttggaggccccagagcggaagctggaatagtgacgaaggctactgggtgggagggtcggaaagtaagggtttctttgtgactgaggatcctcccgttctgctcctccagaggcgacctgtatcacggagatgtcgataatgatggcttgctggaagcagaatgaattccgcgacgaagcgtgcaaaaaagagatccgcgacttcttcgattgtgcttcgagggctgaggtgacaggaggcttctggggtgcccttttgagaggaaaatagggggcatacagtagtggttctttctgctcttgcttcattctgaaagggagaggagatttttggaagctacttgatcacgccagagtgggaaaggttactgttttgaaatcgctgtgatgctgagagatttgtttcattgctttcagctttaccgggtgcaaaatgaggttaataattaatattcgttttatagaatttttttttatcaagtgaagacatgcatgggaaagccactttttaaagtttaaattgcttttcaaatagacattattgtttaaactagagacagtaaaggacagattgtttagtttccagactaaattgccgactgggaattgtatactaaattgtataatttagattttacaatcattcgtggatcccaagtcctatgaatgaaagggaactgggaagatgacacagatctccaggctgtaacaccttagcgtaatttgggttgtgtgagaactattagcttaggtcagggccaacttcagagctgtcattttaatttttgttctgtgttttcaggcagcccgaaaaatgagatcaatccaggaggatctgggagagttggggagtttacctcccaggaagttgaataagctgttacagaggtttcctaacaagcctcacctcagctgaaaatggaggagcattttcaatgactggacttagcttctgagaattaaacagaggcattttagagatat

SEQ ID NO: 31895 - DNA, 1691 bp, Bovine  19866881922288
cctgagttcaattcctggctggggaactgaggaccccacaagccaggggcagccagaaaaaaagagagagagagagattcaatatctacattacagatctattaattatttagagaggatgctttacaagtcatttcattcatgacggaatggatggttttaaatgactagtgaatagaaggcaatacatctgatagttaacagccaagcagtgcccttaaaccgtagggtgaggtttcaaccacagagactgcagaaaaagatccttggaaccataaacagctggagataataagcagcttgtggtaagcatatggatgagatgaaagtaggctctaacaatttaatagtacttaacacctccaaactctattaggctttatacattcattcaaatattaatctaaaactgaataaatattagattagaaaatccataaagcctagctcaataacctatttgggtcttatctttatacaagtcaactttgcttcccaattcttattagcatcatcatttcatctgcttaattaagtattctgttggcataaatggaaatctgcccaatgggaactagaagaaaagagcttttttgcaaaataattacctttctgattcagggaaagggtgaaccaataatctggcaaagaatgcccagttcactttggtttattcctctgtgatgagaggtaattaattcatgcccttcatcctttagaggaccagaaatgcttcaattagtcaaaactatcagagagtggcatatgccctaaatgttgcagtagttatctcagaattatgagattatggaataaattctttttttttttcctccccattttccttctgcctggtttaagtttttttatgtatctatcagaaaagtaaaaccagagggttacctggggaggcattgggatcacggagccaacctttagcctggttcagtttggagtctatggaggccaatgctctcttcatggcttcagtgtccttttgaagaaaagtatcaattattttctttgcaaaaactgagataccatgatacaaagtaagacagagaagaagttacaccattaacatacaatagctacagtagtcctacaacagccttaaaaatattctcatcacaccataacgcttatttctgtcaaaatgcaacatctggcatgcaaatcttcagttaattctattttctggtctccctattactaaactatgaaaactggtaaaactgctcacgtcaaagcagtttaatattatcagcaggaaaaagcccttttgtcacatgcctcattatcagcctttctactagtcaacgttcatacactgcagccctgccaaagccttcctggcttcagagaagcctcattaggatgtggtgccacaaatcacagtttctcttacatcttgttttgaaatatacacattggatgatatttcaccatgtttaattaacccgaggaacctgaaattactggttagaagaaaactgaaaattttaatctagcaatttagttttaattccacaaataaaccactgaatgtatcacaggaaagaaatacattcagccttctctgccactcctcatccgtagttccctcaccacccctaacctggaagaagaggcaggacagaataagggggtctcagtctattgtttacaatcaggattcatagtgactagca

SEQ ID NO: 31896 - DNA, 921 bp, Bovine  19866882150089
aggatggcccctggaaaaagaagagggtcctgtgaattccatcaggctctccagaagcacgctctgttctcaggcagagtgcaacagctggcaaggggccctccttgggtaccatgttcatagctcagctccagccatgagagattgtcccagtcggccgattaatgggggtgatgactaaggaagattcactctctctctcctgttgtgatggggcagggggcgcactgccaaaagatacgatttcaggacgctggcagcctggcccaggaggcacaactcaccttcagttttctccgggcattgaacttgcgtaggcactccactgtctcttgacgatgcatcatagatgccaccgtggaccgttgctggaagccaaacagacaggcctgtgagcccccaggcacatcctctgcccctcaccatagtcccagcaccggtggccttgtgctcagccaccctagttgctccaaagataagatgaggtcatagatgtgaaaatgcttttacaataaaagctctacccaaaactcaaggttatgtaaggacaataatttgaacatgaaaacaccgctggtaattgacgctggatgagggtgcccgagagagcgttccgatcttccttaggggatggaggcgatggaaagtgcgagtattttgtgtgttgtgatccgcgagcagttattccttcacctactatttagcgagcacctaaagcactccaggttctgggcagtgagaaaacaggaaggggtcttgctctctacagagagcattcattctttccaaaagctcctctcagcaggcccctgctgctactgctgctgctgctaagtcgcttcagtcgtgtccaactctgtgcgaccccatagacggcagcccaccaggctcccccgtcccgggattctccaggcaagaaca

SEQ ID NO: 31897 - DNA, 1621 bp, Bovine  19866880210070
atggcatcactgactcgatggacttgagtctgagtgaactcccgggagttggtgatggacagggaggcctggcgtgctgcgattcatggggttgcaaagagtcggacacgactgagcgaactgaactgaactgaatctcctatgcggagaaggcaatggcaacccactccagtactgttgcctggaaaatcccatggaaggaggagcctggtaggctgcagtctgtggggtcgctgagtcggacacgactgagcgactgcactttcacttttcactttcatgcattggagaaggaaatggcaacccactctggtgttctttcctggagaatcccagggacgggggagcctggtgggctgccgtctatggggtcgcacagagtcagacacgactgaagcgacttagcagcagcagcaatctcctatagctttaagaagcattattaacaaatcgaagtcattaaatcagtagctgactttttatcattacatttgcttagtctctttttctctctacccatcactttatcttttcattttcactgtctttgtcacagcagtgttctgatggcttaccttagtaacaacagcgcttgaaaaaaatagcatctagatgtgaataacaatatccagcatactcaatgatccagattaccatcaatgccatgtggagaggtcacctatgccctgagtctagtgaccaagtgccagcagctctgtttataatcatggttactactcacaatactgcatttgacacgtagataatgcattttaaaaagatagtgatatgttgcccagtcgatttagtaggcaatgtttatacttttaaccaccaaccatagttactttggataaaatatcattagtattataaattttccttttcataaaaaagtccattctacaccagtaagaccacaacccccaccattcccctggcaatgctgagatgtacggggatttaaacagatggagtgtgttatgggaatgcccttatttatgacctaaaggcatccttctttcccttgggatcaaaggtgaagttattttccatgctaactctgtcctgaggcagagtctatcaactctgccacatttctgctgaattatatgatggttttgaaatgtgagttgatgttcccttgagatggtgctttaatcaggttcattacaataaaaaaatgaaacctagactaacaaaataaagtgacagtattttataggccataggagggaagatgcactgaataatacttaacagatccttaagataaatttacagtgaatgcaattagcctcatccctcctcaaaataggctgttgccactctcttaagagaattggacgtagtgtgcttcacatgcttcagtgctttgtgtacttcacgtttaataatatattagtcatgctgagcttcagtgttttagatattttgatcctttggcatctctgcaatcataaggcatcagcaatcacatgaataacagttatttcatttttgtcatacagaagtaacagaaaacttttctcagtaacttaaagagtaatggggagaatttttcctgtaacatttatttttcatgacacatactaagtttaactttttgcattattagcca

SEQ ID NO: 31898 - DNA, 1672 bp, Bovine  19866880376713
ttctgaggaagccatttgaaaatatttgccaattatctagttttatctgaaaaaaaaaaagtcacacaatgagggaaaagaaaatctaccttttgtcattatttacttagtaaaagattcattctatctttcctctaaaatgtcatggcctaatattactctgtgacacaaagtcagaccctcatcacacacactgtcattgacttcgtctctttatgctgtatcaggaaatccaggtgataaataattgacagttgcaatgactgaaaatgatttcaactctttaactctctgatttatttttttgttgttgtttatttattatactttataatctgatctcattgttgaaaacatgacagaaatgagctgaaaagcacacatcaacatgaaaaaatgggagagaagagaggttcagagataggaagatagggagggagagagagaggaaagaagagaatctggacctagtaggcaaagtctgtggtcaaatgttttggaagttttttttttttttttccttgctctgcctggatattgctcttccatttgtttgttcataaattcctaattgagcacatagtataaatatatataataacaagttggaattttaacataacggtaatttcaatgcaaaatctgtgttctgttttctttcatagcagaaaaacataatcccctttcttcccccttaccacacactcacatgaaattgaaatcttccacctgtattctagctgaataaatgaatatatttgtttcatccattctgttctttctacattcttcttccccataccgtagataggactagcttttaaattgctaaatgcttttacagtttaaaaatatggcttacatttgtacctcataaagaagtagggaaggaaatgttttatattatgactttaggtggtcaaaaatatttatcactgcagtaaggaaatagctgctgttaacgctgtcttttagatgcttttatggactcatataaaaaattattcatgtcaagattaaaactagtgtttggtagcaatgtggaaagtggccatcagcccagttaatgtgcaattctggtcattcccataagaatcagcaagggcatatcatcatgcgattactaaaaaaatgaacagcactgttcacaagagcttggcaattaattaaatgatatgcttgttcatcttgcaggtcaagcagataattgttctgagaattgctttgaaatcatgcatggttcaacttagctcttttgaatcccaggagagatttgcaggtcacactgcctatcacacttcttgtggatgagagactaatactagctaatcctgttagcatacacaatgggataagagatagccaaagattcacattacttggtacaagttaacacgcccattaaagagacgttgcatgctttcatctacttttttggtaggccagtataatataataataatcatattagatttcacttggcatatattttatgaatctttatggtgccatcatcttcatttgaactttatgtaactttttatctttataactttgtatacccaattatcattgcatagattaagaactagcactttctttcccccaaatagcaagcaattaaaaaataagtaaatattgggttggtccttaatgctaaaaccgtaagcat

SEQ ID NO: 31899 - DNA, 2299 bp, Bovine  19866880392506
gaattggctgaggatacactctggtatctgaaaacactatgaaaaccgtgagagtcagccttcttagaaacactatctcctaggggctatcttctgtcctcattcctgggggccacttccattctggcttcagtcattcttcactctaactatagtctcagtgttttagttctgcccctcagttttcaaacatacttgaatttggattgcatcagaatttcctgtcctcagaatcatttacagcttctctattggctccttctgtgcttcacttctcctctcttgattaaagtccaaggtccatctacaactctaacttcccttttcccagatttcttgatatccctacccacttgcttggcaaagctataagaggatatcagtccagatcttggcttcacacctgcacacgcacactgcattcatggtcaacaaccttaacttagccctgaacgaggacaagcggatgaagttctgtgtcagttcctactcctgcttctcatggttaaacattcacctgctctctgctgctcaatgtgaagttttggttccttcaatgctttgctcagtcaccagaggaactttataaacaaatggaagccatcacaggaaagtgccacaacttccttcactgagtctatccacttgggtctttagttctacttaaattatacttcccattgggattcaaattacaccgtcccattgggctatggggaagacagcagtctcctttagactcgacacccccttctctgatttcactcttctacttcactatgaaatttcttaaaagaagtgctttctccagttcacctctgaattgcctcccaactactccttctggtcttgaaattcaccactccactataggtcctcatgaaaatctccaagagttccgtgttgaaagactcttagttgttctcttggaagatttcacaatgttgcatttgccccacttactcatctcctctcttttcttggctgtcttggactctgctgctgctgctaacacgactctgctgttgcgtcagtcatgtctgactctgggactccatagatggcagcccgccaggctccaccattcctgggattctccaagcaagaacactggagtgggttgccatttccttctccaatgcatgaaagtgaaaagtgaaaatgaagtctgctccctaccacatggctagcactcagaaggggcacagcaaaggatacataatggccactgatacatatgcagtgcatgacttaacaattaatatatgaatgagagatcctgggtcagagtcaccattgcttgggcagttttcaggcttcccaatggtcacttcagtcaagaaacaggtggagtcttgaattccttctaaggcagttcatttcatattaaattcctgagaagaggctaaaaccacattagtctcttaagcactctatatttaggatatcctagaaacagagggaagcccttgcgtttatattatgcagctttcaaagctgttgcacttggtcagaaataggaaactgaaaatggtgagacatctctatgaaggctcaaatcacactattttgcaaagtttaaaatttgtttgtcattatccataaattacagctatatgttataattatttaatctacatttcttgttaaacatctaaattatgtcacttcaccaatttacaggaattatgtgattaggtataattatcctaaatagctgaacacaattaaaaaatcttacatgcaggaagtgtcatatataatatgttcatttttctatgttaattttttttctcttgtctcactgtccttggtctctatcaaaatgagataaaggctggttcactttgaatggggtaagggaatttcaagctttcggtgacttcctactcagaggtcaaacacagcatttctgtccttctagtaagcacatgttcagactacttgtacagttagagttcatgaatcttataaccagtagtatcaactgtgatgatgctgtggttttatttactgcttgaaggttctatgcaagacttaagagttggaggtttatcttttgatttctctgcttcggtgacttgccagactgctgtctatatctgtttccttgtgagacagccgtgcgcacgagtaagctcagtgaagcagagacctggttcagattcattatttactagaatgtgtgaccttggatagtcttataacctcttgataactttgttctccatctacagaatatggacatggtaatggacaatagatgtggataataatagcacctcttagtgtagatctg

SEQ ID NO: 31900 - DNA, 1714 bp, Bovine  19866880406929
aggcgtctggagagtgtaacctgacgcatggaaaggaccgcgcggcccctttaagtgttctcgggccgggaaagagagggaggaaactgggagccgcggggaaggtgggggaaacccacaaacgaccgagccagagaaggggcagcgtgagagcagaaacttcagacgctgctgatcccgacggagctcgggtgagccgcagcggccgtcactcccacccgcagcggcacgctcctcgcccctctccgctaccccggggaggtccgggagctgcctccctgccgctaccacaagcctgggctgcgggcagccgccgcttggaactttgggctccagcgtcccagccgcggagagtttggggtgctttgcgcacacgccccaacggcgaggggtctgagggatggtgagcgcagctctgggctgggagcgcccgggaggcgtgagtgtgtccgcggaccggctgcagtccttagtgccctccgcatcccccaagtgatgggaacaagggcccgcccagggaaccgctgtcgccgcaccgcccccttgctcgcccccagcgcgcggagtcacccaggcacacccccggcaccctgtgcctgctctccagaagtgctgccgctgcctttgccgccggcgcgggtggccagctgttgactgggctcgccgatagacggagaagcacttttcggctcgccctaatccgttctcacaccccaactttgccgccgcgccggccctcgccgcggcgctcgggcgcacagtgtgggggcgcacgccgggaggcttggagagatcgaggaggaaggaaaccgcacaactgctcttctgcttcggctctttgttgttcgctttggatggtccttggaagtggccgagccgcctcggaaaccctggcgccagagaaggcaaaccttggaatccttagtctgcaaagggctctgagatattgacaagcgtccggaaaggtggaccagtaattgccctgaaaactcctggcggattgacccacgttgcttatattaagcctttgtgtgtagtgtgtgtggtgtgtggcttcataaatttggggacctcatttttactccctcctcttggcatgagactgtatgcaggatccacccgaggacaatgatcgcggagcctgctcacttttacctctttggattaatatgtctctgttcaggtaaccccgcgtcgtctttcttcacccttcattccccccttgcacgcctcctctccactttcccgaatcaaccccgaacggaattttggcgacctctgcttccttccaaggccggaggggcccgacccctggcaggagttttagacgaaagggttcttagatggtactttgtgctgtccttattcccccatcccccaggaccctccaagccttttcgcagacctaggccttttgccaagttcgaggcacgcccagatctctccgggcaaacgcacgtctgagcgcggggtggaagaggcagcgggtggcggtgagcctgggccctgaggatgagccaaagtcagtccgttggctcggccgcgtccctggggaagggagctgtgcgcccagggagcggcagcccagaaacccgtcaggattcctgaacctggtcgtgctattcgcccctcctcttccgagcaaacgggttattagtagttgttttatgtaaccaaagtctgtaattaaattcgatgctaagaaacttcagga

SEQ ID NO: 31901 - DNA, 1150 bp, Bovine  19866880456188
ttcactcaaacccatgtccatcaagtcggtgatgccatccagctatctcatcctctgtcatccccttctcctcctgcccccaatccctcccagcatcagagtcttctcaatgagtcaactcttcacatgaggtggccaaagtattggagtttcagcttcagcatcagtccttccaatgaacacccaggactgatctcctttaggatggactggttggatcttcttgcagtccaagggactctcaagagtcttctccaacaccacagttcagaagcatcaattcttcggcgctcagctttcttcacagtccaactctcacgtccatacatgaccactggaaaaaccatagccttgatcttgcatactttgacttaaaaggaaatcttggaaggcatttaacttatatataatgatctgtataatagaaaactcttttaaaattgctaataggtaattctttttctctccagcagcccactgagaactcccctttcttaaaatgaactatatgttcactttagcaacaactctttcaactgtccttgatgactgctgttaaagagtcctcctaagagttgcttctctattctatttcttaggatatagattttgtgtaaggagaaaacagctgaaataccaaggcctactgaaagatcccagcatctaaatactagtctcatcatctgtgtactttttcaactaagagttgattacaatgaattgagaatagagggaatataataacagaaattagatgttgttatagggaaacagatattgtatatcaagaaagaccagttattgatacaaaaacataaggacatgaaatgagactgtgataaaacttggttcagcagccatatgttgaagataaaatgtggggaagtaccaaccttattagaatcatgccctcagcttaactttcagtagcatctggcctagaaacattaggtccctccttatagcccaagttgtagtcagtgttaccaaattatttcacaagaaatttgtttaattacttagcagcacctataactctgctctccatcctgcatatgagacttttgaaaatctgatcatgccacaactttcaaaacttatgtcccaaattctttgctagaacaagtttatcttaaccaaatgagtctga

SEQ ID NO: 31902 - DNA, 2542 bp, Bovine  19866880458743
tgtgtcacaaaggtcaataacttgaagctgtagcaaatgaagagaaagtagattccttgatcgtatacattccagtgtaactttgttgcctcaagttcccttagtctcaaatctggggaccaggagaaagcactcagctgttccatggatgcttaaggaaacagctgaactcagctgtcacacacacatgaatagaaaagcaatttcccaggtaatcctttctcaaatcattccatattgaaaggttaaaattccatggtagcagaatttgaaaataattaaagaaatgacaaccttgattccattttgataaagatgatagaaattaagtgtgaacagggattataaaacagtgtgtaatctgagaggatgcacaagatcaatgtctataacttcaggtttggtaaatccaacattcatcctggcttttgccacagagaaatgactctaaattattccagcacaatgattttaactgtctcatctgtaacaatttccagtataatattttggttctaataaatctatttataaatttgaaggacactgagaaatagggagtctataaaattttatttttctcattttatggtgcagatgtgagccaacaaatttggccatgtagcttatttctgtcagttgactactattttccgattgactttgattttaaattagatatttaaactcataaaaatttagcccaagggtatagtaaaaacacacctaagaatataatgtctttgtaagcttgctattttgaaaagagacaagttcaagactttactgttcactaatcctccttagaaacgacctattatttgtcatttgaaattgttcttaggttacagaagtgttaaattttttgtgtgtgctagagctcagttagttttggacagtgtgataaagcagaacagcgtgcccaaagaaatgtggtaatgaatatattactgctctaactggttcaaaatccctgccaaagtagccacattctcttctatgaatctgtttaacactctcaccactaagattctcacactatatgtcagtttgatatgtttaaataatgtaataaaatgctgagcaggctcaaaagtagtacagtcttgattcatctctcattttcaccatgaagaaagaaattcacaaaattgctagcattaaaatttctagctttgttacatttactaatcacagtgaaatagaaacagagggcagaaatggggttttttgtgatgtaggcctgtacagttgagaaatggattcagggagaatgagtgataatttgaagacattttgaagacaataatctgaagcatttaatggctaaatatcatagagtagcactgtgacctgaacaaaacttatgggcaagaaggtcatgagttctgccagaaatttcatcagtcactgccaaggaaatttctttcttaataaatgaagccatcatgaaaataatcatcaaaataatttcctcatgaaatgtaatgcaaatttagagtaaatgatggtctgtccaaccccaaatttaattttagggagaacagttaagaagtctccaatatgtttcaaaatcattatatacagagttagagtagacagatatgcctagaaacagacatgctgctgctgctgctgctgctaagtggcttcagtcgtgtccgactctgtgcaaccccatagacggcagcccagcaggctccctcatccctggaattcttcaggcaagaacactgaagtgggttgccatttccttctccaatgcataaaagtgaaaatgaaagtgaagtctctcagtcgtgtccaactattagcatccccatggactgcagcccaccaggctcctctgtccatgggattttccaggcaagagtactggagtggggtgccattgccttctcccagaaacagacataccaagatcctaatccaatctttcaacctacatgtatgttgtgagaactgacataatctctctaggtctctgtttttatttgttaagtggggataacatttccccccccaaaaaattgtgaagatttaccacactgatcataaagtttgggtacacagatgttcaaatattgattcctattccagtgttgtaatgattattaatattggtattgtgattattgggctttcctgatggctcactggtaaagaatctgcctgccaaagcaggagacacagttttgatccctggttcatgaagatccccttggagaaggaaactggcaacccactccaggattctgggaaatcccatgaacagagaagcctggcaggctatagtccatggggttacaaaagagtcagacacagcgtagtgactaaaaacaacaacagttgggattattaaatttttattcccctgaaaattccttttttactgtttactgcacatacttctctggaatctcaccaaaaggaggaaagctctttcctgagagcacattacttgcttggtatagagcccagatcaccgtatgcagtaagaaatgtaacagtgacagtgaagaaatgctgatatatgtctatt

SEQ ID NO: 31903 - DNA, 1276 bp, Bovine  19866880468399
tagataaatgactctttgtgcgtactaagtcgcttcagtcatgtctgactctttgtgaccctacagggtctaggccaccaggctcctctgtccatgggattcttctggacaagaacactgtagtgggttgccatgccctcctctggcggaatcttcctgactcaggtattgaacctgaatctcttgaggctccctcaatgcaggcagattctttactgctgaaccactggggaagccctagataaatgattacttaactgtaattcttcaatttcccctttcactagaatttaatagctattgatagtttatctgactgtacatgcttgaagtatttattgaacctacctgtgccaactattaatacctttccaagtctagggaaacaaccatgaacaagatcagtaactgctttcatggaccttttcagactctgtaagagtagtaaaggataatttgagatagtattaactgtggcaaaaatttaaatgtagagaataatgtcaggaattgatggctagggaaatactattttggggcaaggaggttagcaaaaagttttctgaaggactgagatgtgagctaagttataagatgtaacaggaatgaggaccctgtcaatattcaggactacagatctccatacaaggggaacagcgagggcaatggctctttggttgacatgaacttgatgtgtgtgtgaactctaaagaaggctggagcttgatgaacaaggagatggtgggtttaaaatgagaccaaagttatagttacactcgaatagaagtcaggaaaaactcattctcctatccctaggactctaaattctagacgaaataaatcttatataaagcccattatagtagaaagaaattcaattcttacctctgcaatttcataactgggtgtttgggaaatttattgaatcccacattctatgtattttctcactttaaaattgaaattatgcatgcctaatgttaaatagtggtgcatccctgtaagaattgctatttggattaaattagtatatgtaaaaacacatgggtcttcccagatggtgctagtggtaaaaaacccacctgccaattcaggagatataagacaggagggttcaatccctaccagagaatcagataaccatcagctattactcacaagtaaatgagaagtcccattaactatagataaagatgtcaatgcccaatattaattcaaccattatcaaaatgttgcccaggtacaaagcagagtaaatggaaggatgttctgatgg

SEQ ID NO: 31904 - DNA, 1337 bp, Bovine  19866880479128
cttatagtagcacagaggacgtaatatgactggtttctgaagaaacacattttaaatagcaattcattgatttataggtggatacttgtaagtagagggaaaaaaccttttgcttgatattaaactatgacatgttgtccaaacgtgccgtattccttaattttcatgatcaaaaatatgttgaagacaataaaatacatgctgaatagcacagtagatttctaatttgtaatggcgaaatatataatcattcatgttctttccatgtgtaggaaggagactactattccactcttaaaattatagacccaatttaagaaaggagatacttaaattatcatgtttctgaaatttttctcctttttcaaaatggaaaatgggttacaaatatgcaggtgatattaaatgtgcagtgagacttctatcatgagaaaacataactaaagcatacccagacacaccttggattccaatacatgtgttgaaatccccagacagatttacaagagcaaaatgtattatctgttaaatcggtaaatggagaacttccccaatcacaaagcactattggcttcaaactattcttaggataaccaattatggcctcttgggatatcagtcattctttccaaatcaaatccaaataggagacagagaatgtactcaaatagcaccttccctctgacctttgcttgttccttttgatcccaatgactaacacacctgaatcatgctccatttctctgttccagtaataatagctggcatttatataatgcttgttttatgtcaaacactagtcttagtattttatagctactagaatgcttattccttgtaataaccttatggggtaggtagtagtatcattacaatctcattttacagataaagaaacagaggcaaagagaataaccaacatgaccaaggtcatgaagctgtgtaagcaaagcagacaggacttaaaccaagaaagtgtgttccagagactgtgtaatattcagtattcaaaaccacacacacacacacacaccagcaaacaaacatatcttatgttttttctgggaatacaaagaagaaactgataagtttatatgtagaatgctgtcaccacccaccctcttaattttatgttttattccttgcttgcattgatctgtagatgaaatttgataccatttcttcagtttaagaaagtcagaaaccagatttcatattttatgtatgcagagatactttcctgattcacaaccagaggttagtgctagaggttagtgattgcacttaaatgagactcatttcaaacaaagtcaaaagtaagtaatctgatttggcaa

SEQ ID NO: 31905 - DNA, 1256 bp, Bovine  19866880530755
atagctttgactatcaactatagtccagtaaaatttacaaaaaaaaaaataataataataaagaactactgatttctttgggctcttttagtaatataattttgccagagaggtattcaaacatgttattaagtttcatgtaaattaaatagtgccactatctttaaaaatctttactaatataagttgacaagccaataactccattagctctctcaggcccaaacagtgggatttctcttccttacaatggttaattcagattatttttattttcttcaatgtaaatgctgactctgataaggcaacattctccttggttatgtaggtcaaaagtgatttaattattctataaagatgtcattatgaattgaattacttctcagttatatagtgaatcttgtgattttgctagaaggtggaagggggggtgacttgcaggagaccggtaatttaattacttttcctataactgacaatatggtctgagttcatgataatcattttactgcaatgtttttttctttattgatgtttcttgaaacttaaaaattatgttatttaaaaatggctgagcattatatctctgcaagaaataccttgactatttatatttttgtagatatatagatgtatttttacatattctggttactttaggtcatctcctagttttcagtggtagaatatataacattttattatgttttaatatattttctcataaaatatgagacttaaatttccacagatcagtcagaacacttcagaacagtttcttatgctccattaaatacactgttggtttgtttgctgatatttccttttggttatttgttatcttccatgggattttctaatgtctgctagaatttcacagatcagtaatctgaaatgagattttgatgttcaaagccccagtcctttgctagatattaaatattccatgtgaaggtcaggttagggttgattcatagtacttgatacaagcagcagcttacagtgcctttaaatcatggtttctttattttttttctttcttttcatacataacttctgttttttgcattatcgaagaaaggcatatcatattttctaaggaaatctttgaaaggcttagattaagatccagcactgtatattttgtttttatggtactgtttatagcttaggactgtttatttctgaatgtctagcaccaggttttccctgtaagttctcagtctttgtttatttctcttccttcagtgtgatgc

SEQ ID NO: 31906 - DNA, 1608 bp, Bovine  19866880586255
tctcctgcatttcaaacagattctttaccaactgagctatcagggaagccctgagtatgatactggtacagaaattacaggttttgtattttcaaattgtttcagactgaaagcttatcacttgagtgagattcacattcttggttatcacctttcattaattcatgaattatcttaaaggaaaaagaaaaaaaaactattcaagtctgttcagtgttgcaggtccactgtcagacttcaggttaccaatgtgaaacagattacctgatcttcagggaattcaccgtctagtggggtaacagactcacggaagccagcaccctagtgccagtgcatttttcagtgccctgatggcttttatcaactgcagccacacctacttcaattcaggcctggatggctctaaataagcactaagtaatctcttgcctcatttatgttctattctacagctcacataatcaataccagttaacaaaaagtttaaatatcttttggactctctcctatggctcacatgctgttggtcgaatggttgtttgctgtcatgattaccttttgacagaaaggaagacaacaaaagagtgacatcttttgtttcctagacctaaaggtctggcataaaaagttaaagtgtgagtcactcagtcatgtctgactctgtgcagccctgtggactggagcccaccaggctcctctgtccatggaattgtccaggcaagaatactggagtgggttgccattcccttctccaggggatcttctggatcaagggatcaaacctgggtctcctgtgttccaggcatattctttaccatgtaaaccactagggaggcatattagtgattaaagacaatcctaggcagacagaatatactgcacaagtaaggtaagattcactgatgcaaagtctgttatttcctgaacctaggaaggggccagaatgttgatgagtagaaacaggaaagcaaattcagaaaccacttaggataagttacacataggtgaaaaatctacttttagcagacttaggtatcttgtttcaaatgatagtgaacttcctttccttgtctctgctgtttttgtaataatgtcctcattctcatcagagaagctttaataaaaaagcgttcgcaggccttatccccaaagtcttataataccattacagacaaattgacttagatttggatagatttttactgtattttcaacagagtggtgagatatatgtgctttcacattaaataaactatctcatcataaattgaaagtagtatttcctttgaaagagggcatctgctactataaataagtagtctaaaattaaagttgaccctaaacacactgtatcttttaaaactcgattgtaaacaggggtggtcccttaaaagccttttaatacatttgagcaagcaccttccgtttatcttcctacatgaacctcttttatttggttagtctatctgagcaaggttacttagtttgagacagaacatcgtcctaacactgcttcaaaatacacaaaaatgcctggttcccattccgtcttactgctgtgacttacatctctgaccaaaataatctgtgcatataaataagttaaca

SEQ ID NO: 31907 - DNA, 1572 bp, Bovine  19866880594830
ttgctctgcgtgacaaatgagagactgctcttcttatgtcactcttgattcaggcagaattccttcatctacagaattcaatgcaatatcagacagcataggggctggggatgaagaggaaatatcactcagattcagctcagagatgttgtgcaggtatggaaagagacatgcacatatgcctttaaataggtgggtcctaatgttttgttttgcatatctggctgtatctggatacaaacaaaccttactcaaaacttcatgtagcaggcaactcatttagtgacaacaaaatgggcaggaaggcagaaaacttttacaggatgaaggataggggaccaggaagagaaaaatagaaaatgtataaagaacaaagaaatagtgtggagcctagggtaggcttggtatttggggattgggtgattgggtgtacagcagttttggttaagtggagcagttgcagagacatgaaagttgcctaatttgggggttcctgacagcaccccaggacagagccaatccattttaggactagaaatgtattttaaccatgtatatgtattacacgcatttttatacacacttatccatgttacatatacatatgtgtgtaccttccattacagattgtaaatacttctctcatacctaaacactctatgctttgtaaacagctaggccaaagaatcagtatattttaataaatatacattgaaaaattaactagcaaaatctttggcataaaaatatataaaacagatctatcagagattcaaagagaagcatgcaaaatatcaatcatagtgggaaaagatgatacagaaatacttatctgatggcacatggatcaaatttggcccacaattatatttgctctagctgccttacgttagccttcatctgttttaatttattttaaatttgattagatgccaatattttaaaatctaaggcaagattccagtgagcaacaatgaaaattgttttgtaaactaataacctcaaaaatgtagtggcttcaaaccacaatatttatttcttcctcaggtcacttatccaatgagggttggaaagaccttctcctcactgtagtcattcaagaatctgagctgaaaaaattcaatctcttttcattcttccaagattatcacattcaaaggaaatatagaaatcaagtttcagcagttaaaattttcaaccaaaaaggagttacacatgtcactttccttaatattttgttgttcaaagtaacaacttgagtgagtctaatttcaaagcaatctcaactcatgccctaaataaggaaagtccaatgactgccatacttttctatcagaatgcaaaagaatctattaaaaagaatataaataaggatacagtgttggaataaaacaacacagaaactaactagatttatagataaatttccacacaaaaatagaaaatacatgagtttatagaaagtatatatattatacttttacaaaatctaaggcaatttaccacaaagaaaattcaagcaattttaataaaaatattacaagccatattccttgatcaactcacacaaat

SEQ ID NO: 31908 - DNA, 2129 bp, Bovine  19866880666205
ggtcatgtacaatacatctgaatatatcttctataatttaaaaaatatttaattttgttgtttagagtatgacagtaataagagaagaacatttacctggttcccatgtaatgtgggagtgtatgctctctctttcgaaccacatgcagctatctaccagaaatgttcctttagaagcatctgtaagataagaaaatttaagaataatcttactgaagatatgtcttaggcaccataattatacagaaagaaaactcttctaaatctctatacatagaatgtcccagtgaaattctaatcaaaaaggaggggaaatcttgtggacataacttgtgtacgtcagtaaggacagttaggagcattacaaaaggaatattttcagtacttctcccatctcacccacattcatccctgtcttgtatatgcttccctgcaattcaaccaatcataggtgtccatgcatatgtatatatggatctccactggatatttcctgagacctactccacacctatagcattagcattttgatgaaaaaaaacagagtaagcctccggaaatatccagtggaggtccgtatgcacatatccatggaaaccatggctgattcatgttgatgtttggcaaaagccaacacaatattgtaaagcaattatccttcaaaataaatttaattataaaaaatgctaatgctaaatcatccaatactttcctattgcctatttataatactttccaatatgcctatttacagtcataaatcaaatgaccgtgtatcatctcaattgagccaagagatttgatgagccaagtactcttaatacatatataagttgagaaaatggaggctcacctaggagggatgatctgctcacatctatttgtctataagtcacatcatcaggatttgaatgtaggccttataacaccctaaagctgtcttttgagatttcacacttcctgaaagtgtgataacaatttaacatatcactacttcctatgaatatttacactttaatgtgaaagtgaagactgtcaatgtataacccaaagtttccttagtagtaaaaaataaaatattttgacaacttgagagattttattactaaagggggttatcttcccattttctaaagatgaggttgactcaactctgattaatcctacttattctcagattgcctcagtctgcaaatgatgaaaacagaatgctgatttttttaaaaaatagtctacttttattgatatataattttcagtggtgtagattgactctgattttaaatgtttctttctattatgatctatgagtttgtttcaggatgtattagacacttgagtaaaatggataattctcaagtttacacagggtacctttttctctgcaataggagaaatatgctaaataaagttgtattggcaaactgacttgtaccacaaggataatatgaattaaacccaaaacagtgtaataaaaagagaaggagagggaagaattctgggtgagtggaaagtttaacacacacacacacacacataaacacatttacacatacacacacaaagtgaacagagaattcttaaatctacttctatattatatcttcacatactgattttgttctgcttaaaaatgacacaaataattttaaaaataatttggggatataggtatacctgctaaaccaaagcaagctatgattacaacatccagtttggatttaaatagaaccctcatttatcatcaggccatccttagacacattgagaaatctgtttttgctattctgtactctcttcacacaaaggcactgggtcaaacatctttaactaacatgatgataaataaatagttctgctttccatggtaaaagattcaatggcacattctggtaattttcctgaagatggttatgtgggtatgtactagctcagttgcaagtcctgtccagctctttgtgaccccgtggactgtagcccaccaggcttctccatttatgggatttctcaggcaagaatacgggagtgtatggccatttactcctccaggggatcttcccgacccagggattgaaaccgattctcacgtgtctcctgccctggcagacagagtctttaccactgagcca

SEQ ID NO: 31909 - DNA, 1749 bp, Bovine  19866880744218
tatatacatacacacacacatgcacacccaaatattctggccagtagtgtgctatcttactggtttaatgctaaccatatggccttcagtgttcagactagagtatgaaaaaaaataaagttatctgcttaaggatgtagtctggaaattgaaacaattgatattattactggaaactgacatttaaatttttttattgttttaacaaagaagggcatcttttaatacatcttctactgtagaaagcatttacattctatgagagttttcaattatataggaaaataacttcatgtggacttacttagattagacattgtaaatatttctaactactattctgttttgaaatcttggtagtctcagatattggaacaaaagccactaagagtgaaggggttcctatttgcctttcatagaaagtcacatgtttgctattcgagtacaatggcatcaaatatccttgtcaagatttaatatcatttcctgaaggggagaaaagactaataaagcattacctttcagtgtagtaaaatggttctactacacaaatgagaataacacaaattcttttcatttgggttctacacacttttagtgctatctgaaatgagtggaaattggacaaaaatgtggggatgtgaaaggacaataacaggtgaggagaaataaaatactcagtgttaataatagtaatatatatatgaacagaagggtgaaggtcattttactgggcagctgtagaacactaaaggaagctggtccaataacagagattttgaaagtaaggaaagattgattgttcaacattgtttctgcatctggcctccttgatttcaaacatttccagattgttatccaagattgcaactgggcaaacaatgcactcaagtttgcaattatgaaaagacaaacacggcaaaacacacatagacatcaaaagaagtcataggtttgaagtattctgaagtgagaatgctaagtgttgagtcacaattttttaaaaatttagtctctataaccatgccttgtgctttaaagttggaggtattgtcgttaaatttaccattaggaattatgacacccccatcaaagtgggtcattcagaaaagaataaaaactgaggtcattcagaaggatttccttactttctgaagtggtgtaataatagtaaattacaagtatcaggggaatatacttttaggacttttaaacctttcactaagaaaaaggaaatggtgggggttttcccctattattaacaggtgcagagtttggaaactgaagaatataggattttttattttcagtgaaagtgcttagatatcttaataacaaatcaaattaatacatcctgtagagttagctgagtctttaagaaaattactatttaagtatgcatacatgaaaatagaaagttgggtgttgctttgtttcatgttgaatgatcactatgttctcatttatatccatctgaattcaattgagatcaacatgtataaaacatgactacctacaaaaaagaccaaaaatggctgcaaagaaatgtaaaagttgcttccctgggagttacgggagttacacaagttaacaaaattgaaatgcatagatcaaaatcaaagattagtatatttaatttactttcttttttcctttgaaattcattacatacaatgaagggaagaagtcaggaataaaaattaaaaggggagaagttgcaaaagactgaaccaggcaaagaagaaaaat

SEQ ID NO: 31910 - DNA, 1593 bp, Bovine  19866880766330
tttaagctagtcataagaaaagatgaaccgggaattcactgcagtatcactaacatgtaaccaataacaaagcaatgggattgcattcattttcaatataacttatgaatggctattacttactagtactgtatgtggcacaggagaaatcataaacaaaaagctaaacatctcccttccccttccaaatttcaatttagctcaccctagaatgaagaaggtattcacattctttttcaaacctcactgtcagttcttttcctttagttaggctttattaaaagtcaaattgtttacataaaactaaagaaagtatatttcaggtaattcacagtaactagcacttcacagagttccatagatatttgctgaatggatgaaagaacagcaaaagaaattaccctggatttagttgtttattaattaatctgattaagtaagcatgataaaataaaatggtaaatataaactactgcacacacagttaaaataaatacactttgtaatagaaagcagtttgcactggttccatttaggtgtctaataaagcactgtggaaatattattactatattctaccaagttattattataagtaataacttacattaaaaatctaattatgcattatattatgcaaagtagtagtaactgattaagatgcataatcatacacacacaatggcttccactctttctaaagtccctgacacagaagttctgagttggggcagagaaatggcaatcgccaataaacaagagatactcatatgtttctgctggaaaaagaaagagtgggaatgtgttaggaattaaatagagatttgtagcttagaatctgctgtgaggaggctctgaaaaatgtagaagaggcagcctgtctgaagaagcagcctttggaaatgaagattcatcccacagctactatggaagatgggtgtgaaaaggagctaaagatacgggaattaaattaagggtctgtgtaagggcagctctctcacttgtcacccccttctttccaagtacaaaaacatcaggcagctggtatttacctccagcaaaaatagctgaccctttcccagtgaaaccgaacaacctgccaggtgaaaccgtgcataatcctcactctctaatttgagtgatcctatagtctgacagctggcttcttgctgatccccctcaaggaaagtctcacttctgtttacctcacacataactcctagggagatttccgagtgagaatcagttgtaactcagagacttttattaattacatagtccttctttctattggaaggatgactggacatgcaaaaaagctgcagaatgagaagctagagccaaaattaagagattaaaatttgatcccagagaaaattaagggaacaatcgtgtccaactctttgtgaattctccaggccagaatactggagtgggtagcctttcccttctccaggggatcttcccaacccagggatcgaacccaggtctcccgcattgcaggtggattctttaccaactgagctatgagggaagcccaaggtaactcaagcatcacataaagaaactaggtgggagaagaagaagaaattc

SEQ ID NO: 31911 - DNA, 2870 bp, Bovine  19866880797989
ctaacttgtattaagctgttaaatctctggtatcaatacaaaaggctcaaaaattatgttaaacttgcaaaggctgcaaaaatacttactatgatttttcagaaaatacaatgaattttgtcagcagatatcatagtgttgttactagaagtaagttggctgtccttccattgaggcttaataattgagcatgcatcacatagacatgtgcattaattttaatttaaaatagtctactgtgtaatgaaccaatttaaactgaaatttttgctaaaccaaaacatgtttgggggcatttgtatcactttattttctgaaagtaactgccatctttttccatttttgtaaatgaagtaatagtagtatattttctaaatcaacttttccatttattttcataattttagaaaactgcttctttttataaatttactatttgaatctgaattgcactaaatgagatagcttattagctttattttcccctttgagttttaagaggtatttatctttaaaaaatagtctataatgtttaactttctacacatgctatcaaagattggcaacatatttgatgctatatttaaagagtaatggttgccaaataacttattatatgatttgagctcaaaactatatattattccagtatctgacttttagtaacttaggtttcatctggagccctagatagacggtagttttaccttggaattacttttggccattggaaggtcactcatttacacattattgcctctcataaattgatctaatcttctgaataatggctggacatgcttatgatcaatattttattgcttctacaagctaaaacacaccatgaattacagtcaaaatcgttatcacccaacactgcagacataacaataatatacatgtgatattagccctccgcttgtggtactatttatgaaacaagattctgcttgactgcttttatttcagcactattataatcttctttaatttatagctaggaattctactgacagttatcactcagttctattcaaggccagagaagtaactcatcatgggtttgcactataataatcaaatctaaattttcctttgattcaaattattctaagatgaatcactttattttcaaagggtagtgtgaattaacgataatcagcagtgtaattttaaatgtaaggcacatactagtactaataatttgtaataaagaacattataaactaatgcaaaacagtgttgattctgtctaaagttattttattaccatatagttatatgttcttaatcaaaagcaatgtgtgaagcttattatatacattttgtctttttagtgctgtatttttataattatttacttgcactctcttttcataatattttaatttacttttgtgagatttttgtcattgtttttctttaattttacacacaagtgctctgatctctcttagtcatattctgctgtccatgcttcacttattagtcagtttcaacatccgcctttttgatgtgttatggcaatcaatatttgatgatgtgagagcttctagtaatccgcattttgttagcttcatgactgatcaaaaaatgaaaactttctttctcagagactacacgtggatgtaaaaatagctgcaatcagataataaattttgcatattataatcctataaactgtaattttcaatcaggtttaccccacaggcacacaagacacacacacacacacacacacacacacacacatttcagaagttcagttctgtagaggtaatagaaaatagctcatgtgtttaaacagtggatctagttatgcagtcatgaggtggatgcttgccatcatttttggccgcttcctcagctttcagcttacctccagaagtctggtactgcagaccttcgggaagtatctatgtacaagagatgattcaggtgagttggtttgatcttattagtattttccagttctttcactggttgcattgacctattttactttaaattgtagcaccttaaaaaagtgttttttgttgggcaaaatattgtacgtgtaaacattgaaacatgggcatttaaatgacttgagttcatacagtaacattgaatatactctagatatggaaatataataattttaaaatataaaaataaggctgaagactctatataaattgaattattatcctatgccaattttaatggtttaatctcttgtcagcatataatgaaaggctattagtagtgctttctatatttgctggcttaagcttccataccctttttcaattcatgttagtccctagttttaataaaaatgcttttgactcagaattagttttatcagtttgatagactatatatttaataaattgttagcaaaagaaaccaaccttttaaaaattttggactttgctgagtaaatagtgtaaataaactaaaatatttgattaatacttcaatcaaaagggtgcccaactatcccaatatgcattgttttcttttaaaaggtgtgtggatgttcgagtgtgtgtgagagagagagatagtgtgagagtgtgtgttggggatttagcctggttaataaagaagagaagaatttatagatctccaacgcaaggctattgagagcaaatttaaaatgtgatactactgggagattgggattgacatgaacacattcctttatataaaatagattactaataaggacctactgtatagcacaggaaactctactcaatactctgtaatgacttatatgggaatagaatctttaaaagtgtggatatatgtataactaattcactttgctgtgcagcagaaactaacaaaatattataaatcaactatattccaataaagat

SEQ ID NO: 31912 - DNA, 1225 bp, Bovine  19866880920982
taaagaaagctgagcaccatagaaattgatgtttttgaaccgtggtgttggagaagactcttgagagtcccttggactgcaaggagatctaaccagtctatcctcaaggaaatcagtctgaatgttcattggaaggactgatgctgaagctgaaaatccaatactttggccacttgatgtgaagaactgtctcatttgaaaagaccctgatgttgggaaagattgaaggtgggaggagaaggggacgacagaggatgacatggttggatggcatcactgactcaatggacatgagtttgagtaaactctgggagttggtgatggacagggaggcctggcatgctgcagtccatggggttgcaaagagtcgcacatgactgagtgactgaactgaactgaactgaccatgcactatataaatccccaaagacagaattacattatattttgcctgttaaaaatattaggatatttctcaatttctaatattgtttctcaaaattaaaaaccctgcctcaaattaaataggtttaaactaaagtttaaaggctaagcataaatatgtataaaaattgaaaagaggtatgaaaaacatttgcataaagtattattgctattaatgccatttaaaaatgtttgatccttcaatgaaatgaataagtagtatgtaaacattagaaaaggtcatggctatgctaatgcatacagccttcatgtttccaaagtggtgtattaaaaagctttaggagaaatattctctgccccaaataagtacaatttcttctcagttggttagagcaattaaggatttatatttatttaaacattcaacttcttcttaaccttttctgtagtattgaccatgaactggcagtttaccttgggatgtattttagtacacagcttccaaaggacaaggctttctgacatggtgaaccaaatcaggggccatagtttactgtgggtactgatacactttatcctatgtgaatacatttcaaaaacaggacaagtgaagattttgtaacagagaatcaacttagaatctcagaaatctttcaccaaaaactccacacccctttataatgagacagacacacattactctgtaatctgttaaaatacacattcttcttaatagggatcttttttctttccttaatttgtattcttgtgaaaaatgaagttaatacagatattggggaaacttctcactcctcctgct

SEQ ID NO: 31913 - DNA, 1161 bp, Bovine  19866880924421
ccaagatgcttatttattctgtgtctggggctttccagtttaaataagtccttctgcctcattactgtgtccacttttatttggtgtacaaattattttctcattgataccatatattacttgaggagtaggtcttgcagctcacagaagttcgaaggtgcctgtgagcattgtcatggagaatattgaataatttttcttgttgtagactgaagctcaaaataagattttcatctctttatgatcagcagctgaaaagcttctgttgtcagcaaagctcgaaacggcaaagaaagtgggggagaccctgttattgctttttcttccctcgctgccttcaaaaatgtttattttgtgttgcctaaacagagttcttttagtaaatgtacctccttaggtacctttctaagagccatggcggccaagtcctaaattttaccattccaaataaagtgacttttcctttcttctctggtttaaaccatctgaaaaggatgaagttcataagctgctattgatgattctggtatggagtttgactatccgaacagtggaaagttctattttattgagttgaatattttgtggcacatgcactttggagctaggtaatggtttgtttacagagagaaaaagatgccacagctatgctgcagtattttaaaagatctgagtttataggttttccccattgtgtctgtcctggttcttgcaaaaactaaacagagccttatttttctgcaaagctttaagcaataataggaaatgtaaggtctgcagagcattagaggaccatgagatgggtaaagaactgcctcacctcagtgacaatgatggtaactggcatttattgagtgcttactgcataccaagccctgcaataagtgctttatatggattagctggtttaattttcactagaactcatgtggttcctagttatacttgggatcctgttattgtccatatttggcacatgaggaaatggggcagaagggacataagcagcagagttacacagataaaaggaaagaccaagtggctccagagttgcccaatacagaccacagtgaggaaaggacttgcaaagtaagctgttttatgatcaagacgaagaagaagtcactagtgaaaatactttagcacaagctttccaagtca

SEQ ID NO: 31914 - DNA, 1317 bp, Bovine  19866880945766
atatgaattttgctattattttttcatctgaacaacagtatacttttaagcacaaaatatttccacaaaagtttatgctccaagtacaataaattttacctcacaaaattaagggaaagataaaaagatatatagatatagatatatagatgtatatatgaagttattttaatataaatgttcgttagaagtattataatcagttcataacattataatgttacatataaattcaacttacagcttttcaaatgtgatttttataatttttgttcattctttgatattaggaatatgacctgagcttagaacttttagtacaccatcacatgttggcttatgtaaagacacagttttacagaagctcaaagtgagcccagaccttggaaattctattaattatgatcaaattccttctgtgtcttgagaaagtaaagctcgtaaatttaaataataagaacataaaccctccttcacaaaccataagatggccattctgtcaatgtttctcccaaatgacagaagtctttgttggataaatcacatcagtttctgacattttagacaaatctagacaatgaccattgttttaaaatatgatgggaaaaacatgcttccatttatcatggttttatacagtaagactgaaaacagattttccagagaaaattatgaagttataaatatgacttggtagttgctgctttttcacttatttctttctctaagtatatcatatcactctgtctacacgcatagcctccactataggggacttgtgattttgttatttatagaaaggggataattgaagacacattgaagtaccttacatgagggtacccagcgtcaactgacctgagttttctgagagacgctctctcactggacaacatcttgctttattccttcaagccttactagtagcttcatcccatataaaggaagcaaaagactgtactttctctgagttgatatgtgttacaattagagctctctgactcaaattactaagtccaaccttacctttttaagtcaacatagtgtcatagttacctcaaacaactttacatattacatatttcttaaactcaactacagagaaaccattgttgaatatactcaaacctgataatgaccattattagtatatgtgaaagtcttagagccttggaaacatatagcaagaaacttaagaaatatagggattgggtttgcaaaaaaaaatgttttacagcttcagtgataagatgaagaatacttcttgcctcattggtgttggtcagtctctcggacgtgtccgactcttcgtgaccc

SEQ ID NO: 31915 - DNA, 1048 bp, Bovine  19866881043968
atgccagggctaaaaatatcacacgatagcagtcatggttctttgttctctatagcttataatacagttggagacatcacagctataaaaacttagccctatgaagtattaatataataagcccaaaggcctgaaaacagagagattggtggacttcagagtaagtggtttataggacagttggaaagatttctggagttgatgatacatgaactaagtttgaatgagagagctttaatcactagattaaaaaagaaggataatttcaggcaaaggaaattgtggaatccttctggactctatggcagtagcacccaagacaatagaataagagattatgacacatgtactctgaaaaagttttggaggaagttcatacaatcccaacttcaagtttcagtaggtttaattactaaatgcttcttttaagaaaagtctagttatagtcttaattttatgatattggcccatggcttgatgatcacagcagaatgtaaatcccttataaataaaatacatttaattttcttttttttacttttccaataggacttatgaatgaaacatgacaatggaaaaaagagaaaaagatctgtaatcaattcttcattatccatacttaattttcagtgtgactaatttcttagtgaatccagaagtttgttaaataatttatgaagattttatgtgcttcttttaaactgttacctcactttcttcattcttttctttatacaatttaatccatatgactctcactcaatgtagaataaaaataaaataaaaatagatatagcaaagtaatataaatttttataaacttttagtttatcaatataaagggcaactatatttttgcaagagtaaaatatgcccctggaggagggcatggcaacccactccagtattcttgccttgagacttccataggcagagaagcctggagggctatggtccacaggtttgcacagagttggacatgactgactgagcacacaggtcacagaactcgtaagtggcagagtggaagcaagctggctccagattc

SEQ ID NO: 31916 - DNA, 1161 bp, Bovine  19866881157790
ctgtttcttatatatagtcatgctacatagtttagaaatttattcccactgggtgtaacctttgtcgtctagattcagtaaatgcttaacaggcataggccaggaccatgtgtgttttgctttaagggtaaataatctacactgagacagacagcccctgagaatattcctcccatatgtcaatatcatggttctttttcagcatgcctaatatatcatgtcatcagtgtggtcacagcaagacaatggcaataagaacccagtgttgaaagtactgctcctaaaatttctcttagaatttgataatattctctatctataaaattccatacaaggattattgtctctaataaagccatatcaggcaacccagttcaacagaaggataacaaaaagtaaggaatttacatattgacctgtccacaattgtagaagcctgtaagattggaaagtaagctgacacatgggtcattcctcagcctataaatctcatctatgttgtcacaaaagaatatgagaatgaacagacatcctttttagttctcggtcatcaaaccattttcttcccaatttattatcttctctttttagtgagtaactcatctagtatactgaggggaagacaactggcctctgctctctggatagtgtgcaaattaatttgccatgctttatcaagaattcctatgtgaaaacagcaaaaatattttatgatgatactttcatgtaaattagaactattcttttttccacagactgatcaggataaagaaaaatcttaatataaatagttcatcttttctaaagctgatggctatatgatgatgtgtaacagaatgtaaggatttagatggatgtaagaaagaaaatgtctaaaaatgaattaggaatagatttacaagtacattcttgtttagtagtgtttttgctcatgagttttatgcaatgcttttatacacaaaactgaaaacattcactgacatcttgattattatttaaataatatacagcttagtgagtcaacacattggtctttaagatacagttttaaactgacttggcaaatgattaatctaatcatacaatactaaaattgcaagtggaaatgggttagttttccataaacagaacccacatgccacacaattatgtcaaaggttt

SEQ ID NO: 31917 - DNA, 1391 bp, Bovine  19866881168939
atctatttgccataaagtgatgggaccagatgggaccatgatcttcattttttgaatgttgagttttaagacaactttttcactcttttctttcactttcatcaggaggctcttcagttcctcttcgatttctgccataacggtggtgccatctgcacatctgaggttattgatatttctgccggcaatcttacccaataataaattacctctagggtacatcagcttaagaagtataccaaagaagctatgtcttacttaagaaatgagatatcaagaggcaacatagaaatgaaaattctttaagtcttccaagtctgtaaatgagcttatttctgaaagtgcaaagtatacgcaattgtcgttccctgtgacaacttaaatctagtaggcacttaacactgtttgtttggcattttctcatataatcctggggcttcccagatggtgctagtggtaaagaatctgctgccaatgcaggagccataagagacacaggttcagtccctgggtggggaagatccccttgcctggagaatcccatggacagtggagcctggtgagctacagtccataaggtcgcaaagagtcagacacaactgaagcgacttcacacacacacacacacacacacacacacacatataatcttcccagcagcttggcagattggattttatctttacatcatagataaggaaactgagtcagaaacagattaaagcagttttcctgaattgccacttatcatatacagggactctagcttctattctcattcacttcccacatcaaggtaatggttatcagtagtaagcttcatgtattattaataactgcaagtcagcatgcataagctttcaaattaccacagttatccaattaacctctggttacttatatagcctttagtgcttctcttcaggagcaggctaatgaatttcagtataaataattatacaagtgggaaacaaaggtcatgaaaaaaaatggaacacttcataataactgttacataaagggctttttattcccccaaaatcaattttaaagattgaagtcttggcaggagcctagtcgattttaattttagtgctattcagttggttctaataaaattttaaaaactaataataatgatatatcaatttattaagtataacactttaattttacagatgaaataagagaaccatacatgtctagtaaaagtataaaaacatgtggggaatgatttacatcaacttcaagatgctagttatctctggggaagtgaggagtagaaagagagaaggatacagctatagtagaatctgtaaattttagtttctatttaaaaaaggatttaaaccaaatgggggaaattttaattaggtttatgcaaagtataa

SEQ ID NO: 31918 - DNA, 1007 bp, Bovine  19866881266466
gtgaaaaaaagttttccttccaaatggtaatttaaagctactgtattgaagcacagttttttttttttaatcaaaaaagtttttttatattcttaccatttagtaacaaagttaaatgaatcttacctaaataaatccacaaacttttacaggaaaagaaaaagcaaacaggaaaagtggttttgtttttgtttttttttcccacaaatacaagacaaaagacttcaggtaactttttctttactaaattgtagattttgtacatattcaacaatacaataatatttttgtttaaattatgggtaggggaaattcattctttttaaatcaaattttcagtagaataaatatatgaaaatactttctctaaaataaaatataatgaaaagaaaatattttgcatattttacaatatatctaaaattaagacaaacagaatagttaactaatattattgaaccaacaatagttatgtaataatattgaaataaggcaagatatttggaaatgcctgattcacaatagtctatttaatgttgatcccttgttaaaaaatcagtatgtttattttccacaaaatccataagtaatagtattaaagtgaaaatagatgcagtaaattataatatagtcccaaaacattattactttgtgcctgagttggagggtttttttccctaatttaattgatcttttttcctattaaaaaaagattcaattctgttaaattattaatcatttacagtggtgaatgtcatgcatacatattccttaagttcaggtaatagaaacctatatatttagtcagtgtaatttaaccttacataacctcagaaatgtcattcccttgacacttaatcatatcaaaacagtgagatgtatgtcgtgtcttctgtgtggcaaaggtttctacagacaacatgaagcccgttgtgacatttttctaatcattagtcatttcatttctggggtaagtaaagaacacttgttaaacatgaactttcaat

SEQ ID NO: 31919 - DNA, 662 bp, Bovine  19866881282886
atcctgcctatcaatctctttgtaatatacactattccccagccgacgtcttcagtgacagccattcatgtgtcctgagctgatcaaacgcaggcaatagtgatggttcagcacgacttgcctttaactgaatgaacagaaactgttccccaaccatgcgtctggtgcacaaactctactgttcttttaggcttttaatgggctgtcctccaaatggcacatcagagaaaacatttcatctgaagaacaggtatagaatgcaactacttgttcagccacaaccctggccttttgggttatgtgaagtcttagttctgaataaccgaggataagggggggtagggaagcttttccctcaattctaaacaccctttagtctcctttgagtcaacgccgctaattatgccaggcaggctgtatgatgagtagcggttttgtgatcccaactattgttcagaagggctgagatcaccagtgcattttcttagttatagagaatttgaagggaaaagtctgagtacgtattatctctttcttttcttaaacagtgcctatttacaaacttttcactggtgagtaaaaacatttactggcaataaaacacagcagtgtttcagaatgttaacctcttccctcaaaacctgacaaagtactctgagtgt

SEQ ID NO: 31920 - DNA, 683 bp, Bovine  19866881342483
gagatgtgtatttatttccttgcagttgtgctgagtgtcccttcagtgtgggcttgagatggcttcacaaagaagtttccgcaatttgtgtctgttgtaggtggttggatgaatccttgtttgggagattctgtcgggcatctgggcttcctggggacacaccggaaaactgcttcgaaggatgctcctagcatcagcggcctgctgggttgatgctgggcaactttgcggcgtaatctcggtgtctctgaccgcgccgcggttcatgatgcggacagggctgcagaaacctccggggtccagggccatttaggctcccaaactttgaaagcattctccaagaagggggatgaaaaggggggctttgaaaatcagcattactgggtgaattttggtaaactcttcagggtatataggggagtctttccagatctgcgttttcaacctgcagtttgggcctggaaatggagtgctgatgtggaaaaggtggcggtttaaagctaaggcggggaggagggggctttttctgtaggagagcggaagaagaagcgcagatagatgaatgaacaaggtgcgtcccatctttcacacacaaaaaccacacgcgtgggacgtgccaggaagcgctccagttgatcgcgtttaactgaaaatgtattgcagggggggtccagtcacctctg

SEQ ID NO: 31921 - DNA, 1584 bp, Bovine  19866881380425
tgtccgactcttagtgaccccctggtactgcagcctaccgactcctccgtccctgggattctccaggcaagagtactggagtggggtgccatatagacttgatttaatgtgatattgaatggtttgccttggaaacagagatcattctgtcatttttgagattgctttcaagtattgcattttggattcttttgttgacaataagggttattccatttcttctgagggattcttgctcacagtagttgatgtaatgtttatctgagttaaagtcatccattccagtccgtttttgtacagattgtactggcaagattgggaagtaaggaaaagtgcatggttagaaccccaaatcctttcaaaagaaacagggagccctggagcccatgaggactgagcttcctcttgacactttcaaataaaatataaggaaagtcctgaagggatacggttttgcacagacaatggaagagactgctgctactgctgctgctgctaggtcgcttcagtcgtgtccgactctgtgcgaccccatagacggcagcccaccagacacccccatccctgggattctccaggcaagaacactggagtgggttgccatttccttctccaatgcatgaaagtggaaagtgaaagtgaagtcgctcagtcgtgtctgactcttagcgaccccaatggactgcagcccaccaggctcccctgtccatggattttccatgcaagagtactggagtggggtgccagtgccttctccgatggaagagactaaggttatcattaaaaatcaggaaaatgagatcttcacattaccaagaacagtatgttacattatgaagtatcttgatttaattatatctgtgtgcttgctggaagtaaaacatgaatttttttcccctctattatatttttacagtacacataaatcacttttaccctaaaagtattttaaaattccaactgaggggcttttataatctacgcatttagcagaacatgaaccaatcaaagaaaatgtaattttctcctttaaaagtaaatctctgcttcaggcattgaatattctgcttgagtttccatccaataaataacaaactaatactatatcttcaattaagcagacatattcctaaagggcatttaacatagataacatcactctacagaaagttacttcctatggatgaaaaaaaaaattaatgggctaattctcatacctaaatctctaccatttttaacttgaaaattgactcaactaatatacttcttgaaaaaaagttaaaaagcacagcgtttgaaaaatggcagtgactgcctaacatgaaacatgaataccagtatatgtttgccaataaaggtatatgttttttttccagtttctactctcactaagtttaacttagctggccaattcactaaaaaatggctcacagaaggtgcaaattactggagacacattattgctacatttctaccttatagattcctaggatcatatatcaaattgatctagcaacagtcagtatgaaaataaatggactttttcttcatcatgtgtacataaaactctattactccttttta

SEQ ID NO: 31922 - DNA, 1199 bp, Bovine  19866881408612
tatttcttcctaaagttaggatggatttgtgaaagacaatgtcactctaaatcactgcattcatctatgagctgtcatatgcacatgtatataaataaatctttttttttttcctcttggaaactttcccacacacatctgtttctttcagcagatattctttaagataataaacgacttcagttgcatgtcaattagaataaaatttagtgagaagtcacatgcaattcctatctgtattattttcattaagatatttaattgcataaagactgaaagagcagtaaagagaaaggtaggaggtctgatcaaaatctttttgataatgtgaaaattataagtgatcatagttttaagcctccagaaagtgataaaaatatgtaggagatggaaaacatacttctcagctactggacactgacacgaggatgcatttttgtctctatgggtggtgattgctatagttgttttaagaatctcaaacattctgtggtgcatgagaacataaatgacgcatataagcatggacttcataccctagccggatatttttcttgtttttaaagatcatttttctattaatgatatttttaacagaaatcttaagcacaatgtaatctgatacaacataaattgatgcccaaagtctaagtttggttagtgtccaatgaacggttacagctgcatgaagtcatgatcaaccggtttcatagccttctgtttgaaaaggtgcccaatccattttatactaatcaaagtggatataaactttgcacttatttggctcaacatttcaacatttaaaagtcctttccaaacattgacacaatgaataactatttagaagtttgctctcccatattgtgtagaaaaaattacttttagtgtatatgacatccttctccctttcatttatgccttttatttgcttatttagttcttcctgatgttgtgggaaaaagatatgaactctgtataatcaaaaaggcaccatctgatattgtatgttgcaagtatgtgactatttaaatttatgaaaataaaacttaaaaatcattttctcagttgcactagccatatttcaagtacttgaaagctacattaaaacttttccattatcataaaaagttttataggattctgctgttctcaaaggctaactataaaatagagaaatataaaataaaaatatattctct

SEQ ID NO: 31923 - DNA, 711 bp, Bovine  19866881468985
ttattttaaattgaaagaataagtttcatttaattgtctcatgtaaaatgacagtattgaaatagatacccatcttatttgcttccagttatcaatttacatgattccatgaaatagatttccactggactgaaataactttccatccttcacaaatatagtcattttaagtgttttattttataatttgtgagactcttaatagcatttgtttgtaatactatatttgattttcagtttcctctggtgattaattacatgagaattattctcagatatcaagttatatccatacactcaagataccctctcataaatatagggttaataatctatgtatattttatcagtatgcttatcacttacttctaggcccatctatatgtttgaaaacagatatacaaggtaaaattcaaattcaatccttgacatgacatgttgctttgaaaatcacaaaagtcgttatcttcaattttcaacaggtaggctttgtgttttttacaaaacaaaatattttcttaacctctaacttttggaagtttagggaagtgtaccaccattcccagttacaatttgcaaacttcaattatcattctgatatagccatcagccatgccttttgataaaactgtatagatgaatagaaactgaagggtattccatttgtgtcaacgttagcagaaaatagtatgacagggtgcaagactcaag

SEQ ID NO: 31924 - DNA, 2247 bp, Bovine  19866881652308
tgaaattatatttccaggagatatatagtatgctgcaatgtttataaatattttacttatttaatacaatactgtatgattgaagggggataatacacatagtaaattcacaaggaatggtctgggaatcataatatcaaatttacaacactggttacctcttggagggagatgcagtctgaaaaagtacattgagggcttcaattttatgtttaatacataattaatctgggtggtaactcacagacttttgtttcagcattttctatgtctttgccaagtgaatatgacataatcataaaaagtcagagtcattaaaagttccaagtactctgaacagcagtacttcaactctaaaggccatcttaggtgacttttaaaactctgttcttgagaagggtgcctttctgatgcagggctctttcatttcggtaggaatgaatcatataatttgactatactgtctaatcaaatctttctctgaaacacattaatctaagaaactatgttcatagctctcaataagacataagaagctatgttgatgattcctcccccaactgctaaattaatctccatattgacctggctgggctgaggaataatcattgtgataaactcttaagtgcctagttacacctgaaatgcttgctaaaatgtagatttcagaatcccaatcccatatgttctaatgtattaaatctagtagagctagggagtctagggagtagtattttaagtgtcatttttgttaatttggaggtcttcttggttcaatggacaaagtttgagaaaagctgcttcaaggaattcacagtctcctgttgtaaatgaataaacaaattccatggaattttggagctattattgagaggataaaaagatttaaatctatttgcttaacaggaaactcttcaaaagagaagtgatgactgattcatattttcaaaggtcacccaagaatcaagaaagtgagaactaatctgggcagaagttctaacataaacaaaagcagaaagttatgacatatcatgaacatttgagaaaatgaaagtcgattttcacagtgattggcaaagtgaaagttgttcagttgtttccgactctttgcgactccatggactatattctccagatcagaatactggagtgggtagcctttccctcctccaggggatattcccaacccagggatcaaacccgggtctcccacattgcaagcagattctttaccaaggatattggactgggtagcctatcccttctccaggggatcttcaaacccaggaatcgaaccagggtctcttgcattgcaggcagattctttaccaactgagataccaaggaagtccaaaggttcctatatcagaggattaatacactgcccaggtggatgctgaagaaaagaagatgtgaaaagctgtgctgaggttttgtctctcccaaagaccaggatttaggactatgagaaagagttggagaagaggaggaacataaatccatttgatcagctgaccactaaggacttgaatgaagtctctccagaaaccaaattagacaagaagtactcctactggcctcacaagtcaattgagaatttataaacttgagtctgggagaaagctctggcccttgaattataaaccgtgtacattaaaaataataatatagggaagttatataacatagtacatatagatagataatggctataatactggagagcacaaaatactcatgttcatcttcaaagaaagttctattgatcattgctattctaggatgatgagaattttctgtatcttgatatgagtagtagttaaatgggtatctaaatatgaaaaaactcaaactacatcacttgaagttcgtgcactttagttataatttataattcaataggtaagtacatagacatgtttttaaaataactaggagaaaacatatacaatgtatataacagattattcatatttaaaatataaaggaatcatataaatcaataagaatagaacatcaaacctaaaggaaaaatggaatgcaacttataggctggaaacatactaagaagacgctaaggttcatcaaaatcagagaaatacaatctagaacattgagataccacttctgcccatcatactggcaaaagcctttatgactggtaatatcagttttttataaaaaaattaaataaaatatgaatacaagtaacatgagctcaagaagtgtactatataattttgctac

SEQ ID NO: 31925 - DNA, 1273 bp, Bovine  19866881770190
atcatttaaatcacatagtagagataaggtattatcttaatgcatatttgtctaaagattcaataacaaatttatcatttttcacatatagaagttttgattaagaaccaccaataaaacgaaatatgtgcatggaactctctgtgggattatttagaaatctgacgtaatccattgttaatttcataacatcagtgcccttgccttactaatatatttgacttgctcttttagaaatttcaggattaaattattgttttctttttgtgacaccataaagtagaaagagtgagaattttcatgacatatatgagtttaaaagcatactctgctcctagttaactgtttggaaagtatttatctttttgcatctcagtttcctagctcaattttcaactttaaaaagataaagatatactggaatgttataaacatcaaattgataggtgtgtatagactattaccctggcgtattttagctgctcaaaatattgttgaataaatggatgagtgtgtgtgtgtgtgtgtgcacacgtgcgtgtgtgtttacttacatagctgggacctctgtgtctgtgtgtgtctggttcttggataataaaagtacttaataagtggtagctatcattctttcttcatgattctgagaaataatatagtgatgactccaaagtgtctctaagatctcagtgctgtgaatatcgcctgcctagaatgtgacaatacagagccaaagaaaagggaaatgtctgtgctacagccccatcttgccagggcgctttactccttctgtcacagatatgaataaagaactgaaagcaacaccaggactttcttcacttccaccaccacagtggccatgaatatgtggccagaacttgggcatgatgttgcttcacattcctaatccctgttagaaggtgtgggcaagtgtgacatctgctcagagaccacagagtgactgacagcactgtaacctcctgttcacagataggaaaatgttaaaggctgcctgtgtgggataaccatatgaacccttccttttggaaaaagcagatctgtcctcgcagcatttagccaagctgtattttaacacgggcatctggtagaagaagggcataaaagctgtcagaaaacaaagcatcctgattggcattctcatgtaaatggttggttctgtttttattctaccttaattccagcttttacttttatctttcattcgttgattggtgcgggttcagaaataggagaagagaaaaatcagtcaaaa

SEQ ID NO: 31926 - DNA, 1426 bp, Bovine  19866881932059
aattgtataagaagatttcagtatctcatgagcatttctacttgtactattatcttttgtttatataatctttacaaataaggagatttctttgctatttcccatctccagcttttgtaactattatggctcagctggtaaagattctgcctgcaatgcaggagacctgggtttgatccctgggttgggaagatccctggagaaagcgaaggctacccactccagtattctagcctggaaaattccatggactatacagtccatggggcctcaaagaataggacatgactgagtgactatcactttcactttcatgtataaggagaagttttctaggtcatattttaaatgaattttattactgccagtagaaccatagattacttaccattatttagagattatttcatttaggatcctatccacatgattgtttaaaagatatttatgtgttaacctttctttaagtacactgggacgacccagagggatggtatggggagggacgagggaggagggttcaggatggggaacacatgtatacctgtggcagattcatttcgatgtttggcaaaactaatacaatattgtaaagtttaaaaataaaataaaattaaaataaataaataaatacaaacaaccctaaaatagtaaaaatgttgatttcaaactcttttcagcacaaatccaatcaagattccctgccccagctccgcaaccctgacaaaatgctcctctttttaaatacactttataggcttttatgttatccatgtggctacttctgtagtaatgatccatggctcaagcaggaatgtagaaatgcagaaacattctaagggtaaagcaatgtaatctaccacccaagatgccagcagagaggaaactgatgaaaatagtgcctgcgctggactaaacagagagtaattaagaactctttaagagccatgagttaggcaagtctaatctaagaatgtgttgcaggataagttccttcaaaggtatttgttaaaatgtcaagtttgagtatcatggtcaaagcctttgctgattttttttttttttttccgaaatcatagttctctcacaatgaagccatatctgaaaccaaagtcaaatcctgtggttaattttagataaatagaagtttaaaaaaaaatcaggtggaatcttaaaaaatgtgtatgttcccttatatcagcttaggagatcttgcagctgttcatactttcacttcatagcacgtgtcactgtgacaaatgaaaaatattttcatccactaggattactgggttgctgaaaagcaataaacaaactgtaacaagaattatgtatgtaactgacagttaatcgggctattcaaaatggtaatgaagagactgagaagattggataagtatttttgcgacaaatagtctacattaca

SEQ ID NO: 31927 - DNA, 599 bp, Bovine  19866882005880
tggtttcttaattgtgataatgtagagaggaacctgcttttgtatgtgatgaccaaataaccctattatgcgatatgagggttgttcattactgcagcataaaccaacactttttgattgatataaattgctttaagaagaacagagtaataaaaaaaatttcacttgcagaataaagttcaaataaggtaaaaaagatggaagactaatgagtttgtcggtgagaaggtcaatggtgtgttagcaagagcagtttcagtagagtgatgggaggataagtcaggaagattaattgtcctgcaaatcatcagtaccccatggacattctttgacatgcaaacagaaaagcacctccaggtctcatcttgctcatttcacatggcagttcaaattagaagtatatgaatttgaattacaaagcttcatcttccagagaaaattaaaaaataatgatattgctaaaaacattatgttaagccctcaaacaccatcagtttttatttttaacaactttatgaaaaaaatttagctttacataataatgtcctttaaataaatgtttacctcagaattttttaaattgtgaatctgatattggg

SEQ ID NO: 31928 - DNA, 1695 bp, Bovine  19866880466503
atttactgttctttcttttttaaatataaaatttaaacatgcattttctttcataaggaatcacgtcttgtgcttctgagtgatttcccccctgcccccattcctccccacttctttctattgtcatccattacttctgtctacatcccttctctgaatcagcatttgtttatttgggagtgtgaaagtgaaagcgtcagttgctcagttgtgtctgactctttgtgatcccatggactgtagcccatcaggctcctctgtccatgaaattctccaggcaggaaaactacagtgggttgctattcccttctccaggggatcttcccaacccagggattgaacccaggtctcttgcattgcaagcagattctctactgcctgagccacccttgaagtagttgtatataattaattgctttgctgctgatgggattgaccacatggctcccaaatttgatgttgcagtgggccaacacttttgatataatccagacagtactatgaaactgataatattaggtgaagcaatggagaaaaggatcagtacatgtaaaagaatcaatttttgcgggttctaatcatcttgcttttattttcttttatcactctgcttctttctttttcctttcccataggctactttgatcatgatattttttatggctcctctttcccataatctgttctcaactaggatgattgcctagcacagagtaagaaattttctcctgtgagccttctctctcatcaagctcaactttcattcttctcaggagatggattacagaaggagcagatttaaaattcactgcctgctcatgaataaacatggtaaagagagctgttgaggtaaagttatattacaaagtatttgtttaaaaaactcatccttttgttctcatggaatttctctcttaaattcactttagcaaataataacaaccataaaaaataaatatacccaaaggccttaataaaaagggagaacaaatgcacagcattttatgtcatgaaaataatagctctgggaagtccactggaacgtccactgcttcagcctgaccttggctgttggatttccaatgtttcccctcaagttctagatgaactgtgagtgcatgcgtgcacgcaatctcacgtgtgcctgaaacacatctgctgactagaagttggtgtattgagatttcgtgattgtttttgttcatcaaagtgcttatttaagacacatgaagttaatgacagtccactcacctctcattctgccctcctcctcaatctttatttcctgggtaataggaacttcttcttcccaaacagttttgctgcaattgggaactatggccacttgatgtgaagagctgactcattggaaaagaccctgatgctgggaaagattgaaggtaaaaggagaaggggcagcagaggatgagagggttggatggcatccctgactcaatggacataagttggagcaaactccaggagatggtgaaggacagggaagcctggcgtgctgctgtctatgaggctgcagagagctggacacaacttgatggttgaacgacagcaactatactaatgtgtgtttggaagccattttattatctttaaagtgttttttaaagtgtctttctaccctttttattcccactagacttgaaagagtcttaaagagcattgccactatctgcattt

SEQ ID NO: 31929 - DNA, 1975 bp, Bovine  19866880499135
aagagttgttttaaaaccagggataaatcagccatcaagaagaactttctatctccctggagcacaaatgaaacttgataacattgtaatgattgattgatgttgaaatgttttggctttaagtataaatagcataccatatacatctcctccccttagatgtgttttctggagactttgtcactgtataaaaatgtacaatggtttattgacatgtgtattccaataagtttacaagataatgagatacacagtcagtgtctgttgcacttcatgaaaacttcaaactcaaacttaacctagaagttaaatgaaactgaatttctaattaagtaattcttatacaggacaaatcttgatatctttatatacaatgagatactcactacatttatatgctgtccaaacacactttttaaaaaaataacagtctaagaaataagacagaatattcctctttttatccccacccatgatgcaataatacagaattacaaaaagctatatactattaacaatgacttttttttgtatgaaagccagcatcatttttagtccatgggcatggtgattctattattttaattatctataaatgtccaatgcctcacagatcaatgaaagtaatgattatatgcaaatacctcacatgtgtgatgtcttggttcaaaagaagataaactgaaaaaatgaaaaagctttctgtagcaagaattatgtacacagtgtttggcatccttctttctctgtgaatggtttcttttcatggatgtaaaaatggtccatcctgatcctgagcactgtttaaatttcaccatatcctccagggagacaaatcatagaagagctatttggtaattctgtagcaaagcaatttctaattactaaagtcctccaaagtatcttccactacgtaaaaatgaattctgctccacccaacattgctgaaagggaaatgttattgtaatagatatggaaactagcaattttcttattttaatagatgaggaaaatatttttgaacattttaatagaagaggaaatttacctggcagagttgagaatcaacccaaacatgagatttgtcaacccccaagccaagctattcctagcacagcaagctacctcataacaaccccaaatcatcaaaatacttattggggtggatttcacctggacttggggcttctcaggtggcgcttgtggtaaagaacccacctgccattgcaggagacttaagagacatgagttcaatccctgggaagatcccctgaaggaggaatggaaaccctctccagtattcttgcttggagaatcccgtggacagaagatcctggtgggctatggtccatagagtcacaaagagttgggcacaactgaagcaatatcatgcatgcctgtacccagacttagcttttggggaaaaatacaattattctattatatcaaactttagcatatttagtctactttttgctagtttaaaggataagtaaaggcaaacatgtttacttcaactggaaatgccacaactttggaatccaaaaatcttttgtttatttttagccaagcttacaatttactataaaatttaagctaaataaaaactcattttagatacatttttaatttagaaatgatttttgtggttctttaagtacgctaaataggctccatgtatttacattcactcctataccttcacaagaatatactgaaataaaatgactaactaatgtattctcctgcttttataggtctcctgttttcatctctcctcaaacctacaacatttttcttcttttcttcactctcagtcaacaatcttgcttcctactttgagtattttcacaaactactgagttcatttaaaaattttctttaactctattgtgtaggtaggagaaatggataggagcactaaagggaaagtcattcagtcgtgtccgactctttggactccaggactataagg

SEQ ID NO: 31930 - DNA, 2059 bp, Bovine  19866880525144
ttgcttctgctagttgggatgtgtttatgccactataatcaaaagagccttagcaaggactaaataaataatcatttttgtacagatcaaataagtgtttactgaacatttttaccttattaatagacattaattaatgtaacttggaattggattttataaatatgttggcattttagaagtgctcttgtctttcataaaatacagccaactgctaatagctttgatcaaagcataaaaaattacttaaactaacaagagattttgaaatggaaatttgaggagaaggattcttcagttttctaattgctcttccctgctactgaaattaaccagcattttatttttaatgggaacaattatgaagagaaacatttgttagctaatttaatggttagccactatggcatgactaatatctatggggaaaaggatcagtaaattgttacattgcaacaatcagtataattgattgctcctatgaatacctgggatatttaactcctcattttcttcaatggatcataaccactgaagtttacacagagtagaaattccacacaataaatgttattaataggttcctgcttttgcctgctcaaatatgtttctaataattgcaagactttatctttcatctaaagaattttgcttttaacagagaataatcttcactttgatgatcagttttcacatcccagtaactctttctcatgggcaggtaggaagagagaaggttttggaagtgggagggtgtgaaaggggactacagaggatgagatggttggatggcatcactgactcagtgggcatgagtttgaacaaactctgagagatagggaaggacaaggaagcctggcatgctgcagtccatgggatccaaagagtcaaacacaacttaccgactgaactacaacagtaacattagaattgcatcatctccagcatcaaatgtgacccctgggaatacagagactgggagaatgcttcaagatcatttatcaatcaccctctctttagtctttatcaccactctgctcttttccatggtatttccagatatgtaggaagaaggggaaaagtggttttaaaaatcaaccttctcacttggaaaactgaagaaattaagcttcaattttatataattaatgctttttaaataaaaggctcaacttttcaggttgaaaatccacttctctaaagaaacaaaagtcctgtcagattcatacagcttattctgactgtggccacgtcacagaaaagcatctgatatggttcattgtttctcaagcagcacacatctgtgcccctgggatgtcccagtgaagatgctgtcctttccagccaagtagtagggtctgccacttggtataataaagccccttgagaggcaatatgaacttgattggctcccttcatattcatctctgtcaactagtttatttttacaaattgtttattggattttatgtatgtgcttgctttagaagaggcagtttgatcctatgaaagaaagagaatactaatttgatcctatgaagaaagagaatactaattgttcagccatagtgtttgggaccttattataatatttctctgctgatggaatatggagccctatctcacaatgtacaggtaacatgcgttatccagacattcagtcataatgactggatgggggaagctgccagcttgatttttaaagaaggtctccaggtggttcttaaacaaagtgcatcttgagaaatagtgatttagtggacttcagcataaagtcctctccatatacaactggtttatttaatcctttggactttggcatggctgtctatctggcccactgatgagtctgcctagccttgagtacaatatcaagacatcctttattatcatttaggtcctctaatatgtctctatctctcttttcttagctcccttcagtgggtcccaacatgtggttggagaaagggatatcattcaaaaagcaacttcagactctcaaatgcaaacaaacattactctcttcttttaacttggaagtagatggatcctacttata

SEQ ID NO: 31931 - DNA, 919 bp, Bovine  19866880558708
taaataggaactgtttctagaaatgatccattatcagtttacaagtctaaaacagagtctatttttttgggggggctttccaggtggctcagtggtaaagaatctgcctgcaatgaaggagatgcaggagatgtgggttcaatccctgggtcaggatgatcctctggaggaggaaatggagtattttatttttaatctgctatctataaagtttagcatgtgcgtgcatgctaagttgcttcagttatttctgaatctttgcaaccctatggagtgtaacccaccagactcctctgtccatgtgattctccaggcaagaatactggagtgggtggccatgccctcctccaagggatctttcccacccagggactgaacacacatctcttatttctcctgcactggcaggctgtgtctttaccactagcaccgcctgggaagccctaaagtttagtgtatgagttttttcttttttaatctacaatgatagatggctaatgtgttcaaacacatttatcttaataaatttgggttcagtaaatctttagcccttagatttttccctcaggccaaatatttcaagttcagaggtaacattgtgttggcagcagaatgttctctagataattttcattttgcccttcactgggtgtctcttgctagtgcattctgtgtagattctcttacatttgatgaaagcatttgaattaatgtgagtggtgcttatactacttactcctcaaaggacttcccccatctctaaccttctttagtttctgtaatgtattaatccatcaggactaaacaaagctataaattggctttgaataaaaataatgcttagatatgttaaaaaacactgataccgaatgtaacctttaggcccttctggaatctctcagaacagagaaaaggcagt

SEQ ID NO: 31932 - DNA, 1071 bp, Bovine  19866880607896
tcacaaaataatgcatgcttgtgagtatgactcagcattttttccttgaaaattagtcacttcagaagaagacagatcattaacccttgccctaaatatcgaaggttctatttcagcaaagtattttgagattcatgagtgactcaaagtagataatgattagagtttaaatcaagggaaggactataaagcattggccaaaatgctggagaccaaagaagagtgatgatgataaatagcagcaaaaccacttacaaacaagttttttcctttatcaaagcttcaaatacagtgccatactaactcactgtattgcttaaaatgacagtttctcaacatgtcacagtaaaaataatcaaatgggtttgccttaaaacatcttacatgttgttgaaatggtactgaaaaatattagattttcaaccaaaatgtgactggcagactcttaaaattggtgtcatattcactttaagaatatactgctcaacttttgcagatcccctagcttacctttgctcttgcatcaatgaagcatttaatcttgtctgccttcaacaaaaccaattaaacagtcacactgtccagcaagaattgttctttgaaaatatgaagcttaggtgtcagaacttggccagaatatgtgctcccaggcacaactagaaccctatggtcaactggatagaatttttcttctaaaacaccatttgctctttctccaaatccaaagcaaagatcttttgggcaaagtaactgaaaagacaggctcaggataaagggcaaatacagactgatttttttttagaactgaactttccttaagctagaaataaactaatttagaatttgtacacaagaatcagaaagatgtctttccttttttataacttttttaaaaagcaaaaacgtacccaaattttgaaggaaatattactggaataagagctatgaattcaatatttcagtgagtaaaattggaaaaaatctttttagtacagctggcttataattcccatgtattacttcctctcacttttctaccttcctctttgtcaattttctaccttttttgtg

SEQ ID NO: 31933 - DNA, 1554 bp, Bovine  19866880616955
tgactaatgagtatctttgtcactttggtatttagaggaataaaacaaatattttttgtttcttgcatgtgtgtgtgtatgtgtgtttctcttttttcccctcattttttacctaattttttacttgtgatttaaaaacaaaaactcgtttcaaacattagtatcaaaagttgacttacttgttaaggtttatgagccctcaacaatgaaattattaattcttagggcttttgtagtttcaattaaagttctcagtctccatgtataacatatgtaagtagaatgaataaaaattggttctcaaatgaaaaagagtaataaacctcaacccaaatttaacagtgaaattgaatgtgttagtcattcagtcgtgcctgactttgtgatcccatgagctgtagcccaccagtctcctctgttcgtgggaagaatactggagtgggtagccattctcttttccaacccagggatcaaacccagaccttctgcattgcaggcaaattctttaccatttgagtcaatagggatgcccctaggggactgtatagaaagacaaatattaaaaaaaaatgtattcatttaaaaattaatttcctgccaagaatcttggttctaccataactgttaaccaatccaaactcccctaactattccttccctctggcaactataagtttgctttataagtctatgagtctctttctgttttgtaagtaagttcatttgtatcatttatgttttaattccacatatcagagatgtcatacgatacttttccttgggagggtcatgtacatgcttctatatttaaaatggataaccaacaaggacctattgtatagcacacagaactctgctcaatgttatgtggcagcctggatgggagagagctttgggggagaatagatacatgtatactggagaaggaaatggcaacccactccagtgttcttgcctggagaatcccagagacgggggagcctggtggctgccgtctatggagtcacacagagtcggacacgactgaagtgacttagcagcagcagatacatgtatatgtatggctgagtccctttgctgttcaccaaaaacttatcacaatattgttaatcgtctgtaccccaatacaaaatcataaagtcaattatagtttgctcaatctcttttttccccaacgtaatagttttctgaacttttgtgaagttagtgtatgagtactaatcagaaaaatacttgggggttatttgttgagaatcttactttaaccaaaactgcaaaggagtttttccttggatcaagcactggggcctcaaagcatcgtcatttaatatgcaatttttagtagactttcatctgaacaagttagaatttttaaagtgaaattagccctccaatttcattattatttaattatttatcaaaggaatcaggacgaagggaactttaccttttgcttttacatgcctgagtttttacttttggtttgatattagaacttcagtgcttcaagcacatctttttgaactgatatattgaaacggaatgctattccaa

SEQ ID NO: 31934 - DNA, 3279 bp, Bovine  19866880632605
acgaactaactatagcttttataagtgttctttgacaacctccacaaaggattcccaggtggcgctagtggtaaagaacctgcctgccaatgcaggaaacataagagatgtgggttcagtccctgggtagggaagatcccgtggagaaagaaatggaaacccactctggtattcttgcctggagaatcctacagaggacctggtgggctagtccatagggtcacaaagagtcggacatgactaaagcaacttaccatgcacaaatgctttgaccttcaccttctcaacttctctaaagttaacaagaggaaagctcttgtgatcccagtggaaaaacagggcaagtctggtgtcaataaacaaattcccttatgagttgaccaaaccaaatattcagccccaacttgctgggtgcttctccctgctacccggtgttccagtgcagatttgcagacttccctgttggccacccgggacctcaacctcacaactcacagtacacaggagacaggggaacccacaacaagaaatgggttcacagccttaagccatcggaaatgctcagtgcagactaccatcagcgatctcagtaacatcctgcctttacgtcaactagcaacttggaactctccccatatctcatgcacagaccacagacaccatcccccatgctctcacccaggaaaagaactctgtttgtcattttccagaagtctagttgctcaacctttgctggactatttctagaaggcaacaaacccaacaagcctgaaggaacaatgtggacagagtttgctccctctttcacatctcattttaatctcttcttctgcaaaataaacagtccaaggcccttctctcattccctgtttatggatacttcagtcccttagttgccctgttcttattacatttgggtatcaaagctagtttcaccaagggtgtttaccatcatcaccaagggtgtttacaatttctagttaatattattgataatgttattgacacagtactacagataatgtattatttatcacttgtctctataatgggaggcaaatgcctgggcctttaggagtgattatttactttcctcattacatactggagcacatagtaaccaccacttagctgctactttctgatttttctcaaatagttggggaaggggtttttaaaaaatcacatccatttttctttcaaaatcaaaacatagcttctaaaagtcaaattatttcccacgtatttttaaaaatttaatatgataccattcctggaaagacccatcaacgagaactaaagagcagtgagatttaattcaatgaggactggagggaaatgcatgttagaatatgtggaaaatctatgtgacactgaagagtcgagctaaatatagaagccaaatttttaaaaaattctgagtttgtgtccataagctaaaatgctgctaaatacgtcaatattaaagaaagcagcaaaccaaggcccactgtcctgcttcctatatgaagtgggcaaatattaagaagacactgggaggtcattatactttagaatcactgcatagcaggctgagaatagtgtagcagggaaggagaaatggaaggcaagaggagaaagaaggaaaagaaggattaaatctgtaacagaataagccaagcctacttgcctctacaaataccatttctgccaagagaatagaggatgagaatagtgtttcatcttcaataatccatctaacaacctctcatgtagctactataatgatttatgcagtaatttgtagaaaccatccttatctgtattatctaacatggatttgaaaaaagaacatcacgtatataccctgaaataagaaaactttaagagacaagcacacatccaaagctactattgaagagagaggagtaaaaagaaagaattgttctttcctgacatcaaaatgtggcaggtttaaaaccaggaggaagttatctatggatttgtgctgttttgttttgtttagatgatagaatctgctgagagacttttagaaatggaaagaaaagctacagcagatacagctgagacaacatgaagagctgtctttcctgaatcccaaacagcagcagataaaaagcagagagtaaacgaaaaggtcatctcacactcgtggccttctgagtttggggttttcctttttcctttggccactaccttgccagtcatttccatgttgtttttcttgtttaatcaagaaaaacaggcaagacaaaagggattattttccagaagctctgcttgtttagcgtcataggaatttgaggttgttatctagtatatttgggatgattcttcaggggtaacagcgaagtctacagtgtttatgaatttatttcctagtgtgatatttccaccaccttttactcttccggatgggtttcaactgcatctgtttgcttttcctgttgcttgtgaaagtacacctcgtgatcactatccacagctgctttgtatgagcctcagagaattctatgagcagggaaattttaaaacatacgagaccagagtttttcataaagtcttattaatcatattttgaaagggataaacgtcttgccaaatttgtctgaatttctggtcaagtaaaaggcaggtcttcaaaccatcagacaaaatgtattcagtttatatctagtgtgtccagaactacacccagctaccacatgggatgtggcacttttaaaatacaagacatggtccttgctctcctacatggtttaaagtttaactgaaacaatttagagagcaatgaaaaggtaaagcaggaggaagagaggtctcaggaggaacagaaatgccagcaagaccttgaactatttaggattcgtggagaggtagagagaggggactccagtccaggaatagcaagattaaagatatacaggagggttgctttgagaattttcaggaacactgagtaagcctgtgaggaagcaagcagagaaagccaattaacatgttcaaaaagtttcggttatttcattttcagttatttccaggaaggggacatttttatgctcattagagaattaaatgctttgattaattgggtttttatccccatttaagttctatttcctttaatgcaccatatttttatttttttgtagtaaactaaatacaggacctgaaatagtgcttcttcacaaccaaagtatgacctcttccctgaagaaaccacgtgttagcagcacatgttcctcctaccaccagcccaccctactgccagcctggtga

SEQ ID NO: 31935 - DNA, 1558 bp, Bovine  19866880633878
gcatcactctgctgacaaaggtctgtatagtcaaagctgtggtttttccagtagtcatgtatgaatgtgagaattggaccataaagaaggctgaacgccgaagaactgatgcttttaaactgtggtgttggagaagactcttgagagtcccttgaatggcaaggagatcaaaccagtcaatcctaagggaaatcaatcctgaatactcattggaaggactgatgctaaagctggaacttcaatactttggccatcggatgtgaagaaactgactcattggaaaagaccctgatgctgagaaagattgaaggcaggaggagaagggggcggtagagaatgagatggctggatggcatcactgactcaatggaaatgaactggggtgaactccaggagatgatgagggacagggaagcctggtgtgctgcaatccatggggttgcaaagagtagaacacaacttagtgactgaacaactccctaccctgtaactcacattgctattaaaaagaaaaaaacaaaacaaaacaagtaatattccacttcaattttgatttctaaagaagacccaaaatacgggtgtcaccaagacttttatcagtttctttgctctttgacattatagcacacactatctccataatctcagtatcagcaaatgttatctaggtgtttataggtggtgctgaaaccctagctttccattctcttaccctgacttgaactatggttagtagttagtctctgaaagatcagatgcattgcttctagagaaagtgtgtcctaatttgagtgattcagaagtacaggcagaaaaagtcaaaggttattttgtaattaatagcaatttatgaatatttaatactacattggacatagatttcctttgttgttttaaaaacattttcatacacaagtctagaaatgcatttggctcaactctgaaaaacagacactgaagaatttagagcagatagctaggcagttgttgaatttaagtcctgtcttaatctggggagaggaaaggcctatctccagcatgatctgatacagaaagagaggtaaggggggatctcttctgagtaattccactgagggctcactctctttgtctatatttgtgagtcgtatgattcactaggctggtagtgaaatcattagggaaatgctgtgcttggaaaattctctatatcagcttatttttgttgttgaaatagataaagcaattaagctgctattagaggtaactggctttctaatttcaatttgtcaaaagtaatttctttcatgttatacaaacatacatacaagtataaacctgccataagtattttaaataattaaaaaattagctaatcatttttgaaattattctaaaactaaaagtcccctaggagtgactacaaacttgcaaattagatcttaaagagggtttaaaaaaaaaaaaaatctcagtaaggtctcaaaccacaagagacaattttttttttaactccaaaattcatctggcttttataagcattgaaaaaaaattttcttttggggatttccatataaga

SEQ ID NO: 31936 - DNA, 835 bp, Bovine  19866880655262
ggtttgaaaggattgtgattcagtggcagaaacagaaaaactttattacattttttttatgaggcaggatagcttctatatcatacgaattgtctgtcacaaacagcatcatgctagagataaaactggattctgttagtcttcagtcacttttatgaaaccaagcagactggtttaattatatatttttaggatcctaaaactgactctcccattcttggctcttacaattttcaataaatacacactaagagtcccaaccttagagtttcttgatgtcttccaaacaaaatatttcaggtttgttcatttgtctaaatttatttagaaaatataaatataaaggatgatgatggaatagacccagatgagtgtgtgcatgctcaatcgctcaattgtgtccgattccttgccaccccatggactatagcccaccagactcctctctctatgggattctccaggcaagaatactggagtgggttgccatgctcttctccaggggatcttcccaacccagggattgaacctgtatctcttgcattcctgcatcacaggcagattctttccactgagccataagtacaatgtcttaaactttcaaatttacttacttctttttgaaaacatccatagtacagtctcattgacagtgcagtaaaatgaaagaaaaaggttttttactattgttattttttgttgaaatgtagttgatttacaacattttgttagtttcattcattattgttatttgaccttgaagagtaatgaactcggaaaaatgaataaataaaacagtaaatcattaacaataaataattccagttaggtccta

SEQ ID NO: 31937 - DNA, 1270 bp, Bovine  19866880666325
attaattaataagtaagaagagtagatgtcgccagagcagcatggatgtggaacataaaggatgtgtggcatatcaaagccaaaatttagagcagagggtatgcgccccattatgttcaaataatgcttaagttatccttaaaatttttcaatcagcataagagaggaaattttgagaatgagaaacggcttctaatgctgaccactaagaaatctgtggattagcagaaactctactgtgttggcaaatttttttcagcagcctaattcagatcctttgaaaacagtctcatcctttccatctgacccatttacttagaagtgataatgacagaaaataaagttactattcataaaacttcaagttcaaggagaaacttcagtcgtgcctaacacatagtagatattcaatgaatgtttattgaattgaaaagatggtatgtgatgatctcaatattgtgtgtgacttgggcagatctggtattgcaagtgtgaaaggaatttaggtgatccattgaatgaattttgatgaagacatttattttagtcagttactggagtaaaataagggtctttggtgggttacacttactagaatgatatgtgctacagacatttgcagtcttttaaacattagaattacttcataccacatacaggaagggaatatgtgaactaatttccttatgagtctctagtggcctattaacctaaaatcaatttttatcaaaatttaatttgtttatgctgtatcagtaaaactctccctgatgtttgaggtgttttttttttcctatccctttagttttctattttaacaaacaaaatatttcaaaaatgtctttagtcaacttagagatatttctgttttaatttcttatttctaaaaagagttcactaacaacagcatttcatatatgctcgcatgttctcagcctctttgacatttttatcatcctttcaaatgtatccttttttattttgtttacattcaggaattttctttgcccaatttatctaagacaactttcattttatttacatttttgctgagtatttagttctctggctgtgccaacaggctcaaacttagagattttgtggctgcatagcagaaaatgtgtgaatcactcctgtttgcctaatagtctctaattagttggcaggtgattccacttgaaataaatgctctggcaaggagctcaagctgctagacagtaaaggaaagacagagaagaagagatttctacagcattctgcctcaggtctt

SEQ ID NO: 31938 - DNA, 1964 bp, Bovine  19866880752096
attttatacaaccattttaaaacaggggcatttaaaaagttttgctcatgggacagaggagaacactttaaaaaaaaagattattgaactcttgtcaagcctattattgttttttacttggatgccattaataaaggtaaagctacattcatctgaacctatctaccgaccattaatctgcctggtttcttatttatctagtccaatgtgcagactggaataactccccctgcttagagataagtatgcattttatcatcagctaagagtccagaactgtctttaagaccctgctcagttttgtacgagtttaaccactgaggtggcaagacctcaagtcctttggccaacttctagcctttagctctgtttcaaattgataactttgattctttggaaattttaatactttgaagtatatttggctacactcaactatatgatggtactcacatgaaactagaaataacttagatgttcagcaatagagaaatgtgtatataaaatatgttacattcaaatataataagccattattcagttcagttgctcagtcatgtctgactctttgtaaccctatggactgaagcatgccaggcttccctgtccatcaccacctcccagagcttgctcagactcatgtccattgagtcagtgatgccatcaaaccatctcatcctctgtcatccccttctcctcctgccttcaatcattcccatcatcagggtcttttccaacaagtcagtttttcacatcaggtggccaaagtattggagtttcagcttcagcatcagtccttccaatgattattcaggactgatttcctttaggattgacttgttttatctccttgcagtccaagagactcttaagagtcttctccaacactacagttcaaaagcatcaattcttcagctctcagctttctttggccattatttgttattaaaataatactcaggatgaatattaaacaatagggagaaatgtttagaatatggagttaaatttttaaataatgaaaatattgaaactgtgtatacaaaagaattccattttatggaaattaatacgaatgtgtgtgtatagtatatatgacaggaaaaataacaaggaattaaacactaaacaaagttaaagttataaaggaaacttcctttccctcttcctgtatgatgtgttttctaatgttttgcaatgtgtatgtattactttgtaataaagtgaagaataattcacaaccaagaagtcctgcatgtcttcacggaagattcgctctttgttttatcttaggatgaaaatggagatgttcctgcctagagagttggatgaagaccgacctaaaactagtaagagtgagaggcagtcttatagaacctgacagaacggcttcagtctacacagatccctctctgttctgaatttccaagctgcgaagagctcaaccacaccaactggcgagcattcagtctactgttctttccatcatccattacatttaccatctcattttcagttgggggactgttaacttggattccatcccaacagaagaaaaaaaggataatagaactataaagaagaactccagtgctatagattggctcagctctgctccactggtggcacaatttcgttactgataaaagacataaagtgtctcctccctggtgctagttactctgtctcctgcacctctaaaacggctttataataataccacgtgtgacagcataggggttccaatgagacgtctcaaaacttcaccagtgcccaagtgtaccaaggtcaagacttcaaggtctcctagtgccccactcagctcatgagagaatcatatcagtgtcagatccagtgcccattaccaatctgttaatatcactgcacttgggtgtttgtaatctcctttgaagttgtgtttgacgtatcttagtatttccaatgatgctgtgcttggtactttg

SEQ ID NO: 31939 - DNA, 1576 bp, Bovine  19866880809547
gacagggtacccctataatcctctttaaaaccaccttttacttacgtcaacagggaccagaagacttttcccaagatgctgattaaaagagaggcaccaggcttcggtataaccgttcatgttaggaacatacttctttatcgtctcatcattgagcctcagccacacaccatcatcattgtggatctatgggatacaagcaacagaaacaagccatgcccgcctgtcattccgaggaaggtagcaaagttctgaaaggctcaaagcaggcaaataatggtggacatggagattaagaacctagtttttgcataagtatgggagaaccttttaggaaaacaaccagcaagccaagcaatacaataatccacatggtgagatcgtaaaacacattgtcacttagaagtaaaagcacaaagaagtcacactttgagataaacacttcaataataaaagcagaggtttcccaaaagaatacaagcctttcttcccctcaatttagattttaataatcagaagttacgtaattgtattattagaaaaatgtcctgtccaaagttaagtgatacaataaacacatacaaaagcaaacaacattttaaaagttcaagaaaaaccactcattttcactgaattctcatactggctctgactagtatgttaatttttatgctaaaaatataattttagttatttattgataaagaaaaataaatgcaatatttgaaactcaatgaataaatttttaaattctgtgaaacaattttccaaatactacccaaactgcttaaaacatattctaacaaaaaatttagtaaccttatatcatgcaaacagtgcaaaaatttttcatccaaaatttattaccaagtgtttctttacaaattacctcatcaatgaaagtgatggttccattgaccttcactatgcctatctgctcactctgaagagaagggtggctacggatacgcagccctgcactgtccttggccacaaattttcgaacctgagaaaggcaaagacagacagatgaaacagggaaatcatggaagagagaccttataagtggtaagagataaacagacttgaaagtataattctgagaaagcttccaaaattatttgtagctggtcttcctgtgcaaataacaatggcttatttttaacaataaagagaacatttttaagtataaaactgtaaatcactgaaaaaaatagaaaattatttgtatattaataagttaatttctaaactttgaagacatgataaaaaggaaaaaaaaagagcctttttttccttttaggaaggtatgatataaattctattacccatgtttcttttttttttaataagtaagtagtttactaaaattcctatagcacttactctttagatgttaggaaatgaatttaacagcacaggatactttaatcttgagaactttacacactttaatgtcaacagacgttttgttaattgtaaactttcaataacaggaagtatacagagtctataaattactatagcattataccaagaaccaaaaagtacagttttatacttgaattaccatgaa

SEQ ID NO: 31940 - DNA, 1078 bp, Bovine  19866880841866
cacccaattctgcaaatcagaaccacaaatgagatgttacctctcacctgtcagaatcatcaaaaaagccatcaaacaacaagtgttggtgaggatgtggagaaaaggaaagcctcatgcactgtagataggaatgtaaattggtgcagcttctatggccaacagtcactcctgggtacttacccaaatgaagagaaaacactaacttgaaaagatacaggcacccctaaatttatggcagcattatttacaatagttaaggaagtaatgcaagtttccatcaagggatgaatgattaaggaaaatgtggcatatacatacaatggaatatgatccagccacaaaaaagaatgaaatcttgccatttgtgacaacatggatggacccagaggatactatgtttattgagtaagtcagagaaaggcagattaccatatgacttcatagggtatgtagaatccaaaaaataaaatagaaacagacccatagattgagagaactagtggtcacctctaagacagagatttaaactctattattattttttagaaagtccaatttaattgtacggagtttcttagcatttatttttatgacaatagggaatatatcgtatctgtagatttgatgttaaagatttgcatgaataatagtttgggtcaaaggttagtggttcaggaagtgtattttataaactgacctctaaagagcagaatgttactaagaggcctcaatgaaagtcatttctgtcactgggatactgattctgccatatttttgaaacttacctgatatggttgctactagaactaacgtcccattttccttccagtgactatcatcaatcccttcaaaaaagcaggcagctccttgattacaccagaaaggggcattcatttcaggtcggagatggggaaacgtgcagtttccaagttggaagagttcataccattccatcgtgtagttcttctccgttaaagtactcctgaatccaatggcatcatgcatgattttctgtgtaaaggtcatatatgtataaaagcatttgggaaataaccacggttcaggagccagacag

SEQ ID NO: 31941 - DNA, 1990 bp, Bovine  19866880918801
aaaattattgtgcatactcaagtatttataggtaaaatgagcttatatctgagaatttctttaaacaatctaaataaaaagagatagggcaatacacaggaatgattagaaaaatattaaaaattgttgaagttgggtaacaggtatgtggggactgatttttcttttataaaaaatgttattgaaatatagttgctttgcaatgctgtgttagtttcaagtgtacagcaaagtgattcagttatattgatacatatctatatatacatatatatatcaatatatattttcttttagattcttttccattataggttattatgttattgagtataattccctgtgttatacagtagggccttattggttatccattttatttataacagtgtgtatattttaatcccaaactcctaccttatccctccatcatcttttcccctttggtaacctcaacttttttctctatatctgtaagtctatttatgttttgtaaataagttaatttgtatcatttttttagattttacatataggtaatatcatatgatgtttatctttctttgtctgacttacttcacttagtataatattctctaggtccattcatattgctacaagcattattttattcttttttatggatgagtaatattgcattgtatatatatatatataccacatcttctttaatcatttatctgttgatggacatttaggttgcttctgtgtcttggttattataaatggtgctgctatgcacattggagtgcatgtatctttttgaattataactttcttcacttttcacttctttgtagatatatatctaggagtgggatcattagatcataggatatttttctatctgcttttgtgtttgtttgaaattttttctaataattatttttttaaaagtgaaggagggaggagggttcaggatggggaacacatgtatacctgtggcggattcattttgatatttggcaaaactaatacaatcatgtaaagtttaaaaataaaataaaatttaaaaaaaattaaaaaaaaaagtgaaaaacatgtggctattcaatcaacacttattagttgcttacttgagccagacctcaagagaacacggaaataaaatcagaaggctcagttttttgtgtttatgaatgtaagcaagtccttttactccttttgtacttgatttcctcaccataaagttgaaatcacaatgataactaccttcctcagatagcaccttgctgctacagtagctgaggacacaaagaaattaatagcctcaccaaattgatggtggacttgattcccaaagaagaggctgacccaacagtaccttaaagtccaaactctgctaatgaactttcctgtggctataaatgatgtccttaatgatatctgcactgtcacacgaactctaccaaaaatatagccttagaagctatgattgcctcaaaatgtctttctctagagactaacatttacaagttgtcattaattctcagtgtaacaagttaatgcaaacagtgctggaaattacatccaagttctgttaaaaacaggtcatgtgtaaacacagctaatggtaagaggcaacatgcaggaaacaatgccagcatcagcagcatctttgactataaagaaaaactacgtgtcatcaagctcagtttaagcctttactcccacaagggtagttctgcatcacaaatattcaaagccatcaacttgaaggagaatctaataatgatagggacttgggggtaaggatttgttattttttttttattaaatcacttttattactcgaatcttgaataaaattaagttttagcaaattgttaacagccttaacaggatggagtttggagggaaggaatgaggggatgtagaatttttgagaggttctaagctttatgttctggtgcctgtcctcactacttgcacagcttgataggcatgactcatgctgaccgtgcatctg

SEQ ID NO: 31942 - DNA, 1777 bp, Bovine  19866880956331
ttactatggtgcctggccagcatgggtggtttcagtcagtgtacttcccctaacaggtagactatcccttctctaggggatctttccacccaggaatcaaaccagggtctcttgcattacatgcagattttttaccaactgagctatcagggaagcccaggaaagagttaaatgtgaataagttaaaatccatggcttgggaaatagatttctgaatgaggaagatgaacagtccactgaagaaggaggaaacagacatttccatcaagtgagatgaaaattgtcagtggatagtgtgagtcaaataagcaagggatgcttttttttttttttttattgcactgttcccttttctttttcttctcttaaaatttcttttaaaagaagcctaagaagcagcatgcaacgcatttggaataatgcaaatttactctcaaattctgaaaaatagctttttttttgggggggggtgcatttgaatgaagttcattttcttgtaccttagaagttctcatttttgtggtagtttgtgttatacttctcactgtaagcagtcttgaaccaagctcagccatttctgaaaatgaggcccacgacatttctttcaaaaatttcctgttaaaaactctttctttgttcagtgtcacggaaagaactgttggttgcacagaggtcttttaaggaagaaaaacactctataaatagcaagctttattaaatcaaccccaattctccactccatgaggcaaaaatcaagctttcttgaaaactagtggcataaagtttttctagattgagaggagattgggaatgaagtgatgagaagcctgtctcttcactccttgcctcctcactccatgtagggatagtgacccaggcatttaataatcgtgataacaatcagatcagatcagatcagtcgctcagttgtgtccgactttttgcgaccccatgaatcgcagcacgccaggcctccctgtccatcaccaactcccgaagttcactgagacaatagcaaacacttatagagcacttaccttgtgctgggaaatgttctaagcactgtgttctgtaaatagctcaaggactcctctcacaccccacgagggaggtatgtttttggacgtgggaaacaggtacagagttgacgagacttgtcagagatcatgcaagcggtatgtgggctactgtggttttgccagttttactcatagatcaagatgacccctcatgggatatggtttatgtctaccagaaggagaccttcctagtcaagcatatatccttaatgctctctgagattcttatcttagtctgaagcctgatcagtacaagcttcatgtgagttaagtgttgagggtagattttattcaaaggaaagcctcaagaaagagacaagtcatatttactttcctactgtcaactaaaacatatagtgacaacctgaaagtagagagttattttatttggtgggaatgtttaggactctgagcctgagagacagcatctcagtagttctgatggggaagtcaggctatatactagtttgtaacaaagggagcaggcagtctgaacatcaaagatcaggtatcccctgggctcactgaattcattccgttcatatgcacctcagctatctagggccactccggtttccttgtttaccttgctttttgcattcccccagatcttcagcaatcatggggcatggcagcatctgatggatcacagttttgggggccctcattcacttttggaggccagaaaccactgatga

SEQ ID NO: 31943 - DNA, 1071 bp, Bovine  19866881021674
acatgacactattatgtttccttgaaattcgtcttttaaaagacattaaagtgaatattatatatgaatggagataattagctagaaattgatactacttatatttacaaactaattaattgaacttgactaatgcttagtgcaaacctagaaaagcttatactccagtatattcttttcctaagatagataataatatcacaatgaataataccatttgctaacgatatactacctggctcctaacaaaaactaaaccagctggtattctcttaagcaatcccaataatagttatgaaggtatttttgtagaaaaatagtttagatccaagtgtgaatgtacttccttaaagtaaagcaaagaggtcatgcacttgaattcagacagatgactgtacaagctgagataaactctctcaattctgtgactgtgtttacatactatacagttaatgtgtgagctgacggccaagaagagcatattggtgtcatattaggagttttgagacatttatggggaagcctcagcagcttattaagaaaaaagaagacttggctagtataagtgcagtttgtttgggtctattttccagatcagtatgaattactattgatatcatggatgaagggccttttgcctagaaggctgaactgaatcaaatgaccagtttaatatattaagaacaacaacaacaataagcaagaaaagagacaatttgagataatctggaaacctaagttgttagtcatttcagagacaccaaattcacttaaaagaaacaaacaaacctgcccagtacggcctctcctccacccactggtaaagtgaaataggttcattctcttggggcattgccaagtaacaaaactccaatgtaaatcaacaaaagttatccctagaactggtgcttaccagtcatgcattttataaaaaatattaaatcaaatgttttctttatatattttatagtattatttgcttattttggaattagaacaaaaataacagtaatgttttaataactgcacttaataaaaatgtaattacaaatgtcttagctaggtatgtct

SEQ ID NO: 31944 - DNA, 1436 bp, Bovine  19866881026211
cagttcagtttttaatcagctttcccctttatatggagtaaaattttttttaatcacattaaaagaaaaataaactttgttaatcctaagttatattcaagcagagaataaaaataactactttgtggttatttagccttatatctatttcctctgggaaagtatcttaggaaattaacatattggatataatttaccaggctgtttgcctttttttaatatattttctgtgccgtattataattcacctttaacaggaatatgctaagatagcctgtagcaagacccacccttgtggccatccatgtggaggtgttaaaaacgaagagcactgtctgccctgtctacacggctgtgataaaaatgccaccaccctgaagcaggacgccgatgacatgtgcatgatctgtttcacggaagcactctcggccgcaccagccattcaggttgtctgtgcttgtaaagcattaagtgtctagatttttcagtaagaaatataaatatactcatcaagtaaagaagtgattgactctcttataattgggtgaaactgtcccactaatgtctaccagtttcttaaagagcaaatgctctttttgttctgtgtccatgttgtacactgagcttttatctgtggtttgtatgagcctgtatagtcaagtgaatgtctaaagtgttcataagggagaaaaaaaataattattcaatagcttctctcttcttaatttccaaaattcagcatggcattttacagcattatgtaattgatccgtgcataataatacatacctctatatataatgtatatacatacatctgtaatatactagtaatattatggaagttacaatttgctcagtaagattttcattaacatttactggttgtttgtttatatgttcagttcttgtgactctaagacaatgagtattctcaaaaacaaatcttaaattttttaatcaatagtttcttcttcttcctaagaggtacaaaactgaatatttctcatttctccctaacccagcttactgtctataaggtgatattgatacataaataatgaaaattgggagaagctgaagatcttgttcgtaatgtcccatgaataacagaaggctggaatttcattctactaaatttccagatttttctcttacctgctctaagtagcagcctacactgaatcatctgtcagttattcgtaattatggttattacatgtggttatatcccttctccttttttcctttaagctggactgcagtcatgtattccacttacagtgctgtcgacgagttttggaaaacagatggcttggtccaaggataacatttggatttatatcttgtcccatttgcaaggtatggaaagccccagaaattacctacttcctatttatgttcatctcgtcttcatctttgtctttcaaaataaca

SEQ ID NO: 31945 - DNA, 891 bp, Bovine  19866881051465
aaatttcttcttctcagtctccactgttgagttctaattttggcatgccacagtattataggaaatcatctcttttcaaaacactaaattggcaaatagtccatgtatgggaatagttataactgtctctgttctagacatcttacccactattttcctacatgttctgtagtcatgagtaagtatactgtgcctacagccctccaccctgacttctgctcccctgcagagattcagggtgccttaaaattcttcatagattcgattcacaaatgccactataattcagccacacttcagatttaaatgtagattattgtcctgtaccttgaaaatctttcaatttacagcagtgcaatatatccaggttaaaagtcaatatacagacctagtctataaacaagtcttatttgggcttatgacagatgctgtataaactcattcccttgtgagtgaatagtgtcaaaaaccattgtacagtacactgaaatttaatccttgagaagagttagattctcaatgaaatatactgaaataagtcatcacaaatgtgaatttacatagtatataatgtttcttcaaaagtaaaacatattaactaactgcacagctaaaatccttgctttaaatgtgctttcatgtaaagatgcacaaaacaggacttcattgctgatcatatgagtatttctacttacaggcagtataggtacagtcatgaaaattgtttccagtggtttcacttatgtaacttgcgctcggaagccatatagtacatataatgtaagcagacctgtattttaattctcaactccaccacttactagactcctgccatctgtgttaactttctttcttcatctgcagctattatagtattgcttatctttacaa

SEQ ID NO: 31946 - DNA, 1507 bp, Bovine  19866881131764
aaaaggcagagggaaaagcttgagaccttgtaaaggagaaaaacaaacccttctccaggagaatcagaattgaattccaagactgagaaagtaaaactgtttaatggacatgatatgagaggataggctgcccctttgtaactggttttccctcaaagcagcacgccacagttttcagagcactttttttaaaatgaccattgtctgccctggaagaaagggaaaaaaaaaaagtttaagatggctgaagatatcaaatttaaattccagacttgtatccactagagtcagcagaaaaccctgccaatatagacagtttatttgggaaatactcaaagcagcaaaacttagagaaagtatgcagagatttcttgtccttggaatgagacagaaagaaatccagggacatattgtggtgacccacgacttcaatcagcatgcacaagcccatgacatagtggttaggaaagcattcagaactacccagtgtgacaggagaaatattgtttcacatatgtgatttctatccaaatccactcagatccagagaaggggataaagaagtgttcattaactcggattacaaaggtctaagaccactcccaagaaggcccacaacctgaaaagttcaatgaatttaactcaacttattggtgacagtgaactttgggtcaccatccagtcccaactgtattagctatttcttgctatgacacctttacataaacacaccacaaatcttaagtgactcaccatcttaaacatttattttgctcacaagtctatgggccatttggatgacccttctgcaatgggacaggctcagctgatgatggctggacttgctcatggatctgagtcagctggggtctggctgtctatggcttcagtatacagctgggatatctcctatcccattcatgtagttcctctgttcagcaggttagcccagccttgttctcataaaggaggctggggtccaagggagggagcaatagcacccgaggcttcttgggatccaggcttggaataagcagatcttgatatcggctgcattttattggccaaagcaagtcacaacatcagccggattcaagaatggggaggtagagcacttctttataggagatgctaagatttcacattgcaaggagcatggatacagggaggggtcatcaatgaaggccattaggacagctaatctaccacactagcaactgatgtaagagaattagttttgtgagtaaatcaaaggaacttggttaaagacaatgtgatatcctggcacagcaacaacaaaatcatattggtgagaaaactactgaaatctgaatgaagtctgtattttaggaaagagtaatattaatctcctagttctgaaaaattcatcatgattgtaagatgtcagcaagaggagaagccaggcaaaggacatatgggaattataccgtctttgcaatttttctgtaaaactaaaattaatttaaaataaggaagcttgtttggg

SEQ ID NO: 31947 - DNA, 1738 bp, Bovine  19866881181509
gaggcatggcatcaaatgcttttaaaagattaaatgtaaaagtgagcatttagtaatgagtattttaaaaattccagactcagtcaaaaggagcacaaccccctaaagaaatactgagtagaactaattccttggataagctggttctgcagagttgagaagtaagagcagctgtgaatgttggcttcaatccagggtggtaagttagggatggtctgctgctcttcgtggaaaccgttcacaactccactttttaagatctgtaatagggattgtttatccattgtggttttccactgatttctctttcacataaagggaaataagccttggtctaagggtaaatccttctagactgcacaacaacataaggagatgaatcttactttttcgttatttttataactgcactcatttgccctcttgtcataatgagacagaaagaaatactgatatggaagggctgatttatcaatacatgatgcttgaaatttatacattaaatgcaattcttactaaaaaaatcattctcgtgagccagccataatgtctaaatttctactattagtatccattcctttcattttacaaagtgctatgttaaactattcaaattttaacatgaacaaaattactcaaattctgaacaaattatatttttcacactataatctctgaatgcccagagatttattggactgtgataaaagaatacatatatgaagcttagacttgatcatgagagatcttcatggacccaagtttcttttgaagtgcctctgaagatggtaccagaacaagtttatctccagtgttgcaaggtaaggggttaagaacatgcttaaaatcacacatctagtaagagagctgagagttgagccaaatctaattttaaaacattagtctttatcctatattgtgttgcttaggggagtagaactgagaagcttaatcttctcaggtaacatgacaataatcccgggaattatgtatggcatgtctttttcctaagtgctagtttttccagactacggaaatgttaatcagtgttctgtgaaaacccttggcccgacaaagaatgatctaagaattttgttgtctgtatcttgagactcatgtattaaggtttaaagggaaagtggtaatgatagttttcatttaatagtacttgtataagtttaccatggttgctatgacagatgaccacaaactgtgtgacttaaaacaacagaaatgcatttccttagttctggagacagaagtccaacatcaaggtgttagcagcaccatgcttctgaaggctctaggggagaatccttttcttggctcttccaacttctggggtctgctagcattccttggcttgtagccacatctctactctgtctcaacataacgttatcctcttgtctgaattacctacctctgcccttctctaacaaggatatttgtgatggcatttagggaccactcagacaattcagggtaatcttatctcaagagccttaatgaaatacatctacaaggatcctcttatcatttaagttactatttacaagttccaaggattgatacttaatgtctttgtgtcattattattaaacccactgtagtattatatttgggcttccctgatagctcaggcagtgaataatctacccacaatgcaggagatcctgggttaatccccctgggttggggaaaatctcctggagaaggacattctccagtattcttg

SEQ ID NO: 31948 - DNA, 1869 bp, Bovine  19866881317743
agcccctcaaatatctgggaaacaggcaggtcctttcaggttttctttctttatcttccacaacagagagggaaatggtgaactggccagttaaagaaactttacctctggaacaaccaaaaatcacagaaatcttcaccacgttgggcattatacacttggcatttttggactttgatgaatagtatctccccttgcaattaaaaaagtacatgaatatctactaagaatgatactctgttatgtgctgcccttccggagtttttcagagtggaaaatggcattttttaaaatttggggcttctcttttgttatagtaactggcaaaaatttcccaagttatttacaaattattcctcattaattcattatctttctccattactttctgggttggtgataaagaatccaaggtgagatgaagccctcatttctgtatgttgatggaaagggcagtaaaaatatcttcttgttcagcctttatcttttttctttggaaaacattggatgaaagtcacaggttagggtgagaggaatgtgaaggaaatgaaactaggagtttagatttcctggtgacttgggttgtttgcttttctttatggtgtagtcttaatattcactcacctttgacatctatttgcccatttgtaggaggggaaaaagcatttatttctttagttttgtttcagggctccatactgcttaacacataatagatcatcagtagaagtgtgttgaataaatgaatgagtgcttatgttaattcattcttttatgtattagggaaaaaaatgaactaacttagaattggcttttacctttttggtaacactaccaagaatcacttttccctctatatacctatgtatatattttttgagaaatttgtaattgtagttttcacaaataaatacataaaaatgactatcctctttgacttgaaagtcacaagaattatgatgagacctaaactgatttggttatttttttctcaatagttgttaggtggcagctgttccaaagcccaaaacacttgacaatatttccattttatgatggaagttaagttcactgacagctatattataggctttcctctggggctgttatttgttacagagttttgaaaatcttaactggaaagtttcaagaggtgcctcttaagagttgtacaaaagaaatttgacttccctgacatgctagagtgtactgtttcaaatattcagctggtgagagttgtgagtttttaaaatgacagctttaaggacttttaaaaaatgaatgatctgtacaatgatgtgctgaccttacaatagcagacatggtttttttttccttcagctcagaaccacgtgtattcaaatgtataaattctccccctcagtttatgttagaaacacagctgtaaggtcagtgttttatccagggatctgagaggctttcttttaaaatgcgagcaagaaatagccacagtgctatgggttgagtgtttatgtcctccccaaattcatatgctggaatcctaattcccactgtgatggagtttgagggtggggactttgggaggtgattaggtcatgagggtggaaccctgatgcatagagttagtgcccttatagaagagaccccagagagacccctcatttctcccaccatgtaaagtcaacgagaagatgtgtgtctatgaaccagaaagcagtccttcatcagacaccaaatctgccagttcctccatcttggacatcccagcctccaaaactgtgagaaggaaatgtttgctgcttcagctagatggtctatggtatttttgttatagcaggccaaaccaaaacttcattatatttggttgttatatttctcccctataat

SEQ ID NO: 31949 - DNA, 671 bp, Bovine  19866881401316
atatatctcagaaatttcccaggtttcataccctactgatgagttcattgaagttcagagaggtgaagtgtcctgtcctctcgcctatgttgtaatttcagtttcatgtttttacagtgaattgatgttttttgaaattgtgaaggagaggaaataagatggaaatattttgataaaaatgttcctaagttatctcaactctaaattaaatatccagactcaattccttcttaatcccttctgctgtggccagtatcagtttctatttagcaaccagcctttcattcaatcagcagatatttatcaagatagaaacaatgaccatctggtgtctcttttttcggaaccaaaaatcaggacttctcatctgacagacaatttatatgccttttctgtgtgtcaggagcagtctacaagatataatttggatgtgaacctgttgggatttctgagatatttttatggtttatggggacagtagttcagaatatcaaaaatcaaatctgatggtgcatccacaaataaacatccagtaagctgtggggaaggcaccagccacaatgagacaaaagtctattttaaattgaacttctggttattaccatttcatgtaaggaaaaagctagtgatgggatgaggaagaataaaaccttatagcagaaaataaagat

SEQ ID NO: 31950 - DNA, 2478 bp, Bovine  19866881609279
aaattacataaataaccttttgagggaagatcaggcaaattgttttgcgttgttatccgacttgtatttgaaagtaaggaagtatgtctatagaggtttgtagtctgatagtcaaatgattaatattggttttccagcaaagatatggtctttcataatacagatttgccactatgctgattctacatcagaatctgaacatatgttaggttcactcttactgtggcaccataatgctgtatctgatgtcccaaagaagactcagaaacatattgttcatggggaatccttgagagtacattaaatgaaaataacccataataaccaatgatttggtcctattaagccaggcaaatgtggcagggttgggaagaattttgtgtgttttttagaaacacatctctgatggaacatgtagattgaagttagcatgttgggataaaaactaggagaggacttgaatggaattctggttgttcatataatttctcctgctcagtcacatagactttattatcccaaattacaatttgcatcattcaaatgcaaatgaacattcaaagccctgtgtgggcttcatgtaatttctttctgggcaagagctgctcactgttttacttatttgaaagaattcagtgatgcaactgattccaagagaaataaaaaatgtagatttgaaagtgttcttcctattggaggggatgatataatcatatcaaattcacatctggttttattttgctgtctctctcttggcttccctaagtaatatattatatctctttacctgactatcctttgtttcccagagcccaaatcttcccagaattatgattccacttaaatattgactataaaagtatggaacagagaagaaagttttgaaaagcaaaataagctaacgatgttattatggatatgtggaaactcgttcagtggtaacacttcatttttggcctttatgaaccaatctcacagtcaaccaaactgctcataatgcagggcacttcataagtcaccaaagctgccttggaagtttattttaacatcttttgttcttgaatgtaagaagatattcacacaactttaatcctctccagctgttcattggtaaagaccttaacatgaggcttataggaagaaaattgtgcttgatttaaattctaaaagcagctctacaaaacgtctgattctctttagcctctactctcagaagatatatcaatatcttttcccctcagccccgtgacacttgtgcttctcaaagtttttcagtggtttttctgtggtcactggttcaggttactcagtgaaaaactaaatggtgtgatcttctcttcagatctttttctgaccagcttgctccaacggagaacatggtttggttctgaaggggtcctctggagagctgaccacacaggacgctgcatggtgaaaaaggcgcatgggacaaattagcttgggaaattaatttacagcttataaatgatcttataaataagcttataaatgcttagtagcatattaaaggggcttcccaggtggtgccagtggtaaagaatctgcctgccaatgcaggagacataagagacaggttcgatccctgggttgccaagatcccctggaggcgggcatggcaactcactccagtattcttgcctagagaatcccatggacagagaagcctagagggctaccgtccatagggtcacagagtcagacatgactgaagcaacttagcatgcacacatgcattaaagtgtttaagatattctgcagtaaagaatttctacttaactctgcttcacccagtagtagatcacagtatttaagaccaccactctgaacacaggtagacttgtactgaaatcccaggctcaccattagccctgagacttgggcaagtttcttccctgcacaatgggaaaatgagtcccagctcaggctgttgtgggggcggaaaatatatatatatataataatataatatatatataaaatataatatatatattaggtatataaaatattcagcagagtacggaatagtagtccatacttagttactcacttttagtatgatgttattatcttatttgattgtatgacttgttttctgggaaacatacaaggaactactcttctaagaaaacgtgatgagaaatgctgatctaatagcttgatatgtgtagcaatacttttaaagaactgagagggtcggtacccttatatcacgagaattctctattaagttggctgatacctctgtcctggtattgtattcagaaacaaaatatatagaattttgggtagttaatgtgaaatcgagatgtaacacacaaaggttgttataaacaaggcctgttttctgtctggaatatcaaaagctaaattctaagacctaaacatccagaaagaagaaccaagagggtgagagagaaagaagggaaatttgtttcctggtgtagagaagaaatt

SEQ ID NO: 31951 - DNA, 2094 bp, Bovine  19866880495399
catgaggcccagacgtgtgctcctcgctgtgacaggggttagggggagaagtcccctgccttcattcttggggttaggaacggtaggactctcggtgctacttcctcaaaaaaaaacactccctcacaaatgtatctttctcctctatcctcctgactcatcttccacgtcagtgactcctctgttccgggtttctttggcttactcagaatgaagggcctggtgggctcttggaatgcggtgtccctcgtcattgctcctcagccacaagtgcccctggaagggccccattttaacaacatggaacattacagaaacgcttgaatatgtaagattaccttctcaaagaattccagcggtggtcttccctgagggaaatggacgggcaaaggccagaactgacacatatttttcattctcttgttttgggggatttttgtatcaggtacatgaatgttagagctaatagactgaacctaaggaaactaccaacttttgacaactttcaatctaccattttcagacaatcttgtttgtcctcaacatagtcaactgcaggaaatcagaggtgaattatttgatgtttctcctaccatccaatcatgacacctgttaagtggccaaagctgtccctcatctcttgctctcaaaccttgaccctgctatataattttccagcttctatcttctactcaccaagtttgcttcttgaagcagaaaagaagcagaatggaacctatggaagacaagaacattcccactctgtccctatgctatgtccaatacgctcaccaaggacccagacaaacaaccctctggttttctgctgaatttattctcactgcctacaggccaatggagagagagtgccattccatggcacagatgcccattcaaggatctgccacagattcagcctcatgtgtagacatatctgtctcctgcattacatgattctttttttaagaaaaaaggttatgtctttatcccccaaatgagaacagtgcgaagatcaggacagtaggttctcaacaaatgattactgaatgaacaaatgaccttgttatgaatgctggcatgatttcatagcataaatgaactcagcaaatacttgacaccgttgactccttattctggttacagggcaagagtctgtctcaatgtgcagggggatacaactgtgaatcattagcgtatgcagactcaattactcaatgggccgtgtatgacagatgtcttggatacacagtcctagcacacagaaacgcactctttttgaaaacatcccttgacaaagaagggtagccagtaagaccctggctcctacagacgataattccgttatgcctcagagcctccaaatttctatcttgcttctaagtgatgaggaatttcaagtctccaaggaggacaaataacaggagaaaacttggtcaggaaactccaggcccccagggctagagtttagaaaacacctatgcaggtgaggccgctttcaagaagtttcgactatataaattcctctttgtcagacttaccctgtattagtctaagacagttattatattttcttattataagcgtgcactgtgtcctgcacctggagcacttgccaaattgcagatttattcctctttctatacatctgcaaaaagaatgtgtgttctgtttcatcagggagttacttgaagtcacagattgctaactccaaatgaatagaaacagtgattaatcttgaagatacgagctcgccactattcatgtaacagatgtccgttatgatgagttacacatttgttccatgtttacactaaaatacaaaaagaagattcaactattttgttaaaaaaaaaagaaagaaaagaatgaatgggggagggggggaggtagggaattaaaacatactggaaagtgtttattcaggtgccaggttagatgcgatctcaacatgcagtacgtccacagggtggcaggtaaggaggcagggagcgagggataagctggggtaaacgttcctggcttcatgtcagggtgtggatattaactcacttcatctcccttggctgacagaagcctaaagccaaaaccggcaat

SEQ ID NO: 31952 - DNA, 3917 bp, Bovine  19866880527023
catgaagtgtatggtttttttttaaacatcataagcttattattgcttttattttgacaattaacttactatgataataatatgcattgacaccccccccatccatctatacagagtagatgtttaataaattcttgttgaaattcattgtataaatacatttataaagttggaaatctcctttgccagaaagctgagaactcttcagtacgaaaaaaattcagggcaataagaaacatttcagtagtttgtaatatatgtgtgtatgatatgtatcatgtatatgctattcatacatatataggcacacacatactttataggaaacatttctaaagacatattatcaaatgatctttaggtgtttagaggaagatttgtacaagaaaggtagattcaaaaagaaaagctgccttaacttactttattgcttctttgctaaaggtatttattcagaacatcagaagtaaagctttaaagtcaaatgtctggagaaatttaaatatatgtgaatgcgtatgtttaaattgaagaagaatgttgacagaaataaatcacttttagagagaattcccaggacctggtcccttttaggaaagctctcctggtccttgtgcaaatacatgttcctttaaagtacttgcccacataatttatgggtttatgtctgtatgcctctgtttatttttggtataaaaatccttgcttataaaaagggtagttaagtatggtactacataactgtgagcccttttgcctgacttaagagtttggacttaaggaacataaactaaagtcagaggtaattcaattaacattctgaacgcacaaaggtatgctcgcttctcagctttagggcacaaaacaaccccgttaaattatagcagtaattacaccacacatgcacattctttaaaatttcatgaatcacaaggctgagctctaatttgagatgtttgtgtctgtctctggagaatcaactgaaatagaaatcttgaagccaaagagctcaactcccatgtccagattcacaaaacaaaacccatcaccttccagtctcaagacacattccagattctcccagtttccttaccactcattctaactcatcactaaactctgtggatgatagctctgaaatagctcttgaatctgcctacttctgcccatcttccttgccatcgtcctggtccaggatgccatcttctctcgttcatatccgcatcagtggtcttctgcctgttctctctgcccccattattgtcttctccagtctccattccactttgcatacacccaaacttttaatgaaataagatcacacctggaaggctgctgcaaacctcagtctacatgtcacttctccaggccttttcctgggttccactcccttgcaccaccctcctgaaaccccttgtaattcctatgtcataacaagtgtcacataggattgtaactccctgggtacttttctttttcagtatatcataagttctgtgagggtagggactctgctcgtcttgttaatcccagaacccttggcttccagcctgggggtgaactctcaaaatttgaaggaatttatcataactttttaatattaggccagtttagaaccacaacatgtaccaacactttttaatgtgctgctgctgctgctgctaagtcgcatcagtcacgtctgactctgtgtgaccccatagacagcagcccaccaggctcccccatccctgggattctccaggcaagaacactggagtgggttgccatttccttctccaatgcatgaaagtgaaacgtgaaagtgaagttgctcagtagtgtctgactcttagcgaccccatggattgcagcctaccaggctcctccgtccatgggatttttccaggcaagagtactggagtggggtgccattgccttctataatatccttctaatacactatttttctcatgctagaacatttatggctctaaaggaaagttccccaaggtgtggtgtatcctaatagcccttattttaataagaatagtaaaattttataaattttttcttgcactaaagttaccaacttaaattccttcttttgactttgagtgaagtgctaatcatgagattttaaagtgtttttattttaggtatgctttatgatatcttactgtgaagttatctagaactatggtaataaaatgtgatagggaaatctgcccctggaatgtgtggagtggggtgtggcattgatttccttaaccgtgttagatgacctttcatgtgtttttcttatttcttcctttaacaccttatttatagatttttttcccccgtgaccaaaaaaatctggtttggtttaggcttagaagaatgtgatgcaagaagaaaaattacatatgtctttctgtatgtgtgtttgtatgtatgcatatatgattgattaatgactattattagccataagaaaaatggaacatgtgggagttcttggagaagttcattcacagctctgttgttaaggaaaggtcattgccagttcaagtgcattcttttttcccctagctttattgagatataattgacacataacattgtgtaagtttaaggtcaaatgaaatcttgtctttattgcaaatgttaaaaatgagtactattgaacaggctcagtctattttacaaaaatagtaggaaataaaagcaattctcctggcggaagtcaaaacaaatatttaattattgttgttattcagttgctaagtcatgtctgactttttgcaaccccatggacagcagcacaccaggctccactgtcctccactatagccattgataaaactgtcctaaaatcccacaagaaagataaacctaagcatatacgtatatacagaaataattgtaagtggcatggtaataacccagggtgaggaggagagggaaaagtaggtaagggtatggaagaaaataagaaaggtcctgagttgatagttcttgaaactgagtgacgagtacatggtgagttattatatattcttctgacttctgtatatgtttgaaagtttccatatacaaagtttttacagaggaaagaattatgtagaagtaaaaacatcctgaagctgataaagcttaagcctgaggaccaccactggatgggtcccttctagaatgctggcaggagcctctgtcttcaaatggtcatatgtttgtgtaaaatttgtgaatgtaatataatttaactagagtggactaaaactgctgtctcttcctatttcagaaccccctctgttatacttctcttcatggtatccaagaggtcatgggctttgggaggacctgctaagggaaagttgagttggggatacaaatacaaaacttttggtgtgtttacttgtggatgaaaaatgcagatataaaatcccagctgtgactttgacacccccatgattattggaatatatttattataagtctcttctgtgtatattaccactagttgtgctagcgtaggaatggtttccaggaagactccagtctccgtccctctgatgactcactctgtgttatgacttgaagcataggaccacagattgtattggggtatgagtgtgctccacggaatgtggcagaaaagtgtgtagatggtggggaaagaaataaagtttgaaatgtatgaagccagaaatcattctgtggacatttttgctaatcaacagatgtgtaaaattatatgcattggttttggttctcattgatacttagttaaactggaaatcctctccagtcagaaatatactcagtgctacaaacataattataaatgcatcctatttttgcattttgattgaagtcaagagaaatataatttatcaaaatgttgtgccgatagtgtacagaactctactaccagaagcataaattttgagttt

SEQ ID NO: 31953 - DNA, 764 bp, Bovine  19866880558977
taaaaagcagagacagcaaattaaaaagcagagtacattactttgccaacaaaggttggtttagtaaaagctatggtttttccagtagtcatgtatggatgttagagttggactataaagaaagctgagcaccaaagaattgatgcttttgaaatgtggtattggagaagactcttgagagtcccttggactgcaagaagatctaaccagtcaatcctaaaggaaatcagtcctgaatattcatgggaaggactgatgctaaggctgaaatttcaatcctttggctacctgatgcgaagaactgagtcattggaaaatatcgtgatgctgggaaagactgaaggtgggaggagaaggggacagcagaggatgagatggttggatggcatcaccgactcaatggacatgagtttgagcaagctctgggagttgctgatggacagggaggcctggcatgctgcagtccatggggtcgcaaaggttggacatgactgagcaactgaacggaactgaaagactaagcacattcattgatagctgatatattctaggagtttatatcatttccacatttataatatcatgtatcctataaaacactttacccaatgatttactgtaaattgtagtgggcccatacatggctaattgacatggacaacacacatgtgccacaagtaggaatcaccgaaaagaagaggaagtgaagaaataaaaagtgattgctctatataacatttcttcatacataatattatgtcctg

SEQ ID NO: 31954 - DNA, 2073 bp, Bovine  19866880592723
atcagagtttcttggagaaatggccaattcaagatctggttcagtggcagggaagatacaagatgaacccaggatttttgtagtgccagaaatcaaggaagatttcaaagacaaatagaatcatttcaaaaggacagtggaatcactttaaagaggctcctactaggtcaaatctatgaacatctgagcaaacagtggctacagttcagtatccacactttctaagtattaactgtagaaacacaggctgggggaaatgagatactttgtccaagaacattcagccaatgagaagtgaagttgatgctgacagttttcatgacttcaaagtgacgctcctaccatacagcatgctcctcgaccaaagaatgcttaactgaagagacaagtgcagaagtgaggagcataagagacagctagaaagaggcaagtaaggaagcctgaacgcactcttcattgggaaaggattttctactaagtagctccatgcaaagttaccaaagaatgactacagacacccaagcagtggctgggtaagatggagtattagagaaatgactcaagtccttccaatactgatgtccagatgtacctcatggtgacatttccctttaatgtccctgcgtatccttgtgcttggacatgagtttgggtaggctctgggaattggtgatggacagggaggcctggcatgctgcagctcatggggtcacaaagagtcagacacaactgagtgactgaactgatctgatgcttgtgctaagtctctcagtcacgtccaagtcctgcgaccccatggactgtagcccaccaggctcctctaatccatggaattcttcaggcaagaatattagagtgggttgccacgccttcttccaggggatcttcccgccccagggatggaacctgcacctcttatgtctcctgcaggggcagcaggttctctaccactagtgccaccttcctgtaatagtgctcaaatgcccgctcctgacagaatgttcttgagctcaggcatctctggagaagggaatggcaaaccacttcagcattcttgccttgagaaccccatgaacagtaggaaaagacaaaaagatggaaaaaaataggaaaagacagtgaaagataaaccccccaggttagcaggtgtccaatatgctactggagaagagtggagaaatggttccagaaggaatgaagaggctgagccaaagcagaaagcaggcccagttgtggatgtgtctggtagtgaaagtaaagtctgatactctcaaggacaatattgcataggaacttcaaatgtcaggtccatgaatcaagatgcctaatggtgtgttaactatccctcagttcaccctggtgcccttgggggcctacagccagtcctggaattcagtgcccgacgatttcctagtctttcccagaaggttacagtaactcttctcacagttttgcccccaactttcactttaaagtgaaagtcgctcagtcatgtccgactctttgtgaccccatggactaaacagtctgtggaattttccaggccagaatactggagtgggcagcctttcccttctccaggggatctcctcaacccagggattgaacccaggtctcccgcagtacaggtggattcttgaccagctgagccaccagggaagcccaacagggaccctatccctcctttaatttcacaaagcatggctaagaccaggctctagaagttaatcaaattttactgactacatgaggctactaggaaatcagatgggaactagtgcagctcctggtatccaccatgttatggagtagagcccacctcccattacccactcatcctgggaggggttttgactgttgtctcccccataccccaactctcctgggacttagagagaggaaacgctagtttatccttgattaccagtctcaggttcccttcctgtgagggttcaactccagcctgctatgaagaattattatgcacatggctcacagttacagcttccctttggcataaccaaaaagtttactgtgggtatttttcattgccacaactgaggagcaatcatc

SEQ ID NO: 31955 - DNA, 2731 bp, Bovine  19866880617852
cccatggaccgaggaagcctggtaggctactgtccatggggtcgcaaagagtcggacacgactgagcgacttcactttcactttcaccccactccagtattctggcctggagaattccatggaatatatagtccatgggttgcaaagagttggacatgactgagtgactttcacctcaaagagtcctgtacaaagcaacacaattaagtaatagaagtcattagaggagatacaccatcaagaaaagactttcctaatattaatttcaagtttatctcttgatgcacaaagggatcaccacatgggtgctaactggacactattacctcatgtggcagaaaggaagagggagccaggtctccccggccccttttgtaagggcactaaccccagactcccatttccctctgacaactaaggaggagacatttactttctcaggaaagacatcttcttgccaatttcaaagcagtaacgcctcaagtcctttgcacatgatggcaacttaaaattactccactgtaaataatctgatgacaaatttggcagtttgattttagccacagtggggaagggaagagctaaagggctcagagttgggcttctctccatccaagtagacagatttacctcaagcagtggttctcacccttgagtgtgtatctgagtcacctggctgctgctgctgctaagtcgcttcagtcaggtccaacttttcatgaccccatggactgtagcctgccaggctcctctgttccaagggattctccaggtaagagtactggagtggattgccataccctgagtgtgttacatcacagatctctgggtctcactcccagtagatttaaggtggactctatagttctaacaagctcccaaatgatgctcaagatggtgttcaggactcctctcagagaaccactgcctgagggatgcaggagtcatgcctgcaagcgacagcattagcctctccttgaatccccacctgtgaactcaggctcaaccccagtcaaacaatggagagcagagcatgcgaaatgtatgacatttctgaataacttcaaattatttccagcttgcagaacttgagactagacgacttcatttgggggtagatccccttcaaggaagcttgaagggagatgagaaaggccacctatccaaataagccggcttctcactacctcactcgccgacttgccaacagagagaacaaagtcacactcaaattctaaacgcttttaagggcgtacaagtatttcaagtccatgatcccttcctttgttttaggtctcaagaatgtagggctttttgcctctttgccatcacaaaaagccaggactgtgctccgtcacaaaatgcaagagcgtggcccagaggaactgccgggcgagcctgctgtcaactgcgtggccaacaaaggaccaaagagctggattagacaaaaaaaaaattttctgtcgtttgaggcaacagatttttccaaacaatattttaatttgcataccaagccagattccctctcggaggacggatagagaacattccatcgtgtaagacaatactcattcccatagagtgatgtcagggccaagcgagcaacgctctttctgagattcttttcctggccgttaaggttcctgttataaaatgttaaccacttcagaatcgggcaagaggttgcaaatctctgttagtgtttttacagaagcaaaagagacaaggctgtcatcaactgcctcatgcgcaattatttaatgacttttccctcctggtatgaataggatttctgcaatctatcttcacctcccaggactttcttctcccaggaataccaatttgggtagtttatttctgccagcttttgacgtgcagggagcagtctgattgtttgctaaaatgataggaggcatttcagggctctaggactaaatcctggtaggaattttgaggttaataggaaacacactgggcattttgctagttaggggaataccacggcacagggaagattaaggacaaaacgctctctaacgcataaatgatagaaaatggtgtgaagaagtacagcacagcagggagatgctgccaagagcctattcttagggttacttgaaaaaacaccaagttaaaaaaaaatacactatttcatctactaactaatcaagtatccttttctctctctgcatatgtattccataattttaagatgaaagaaaaaacttgtattccatttgaactctaactatgtgctactttttaattgtgaaaagcctgaaaaaatggatataggacactgaggggaaaatacagtatcaaacagcctgaaataactgacttttagtcaatttaacagagctattttttaaaaataggagtatagttggtttacaatgttgtgttagtttctgctgtgcagaacagtgaatcagttatgcatacacacatatccactctttttagattcttttctcatataggtcattacggagtattgagtagagttccatgcactatacagtaagttcttattagttatctattttatatacagcagtgtgggtcaattccaatctaacagagctaattttaggatgaaaaaaaggaatacagagaaaccttgaaatccccttgatttttccccttgtcctatttacctctcattatcaaatttgttgggagtcttccctatacagggctttgtccttttattttatatacatatatt

SEQ ID NO: 31956 - DNA, 864 bp, Bovine  19866880666432
cacagataaacaaggagtgcacataacaacatattaaaaggcacagggacaactgtcctaatactcaaacaattattcataaactataattagaggggaaaggcacaggatgttcctacctgtttacaaaaattaacaaatctcagtcaaaccctccttcttttccttatcttcagtaattgtcaagcaagtccaactgcaaagctaaaaaatttgccaattctttctttcacgagtttacttctctctgtatacactgttcgttttcttcagtatttcatcagaagttccttagatctgcctttagataaattgcccctttttatttagctgcagcaggcctcacacacaaagcaaaaccaacatctatgaacaattttccttctacttttttcccatcaaattaagcaactggcctcaaaggagtgtgtcattctgtagatgctaaaaaagaggcatggcaggtgacctggctttcccaccttcaccctgtctatccatggtaaagttaaaattgccttccaatcctagaacaatcctccaatcccacctttcatccatcacctgccatcttctttcagcttccatagttgcatttgctgattcaccacactccctcactagtacgcactgatccttcttaccacccaagccatcacatattttataaaatcaggcaaccttgttgtttcccgcttttctacagaacttgaatttcttcctctttatctcattaaagaagaacaatgacacccagttattgagccagttgttactgtgtttacataggctttgcatgaaaattaattttgccctctcaatacttgtatgaggtaagaaccataggagataaggaaacttaag

SEQ ID NO: 31957 - DNA, 1854 bp, Bovine  19866880691622
atttttgtatcttgtggccaaggtgctccttagacatgaacagcatttcaacacttacagaggcatttgatcaaacagctagaagattgagatgtttttcactggataatttattccatatgcacccagcggcaagcatttggcaaaagaccaactggtatgatttagaaagcctgaatagctcatgcaggaaataagtagctgacagataaaaggaaaatggcaactttatgctttaaaggcaatgtgaagtatttggaagggacatttatcagttcaacaaggatcgattttcttccactctcaacccctggaacaaatcttgtcctctgaaaatgtaggctcactgggcctggtaatttatttgtttgtgtatataaatagcccatttcgagacaccctataagacatgtctctctggcacatatttcgtcttgatcctgggtggaagataacaatgaccgactgacctgttgaacaaggcaccctcggagttcaggtaaagaaatgtgatttaatgtgcatcaacactcatcaaggcaagtgttgtctgaacattcagacagggaggcagacggcagggtgacccctgctcctaaaagagacgtgaactatttgaactgcctgattgtatcccccttgatattttaaaatgatgtaagtcaaaagaggcataacttaactagtgaaaatctcgaaacagagcatttctggttaattcacagaaaacagggaactttgaacacatttcaagacaacggttttactaggggggagttaattctagcatgagctgaacacacagagaatggagaattaatgttcagtcaacattatccaatttattccttcgatgatcaatcattcatttagcaaatgtttattgagcgcctctctatgcctgggttccaagaataaaaccatgaatgcaataaaagtttctcctgttaagtaaatagcagccataatacgtgatttgagagctagggaaccactatagagagaagaacaaataccattttgtttgagaaccaacggacaatggtgcaagaaaaggtgaaggataaagtgacttcgaacgaaacaggaattgaaagaaagaagtccctatagacagagactacgatgtctgcagagccagttatgatggttaaacaaccaattacatccatctttaccaattacttactattcattctgaggcaaagtacttagcattctattctctgtctttatgcccataaaatagagatactagtaatacctaatttacaggctattaaaggatcaattgagataataagccttgaacagcgtagcccttggccacgaaaggctgatcttgtggtgcattccaattagttaggttaccaccccttcctaaaggttctcctctcttctcccccagaaggatacagacaactttgaagacaacacagagcacgaaattaaagttctgttcttgttgtttaggtgaagcaattcaaagctatcttcagtggctccctggattttactgtccctcatatctccagttgttctatcccagaagttcttgtcattttagcattgacttttctacatcatcttttatcatcaaaagatttcaagtgaggtcgaactgtggtcaaatcccatccctctttagggaccgacatttttgctgctgtacactgggactcagatttctcttgaagtacttccacttcccaaatcatattttctggcagtttggtcaatgatttataatcttatgggattaaaattagcgaaggtgaaccgtatacaatcgctggctttttctagtttctactccctcctcaaggggggcttcccttgtagctctgtcggtaa

SEQ ID NO: 31958 - DNA, 1917 bp, Bovine  19866880729732
ttgattctggctaaaatgtacaaagtcctaacagagcatcattcttactccaaccaccaaaatagccctgatggctacaaaaatcaaacttttataaactcctttcaagagcaaagatgcaaagaaccctaaaggaacaaatttctagaaaacaatgagctagtcccaagtgagaggagagccgtaagtgttctcactcacagcagaatgacaaatggagatgaaattcagacggaaagcgtaaggagaaaggagccaagttgcagtgaaagttcagtggtcatgtgtggcggacacgtggacaacaccaagagttcggccacagagcgagtctatgctgagccatcaaatcattcccacagtgtgtcacaaagttctcaggagtattgtgccaaaggttggggcaggacagaaaatggatttccccattggaggaatagggcctttcccaaggaaatggcaaccctctccagtattcttgcctgagagatcccatggacagaggagcctgacagactacagtccacggggtcacaaagagtcagacacaactgagcgactgaacaacaagtgcaaggcagccatctcccatctccaaaaccagacctgattaaagtgtacccgtgaccctctggactctgaggtcccaaaggcctggggcttgtcagttgagagaaattaacctatgacattcctggtaagtcagcaatagaagaacaataagaatctacaaattaccaaggaaatgtgaccttaaacccaaactgaaaagactgacatcaaatactggtgaggttagggagcaactagaattcttgtacatttctcatcagagtttaaaacagtacaaccactgtggagaactgtttggccatttttttaaattaattactttattttaattggagaataattactttacaatattgtgatggtttctgccatacatcaggatgagtcggccacaggtatacatgtgtccccctcccatcttgaacccccttacttctctcctcaccctatccctctgggttgtcccaatttctaacagtcaaacacacatcagtcctaagaaacaacactccgctcctgggtcataatctaagatgaataaaaatgtatgtccaaaaaaagatttatttacaaatgaccaaagcagtgtaactgatgagctcaaaattggagactacttatgggttcatcaacatgtaggtaaagttttgtgtgttcacacagtacaatactagtcagcaacctgacttacctgtacaatcaaaaacatagatgattctcagaaatatgctgagtgatagaagcaaggcataagagtacccatgaatctacccatttatacgaagttctaaaacaagaaaaataatgcatggtgataaaccccaagttgaattagccagtgaagggcacaagagagctttttgggataacagaaatgttctatttttttggctttggatggttaatacatgtcattgtcaaaatttagttgaaatgaagatttgtgcaatttactagagcttaattatacctcgcttttaaaaggtataaggttaaatattgttctttcagagtacgtgaatgagtcagctccaaactgagtccataatatcagagttaaatgccaggtcttgtaggccacccaaggtcaatataaaacaatcacagcacttctcttattcagagcttttgacagtcaggtgcagacatgacgggacctgctagaaaagggcacaatcccacacctcatgagtgattctatcctttcatctgtttctacccagtgttatctcatgctgagttatccaaaacctgctgatgtgtcactgctataacctctcagtgtgagcctttaattgctcagggtcagcccttaaaacactggggattcccactctaactgca

SEQ ID NO: 31959 - DNA, 1366 bp, Bovine  19866880833768
acatactttcttttggatcgatgactatgtcgaggggtagaacagggtaatatgatttgcgggcagcctggagtgttgcaattgattacaaccaccatgcaatgggagacaggatgtccctcagagcaagtgatactggacagactaaagcagcaggaatctacatgcaaatgatctgtctgtatggacaggaagatcaataagtcaaataataacaagatccatttgccaacagtgtaattaatcccaattgtagttttgcctccttaaattctaccacaggcctaatgagaaggctctggattcttgagtaaataatttggggaatgtctctactaattcaaagaggatctaagaactgttttctattgacaaatgtctctataaaaaggaacccgggttataatcaatacagtaaggaaaacaccatgacttcaatatcagatgctgaaaagaaaagggaacatactgtctaataatgaaaaggacccacaattgcatctgggactaacagtcccgagattttccctggaaaccccttaaggtctccgtaattatttgcaaggctcccttaattcaagtgatctgctttctatggaaaccctaatcatacaaaacacatgcaaaactgaaacaaagtaaaatttcaagaaactgaacgcctacaataactcacagccagcactgatagggtgtgactggaaacagccgtggcctttggggcctgagcggcaagagtctgtaaggatgagagggttgtcggaagccacagtgctgagggctgataccaacacacagttccaaggtctaagagaaaagccctaggccctgcggtggggtggcctggaagtcttttccagtactcgtgaaccttctgtgccctcgatcgagttcttctcttgagctccgtgcctgcgggctgtgactctggaaggcacttctgctcccagtgaactggcgggattactgatctaaggaggcatcttgcagatggcaccaactatcacagattggtcgaacccaggagctggtgcactttttctttaaaggacaggaaagctcatatttgggtcttcaggagcccttagtctactcagccagcctagcgggaaagcagccctgggcaaaatgcagatgaatgggcatgatggaggtccaataaaagcttcttgacttaacaaagatgacctttgaatttgacccgatggccagagtgagctgacctctagtccaattggttgttcttcccgtcctctaagagttagctcatccctgtcatgcgatgaattcttctgtcccttgtcagagagcaccctttttatggatggaattggagtttggggggtacccttccctactcgccagg

SEQ ID NO: 31960 - DNA, 1777 bp, Bovine  19866880914556
ctggggattcccactctaactgcacagagcttatcaatgtatggcgtgctagagctctactgcttattttgttattgccatttctgatcttaacttctccacacaggcaaacacttttccataaggctcctctgacatgctccaaaatgactcctcctagagagatagaaagtggtattatgcagtagggtgaaatggaggtgagaaaacaagcagcttgtcttaatactgcctaaaatgtcactccccacacgtgtttgtacataggaaacatcaaggaatattgttaaaattatgatgctgattgagcaggcctggagtggagtccagggttctaaatgtctaacaagttcctaggttctagggtgttgctggtccacagtccacactgattttaaggccaaagttttcctttctcttcagtttctggaaggtgccgctctccatgtgtgaattctcagtccagggttcagcttttgactgcttcaggtttaaacgtgcaagctagggttccagcagtggaccaaggttagcttttggaattaaaaataaacaacctggaaaggcattttagttttcatagattaattcaaaattattccatctcttctcatgtcctcccatcattcatctgtaggactcccattgatcagtagcttccacagagtaggcagaccttccagaagcatctaggatcagacaatgagtcataggcaggagcttcaccaagacttcagctcacatcagttaggatatacatcctgactgacagagaaatagggatgcaggtcagcaagttcctctctggaatgggtcagagcctgcttccataaccaagtggggaaaacagcttccttccccattgactctgctgggtacaatgatgattctcagatggacacaaaggaaaagatattttaccccagagtgaccttttggcaacagcattctaagagatggtaagattatgacagcatggtatttggcatccaagttcttgaatcattcaaaaaacatttaagatgtgatctttacccaagaattccagaaacttttttaaagaaaaatacacttgagacattgaatctaaataattcagaatattcataaattccccaaccatttaagcacttgattcattatttaggaaaaactttatatgcaaaacaaaaaataaccagtgcttaacataaagacatagaagacttattgcaattgatcaggtttaactggataagtggcattagtccttgaccacatgaatattttgtgaaaaaataaaccacaaacaaccaaaacatacaagggggccacagaggatgagacggttaactggcatcacggactcaatggacatgagcaaactccaggagatagtgaaggaaagggaagctggcatggtgcagtccatggggttgcaaagagtaggacacaacttagtggctgaacaacaacaacatacacaacgtgacagcaaaagaagtctacaatcagctcatagttttgctagatcaaactcttagaggaaaacaggcagaacactctctgacgtaaatcgcaaccagatcctctatgacccactcccagagtaatggaaacaaaaacaaaaacaaacaaatgggacctaattaaacttaaaagcttttacacaacgaaggaaactacaagcaaggtgaaaagacagctttcagaatgggagaaaataatagcaaatgaaacaactgacaaagaattaatctccaaaatatataagcagctcatgcagttcaataccaga

SEQ ID NO: 31961 - DNA, 1549 bp, Bovine  19866881120136
ccgccttcgcccccgtagccgccgatcagagcagggtccaggctgcgggtctggcgcagcttccttcttggagaagcccttggcagaagccgcgctgcccgaggccggcgaggagcaggagaagacactgtggagcaggctctgcgcggacatctcggcgggctgtgcctgggggccaccctcttccagctctcggaactgctagcgatttggggccaggaagcaagggggctcaggagaggctgccaggcggcgtcggccccaggatcgccgagggcggtagggggcagttcccggctcacgcgccaccagcgcgctccaagtgccccggtgggggcagaagcaggagatccatcaccagccttctaggaaaaggggtggggagggaggactccttcggtggcgagaaccttcccgcagagcctaagtcctgaagagggtaaggaagaagaggaaggtcaggcgctcgctgggttcccagctccggcggccagcgccactcccccttcccagctgaggcaggagacgccgcgctcgggctctctggctctggacagcctcgaagtctccagcaagctcctcctcgcgccctaaggacggtcccgagggctgaggaggaggcctcctgggcgtgcgcccagggcgcgtccctcgctctccgctctccgtgagagggacttcctcccgcgctggagctgggcacccgatctgcgccccagggcaccgtcgccgtatccgggcccctgaagctacgcgtctcgccgccacttggctgctgcgcccactcctctgactggctaggcgcaagagtgtctccaagctccaggctcccccgaggtgctagtttctcgctacaaagtgaggacacggagcgcgcagcgcccagggccttccaacggctgagcggctacggtgggagagaattcctggctgcgcccagggagctaagggaagaaccccagggccggctgtccatgacccgctggagagggactcttaatattctcaacccagctttgggcccagggctggcgcggggatgtccccacacgctcgcgctagaggcagcgcgaagggggcggcccgggacgggtagggtgggagagacgccaggtctggagctggggcggagccagaagtaggagaaagcaaaacgtggagttttccaggcgccaaacctgggagcggcgcacagcgagcgccgctcaccactgataccgggtctcctggggagaaaaccctgaggacggaagtgcggaccttgtccccggtctcccctcccccagatcgaagggggcgccagctccactcacgtttctggaaaggaaaggaagtgtcagattgcaccccacccactggtgtcagatgggcagcccaagacggctgctctgaagttggagttaaatctcctgccttccttccccccacccccccccccaccccccaactgctgtttttgtttttaaaaaggaaggatagagattcagttcaaatgcagtggctgccgatgaatgggctggagatggggacctactaagaaaagtggcgg

SEQ ID NO: 31962 - DNA, 2773 bp, Bovine  19866881132286
cacggctgagtgacttcattttattgcctttactctggaggagatgacctctgaattgtctttttgaaagccattttgggtgtttttaagtaagtgtacaatttagcggcattaaatacatttataatgtacaaacatcaccatgaattgatctttaaaggctaattaggggttattgcaatgtatcagacctgttagatgcaatattacacctattctctttttccttcagttaagatatcttggaggttttccatattgatgtgtaaagtgttcccttttgtttttatttaacagttgtacactcttccattgtatagattaatatactttacgtaaccggtctcttactggtgaacaacaaattagattgtttctaatactttcccattactaacagtgctgcattgagtaatattgtatttacacattgtttctcacatgtgagcacatctatggaataaacacctagaatcaaaatgactgggtcaagaggaagttgcttttatctttgataggtatttccaaattatcatcaataggtggttataccagttgacctgtccctcttggaatgcatgtgtttccccacaccttcatcaatacaatgtattgctctttttgttactgattttgcagaaattatttatatagtaaagaaattagctctttttctaaagtgtgagtgtattagtctgcttgagttgccaaacagaataatacagactgaagggcttaaacaacagaaacttgttttgttcctgaggtcagagctttagatcaaggtgctatcagggttggtctctggtttgctggcttggagacagctgctatcttggcctcttctccatgcatgtgcagagagggagctctctggtgtctcttcctttgaggacaccagtcctttcagattagggctgtgcccttatgacctaattgactttgattacctcccggaagacgcaaacaccaaatatagtcatatttgggttagagctttgacacgtgaatttggaggggaaatacacaattcagttcacaatgatgaactagacatattttctcagttggtcatttttcttttgtttttgtttgtggtgaattttgctttgagtaatttttgtgtaccttaatttcacagccttttcttttatgatttctaggtgtggggcatggttggaagtactttgagtcctaaatgaattcttctgttttttcaagttaaaaaaatttcacctgtttactttaaacccttaatatgtttgaaatttattctggtgtaaggaatgaagtacagctctaatctcccctctatctttttcatttactcaattgtctcagggctagtttttcaataaatcatcccccctatatccccttacatacagtgatttgagacatcattgatccctgggtcgggaagaactgcaggaggagaaaatggcaacctgcttcagtattcttgcctgggaatatcccatggacagaggaatttggccggctatagtccatagggttgcaaagagttggacacgactgagcaacagagcacgcatgcatgctcattattaagacactaaattcccatgtgtatgtggatctattttggactttgtactctgaaccattatgtccacaaacacaccaatactatattagtttaagtattgggaccatctggcatcattctcctcattattctttttcagaatttttcttgatactttgcttgtttatttttgaatgaaatttggagttggctggtcaaggttgtttgttgttgaaaatctggatggtaatttactgggattatgttaagtttctatatttaggaaaactagaactctttagaaaaatgtgtcatcctatacatgaacatgcagtacctttccaaatgttcaagtcttcttttgtgacccttactacaattttaaagtgtttcttaaaatcatttaaaaatgttgagtttattacttgttatttaaactttgtttttgtaatgactgggagatcttttcctctttttatatcttcaaatttattgttggtatatttatgaaagcttttgactacatttgccttatgttttgcaaagttttgaattcacaggttgttgttagtcttactttttgtttattatctttgattttccagattttccagggattctgtcatataatttcaacttataataattttacctccttatttctaactataatgcctgtaattttttctgattatgtgggttaggactttacagcaaaataaaaatattaactcaggaaagtggctatggatattcctaattttgagggggtgggggcagtgtgtctagtgttatttatccattacccattgggttaactttttagattggcatatagtttttttttgaataatgttcataaaatatccaagtagctgtgttttattctgagttttaacaaaatcaacaaaagctttggcaaatggatttctgtacaagatgatagaagggttgatttttttcatctgggtcaatgtgaactcagtcagcccacgtagaaagaggagtccagaggcagaagtgaccataggaacatagatctctgagaagcaccatgtaacttagggaaacttgatcttcccaggacctagagattcaggtgactcagatcttgagccctggggggataggaaggccaggcctagatgatgaaggcttatcctttgcttaagggtgatactattaaataagtatcgtacaaaatatgagttgataataaaacat

SEQ ID NO: 31963 - DNA, 1710 bp, Bovine  19866881392978
aactgttatggatccctgagtttttactgttggatggcttggaaaatctttgtagatcttgctttcctcattgacaaaaggaagaggccaaagtagatgatttcaaaatctctcttaacaccagtattcaatgatttaaaagaaagcaacgtatcttcactggaaaaattgataccattagttttggaatacctcagacaacaaaatgactaaaggaatatacaaattgttattcaagaaacacttctttaaaaaaagattccttcatgcttgtcacatagacaaagttcctttgtctctataacatcaagatgtgtctttcaaacttgtcattttactgtttggcaaaatgtgttctaggtatagaaaaataactgtgctgagctgtttaacatttgttcctaatgttaactgttaaactctgcttagaaaaataattctgctcagaaatttgatctgtctgccttccttttgtattgcttttggctcttccagaactcagaaatgtcaatttgttattcaagtttgccttcactaatccttccaaaagaatgtgaaaagtcccacagtcttttatattaggaaataactatgattaaaacggattaagtctgagctcctttctcttgctctgtactggtgtaaagactgttatcaccacatttataaaagcgatggggtttttcatactaaactataatttcattgtatgagcattcagtaggggcattgatacagttaggcctggcaacttctcacaagctcagtgccaagatcctgtggtgtccttctgaaatgttggacaaagtggtggatgggcagggattagagagacagaagtgtgtgtcaagtcaaaagtcttcaaggggggcaggcagggactggagagacagactgagggctcttgacttgtaaacttagcaggagagcatagcatggcgggagaattcagctgcttatgaataggaagtagacttgtttatgtgaatatcttctatgtagcatctacttttatcaccagggataatagaatgctatctctttacatggaagatgctacaggttttacatcagaaggatggtgttttattggtggctcagtggtaaagaatccacctgttaatgcaggagacacacgttcgatcccagagttggaaagatcccctggagaagggaattgcaacccactccagtattcttgcctgggaaattcagtgaacagaggagcctggtgggctaccatccatgaggttgcaaagagtcaaacacgacttagcaactaaacaacagcagaaacagttccgtagaacatgcagatctatccacacccagtttctgtagacctatttagggtgagacagtgtgaggtaaggcaaagctaagcaacctacagaggtggaaacacatgtgacattggacttcaattctagcccccaggctggcatgtcagtgactttaaagagactgaatgcagagtgaatgcatggtgatatttatcagatctttctcagctagattctataacccagagccaagagaatgctagaaccaaatgctctcaagggtctgggcaaaagtgttccccttttatttatttattttttaacgccaaaacatttttattggggtatagctgattaacaatgttttggtagttcaaggtgaacagcaaagggactaagccatacatatacatgtatccattctccc

SEQ ID NO: 31964 - DNA, 2361 bp, Bovine  19866880276467
tgaagaagaactaaagagcctcttgatgaaagtgaaagaggagagtgaaaaaattggcttaaagctcaccattcagaaaactaaaatcatggcatccggtcccatcacttcatggcagatagatagggaaacagtggaaacagtggctgactttatttttccaggctccaaaatcactgcagatggctaatgcagccatgaaattaaaagacacttactccttagaaggaaagttatgaccaacctagacagcatattaaaaagcaaagacattactttgccaacaaaggtctgtctagtcaaggctatggtttttccagtggtcatgtatggatgtgagagttggactataaagaaagctgagcactgaagaactgatgctttcaaactgtggtgttggagaagactcttcagagtcccttggactgcaaggagatccaaccagtccatcctaaaggagatcagtcctgggtgttaattggaaggactgatgttgaagctgaaactccaatactttggctacctgatgcaaagagctgactcatcggaaaagaccctgatgctgggaaagattgaggacaggaggagaaagggacgacagaggatgagatggttggatggcatcatcaactcgatggacatgggtttggttggactctgggagttggtgatgtacagggaggcctggcatgctgcagttcatggggtcgtgaagagtcggatatgactgagcgactgaactgaactgaactgaagggttatatatatttgttttacatatacgtttactcaacaagttattattaaaatttatttatgatacttataatactcatatatatgtgatatatctccatgaggaggaattggtgagttgacagcttcagagaagaaagggaataatgagtgagggcaggcaggcagacagtaagtgaagaaatcagaaagaaaatcaatatttatttagctatcatgtcccaagaattataggaagcagtgacatgggttcaagccctcactttgcagtttaatagccagacgacttgagaccagcttcaattccctgtaaagcttagtgtctttagctgcaaaacagaaataatgaaaatgtctactttttagaaatgtgatgaagactaaatgagaccatgcatataaagagtgttttgtaaactgtgattcagtaaacaaatgctaattgtgatttttactatctgtggttcctttctctaccattagcttgaaattaaaagacatgaatcattgccatgctctcctttgtatacagaggacacttgaatgcaggtgcctgactgatatgatcattgaagagagaatatcagagttagctcaatctgaaagaagataacattagctaaacagacaggatcagctttgcatacagacaaatactgctgtactttgtggagatgacaaagttcccaggggcttaaataactacccctacttcctgattcctgcctaaaattttgttatgtatttatcgcctcaggtaaaatatctgatgcctctaaaatgaaaatatctttggaagggtatccatttcaattatttgccagtcagatctaatgaaagatcaggaagacaatcttggtggaaatgggactcaagtacacttgctatcctaggatgaaaaggagaggtgacattcattggaaaggctggtaaccaagagaacaacctctcttcttgcttgcagtcaatttctatccctaatttcactgtattttagtaatattctttccactttatgagcttgaacacttctggaaatttctcaaattaagatatatttcttatttgtaaaactgcaggtaaagtttttgaataaaaatggccatttgcaagtctcccagtcaggagatacccactttttaaaaatactttattcaataccaactgaagtgagaaaaatgcctaaggtttttaatagagctgtgggtacaagttgaaaacttcagacctgtcactgttaaaaggttctctcttagttgaatgcacactttagaacacttttctgcccaaactctataaaagaaaaaacttgaatctatgtccttaagacagattctacctgtttgtcacatgaatcttaacctgttactattttcaacttctagagtttttgcataagcaaataaatgattccttaaaattacatacttagcaagaaacacaagaaataaagtccagtatgaagttatctgattgccagccttaacaatgttccttttgaagttatatacatatataaatattacatatatgtatatatttaaagaagcatataaagggacttctgatatagtaaagtgattaagtcagacaaacttatcccag

SEQ ID NO: 31965 - DNA, 1596 bp, Bovine  19866880389204
actaaataaaggaaagtgaaaagtctgaaatagctactccacaggtgaaaaaagatgggcagccaaaatatgagtgaagcagggaaagtaagaatttctgcataaaatatgtcaacaggcaaaagagagcaggagaatgacatggaatcagggagcagtcatcaatatagaaaacagtggaaaataaattgattttatagacaatatcttctgttaccctttaaatcagttgagccgaatactaatacttacacattcagttttatcttcacgaaataatattataaacactttcatattattgtagtttggttgcaagtcagctaattttacatacttttttctgcttcatttttaacaactttattgtgaaatgcaacatacacagaaaaaacatatctgcataaaatatttatgtacaaattaacaaatagttttaaagtggttttccatgaacagtcaaagtagaacatgtgaggggtagattatagcaataaacattgttatatttcaaatggataaccaacaaggacctacttcattgcacagggaattctgctcaatgttatgttgcagtctggatgggaggtgagtttggggaagaatgaatacatgaacatgtatggctgagttcttttgctgtatacctgaaactatcacaaaattgttaattggctgtactccaggtacaaaagtaaacaaaagtttttttaaaaaaacagaacccaaattaaaattctggttaaaaagcacaataatttaaataatcaaaaaaatattactagagaggttcaatagcagatctgggcagacagaaaaaagaatcattgacttgaaacgttaacttgaactgctaggtttaagtgattttccatttgagaaataaaaaagacaagaaaaatagtccattacattccaaaaatcgtcattaagagtttgtgttttatcagaaaccatggaggtcatgttggagtccggtattccctgactgcggtgtgaggatggcccccatcctgggtctcacttggagctgcccccctgcccctgcacataccggcctctctcctgctttagtctcacagctgagtgtcttactagagtcactgctaggaacattggaaaatgtctgcacatcattgtgccagacttacccagatctctgcctgctgaaacaatgggaagcgagtgaactcagcatgtgtgccagccgtgtggccgtgtggatgaggctccacacgcagccccatctcccttccccccgccccctccctccccagggcttggcccttctcaggagtgggacccgccactgtggtcacagggcgtcttcaggcgtcacgaaggagctgggggtgctgtatgtgcacacctgtttgtgcacatgagtgtgcgcgggatgtgtgtgcgtgcggctgcagtgaaatcatgtggcccactgccttgatctcatctgaagcagtgttgggaagtgggagtggttttgtccatgtgccgacgagtccagaatttcctgtcacaggaggaggaaatgtgtgtttactggagaccgtgtgtcaagagaatttcttgagaggtgtgttgttggacaaacgacac

SEQ ID NO: 31966 - DNA, 2002 bp, Bovine  19866880457819
taaagttagtcaatgggaggaattccctggtagttcaatggttaagaatctgtcttctaatacaggagacacaggttcaatccctggtgggagaactaagatcccacatgctgtgggacaacgaagcctgtgctctgcaactaaagaacctatgcactgcagctactgagcactcgtgctctacagctcatgtgccgcaacttgagtagcccgagcaccacagtgaagacccagcgcagccaaaaaatcaatccataggccctaagacaaacacattccctctttctctatttataaaactcaagctcccatgcctgtccaagtgaaaagacccagatggggaagggagagtgatgtatggagctgtctgcacccatttcagccagacaacgtgccatcttacacccaaaccaaatttatggaggaaacatctcagtcgagtcctagacagaaagagcgatgataggagcttgttgtctctacctataaatcaagttgtaaaattttagggaatgcatcacagtcatcttccacataaatttttatgcataattgtgatctttacaggttgaattaattgttctctcttctgtggccctatactacatttatctatatctttactatcatatggacacaacttttttcttgcattactgtgatttatgtatgtgttttctctctcctcctagattgtaaacttcttaatgccagagaccatatttatagactcaaactgaatatttaaatgtttagaaattgtttaaatctttctgatagtctcctaccatatatctatgaaacatctaaagttaaaatttaaagttcaaaataatgactttaactcagaattcaaggttgggtaaaatgtttaggattattcttttgtaaaaaacaaaatgttaggaaataggattatcaatataaataatatgtccttacaatttagccaagtcagagcctaacaataggagaaattctgtgaaatagaaagaaaaagcataatcattttctgttgacaatctcccttcataaagccaggctagtatctcaatagagaacagtgctcttagaagcattctagacttttgaaagattcagttatcatttctgtcccaaattctgtccttaagagaataaagatatacaggataaatgatacatttcaatcaaagagagataatggctttatcaatttatatatgttgttaaaattttaaatgtcactcactttgattcactgaccattcagagatgatcagttatattgccattccaaaacccttgggagctattttttcccgctctttgcttttttgaaatatatcctttatccataccttaatgaagatcaaagtatgaagttctagagattttcactgataaattctgaaaggtcgataaactgacatttagcccagagatcctgataatcaagattgtgtcaggacttttcactttgtttattatttattatctctctgcctacctaccatttactttgtatgtcatctatctatccagccatttagccaccttttttcttagtctaagaatctgcatttaatagacagtcctctaattttacaagtatgttttcctccttcgttccttgtctctctttcccgttttcattccgtcttttcttccttagagatcctactttagaccaggcaccatataaaagggaaatacatacaacccatgagagcaaacgctagagcacttacagtatgggtagtgacacaggctggtgaagaagtcatttaacaaaacgagataagcagctctcacgaatatattcaaagcaaaatgagagcagagaggaaagagcaggtaagaaaaagggataacattttgagtcaaaatttgaaagacgagtatgtagggagtttttatacagacatttcaggcagagggaattatatatgccaaggcatagttgagacacgtgagtcaacagggcatattcagagccttagaaacattcgatattgcctgt

SEQ ID NO: 31967 - DNA, 1681 bp, Bovine  19866880490966
tttaaataaaactcatttccctattgaatatatttccattttaaggccttttttgttgttgttgggatagtctagtgagacctcatatatgccatattaccatcacagtgctggtaaagacactgataaatgctcattttatttcaaattatgtactcagaagaatagtcattcctgcataatcaatttgaagatatttcaactggaaaagaagcagtgtggcttactctctgtttttactctgttagcattaaatttctgctatggaaataattatcttttagtaatgcagctctaaaattagaatgaattaagagttttaaagttagaagtggaaaagtactattaaaatgattttagagcaataatcaatttgtgtgttgtgaacatcctaaattctacacagaaaaggtgtaaattactctttaattgctcagctaattgctagcaattgtccaatctttgttattaaacaaaaatgctttatcttattcttcttaatttctttaggaaaaaattaacctagctttaatttttagatagtctcttgatgccctgctggtcttctaaatgtggctttgatagttctttctgcccctgatatatttagtatttttgcaaagcaataaaaagaatagggacctaggactttaacaaacttacatctgtaaatgttacagacttttatcaaaaaaatttttactttattataatctcataggatatgctagggtagctaccctttcatctattggacgctatacaagatttttttttttttttttttttttttgagtgctaatggtaacaatataaggtttaggtgatttacctgcacacagctaaggggataaagagacaaggtactgcacagaaatggccttaaatttgttatcttcactggcaaagacatattagaaagttagtgaagtggaaattcagaaggtagcctaagaatagttacagattttgagagttagacacatcaggtgagaatataaaaattcagagaatatggaaaactgagggaaatatagttttaatctttagtaaaagagactatagaaaatttttcatgatttgtacaattttcattcatttctccttataagtgctggcaatattatgtgaattataagtataattaaaataacatttcctgacacattgaggctaaatgaaaatgaattagcaaaactcaatatagaatttctttctctgaaatttataacaaaaggccttatctcatggctagaaatggtatgtgtgagtttacttgaaggcaaggagatggattaagttacttatttcatcagacacaataaaagtaatactatataagcataactgaaaggagtttagagtaggggtttcatacttcctaaatttgaaatgtcagatataattaccatttatgttctcaagatctttatttcaaggcttatttgaaagaatgaattgctatgggtcttttcatgtaggccaaggcaaaaatacacatagtttgcttccatgagtttatcaaatgttaaaacaaacaaacaaaaaatagggttacagagtatggaaaataagaaatgaatatttctcttgtgccagctttcatatgatggcaaactgatgagatgcaggatgaacacaatcttttcattttctaatatatcttacaggtataatcaaa

SEQ ID NO: 31968 - DNA, 2332 bp, Bovine  19866880528437
ttagaatattcaagttgttttcatgaatctcccctcctcccaatctactccatatttgtccataaaaatggaagtcaatactagatgtatattttgttatttacgaaaaaaaatctctgattgtctacttgttttttgtttttgttttttcagtagacagatcattaaccattttcttaactactttccataaagggagaattaatgggctttgtttatttctcatgtttaaaataaaaagaaatcctaatctacacgtatgtgatatcagcataatgtgcatctatctaacacaatttgctcaaataggtacttcccaaatattttgtaaagcttttagctctacttctcagttttcatatccaggaccaagtgctgtgctgtctagaataacaaagtccattctctctcctttaactacccatttttcagccaacaaggcaaccgggcaaatgctaatggctggtctccagcgacagcactgtatcactcccagaattaaccacaggcagttcctgagccaggtcagcccagaacgctgccttgcacactttctcaagtattaattacctttctaaaggtcgcagtgcctgacatgaggacagaaatgcaggacctcaccagccacgctccctagaccagttcacacaaccagttgcactttgcttgaggctgggtcacttcacttgcttactgtctcatatgatgttataatcttcaaatgggtctcctgctgaatctgacccccttatccacctggaaaatccactctcttgaagtgcaagcagcccagggcaaggctttgttgatgccacaaggcactgtttatcttccctttttcattgcaaccagcaggttctgcactcactttctttcttctactagatccctgatgattacgctgccctatggtgatatattaacacatacacgtccatccttctaccctggccctacctttgcccttagattttttcttgggtctaatcttaatgtcactcctcaggctgacctttcctgaaggctcaaagttggttttctctgttatgtgctcccatcctattctactttattcctttatataaaatcacatgtcagcatctataccatttctaattcccaaaccttaaattctgtagggaccttaacaaccctgcttacaattgcatccctaatgccttggacagtgcctgaaatttgttagttctcagctgtgaaaacattgggtgaataaataagtgcatcatagcttcctgaaagctggaaccatatcttattcaagttactatgcccagtctatccaagtcagtagtggaaattttttgaatcaatgatgaactcagtaaactgtatgctattcatttataactctacaaatacagtcacattataacaatcttgattctcaaggaacgtgtataacccaatttccccaaatttttataagtttcacagacatggaagagtaaaagaaagcattgagaatatagatttttaagtataatttatttttcactagtagtatcttgaaaatatggtaccatgccataaaaaattgctttgatgtatgtccagcagctaaacaaaaatcaatacatatttatctatgtttattatcaagcatgggaaaattaaatcacaggtaattcagagtaattcaagccttcactttagttttgctttcaatgttactttctactcatacttgcatatttcaaaaaataatcaattagtcatagtcaacatttatgtgcagagaccatattaggcaatatggaaaaatgcaaaagaaacaggagggagacagatggctccatgaaaaatacataataaaatgtcctgctttgctctgccttacttgggtattatgcattcaatctgtaatgctttatattcttttgcataggtgtgcgttctttcttctgattagacctaaaattccttgacaacaaataacttgacttttagttaacaccttttgattatcgtttgaccttctttcttactgtatcaactcatacatttgctcatcaaatatttattgaatatctgctatgtgtcagttactctgctagacctatgctatagagaacaagataaaggccctgctcccatgaagccatattgaatgtgtatgtgggaggtgaggtggagcaaatattaaacaagtacacaaacaagtatgaaaaatgctagctagaaaaagtgcttaaaaacttacataacaggccaaagggctatgaattgataatcctgagagttgtttcagatgaaatggccaaggaacaactaagcaaaaaccagaattattggaaagcattgaaagatctgg

SEQ ID NO: 31969 - DNA, 1418 bp, Bovine  19866880535967
ttttaataaaggaaatatctgtgaaagtgctttataattaaaatttatcatatacaataagtcattttgtaacatgctattctttaaatgagtttaacctttcagaacttcttttttcaaagaggaaattagtcatgttttaattttttttttttcctgctagcttattacaattgacagtttacaactcaagacacgtttctggtttggaaaaagttttgtttgtattccaaagtaggtatatttggttatgaacatattacaggagataccaaacatattcaaaagagcttgactacagaaaagacattcaagagaccaggacttcacagctagttcattcaacaaaacctatgacacaattttcaatttctctgagcctcattttgtttgtctttcaactacaatggtagactgaaataatctgatgctccttcttaatccaaattttcctataattttcttataagttccctaaagcgtccccttaaatattgataaatagtggttatttacaaaatatcagctgccatttctggcttttagactcctaaactcacaattaattagaccttacatagaaacatgctttgaaataggtcatttacttatagaggaacagtccacagtccttttgttattagaactacagagtggtgactgttctttttagtcactggggtacatagaaaaggttcagaaaaatttaaatccaaaacatgagaagctactttctcaggatgtaaaaaaaaaagaaaagaaaaatggaacatctctgaaagtataaggcaaataaaatacaagatctattttattctattcttcataacatatcaattgcatgaagatctataaaattttggaagcatttccttttttttccttttcttttaatacataacttcaagttttcctgttttgaagggcaattcctcaccccaaactcttcctccaacctgcttctccttcgttataggtctgtcctgtggccacagagctctgaaatacactccttagcccaccttagaacatttgcttccaatttaagcacaaagaaaactaaagcgaaaacaacaacaacctcgaatacaaataagaatcattctacacataagaaaatgtgtgacaactgcccgactcacacagggttaggtacagaagtgaaaatgggacctgactgattccttagataagaggaagccttcctggaacttatttattacatgatgaagaagaaaaggatgctctttatggaaacagttttcttgggaactcaaaatgtaagcttctaccactgacaaggtggcatttttagattaagccgtggggaaatctagcatgatttacaaatacacccgtccaagaataacagccttcctgccattcgtgattggcatcgttattacagactctattat

SEQ ID NO: 31970 - DNA, 1741 bp, Bovine  19866880565473
tagctgtgagctaatacagttgtgttgtttaatgctgcaagtttgtagtagttatgtagcaacagaaaactacccacattgtaaatcttttcattgtctttcatgtcttttattcccttttctgtattttactgttttatttctttgtacactatttaggatatattatttggggggcttctatttcagttcactgattctttcttcagctgtgtttaatctgctggtagaaatgatcactgtgtgcttgcacagtctctgttttattgaactctttgcaaccccatggactgtagcctgccaggctcctctgtccatgggattccccaggcaaaaatattggagtggcttgccgtttccttttccaggggatcttccccaccagggattcaacctgcatttactgcattgcaggtggattcttaaccactgaccccacctgcgaggcctaaattcttaattttggttaattttttatactactttttaatctagtttccacttggataatttttatgatttctagttctttgatgaaatttctagtcttttatatctttgtgtagagtaagaacactcattttaaattctgtggagtatctgtagaccttaaaactgtgtttctcttatcttttattactgttgcttttaaatcatatcctcttgttcacatatgtataaatttttatttggaacctgatattatgtttgtaatattgtgtaaagaaataattcaatgcttagagtgatgtcatcttccttttgagaaaacttatgttcatttctccctggagacctaccattatgggtgctagaaccatttgctctcagaccacttaatacaatttcaatgattgataagattcaaagttgggctacagttcctgtgaaatgcattaaggtggattcaccaaggtcccttacatggtcatcctggacatcattcaccgtccatctatcttcattaggccacccaaagctctgcctcagtcttttaatctctcaaccgctccctccacaatcagtcgatgccctgagggaaaaattaaacctctaagtggactttcttttctgagcctatttcctttatttgtgtttttgaaatttgtctttaacaccctcaagcagctttaaaaataaacattctgtccagcttttatagctgtcctcaactgaagagttggctcaaattgcctaccattacagaaatacttactagatggactcaatggacatgagtttgaacaaactccgggagataacgaaggacagaggagcctggtattctgcagtccatggggttgtaaagagtcagacatggcttagtgactgaacaacaataacaaccagaaatagatgtcttcacaatcctgactttattgtttctatcttattaaaatgagtgctcttaacaaaaactttatgtgaatagagaagtgtacttttgttgatagattttttgaattgagcatcacattagtcccctcttgattgaaactttttgaattgctttttcctagaaaaatattctccttaaggtgataattgctttttatcccccaaactgaaataaattctattgtttaccctgatactagtaattttaaggtatctagagctgtagttttggcttccttttttttttttaaagagtattacattaaaaactttagacagatttgttgacatcctttttattgttgttgtttttattttattttattttttaactttacaatat

SEQ ID NO: 31971 - DNA, 2524 bp, Bovine  19866880580468
ctgctttgatttatttgcagctcctggtacactaaccaggagaacagaacagccagccacagatcaaggcagttcaccggttagaatgctctggttaccaagaaagcacctactatatttgaaagaacctttacacagaaacaagcacagtggaactgaaggcagtgcatatattaactacattccctctgaagaaaaacactgtttccactaaacacccaagcagattcatattactgtcagcccccagtggcctggtaggcactgggggcttcaccattagcaaaatacaaaggctaccatagcgtaaccctgttacttcctgctagtccttcttttgctctttcttttctaaagaccaagcaaggataagtctaaataagagtagtgtttttctttactgatggaaacagagttttatgaatatacagtttcacaccatccccaaaaaacctatatttgggggtcctcttataagtaaaacaagtttccatttcagtcttcaacattaccacaaaccacacacacacaccacaaaatgtattcacaattttcagggaacctttagctatctggagtatgtattaaaatcagttcaaatccacaatgcaaccacgcacagccatgtatttggcctgtcaaggtatgttcaaatttgaaacaggtatgctaagtgaaggttatattcacctttgagcctcggactctgcatcatcacagacgtgacaaatgaggcatagaggtctcctccctctcttgctgcccacagtaagtactaaagatttagaatgaaactagagaagctctggcctaagttagcaagcgagcaaaccaattaaaggaaaaaaatcaagactgactctaatcttacacttgagaggtgactgacttctggtgccatttcaacacataggagagaaacagcacaatcaaattagtgctgttagctctatttagtaaagctatttccttatttcctaagagaatgagttttgggggacaaaatttgataaaaaaaaaaaaaagccaaattagtcagaattaagtgataagtttcactcacaaagctacagggtacatttttctgtagttctgtgtgtgtgtgtgtgtgtgtgtgtgtgtaaacacgattctgtacctgtttttctaacctatgactaaaagaacaataaatgtgtttttcaaggaatagttacaaatgataacatcatttccttcactgagtagaagcaggggacaaaattccaaagtcattgttggttctgtcattgttagattttgctttctgcttaaggtttccattatagtttaatgctatgaagtatgaagaaaagaattaagaagtggcagaagatgaaaatctcaaacctccaaatgagaacaccactctcatttctctaccggcacacatggctccatcccctagtccccagcctcctcctacccaggacaaggacccagtcccatccctgccccaccaccctccatttatccctaagagaccacttcattatacaatttgacttctccactctgcctactctagatttgcctagcttttgcaaagcttttgcaactgttcaaagtgttgaattctctacttgcaaagcttttgcaacttggagaaaacaccctcttcatgctccccaggtggtgctagtggtaaagaacctgcttgccaatgcaagagatgcaggttcgatccctgcgttgggaagatcccctggaggaggaaatggcaacccactccagtattcttgcctggaaaactccacggacagaagagcctggcaggctacagttcatggggtcacaaagagtcggacacgactgagcatgcacacgcaggcagggcgatctcttcacgtccctcagtccacgtgcagttacagcttgcaacagaacatgcccacgtgcctccctgcacctgaactgacatggattcaaagtgccctcgcagtagcatctcaggcacgcagagagaagagaccacctgccccaaacccgggccaccagcgagctctccccctggttctcctcagcccccacgcagctattacagtgctgagtgggaaagcccagctgccccagtttgactcacacctacaggcttttcttcattcccactctcatttctgtgagccccaactgcttgtctctctcctccccttttatctgtattagaggaagtataacgccgtgggcagagtcccctttgtcttcccgtttagatcagacatgtaaataaacacatctgtttggctagggcacaagcaaagccttaaatagtagcattgcctaaaagatatcactgagttctgtgaaagaattattacaattaagacttctcatgacaaggcagctttcacacagctaatcaaacaacaagacagcatctcacaaactcacttgcctctttttttgcatatatgaaaaatgctggtacttagagaaccatagaaggcaagcaattgcatataacagccaagtaaatccagttctcaaaacagggcaccagagagaa

SEQ ID NO: 31972 - DNA, 1545 bp, Bovine  19866880667111
ggaaagattgaaggcaggagaagaaggggatgacagaggatgagatggttggatggcatcgccaatgcaatggacatgagtttgagtaggctccaggagttggtgatggacagggaaacctggcgtgctgcagtccttggggtcacaaagagtcacacacaactgagtgaccgaactaaactgaaagatgaattagaacactgctgcagccaattgaaaataatttttacccatttctactcttccagattgcaaatattgaaatataacttcacccaacaacattcattgaaagtttgatatatctaaagaggtatttgagctcaaaaattgaaagtaagtattgtaaaaaaaaaaaaaaaaacttaattacaatgcaccataatttcatcataactctcagggataaagcaaatctccatttctagaacataggtatatgcatttggattactgaagtaaagactctctgtgttggtaattatatttaatgagctcaaatggatttgatatatagcatcagctaacacccaaaagattagcagaggttagtgctgatagttaagaatggctaaactagctctgagtgtgtaattacaattatgatttcttagttgcctcatttcaccaattgattcatccctctgtcttaaaacaattatttcctttagcatgattccctattcctgtaaagagcatttctttgacctctcatcctcatagcagcaaattgccctgcagttacaaaatgaagtttctctagaactttatataagctgaaggccaaggaccatattaaattggagaatgcatattcagactaaagtcatgtaaatgcaaactcctcaggcacatgctcagtcactaagttgtgcttgacccttttgtgaccccatggacagcagcccaccgggctcctctgtcaatgggattccaccaggcaagaatactggagtgggttgccttttcctactccagagactcttcttgagctagagatcgaaactgtgtctcctgcattacaggtggaagttatcaatacacatggtttaggagtcaaatcgtatcaagaagattatactgaaaattgccccttttcaaatcctgttttccccacccctccattcctctccccagaaaccaccagcttttactcagattcttattttaattagcactttattttaaaatacttgtattgctaattaaaataatcaaaaacataattttttatttactttatgctatgagggatgaaaattaagtaatctgataataagcccagctgtccttctctatcttctccaagtattatgtcactattctccattaaaacttacaagaacatttatggcaatatgtctttgtgtgttcacagccaagacaagtagaatactatcactacatttctcttctttgaatggcagtacttcatcttttcttgtgattctaattgtcctttttggcaatatattgtactcacaaattccattatatcaggcttttcatcattcttagaagagatatctttagtagattggggtt

SEQ ID NO: 31973 - DNA, 1245 bp, Bovine  19866880769252
tttgggtggactccggcagttggtgatggacagggaggcctggcgtgctgcggttcatgaggtcgctaagagtcagacacgactgagcaactgaactaaactgaactgaactctcctaatagactcttctctgctgtctcttctagtccactactttcatgtgcaagaattcatgtttctttatcactagcaatcgatttagattttcatacaagtgtattagagatcactctaaggaatacttatgggaaaacaatgtaggctgatgcaaactttttcaacatgttaaattttgcacataacagaatattgttgtttctctgtgtcaaaaaactcaaaaaaattaaatataaacaacttgaactgccatggactatttttgctcttcatatttaaagatgaaactgctaacaagattattctcagctaaggacacacacatgactgatgcatgagctgcaatcattcagggctatataacagcttctccagggcctgtcattattcagtgggctacaggagacagcgctgggtcccttacttctgactggtacatgccatcacactgtctaacggcatcactttcccaatctctcttgtctgccacaattattctttaatcaccgcatgaaatcacacacgcacacactatcgtgtaccttctcactaagccataaacatccttatgcattcttgtctggctgtgcctgggaacttcaccttaaatacactgcctctcctctccctagaagctctgcccatcttcaaggtcctattcaggctctgctccatccatgcaccttccctgactactctagctctcagatatttctcttaactctgacctcttacagctcttaaacacttcactgttcactttcacttcacatgtatatgtcttgcctcttcaggtagcatttgacttccttgtgataagactattctttggaatgcctctgcacctctcatagcacctagctggctctcatacatactgacctcaatggaataccctgcttcaaacctctaccctcccttcaaggctaatttcaggttccacatctcttaagtattctttctaagtacaactcaaaacggtatcttactatgtatagtataactttgcttgtacatttagtatataattgcttcttctttcaagcatatcagctgttcatatattttcttctttgcccgtgtgaggttataagatgttagaacatgcactcatctttgtatccttca

SEQ ID NO: 31974 - DNA, 1005 bp, Bovine  19866880821784
cctgtgttccctgcctggaagccaagtcttaaccctggatcaccagggaagtccctgcaatgaccattttctgattgcatagacacaaccaagacatgagcaaacccaagttttaaattagaggctttctttgcgaaagcagtcttagaataaatagctcattagagcaaagtaaatgagatccttactatagatagacctatattactagagaggaaaggccagaaagtcagatactcccacagttacttctcttggactggcaaaccctcaacttgcccagattcctctactgctttaatttgttgatttactcattcattcaccatgcattcactaacatttttcaactagtatttgttgtttatagaaaagggttatagaaaaggcagaggaaccagagatcaaattgcaaacatctgatggatcatcaaaaaagcaagagagttccagaaaaacatctatttctgctttattgactatgccaaaccttttgaatgtgtggctcacaataaactgtggaaaattctgaaagagatgggaataccagaccacctgacctgcctcttgagaaacctgtatgcaggtcaggaagcaacagttagaattggacatgtaacaacagactggtttcaaatagggaaaggagtacgtcaaggctgtatattgtcactctgcttatttaacttatatgcagagtacatcttgagaaatgctgggctggatgaagcacaagctggaatcaaaattcccaggagaaatattaataacttcagatatgcagatgacaccactcttatggcagaaagagaagaacaactaaagagtctcctgatgaaagtgaaagaggagagtcccacaagttggcttaaagctcaacattcagaaaactaagatcatggcatccggtcccatcacttcatggcaaatagatggggaaacagtggaaacagtgacagactttattttcttgggctccaaaatcactgcagatggtgactgcag

SEQ ID NO: 31975 - DNA, 1187 bp, Bovine  19866880936510
tgctaagtgtgttagtattcttggcccattttcttcagatatgagactgagtcacccatgtaaataggatttatagcctctaagatctactatacagatgtctatatttgtcattgttgtttagtcactaagtcatgtctgactcttgtgaccccatggatcatagcccgccaggctcttctgtccatgggatttccccaagaatactggggtgggttgccatttccttctccaggggatcttcctgacccaaggatcaaacccatgtatcctgcattgcaggagggctttttaaccactgagccatcagggaacctgaaatgtttatataattgtctacagtgaggtcaacgctctgatataaaatagctataggaattgtgaaatgaagctctagaacctcctttgtgttactattctaagtaagacacgttcacatagggtctttggactaaaaggacgaatacaacctggtttggaagcaagttaaaaaaaaaaaaaaatcttctgaccaaaagaatcatttttttttctggcctcctaaatctacatgcattctaaaatccaatctcagatcattatatcttgaattactccaactttagatcaaccatagttagtaagcaatgctattctacttcacattcgaggaaatttgggttcaaggccacatagctagcgagtaaagaagacattttgtctataatgaaggattgtttttaaatctttattaatttgagttctgtcagggtgtttttaaatactatacacaatttctttcagattttctcttccttgttttgggtacatgaccttcacggctttgttctgatttgtcaggggatgtgagatgtttctctttgttatggtttttgttttatgtgcagttttgacttttctccataatggtaatctaggctggtttggggaagaaagagaatacctgggatttatatcaaagacattgtcagatactttttttttcctctttgctctcactgtctgccccagccctgaaagatgtgccatgagaaacaaagtattagaagttttcagctggcctaaggggaacagtctcatttactgtgctacatggcatcataaatcagcaaggataatacccatgtgactctaatctggcattaattctggcactaaaaatttaatggttccctggccaaccctca

SEQ ID NO: 31976 - DNA, 1314 bp, Bovine  19866880986912
tgagataagtgcaattgtgcatgtagtttgaacatcctagggcatttcctttctttgggattggatgaaaacttaccttttccagtcctgtggccactgcccttgcatttagatggtgctaaatgaatagttctcttcaaacaattttaagcaaagtgatttgggtcacttttattttggaacagtagagagcagatgtgtcttccttattctttctctatttatctttgctcttcttcaggctggatcaggctcagaaaaccttcacaccacatattgtaagctcagtggaacctgagcctctgaatgactgcagagccaacacacacacacacacacacacacacacacacacacacttacacatccctatacaatcaacctgcagtggacacttatgtaaataagaggtgaactttttttcctaagaaactgaatctttgggttttacaacttatagcaggctactgctgctgctgctgctaagtcgcatcattcgtgtctgactctgtgagaccccatagacggctcccaacaagctaagtttgcttaactaataaaaggaaactaggaaaagaaaaagttttggaaagctaagttgctaggaatttgagcaatcatgaccattgtgttatcattgggtttgtggtcaattaaataatgattatctgaagatttaataactctttgagaaatgcttgtagagaagaatttttggcaatctttaataaaagaaagctcattaatcaatgtttaattttcatgtgtaaattccactaacaacaagaaaaagagcatttattaaactgtaaggaattattaaagatctattcataaagcatttctaaaatgtcacttagataaaccctgcacattatgaatcaaagcacaaaactctttcttgatctaaatgtgattgacctttataatggcaacaaaaatcctaagaggtatcatataggtaatcttgtgtaatagtgtaataggtacactattacactattacacaaatcttaaggaactattacactattaagattgtgtaatatttgcagaaaatgataattttgtgatgcatatatctgatcttagttttatgtttcagattattgatgtatttgtttatatattttataaaaatatactttgtttaatgaattgtaaagtgatgaattttgctaaattgaaacttataacataatgaaattaatctaatttttctcagctatgccatttgattaaagctgtccaatgtgacccaaatctctattgctagcaagaaactcaggaaaacccagtcactttttaacaata

SEQ ID NO: 31977 - DNA, 872 bp, Bovine  19866881168114
gaggatgtgtgaggatgaagatacgtttgttaacttggtgatgggagaatgaagcatttgcagtctgcttttatttgattaatgaggtacgaggtaggctatcagtttaggatgtggggagtatataatgtgcaggaaggttaaaggaaaaggagatgttttcagagagttcttccgaagaatagtaaagcaaatttaccagggaaacctaaaagtggtgctaggcattattaagtggagttctgctttatagaaactaaaataaaactagttattcaaggcgggtgatttttttttccccagaaatttcagttgttcgcttatggacatggaaaagacagatgcttgaaataaagttacagtttttacaagtgcataggatagacacagagagacagagttttgtatccatagggaggtaatcaaaaaacaaaacacagaaactaaattgaatatggaaggaaatgagggcaagagggaggtgatggttttatgtaaatataattttcatgtggcatcattccaagaattgatatttggaattagaaaaggaatgcagatttcgcaaagttcagacagaaggagaaaagaatagaagaaaagcaaagacaaaattgtaagcggtagagctgaagcttctggtcctgacttagcaaattttctgcgagtagaaaagcaacattttagagagaaatgggggcagagcagatcatagacggtagaaaagcagttgggtaggactgacggccttccaaggctggaggtcatcagtttaagatggcacaaaatactcaaagtgaggtgttttctcaggaagtgttcagtgttagagatattggaataaatatgttactttgataaaatgaagatat

SEQ ID NO: 31978 - DNA, 874 bp, Bovine  19866881260462
tgcagttttcctgtgtttatcacaattaattttggtgtgaagaaaaaacaaaacctttgatattttcatgaccatgcgttaacattttggtttaagaaaaattcacagcaaacatgaaaatgaatctctttggtagaagtctctgagttcagctttcaatgttatcataatcataatcatttaataaagggttactgatagcctgctgttctgctatatgccaagcattgtgataagaagtcctatagatcatggaacatggtaagcaaagctttagaccttatttagaatgaatgtattagaaataatataatttttatatgtgtgtgcacatacacaggttttctatgttttgaaaacttttagtatcttgtttgatgtcaggagatacaaagttctgaagatgaaacttaggaatctgctcagattcttcattatattacagggatggtgtacatggttatgggcttcccagtgactccagaaatgattacttttcctgcattgtgtgacacacaggagatacagagacacttcagttgacaaatggggctatttttgcttgtctttcttttggtgcagtgcagtggctaagaatacaagttctggacactgtcctcgttctgtcagacttgaaaaaaattatttttttcccggagccttaatttcttcatctgtaacatgggttaaatgagagataataagattgaactccgaattatgaggatttaagtcaacgatgacccttgggggtctaacatctgtgtttcctgtgttgctcaccagattcagttgcttatgagcttgcccattcagaagtctttcctcaatagaaaaacccttagacaaacatattctttttggcattggctaa

SEQ ID NO: 31979 - DNA, 760 bp, Bovine  19866881282451
ggtttggaaaaacgaagagaaataaggcatagctcaaggaggatctagaggttaagaaaatagctttccttttatttttatctctaaacatgcgtttgtaacatgtgactatatcatatgaaatatctgagcatgtcaaagggaaaagacatcccggggagagaggctggaactagagcataggaaaagctgagacagaaagagggtggctgccagagcagagtactggaagagatagaaaaacagatctggtcagaagcatccttcattcccatgaccaaatgaaaatggcttaagatgtggggagatagatggctgaggatcctcagcctgaatatctctctttcttttgaaataaatttgggtgttacttttgactatgaaagacttaaaatggctaagtagattttaaaaggtggtacaagcctgaaattggaataccagatctgactatactaactgtgtaatagaacgtggtagcttgcccactaatccagactttagctagaagaaaagaaaatttccttaaatctgtccttagtctaattatgcagcctcaatcatcttaattccttaactctatctcctagaataagcagttcactcaaatataaagaatctgaaggaaataaagcaataggcctgaaagaaatgtatcatatcctgacccactcagcaatctgtacaattttatgtgattaatatttaagtggacatgatgatgatatgcattttgttctcttagcccagcatgtggaag

SEQ ID NO: 31980 - DNA, 736 bp, Bovine  19866881363144
atacacttctttggcatcctcttaattagatctggcttctgaacacttaattactgaactctacatagagtgattgagaaaatttaaaatatatgcataatgctgaccatataatgagaaagttgttttcacagaaaagaaatcccaactcctaagtaactattgcaataaaatcatacaaatttgctattatacagtgtaaggacttaaattgaagattgagctggcaagattatataattgcatataagagataactagcttcaagctgggtttattataaaaactaatttttaagcattatctaaatgtaatatattaccaactcaagaaaatgcttttattaattgctatatgcttatgtaggcttccctgatagctcagttggtacagaatctgcctgcagtgcaggggacctcagttcaattcctgggtaggaaagatcagctggagaagggaaaggatacccattccagaattctggctggagaattccatggactgtgtagtccatggggtcacaaagagtcggacataactgagtgactttcacttgcatatgtcatgtactttgagcatataaatacatcatgttaagagagttaatatttttaataataatacaatattagtatcattgtcatatataacgtattatatataataatattaacatcattgtcaagtcactgtcaaatctaagtttaaacagtctccatcaagcatatcaagtcag

SEQ ID NO: 31981 - DNA, 1853 bp, Bovine  19866881390002
tttaggaactgttataaaatcacttaaagggcagaaaagtggaaggagtcaattctactaaaaatagggagagattttatagcacaggttcaccagatccttaaaaacgtaagtggctgttccagtgtgctgccccttcctgcttcccttgactacctgataaaattctatttactctccaaagaccaatattctcagacgccaagcaaaccattcacctgttattccatgatcagtgagtcattcaaagcatgttgctgtttgcactgcattgcctttgctctgaaggtaaaacagatatctgctctcctattgccccaccctatgctacactgtcacatgcaaagtaactttcatgctactgtcttacccaaggggccctgttatttataataggcttaataaacttgccaaaggctttttctcacattaccttatttgcactgcatacacaagttgagtgtatgtgattattcccattctacagataggtaaatcacacagctggtgaaatgccttgccccaagttgcacgggagagttaagtgcatgggcaaaaatgaagacagatggcctcctctcagaggacacattctcctgtggcattgctcttcccaacagcaggtgcaacatgtcatcactttgccatctttctcaagctatgctttagcttctagattctcttttattcacagtatatgtggtgcagatttctgtacaggatgtaaataaatgacttcacacctctgtatgaaagcgctgctgctgctgctgctgctgctgctaagtcacttcagttgtgtccgactctgtgcaaccccatagacggcagcccaccaggctcccccgtccctgggattctccaggcaagaacactggagtgggttgccatttccttctccaatgcatgaaagtgaaaagtgaaagtgaagtcactcagtcgtgtccgactcttcacgaccccaaggactgcagcccaccaggctcctccgtccatgggattttccaggcaagagtactggagtggggtgccattgccttctccggtgaaagcactacatttgtgtaataaatgttatacagtaaggaagattcaacagaaaatatcaagatgatctcaaaccttacagagtcatccacagtcacaattagctcttcacctgattgccttctgtgggctgttgttgatgtctggggataatcactaacttagctatcctagtactcttaagctatatgacctttccagtgtaagttttttgtccccatcagtatttattgcatctttttactgcagctattttccattaggaaacacaaacagaaataaatattgatatcattctctaggaatactatgttctctgcactatcgctcctttaacaagtgaatttttgtaaatccaatataatctgctatttcctaagacctcagtgataaactcagtccttgaaaaatgcataaattttaaaagtgagccaatgtacttctcagggctgtgtttacagtgtgaaacctcacttcatgcatcccaaccatgcctattgaacttgcttaaaaaagatactcacctctgcctttctgaaagagacagaccctctgaattagttttccatgaattgtttccctcgtgagactaaggccaaataagccatctgggacaggaagaaagcacatcttttcccccttgtattccaggacattttacaccttaaaatctaccaagattgtatcacatctgaatatctcaccagggtcccaggtcagaagtgacagagcacacctgtgcagagctctgaccgacacctacggaaggggcagggaggctcttgcgagggggcctgggaacagca

SEQ ID NO: 31982 - DNA, 932 bp, Bovine  19866881579798
tcactatgtatactatagttttacatgagatggtacttgaagtctcctcagtctgctgctgcagagaagttaaaattaaggaactttcttagtaaaactggagataatacctccctattgtgattagctttgttttctttttcttagagcgagtattcaatattcagcatgagatttttctggtagtaggaagcacattttccatgctatggtgaatttattaacttagtatctgctatgaactatttttatatttaatacatgtaatcacaagtatggtgcatattactatttataaagaatagattttaaatgtcaaatatttacctggcttaaacatctttgttgttgttgtttagttgcgaagttgtgtccaactctttataaccccatggactgtagcctgctaggctcctctgtccatgagatttctcaggcagaaatagatttctcaggcagaaatactggagcgggtgagttgccatttccttatctgggggaccttcccaacccaagtattgaacccgtgtctcctgcattacaggcagattctttactgctgagccgccagggaagactgcttaaacatcttgctgctgctgctaaatcgcttcagtcttgtccgactctgtgtgaccccatagacggcagcccaccaggctcccctgtccctgggattctctaggcaagaacactggagtgggttgccatttccttttccaatgcatgaaaatgaaaagttaaggggaagtcgctcagtcgtgtctgactcttagcgaccccatggactgcagcccaccaggctcctctgtccatgggattttccaggaaagagtactgtagtggtttgccattgccttctccagcttaaacatcttattagtccacaaaaatgattcatgaatgtttaattatgccataaagaacaactg

SEQ ID NO: 31983 - DNA, 809 bp, Bovine  19866881745427
ttcctttcacaatggtaacactagtctcacagccatgcatttccccaacaccgtcttattttgctcttgtcacctgaagtccttaaagaatgcgaaaaaaatactaaactgttggactgcacatgtttgtctgaaggagagggtaaaatggagagttagcatactgaaggagtttaatcctgatgaaacattagctgtcatttgagtaaaaaaggaaatatttacattataacaagacaagaaaagcatattctttgttcagctactccacattaattatgtatatttgggggaacttctatatgatctcccacaaagtttccctcctttttaaattctccccctggaactaaaatgctagagataaatgtttatggggaaaaaaattaagttttctcacagagcaaatcccaccaaagtaagtatcataaagaaaaaaaattgaactctatttttttcctacctgaaaatattagggtacaagttgtctcacaacaggaagtcctaataaggaatgaggggctgctttgaaaactcaccagctaattaggcaggtgccaaaagaagggaggaaattccagcccataatattgtcctaccaacctccaagatcagttttcattccaatcccaaagaaaggcaatgccaaagaatgctcaaactaccgcacaactgcactcatctcacatgctagtaaagaaatgctcaaaattctccaagccaggcttcagcaacacgtgaaccgtgaacttcctgatgttcaagcggctttagaaaaggcagaggaaccagagatcaaatgccaacat

SEQ ID NO: 31984 - DNA, 823 bp, Bovine  19866881952122
attcagtataaattctgcacaccaaaacagaatatgtctagatttgaacgactgcagagcttacttgcaacactggcaatgcccatttatggaaaataagaatcctaacaacttgtgtgtaattgtacttgtcagcagcacctataacttgaatgtaagttttgaaggactgcatttattatgtcagaggaaaattagcagctgctcaaacggggatggtagaattttaatataacatctgcaaaacagcttttacatatctagaatcagctttttctcatgccagagagttttcagagagtttcattgataaacttctcactccatatgtctcatgcagtatttcatactctctatagtaacagctattttaactggtatggctagactcaaaaacctttatgtcactgacgtttatccatctcctttacatccccttcaaattaacctccaacataagtgccgtgtttctctaactgatagcaatgttctacatttccacagtagcaacttatcaatataggccttccctggtgactcagatggtaaagaatatgcctgcgatgcaggatatgcaggttccattactgggtcaggaagataccctaaagaagggaatggctatccacttcagtcttcttgcctgggaaaccccatggacagaggagcctggcgggctacacaccatggggttacaaagattcagacacaaatgaacaactaacactttcactttcagatgttttaataggatatgtctagttttatagtctttaatttaatatattttaaaatattatttttttacattacattcttttct

SEQ ID NO: 31985 - DNA, 730 bp, Bovine  19866880393187
tggtaaggaacctgcctacaatgcaggagacgcaagagaagtgggtttgatccttgggttgggaagatcctctggaggaggaagtagcaacccactccagtattcttgcttcggaaattccatggacagagtggcctatagtccaggaggtcgcaaagagtccaatgagactgaacacacaacacacacacaccacctgccccatgggcttgtctgaggggctttcagtggccagtgtctgaattagccttatgaacatgaaagggcgtccaggtgggcttatcattaaggtacggtttgtatggacttgctccttgtccctataaagaaattcatggagaacagtatatgagattaaaaaaaaaatcaccttatattgaagatctcttgtaccagctacttcatttatttttagtttactttggtgcaaatgtatcttacagtgtttctcattttgcatgggccatagtggttgctagctctgtttggaatcagcgaaaagtttcttgggtaaatttatttcttgcccaatccttccttgtgtttcaatagcattttgccatgcgacacttgtcccctattcatatatttccttcctctctaatttgttctgtagaaacttgaggagtctatttctcgtttttggatgcattataaaatgggaaatgtaaaaggctttctgaaaaagcatcttcaaaatccacattggacagttcattttgatgttgga

SEQ ID NO: 31986 - DNA, 1097 bp, Bovine  19866880505120
ttatgtgttgaactgacaaaattaggattttattttaatctgcttctgttttttactagtcctttgacatacagaggagaaaagatatgtttgcgttccacccagaacaataatactgcctttctaaagtaacattatttgcattacacacatgtaagaaaaatggtgcaaacatgtactaatctgatggggatcagtggtttttattcaggtgaaatttctttgaaagttaagcaagattatttaattctttataggaagtaaatgaaggaattcaggctctctcaaacaatgaggaggagaagaaaggggtggcagcgtcactgcttgctcctctactgcctgagggaataaaagaggaagaagagagatggagaagaaaagtaatttgtaaagaagcagagccagtttcagaagagaaagaaacaagtacaacagaagaagcagcagcagtaaagccacaggaagttctgttggacagtgtggaagacccgagtcaggaggatctctgcagtgttgttcagtcgggagaaagtgaagaggaagaagaacaagatacccttgagctggagctggttttggaaaggaaaaaagtaagtttttgttaaatatgttttcttccttcaggactgtcatactctgggatcattgtgcttcatttacgccattggcggggcagggggtctgttcttcttatcctttcatatagatagatgtttaagcctatgtaataaaaacctgaactctggagttgatctactgaagccctgagtgtgaagcagagtctcaataggtgttgtaacagtaatacaacttcgaagcttcccccttttgaaaaatttgaagctttggagagcagctgggcttcctaggtagcccagtggtaaagaatctgcctgtcagttcaggagactcaggtttgatccctgggttgggaggatcgcctgaagtaggacgtggcaacccactccagtattcttgcctggaaaatgccatggacagaggaggaaaagaatgtggagtttaatgctcagtcctgatggagagatgtattaagaaatacttcttgttctcaaagtacttaaattccaaaaaca

SEQ ID NO: 31987 - DNA, 1298 bp, Bovine  19866880541240
tgacacagccacagaacatttcccaggctcccgtaggtgcagccatatgatcaagatctgacagtggaatgtgagacaaagtattctgtgcctgcctcctccaggctcagcccataaaaccttctatgtttccagccccagggcagccttgatctcttggaactggcaaaatctatgtatctggatccctgaatgacgacatgaagtccttgccgccaacgaggaacatctgatttggactttatacatgcaagatatcaagctttagagtgttaaccaatgtggttttcgggtttatcttttacagcagctagcattgcgtgaatcaaaactcaaggctaggggacttccctgggcagtccagtggctaagattctgcattcccaatgcagggggcccaggttcgatccctggtcagggaactagatcccacatgctgcaactaggagttagcaagtttcgactgaagatcctgcatgccgcaactaacacccagcaccaccaaataaatacataaaactttttttaaaaaaagctcagtgctaaagatgaagccgttacttagagggaaaacctacataggtttgacttaaaccacggtggcttttgaaacaccaaataagaaacaacacaactgttagggaggacattcaaattttcatattgtactccatcaaacttacgacacctttttcaacataattttaacgtctccgaaataaggccgttaccaagtgtgtagtaacgggcggcatctcaaatcgcaagcagccgggagatggcggtgatgtagtgcgtgtgcacgaacttggtcacggttccgcatcttgtcatccttgtccttaagctttgggcagcgtcagcaccgcaggcgttggtttaatctctgctgacaacgtcttcaaaaagacttcatgctgatttggcactgaaatgaaaagttattgtgttttttaaaaagcaaggaaacagagcagattgatatacaataaaaatctgtgtctaaataagacttaaaagagctctttcgatatgcacgaaatggaaattctaagtgataagaaagctttatgccatgattttgtatttcttagaaatccattagtaatggtgtgggttataattgatgggtgctttggctcagatggtaaagaacctgcctgcaatgaagaagacctgggtttgatccctaggtcaggaagaacccctggagtagaaaatggcaacccactccagtattctggcctggagaattccaggacagaggagccggcgggctaagtccacggagtcgcaaa

SEQ ID NO: 31988 - DNA, 728 bp, Bovine  19866880599961
cactctatcagacctaattccttgaatttgtcacttcccagtataattgtaagagatttgacttaggtcatacttggaatggtctagtggtttccctactttcttcaatttaagtctgaatttggcaataaggagttcatgatctgagccacagtcagctcctggtcttgtttttactgactgtatagagattctctatctttggctgcaaagaatataatcaatctgatttttgcattgaccatctggtgatgtccacgtgtagagttgtctagaaagtaatttttaaagttagttttctccaaaattatttggaacaaaaaaaagtatttctgaacaactttcaaacaaggtttgccctgagcagtttgttttgggacttgtcctttaacgatatccttttagtaacaaaaagtggggtttttgctgggatgatttctagatagaacgttgactagatgactaaagtttcagggtgtaaggtgtggactagaagaaggccacttgcaggctcctatgtaaaaagcaagggcagatactcccccctaaaaacacacacacagtgtgtgtgaggggtttcggggaggtgggcagtatataggaactctctgtactaaaaaatttcaatttctctgtaaacctagaatggttctcaaaataaagttgcctggccttccctggtgatccagtggttaagaatccacccgccaatgcaggggacgtgggct

SEQ ID NO: 31989 - DNA, 1443 bp, Bovine  19866880608456
taaagctcttataatatgtatgtaaaaaaaaagtctgtgaatagacagggcaaaaatatcacttaatatacagaaatatagaaaactacctaagaccatgtaaacaaaaacactttccaacactttttaaaatgtgtgggtcacttttaacaacctctacctcttaacatggttttcactttaagttaaacatttccccctcactttttgttaattttggaatacatgtggagtcatcacatttttcctccctaggttttaaagaagaaagttgcaaaggacaaaaaggaggactccaaggcagggtaaccagttaggatgctattacgatattttctgcagatcttaggacagttgaaaattcctccaaactattcagtagtgtcaggctttttcttaggctgctacttcctgggtgtcagagtctctataatctcacctcatctgctatgttcagtaggtgaacagggaggccatctgagagggagctgtcagaaccgctggtgctgtttccagaaggaaaggaaaagggaaagacctgtcattaatttccaggatgtgtatcactgaccagaatagtggcatggggtgaggacacctggtctgctatttgcccgcaatgtgtatttcaattactaagaaatcaagacaagcacatccattcattcactgcgaacacctcggcatgccaggcagtgcaccaggcacaggaaacagagatgaccggtgtggcaaaataaatactggccagatggacaaagctgcccttggcagtgattgtgagaggctgtgggattcttaaggaatcccccacagagaacagcccgagagaacagcagggggctgtggtttgtctgaaagcaagggctctttccagtgtgcaatgcctgtctagtcagtaccagctcagagagcaggatgtgaccagttactctttaagaatgcgttgaaaatacaaagagatactgtaataacaaaagatctgtaggtcacagattaggagcattacttttaacaccccaaatcccccttggaaagcttcagatgaacgtctaggctgatctgaagtccccccgcaaaccgtcgtctccccctttcttcacaggctgggatgaataaggactcagagaatgcatcctcttcatcatgtcctcagtttctgagccgtgttctattttctcctctcctgggggtgtggttggcgagaactgaaagctgtgccctgtgacacgtcctccgtatatgaaaagcgtcttaggcacaaaacccagatctcttgggaaaggacagcatctccagccgctcttttgctcagccctttcatgctgttcgtgctcctctccctcccatcagtgcacaatgaggagccctgcagcaaagcagcgggaaggaagctctcgcttctcataatttccagctcccctgttctcataggcttttcca

SEQ ID NO: 31990 - DNA, 1511 bp, Bovine  19866880616173
tttaaacagcaccagactccttgccaagagactcttcaggcacaaacactctcgagagcggcacagccaacagaaatagaatgcaaaccacataagtgattttaaatttaccagcagcctcattaaaagaagcaaaaaataaacaggtgaaactagttttaatgatgtattttaactcaattatccaaatgttgtcatttcagcatgtaataattatttttttaatatttattcacttatttcgctgcccttcgactcagatgtggcacgtggttgaagcatgtgggatttagttccctgaccagggatcgagcccaagtaccctgcactgggagtgaagagtcttacccactggaccaccagggaagtccctcaacacgtactaattattaatgagatattttaagttctctttctatacgaagacttggacattcagggtgttttttacacctacaacacatctccgcttggaccagccacattgcaagcgctcaagaatcacatgggcaagtggctatccccagtatgggcgtccatggtgtcaaagcaagaacttgggccactgacccaaaaggctcgcttacgcagaagcagccaagcctctttctccttccctcagcccctgcccttggccagtttagggtctgagatctcccttgggtgctgtgcgttcctgcccctttcaggcctcttccccttgaagatatccacaccccccaccgtaacacccagtgacccactggagacccaaactctctgcagtgggagtgtccggggtcagcctcctcctccatcgaggggaggaacgagggacagcagaccctgtctccccctgccctgggaatggaatgcacacaggggttcctcctcttcggggagggggtcggcaggcccagcccagcgcatgggggaggggaggcggctacaggccctttggctggaatctctgttcacgcctctttccaggaacaacagcaacaacaacaacaaaaaacctctggagcaattttggcttccctcttacaagtcaggacagtcgaccagttcccagggtggaattaagtggacttcagcccccgcttctcatacagctcttccccaaagactgccactcggtcctgttgtatatccgctcttgcttcagctcgtgtccaggcttccctatcgccaggatgctgactgtaattttatcaccttcccctcaaccccacacgctcatttctacctgcgcctctgcacttaccgtttttgtttgtttgttttttatgatgatgacttcccctttgtttaatcattccggtgaaattggactcaaaatagaaaacaagagagtgctgacacggaagggaaataggtccgctagaaccactacaagtccaacaattgcttccttacagcttcgagtaacaacgtgctgatcaccacccctaagtatcaccggctcccccacttatggacgtaacgtcatctcacaatccaggggcagccctttcactcccgggatagcg

SEQ ID NO: 31991 - DNA, 1962 bp, Bovine  19866880629648
tgtttgctgcttcctaggagcaatgaaatgctgagagaaagtagccagtcaaccgaatggtaaggggtccatccatctgaggacaggtgccctcccttgtagtcaaatcagtggaccaaagaaaagagccttctgcaggatagtgtaaaacggtcttcgattagaagagacctggtcttttgcctctgcagaatgataaataggtgaagcaactgaagatagaaatgatcaccgttacttttctaggctattgggatttatacagatgggacacttactgtatgggaaggctttattcctatgagcacatcagtccagtacatctactccccatttgaaggctaacagtttttgaaagtgatttatttacatgtcagctcctcactggattctttttttttttttttttgccttggctcatgggatcttagttctgtaactagaaatgaaacctggactctcagcagtgaaagcatggactcataaccaccagaccaccaaggaattccctcagtggattcttctgaaacatacttgcctattggatgggttcattcctgctgcctccctaggtgccatagtaatttgtatctttggacttttgggtggttttgttttgttttgttttctttttagtttcagtggagccatgcagctctgggatcttagttccccaaccaaggatcaaacctgcgcccttggcagtgagagcacagagttctgatcactgggctgctagagaattgctctggagtttgtttttgaaagtagacaaagatgggtgtctcactcctctagagagattttttttttttttagggttaaggatgtcatatgtgacatctcattttttctccctctcttgatccctcattttattgtctcatcagacttgagagaattagagtcttgaactctgatttttgtcctagagagaaagtttcaaaggaaagatccttttgccaccagtgcccccccagcccaaaaaaaaagaaatctttgcagaagaatatcttggctagtagcagcaattagttttctaaagcaactgtttcccttccaaccaactttgtccatatgagtcagcttcctcctctgttcactgccttcccacgctgtcttgggaaggcaggtcttccaaacacattgtcatgagaggaaatgttgaaaagcccttttgcctcggtctcataagtggattcctctgcagccggggccccagtctcctgtctgggatcaattagtcaaatcttgtattaaaaaccacagttgttctggaaccaacttactaccaccccaaaaaagcatgtttccaagtagattcagattagtaccacacaccaaaaatggctgaagacagtgctttggaaaagggggagaaagaaaaatgtgacctggaagagtttttgaagacgcaccaactacccgagggagagtaagtaaggaaataaacccgccccatgcaaaatccaagaagctgtctggggtgagagaaccttttctagcactaatttttgcctccctcgggcagccagaagaatggactgttccctggtaatgccacatttccacggaaaaatctattaggctttgcagtttttatttccaaactgagtagtacgaagagctagaggtgagataaggacaagaagcagaagtgtgcctactgactttccatcctgtctgcagccctgccttgctggcaccccaaagactggtgagtgtcctctggctggaagcgaaaaaggaggtgaaaatgcaacgacagccgcgcctcacgtcagacagctccccacctcctgcagtccagcatctcagacccttgctcccgaggggaccgcacttagagtttatacacaaccctcagccactcagcgcgagaagccctgccacgggggcagtggggaggtactgcatctccatggcccctgggcctgcctgtgcactgaggaaaggacggag

SEQ ID NO: 31992 - DNA, 990 bp, Bovine  19866880638992
cagagcagggcgtgacttgccaatcacccagctcgtaaagggccagacctggcattggaactcagacgcttgaactacctcctatgatttcacatggagtaggaaacccagggcagtattcttgcctggaaaatttcacaggcagaggaatctggcgggcaacaatgggttgcaaagggtcggacacgactgagcgacagagcccgatttcataaccccctgtgagataggagtgttcttcccattctgtatccaagtaaactgaggcagctcaggccagtgtaccccagtctctttctctccccagccccgtccctccctgcccttccttccctacaaggcaaggtctctgtccgacagccctgcctgcagccctgccctatctccccttccaggccctggatgccattgagagagcccaggacctggccgaggaggtggggaacaaggtcagacctgattccgtctgctgggtctggagtcaagagcccaaggtgggatctagggtggatggggagaccccccccaccagcctgctcatgccctgagtccttcctgatctccaggagatgcccctagtcactccctgaccctggctgtttctcctccactcagagagcacttggggggtgtgggcagggtgagagttctgtagctcaggggacatcagaattcctcagtggtttctttctctctttttggaaagtttctttctttctggctgcgctgggtctccactgctgcttgggctttctctggttgcggtgcacaggcctctccctgcccaggtggcttcccttgtggagcacaggccccagggcacctgggcttcagaagctgtggcctcccgggctctggagcacgtgctcagtacgagtggcgcacaggcttagttgctccgtggcacgtgggatgttcctggatcagggatcgaacctgcgccccctgcataggcaagccaattcttcaccactgcgccatcagggaagc

SEQ ID NO: 31993 - DNA, 947 bp, Bovine  19866880667718
agagggcctcggggactgagtccctgccggagcacctaatcgcggggctcagccattctcctgtgccggaaccctcacgtatcctctgctgaaatctggcatgttcggagaccgtcagttccgccttggtttccctgccctgccataaggccaaatctgcctcatctagtgagtcattactgctccgctctccaactgcattctgacttcagcccactcgtgcagctcaggagggctgtgccatatgttagtgccatgtagacagaatgtgactgggtttttttccctaaaacactgtcagagttactttttaaattaccttataatcttgatatctctgaagagtcatttctgtaatacacaaccttctggagatgactttataattattcttctgagtgctcaaaagagattcttcagcatttttagtcccatattccagatgagggaactaaagtgaagatatcagattgagtgacgcaggttccacagccagccagtaaaatttgtactttctggagtcacggggctttatttggtaaaatacacccgtttgtaaaatgcgctttttttgcggggggagggggcacaatcaaaatattagtttgcttttattttctgaggtgattattaaactttaggtacagcaactacttggaattttttttttttttttaaactacttggaatttattggctgattcttgtgactggtctcatgacatccacctgagtaggtgaaagagaaaaggactgaatgagagatggaccacaaatgttcttctaaggcagagatcacaaatgggtgaaactaacattttgagagtaaaagaaatatatctggcttacagatttagctaccatcaccacgttccctaaaaatttttaaaaaggaggggctaaaaataaataaataaaataaaaaataaaaaggaggggtactcctg

SEQ ID NO: 31994 - DNA, 1804 bp, Bovine  19866880730231
caagcagggagtgctgaccctggagatcagaaagccctgccccttcgatgggggcatctacgcctgcagggccaccaacttagaaggggaggcccagtgcgagtgccgcctggaggtgcgaggtgaggagccaccggggccaaggccgggtgacccggggacgctgggcttctgccctgctgcgcgggcccaagctgctgctctggctgagagcgcggctggcacagccggggtggtactggcccctgcactttgctgccagagctgttccctgagccttcccgaaggctgggggtgggggcgggggctacacgtggtgctgggaggttgcagcacagattcggcatggccgcctcctctcccacagtgcctcagtgaccgggctggctccctgtggatggccaggtatgtgctccagatcacccttggtccaggggcagccaccaggaggtggggtccaagaggctgttagggtttcagcccagctcactcagatgggaacctgtattacagatgcagctggagctggcccgtatgccaggagcctggaaggaagctggataggccgccttcctgctgctggatgtgtgtgcaagtgtgtacactggagttgggcggggggggcacccgtagggcagcatagtcacgacaagcgggcacattctgacctcagagctccatgcggaagctctcagaccctgtgtgggctttggaagtggttgctgggacgggcctttctggcctgccgtgctttctcagcgtgtaagggcaataaaagatcggtgcagccactgagaactgacttttgtccaaggtgcctgttttcacaagaagcacaggaaaatttatattgaaaacaaacaaggccggtgttctttctcctggatgaattaaacgaggaccagaacagggtcctaaattcacgaaacaataatagaaggaactcagtctccccgaccttccgttgaggaaaccaaggagctgtgacagaggaaagtgcactgttattagcaaaaaggccagaagccccaggctctgccgttgtcgtcctggcgaccgtggtcacggtggcctggtgagggatagtgacgggcgtctgtgtttctttgcccataaggcctggggtgaaagcatcccagcggctttggggtcccagtaggcaaagaacccgctgcccacacacagctgtgttgcacggggagagggtcctgctgttggaccagacaggaccaggaaggtgtgcgggggccagggccctgctccccccgtcgccaagtagtcagaagcccaccacggatgtccttttgggaggaggaagccagcagctttcagaggtcctctgatagagtggtttttccacggtatagaaaagaagttccatgaaggctggtccaaggactcctgccctgcctcagacactcctggtttccaggccctgggggaggcccagtcctgacacctctctggggagctgaggcccaggcctcggtctctgtccagccccactgaatccctgctccctgtcaaagcccagtttggcggctccctctagtggcccactcgagcacagccaccctggggccgccccttggagcgggcggcggggcaaggtggggcgggcacagcctcacctccccaactgcctctggcggaggtgcctttgtggagtccagggctggccctcctcgcacagggctgaggggcctcactgaatgcacggcagccaggaacccacggggagttcaggacgtttatttcacattcacacctctgtacaccttctataaatagtgggagccgaaat

SEQ ID NO: 31995 - DNA, 1074 bp, Bovine  19866880775978
atagaaagctcacccattataaattccttgttcacggtcgcatgctcttgtctttgggtttcgccaggtatggtcacggggcgccttgggtatcactggcctgttttccatcttgcaggggtggtgtcagtcgtggagctgaaacaaagctcagtgatgcagcgcctgctcataggctggatgcccacagctatcaggtgagtggtctctagccggtgaatcagagggcccaagagtgtgagcttttgccctggtcagcggcaattaatgcttccagtctgactccaagacaaataaacgttatgctggaaagaagaagggtctacacaacactgcattctgtctatagtaaccggacataagccaaatagaaagtgtgctgccacagcccagcctggaaacttttgctccttccgttaagattgtacatttaaaattttatttagtctcttaaattgcaaactctaaggatcgggtaattggcaccagtaaaacgctaatgctcagccttccgttttcagaggtgaccaggggccttcagatcgtcccctgagccttgctgtgcattgtgtcgagcacaatgccttcatctttgctctctgtcaagatcataaactacgaatgtggtcttacaaggtaaatgctacattgatagttactgtaagttaaaataggattgcaaattgtagagaaattgaaataagtcttgtttcctctcgtaaagatgatcagatctcttactttggaaatgatgggccatttccagattcagacagtttcatttaattttattttccatacacttctcccctaaatttttgtatttttattttggaaaattaagtcctacagaaatgttgaagtgataccaagtatactcttcagttcaggacaaatgtggttttgaaatgcaagttgagaggcttctgccggtggtccagtgtttaagattctgtgctcccagtgcagggggtgcgtgtttgatcccagtgcaggggttggggaactagggtcccacatgccacacagtgggccaaaaccttttttaagcataaaaactttaaaaaataaaat

SEQ ID NO: 31996 - DNA, 1508 bp, Bovine  19866880822786
ccctcccccgctccctgagctaagcttttgctgagggccggcgggccaggctagggggaggggaagagaagaacggtttccctggcgaccgtttcccgggcgactccaggtggagcggggacactgcacgtggcgatgggccgcctctggccccttgccggagaaggatcgagctccgtctcgcgttctggacgaagccttggggagtcattagggcgagcagggaagtgccagggagaggctcagaaaagagcagatggggagctgagagatgtcccaggctgaatctcatattgtaaggtctggattccctgcgccagggaagaggagcctggctgcaaggacgtaggggtcttcttgtcgggttctgctgcctggagcctccacacgttttacgtccagggcttatttggttggactttttaaaatgacaggcttcctccagtcccttgctctcatatgttgacctgaataccaagcctcttgttacatcatggaaaaggggttctctgtgttttctcagggaaatacctcgcgtaggaaatcttgattttattaggtatgtgatgtcactgtgagagagtgagcccagctttggttcagggggatcatcagagttgtcattagcagggccaggactaaggctaatctgggttgacggtgccctcctcccttttcccttctctctccctgaattggacagttagattcatagactgtggctttcttcagttactcaaggtggtgttgttttacagacagctggcagagagagaagttggctaccaccatggaatcaccagaggaacctggagcatccatggatgagaactactttgtgaactacactttcaaagataggtcacactcaggccgtgtggcccagggcatcatgaaactgtgtttggaggaagagctctttgctgatgtcaccatctccgtggaagggcgggagtttcagctccaccgattggtcctctcggctcagagctgcttcttccggtccatgttcacttccaacctgaaggaggcccacaaccgggtgattgtactgcaggatgtcagcgagtctgtcttccagctcctggttgattatatctaccacgggaccgtgaaactccgagcggaggagctgcaggagatttatgaggtgtcagacatgtatcagctgacgtctctctttgaggaatgttctcggtttctggcccgcacagtgcaggtgggcaactgcctgcaggtgatgtggctggcagatcgacacagtgatcctgagctctacaccgctgccaagcactgtgccaaggcccacctggcccagctgcagagcacagaggaatttcttcacttgccccaccatctactcaccgatatcatctcgggtaagcagagggagagggaacgtcatgcctagctgcatgggtgtgtgacgtccgctgaaagttctcctttaggacaagggtaccctcagactcctggtgctagtttacattattcttgataagagttta

SEQ ID NO: 31997 - DNA, 1650 bp, Bovine  19866880823331
tgcctgatggtaaactggactccctttctggaaggttagccagggttgggaccccagtcatgtctaccgtgctgagccgcaactgctccactccctgctttctcccactcctggggccaggtccgccagcacagaaaagaaaatgaaaaacgcctgatgtgagtggcaggaagagggagtcccgtgaggcagcaaagcaacaaggaaggttcacggtgtatggtaatatacgcggtatactgttggcctaaaaagaaacttctttcagaaatgtctttaagatgactgacttacatggtctttcatcaaacaacagcaatgcttctgagttagaattatgtccaagatttacagcgttcttagtatttgaatctttagcgacaaaacacaaactgtataaaattcatcgacgaaagctgcgtaaacagtttttttgcatggccttggtgcttgtgcagtgatccagctgcagggttcgactactacattttgcaaggccttctatttctctgcccgtaagtattctcttttttaccacttttttggagaggggtacgtggtagaaaataagagttattttaaaattaaaataacgtacctacttttgtttttgcttagaaggaagaaaagaatcaacagaagaaataaggcctctggcaaactgggtaacttttttattttttgccttaagacttgaggtagactttttgttattaatctctttagcaaatcagacacatgactctgaatgaaggtcaacatattatacagctaacgaaattaaccaaaaacagctaaatctggcagtgtgtgtttacacatcaattacatcaaacacttggggagcctgctacatcagatcagatcagatcagatcagatagtcacgttcttaggccgtgatttaaagttcctgagtcagaagctcttaggggttgtacctaggaatgtgctgtcttaacagacagccggataatgcttccctggggctcagagggtaatgaatctgctgcaatacaggagtcagtcagttcagttcagtcgctcagtcgtgtctctttgtgaccccatggactgcagaacaccaggcttccctgtccatcaccaactcccggagcttgctcaaacttatgtccatctagtcagtgatgccatccaaccatctcatcctctgtcatcccctcctcctcttgcctttagtctttcccagcatcaggtcttttccaatgagtcagttcttcgcatcaggtggcaatgcaggagacccgggttcaatcccccgtcaggaaaatcccctgaaggaaacagcaaacaactccagtcttcttgcctggagaattccatggacagaggagcccggtgggctatagtccacgagattgcaaagagttgggcatgactgagtgactaacaccactaccactagataatgcttagccatattaaaacatcagaaccattgccttggagatttattttctctaggctagtgagagaagatagcagatcttgatgcctcacacccagagaccaagcactttctgtggcttgctccacaggaccgaccacactgaggctaataacacattttggctactaacttctgagattctgtggcaaaagttctgtgggaaatccaaggaattgctat

SEQ ID NO: 31998 - DNA, 1389 bp, Bovine  19866880844447
caagttcagggaagggctgaggagcaccaaacgcagcgcctgctcctctcactctggccatatagctaagaattaggaacctaaggaatagtcttttaccacataaatatcttctgtgaaatatcctagttgaaagcgtgctgtaaggtttaacaaaacagtgctgtttcaaagtgcagtagtaacccgctagctgacgaatgtgggttatacatttccaaggtgcttgtcaccaccctgacttcctttcactccctggaccccctaagattcttgcccaggcagccaacaggacagcacaggtgtctcaatagtaatatcccacccaacccagcatggttaacacacagacaactcaggctaagctgggtgctagtagtgtggggggaggggactggaacagaaaagaatgtttcccacatacaaaagctataagcacaaaaaaactgaaaaaagcctaaattatttgtacaaaacagaaactagcaaaaacttaacagatgtccaaaaaatactgggttaaaaaagacagtctactcacagtagactattagttaccctacattatcaccaaaatatcacacattcccacatgccagagcttgcttcaatctcacaagaaacaaaaaggtacaaagaacaatgagaaagtggtgacagtttctaatttactgattcctttgctgaagagtaacaatgctatgtaaatgaaaaccacagacctatcaaaattaaacgtctaacactaaaatccaacagctttagaaccaaaaaacttcattttgtataatccccaaactaaagacatttcccaatctgggaataaaatttcaatggagtttcaatgtggggggggaagtgatatttaactccattttttcaaagctgaacacagccatggagatcagaaaaagctagcgaacaattctttctaaagccacacttctaacctacaaacacatcccaaaagaggcatgttaaaatcaattaattgagatccactagatctcactgccgcctccaaaccagaactcaccatccctcttcatattttctgccacattttctaagtgaagtaaaagaaaaatcaaaatgttacaactcaaatgctgttctaaaagtgagtccatggagaaggaaatggcaacccactccagtattcttgcctggaaaattccacggatggaggagcctggcaggctacagtccatggggtcacaaagagtcggatatggctgagcgacttcactttctatagctagctcagtgtcccaaatctcattctctaaatcaaatgtggatgagattcctaagtacaacctgtctgtccggatctcagggcaggacttcctctctatctgtgcatctatgaaactaaaatttctaaaa

SEQ ID NO: 31999 - DNA, 1786 bp, Bovine  19866880848133
ttaaagggactgactaggcccactctttttgccctccctcttcccttttcctggaacgtatgcatgaaggctggagctccagttgccacgctgggccaggagacaacaatgaaattttctgaaacagtgtcaaatagggtactcaggaggaagctgagatgaataggatgtagagattctgctctcaaggagctgatcatttagggagagcggcaggatttgggtgtaaagaaccacaataggtaaaaagagatcagcaccaggagagaggtgcagaacttcctcctgggggaatcagggcggtgtcacagaagttatttctaaatgatggtgaggattttacatagtgctgatagaggagtaagggagtgggatccagtttaagttaaaagtttgagcaaaggcatggaggtagcatacatgcgccagtgtgtggctagttgaagggggaagggttcgtgaaggagacgaggcagataaggtgtatggggcttaaatgctgagctaaggagctcggttcaacctgcagcaggagggaagagtgcccagagcagtattttaagattattccagccacagagtgaaaggcaggagacagaagaggcagggagatctataagaatctaataaaagtgtccaatctgaactatacagggttagtaagaaaagaaaagaaagggaataaacagatggaagagagactgagaagagttgcagagacagagggcacacaggcacacaagctcagaatttaattagcttcttggtttgccgatggattacaggggaattagcagagctcagagtcgagggaccttgctgggagttgaggggaagctaatgagaaaggcaacaacaagccccagggagaaacgaaaggggagggatcattagccaagcagagaagctggcaggagaaacagatgtcagggcgctgagtccctgcctccctgggagatttcagccttccggggggagcagacgttcagagcgcctgggctgggctcctggccccatggcgcctggttccaatccctctgagcacttggtaaacagcctggaatggggggaagttgggagtggctgtgaggagcaagttcctaactctccgttggcccttttcccagaagcagatccctaggtccttctgcagatggggaggtcgaggcctgctcctgactagacatggcaaattgcattttccaaagacagctgtgactcccaccctgcccttcttgcactgggaccacgcccactaccctccaagaggaggacttgggctcacctgtgaaaggtgatgctgcttctctctggtgctcgctctcttgaaattcacacttggaatccagccatcatgatgtgagaaagcccaggctgcatggaaaggctgtgtgtagatgtggtggccaacagcccgaggcaggaccagttatctaatttgcagggtccagggcaaaatggaaagacagggctttttgttcaaaaattaagaattgaggaggtgagaaccgccttacaccaagcatagaggccacatgtgggactctgtgcagtggtataaggcaccctgtgaagctgggcctgaccccagctgaggttccagcatccgctgtttgcggtacgactccggaagcctccaagatgactcggggcgcaggtactgtctgatggcaactgcgaaagaactccaagcgggacccacccggctgacccagtgcacttccagatccactagggttctgttttaaagaactgactgttttaaccagaaacttttagttactgc

SEQ ID NO: 32000 - DNA, 2107 bp, Bovine  19866880880033
aatgaaaatggaaccaagcatgcctttgtgtaaggccaagtattgcgttggacacaaagttcgttctggtttttccgtaagctgttttagaaaaatctgaatgaactttttggccaacccaacagttcatgcaggttaaatctgttatttaaatttgtgactttagtttcttttaatgcttccaaactagagaggcctatatttgataagctactgctttccaatggagacttacttataaatagttgagcatttagaatttatttttagatttccttacatcaagtcagtctccttatttcagccttaaatataactttttcactcaaccaaatgatttatacttaaagatagcaaagattacttttttactattatccagaagaaaaagtttaactactttctagaaaaaaaagtagtcggcctatttaagatggttggccaattaaaaaatatttgtcaagctgcattaagtaatatacatactttcaagtcctgttcttcttctactttaggtactgtctgtacttttaatttttctggagattcttctgcttccatctctttgtctgagttttcatccattttttctgaattttcagcaccaactgctgcaaaagaaaatatgtgaaattaaatcaaaaggaccataaaaaggtcttactatacagtgcagggaattatactccatatcccataataaaccataacgtaaaatattaagaaaaaaaaaaaaagaatgtctctatgtatataactgagtcactttcctggataggagaggttgacacaaaaccgtaaatcaactatatttcaaaaaaatattaaaaaaaaaaaaaaaaacagaccagtactaatagagccccaaatatactttcttatccctagagcagaggtatctgaaggttattagtgctctactttgcctatgtgttccttacatgttaaggaagctctaatgacttaccaacctactatctttataaagccaaaaaaaaaattatttctttataacaggggtcccctatctttgagggtctaatgcctgatgatgaggtggagctgatgttaacagtattagaaataaagtacacaataaatataacttgtttgaatcatcccgaaaccatcccttgccctccccacccccaactgggtccaagggaaaattgtcttccacaaaatggtccctggtgtcaagagctggagaccactactttacaatcacatttcttaaaatgtatctacatataggatttacttgttttatcacattaccccaaagtttctgtttttcctttctccatctattaatcttttatttttttggtcacatctagtggcttgtgggatgttagtttcctgaacaaggatcaaacctgtggtcccctgcagcagaagtgcagagtcctaaccactggaccaccagggaagctccttttctgatctcttccaaaaactcatggcttcaactacttatgaaagctagatatcaaacctggaatttgtgaggattctttatcaagagggttttgataaaaaggctttcataatcagagcagcatattaaactaccaaataactcccttcctggttaacacctgtagacaacctttactggacctacttattcctctggttagtgctatctgttggtagtgggaatctccataagagaacaggtttaccacataattaaatggactaaaagttcataaaagatacgaactctttgttatatttgattaacacctgcttatcaaactaacccatatatccagtataaatcactctcatgaggatcatagataaaaagaaaaagaacaaatttgagtactctttcttaacttcggttcatctttgatctaaagaagaaatgtgactttaacaccactctcaacagctttcataaaaagtttgaaatttagtattaagtactaaaccttatcatacaatggcctttttctttttatttgttcattaacatcgcttctgcattttcaaattgtctaaatctttctactctcccattgactagtttctagtttatttatatatcagacatcttacatttaagacaggtttaagaatttaacaatttcaaaga

SEQ ID NO: 32001 - DNA, 1322 bp, Bovine  19866880977554
gtcagcctgagcatgggcaacgccttgctgggcctcagtctcttccagaaggccctggagagcttcgagaaggccctgcgctatgcccacaacaaacgaacgacgccatgctcgagtgccgcgtctgctgcagcctgggccagcttctatgctcaggtcaaggtgcgccccggggcccccggggggagggtggtggaggtcccagctcccggagagcctccgaggagccgtgctccctgttgcatcactgggttcagtcctcccatatcagtagggacgaggcagatgggagtctgagaagagaaagacttggccgggaggaatagacatggccgggcttcccagatggcactagtggtaaagacccacctgtcaatgcaggagacataagagatgcaggttcgatccctgggtcaggaagattcccctggaggagggaatggcaacccactccagtcttcttgcctggagaatcccatggacagaggaggctgatgagccacagtccactgggtcgcagagtcagacgcaagtgaggtggcctagcgtgcagagatgtggccaggcatggcagagtcaaaattcaagcttcagtctgcctgacttcctgggggagtgggaagctcctatgtgaggacaggccttaaacctgtactttgctgtgtttgctgtgggatcttaggcaagtcacttctctccaagcctatgaaatgagggcgaatggaacccgccttataacacggtcgtaaggattcattcatcaaacatgtactgagcatctattgtatgccaggcactgttggtcaggatacagcagtgaaaataacagccaagtgcctgggctcacgaagcttgctttctagctgggggaggaaggtgaataaatataatcagcaaagccaagtatacagcatggtggaaagtgcttaggaaaaaggggagcagggaaagggggttggaagggctgaggagggggtgttgcaagttcaaacagggtggtaggggtgatgtctgatgacttggagaagagagggtgagccatgcagaaatctggcgaaagaatgaaaaagggaatggtggaagcacagctctgcttttgggggagcttaccttgagtattccaggaagggtggaggccagtgtggctgttgcaggtatgtgagaggtaggaggtggtgggatccggggggttaggggaaagggagatagaagggagaagaaactgatggagccaatgacctcaggcttctggccctgagcctttgctctccgtcctgcagacatccaggctgtgctcggccctcggggcatgtcagccccgg

SEQ ID NO: 32002 - DNA, 1115 bp, Bovine  19866881075506
cctcggcaagcgcgaggggcaaggagtagacaggcctggacccggaaggagttaaatgcataaggggcctgggtgaatcagaggctccgcaggctgagatggaaattccctgtgcatggcgtgtggtcacccagaaaagggaaacggtgcttttcggagcagaggatggcgggggctccaacccgggagcagatgcctgcctgggtggggctggcgagggcgtcgtgaccaaggaggcctggcttccgggtgggaagaaggaggcaaggagccatgaagccaggccaggcctggtcattctgtggtgtgtccatgggccttgacagatgaataggagttcaccgggcccagaggaagaaagggcacttgacttgaactgtgggaagcactagagcccaggcccaggggtgggactcagcatggagagcccgtctccccgggcttttgttggggacctcttttcccatcccacccgagggacccctccttgccccgggaaccacccatcgccttctcctgggtctcccagcctcagtctcccttccagagtcctcgcatcttgtcacccatctgcctcccgcacaggactgtgggcaggcaccatgtcctggctccagagacagcttctgcctgctgtgtttgagcactgacaatccacggaagaggattctgacgttcagagaagttaggcgaaatgcagcccgctggctggggctgagggggatgcgggagccagggctctgcttcagctgggacttggtgggaggcatggagtggggcaggcagagccttctcctggggccgtggagggggacctgggccgctgacgaccaggtctggcagctccagggtccaaggcctgcgtgtccctcaagcttcgggacagcctggcttcctgccttgtccccggggctgggaaacttgtgtcctccctgggaaggagatgggcggatgagatggagccagggccagtcagatggacagacaaggggactgggtgtcgggaaaccctgactcccggtccagacacttgcccactgcgtagcctgggacgcgcgccttgccctctgcgtcccagcatccatttctgatggagacggtgggacaggctctat

SEQ ID NO: 32003 - DNA, 1329 bp, Bovine  19866881096561
cccctcggtttgcaggcccgctcgttggcagagatttgccacctgctcttttctttctggaatgtgcttttccttttcccctgatctctgctggtcggttgcccagtgatgtgttttcagccctcagatctcagcctgagggatatttcctcggggacagctgcctgggccccctgttccatgccaagtctgggccagatctctctatttcttctgagttttagttcagtttgtgatggcaccttcattgggggcacaggccaggcagcgggttttgctcactgttctgtcctcagttcggcacctgagcccaggagctctcacatctgacaccatttctgtgctgtccctgggctgggggcccccaggctgagcgggactcctctccgccccgggatgggttgggttgggcttctggaggagcaggggagggcgtcccccgagctgtggcctcaccagtgtctccttcggggcccagcttcgacagtgagaaggccggggaccgggaggtgcagaggacgatgctggagctgctaaaccagctggacggcttccagcccaacacccaagtgaaggtggtgtttgttctttcacagggggaggaaggggcgctgagaggtcaggggtcttctgttgtctcactggcgcagctcgagttagaattagaggcggttttgaatatccggtgccgtctcacctgacccgggctgcctccttgctggtcgtggccatgcctgtcacctgtctctgaagctccctcctcattcaagcggccgcgtctccttctcaggtcatcgcagccaccaacagagtagacatcctggatcctgccctgctccgctcaggccgcctggaccgcaagatcgagttccccatgcccaacgaggaggcccgggccagaatcatgcagatccactcccggaagatgaacgtcaggtgcgtaaagtcacgagcgaggcgctgagacctcaggggcagcagagccatcccagtcctcttcgtactgagcctgcccgggcttcccctctccctccacctcccattcacacagcactgtccccgcagcggcctccctttctctcaggtgcctgacctgacacagaaccttactggggcccaggatccttagcgttcacctgcacacacaccccctgccccgggatcggaaggcgtgccagcccgggccgtttcctggcctcctctgccctagcaggtgaacacagcccagcctggcccaggggaatgctgccaggggccaggcagacctggttcagatctgtgtgcccgtctgcaggtggcataagcctttggttttcttcctgggacttg

SEQ ID NO: 32004 - DNA, 3776 bp, Bovine  19866881140179
tcttaaaggcattcatacttatttggaaaagcacataagatgaaaacaggaataaaaacaagtccttgaaaacagatgtgaacagaggttttgatatagtctaggtctgaaaagtttggagtaattaaatctattttagtagtctaaatgtaagaatgtaatctagtgtcattttttaaaaagaagctctcactaagctttcacacttcacctcagcaaaagtaaggtctcagtcaatataaggcgttttcaatcagcatttttcttaatattttccttgggttataatcaaaaagatgcagaaccaacatgcaaattgatcttaagtttaatttgttgtaaaataggaattatagtatctaccagagagagatgctgtgcagattaaatgaattactgcacatagagctacacttggaccttaacaagtatcgtcagtgatggtgatagtattactgatggcagtgtctctgatacagacagatagctccttaaaagtaacgtgttccaagaaccttgaagcgcatgcgctacaacagtatttatgctgagcaagaagaaagaagtttagagggaataaaggaaggctaggaaagaattcgggaagacttaccgccatttttgccaacagttcggaagcatctccagaaggcgcgtaggaatgatgccctgttgtgaggggtggcttggatgaagctgaattcccggaaaagaatatgagttccctgacatacactgttaaaactgcaaagagaataagcaagaaatcatcactagatggatagttacagaagactggaattagaataaaaagtcaagaatatatagaacgactgcccagagaaaaatcttttctccaacaaaactctgtactacagattagaccaagttgctgtatgaggaattctcttcacataactatatctctttggaaactcctggagtccaattcctctgaatgccacctcgtgtgtgtgtgtgtgtgtgtgtgtgtgtgtgtacactctaaggaagctttaatcagttgttggaacatctcatatagagggaaatctttgtctttagctcaatgataaactggcactcatatcctcttggagaatacttctccttctaccccatttgaaattatgtttccttaatgacattctttttatcttctctccggcctctatctggagaaggaaatggcaatccactccagtattcttgcctgggaaatcccatggacagaagagcctggcaggttacagcctatggggttgcaaagagtgggacacgactgagtggctaaacaattgacctatattaggtgccttaagaacaacgtggcttatggaaacacaactggattgtctgttccaatttgggggtggcgttgtatacctctctgacaatcaccttagaggaaagtccacatgccaaagatataaaaggttccagacagacactaaaggcaaataaggaaaacaagggtagaaagtggcccctgaatgggagtaagaagcaaagccccagggcccgagtgagtcattgtttaagctgggctggggaaggggaaaaaatacactccattgccttcgggttcttctgccaaagaaataaagactgcagagcctggcgtaatctaaaaatggaaaatccaccaaagaataggcaattatccagtaatcatcactaccaaagacagacttctggttccagaaaactcctcaagtccctgacaaataaatcatgagtggaaaatatgttaatctttgtagagaagcagacattaaactgaagatggcaagcaatagagggatagtggtaattccaaatgccacttttcatttgtttatttaaagggggaaaatattctgagtctccgaactgaacaggaaaaaaatgtcaggagccatctaatccattttccttttccctgaccaagtttagagggaagtgtctaatctgtctttaacatggagcatattatcacttgggataaaattagcctctttctgttaatattaacaacactgtatgaaaaagaaaattacatgcccttctttccctatggaaaacgagcctagaaatcttacttctaagatactatgaggaagtatgaggacaacatctggcaaagaattagaagagagatttttaaaaagcaatgaaagtgttaacctaattatgcagtttgcagtgctgtagtcttgagtaaaggaaaatgaaaaataaagcaaatgagctgttacaggtaaatggagtaggccacatttccagcaaatgaagtctagcaaatgataacatttgagcctaaatttatgaagctaccagcaaagaattagtcccaaagtgtactgcacacccctcaagggaaacaagctggtgtctaggtcatggtctagggtaaaatggaactaatactagtgaaattctattcttcgtgcagcttttaaaaaaatagcttttttaaaactagggagtaatttacgcattgaagaatctagctgagcctcatttacagatgaatacaaatatacacaagaatttataaaataggaattttatacaacagggcaagtcagataatattgaatataaaaagatttagaattgtgtttacattaccatctttagataactcataccaataaaactcacatttaattaaaaataaaaataagcaggaattagcgtggcagcttattagtatggagatcataatcactacctaaggagttaatagacaatcttaacacagccagtgaaattcttttagataagatggctgtaaagaaaaagtagaaaacacaattactccaaacttcactgtttttcttcaacctgaaatatctttttcctaccacccccacctcttaaattctatccaatcttctaggaccatctcaaataccatgtgtatgaagtcttttcctgattccaccaccacagccaattcccatcatatatcacttacaactctcttgacgatactcacaatttgctgccttgttttaaagtgactggatttattttctctattagattctatacagtaatcaatttgtttgtactcatctttgtctccattacattacctaacatgtagtagataccgcttaagaaagataagaaaaaaacagatgaatgataccaggaagaaagtactaggatttatgtttgtagccagccatactagtgatactgaaagtcaacattctatgatctttttaaaagtccaggactttggtctgatattagtgttgtaattctgcaatactagcatttttttttgattggtatgtgcctggcatattttttccatgctcttaatttcaatctttttgctaattttaaaaaggtaaatactcttctgagtagtaaatagttggatcttgtttttttaccacacagagtcggacacaactgaagtgacttagcagcagcagaggggagaggggtagagggaggggtaaaataaatggataggattcagacatataactacaaggtataaagtaagtaagttacaaggacgcaatgtacagcacagggaatatagccaatattttataataactttgtatgaagtatactctataaaaatattgaattattatgctgtacatctgaaacataatattgtaggtcacctatacgttaataaaaattaataaataaataaaattggatcacaaattttaaaaaaaaaagtcctcaagcttacctgtaaaaccaaacataaaagttcataaaaatatcttaaaagggcatgcaaaagataccagatg

SEQ ID NO: 32005 - DNA, 1276 bp, Bovine  19866881161679
tgaatttaattgttaggaaacatttgacagaaccagatagaggaatgttctacaaaatacccagcctgtggtcttcaaaaatgtcaatgtcttgagagaggaagaaaaattttgaaactattccggagtaaataaaactatagacagcacaaccaaaggtaaaatgggatgcaaggttttgttctgctctaaggaaactgttgtggagaaggcaatggcaccccactccagtactcttgcctggaaaatcccatggatggaggagcctggcaggctgcagtccatggggtctcgaagagtcggacacaactgagcgacttcactttcacttttcactttcctgcattgaagaaggaaatggcaagccactccagtgttcttgcctggagaatcccagggacaggggagcctggtgggctgctgtctatgggattgcacagagtcggacacgactgaagcgacttagcaaggatactgttgagataatgagaaatctgaacaaagtctgaagattttatactatcacatgatcatcaataaagtatttagggataaaagggcttatcttgtctgtagtttaagctcaaatgattcagaaataatatgtatgtattacatatatgtgtgtgtgtacatgtgtgtgcgtgtgcaaagagagagaaaataataagaccaatgtgatcagttgtaaatatctggggaatctgggtgaagaagacatagtgtatttcttgtgttatccttccaacttttttgtaactctggtattaccttaaaatagatacgttttgtttaaaccctaaaattttaaaaaatcctaaaaatggaagagagtagggacagaatttaaaaatacaaagaaaccattttttgttgttttaaaaataatccacagctatagggaaagagatcttccttaacaagaggcagttgtcagaataaaggcgaaggagttctgggcttccgtttaagcatctgctgatttcaggttccagcaagtatgctggcagagtacctccaatagagggcggtgcaacattatgaagaataaatcacataccacgggttttggacattacttcaagtggattctcaagtgtttccaaatagaggcaccgagaatcttagagctaaatctatctgcatcccattttacagatgcataaactgagactcaaagaggggaagaaacttgcccaaagtcatagccaccagtagcccaagtgccttgcaaataatagccacagctatatttaggaaggcttactctctgcca

SEQ ID NO: 32006 - DNA, 1301 bp, Bovine  19866881166071
ctcggcatccttagttgaaaccaccaagggcccccaaacctgaagcttttccagggacaaatcgcatgctgcggtggagacggggagcggaggggtggagcgcagcagcggatggtgcaccgtcgggccgtgggcgagagccaaggggttacttcactgctgtttagtatactcaggcacaccagaagactccgattaataggctgtttattcttcagcatgttccttgaatcaaaggctctggatgccgttattgaagagtgtttgtgagagtgccccggaacactcctcctgggctccgctcgctgaagaggaacgggggagtcctttcatttcctgggcagcacccctcacgatcaccgctcactgcagtctaaaggtctgcacagcctttgtgagaaacgggattttttgttctgtctccacgaggtcccattccctccagcaccttgctctcttagagtctaatcatttcatgttcttgtctttgagcctcctgaacctgatgaacgcagccactttatctcaagtttttgctgttgttgtttgggatttctggcggttttgagttgactctgtttggcaccaattctctgcctgggcagtattgtcatcttttcttttcatggttgtttaaaggcatttttgccaagggtgaaaaaaaaaccatccatctgaacccttttctgtgaagcaaatgaagatcttttttttaaatttgactattagaaatacaatgagacttcttcaaaccttggaattgaaacatacttattatgaaagagttacttcctgcatcaccaccccctgcagtagacatctgtgtgcacgtgcgggtgtgtgtatgtattagtctctcagttgtgtccgactcttcatgacctcatgggctgtagcccgccaggctcctctgttcatggaattcttaaggcaagaatactggagtgggttgccattcccttctccagggaatcttcccaacccagggattgaacctgggtctcctgcactgcaggcagattcttcatcatctgagccaccaggggagccctttatatcagaagtcaaaaaattaggagggacaccgcttctccagtcccccaagaagtcactgtcagcttgggggacacggaagggatcgccgtttcctattccctctggcagttatgcttttccatggcctggaaaataattgtatttcaggccttccatgacttctgtgcacacacggacaacacaaccacgaccctcatgggaatgccctcagcacagaggcatccagtgtattgcagagggctcga

SEQ ID NO: 32007 - DNA, 1751 bp, Bovine  19866881171690
ctctcaagaggaatactgaaaagcctgggaacggcagtcagaccattccttctctcaagcctggtctcccaccaccctggccctctccccctcccttttaaaacttcgttttcttttctctttttctggtctgaggaggaaaccgcggcccccacacctctccgagggaggctggggacgacgtgagagcaccagggcctgccctgtgtgtggggacgcgggcagggagagggggcttcactgcccaccttgatttcactgtccagcagccgtgtgcgctggatgatctcttctgtggacatcttgagaacttcctccccgattccatcttgctgcgaaaagaataattttttttcccttaaattcaaggcagttaactcagcactgtgagttagccaactctgcctcaattgacccactatgcgccaaaaaacccagaatgcagtcgcgaccgcataccaagcggccccaatcccgggaccgggctcgaccttgacccccgcagccaccgcctcccctcccgccagcggggtctccccgtggcccgagctccagcaccgcctgcgcgcacctccgcttcgtcccacacagtcgccatcttctcctgccgagtcactggactctcgagtttcggcagcagattcaccattcggaggagcagcctgaagattacaccgggcggcagccgcagggagagatcaatattacctctctttacgtctgctcttgactagtgagactccgtcaacaagtcctgactcttgaaaaaaattagcttgggccgcgttgcggcggcgaatctgcttctcggattcaaaagctgaagcgcaggccacaggacccgcccccgcggctgctgaaaagttcccgccctcgtcctgttagtgccacagcgagaggaggatgcgccactggctggaacgcccagaggggcgggacctggggcggaaaagaaatagaaagcggagggagaaacgacccagggtccttgggaaatgtagtcctaatcaggctgctcacaggctgctcctccatcctaaaggaggcaggtcaggtggtctggtattcccatttctttcagaattttccacagtttattgtgatccacacagtcaaaggctttggcatagtcaataaagcagaaatagatgtttttctggaactctcttgctttttcaatgatccagcctagacattttattacaaaaacagagacattactttgccaacaaaggtccatctagtcaaagctatggtttttccagtggtcatgtatggatgtgagagttggactataaagaaagctgagtgctgaagaattgatgcttttgaactgtggtgttggaggagactcttgagagtcccttggactccaaggagatccacccagtccatcctaaaggaaatcagttctgaatactctttggaaggactgatactgaagctgaagctccaatactttggccacctgattcgaagagctgactcatttgaaaagaccctgatgctgggaaagattgaaggcaggaggagaagggtgagatggttggatagcatcacctactcaatggacatgagtttgaataaactccggaagttggtgatggacagggagacctggcgtgccgcagtccatggggttgcaaagagtcagacacgactgagcgactgaactgaactgaacagggtcttgtgcctgttggctttcagactacaatgtacaccggcagctccatgggacctcaggcctt

SEQ ID NO: 32008 - DNA, 1101 bp, Bovine  19866881253526
tgctctgcagctcctcctgtctgcagctcctcctgttgtgccagcctcacatccccctctcatgctctgcagctcctcctgctgtgccagcctcacctgccgcgtagaggttttgatcactgcgcacttgcccttcctttgggagtctagatcaatgtttgcaccatcttcctcttggtcgttaggatcaacatctagaagctgggaaaggaagaagctcagatttgctcagcccccctgtactctgcagagcccagaacttctggggcctagacaacctcagcactcccagggctcgccatccctacctcactcctcagcctagccccaagcccagcaaaggtgcggttaataaatcagaagatttagcgtgatctctgctcagagctcatctaccccctgaggaaaaatacccagtagaaaaagaaacacgaagctttcgatgccttttcaggcctgtatattcccctaaaaacttacagcggggaggagaacctaagaggtttagatcctacatgcaatttaggcctcaaaaggcccacccactctttccccaatggcaggctgtctccaagccccactgacccctcttcccctccacatacacacacacctcgatgacgttggagaccagatacggcagcgtcttgttcactttgattttctcactgttctctttgatcttgtccttcatggcctggagttcgtgggtgactcgcaacacttcgctcttcatgatctgggatgagggtgaatggaaggaaacattcagccttaccttagcttatctgagggccacttaattggagcaccttatccaggcagccggaggaaccctcctgcaccccttcactcagctcgaagctctctgaatgctcagcctaactgtgtccacaaccagcaggaaacctcctgtggaaacaggaggcctgtcgggagacctccagggggaagcagttgtagtcgagggaaaagagccagactttgagttgagcaaatacgggttttcaggttctgcctttccttacaggctccatacctcaccacagtaaaacacaaaacaaaacaacaaaaaccctcttttagccctcagtttgctca

SEQ ID NO: 32009 - DNA, 795 bp, Bovine  19866881411437
ctccccctcggcagattagctgggctgcagacggccacaaagtcagtagtttcaatcatacacagcaccctgtgtgtacaacaatcacattctggattctacaaaatcctggccttttccagagatataatttaggtaataaatattctccaccccggagctgtataaaacttctataaaaatagaaacgacattcttggttccagccggttgggattcagaacagcgcctccccaacctagcatttttttcttttttttttgttttcttttttcttttttatttttattttttgcatttatttaaaaaatcccatcatgaccctggaagcctttggaacagttttatccttgaaacacaggacacatttctcccagtgcgcggaattcaagtttacgtggttcagcttaagaagtatgtttcatgtttcttagaggacaacagacccaagttatcactatgagaagggaacagctgtcccagcttcagtggggtaatccaccaccaccaactacccgcacaacagcaagatggtcaacgctcgtctgaggcccgaggacagcatgacaaggagagcgtccccgtcggactgacagcaaagcaacccctgtgatctcgcctctgccgctagggggcagggctgacgtctgtgaggctgaggagcccagggacttggtccctggccttggctacgggtcacatcctaacagggccacattccccactaccagcgcttcttggagcagcggcagagcccggaggctgtgtgggtcacatgcaagagtgagacctgtg

SEQ ID NO: 32010 - DNA, 1813 bp, Bovine  19866881431353
ggggttgggtgaggacctctggcagccacacctttacgatctaagcacgctcaatctctccccagatggcaaaaagtgcagagacgccagactccagtggacacctccaactcttccgcagaaaacatggacttctccccagcagatcgccaagcatgtgacagaattcacctccagaaaaccagttctgcatctactagagaaacgggtcaaagataggtatgctccctgaaggccccacggcgtgctcactgtcgggagctttactgtttggaagaaagacagtgtcttgagggagccaggaagccaggcttacattgtgaacagctgtgtgaccgagggcacatggcttcccttcttggggcctcactttcagtatctgcaaagggcaaggtttggatgaggtgatccttaaggtcccttcctgctcggaaggagacccttgggcctgaccaattatataaatgaacagtgactggaccccatgatctgagctcataagtgcagccccaagccaacagctgctgcctggaggcaaaggggcagaaactacgcagaggaaggacagtacaccgaagtcccctgtgtcctcatgcgtcactttagtcgtgtccaactcattgtaactctatggaccgtaggctgccaggctcctctgtccatgggattctcgaggcaaggatactgccatgggtttccatgccctcctccaggggatcttcccaacccagggactgaacccacatctcttatgtcctcagaggtcaggacaaaacagaacacatcagatcattctctgatagaggttaagggcaggattcttagtctaaggaaaaatcatctgacttgcatcacataaaagcctagcttctcattttaagacaaatgtgcttgtcacacttggggggggaaaaaagtgactgattgataacaatccagcaaaatactggagtcagaacaagagcaagtcagtgcaatgccaactccaaaggggaggtttctatctttattttctaactggcaatgacaagctttacacaaaacgccggtaagctgcaagtcactgataaaggggacagccagctctgccactggaacagaaacaggcccagataggagaggccacccgagtgacctcaaggacccgggcaagcctcagtggcttgaaggtgatgtgcaggcagaatgaggaagggacgtgctggaggcagccactgatgctgagggcaggtcagtgccagactcttcctggaaacgaaagctccaattcaaacactaggaaaaatcaacagttccagggtgacaaccagctcattaacctctgggtaggagctcttccagggttcgggactcccccagatggtcagggatgttcctcctcccagaccagctggcgacctcctcccgagcctgcctgcacctgccgcgtgtcccttcccgccgcctccctcccagacatgttccagcaggttctggtcccccccttcttcctttctcctcctcgcctcccttctgcccttctctccccaccctccatctgcttcttgctcatttcagccttcagggaggcaggaggctgggagaagagccccaggttccggacgaggaagttcaagttcagaggagacaagatctgcccaaggtcacagagatggtgccaagaatccaactggctctcaatgactccagctcagggttctctccactgtcgcagctgcacagcaggtcctgcccctgatgcctgtacaaggcctcccctcccaacacacctgtctcacaccggtgcacacacacaccccactctatcccactc

SEQ ID NO: 32011 - DNA, 447 bp, Bovine  19866881467353
tgaccttgtgatgagagggaacagagcaaagctggaggcagaactttgagatgggggatgtcagaggggcttttctgaaatgtgaaaatgaatacatgggcagattttgcaacactgcccagcctgctgtcttctcaagttttggtccccaacttccacccattccccctgtcccaccctgagcttcctcccatctttcactaagctcctttctgtttctgcttgcctggtgcctctcccacccagttccccccaccccgtgtccactcttgccctgctctctctcctcttccctggtgccctgttcatatccgtgtctgtccctctggctgcccgccctggcctcctgtcctctgctttaatgtgggacccatgggaactggagttcacagcaaaacaggaagagcctgtgagcaggaaactgggaagtggggcggggtggtgggg

SEQ ID NO: 32012 - DNA, 1506 bp, Bovine  19866881647012
ccctggggcagcagagaggagtcagggccctgccaagctccacccggaacacccagcatccccagactgcccctgagctgcctggtaggggtgcccagaagttcttctatctacaaaagaagaggaatgccaccccatgtccacctccccctacacacatgcacatagacattcactctcccaggcgtcatcccaaacccagataccatctcggcaaatgtccatgactcctcctcgaacttctacagttcccctggccaagagctccagcccaacgagtcacaagacacttccctttcccattacccctccctatcatcatctggggacagcgtgacctgaaacagtgccagtgaccctccccaaaggtgaagaccgctttgagaaggacctagtcctttcccgctcctcagtaagtgactacaagacaggaggccaggcaaagcaggatgcctgccgcagcttccgcatctctctgcggtgctgcctaacccttggaatgtctgccctaagcccagggcagttcaggaggtcctgctttgcacatcagccagaagaagcccaaggctcgttgagagcactgagggcgaaccaccctcacttcacctggacctttctggttctgagtgaggcccacatcattccgtcccccactctgcagcacagggcagcctagcagctatcacacccacagttcctaagccctgctggactcagataggaccaagtgtgactgctgtcagccagcagccttccttagctccctccaccccaccctaaggcccgggtacctgcatggtggtaggttgtagtcaccccggggaggaggcaaatggctactgtcagccaagccaggaactgcattgtcccggccatgccccaccaggccctctgagtcttactcttcacggcgtctctctgcacctccatctgcctggcacacactggggctccaactttccactaggctgctccagctgctccctgcgttgcgtgtcggtcttcagagctcaacagggaggggctggctctggcttcctaggggctctttccatcccagagaaatgtggaatctggttgttggcagtaggagcctggctcccagtttgtcaggccctaagcctattcctgcccagatgggcgggatgcttagttaatagaaaaaggcatttggtagcaaacagctcaggcttggccctcccaaagaggtaggcgagaccccaggcagtaagactgccttactatctgtcctcacccccaaaacactgcaactggctctagactgacactcagtctggcccagtacagcctggcccagcctccaggaagcccctcagtagccaagaacagccacaaagcctgatcttccagctgcctggtgggctggctgagtggcccctggacaggcagagaactcttccccctcaggcactcagccactggctgaacagaccccagacggctggaatggggagtacttgtttcctgagacagatcagcagctcc

SEQ ID NO: 32013 - DNA, 1816 bp, Bovine  19866880035886
aggagagtgaaaaagtcggcttaaagctcaccattcagaaaacgaagatcatggcatctggtcccatcacttcatgggaaatagatggggaaacagtggaaacagtgtcagactttatttttgggggctccaaaatcactgcagatggtgattgtagccatgaaattaaaagacgcttactcccttggaaggaaagttatgaccaacctagatagcatattcaaaagcagagacattgctttgccaacaaaggtctgtttagtcaattctatggtttttccagtagtcatgtatggatgtgagagttggactgtgaagaaagctgagcaccgaagaattgatgcttttgaactgtggtgttggagaagactcttgagagtcccttggactgcaaggagatccaaccagtccgttctaaaggagatcagtcctgggtgttctttggaaggaatgatgctaaagctgaaactccaatactttggccacctcatgtgaagagttgactcattggaaaagactctgatgctgggagggattgggggcaggaggagaaggggacgacagaggatgagatggctggatggcatcaccgactcgatggacgtgactttgagtgaactctgggagttggtgatagacaggaaggcctggcgtgctgcgattcatggggttgcaaagagttggacacgactgagtgactgaactgaactgagtatatttttatggaaatacagttgttttgcaatgatgtgttcatttcaggcatacagcatggtgattcatacacatgtatgtgtattgtttttcaataactcttttgcattatagattattacaaaatattgagtagagttcccagtgttatccagtaggaccttattttttacctattttattcatagaagtgtgtatatattaatcccaaactcctaatttatccctcccctggactttttactgagttacgatgttttgtttagcacagtttcctttcttattatgttgctggagactagaattctattccaagagtgcaacctcccagtgtactgagcagacagtggggatctgtgttagagggtgaggaaagcagacctcaagtgagatccttgccaaacataaaccaggagacaatgaaacaagggagggagagaagatagcagattacagcagatagagctgatagggagaaggctccttcttgtcctcaaaaaaaaaaaaaaaaaaaaggaagaaagtaaagtgatgtctttggaaatgttctccgtttgcctgctgaaggggtcgtggtggacactgctatcctccatgcaaccccccaggcacagacctggccctgaaggatgtggcagggggcagtccaaacccagccttctggagacatcgggagggctgcctctgcagagagcttcagagccgagagccaggaccaaagccagccccagcgcttgtccagctctccccaaactcacagccgcgcctgcaaaaccacagctaggctggagggagggacttgcctgaaatgcctaatgtaacaggtctgagttgatgaaggatgactaagatgggtttttctctttccccgcagggctctccaggtgtgaaaggcagcagaggacacaggggagaggagggagagcctgtaagttttgtgactcgctgcccaccacactctttccttttccattaaaaaagctttattctccagaaggaatagtggggtttttgtttatatgccttttgagtttgaggggtggggggtggggttgccttttccccccttctctttgtctgcgtcacgaggcacttgctgaat

SEQ ID NO: 32014 - DNA, 2156 bp, Bovine  19866880465257
cagtaaattctttttattttaaaccactatgttctgaggtaatttcttacatagcaatagaaaactaaaacatgttaggttaaatcagatcacttccatatatacacaagggtctcattcgagagaaaggagtctcaatctttctgaattctattaaatacaaagaaaacaaaacaaccacacctatcctataactaccagatccttccctataccaacatctttattagtagttcacaaaaacatcatggtatcgattttactatgtggcaagtactgtcaaactgaatcaattaacatttccgggaaattttcatttctacaagcaaaccacattcagctgctagaaacacatgaactaaattaaaggtcacgggtttacttttatttttcaaggcacatgggcatccccatctgctacaaatgagatctataaaggtcagattgtaatataaaagtcagctccatcataattgcaaacctgaacagtgatatcccctggaattaagtgactttaaaagttctcagttcagttcagttcagtcgctcagtcgtgttcgactctctgcgaccccatgaatcgcagcacgccaggcctccctgtccatcatcaactcccggagttcacccaaactcatgtccatcgagtcggtgatgccatccagccagccatctcatcctctgtcattcccttctcctcctgcccccaatccctcccagcatcagagtcttttccaatgagtcaactcttcgcatgaggtggccaaagtattggagtttcagcttcagcatcagtccttgcaaagaaaatcccagggctgatctcctttaggatggactagttggatctccttacagtccatgggactctcaagagtcttctccaacaccacagttcaaaatcatcaattcttcggcgctcagctatcttcacagtccaactttcacatccatatatgaccactggaaaaaccatagccttgactagacggacatttgttggcaaagtaatgtctctgcttttcaatatactatctaggtcggtcataactttcctcccaagaagtacgtgtcttttaatttcatggctgcagtcaccatctgcagtgattttggagccccccaaaataaagtcttgacactgtttccactggttccccatctatttcccatgaagtgatgggaccagatgccatggtgataggttatagtactcactaaaagggaataaattcatttcctcctctggaaaatgaagcccgaggtggacacattttaccccctgtctgctttgaacagcaacctgaagaggttgggggtaaacagccaaagatctgagcactgtcccgaactccataaagacacacatgttaggttttcaacatgtaagtcaatagggtggtcaaaatttgtctcctggaagtatccttaggaccttagggtagatttacactcagcacaaaattgttcagaacacactgcaaaccaaaacgcgttccaactgaattcaagaagagaaaagaggaggaaacctcgaaaaacctcaatcaaaattgacctttaagacctcttaaaaggtgattgtgttatataaaggctaagtaacaaagatgcaaataggaaccacatgttactctctagaggacaatggcttcgtgacattaataatacacatatcagactgggaacataggtcaggttttctttgtgggaagtgattattttttttggctttcataatgcaagaagatgggtttgtaattctatttctcaatggcaacttctctttctgactcagttatttaaggcaatctattcaggtaccagtattattcacccatattttaaataaaaggtagatgaaaaaaaatgtgattgtaaagctccaatatttgattcagaataaagttaactttcccttttgagggtacatctgtagctttttatgtcaattcaaattcagattagagctgtgtgaagcacattttttttttcaaacaagaattaaagtatgtggagtactttatgttctcgtttttaaagtggaacttgaaagagaaagagctcaaggaaagccgctcaaggcaggtggcatcatttccctgtgctcctctgtacttgtaagttagctacatccagtgccccagctcccaccc

SEQ ID NO: 32015 - DNA, 1752 bp, Bovine  19866880466213
cgactcatggacatgagtttgcgtaaactctggaagctggtgaaggacagggaagcctggggtgctgcactccatggggttgcagagtcaactacaactcagcatctgagccataatcacctttcaggtttcagcgtaattatcatccttccaataaagattcctttcctgattctgcctctctacccatcaccaccaaagactcatttaagtatccttatgttcctgtaacagtaccctaagcatatcaccaccacagcaaaaaacactgcaccgaaatctcttttcaatatcaatctctccaattaaaaggcaagcactttgaaaatagaaacaactactcatctctctcacttaagacagtgcctgacccatactgaagaattcaaatattccttaaacatctgaataagcagaccactctctgcattttctaggtacttaaaacacattcaataaaataatgcatctgactgaagagtaggtggatttaccaaaaagttaatttctgtattcaagagttaaaataaatgcacattcccaccttagcaaagctgaccaactcaaatacctgctgaaaagatatccattgctcgcttcaattctcctcttgttctctgattgctgtttaagtctacaagtggagttgaaggatctctcatatattctaactctgtggcaaacaatccaccatcgacaaaacgttcgggagcaatgtaacaagttctcctccgtgaagtgtcaaaaaaatagttgaaatctgccgggttgtcctctggaaggtaagtgggcttgaaactggcaaaatccgttagaagaacccagttccaactggtgaccatcacattctccgtcttgatgtccccatgacggacgccagatttgtgcgcttggtccacagctgtgaggatctggaaagcgacccagcgcttctcgatgttatttaggaacggacgggtgctgattcggtcgtagaggttgtctcgcacgtactgcctgaagagcatggctgccttctcagaggctttttcggcagctttctggaaaggcagacagttctgggcagaatgaagcctgattttcagttcctccagctcctgtttatagctggtgagaggcaatgtgggatcctgaattgcaaagaccttcacaactaccaggccttctcggtgcttcgctcgagcaactttaaagaaccgagtactccccagactcttatcatattcaaagtcatggatgtctgagaaataactctccacagaaaggatctgggagggagcaatgccagcgagctggtttcccatgatggcagcaagcacctctgagacagcaagttaggatacaacacgtactttctgaaaaaaaagaaagaaaaaaaaagaagcaatgaaacatcattttttatctatccttctacaaggtagatacatcatatttctcttccatcccacaggactgtacttaacaacttcttggcagcctctaaatttcagacatatttatcttaaaagatattattttgtcgtcctttccgggatattaaaggaaaataggccccatcaatattaaattgaaatgttacaatgtgtattttctgatacttgaaaaatttaacaaatctttactacgtgttcagtattgtgcttggggctgaaagaggcaccaaagtgctatgtgacacagttatctgtccaagaagaatgtgtaatctgaatacgaaacccaagcacatcttaaatctaactgctgctg

SEQ ID NO: 32016 - DNA, 673 bp, Bovine  19866880610594
aacgctgatacctggacacttagtgccttcaatgaccttcctgtagtaggacacggacggggagcccgcgctccccgcgacgatgtaggacctctctgggtaggccaggtcccaaaacctgcggaggaggagagaaggggtcattgtgtcgcaggagacaagggatggctgatcactgactgacactcgtcaacgctggtgtgtcctcttctgtgtttgaaatagagattttctagaagagcctaaaatcagttacaaatgaagtattaacagctgtccctgcagggtgtggatgactgccatcatcatcccactgctggtatctgcagtaaacaccaccttgtggtaaccacggtattcacacacatttaactgcccttcttctttcaagtgctgaatatgaagtctctttactgtaccttattttcatgtctgagccggccgttagcaggatggggttcccatccgcaggactacagtagagcccgtggacactgtgagaagaaggcttaaaggaagtaaagaagagagtcaaatgtcgcccataaaggatgcagccatttctagagataagtcagctattagcagttaactgaagagaccagagacagatcacttatgtcttaaatctttctttgggaatttaaaatacatttgttctgtatcaccctga

SEQ ID NO: 32017 - DNA, 3194 bp, Bovine  19866880667786
caaaagattctgaagaagtgacaaaggcatcagcataacaacatccaaggtccattaaactgaaccagatgcgtcatgccagaatatttctgcatattaaccctattgggtatacgtgtattaaagaggaaaatgatatcgcaacatgcattgctatgactagtttccccatataataatatcacctgccagaaatgtgatgattttccccatagagatgttagctactacaggcatgcctgattttaagaaaataaggctctcttaaacttaggagtgattgttcaattataaaaaagggttatgtattttactaaataatttaggctttaagaaagcctcagctccataacagaattaatcaactcatatacattaaatagatccaattacttgtcttccttgttctcctttggagcccttttgtcctttgatggtactgctttgtcctggattaccctagaggaagatttaaaaagtactttagaatcaagaaatatcagcctttttttttctcaaaatagtacaatgttcaagaactaagctaatctgggctaaataatgagaggtgggagaaaattctccatatttgaaacacaatttttttttaaagatgaaagtaaatctgaaggaggcttagtgagaaatgaagagttacgagtgcttgctgagctcacagtggttctccctcctctatactggcagcttcactagtgcacccatccagacaggcccatgacactcactcaaagacgtagcaagactcccctgtaatcgagtctgcatgagggaatctacaggattgaaaactcagtaagcaaaattatggaaatttcattcccaaaggaacttgaaagtctgaaaatgaataagatggaatttttgttcccatctctgagttttttatatataatcagcccagaccatatgcaggcttacctcaaccaaataagcctcagtcaatacctactacacccctcccaagtcatgtgtttgcctacaagtgagaggaaacacaagagaaaaaaagacaggaaatgtggagtaactacacaattcaggaccatctgggccccagaaacttacaggatcccctgggaaacccttgtccccatatcccccagggaggcctctggaacctgggctgccctgaaagaaaaataaataaaatgagctccaagttagcttgcaggagggtgttaaaatatcaagtgttgtggcgactgtaggggagaaaatccatcagacaaaatgattcacattcctctctcccagctagattcttttcagcctctcaagcagaaccaagcccagtttgaaacctacggtcaggactatttataatgaggctgagaaaaggtaaaagttctcatggtctagcaccgccctctagaaccttctgcagaggatggagaggttgtccatccacactgtccagtacactagcccctggccatcgatggccgtcaagcacacgacaggagagcagaagttttcattttagttaacttgaataaatctgacatcctggagccagagccacggtgagacaaacaagataccaagggtacaacatttgggcaggcacccactctacatcactctgagaataagtgcttcagtaaattttgcatgccaggacctcactccagcctggaccctattacatccttaatgtgtcttttgtctgttgcttcatttgaaggcttcagcacttctcaccctgattactacacatccacctctcatctttgccttgcatctatgtcatccccaacacatcctccacgctaccatcatgcaatagttctaaaaatgcaaattggattgtgacctccttgcttaaaatcttttaaggctccacattcccaatgattgtgatccagacggcttctccttggctcaccagtgcctttcccagctcttcccaactccttttgaaccccagctccctccatctgaaccctaacgctcataacaggcagaacaactttcagggcccccccaagcctccgtgtctttgcttaaatggatggataagaaagttgtggtgcatatacacaatggaatattactcagccattaaaaataacacatttaaatcagttctaatgagatggatgaaattggagcctactatacagagtgaagtcagaaagaaaagcactgatacaggaacgatgaccttatatgcaagacagcaaaagagaatagacttttggactctgtgggagaaggggagggtgagatgatttgagagaatagcactgaaccatgtatattgccatatgtgaaatagatgaccagtgcaagttcaatgcatgaagcaggccactcaaagccagtgccctgggacaacccagagggatgcagtggggagggaggtgagggggcttcaggatgggggatgcatgtacaccatggctgagtcatgtcagtgtatagcaaaaaccaccacaatattgtaaagcaattagcctccaattaaaattttaaaaaaccgctccctctgtctggaatgccccctctccacgtcttgctaattcctattcatcttcagttcagggatcatttcctccagaaagatttcctgcactccctccccactgttctctgggaccacacagtcgcctataacatgatcccaaccacatcctgcgttccattagctactgatatctctgtcttcccaaccacaccaaaggatccctgaggacaaggacagtctggttaatctctgagtcttctgtacataactcagtgcctgacgcacgccaggtattcaaagtatttaataaataagtgaatcagaacataaaaggagagctgcttggaaccaaagaggcacacattaatgagtgttgaagtgaactgaaaataaataaacatgtatatatatatatatatatatatatatatatatgtatatatatatatatgtatgtatcattgtgatttgctatatcaagtccaccaaaataattctgtctcattctcttgcttttttttttttttttggatgcaataaagaaaacaaattgctgaccggcaaatggattcacttgcagacttccgaaaagattcttgcaagcagattgcaatcttgcaaaagattcttgctcacaggttcttgcaagccttggatctttctagctggaaattctgaaaatcgcaagttacccactgccccaaag

SEQ ID NO: 32018 - DNA, 1100 bp, Bovine  19866880905864
tcaagccttggccaatcacgttaatgttctcccaaagcattgtgggtcattttagacaacttttgttctgattctgtttgctttctggcctctgcatcttgggatttgcctccaggatcagggtcctcaaataactgttcactgcccgaaggctccatcagtagacttaatacgcttatttgcaaactcaaaaaatttttttaacacaccacgactgtcaaattaggtaggcattgcttcgacagtaactacacatgcagctgtgagacgaaggcttcatgcctacctaatgttaaaaaaaaaaaaaaaaaaaagctcgtattataaatccatgcagaaactccagtgttaaaagaaaaacatgccactagcccaagaagtagacactatcattaagcaatctttaatcagaagattaaaagatagttttctagatagtgggtaatgattattttctagaataggaggaaaagctccgaaacaagtacaaaggaaatgaaaaaacagcgctgttaaaaaactccctacaagttgcaatgtgaagaggaactacatactagaaggttcatcttggaatgcaaaccataataatatttgagagaacagccattacttgggaaatcgagagacatccgagcacagagcattcaatacagacagtctagctgaggcaactgaaaatgattcctctcaatcacaaccatagttaattatctgcatgctgaagctcaatatagtaaattcaaagaataactgtgaaacgtggacatcccaatctaactgcattgtgggttttaatggaaaagaggaatttccagttatattcatcaaggtcactggcaactagacacttctcttttgagaaggtttgctcttttgaaaagaaaatgcaaactgaaatcttataggttggattctctgctggaacacaaacgacctttcggtacaatgagtacatgatccagaaagaatctgtcttcagagactagagcttggctcagaaccagtgaacaaagaaagagactcaaaggaatccctttcttgaaaagggtcgactcgacaagaggctgcccatgtacagtccaccctccatatgcacg

SEQ ID NO: 32019 - DNA, 1196 bp, Bovine  19866880973118
aaatgtattctttttaatggctgagtaatactccattgtgtatatgtaccacagctttcttatccattcatctgctgatggacatctaggttgcttccatgtcctggctattataaacagtgctgcgatgaacattggggtgcatgtgtctctttctcttctggtttcctccgtgtgtatgcccagcagtgggattgctggatcataaggcagttctatttccagttttttaaggaatctccacactgttctccatagtggctgtactagtttgcattttctccacaccctctccagcacaaaattatagtattaaattggatataaagtgaagacttagaatggaataagaaacctcaatgaattacagatttgggtgacaaatataagaaacatcacaaaatctaaaaaaaaaaaaaaaccgcatttttgctaattcatggatgcatcctaaggtgttttgttcctacatttttagactacagagtctttgatcaccacttcatgtgaaaatggttttctaatattttctattgctaaagctgaaactccagtactttggccacctcatgcgttgacttattggaaaagactctgatgctgggagggattgggggcaggaggaaaaggggacgacagaggatgagatggcaggatggcatcactgactcgatggacgtgagtttgagtgaactccgggagttggtgatggacagggaggcctggtgtgctgcgattcatggggtcgcaaagagtcagacacggctgagcgactgaactgaactgaatattttctaaacagctcatcaaaagataattcagatactcctaacatggttaatttatatttggtttttattagagtctagaaaagttctagtgactagtttctggctctgtttctcctttaccaccatacacttcaggtgctgggcaccactggacacacttaggtgaagatttcaggtcttgtgatttaggattatacgtggtgggaatattcctagacgtcctaccaagacagctagtgataacttaaccatacacagacatgactacaaaccacacttatatgtcatgaaatccaaatgcaatctaaatgtctcctcatctcaacttcctttaagccagattcagaattttggcttgagggcccctcacttgcagatgtaccttttagggtcctaaaagaaatg

SEQ ID NO: 32020 - DNA, 1933 bp, Bovine  19866880975965
tttattcttgggccttagggttaatccctgataaggatagaagtgcctagaagtgatggcctcccctctttctggtcatccatagccaatggggtgagtgtataaaagcccacctcttttacctctaggaggtgtaaaccctagatgagaaaaacatcagttctgctctactgtgccctgtggggtcaggctgaacatggggtgccacctgaaatcacacctaacttggcttcttctattgccttcttctgcttcgtgaccccattggtttctgttggaagaatgttaataattcacctgtaccaaaatccttgggacttcctaggttgctcagtggtaaagaatccgcctgccaatgtaggaaacgcaggttggatccctgagtcaggaagatcccctggaaaagtaaatggcaaccctctccagtgttcctgcctgtgagatcccatggaaagaggagcctggcgggctacattccatggggtcacaaaagagtcagacatgataccagctaaacaacgacaacaacccaaatccttggctaagatactgcttctggaaaaatccagcctacaatattatctaaatgcattcacatgcaatttttaaaaaggtcatttttctgtcaaacaaaatatattagaataccagagctagccagtaaaccaccagtttgcaatctatggttttatcttttattcccattctagtgaaaaaagcagggacttgaagagattgcaaaagattttgacaaaaatgctgaaaaagtgcagagacctatgtgtacaatgcctgcagctattatatgctctgttttcctaatgtacttgcttctttctgctctatatatcaacactggctataatgattaaagaacaggaacaaagtggctaattcttgggctggtttataatgcacagtggaactcacttattctttccatattttaaagacgctctggtgttctctgcactaataacgcctaacatttgtttagtgtcacatagtcttcaaagtgcttaccaatgcatgatcttatacgactcctactgtccttatttcacaggtgaggaaactgaagttctcaaagttccaaatcagacaaatataaccctaaaatgtggatgtttttctagcatatagagagttggttaaagatcttttatcttagacaactggtgattccaaatgagatagtaacaggagaaaagtgtgtaaaaattgagataaacagagaaagttagaagcatatatgcagagaaaataagacttttaaaagggaaaccaaactagtggaagtcatgaagagttgttgggaaaataagcaaaatgaagacagaaaatgatgtggttcaaaagaaagactgaaaagtggagagaggaaaatttggtggagagagataaagactcaacaaggagaagggtcagaagtaaggctggtgggtcttttttttctttaaaatttatttacctatttatttggctgcgctaggtctgagttgcggcacttgggatcttcagtcttcactgtggcgtgtgtggtctttatttgtggcaggcaaactcttagttgcagcatgtgggatctagttccctgatcagggatggaacctgggccccctgcgttgagcacagaatctgagccactggaccacaagggaaatatctggtgggtcagttttgagaatgacaaaaggcaataatcaaaacagactcattatgttacccaaaaactgggtttgcgtattgttgggtactgagccaaaagatacaaccaagacaaagaacagaagaaagaaggattaattacttttggcaaataaggagactacacttaaaatatttcccaaagcagtgtctatgtgaacagtgaaattgggggaagttttaagctaagggtacatgcgtattcatgaaggagccttgggtcctg

SEQ ID NO: 32021 - DNA, 788 bp, Bovine  19866881049928
tgccgtctatggggtcgcacagagtcggacacaactgaagtgcattgaagttgaagatgtttgatgctctgtgtcccagaaattctgtttcgacacaaatccctagagaaagcttcatttacttaagactaaatctatcgaggatgtttacacatacacacatgtatataaatatgtatatatgtgtacctatatgtaatcaatagctatagacacctacacagggaaatttagagtgaaaaggggttaagaccttttaactttccaaattcggtgcctctctctgcaatgtgctgccccctcccaggcagagagcctttgcctctggcagctggctgcctgcttctgacttatggccctcccgagtctccagccctgtttctctgtggaaggacctatgtttttaccaagatgcttgatctgtctgcatatcttcaaacactatttgtggccttgatttgttgagtcgtctacaaaaagctcacgaagtagagtctcggttgccatgatttcttacacaatacagaacgctgttctcctaccaaataataaccaaacttcttttgttcttcttccccagctggcagacagggtgagtaattttatttatagcatattataatcaagctccaaaatgtcgcacatctggaaagatgagttagaacattgtgttgcctgccaaattataaaaagtttatctaagccctcttggtagtacagccgtagccctgcctccaataaatcactcacgtttaagctgagtctcacaactctttgtcaaccaagtg

SEQ ID NO: 32022 - DNA, 659 bp, Bovine  19866881073037
tgagcattggttcctaaagccaaaagcctggtgccagagcttgaaaaactcattaacaccatagttggtcaatctgtcatctgagagaaggaactgattacgaagtcccaagacatgagtaaacttgtccaccaacgcttggaactctgaaaactttaagagtgttagaagaaaatcgtccaaccctctcattccttagtcaagcagaaacgtacatggttcacttctgctggcacttaagacatagaaatattagatagcatggggcaagggaggcaggaacatactccaggaaagcttaggaagaaaaaataaagtaatacgagagaaaggataagacactgcattcagtgctatttcatatgggcaggagggaaaaagtagatgccaaaatgttgtgagagcttgcttgccctcccaagcacattcagagtggagaggctgcaaattaagtgctgtctgagagtctgcaaatgtaagagccaggactcagttttgagattcaaagttcgccaacactcgtttcccagccctccccatttgtgtggtaccttcttttctaagttcatcagattttcgttcaagtttttcaacatcatcatccaatccatctgaaaataagagggccacctaggagagtattcaaaaaagaaaaatga

SEQ ID NO: 32023 - DNA, 1368 bp, Bovine  19866881095544
aggcatatataagccaaccctgtctaggattgtgttagctgtgctgccaatttaatcaccactgcacacttgagtggttgctattagccccattttgtagatggggctgctgaggcccactgaggttaagcatgtgaactggtttgcatagtttgtgtctaacagggccaggacttaatgctgacttaagaccaccttaatgcaaccttaatacaaactaagaaaactgtaagggagtagaggtagatttgaaaaagagagtactattacttgtaccaggatgggatagataacacatagtgttccagagtaagaaagttgcttgtttgttctttgtttagtaggttgccaaatatgccaactgtcacaaaggggtcaattaaatgcaaaacatatgtgcatgagaatatccaattatctcatttctgatccattacattcctcgggatgtttcctattcagactttaatgcggcctgggctacatgccgctggcctgcatgcatttccctctgcagagcaccaaggacacaactgaatctccattatagacaataagtgcatttcggaaggagtaagaaaacccattatttatagagaaaacagtttcacaaaagctggaatttcaaagcacagtgagactttctcacattaagccatgaatcaaagttcgagtgcataagactaagtaactcaatactagaagggataaaaaaattacattgcagtgttgaaataagaccatattttattgcaaagaggcagcaccttaaacttccctgagtattttatatctttagctttttttttcttcttcagatggtgatgagtgaacctgagattaaagtgccattatttcagagcactgaagcacaaccatgtaatgactccagaaatccctggcagtttcagtcagcaatctcttttttattaacaatctcgacattgttggggctagaatctttcccgactttagattgttggtttacttgacacttgagaatgtttttgaggacaaaacaagtttggagccagatccatgtaaagccagtcatgaagcacttctatgaaaaatttccacagaaaaaatcagaaacaagtgtttctttgaagaaaaggtaaaaataaggtgaagttgatgccatagtaagtctacattactcacaaatcatggatgaattgattccagtagttgtttgtttagctttcttctaggtaaaaagagcttatttttttaaagcatggttttttctttcgtagtatgttgacttataatgtcaatttctgctgcacagcagaatgattcagttatacatatacattcattcttttttaaaatagccttttccattatgttttttcacagcat

SEQ ID NO: 32024 - DNA, 786 bp, Bovine  19866881165011
ctggaaggcttaaagaaagatgctgtcttaaatatgatgccaaatccaaagcaactgattagtttgtctgtttctctttttaaggagagtgagtggagttatgtatgaagaaaaaaggagaaatcctatagaatctaaaaaaatgatagaacgaactatttacaaaacagaaatagtctcatagtggtaggggaaaaacttaatgattgtcaaaggagatagtgtggtggggagagtttgggattaacaaatccacacaactatacataaaacaggtaaacaataagcacctcctgtatatcacagggaactatattcaatatcttgcaataacctgtagtgggaaagaatctgaaaagaatagatagggagatgtatgtataacggaatcacttggatgcatacctgaaactaatataacatgctttcttatagttgtaagtcagctatatttcaataacttttaaaaaaaaggtagaaattttagagacaggaactcctcacaggaatcaaaggacccacagaaaacacttttgctgcaagtgtcagctctgccagagaatcagagcttcttattcagcctcagcatggaatattctttgagttagaataactgtcacactgacagctttattttggccaattacttcgacagtcattgacaatcacaccaaataagcagtgtattcagaagaaaattatagaggaccctgggttgctacagtgacagaccagcctgccagacttaatatttcccctttcagcttcttattaaaatagccttaa

SEQ ID NO: 32025 - DNA, 811 bp, Bovine  19866881360233
tggcttcctttctggctcccttgggtatccctttcctcaaatgtgaatctgcaaaatgttttagtcattgctaagaggcaattctatgtagcagatacagaaaagtagaaacaacaacaacaaaaaacaaaaaaaggggagggggccggggcggggggtggagacccaaaacataagcgacacatttatcttaccaaagccccctgtcaggcagtctgctgattttgcttgccacaaagctcatccttcatttgtgcactgccagcgcaagcttggatcgcgcaaacaatcacaacctcttttggctataagctctttccatttgtcccagcttccaaactgcagacgagctgtggcagagtctgtcacggctgcacatacttggtttccgagaataacgcggtaaatgaggacagctaccactgggaatgccttcccccaccaacagccagccgaaatgaagcttctagttgatccctgggcttctcaccttcacagcctcagagaagtgcctttcacagaacaggcaggtacagccacaccacatcaacatccccgcatagccaccaccctgcagtacggcctgcgtactgttctgcttctgtctcccgtgtcagctcttggagctttctacattggggagccagggaggaaggactctgtgctgaacaaacagaaagcttctgccaaacaagcatccgtgtgtgtgagagagagagtgtgtgtgtgtacgcgcacgcgcgtgcctgggtgtgggcacagtttgctagagctgaatgcaaatgaacagtttgagaccggagatcacaga

SEQ ID NO: 32026 - DNA, 1542 bp, Bovine  19866881418772
cctaaacccagtgtactgttcactggatgtgagctaaactggcttcctctggggcatcttactttttaatattttgccatttttaaaagaaatcaaaatgcttatttccctaccttactaaagaatattttaaatataccataacctttcaatggctcagagtcatcatcagatgcatgttactgtagtaaatgctgtaaaaaacatcccctcaaaacagcagtgtggatacacggctgacatgacctcccagaattcctcacgtctgatctgatgccgtaaaaaacatcccctcaaacagcagtgttgatatacggctgacatgacctcccagaattcctcacgtctgatctgctacactaacaggtgattcaacagccccactgccagaactgccctcaggtcaagggaggtctacaaagctagctgcttctatacgaaatgctcctatactactgtattatactcaagctgattctcctgtctcctcattttacatatttattctctttattacttatcagcaagctctatcttggacaacctctctaatgcccaagtacctccttatttccttccaaatctgtccaaagcagagttaggaatctaatggaaagatgtgtgtgtatttgtgtgtttgtaacataaagtcaaatgagctctgtgtctaagaagggggaaaaattatacatttctgcctaacaaactaaaaatgataggaggcgtatattagtctacggggctttattgctcgtcccaaattcagaatgttccagagaactaatactgaagggagaatatagttctatttaaaacattatggtaaatatttgcagcatagttaccagttctctgatactgcgatcttcaattttactcagcacctgctcagggaaaaactgcccatttctataggccaaaagttgagagagatcaaacaaaggcacgccttctgtaaaaagctcagcgatcacacaacctggaaaacagcaggaaataattccattaaaactgaaaagcaagagatccgtaatacagatcaagaattcagagaattcatgaaactcaagatacgtaacttctttaatttaacacacaactacaatccagcaaggcagaaaaaacatctactggtgaatcatcagtttccaaaagtatgaaatcaaaaaaggcctacttaatttttcttcttaaaaaaattaaatcaaataaaattacttccttgttctgtagtttaaaacaaatgtactacacatgcattatacatcagatcagatcagtcactcagtcgtgtccaactctttgcaactccatgaatcacagcacgccaggcctccctgtccatcaccaactcccggagttcactcagactcacgtccattgagtcagtgacgccatccagccatctcatcctctgtcatccccttctcctcctgcccccaatccctcccagcaccagagtcttttccaataagtcaactcttcgcatgaggggccaaagtactggagtttcagttttagcatcattccttccaaagaaat

SEQ ID NO: 32027 - DNA, 2758 bp, Bovine  19866881453891
acagctagcatcacaagcaggacgaagagcaatacagttcactttttggctaggatacaatctacagaatacttagagctaaaacactgcctttactgaaaccttgaacaagcacgtggtaggttgggttccctcaaggcagaatctagacaagaatttgtgtaataagtttattgaggagaggatccctccaatcactagtagaggggcagggaggtgagacagggagccaggttgaactgtgaatgagcaagtgggttagtgttctgggcagctggagctcatccccttgggcacctcaggaagaacataaagatcagacctcaagagtggcctcccccaaggtgtgagaagccagaggatacttattcaccagctttcatcagttactgggtaaggggttgctcccagagtattaacttccaggcccctctagcctgctctgcatgaatcaaccatgctcccaaggccagagaaaaccctcaaggcctccaggggggcttgacataagaagcctgcagtgaaacgccgaatgcagaaggggcatgcacaaggctctgatatcctctgccagccagcggagaagagaaaagcctgggcatcagggaaatctattacaacacaaaacgccatctgcccagagacatgcatacataaatgggattgatcatagtgttatccacacctactgacttatggtgaggtggggtactgaaagatagcacatgggccatttgatacactatggtattttttttttccccaccaaacaaacatcgccaaatatgactctgactcgcccagaatcttcaaagttctattgtatttggactcatgcaatggagaatttcagtcataatattttgccagacactcatcaagttgtttttaaaggactcaataagtgattagcttatgggttttcaagccaacacaaatgcctttgccaactaactctggcaaaatctttcccctctaaagtttaggatacagtacttaaagcactgcaaaaacatgtttgagtcaaatcaacacctcatccttaactataaatggctaaaataatggttaaatgtatatttattatctctttgtgacttaaggggaatgctaaggcttgagacagagttggtttggatgctttatttttcttgcctcctctccatctttgtagcatttgggggaaaactttcttttcatggcaaaattaaatcagccaatttcctgaggtttgctgtttggaatcataaaaagtgttagtttttaaggttatctcagtcaatcaagatgactcataaaggtaagatttagaatcttcttcccgattcttttgtctggattttctaagtgcaactgctccagatttacatgaaaagggtacttcagccagactctttcactaaaattgcaaagtgacttaaaattagtcattgatttatcaaatatttcttgagtaccgactaagtgccaggtaccgtgggaaacataagggttacaagagccacaggagacatttccttctgtgcattgcttatgttagccaaacagtatccattttttctcatggtatcttcatccaaatttccctgtcagcaccctggggtcaccccaagaaaagacaagtttggaaggaggacgaggaatctggataaggagcaagaccaaatctttctaactattatttcttcattgaaaaaagtttggccttgactgttctgtaaagcatcctgtacactttctaagttttcctttcccttgaagaactgaaggttgctttataggccttcaatttaaaattctgaaaatgtaaacttaatacctttctgctgaaagtagaaagatatttttgttaccacaaaaccattatccaaagacactaaaacagtgggtgcatttttcaaagtcttcgacctgcaggcaccactggacttttctagaaaatttcctctaacttgtaaagcagaagaggcaaagagacacggaaggaatcagaacagccacaactcccaaacagctctttcgggatggcagcatgcctgagtgactggtctttccttaaatgatctccaccaacgggaacacttccaggtggaaaagggagattacaacgttgggtgagctatgcatgtctatgaatcatgttacaatcatcttacactccatggcaacaaggtatttcagtgagctcaaaatatggactaaaattgggctcaatgataaatgaattattgggaacactcctaggggccttgacccttaagaattccccactaccatcaccatcaccctcatttattgatcatgtgtacctggcattttataagaatctttttttttttctttcctcacacatccctgtgaggtacataggtatcatgctccctgtgacgggtgagaaaagactcagagagattaagtggctgtccaagctcttctatggacttccctggtggctcagctggtaaagaatccacctgcaatgtgggagacctgggttcactccctggttgggaagatcccctggagaagggaaaggctactcactccagtattttggcctggaaaattccatggactgtatagtccatggggttgcaagagttagacacacgactgaacgactttcacttcacttcaagctcttctataatttgaatctggattcttttcataacaaagcttatccacttcctactttaaccagcaaagacaagaaacaacaaaaagatcaggacaagagaaaaaaaggtttgtccaa

SEQ ID NO: 32028 - DNA, 1025 bp, Bovine  19866881456360
tatttgcatatgcaatgatgtcatgggggtctttcatactatgattttggaatgaaacaatgaaccacatggaacccaggcttcagggagacaagacaatgggataaattgtaataatgcctcagcagaggtgtaaaattaagaaaggaagaactctggattttggctgaaagtaaagatgggcttcgaagaggaaacggcttcgatcagggacttgagggatggtatggcttccctgggaggaacaagttctcagggaatgtgaccagaggtccagaagggtggaacagcagttcacccaaggcagacaagagtccagtgtagccagaactctgtgctcatgatgcggagagatgggaagtgaggttgagataggttgaggctgaattctgggttctattttggggtaaaatttcaatatggaaatttctgaggaaatcatgaattttaaagcaaaattgcaataagctaatgaggatgtcataaaatctgtcaatccagaaagcatgcttgatgtgtaacttctgctgcagattgtgggacatgtgaagagccttccatcagagacctcatcagcttcctccacctaatacccgccatcagccagttacacactgctcagtcaatcaatggtcactgataaatatcagagctttccaactcacgggagaccgatgccttgattttcctcgtcttctgaatcaatgagttggcagatgttctcaagcactggtggtgggtactgattgaatcctcctattgagagaggaaaatgatagttaaattttaaactataaattgtatgtgctaaggggaaaagaactgcagtaggaatcttcgtgaagcaataaatatcactaaaatacttcagcacaatttggctggggtgagaacagaaaatagtagcaactggaaatagcattcagaatttgattatagaatacttttcagccagagaattaccagggacctcctcaaattgttcattttaagagttcattgtaaccagagacatttatttccat

SEQ ID NO: 32029 - DNA, 1699 bp, Bovine  19866880396434
gggaacctggtgggctgtctctatggggtcgcacagtattggacacgactgaagtgacttagcagtagcagagaggggagagaacgaataaagcaagaagtgcagtttataaattctgtttccccaacatggtcataatttgaaatctactctgcatatttatttcagatgtaatactctgtacatgcacaattgatttaagacattctccatgatgagcacaagcattttaaccacatttggttctcaataggaattcaagtggaaaagttttttttcttttcaattccagtatgcccttattttggatgttgttgcctttgccagtcagggggaatgcctttgttttcattttaaaaaggaaagatggtggagttagccatcatttagaggagaattaatttgcttttccaccaagtagagtctgtctggttattctgaagcataggaatattctgaatcttctgaatctgaacagattttgttgaaatataatattaatatgcactattgagaggattttgatgatttataaaactcttgtgaatcatgtttgagagagagatagggaagagtctccatagatcaagtaatgacatgtatgccatttgtatatttttcatttgactatgtttttgggtgttgtgttataactgtttgatagataaagggaattgcagtctttaattttagagggagataataattgcagtgtgacattggagggtggtttgtgagtctgagttggggaatttgtgagagtcccaaggttggtcctgagtgccctggttatagaggtgctcaggtgcccaacattgcagtcctctgagttcagggatgacaagtaggagaaagagatggctgtaccttgtgtccctttgcagtctgcgttattaaagcttgtgtccaccggtgatggggcaaagtggggtgggcagaggagaggcctaattgtacattgtacatccctacactccctgctcatcccctgctcatcccctgccccgcctcccacatcaatgtctagagaaatctgaacatatttctactgacttcaccacgacttttaatgagatggcattagactgttcaatggctagggtcttgcggttctttcagagcaggggatagcaaaatcctggctttccttgtatttatgtacatacttatcaatgaaggcttattccaaatgagctatcactatggatgtgcctgtctttatgcatgtttatgcttgagtgtgtgtacatatatatgaacaagttacgtaacaagtcagcttaaaggattagttttgccttctgatccgactgatgcatatatgttagaactttgaacttgttcacccaataaagctggggtaatgtaagaatcttctatgtttttatgccccatttcagcattctgaggaactctcaggcagttcattgcttaaaaggtagttaaataaagatgttaaaggattaattaaatattaaccacatgttatgccaaagttagtgccgatacctaccaacaaaagagattaatctctgagcctttccctaaactgcaggctaaagcccagtcacatctcaacgtgcttgtttgcagggaggctgttttatctctctccaaggtggtattgatagacttatggaatacgttttcttgttctccagaagcttgtcagccctccactgacatgtttttgcaaata

SEQ ID NO: 32030 - DNA, 1297 bp, Bovine  19866880434823
cctaactctcagtcctatgaggaattaccataaggttttttatacagtgtacattttaaaagacattaatggacagtggctctttgccagatgttttaccagaaatgtaaagacatttctcataacatttcttcatagcagctaaattctaggggttttaaaaatactagataagtagcagttaactgcttcaataagtcaattttcagttgtgccgtgccagaagaaagaggagaacatttatggaagtggtctcagagaactgaacttagtttttcgccaccccaggaaaatggtgaatgttacaggtagccttcctattgacaggtgggggtaaattcactggtggcagtgctggttgtggtggtttagtcgctaagtcgtgtctgactcttgcaaccccatggactgtagctcaccaggctcctctgtctatcaaattttccaggcatgaatactggagtaggttgccaattccttctccaggggatcttccggacccaggaatcaaacctgagtctcttgtatctcctgtattggcaagtgggttctttaccagctggatcattggggaagcccaaaagatttataatactgtgtctatatatctctcccacctcattttttttgatgcctttgtcttttgcacagaagattgacattttttgtcagttggaaccagcattacaaatcttttccacaggttttcaaatgatatctcaattgctacagatatgaatccttctggagatatgattacatatacacacaaacaaaaaaatttggaaaactcagcagtggccacaggactggaaaagatcagttttcattccaatcccaaagaaaggcaaggccaaagaatgttcaaactactgcacaattgcattcatttcacatgctagcaaggtaatgctcaaaattctccaagccaggctcaacagtccatgacccagatgtacaagctggatttagaaaaggcagaagaaccagagatcaagttgccaacagccactggatcacagaaaaagcaagagaattccagaaaaacatctacttctgcttcattgacaatgctaaagcctttgactgtatggatcacaacaaactatggaaaattcttaaagagatgggaatgccagaataccctacctgtctcctgagaaatctgtatgcaggtcaagaagtaacaagctagaactggacaaggaacaatggactggttcaaaatcaggaaaggagtatgtcaaggctgtatactgtcaccctgcttatttaacttatatgcagagtacagcat

SEQ ID NO: 32031 - DNA, 2535 bp, Bovine  19866880541300
cccaccaggctcctctgcccatgggactctccaggcaagagtactggagtggggtgccattgccttctccaagcatcaggctagcttgtgtctaataagaaacctggtttagtggaagttctcaagaaatatcggctctataaatgaatgcatgaattgttcctcagttggaaatagcttcaagacagattcttttgctcaactcctttggtcaaaaatgattcttaaaaaaaaattaaaaataatggcaactatggatttggtacaaagaactgattttaaaaaaaaacttgtcttattcgctttctctgatatgacacagaaggtagctgctgtgatttctagacttttcactcttccccaaatatctcaaataaacaatttcacctgactccgtgtgtgtgtgtgtgtgtgtgtgtgtgtgtgtgtgtgtgtgtaacataccgttcttatttactctggggctcacctaaataaaacctcctgtggaggagaaacagatgtgcagaaattaggccagaaagaggggccatctctgtacttacttcatttccccctgtgattctcttcgaattcactccttcaagcaggaagcacatgggctttcatctctgactgtgaaaattgtttatgtggcgcattcctctctcccaaatccccatttattcattgtttgtgcctaaatccaacactctgtgatagttttcctgctgagtgagagtttctcatcagcctctggatgggtgtgtgtgcatccacatggctgcagccacagcttgtataaatgcccactctggggggtaatcaacacatttctgcctgttgtcctacacaggaggttactctggagaggctgagagcaccttcaagatacttgagtcagtacattaatgagtcatccgtggaaaaacattacttactgtccaagaggagcagcagttaaatagctaacattaggtgagcatttaccatgggccaacgagctgcatggtttgcacgcattatccaattctctgcaaatctgcatagggactaccaccgtaatccacacttgacaggtgacagaccagaggctgagacaggatcagcaacttgtgatcagccaccaacagaaggcagagctggagtccaaacccaggcctgcccctgctggagcctaggggttttcttttttcctttttctaaaatggaagtataactgatttactctactgtgttagtttccagtgaattagcaaagcaattcagatacacgtgtctgtgtgtgtgcgcacagtcaggcttgtctgactctctgcggctccatggattgtagcccgccaggatcctttgtccatgggattttccaggcaagaatactggagcaggttgccatttcctactccaggggatcttcccaacccaggggtcgaacctgtgtctgttgtgtctcctgcattggcaggcagattctttaccactagtgccacctgggaagccctatatattaatatatgtatatatgctctcttttttttccaattcttttccattatggttactatattgtggagcctaggatactaactgttaccctgtgcttcctccttccaaaagcaaatgaaaccacccttactcccaaacattttgggtttcctctttttgctagaattttattttccaacaatttgatcagggagagctgccctggttggggcgtgagctgacggggagcccctccacctcctctcaccccatccttgcctggggtggcctttccacagcgcagaatgcagtttggccatcactgtgctgtgagagtagaaacagcagctggtgtctcgctacaccccccttgcagcgcctgcaatgctgtgcacagccggttctcaatcactgtctcccacaggaatgtggttctgagagggggcattaccgcctgcggccactgacaacttgagcttccatgagctgccaacagggcacccaaggacagcagcgcctctggcctttgagctctagagggagaatggtctccatccggaaggcataggtgtctgcacaactgtgcccagagaggagactccagaggagactgccctgggatgtcctggcaggagctgagaggtgggggagtagcctgctaaactcaaatggatcttcctaaagggatctttcttttaggctttgtttttttccaatcgtgttttccatgcttgacattaccaggtgacagctcctcctccgtggagaaatttgttatcccactgggataattccaaagttattctaagagttcctgctcagaacaaatcaagccaatcaggaagctcctccacttgggctgtgcctggctgattgtttcctacttggacacttcctgccattgttcgatggcctgttctcagaggcacaaccatggggccctgccccttcctctccggagcccagggccacactggtggctttgggttgaggtatatatgaggctcagagatcaggtacttggctgggaggaagatgcctacaaagaaaagaggggcagtttcggcccag

SEQ ID NO: 32032 - DNA, 3318 bp, Bovine  19866880580903
tggcatatgactggtgatggaaatatgtctataagatatggcagcaagcaagcatgggaacggtgtcagggaagacttccagaaagaggaaatacctaagcagattaataagtagtgataacccagggaacaaactgacagaacttagtggcttgtatacgtgtgtggtgtttaccaaagaggggcaagtcagaggtcatggtaacatccagagactcagacacagaggacagacttgtgttgccaaggggcaggcaaggtagaggagggatggattgggagcttggggttagcagatgcacactactgtatttgagatggataagcaacacggtcctattcactagcacaatgacacaaggaactatattcagtattctgtgatgaaccataatgtaaggaatttgaaaaagaatatgtgtatgtataactgagtcattctgctatacagcagagatgagcgcaacgctgtaaatcaactacacgtcaataaacagtttttgaaaaattaaaaacgcaagataacatccaggtttccatcttaagtaggatggattcatggtggtaccagcagcggaactaaaaaaggccagatggaggaacagctctgtgaagaggataagtttggcctcacatatgttggatttgagatgcttatgggccacccaggtggagacactgaaaatgcaattgttatgtagaggctggagttaggagagaggctgaaggtattggttgggtagttataagtcagtgtttaggtgggaattaaaactcgagggtggacgtgattagccaaggataaagtatccagccaagtgaacatttagtgaagaagtagaagaggcgcctgtgttgaggatatggcatctcagcttctgaaggggaggaggggtggtcctcagagttttataaaaggaagatgtcggtaggttcacactgaagggtgtccattagatgtggcagttaggatgtcatggactttaacaagaccagattcaacagcatggcaggtgcccaggtggagtggagtgggttgaggggtgactggggtgtgagaatttgagacagcaagaggcaggcaagtgctactggggaaatctggaagagagattcagcagtaataggaacaggactcagggtcaagataagttcacctatttttggtgtgagagaatttattctaaagggactaacgggaaggaggcatcctggagataagttgaagctatagcggagaaggggtctttgataaagtgtcatcccataggcatttgcacaaggtcaggtccacagatggagtcattgaccttcacagggagagtcggaggtgaaaggctggatgagatatttttttctcttcctacagagaaagatatttcttgggaagataggatttaagttactgagaaatgtattgctttggaaggagatcatctcattttcatgtaatcaaaattctgtatttctgatgaaacagactcacacgagaatcacacccaagacatcaaggctcagcgcctgcttggaaatgattttctgcagcggaaatcaacttgcatagattctgacagtatgagccatgtgatttcagatgagctaaatatacaagaaaagaataggctggtttccagagactaagaaaaactgacagagaaattttcattcatatttacttgattaaatttgattgtaccaacatcaataatgaaaagtgctaatatgtcccagcagttcactcagataaatatagaaagcaatccagtattgatttttttcaatgaatatacaaattttaatacgtttgagggagtggtgaaagtagcaaaaccaagctgagagtttacaaaatatatatatatgtatatatattttgcattgctctgtcttattttgttttttattttattttttaactttacaatattgtatttggttttgccatacatcaaaatgaatccgccacaggtatacatgttgaatagcaccatctccaagttagtttcagtatagaatcctttaaaaatgtgttcttgctttgctttgcttttcattcactcaacaaacatttattgggcctctatgtatacagaaaagaatatatggtccagtaataaattcataaaatattgtcctatttctcagtaagcttgtactcaggagaggatagtacaggttggggaggatggacacatttttagtgccccagtaccaggtgaggtataccaggtatctaagagggagttggtgattgacagggaggcctggcgtgctgtgattcatgggatcgcaaagagtcggatgtgactgagtgactgaatgaactgaagagggctaaggatgctcttagctctctaaggatgccatgatggggattgggaaggagtgaacacattaggatgagtgggttgaagaaaaacattactaaggcaacagtttgggctttgattatcagatatgtttccagtagatagaattgatagagggaagtccaggctttttcacagagcagcatgctctctgttctgtctaggacacgggaatgtgtaaggctgggaaggggtaagagcagagcatggagggtgtgaccttccagcctaagaaggtcaatcagattcgggaaggagatgatgggcaaccatcaacttttcaacaagggaaaggatatgagctacacttcaggaattcttaaaggcaccattctcttcttggccatatttctgtctccatgatgacgaagggggaaaaaatgaaacgagcttgagtttccactgacaccttgcagtcaaggaaggtcctgttctttcacaaggagaagtggaaatcctctgtttatttaaaggccattaacctttttcacagtaaaataccaaatgatctgtggtgattccagatatactcatctaaataaaaggaaactgtctccttgcaaactgagtcacaaatgaaaaatatttggggagtgccatagaaacaagtgcactgttttcctgaaatatggaaaaagaattttgtagcatctagttgtgtgaaaggagacagtattctgcccagtgtcctacctggaatatggaaacagaaagctcttaagatagatagataggtggaaggatggatggacagacagacagatggatggatgatagatagatgaatagatggatggatggatggttagatagatagagctaaatattcttagaatggaggggttacataatcaggtcccaggtagaactgaggatccaggcagcaaaaactgacagggcagtcttcagaatcctgctgtaggaagattagccacgcccctaccattat

SEQ ID NO: 32033 - DNA, 724 bp, Bovine  19866880586783
tgcacagggcaggggttcggctagcaagactgtcatggtggcaagaaggctggtgctggtataataatctggagaagacagccatggctccctgtgggccagcaacccacccagctgcctagtaagtagcttatatattatatcccaagggaactggaaccatgaaaaggaaaatatctcatacagagggtttcccagcttaacctctgcggaaacgcctttattctcatcttgaaagcacgcagcagctgcagatggtttcaggcaggcctgcagaagtcggccgtgttccctctggggaggccagtgggaataagagcagctgccaggggtttcacgtggagagccgctcacatccaaaagtgggcaagtgcgagtgtggctgcctccgttggccccgctctggcccgtaaccttgaaaagcactgagagattttcctaccctcgatttctctttcgaacagacccagaaagtggccatgagagatgattccctcgggccaatgttcaggatacagtgaggggggccatttccagacctacagccttggccctggggcacttagggactggggcaagcaggactgtgactcccaggggcaaccctatatcctgcctgcctggtttttgttttgttttacatacttatgtccttattttaattgtttggctgtggcgggtcacagtcgcatcacgtggcatctcttgttgggcctcaccagct

SEQ ID NO: 32034 - DNA, 1224 bp, Bovine  19866880631104
cagggtggatctaaatcagtggttctaaagggggagaaagggaatatgtgcccctcgtccagaggcaaggaggttgggaagacaactgagggagagggactgctgctgggatctactgggcagagatgaaagacgctgctgaacatttcacaatgcagagaaaaagcgccacaacaaagaattattgaaccccaaatgttaacagtgccagaatgaaaaaaccctaatctaaataatcactgaaagttgagtttgggagctttttagatgagaaatcttcctaaccaggctttactttcaagcatgagctgcctaaacacttgcaagatggattgccagacagctcttttgtaagtaaagctgaactgccaactcttggagtttctaaacgtataaaactgcttttaaagaagatgctctccgattacaattcagctaaactgtttttccaaagatttcaggagaagttctcccaggcacaaggcagggtctgtcactctgccactgggccctgaagatgcccagtggcaaattctaatttcctggtgaaatgggagccacgagggtctctaaacgaattaaattcacatcacgccaactgctcgcttgctttgtgctgggcaccgtgccaaacacctccacatcatttatcccacttaatccacccaacaacccagtgaggtgggcattattaccggctgtttgcaggggaggaaactgacgatcagcgaggttagacaactcgcccaaggtcatcagctggcttaaggtgggggcctaacctgaaccgaggtctccagtttcccagtcacaagctctttccaccacctcggaaaacccaggtgtcaagtcgtctcaacttcccatgaattttttaaggcaaccgcaacttctcagtaagttcaggttgctgaaaatgggaatttccggggcactgggcgctctcacatacagtcccccactgcagctgtctcgccgcaggtacctgataaatcattccatatcacccgcggaacggggaggatttattggggctggacttcgtgccaggcccaggaaatgccatctttgaaagccgagaggcggattcgccctgggagccgagaaggtctggccgccgcgcttggctggctccccgcgcgggctgtgcgccccctcggcgtcgggggcggggggtcgcggcggcgctggggcctcccggatcaccagccgctccggctctac

SEQ ID NO: 32035 - DNA, 2272 bp, Bovine  19866880668372
ccctaaacagacacttcctcttaagaagctatacttaatatgagccaggcatccttctaagggtttgccttcagtttttcatttgaccctcagagcactttgaggtaggtacctttaatatccctgattttgtgaaagagaatagtcaaggcttggctagggtaagtaaacttactcaagatcatgagccaagaagtagccacgcaggggttgaaactgagacaatctgactcagggcactttatcctgaacacagatgtgtgttggtggctaagatttgtttacctccacacaggacacatgaaacacattctctcagcatcttcatgcttgtgtgccaaaaccttccagaataaatgagatgttgaaaatgcaaaacactctgctgtcaaatccttccactcctaagacaggaagcctcttacaaaatccgggggcatctcccaattccaaacaaataggtccaggctggactggaaccttcagtaacgcctggtgaaccaatatagtcttctactttaatccccgtgggagacatttctgggggactaaatgataaggcgagaaaatgcagaacatttcgctcccattttcattgcagagggactgcttgcaatgaggcggcaactgggaaagcgctcaattcaccacattgggatcatgaaaactctctaaatccgggcttctcgatatcagaatatatctccctaaaattagacgacaggaagagaaaagagcagagatgtccattaagttgacggcccaattctaggaaggtaccacgaggcctggaggaacatccctccgcaggaaggaggcggggttgctgtctggacctcgctataagcaactttcccattggctccttgcaggtctctgagcagcagcccacggagacagcagaggagctggggcaaaagtgagtatagctgtggcgatggcaaatgtaaaatgaagtaggatgcacaaaaacagacaacatgatgtttctgataacaacaaaggactgcgaactgaggtacacaccttttatgactttggccaattgtgtttttgttttctttagataccgacctcaggagaatgtctgtatctaccagataaatatagcatttaaaaatataaatcaaactaatgtgtttgtaggaaaatttagacaatacacaaagaaataaaatgaacagctgaatttcccttcactccatctccatcaatttctttcctttagactttctatgtatcctacttggggaaaaaataaggaatctatctattacccatatgctgcttttattctttacataaaagcaatcataccataggtgtcctattttcagcttactctttctatgccattttccccattgggtccccccaccacccttgtaactgccacaagggagttcacaaatgtcccttaacttcttttaccagtcttttgttgacagatttaggtggttcccaggtgttttatttgctgttataacctgggctgcaatgaatcttcttctacatatatgtactttttgacaatatccatagggtacatttccagtagcgcaactgctgtgtcaaaagatttgagcatttaaaactttaataggtccaaactaccctcttcaaaacactttctctgtgttttaaatgatataaatctgatttgaaaacaggactcaaacaactaataagagttttgatgatttttcccccctttatgagtcctatccttagtgacccaggggcattttaaatgaaagaaaatatctatcatcttattaataactgtaagctgttcttaaaacacacttgggtgatctgtccttatcatagactactactctatgttttcaggtttaaaaaatgattttttacctcataaacaagtctgttatgactccatcagttttctagaaggaaccaaatttgtacttcttttccttgcactgttaatattagagttatctcatagccaagttgtgcccacttatccataatggaagagggtctattccttctgctgttgttgctattctccatgatttaaaatacaaaattttccatataccaaaataatctctagatggactaaagcaatgtaaaaacggaaacatgagaaaatagaatgactatctgattttagggtagaaaaggcctttaaaaccaaagcacaggaagaaatcttggtggtccagtggttaagactttgccaatgtggggggcataggtttgatccctggtcaaggaaaactaagatcctgcatgccacgcaatg

SEQ ID NO: 32036 - DNA, 832 bp, Bovine  19866880799216
tttcttgggaaaaagaaaagtccatcttttatgaggagcacgatgctgttatatatctgtattttcatagcttcagcaaactccataatataatccccattttaatagaaaccaaaatacttattatttgaatatagaaaggctagaataaaaattacatcctgaaagtttccaggggtaatttccctggggaatccttggatcagcctcatcctaccaccccttaatttttatatgacttaaataggcctctgtgtcccctctccactccagtctaaaaggtctgaactgtacacaaaaaacttgctgtcagtgtgaaaataccatgtgtattttggggggaccacagactttctgcatcaaagatctgggcagccttaacttttataaaagaattttcagtgctctcttttactaagcagggaaacaaaatgtttcctgaaattaatgacttttttatattttgtgactattttctaagtttctacaggttcatcttttccccatattgcctcttactagtcacctggggctattttttgcaagtcattgcatttttatcaaaagaaaagtacatctcatgaactacaaaattccctctagacttcaggcagtccttctggagtaaaagaacagaaacacagaaagaaatgaatgacagggtggcttttgtgttcctatggttaatgtactgtatggtatatatgtttacagaatgtatctgccttgtgatgttaacaaaatgaatgacaaaaaaaatgagttctgatgtgccatttgaaagtttgccttagcatcgctgtttatgttcttttctgtcctttcaaaatca

SEQ ID NO: 32037 - DNA, 1794 bp, Bovine  19866880858359
tagaaaaggcctttaaaataaagcacaggaagaaatctggtggtccagtggttaagactttgccaatgtggggggcataggtttgatccctggtcaaggaactaagatcccacatgccatgcaatgctgaacaacaaatggcattagaaaacttgaatatctctatgcaaaaaacaaacaaacaaacaaaccagcaacaactgatcatatcttgcaccatatacaaagactgactcagaatggattacagacctaaaatataaaaacttgtaataaagaataaaaaagaaagaacaaaagtgatacacttcattacataaaacttaaagctttgctttttatggtaccaaccacagatagcaactcaaaggcaagtgccacctgcaacatatatatgtcaaaagactaagacctgtagtaaatacagggttcttataaatcaatatgatttataaagaaagacataaacaattcaatataggaaaaagaacaaaatataggggaaatcttgaacattattaataaacaaagaaatacaaattaaggattgaggtgtcactttccacctatgaaatgcattctctccaccccaccaaagtatattttaaagtatcatgtgttctgtgttggggagggtatgaaacaaaagaccctctctgtaatctgtcagaattataatgaatagttataaaagtataactctgttggaattataaattgtctttccagaaggctatttcaaaagttttgatccactttatcagaaagagtttactagagaaaatgctcttcaatatgtttgaagatttttgtaaagaacattcaatacagagcaatagcaaaaaaaaaaaaaaaaaaaaaaatcaaaacagcaaataattggttaaataagatgacatctaatgactccccttttcacttgaaataaaatcaaagcaagcccactcctggtccattgcctgcctttcttacgcccctcaccttgtccctctctcctcctcatttcccactctagccacattggccttaccgggaaatctgccatgaaagaggcatgcagggcaggcaggcagggtggggtccccctaagtctggctcagaatcaaggggaactttgctctccctttgccattatcccacatgtgcctatctccctggagaatcctccagagttctggctgcactatggggtaagatgcaagatctctggctattaataccacctaagtggtgccctgaccccattattaacatctgacttccagtctcatccagttcttaacacgcatgagcagctggatgccaccacactttaccttaattcttcccccagtgcaaaaccctagatgaccattaagatcacccaagaggaacattaaaaagtaccaagcccaggccccacctccagagactttgattttatcgttctgggcattggaggaagctgtaaacgctcccaggaagttttaacgtcagccgaggtggaaaatcattgctgggcaagtggtaatctcatggtccaggctgataagcagttcctatggcttaagctggtttgagctctttcttcatcagtttgaaataagctatttggttaaattttagaagacagcactgggtcggtcatttttctattttagcaattatgtccttgcttcctttgctcttcagagtctgggtttcaaccacaggttaatgggggttttgacacaggccttggagatcttgttctgatcacgtggctttcaagagtcgacactgctttattattgtaggatttatcatccttatcag

SEQ ID NO: 32038 - DNA, 2305 bp, Bovine  19866880862113
acgtacataccccagtaaataaagcctgctccccacaaggtagagcagaatgttgtccagtctgtattttttcctgggtcaggattctttatcctcaaaggattgcctgtcatcacccaccaacatatgctttggcctcattgttgtatttgtcttttattcacttaaaaggttaactggatggttgaattacaggattctagccaaagtatgcttcccataaaggagttcccagctcatcagtaagctgagctggtttggcatctgtcttacattagtaaggagctgggcatctgcagtctgagctcatactgcagaggcatcagcaagaccttgatcagccttcacaccatcattgctggatgacaggggagcagcggaggtcatggttcaaatctgagctggcaggttgtgaggacaaagcctgcagggatcactgtctgttggaaactctttcattttaattcaatgtcagaatattccaactccaggtcttccaaccccagacaaagtgaaagcaaatctaccttttctctttccaccttatcattgcctccagatttttttcttttggttaaaattttctcagataattagatcaggcttcccagatggcacagtggtaaagaatctgcctgccaattcaggagacagaggagatgcgggtttgatccctgggttgggaagatcccctggagtaggaaatggcaacccattttagtattcttgtctggaaaattacatggtcagaggtgccaggcaggctacagtccatgggggtcacaaatatcagacacgactcagcatgcatgcaatggaatgcaagatcttttccacttctggctagtatgtttgggtcccctttactaataagccaactccgtctccaaaatgtgctatttctattaatgatgctatctatcggtgtctctaatctctctggttctttaatatcccatccaggaaactttttttcttctctgccttttctccattgtctggtagagacctagctgaaagcctgaatggtattggagatgggaaggaaatagtctttatagtcaatacttcaagttgaccaaaagtgttggctgtcctgtcctttttattaatgaacttgaagcaacccttgactctttcctcttccatcatctgtcatatctagttagttatatatgaaatcagattctttaaaaactgtttgcacatgcatccttcatccagtaactttcaacaaatccctattacaaattagaatccaatacattagtcaactgtttgaaccagtgatgaatacttttaggaacttatcttgcaaatatagtcatagtcatgcaaaaacacctctttgcaaaaattatcatagcattatatataatagcaaaagacaggaaataactacacccattaattcaggactaataaattattattcattcatacagtagattactgtgcaggtatgaaacaggagattctttatttactgatggcaatgatctctaaactctactgtcaaatagaaaaagttaacatttgtgaaaatggggtatgtattcatgtatgtatgtagtcagtcagttcagtcattcagtcgtgtccgactctttgcaatccccatggactgcaagcacgccaggcctccctgtccatcaccaacttccgggagtttacttaaattcatgtcgattgagttggtgatgcaatccaaccatcttgtcctctgtcgtccccttctcctcccgccttcagtctttcgcagcatcagggtcttttccaaggagttagttgccccaggtcacaggactgggttcctcctccaggcctccctgcctgccccttctctgaggtcctggtttcctgtctttcttgcagtagccccggctctcaaattatctgccccttccccctctccctcctgattcactgcagactgagaaaccctgtctctaagtgtgttaccactgcaaggtaaatcaggagtctgcaggctctgaggaagggggactctgaggaattaagcacaaaagcctgagcccagagtctgatttccaatcaggctgctcccggctgcctttgcaggaccacctccattcactcagtcaccatctggctcagatctacctggggcctctccagagatgaaagaaaacacagagaccagtcccagagggaaggcagaggtacagacggctgagctgtgatactgctggagcttgggcagagctgggtctgacagcagcaaggctgcagagccctgggagggagccccagtccccagcgaagtccacaggggatgggattc

SEQ ID NO: 32039 - DNA, 1455 bp, Bovine  19866880872012
ttaacatagaagtaaaataattctgcaggtattgacataattgtcatgtacattggcaaaataaaagtattcctggggactctataaatatcttagcatattattgtacaaacagattcacagggttctagagttgggggcaggtactgtagatggtatctggtcaaactcaagctaggatcccagggtagttaaaaaccttgtagctacagtcatcctacgaagggaccattggcagtgatttaagctgcagattcttttaaatgctccaagatgcacttctgagatcaactcgggataacaattcttcaaaaggcacatacctccctgcgtgttattagagtgttggtggttcccagtagttgtgggtaaacagctttctagctcctctccacatttctgcgactcacaggacatgcaatatgacctaattaacggatcagttcgtgaaggcggtagggccagtgtgtggggactgagagatatgaacaggatttgagcagcatcggcagtcaaggaatgtgagcttcaagaatgatatgttactgggattgcagttctgtgtgcataggaatacacacactttcacaagctaggatccttcctcttggaagatactgtgaaaacataatgaatccaaatagcaaatgcctttttgaaaaagtattctgtattaaaagtcttctaaaaaataagtctacatgtacttttgtttatcagttaagaaccaatatgcataaatgtatctactgtggaaatatacagatgcagaggcttgaaaggaattgcatttgatgtggttaactgcttcgtccaggctgcttttgaaatagagcatccagattaatgatcagttatggctagcagtgattacacagagcatggacagcttacaaatgagtggcagtcgcccctggaattctttcttataggtatcatccatcttgctttaggggtgtccttttgaaaatttgcacagtcttagggccattttaaaaaatgtcactggtcgttactcagtattatgacaaatattctggttgtctggagtttgggaggttttgggttctgtataaatgggaatttatttacaatctttgctttgcagaatcaggaggcatctgttccaattccttattcaaacatggaagcccagggacagagccttgccacgaggccttcaaaccacagggacacaccatgacctgggtctccctacagatggcccattctgtctgtaattggctctgacacctgggaagttcatcctcagatggagctctcattagtctgctgctttcatcttttacctatttttacgtatccttaagatacaaaccgaagtttgtatcttaggagcccttcagaacaaacctaagttctgatttccgtttaaatattgaaaacggctatcacatcgtgtctttcccaggccttcactttccatccccttaa

SEQ ID NO: 32040 - DNA, 1588 bp, Bovine  19866880886887
ggccaggacttggtaccgtggttggtggagccacgaagacccagagtttatcagagattgctctggtggcagagtggaggcaagggtgcttgcctgcttgcccagtgtcccattgctgttggagctggtaaattgctgcaggcttctgaggtggcctctctgttttgtgcaggggtcacctttagctcttattatcgctcgtgtcattctctgtagacggaagcccaaaagaagcatctgaaccaacttcagctgaaagcctgattgttgatggaggccaatttagagttggaatgtggaggttatttctggacactgtgacatcctgttcaactttcagaggagcctgggaataaaggggtgactcagtctgtgagcttatttttaggaaaagctgagaattcagtctagagccactcacagtcctccgtccctgccagtgcagaggtgctgctggtggagaggatgctgagcagaaatgctgtatttatcatcaactgctacccggtgcctcctacacaccagcatgtggtttattgatttgaaaacaagatgggaatcaacgtaaataaacctttgagtcagaggagcctattttagggcatttacatttgagaactgatttggagctaaagaattagtattgtaagtgcttctgtttattgggcatttaatatgtattaatacaacatattttgctttgcgaacatttaatgggaactctgatactctgttgaaggtatagtgctgttatcactgttttagtaggcatggaaatgttaactcgaagttaaatattattctaggcaaaggtggctgagtttgaatttgaccccagatctggctccaaagcccatgcaaaggatcactccaggtctggcaaataactgcgtctctttggtcttgtgggttcgatctcagggtcaggaagatctcttggagaaaagaatggctacccactccagtattcttgcctgaacagaggagcatggtgggcttcaatccatgggattgcatgggaatccatggacttcaatccatgggacacgactgagtgactgactaacttggtcctgtgtatcactaattgatcatgggattattgccagttcagctcagatttggcctcagaatccttctcaacacagtgctctcagtagagctactgtgaccaacctagcagcttagtatttgagataaagcccatctgtcatcttaattttatctttgctttagttcaaaatggagactttaagtctggagaatctgttattgttgatttctacagctctatttatagccttttattttctaaacacttggaagcagtagagcattcactacagtttccttttacagtcagtggagactctgtattctttaataggggtttctgactgccttggagggaagaatgacatttgaggaccccaagccttgattagacaattggcttatgtgtgggtgtctgcagtggtgactgggagatggagaatgagccttaagaactttggccatttatagcagcaaaccttttaaatagcccagtctgatgggcggatgtggtaggcagcctaagacaccaaga

SEQ ID NO: 32041 - DNA, 3330 bp, Bovine  19866880895852
tcctagaaaattgctcattcttactccatagacataattattctttgagattccaaataaataatgactagactcactggatgcttactgttctaaagattaactttataaatattaatttggttcttgtaccaactgtatgaggtaggtacttctatcaacgtgccagttttatagattaggaaactgagatagaaaaacttaaaaaaacgaaacaagtaacttgcccaagggtattttgctgctaagtaatgaattcaaacccaagcacactggctctagaactgcgtgctggccactgggctgtattatttctcaaagcttcattataaaagtcaatcaaaatttttagaaatacatactaagtattccagaattatattgcctgaggtctgagattgcttcaaatattttcgtacagagtggtgggaggaagacaggtagatagcatagatgaaacaggagtggtaaaatcttgataatgttaatataattgataagtccattggcatcatgatagcatttcctaattttcataataaaaaatagaaaccatttccagaggatttcaagaccttcaaatatttgtacccttactgttaatatcaaaagactttttaccaatgatctgggtaattgagatcaaagcaatgagtttcattaagttactaatgtaacggtgccaatgtattaaaaattaaaaatttcctacataattgccagatgggctggtcatatactttttttttaaaaccagtaaaggttgatcttcttgccaaatatatttgatagaatagcaaaatgtttgagttagagtagacttctaagacagcgtctccccgtattctcatttcctcgctgctgctgctaagtcgcttcagtcgtgtccgactctatgcgaccccatagagggcagcccaccaggctcccctgtccctgggattctccaggcaagaacactggagtgggttgccgtttccttctccaatgcatgaaagtgaaaagtgaaagtgaagtcgctcagtcatgtctgactcttagtgaccccatggactgcagcctaccaggctcctccgtccgtgggattttccaggcaagctagggaagttgaaacttggagaacctaagtgatcaatccaagattaaagtgggaacataacatggttgtctgcagccaacctcatggctggttcatgagagagcagaaattaaaacccaagcttcctgaactctgaggggcttcccacctcccatcaaaggagctctgcctggtaaagtcttatagccacccacatagagatgcagaccccaggcttcacttgtgattctggctggctacatcaggcagtctggggagtaaggcaaagaaagatgacctgccttcatcctgggtctgcaggaggtgggtcacgtgggtcttgaacctcccctggtcgtttccaaacttttgtgctttaatagccccgtatattttgtgtgttttctctacattccttgtttacagtccctatgtctctcacaaggggcatagttgaaaacatcatgactgttgaacctgaagctacttctcagaggtgcatttggggctctggcaataaaacccactcctacctgggccagaagtcagggccaggcttttccagagagggtgggatgcatgcagtcgtggctgcagtgcctgacatcaccacaccactgcgactgaggacctgatctcatcctgagaattcctgtttggcatctcaaaagctggaacctcacctttcccaagtctgtcacacccctttcctacaacatggaacctgcggttgttggcattcattccttaagacctgggaactcaaacctaaatgctttcaggaccatggcaggtaaggtaaaaaagtgaagctggctgattgatgtaagaccaggaagaacaggcttagttctcactcaggggttttacaacccctgctgtccatacgaaaaactcgggctagtcatctgaccatcggtgacctctgatgagaaagagcctgggaaggaaaccaggagacctggataccatcgccagcctcctggtgactcagcagagccttccctttgcagagcctcagttttccttatctgtaagaaatgggcctttaagattcaaatagaatacatgtccccaaaacaaccagagccaatgtctgtctatgtgtctgtctgtctgtctgtctgacatatttgcgaaatgcttgacaggtctctttggtctaactgactttagaaccagtttccttgaggtctttgttggatgcatttgtgacattaatccttaagcacttggatccttgtaataaaatgacctgcacttaaccatcattctggtaccacgctctatgtcacaggttgcttttttgccagtgttctcttctttccgaaagctgtcatgagcagacaagcttattagaaagggtgttctcttcgtgttgtttgtttcagggaaaatagagaaagtcagacctcctccatcccccacacctgaaggtcccagcttgcagcctgacttagcccccgaagaggctgccggatcgcagcggcccaagaatctgatgcagaccctcatggaagactatgagacacacaaatctaaaaggcgcgagagaatggatgatagtagtgtaagtttctcctctttcctctttcctgcatccaagggtgaacgtcggcctggtgtatggtactgtggatcaggctctgatgtgtgtgcgggtctctggccagcatcatgggaccagaaccaattttcagatgtgtggttttaacatgcctggagttgggttggggtttgtcttgtttctcaaaaacattgatcatgcaaagagtgggtctttttactgccaagttttggtctgaatctactggcacagcttgtacatgagatatgggatgtgtagaaagataccacgcagggggaacacagaaagaaggacgtaagctccctgaaatcacccacagacaccagggagctgaccgcagtcattgctcgcctgctctgtatagatgttatttctctaggcaggagtccccaacctctgggatctaatgactgatgatgatctgagatggagttgatgtaataataataatagaaataaagtgcacaataaatgtaatgcacttggatcatcctgaaaccatccccccatcccgaccctggtccatggaaaaattgtcttctgtgaagctagttcctggtaccaaaaaggtcagggatcgctgcagagacctgtgatgaggctgacccttcagtgtcagctcagggcagtccttgtaagtggtacccagtgctcagaaggctca

SEQ ID NO: 32042 - DNA, 1263 bp, Bovine  19866880943845
ggaagctacacctttttttccaccaaatgagtactactgaagatacatggttggttagaaagactgcaagacacccccctatctttgcataagtaggatatatgatctaatgaacccagcagactgacctttgcaaatgactatgtctccattctctcttctttaacctttttattttgtactggagtatagccagttaacaatactttcatagtttcaggtgggcagcaaaggcactcagccatacatgtacatgcattgttccctattctgttttgtgaagcatcctggggtaaagggtgactattattccttaaggactctttgtatgcatataccaactctctgaaaaggcaataggtgttttttaagaaacggtgatttctaaaattgtcttagatttcttaagccaaattcaaagtctcagaagtaccctattggcaaaaacacggcagttagccaaaggccaactgtagaagaattcactcctggtagtgcagtcccaggcaacattctagactaagtcaacattatgcaacagccttattaaaaactggcagggaggaacctgccaacttctagaaatggttcatcacctcacaaagataattggcctaatataatgcttatgttgtggctaaagtccaacttctggccaatgtccacagcaggacatttatgaattggggttttatttgcactttgattgtgaaggtttgtcatttattaccttatgcaagattttattcacggattcctgctacaaattattagatggctgaaattcatgtctccattcctttgctcacgctgttgttctctttgactataatcccttttcctccattccctcctcccttctttgacctagacctcctactcaatctttgatacccatttccagaactctcctctggaaactgtctggtttctgtttcctcaaggcatttgcttcccactatagtgcatttattcatccaagagataattgttgaatgcctgctgtatgcaatcactgtgctaaactctaggaactcagcggtgagcaagacagagtccatgctcttttattaatttggaagaaaatcaaccgtaatataatttaagaccaaatcatagcattctcactcacaaactttcacaatacaagttcctctcttttaggaaacaaatggtcttctgggggaagaaatacatttcctggtagcctaattgcaaagaaaggataacaggtcctccaagaatgccaaactcagccaaggg

SEQ ID NO: 32043 - DNA, 1545 bp, Bovine  19866880972363
caactcccaaagtccagattcctaatcactacactctgctgggggacctttgcatcatcacacatggtttccagcagagatgagggttgtatacaaccaagaaagtgtccttgggagccaagggctttggaaggctacaatggaacctgtacttcttgaaagaatctgaatgggccagcctccccagtcatgatgctcactcacaatggatccaagcccagactcttccaggtccttgagaagggagaaggagtatgtctatctgtccatccacctataccatgaggtaaactttggtatgctctcactcaatatcataggtctcaaagactttcagcttaaaataaccacttctgttgaaaattttggaattgggcagagctgaaatcaaacactggctctttcacttcttaatggggtcattctgggcagcaagtcactttatctctcttctaagattcagttctcccaactgtataatgggtatcattatcatcacaactatttcatgagagtgttctggggatgaaatgagaatattaatgaattcatggaggccccaaagttaggtcagtacccaggacagaggacaagaccaatgcatattagacaatacagtccattatatcatcatatgttttacagtctatatggatatattttgaaaaggatgggaatcagaccagggctagatgtgctcagatgtggaatgccaatgtggcatgctccgtgccatgctgagaaagaacagtgcatcatggacttaaaaatagcaagcacaaagaacacactgaatcttgagcaagtatcctttgtgattctaacgaacatttctgcggttgccttttctagtacagctatttgtgggtgactgtcatctctttggttgccaaaatcccataatataacacacacatgcttatgcctgatgtcgccagtcttctgctttgagtgcctcaagaatgtggaaaattaagtgaattctggtatccatcagagactaatgtaggcactcgaagaatctcgagtcagaagtagaaatgaaccaggccacttgcgtcttgaattttatttctaaaaagttgtatgaccctctataggttagcaattgagacttgaatcttttactcagtgaatattttgatgtcacatattttagaactgatggctgttgagatgaaattagtcacctctgggatgagtcagttacatgtggagtttttgtttcctgagaatttagcctctttccccaattctggcctgtctccaaaactacttccttctacaatagtgatattaatatttcactgcacaggtatatttgtttaggagggatttttggccaacctcccaaattagaggatctcagaataccatagctgaaagatcctgagagacctcccactgaaaacacgagggaaccgagaccagagaggatgagagatttactgaaagcgacacaacgaattagctgcagagctagaatcagaaccttggctttggcagtttgttactttttcatttaccactgcataggtttctcat

SEQ ID NO: 32044 - DNA, 917 bp, Bovine  19866880994638
attgaaggtaggagaagagggtgacagaggatgagatggttggatggcatcatcaactcaatggacatgagtttgaacaaactcagggagatggtgaaggacagggaggcctggcgtgctgcagtccatggggtcgcaaagagtccgacacgactgagcaactgaacagcaagagtgatcttcacaggtttcccccggaaggggcttgtcttgcatctgtgtacggtaagcatcttatcaatcccttcttgcctctgacaatcatgttgaaactgctttctagtctaggtggaaacaattaaaaaaagaaaacaggtatcagtttgaacagactaataaaatggtttgtccacatcaccttcaaagggttaggctatatcttgtcgggcatcttatgaataacctccagtattcaaaatccattttccaaaggcctgccccactttcctgcttccaccactgctggctgaagtcatctgacttccattttggaacttcccacaagaattcaagcttggtccaaaacctctccagcctccaaggaaaacagaccattgctgaattaaagacactgttaggtcggttggagccaaaataaatggagccagcttttccttaatgagggggaagcagcctttccagggtggtgacctaatgaggcaagagacaaatgggtgtcaggtttcaaaccccagccccttggaaagccaggcaaatgatattttctttcaggaggaacttcaacaggcttggaggtagcctggagatttcacacttgccctctgagcaagtgaagccctaaattcgataatcctattatttaaaaaacattgtaacagcccttgtccatagaggaaacatttatgtggtaagaatatgaccactgatggaaaaaaaatgggcaaagatactctttt

SEQ ID NO: 32045 - DNA, 1333 bp, Bovine  19866881011272
cggaatgtgacatgggctctaacaaagcacacacaggggcaccattactggagagtcagttcaggaagtcaaaggtgtcacagaagcagtaacatctaagacgcacacggtttacaaataagagagggaaagacatgtcaggtagagacaagaatgtgggcaaagtttttatggctatttctagttcaagctcaacatgcaaggttggagacatcaagcttttattttaaaataattctcttcattttataaaccaagagatgaaaaactatttcttaggggcatttattcagaaaaaattaaatctggagaacttacgttaactttaaaggtctgtaccaagccatctaaaaagcggacgctacagatgacttctgatcgcgttttttctttgggtaattctgaggtgcgtatgttattaattcttccacccaacgcacgtaaccgggaggtcataactatcgctgaataacctgtaacagaagacacgcctgttagctctaacatgaaaattaccatttccatttgaatgtatctctcagtctatccatccctcacctgtctgccttgatcctcacaaaaccgtccgaagacctcagataaatgtgagttggataacaaaccatgttccctttgagttttgagttctaagctgctttagacaatatttattgctcaactataacacattcagagaattacatggcttatttggtgtcttattatctctctagtctaaatcttctaattcatattttccatgcctgtaattgttgatgttttactactttatatatttgtgtattctacccctaagaatttttttttttgcaccacagaactaaatgcggtacagaaattatttaaaatatgaagacatttattgatcaattagactacattaagaacatctattcattaagaggctatttaaaagaaaaggcaacccagagacagctgtaataaataactacaaagaatatacaaagggctcctacaaatcaaaaagagaaaaaacaagtaggtaaaaaatgggaacatcagttgtcaaagaaatgcaaagtgaaaccgcaaagcagcagtgccacacccaccagaacggctgccagggaatcgggcaaaaccaagggacacagcgaggagcagctggagcgcttgggcaccacgagtgaggacgggaaactagtgcagctaatctggaaaagcagagacgttactttgccaacaaaggttcgtctagtcaaggctatggtttttccagtggtcatgtatggatgtgagagttggactgtgaagaaagctgagcgccgaacaactgatgcttttgaactgt

SEQ ID NO: 32046 - DNA, 1458 bp, Bovine  19866881043340
agaaggtggcagggacgcctgggagacaacaggtttcagataaccaggcttacgtttgagcctcaggagaagcagtcacagatccccagagaaaggagacactgcacccccacccccagacctctggtctggttgatatcgggggaagtcagcttgctggggcttctctgctgtgatctctaaccaccctgcctccagtatggttccaactaagcctggaattctcaccccatcttaggaatcacacaggtcatcaaaaacctagtttgcagctcaatcaagttttccccttgatttgttgtcgttcagttgctaagtcatgtccgactctctgggaccccatggactgtagtaaaccaggctcctctgttcatagggttctccaggcaacaatactacaatgggttgtcatttccttcaggggatcttcccagaccagggatcgaacccatgcctcctgcactggcaggagattaccactgagccaccaggaaagtcccttttccccttgatcaggatggtgaaaaatgtctcatgctcatcccccagcagtagacactgcagacaccaccatttgggcctcatgacacaaacaagtaagcaagtgatgcaagtaatttgcggtacaggcccgagaggtctctctcatcctgtctacagccctggggggcctcttgaaattcccatggcccttaggacacaattcatcaggatcttcaaacagtgagggttatctctggtgtttgctggcatgaacccagattccgctaccctcaggttccatctccacttgtctcaccaaaactggttctcagtctgttcagctgggaaggactgaacagctgacagtagctggaagtgtcctctatttcaatgataaacatcctgttatctagttttgtacctgggcagaatactctacaaaacatttcccttaaaggagccagctggcatccctggggtgtcatgtagacctcagggcagacctgtgttggtcttggccaagagctgctacctgacatttacagagcaggggtgatgtgagtttcacgactgacataggaaccaaaagaacaaagctagattgcaattcggagtggagggtagaaaatgttctcaagtttatgtcctacacatgattttgtccaaactattccgtctagagtgattttagatttaagcatttaaaggtgtttgaggataagcagcttcacttggcaggatgatgccaaagctgtgtttctaaaatcatgtcctattaccttagctttgtaagatagtactcaatgctgcaaacagtcaaaaagacattggtcaaataaatttgagacatactcgactaaagaaagttttaaataaaacaagatagcttttctttaccagaggacttctccgaagttttagtgctaatagattgtgaatctctagtttaaggatgggtgtacagcacttctcaaa

SEQ ID NO: 32047 - DNA, 1065 bp, Bovine  19866881089684
ctgaaaatataaattcatactaaagatgggcaaggagaattatgggcttaaatgtgacagtcatttctctggattcatctctaaaggttaaatcctgattccgcttcttgttagctgtgtaacttacttacttcacttctctaaatctcagtttcttcaccagtaaaatgggaataaaatagcatcagcctcatcaataagttcatagagtcagtgcacaaaaggcttccctttagggttattattatttttgttgttattgcagtttttgttatgttttaggaaaagacttagaaaacttttagcagaattacttaagagttattcagtagctattgggagcctgacataaatggcacagcttgctttataaaattgcgttctagtcctgagaagtattcattgttatttccttagatttagtttctctcataacatctgagttcacaattagctttcagtagtcacctgtgatttcaaaaaacaaaggccattattaagcatgttgggtgagaatgaaattacaaatcactatgaaaatattttcttttagggggtggttgtcttcttcatagagccaggctcaccatgttggtagaaatgtgtttaaccaaaagatcttggtccaggattcactacttaccatgattttcattcttactggtttagttaaatttttttcttttttggtcttaaactatatttgccctggagatgcaaaactctttccttctccagttttccttttccagctccgttcagagaaatgacaactcatcccaactcatccctccttaccctgaagtagtaatatttggaagtttctgagacttgtgtcagcaggtagggatatttctcatttctcatttctgagctagacctatagtatgaagattcatatcatcgcattgtcccactcctggggccttcaaaggaggagatgaaaggagcaagggtgtgtgggtcacagctggaaccgtacaagccagtgggatccaacaagcaggatattcccttgtacgggaggaaaggattgcaaaacctaagtcggactccttcagcaca

SEQ ID NO: 32048 - DNA, 638 bp, Bovine  19866881186756
tttttggggtgaggagaccccacccctgcttttaataccctctaaggcagtgatcctcaaagtgtgtgacccactaattttcgctcctccatgagtggttattcctctgtgatgaggtcagtctagaaatccagagaaatgtttagaaactttcatagcaatttgttgaatctaattagaaaaagttggtacctatattatcctgacctttttattccatttcattttttttaataaaaaaaaattatgcaagtattgttctgagatgaattggaaatttaaagagaagaaaataaaatctgacccattgccacagctggttagagaagcattgttctcggggagttcaagttccccggggctgggtggattgcatctctgagaacagagagaccctattggcaaggtccaggaaacatctgggtgggtacttcctatgtgtcactctcctttccagttgcagcaggtgggtgagttttgtgttctattgctgggggcagaggagggactgtgggagaagctgcttttggtcagtggtccttcgggtcttttgcaaaagccgaaattcacgaaggagatgacgctaggcctgggcggtggtgctggggtggtgggggtgtactttcctcccggagctg

SEQ ID NO: 32049 - DNA, 1260 bp, Bovine  19866881196524
tcggtttcctccccctcaaattacacttgtgacacctgaatgcagacggtttaaaacatcttattaaatgattaagcacatggtaatcattttcaccaaagatactacttcccgttgaatgattcaatatgtgctaattatacaaaatgacatactaatttttctggttagccttaaatgatggtgtttaggactcaagaggtttttgtcagaggtaagaggaagggaacacatgtcattgaagagaacacatcttctccctttgctttctccaacctgattattcccttacccatgctattctttccttgtcaggttcctttcattagtgcccttcaaacaggcattttcccaggaagctggtatggggtctggcactgcccacaccctgtcccacagagcttggtcagttcatctctaactcaaggctcttgttaggtgggaggctctggagtagacatctcttagcttcttcttcagaattctcccttcacgttagacttaatacgggtaaaaaccaacagagcacctcttcctccccaccatgcacaccacttccccagcctcacgtgcctctttctgtccaccatcacttcaaactttgggatcatctctgaatggcccctttcgacccagaaagagaagtcactcccttactccagagccttcagtgactctctactgtcttcaaggtaaaagagaagaaacaacttttatatcttgccacacagttgaactgaatcctcacagcgctgaccagtattcccaccttatttagttatttattcccactttacaggctcacaggaaaaagagttgtccaaggtgacccagcctgtcagggtgggacccggggattcagtctacacgtctgaccctaaagggcacattagtttcattgatcacagaagctcagattctttactgattttcatgggttctgtaactctctctgttactactatttttttatttaaatgtttattttaaaaatgaacttatcatgacagctatagaaaatcagcggcactgctcctgcaactccactagtctacaaacatctctgttcctcacctcaaacaggtgccagccccttgccatgggtcggtggaggatgcccacccagggcctggccagagcgctcgcaggccacttccccctccccctcccccaaggccccgccccttatcagccagctggcacttcacgtgatggacaggcttgcttccagttgctgggttccttccttctctaccatca

SEQ ID NO: 32050 - DNA, 1824 bp, Bovine  19866881202582
aacctcctctgaaataccgacttgtattttgggaagaatctgttcgttcttggctttccattttcaatgagttgatcttcatagtctttagacaggaagttcacatctaagatgtggaatggaggggttcacctttgggaagagggtgaaaagtagagaagatgaaggtagcagtttcaggagatgcgatgctactgcttttagagcttaggtggttgtgagaattacgcttgagaatacagagtgcatggttcattcatctgaaatcctggacagacaataatggatcatcatcatctcccagcagatatgatcacctctcccaggcagcctttagcctcagtgtttttccttggccacctctggaagcaccaggccaactgatatttgcatagactcgcacagctctcagatgaactcatctttcattcattatagtaagagaatcaggagctgggagaaactcaggccttttcaactgtacatctggggaattacaacgaccaatagaacgccagcaccatgagggcaaggattttcgtctgcttgctcaccgccatcatcccagtgcccagacagtgctgagcacctagcaggtactcaccacttagttgaatgagtgtgtgaataacttcatagatacttacaagagttaataatggtgagatgagagaactcacctcatggagatgactcacagctgagcccaatgtgaaaaaggctttagtcttttctctaaagccttttctttagagtcttttctctagagtctctgcttttctctaacaacctttaaaataccccagttttatggggcattttactggagataaacttaataagttaaagttacataattagttagactcagcttccattataattccttattgatccaaggctgcccatggagcacctggcaacagtgaaagaaaaacagtagcaggtgtttggacttagttcgcttgctaactaattagatgagggattcccccctcccacccccaccccggaaaccctaagcagtcttcatttggctccagaattgaaagtacaaacccagaggcttcagccaactctgtttctctctcttgcttctggactggaagacattctagcattaagatgctttcacataaaactaatgttgttcattagaagttgattttatagtttaagtctcagtattctgacgatgccagattttactcaatgggtggactggagtcagagtgtagggtttgagtcacagctctcccttttactgtgtgtccttggctatacttaacttttcgttgctccagcttcaaaacctataaaatggggataacgatgatatttacatcactagattataatgacaaataaaccgtgccttggacacaataaatgctatacatgtgttccttcaatcataaaactacttaaattttaatgctttagttcccagtaaagtttttgttaataactgactatctgatcatttaggaacatgatcaaagttgttaataaacaggtttatagttgacttatattcacatatgcctagtaaaaattaaaaatgtaactcctcagtgaagggttggttgtattcaaggattgtttaggcagagaatgtcagctaaggtttttgacaacctacaagagaaactcaggctgactgctttaagtaaagccactggggaggccccccagtattaagccttgggaaggacaggaatcgggcatttccaggcatctcaggaacatacagagaaggcaatggcaccccactccagtactcttgcctggaaaatcccatggaccgaggagcctggtgggctg

SEQ ID NO: 32051 - DNA, 951 bp, Bovine  19866881203577
tttttttgtttttatgttttaattggagtgcagttgatttacaatgctgtgttcatttcaggtgtacagcacagtgattcagttatacacacatatatactctttttcaggttattttcttgtataggttattacaaaatattgagtacagttccttgtgccatacagtaggtctctgttggttttctattttttaatacagcagtatgtatatgttaatcccaacctcctaatttatccctccccatctccacaattattaatcccaatactccggaagtaccatcttgggatcaactcctttactccacaggatctgtaacttgttcagggaatggagctccaaccaggagcccctgggaagcagggtagggtcagatgtaggatcagtggtattccaatggagacctgtaactagcgcccttgctctcctacaacttcaaaaagtcaaatagttttcttattatggagttgggtttatttataggcccgacaccatgacactcacaaaactaaccaaataaaagttatacttgatactgggaggataacaagaagtagttttaagctgcctgaagggcaagacaaagaatgctgtgggagctgcaggcagtttcagggacagaggtaatgttgctataaagagaaaccaacctctgacgtcccgcgagctgggagtccagggctgtgatgagaagccagccagcacctgaagcgcacagctcgctccctggtgaccagaaaaccacgctcaacctgtgaggacgttgggtgaacccatcaccttttctcctctttcttgaagtaccaccgagggaaaaacacaaatctcgagtgcacatgttccgctgtcgaggaggctggggccagtctcctcctgctccttccaaacatgacgcccccccagaccccaccacgccccagggagcacgctcccaaattttaacatca

SEQ ID NO: 32052 - DNA, 1201 bp, Bovine  19866881235960
ccaaagtattggagcttcagcttcagcttccttccactgaatattcagggtcgatttccttcaggcttgactggtttgatgatcttcttttatatacaaagacgaaaaactatttgcaaaaaggagcacagaacattctggtacacacctcagattttttctcagaaagacatcttgtacttattcacattgctaaaagataaactgaactcatagtaagaattttaaaatgttgtttgagcaaaatcccatgtgagttgggcagcatcaaactggaagtggttagtggtgccctgcccacaggagctgctgctgctgctaagtcgcttcagttgtgtccaactctgtgcgaccccatagacggcagcccaccaggcttccccgtccctgggattctccaggcaagaacactagagtgggttgccatttccttctccaatgcatgaaagtgaaaagtgaaagtgaagttgctcagtcgtgtccgactctatcgaccccatggactgcagcctaccaggctcctccatccatgggattttctaggcaaaagtactggagtggggtgccattgccttctccccacaggagctgaggagagacttttatagagaaaagatgggagtaatgaaaggaaattaatcgactggctgtaaaagcgtcactggctgtttgcattgtttggggttttgatttcgtaaccattaggcatttacaggcttaaattttggtttgctgctggaattctccatggtagtagagccacctctgtcccttggattccttgtttaattcatttaaccacatagacaatatttttcagttgtgcttaggcaagaaacaggatggctatcagttagtcaagtcggggctgtcaaactgtttgaaaggggtgcatttcctaaccaaggacatggcagaaccacataaaaagaggatgttgcctctgtatataaaacttactgctgggagggtgactgttctcctggaccaacagatgttctctgttacaaaagggggaaaacatttaggctcttccggtggtgaatagaggccacaggttacagctttctttggaagttgcttttaaaaagccattctactgaggaccttctgttgccagccgtgctaactggttgtcctttgtattcactgatgacaacataaaggaggtttgtgcagaggctcgtacaaaaaaatacat

SEQ ID NO: 32053 - DNA, 771 bp, Bovine  19866881292178
agatgacatacatcactgagaccgaagatgtgttctacacctacaagggctccctgtcccctaaagacagtgattccgaggtctctcagaaccgaagcccgcaccgaggagtaagaaacttgtgctcctatctttcctgtgtcccttggttggggctgttgaggaatttgcacaggccccatggccatttaagaggaggcagaggctagagccagcagccagctccctggggtgctctctgccaggctgagaacatcagtccactcccttcccccaagagctgtgtgcctggggtcattagctcgccctgcttttttgtcagtgacagcaacctaccgtccacacacccattagctctcctgaatggtgttttctccagttgatgagcaaaacgcagtttaaaccattccatacaccagaggttgagggcatgttgactagagcagtatgtctctagattgtcagccttcgtccgctgcaagattccccacccttgaaagtgtgctcatttctctctgcccacagaaaaccttctcagatccacagtctgtcctcagggcatttgttcgctttggtttttaatgaatatttagaataaaggaaaaaaaaaaacacgcgcagagaacatctcagcatctcggattttctttgttaaatttttgtcaaggacagtttgcatcaaattcttttatgtccccatagtcctttttttttcttttgtgacaaactcccttcacatttcaagatcaggaaaaaatatgtctctcctaa

SEQ ID NO: 32054 - DNA, 986 bp, Bovine  19866881411072
tatttactgtcctagattctacacacctgctgaaaagaactgagtttatactcatgtttaaaatctatatatgtttctccccaagtcttaatacatgttagctccttttttcttaagctgtcagacaggctctgagaggagacatctggcaagagacaaggttttgctctctccagcctccaaaaagatatcaggggcttctgtttgaaaagcccacatcacaatatagtaaaactacactaatttaaatgcagttgtgtgtgtgcatggaggtggaattgtctataatagtgaaaagtctgaagtaatgaccggttatttttaaaaacaatattgcaagtcaagtcatcttcctaaaagctaagaaggtaacactcagtagagtttctcagggtctacttcaataagcagatacaaattttataactggtataacaactgcctactgggatatgagtgttcatagcctaaagtattaaaaagattattttttagaacagactaaaactatttaatattaatttacaatattgattttcttgtataattttccctaaggaaaactcaagggcaatattcatcccagacctgtgtgaatcacccaaattctacatttcaactgtcaagcattatgctaaatgagaactggaacgtttttctgtttgccacttagtaaatattttaggttctgtggtcagaccacttctgttgcagcttctaaagctgccattattgagagaaagcagccagagataacatataagcaaatggacatgactgggttccaataaaactttatttaaaaaaaaacaacaaacaggcattggccagatttggctcatgagacgggcatttccagccctctgtgctaagtcaagaaaccagagatgtatctaggaaagattgttatactttggcatttttctaaggatcaactggacaatcagggggtgaaactatagggagtagtttgcaattacatgaca

SEQ ID NO: 32055 - DNA, 793 bp, Bovine  19866881415686
ttcagcatcgtgtgttttgattgaactaggaacggttgctcttacgaaactgtgaggcaaagattagtatttaaatgaatgcaacacaaacaactagaggtatgcttcattaggccagggaaagaagcagtttatgattattgccagattcttgctttttttgcatgaatgccccaagaggatgagccagcttccgaaggaaagagatgtatttaaattcctggaaaggcctccaaaacaaatgtaactagtattttagaaaacactgccctcccttcctcttctttcttcacccaggggacagctgctgctttggcctaacaaccctccccatttctctgggtaatgacacccatctcttcctttggataactctcccctccattccctgtcattctgctgggactagtcagtcaggtaccacacctgcccctaccactaggcccaagcatgggcagctgacttcaggccaatcaaactctctcagaagagcttagctctcaaagctaatgattactcaagaagtaatgcaagagggaaaaatcacaggagtcactcctaaagggcttctccatgaatttatgttcctgctgctgctgctaagtcacttcagtcatgtctgactctgtgtgaccccatagacggcagcccaccaggctcccccatccccgggattctccaggcaagaacactggactgggttgccatttccttctccaatgcattgaaagtgaaaagtgaaagtgaagttgctcagtcgtgtccaactcttagcgaccccatggactgcagc

SEQ ID NO: 32056 - DNA, 3507 bp, Bovine  19866881524192
ctggttctcccctgtgtcccagtgcccggcccagcacctgaggacacagaaggtacccgtttgccacagcaagtgagtgggtgcagctaagcgccccccatataccgggccctcccttccccccagtatccagctctcctgctcatggagactgtggagtctatgataaagttgcagccggggagacagtaagtaaatgaatagctcacatgtcttaatagtagtgttaaatttagaaacagagcttcaaccataaaaaagaatgcaatcatgccatttgtaacaatatggatagacctagagattattatagtaagaaagagattataatagtatataagaatgatatcacttacatgtgggatctaaaaaaaatgatacaaatgaatttatttataaaacagaaacagactcacagacagaaaacaaatttatggtttccaaaggggagaggcagtgggggagggacaaattaggagttggggattagcagatacaactgttatgtataaaataaacaacaaggtcttagtatatagcacaagggaagtatatttaatatcctgtaataagccataatggaaaagaatataaaaggagagctagccatgcctcacttcaaatttccagacttctagacctcagcagaaggcaatggcaccccacttcattactcttgcctggaaaatcccatggatggaggagcctggtgggctgcagtccatgggggtggctaagagtcggacacgactgagggacttcactttcccttttcactttcatgcattggagaaggaaatggcaaccctctccagtgttcttgcctggagaatcccagggacaggggagcctcgtgggctgccgtctatgaggtcgcacagagtcggacatgactgaagtgacttagcagcagcagcagcagcaggggagaagggaattccaaagatgcagcttttgataaagccttgatcttccacctcatgcaacttctgcttagaaaggaattagaacctagagtatggctgttgcagagattcttctttgcagttttccctctggctgttttttctactttctcttgaatttttatcttgatggcaaatgtctcttatgaatcatgttgtgtatgtaagttcccctaacaggtttatttttgtttgaaatttgatctgctgtctatagaggcactggcaccaagacctccgtggttagaactgaacccttctgaatggagagaaattattcactttttgggcaaaagatccattttaagtttttatttctttcttgctcagctttctcttttggccttatgaacttggatccattgttcccatctcctttatggctgtgccgtgatcccttgaccgtctaaagaggtgccatcttgtaggatttctcaagggtctcatcctgaatcagtagaacctcttaaattgccccctggaagctcccatgtttctgtatgtttgtcacttagacacagttctttttttccttgcttgtaatctaaatgcagcctaggaaatttacaagagttcaactgtttttttaaattttttttgaacagtaaggtgtcacatcttgagttcagttcagtctctaactggattctgtccagatttattgtttgggtttcagagatttagccccaaactgagaactatattgaaacaggtccagatctgctaatgtttgagattcctcccagagcacaaatggtctctcacttgaagctcccctaagtgcggttcttgaatcttccatctctgtgttcccagtaaacactcacggtagaaacagttaacaattaatctgcttatgttctagtgacttgaaaattaagcatcaacatttctgaagcctctttttatcaaggtctgaagggtggttttcatagctgatacaaggccttggtttatcagctccaatggtctgcaaatgccttagacctgaatatttgggatgagcagagtgtgctcagcttaggaattccaagaaggcagaatcaagatagagagcagccaaggctcccaggtgtgaaatgaaaccagtttctaaacctgattcttctgcttagttgtaatatttaacacttggactcccttgagatttttgcacctggttggaatgttttgaaccttggaataatgcttctttgtggatttacctgtgaaacataacatagttccaagctatctcataagggtgctgttgacatcttcaaaatgttgattttatcttcctggtgcttcagaagtatgaaatggtatcctgagactatctgggccctttctctctattgagatcttagttgacagatgaatcaacttgctcaagttagtgatactgtctcttaagtgatgtactgcgtcatcctacccagcatccccattttacaggaggagaaatagagatggcggaaggagcaaggctagaatcccttccttctacactgtaaattcaggcaagggtctatatacctcttaatggttagttttctggagtttcacctcgaaagatagtaagtcagaagcttgaatacacatgtgtcctgtggctcttttgagactggcttgcagtaaaccccttgggttatttataccaggaaagggcacacttataccaggaaagcatgaatgtgtgatgtaaatgctcgcattgtagttcccatacaatagcaataatctatgctcatggttccctgatagcatctaagtattgatattattgcaacttaaaatttggttgctttgtaactcctacatgggagttgaatcaacttcagtgcacttgacccaagtttctgctttttctatagttttggggaggttttgtcattaatggcaacccactccagtattattgcttggaacatcccatggacagaggagcctggcaggctacagtccataggtttgcaagaattggacacgacttagcactatctttctttctttgtcattaacaggtagtagttgttttaaaggactcgatcgttaaaaaaataattaggagttaatttttaataatgtccatttggtggctacaaattactatgttttaaagcccctgttatttgacccctgttcatttcctgctcttgattggtggtgaacagcaaggctaatgaaatgcttaagtactgctgtgtttcacagctcattactctagggagttggtctttttttttcttttttaatgtaggtagacataaaatttatcagcaggcaaatccatgaggaactaactttattacaaggatccttttagacttgcaaattccctctgctagttaattaattttgcacaatcatctatttggtttttattccaaagcttcttgcctaatgtaagaaggctctgcttgatgaagcggtgtggtccagttgttttttatttctatatttccctgtctagtctaatgctcttttttacctctccagattctttcaaactcccttacccctcttactacaacataaacacacaaattattacaagtca

SEQ ID NO: 32057 - DNA, 1704 bp, Bovine  19866881573242
ctcttctcccaagtggagtaggccaatcagggctccttccagaagagtttctgtgtgtgatgacaaatgtcagttgtactggtcacctgctatgctttttccagtagtcatgtacagatgtgagagctggaccataaagaagtctgagagccaaagaactgatgttttcgaattgtggtgttggagaaaactcttgagagtcccttggactgtaaggagatcaaaccagtccatcctaaaggaaatcaaccctgaatattcattggaaggactgatgctgaagctgaagccccaaaactttggctatctgatgtgaagagtcaactcactggaaaagaccctgatgctaggaaagatcgagggcaggaggagaagggagcaacagaggatgagatagttggatggcatcattgactcaatggacataagtctgaacaaaccctgggatacagtgaaggacagggaagcctggtatgttgcattccatgggattgcacagagttggacactactgagcagatgaacgatgatgacaacaactggtcacctgaagcaataactggtcactccaaagagactaatgccccatgaaaaggaactgaggtactactcatttgggggtgtggaaagccaggctttcactggaaaatttaatgacccgttttcccagtgtaaaaatgggataaaaatactggtttttatctccatccactgattgggtagtaagttccctccttttaaataagtcctgttatggaaggtaataccatatctgttgggacagtatctgtggctgctacaaaaaccattattgacaatcgaaagaatattattaagcataaacccacacttagcaggcactgctaatgttttcagagattcttctcatagccgtccattcaagacgtcagccttgttttaaggtacctagtctcacaaacccaaagtcatcatccctacttgtacagagaatggtttaggacatctgctgctcttagggaactgagttcaaaatgtcagagtgttttatttgagtgcttctcaagccataggaggtcttgttaaaatacagattctgattccgtaggtcagtgcattagtcatgccttttttatttttctatatttctgatgctctgacatcttaagggcttgctgatgctgcctggtcaatttctagagacaggaaaggcctcaccttcaagtgcccttttagtatgcaaaatgacaaatccaaagctccctcctctctcctctcacaaccaactcctaccctccaggccactattcccctgccctaatcaccccagggtcaggtaccagacaactggaggctgcccctgcaccccagagcctgcttcaatgattcaatctagccaatcctaatcttccttactctgcttcacctgttcctttccatggacgctaaaataaaggcccttgctcatgttttccccacaacctctgcctcctgactgacccagctgcttccccaggtggccctgtgtgacacagcatgccatggctcttggggactgtgaataacaaagtgccttttcagtggcaattatctcctgatctgttggccttaccatatctgaatcataataaaacgtacatcttcaaacagccagggatggggcctggtgatgctgatgacccaggaaccacacttagtgcaggaaggctctaaattactgtgttc

SEQ ID NO: 32058 - DNA, 1486 bp, Bovine  19866881618526
aacggaatcgtcaaacatttgtactctcctaactgaacggattcctgcaacacgagagcatttcctctgcaaatctcctgcctggtaccacaagctgaagcaggtccctgggcaggcctggtctcgttcttactttctgggtttccttttctttcactctctctctctctcctggcaaaatgtcttgaaaacaggacatttacactacaccctcacgttatcttttctctctagttctttgcttttgaactagccttcaacatggggaagtttagctgagagccccccaaaccacttcctggcccgcctatggcaccgacaagttgtaacctgtcgttccgcagggatcgttggtaatgcttggcttgccttgctcttgttcaattttttatttccgcagaagctcattaggagggaacacttctgaaaacgtactgcctgaacctcaaaatctcttctggtgtattcaaactcaggcacagaagtcattcagaaactgagattgaagttgatttagccgggtgtctgaattagcccccaaaccacatcattcttattgtaagtatctctacttgctgtcatagaaacggttgaagcagtgtaaccacaaacattattcaccttccactattaaccctcttgttcatttctttttttttttttcaaagctcttctggaaattctacaacttcttttaaaacagattttctagacaatgactgcttttttgctgatggagtcctattataaaaataggaagaaattcagtttcaatatccctctgattctacttgcttaagcagttgctttcactccaaaatgggcaggaaggtaaacactgcaatctttttaccatttctttaaatgcttttaaaaaagagaactcacagttttctggagggtgcccacatgctgttaatccctcttgctccaccatggtgctgtgggactaaacggaggactggctgccgtaatcctttaactggcacttcagaaatgatgtagaaaagctaaagtctgtcttgcaaaccccaaaacttgtctccacaatcttgcctcgatcagcttccaaagtataatgcagcgtgattattttcctctggggaaacctgtgtaacaggtctctgagtgccattggatgtgtcagaggtttaattgattcttcaccatgtctctgcaccccataatagccttgctaagcacaggacgtgttttacgggaatagtcacccagagcttaatttgttgttgtgaggcagacaagactgtttcccaatgaaattaaatctgtttcgtgccctgcgagtttcttcctgatgaagtgtgctctgctgactactgagagtgcaacccttgatggtctccaattagcatggatgccattccagggaaagcttactctctgttccttgccagttttggaaaaacattctggtggagaacagggctgccacagaactctgttccttgatttcatttacttttct

SEQ ID NO: 32059 - DNA, 1885 bp, Bovine  19866880345622
tctcttgggcccttgaatctctagccctctgttttccatcttcggacagccattctcccattctctgatcatactctggctccaggctaggatgggaggtgtcagtgcctggagtttcttcctaagacagctttaatgagaacccaaatgacagtcacaaacatcttgcatcataactggcctacgtggcagctattatgaggtctgagtttaggcatcagatggtcccctggggtgaaatggacacacactaccatggtctcggtatgttggagtccagaggaatagagtgggcagagaagtatagctgggagacaatctgaccatgtcaatgccacttataagcccataaagactgctcagctctttctggatgaacactcatcacctgaagtctctccctggtattggcttgcctctccaatcttagctccaatcttagttcctcatgctccatccatgaactctatccatggttctaggaatcagcttctagacatactcccctcttgtctcaaatacgcctctctgccttgacaacttgcttatcttttagggcccagcttatctggaaatatctctgagaaatactgttagtgcaaaaatcaaggcacaaaagtatataaattgtagacaacctttttgtattgaaaaggaaaaaataagcatgtatacttgcatttgcataaagaaacactagaataatacatgcaaaaaatgtcataaatggctatcagaggtgggtacctggcagatatggatagggtggtaatgcgtcttttcattgtgtacattattgttttgtacagtattgtttagaaccatgcgagcctattaccttttgaaaaaaatgagtttaaaaagtaaagaagcagctcatggaagacgatgtctctgacaagtactggtcctgaagctttcctttgcttctaccagaaaacacccctaagtggcgatatgtccagagctcatgcccacagcagccatctgaaacacaccaatgctcctctcacacacccaggcaatttcagttccctagaacagctgtgaacctgggaatcagcagccagtgccgcggagtggtatagacagtgcctcttgccctgtatgcatcgactcacacatttgtcctacacacagccgtttgcacaacccacacaacacctggcatattgcgtgcacagcacaaatgtttgtggaacaaccaatgactggtacatgatggaatactaaggactgtactttctggtggtccagaggccaagcctgcactcccagtgcaggtggcctgggttcaatccctggtcagggaactagatcccacactcttactaagaatttgcatgcctcaactaaagatcccacttgccacagtgaagactgaagattgtgccgcaactaagacttggcacagccaaaaaaataaatattaaaaaaaagattattatggatctcagttcagatggtaaaaatatccacctgcaatgcaggagacctgggttcaacccctgggttgagaagatcccctagaggagggcatggcaacccactccagtattcttgcctggagaatccctatgaacagaggagcctggtaggctgcagtccagagggtcgcaaagggtcagacatgactgagcgactaagcatggcacacatcaaaaaaatcaagtcttagtcaaatttccaataatactctcgggatgtaatgtgatatttttttaaagaccatacaaaacttatatagagtatgatctggctatgtcaatacaacagtattcaagaagaaaaaggactagaaggaaaaacacagagatacgagcagtggactgtggactagtggaggatattctaggactggccatggacctgcagcctggtccca

SEQ ID NO: 32060 - DNA, 1345 bp, Bovine  19866880370306
cagtgcttgatatgtaataaaaaagttcaacatacgatagctattagaatgctctttttgctgggaattaaagtcattatatttcatgcccggccattaagaggtacaccttttacactctggaagtgcatataccttattatatttgcgttcatttacatatttacttatagagaacttagcatttgcatatcctggtaaatacatttctctgtaatttagagtcattttagcagactgtaatggcacatttctctttctgacacagcttcttggcaaattaacttacttgcattttcattttaaaaacgtgtggtgccttcgcagaataatttcccgtactttcagttcttcttgtaggaaaaaaataattgcacagccaaggaaagctgctttcatgcattgggactctggaatgctgctttatgtttatgtccaggctctttgtgggtggactgtagaaatccccactcttgggaatgtttctgagccccctctgagaaactgaatagggagaaaagagctaattaaaaaagctgccgtccgcctcctctaattaacttgctctccactcctgggggagggtgtgaaaatatgaaaacggcactcaggcggtgctggaagtgaatgccattctaggggtccctggtagcctctggtgttttgatgcagaaaaggttcatagtaaacaaggcgaggagcctcacaaggggcctggtgtacccttgccctccctggacactgcctcccacacggggcgctggtgaatggtggtcccctctgagcaggtgtgcacgctgggcagctgcgagctggggagacctcattggaattcagcagcttgaatccatgagcgtccggccctccctgtcgcttgcttatgctgctgggaaagatcaggggccctttgtgctctcaagccacacatcgctggagcccggggatgcagaagccgtgggaagagctccctctgcatctctgctgggccctggggaagctcagaacatccctgcctggtggtgcggcggctaagtttctcgtgacatcgtaaagagattcagaacccagacgtatcagcaaaggaattaggggtggaagtttggggacagaagctgttcttcagcggaaatggctttggcctcctggtggacatggcccccggtggaatgggcccggtggatgtggacgacggtaacccggcagtggggattccagtctgcgggtccttcacggaaacccaggaaagaggcaagttgtctgtgtgcgtctcttcaacattgccgctgatgagtgcaaagctgggggccaggtctacacccagagcccaccgggcagatctaaacta

SEQ ID NO: 32061 - DNA, 2692 bp, Bovine  19866880532907
cccagaacaatggcaggcttgttaacatcgttcagttgctcagtcgtgtccagctctttgtgaccccagggactgcagcacgccaggcttccctgtctttcactatcttccagagtttgctcaaactcaagttcattgagtcggtgatgccatccagccatctcaccctctgtcaccttcttctcctcctgccctcattctttcccagcatcaggctggcaggctaataacaaaacaatagcagctgtactgacctagtggcacgtgctatcatggttaaccctcacaactccagtgcaagagggacattgttattgttccccattttacagagggctcaaagacacttcacatatatgttgctagcatttactgagtgattaccttgtgctgtgtattagttcatttaatccccacaacagccataagaagtcagtactattgctattcccatctgggaaacaggcacagagaggttaagtaactattcaaaagtcacacagccagtaagatctagacagtagagtaaacccaagtctgtctaactccaaaaaccatgctctttcaactaagctctgcctcccaggtttcaaggctaattcatgttgcaaagacctccatcacagcccaaagcaagaggaataaatatctattttaaggaatctggtgaaatctaaaaggatgagtatggagtgcaaggatatgtaatccacagagcacagagggtcccagaggctggtggaggcttgtaaccaaacacagcatgtgcccacagcatgccacgctgtcctttctgcagccttgtaggcttccacgtgggcagacaaaactcagaccccacccagagccctgtggcccttcgggagatgttgctgagtgtttatggaggatccaggcccgccagccgccaggccagttccttccagaggaaccatctgtgatctcctgagtggatgacaggccgaagacagatgggctgtggccgggctgcctctgaccacatgccacccacatgccaccctgcacatcctccccacctggggcagcccctcggccctggggaccaccagaggagcagaccaagaggcagaacatctgagtctgagcccctggagctgaaggccattctctgagtcaccacctttaatgaggagggagggaacgcaaaacccacgccagcagggagagcgtttgctggctcctccctgactctacaaggtcatctaagcagggagcggagggacgcttccgtgtcccacagaacaccagcggcccagctgccaagcattgtaccgatgagggcttggttctgctacacctccacttcacttgggcctttgacctgccctagcctctctgttacgaatggatcgtcgaggtctagcggtcgagggatggttaaagctctcaatctacaaaactgaacctccatcctgttcaagtacccactcctgatgactgacccttagaaagccttcaccctctgctctggttgtaaacagccccctctgtgatgtgtgcaggcactcaggtctgtggaaattcccaagctcaagttttcctgggtccagcttcccaaactcctggaagctttctccccaaactcctggaagcttatctccccaaacccctggagataaaggggtccacagctgcttgaggctgtgtctgttctaggacgtgtcaggggagccctgctccaaacccccccaagatttaaggttctatttcagagcccatgacagctgaaatcagcttcagcctgtactttctaaagactcaggactgctctcaggtcacatcctggtctcctgaaccatctccctttcagaaagagacctggtctctcagcggaagctctggggttccgctctgtgctcacccctcttcctcagcctatgcctcacctggcacagactagaggcccagggactctttgctgactgattgcatgatatgtggggttgacagcctctttttagtttgaaaagccccagatgcaagggcaactgacttcaagcctctttcaggaatccggggtgacggggcacagtgttcccagcacgcgtgaacccccaggctgactctgaaataactggtgagacctcgagctcaaccctcacagacaacatggtttaaagagcaggctgttgacatgataatcgattcaaagagactgtaaccagctgttcccgggaaagaaggacgccaggacgcaaagtatgaacaagtattttaataactcaagtcactgtgctcccagttctgaagagattcctaaaagaggcaactgtggccattccggaagccagcgctcaccctctcgttgtctcggcatctccctcctctgggtgctgactcggaagaaagcataaacacgcccagtaccatcctggctcccataggaccttcctcttatctatgcgttacagcaacagccttagctggactaagatggtgactcagttaaaggggaagacaaatgctgactgtccgagaagggacggtccaagctggcaagaaaaagcacactgcgtacataggatacagaagggggagcttctgcctgcgggtctacaacgttttacattggcttttgcctgcgaactatcaagaagggttctgctggccagtgtttctgcggaacaagcaacatggcagtcaagtcttgggcatccggtgccaccagccc

SEQ ID NO: 32062 - DNA, 1371 bp, Bovine  19866880625459
ctcagactgcaaactcgtcccccacctccatgtgccctgagagagtgcctgtttgtaggggctgggccaaggctgccaccgatgatgctggaaaagacgcgggcaggtgaagtaaaggaggagagagacaacccaaacaagtctaagacagcctcccccaaggaggaggaacggctttcagggggcgcccggccagctggccagtcagctataagcaaggcccagttctctgcagtttcaactttactggtaaaaggtaaaaggccttttccagaacaaagcgtctatgtttaaaggtgcctgtcattgataatcgcttttcagtctcactggcgaaaaagaaaaaagtcctcgcttgcatacccatactgaatgcttgggtttgctgggtattgttgcctttcatagttttttttttttttttttcctgacctgtttgacgtattaggggaaaaaaaaagagtttccaatccattccaccacacgatttcttttttcagaagtctcctgaacacccagcatgatgtgtctattattatctttggggaaatggctgactgctcagctcacaaaaacactattaactttcctcctgataagcatctggctccggtcttgaccttcccagatttctcagcccggttcttttcctgctccagctcctcctgcttgttgtgtctgaagtggccaaggcagttcaggcttccgagaagcctccagcctcaagcagcaggcttggaggtgaccagtctgtcgatgaagggcctgggacacgctcctgagctgtcagcagccatcctcctgcaggtcctggtggagaggggtgggcccggtgcttggggttagaagatgggaaagtgtgaggaaaaggatgtgatggtgaaccaagaccctccatccgggtagggaccatccagagaggtaccccttctgcccatttgctgataggcagtatcctcgagcttcccaggtgactccgtggtaaagaatccacctgccaagcaggagatgcaagttcaatccctggatcaggaagatcccctggaggagggcatggtaacccactccagtactcttgcctgggaaatcccacagacagaggagcctggcaggcaacaaaggggatctcaaagagttggacatgacttagcggctaaacagtaaaccatcctccggttaagaggaggggaacttgtaaaactgagacaaaactcagaagaaatctttggctcaagtgagaagtaaaaagtaggtcttaagacccaagatgagccacttcccttctctgggcctcagttacctcatcagtaagatgagggggatgactaaaccatttccaacatcctttccagctcctaaaaaattatacga

SEQ ID NO: 32063 - DNA, 1924 bp, Bovine  19866880646435
atcttgggcctgtctgctcggtgcagcgatacctccactggccaattcctacttggtaattgagcattttattccatagctgtctagacacacactccaccagggaacctggggaagatgcaatgcagatacagcgggaaacgccaagacatgcctcagccttgacctggggataggaaaaccctggggcccaccctcgaccccctcccaattcccagtttaaccctgcactgcagtccataggctggttcccacgccgcccacatcaaagctgtctccaggctcctggcggcagacactctgtctgagcctcgctctgcagcgacccggccacaggccatcttggagatgccagcctggctcctgacagctgctgcccacatctcatcacctcaccagagcctcgcagcacgcctatgaagcacaggcacggacattcatcctccacttggcaggcaggcaggagcagaggggaaggaggaagaatgggcagacgcacagctcctgttcctcgtcttcaggttctccagccattgcaggggaaggtgaaatgcagtcaggcacggagcaaagcaggagtggagagctcgtagtggcgaaagctcaaccctgaggctccgtaccagagccaagcaagaacccttgaacctcaccaggagagcctcatgttatcccaacccctccagcacgaagggcatcccaacgtgagtccatcatactgcccgttctcaaggtcatgcttttgctgatgagagggaggaggctgggaggccagtgggagaggcaggaagtctaagttgaaaggcacgtggccctcagcctgtaagtgactcactggtgctaaatgagagtcagagtcagcagagtcagcaagaggggctggaagggaacacggatcccccgggtcattggccatgccacccaggtcgacggagaaacagcccagacgagggtgtcagaatcttgcatgtggactccagacgcgccatgtccgtgttaagtcactaatgataagccgtaagcaggatacaaatggtgtgacagatttactgctaaagcatggaggcatgttttattgctaacacatacatagcatgattaaagaaggctcttaccattcgtttagatgacaacaaacgaaggacccacaaccagcaggcctggcagtacccctcccatgaaataatgcctacactgaaagagaaccttctcaacaagtattcaccaagggccaggcctggcacagggatcacaaaagataagtgaaatccacctgtgcccaccaggcttactgtctgacgggtgggtagacacacaaatcatcaggacacacagcaataaaaagagctaaaatccatctccctcccctagggccactcagcagagaatcttccctaagggctaaatatagatcaacactaaaaaatgatttgagtgaattaactaggtttttttttttttttttccagccgcaagtaagagaaaaaccaatgcaaataaaataaacatccacctgctcgagggcagagcggtgcgaggactgatcacttccatggctcgagggcagagcggtgcgaggactgatcacttccatggctcaagggcaagggcgagaagcagctccttccttccttccagcttatcaacggcagcctttctcacggccacaagagggccaccatcattccaggcaggacatgaagatgtggcaacacaaactggaagtaataggctctttgctcccttgtgtgtctcttcagaagggctgagtgtctaaaagggcccagcacattccattcttccctggcggtcaaggttaccctcaaccatactttggtggggggctgggggtggtcatggcccccatggctgccttagcccctcaggatttgcctgagataggtgctggggcgggggtgtcagg

SEQ ID NO: 32064 - DNA, 2854 bp, Bovine  19866880669051
tcgataacctatatgtcagcaatttggtagtttcataacatgttggagcaatgaaaactaatctttctggcaaattatttttgtgctgtgcattactggcatggtctaagatgtaacaaaacactgtaaatgattaactgtcgtgtaaagatgaacacgggcttccctggtggctcagtggtaaagaatcctcctgcattgcaggagatgcgcgttcgatccctgagttgggaagatcccctggagaaggaaacaacagcccactccagtattcttgcctgagaagtcccatgggtagaggatcctggcgggctacagtccatgggatcgcaaatagtcagacatgacttagtgactaaacaacaaagaggaatacactggatgatgctggatattaggtaggtgtttcaaacgcattttcatattaaggaaaccagcttgatcagctagttttaggcatctccccccgagaagggcatctagaacaccagccctgggcttaaggtggaagatgcgaattgctcatgacccagtgaatgggtaactgcacatggaagactccttaaaatgatattgaaaaggaaaggtcagcacgcaacccttaactcttcctagatcacaaatccatgtcgtgtggtgctcaaatctagaattgctctgtgttttaaaaattactattttgaatatgcttcttggcagaccaagtattgaatacacaaagcagataaaacagaggatattcacagtagagcacaaggtctgtaggacaagagggttggaagaaggcaggactccgagggcaaagagaatggggttcaagctctgactcagccacttagttattacgttatgccactgggcagttttctccactttatttcagctccaaaacaggccaagaaaacgtacctcctagaattgctgtggtgtttggggacagcgtgtttaacatgccaaccccatgttggcccttgtgaaatcgaggtgacaggggtcatcttcatcactgccgtcatgcttctatctgactccatagatttgtgcctcgtgttcagggctctattgattacataaaagtatcctgcgtccttactttttgccaggaggggcgtatgaaatgacttattcatctttaaaatgacccaccatttttaaatttcccacccacagttgcctggatcctactgacttgtaagtgatagattgttagattgtggttgaactgagctgaattgtaagcttttgattttgacagtgggtggagaacatgggcttttttcaccctttagcagaccataattaaatgactagacctgaaaagagtcaacagagactattatgtccacctgtttacctgtaattaggacacaaaggctctgaaatatgcgtgctccagggtcagagctccaggcactgtgaagtcttgggaacctgtctggattccctgtcttttttaaaaaatcaaagtttgctggagacacctttggggccttctggtaccaggcttgaacttgatttttacagcaaagggggcagctagcggctctttgtaatcagagtgctttgtggtttccataaaagaggaccagttcttctgaccatgggaagaacaaatatgaggcagtggttaagcatgcaggctgcacaccacttagacctgggactgaatccaagcactcacttattattagtgataacatgctactttacttaactttcccaagcctcagtttccttatctgtaaagtgggcgtgtgataacatcggtgcttttctcataagctttgggaggataaatgagttactgcagcacagtgcactgagcctaacaaaacttcctgctatcattgttgtctggtctcccagagccagttgggtgccctcctggaagtgaccttgactgcagaacttgaattcattgctctgcttcctgcactttgggcctccattcataatagctggttagatgagaacatcaacctctaaagctcagactcttctgatacgtggatgaaagctgtgaattttatacctaggaagaagcacacagccgtatgttttaagtgttcatggggctttaaagcccataggtccatcggaccaggttttggaatccctggctcaaaggaaattaatcagaaaggaattatggagcgcttcaatgaaccacatgagctttccaggtggcacaatggtaaagaatctgcctgccagtgtaggaaacgcaggagatgctggttcaacccctgggtcaggaagatcccctggaggagggaatggcaacccactcctgtattcttgcctggagaatcccatggacaggggagcctggtgggctccagtccaaggggtcactaagaatcagacacaactgagtaagccctcaagtgcataccagtgcacaatgcttgccatttggcgggatgcaaaatgacatgggcagtgagtacttttcaccgatctttgactctttcaaagttgactcattctgtggatccattcaaaaaagactcatagaaacgcttctactggttgatggcagagtttctgcccagaacatcagtttgagaaccaggaatcatcatttattccacaaatatttattggatgtactctgtgtgaggtgctgtacagcgaacaaagaacacaggagccctgccttcctggggcttccagacaagaggaagaaccttaaataagcaaagagatgggtaaagagggactgaaatgacattcagtccctttatctactcctattcagttttaaatatttatttatttatatttatttttggctgctctgggtctttgtggctgttgctggccaaaatcttggccttctctgcccaccaaa

SEQ ID NO: 32065 - DNA, 2370 bp, Bovine  19866880716759
taatatatagtccaaggggtcacaaatagatacaactgagcgactttcacttcacttgagcattttacaagcacaacaattcaagagaaagcaaactacctcttcagcaaactgacttaaaaagatggcttggagcccacagctccaattactcccaagtcacgccccttcccagaggctgctggggtgagattcccccccaccaaggtgtgccgtgtcctgggggctcacctgagcagacgacgcctgcgtcctcgtggtgcccgcagttgtgggagaaccagccgctgtgggggcactgccacaccttggcctcattccccacgcactgcacgttgtccaggatgatgtggccagtgcctccaccgaagtagctctgctttggggctgacaaggcctcgccacagccaagctgctggcacacgaccctggcgtccgtcaggtcccagctgtcgtcgcacacggtgccccaggtgccgttgtaggagacctccacccgaccctcacatctgtgactgccattccccagcctcagggactcacctggggacgggaaagcagagtctcctgagctgcggggctgtgccccatctctctggaaccttctgcccaagagaggatctctgacattctcctatgggcacctttctgcatattcagctgctggactctagatagggagaccctatgtcctgatgtgccaggaactgttcagtcactgagttgccgccaactctttgtgacctcatggactgcagcacgccaggttcctccactatcttccgatggttactcagattcatgtccattgaattggtgatgctaattatctcatcctctgccaccccctcttttgccttcaatcttttccagcaccagagtcttttccaatcagtcagctcttcacatcaggtggccaaagtattggagcttccacttccgtatcagtccttccagtgaatattcaggactgatctcctttaagatggactggttggatctccttgctgtccaagggactttcaagcatcttctccagcaccacaattcaaaagcatcaattcttctgcactcagccttctttatggtccaactctcacatccatacatgaatactggaaaaaccattgtctctatggatggacctttcttggcaaagtgatgtctctgctttttaataggctgtctaggtttgttatagcttcctggtttatgactggggaaggtcaattaatgcctgttgaatctgcctgcaatgtgggagacctgggttggatccctgggtggagacgattccctggagaaggaaatggcaacccacccaggtattcttgcctggagaatcccatgggcagaggagcctggggggctacagtccatggggtcacaaagagtcgaacatgactgagcgactaacactactactggcaattatttcagagtcctttttatactctccgaagtcccctgacggagggataagttgcacagtcaccctcagcattatctgctgagagctctgtaatcatcttcctatcttgtataggaagtattctggatggtttctgtattgaactcagctggaagcaggtgggttggcagttgtagtttgagatggctttgttctagaaagatctgccttactgcatttctgcttcctttggagaagagcaggctgttgtcatgggccctccctcaacatgcacggccatggcaagacgtgagactcggctctctatctctttagggggacatcttggtggaggaagacgacattgagggacagagcagggggaggggtgatctgggggctgtcagtgtcagagtgatgtcactcagatgtcagtaatgcgggtggaacccacaggtcagatttacaaaagcatctcctctcttaaagggaaagggtgcacattagacaggacatccccctgaagtccaagttaggatacccaccgctctccctttcgacctgctggatggcgctgtacatggcgtagaaccccgtgtttgtgatcctggagtcgctcctgaacaccgtggtcaggatgtttgaagaagagtggaatgtgagcttggttccagcacaaaatctgcccaaggagagcgaggcaacctgctgtccatcgaacacttcgatgaagtcgtaagggcacccgtagacgtcctctaagctgaggaggtgaaggcagagttaagctccccaaggaaatctgccagaatgttatacataaagtcaaatttttgaatcacatacagccagaaactgcagtcacccccgcatctccttccaaccacacatctccctcatggacttgacccctctgatgctgcctgagtctgccctttttgtcccactccttgttggga

SEQ ID NO: 32066 - DNA, 972 bp, Bovine  19866880729676
ttggcgcttagggctttattttaagaagatccagaagccccaaggcaggcagagatttgagcagatttgcatttttgaaggatctctccagctgcttggcagggctggagtggtttcagggtggatcagggcccccagggtttagggctgtgtgtcctggcccagtggattggatgggatggggcagctgcggtcccatcgccctaagtacatctcagctgtgccttcagggttgccagccccaccctccaccccttccatggctgctttttacaacagggctgtggcctggatccagggatccacataaatcctgtctttttgcctttgccgggtccttggaagttttcaaagcaagtttcaaaaatgcacagatgaagatttcatttcactgagatggaggttgttattcaggtctaggctagagtccgaggtcccagctggtctcatggttcagagatgtatccttcatcagtacgatttccaggtttacctggtggctcagttggtagagaatccgccttcaatgcaggacatctgggtttgatccctgggtcgggaagatcccctggagaaggaaatggcaacccactccagtattcttgcctggaaaattctatggacggaggatcctggcgggctacagcccatggagtcacagagagtcggacatgactgagagactaaaccaccagcagtgcccgtttccagccagacttctctcgctggagctggcacacgctctgtgtgtttctgtgtttactccatgctcaggcgactgcagtggctttgtcttcccctttttgggcttggaggggaccaggagggcatcaagacccggcatcttaacaaagaaagcccagggcacagctcatcacagaatcgacagatgttctgttcttgcaagcacaccgggtgacttcctgcagcctcccccttcttctgatggctgctgtggaaatgatgacatca

SEQ ID NO: 32067 - DNA, 2685 bp, Bovine  19866880749104
cagatgccatgccgattttccagctgggcctgactaccttctcccccatcccttacttcactttagactcaatggcttcttctgtgttctagaatataccagctgtacctggtacagataaagtagcttttggcactacttggaaagatcctctgggcatcagtatggcttgctatttcctttcattcgcatctttgcttaaatgtcatttcctctgagaagtcttcatgattgctcttttaaaaataaatcctcccatcactacactgtcttaccctactttctttttcttcagagcgctggcatatattcatatatttcttttgtgtgtgtgtctcctcactatgacattcggttccctccaaacgttccaatatctagaataaagcctagtacagagtagccactcaataaaaacctactggatggatgaaagcctgattccaggggtagaagtataacacaatcgagttgcacatttaaactgaaaacatgatgtaaacgtcacaaatgaaagtacgtaaagtactcgtgtccagggaacaagagtagtagtagagcatagtctcaatgaatagagtcttaactactcagcatacctttggcttccttcattgtctgagagacaattcttcggagggtctgatcagcttgatgaagaatgttagttgaaccgataagtctgtctgtttcctagataataagacattgttattgggacagttacctagttgtacaaaagaaatgagcaaagtgtaggtgatacataggtgaagacactgaaagaaaagtaaaagtggcttttctcttccaggtatccttctctactgaaagtgttatttgctcagtcgtgttcgactctttgtcaccccatggactgtggctcgcctggctcctctgtccatgggatttcccagccaagaatactggagtgggtagccattcccttctccaggggcatcttccaacccagggatcaaatccaggtctcctgcattgcaggcagattctttacatctgagccaccagggaagcccctttcttctctaggagagggtctaaatgaaatacatcaagttgtgaattgggttccatgtaggcagtatgctggttaatgtctaagaataggctctcgaagacagaaacaaacgcatctatagtgtttgtctatttagaatgggaaagattctctattcaagaaaattagagataccaagggaacataccatgcaaagatgggaacaataaaggacaggaaaggtatggacctaacaaaagcagaagatattaagaggtggcaagaacagacagaagaactatacaaaaaagatcttaatgactcagatcaccacgatggtgtgatcactcacctaaagccagacatcctggagtgaggagtcaagtgggccttaggaagcatcaacaagcaaagctagtgggggtgacggaattccagatgacctatttcaaatcttaaaagatgatgctggtgaaatgctgcactcaatatgccagcaaatttgggaaactcagcagtggtcacaggactgctgtgacctgaaaaaggtcagttttcattcgaatccccaaaaagggcactgccaaagaatgttcaaactaccacacaattgcactcatttcacatgctggcaaagtaaagctaaaaattctccaagctaggcttctacagcatgtaaactaagaactcccagatgttcaagatggatttagaaaaggcagaggaacctgggattaaactgccaacatccactggatcatagaaaaagtaagagaattccagaaaaacatctactcctgctttattgactatgataaagcctttgactgtgtcgataacaacaaactgtggaaaattcttcaggagatgggaataccagaccacctgacctgcctcctgagaaatctgtatgcaggtcaagaagcaatagttagaactggacatggaacaacagactggttccaaattgggaaaggagtacatcaaggctctatcttgtcaccctgcttatttaacttatatgcagagtacatcaagtgaaatgctgggctagatgaagtactagctggaatcaagattgcagggagaaatatcaataacctcagatatgcagatgacaccacccttatgggaaaaagtgaagaggaactaaagagcctcttgatgaaggtgagagaagagagtgaaaaagctggcttagaactcaattcaaaacactaagaccatgccatctggtcccaattacttcatggcaaatagatggggaaacaatggaaacagtgacagactattttcttgggctccaaaatcactggcagatggtgactgcagccatgaaattaaaagatgcttgctccttgggagaaaagctatgacaaacctagatggcatattaaaaaacatagacattacttttccatcaaaggttcatctagtcaaagctatggtttttccagtagtcgtgtatagataagagagttggaccataaagaaggctaaggactgaaggattgatggttttgagctacggtgctggagaagacgcttgagagtcctttggactgcaaggagatcaaactagtcaatcctaaaggaaatcagccctgaatattcattggaaggactgaagctgaagctccaatactttgggtcacctattcgaggag

SEQ ID NO: 32068 - DNA, 2944 bp, Bovine  19866880761772
ctttgaaaacttatattagattttcttttttgcagttacatttgaaaatgatagaatgaaaaagatttatttattctctttctctgcagatatatccattacatcggctcttttagaaagctcatttttcatgaacacacctaagacatattgggcagacagttggtaatattcaggactttaatactgttttctttggtacagcttccatattacgtgttcattttaatattttggtatggtaatttaatatacttcagagtggaaaaatattagctttattttgggactttttatagaactacccttgtattcaatagcacaggaaaatgttcttgtgagtttcagggtctctttatctcagtacttttatgattctatgaaaattatttattttaaaacttatacttttgttgtaagtatgccacatctgaattgttaaaaaattactttgaataccttaatatttgctgcatttttttctgtaactataacatgacttctttcagaatggaaatatatgtgtgcttcccaatgtttacttttgtgtctgatctctttatatgtccaactgtaatgatgagaataaatgttcaaaattaattctaaaacaaaaaaacatccagaaagcacagatgagagcataagcttgaagcagaaagactgtctttgttcattgagaaggccagagataaggcacaaggccaaggtttctaattgcctgtggaatgctttattttgcagaggtcctgctggaagctttgtacttgactgtggatccttacatgaggtattattttcctctggaaaattcttatgttgtgcattggatactaccttgccatgggcaatcttagaataatccactgtcacttcctcatttctcccagtatgatgtcagtgatgggattcacagatgctcatctttttcaggcaaaagtctgagcagaatggtggtagacaacactggcccctttattttacaagcatcccctatcttattgtgttcaatttgcccctcatcatttatcagaattgcttcccaaaacactaaaagaagaaataagccaaactccagtttttccatgtcactgttggcaaatgatttgggtataggaagatggctgagactaaaattagattttcttgcctttcctttacatatattcttgtaatttaggtaatctgcagctgactgaactgtgtgtacttagtaagcaattcggggtggggagggaataaaagctttcattggccactgagtcaataactttttgcctaggtggacaatgcagtcatcattcttttaaataaatttttttcacagttgattgatagagattcagatctaaagtgaaaaatgtatttccagatgttaactagcatttctttttgcatgtctagtgttttgggtaacaagtgcccagtggtacctgggttatgttttcaaagtcattggtagaaattcagccacaattgagcgtgatggtaagattctcatgttcatttcatagaaaaatactaccagatcaaaactgcctgttacagctttcctccccaattccacctagtggtactgccctcatgtggctggtttcagttttatatacacttccctagtggttttccatttggcttgaaacttaagacaatttcctcccagatgctcctatatattaagaatggttttgttttgtttcagaattatggcaaaaagcttgaaggagggtgacatgatgatgggagagcaagtggccaggtagtgatatccttttgtcccactgcttggaaaatatgtctccccttcacctcctgctgggccctgtttctgtccatcactcttacaacctcttcaggttgcgtgggtcactcactgttcaacttggaaattacctgggaaatctgtccttttcctgactagctgatggggaggaaagaaggcgaacttcttatcattgcaacttagctttgctatccttacttttgagggtttccctggtggctcagatggtaaagcgtctgcctgcaatgagggagacccgggttcgatccctgggttgggaagatcccctggagaaggaaatggcaacccactccagtattcttgcctggaaaatcccatggacagaggaccctgggaggctacagtccatggggtcacaaagagtcagacacaactgagcgacttcactttcttggagaaagaaagtgaaatggggatggggagggaagaaggtgaaattcttatcattgcaacttagctttgctatccttacttttaagtactaaaaaaaaaagtgtattcatgcagttcctgattattataaaaattcaaataagataaaaatttatatattggaaactaaaagttcccccatcatctgaaccttagagatgactgtcgttaatgtattattatttcaaaaattgttcagtacatgtactaatatttataatctttaagggaattaaaagcccttcagcaaattgcttttcctcaatatgtcatggctatcttttgttgacagtgtataaatataccacttacctcttaatggcttgcagattactccattgtttttattgttgttcagtcactaagtcctactctttgcaacccccatggattgtagtcctcctggttcttctgtctgtgggttctcaggtaagaatactggagtgggttgccatttcctactgcaggggatcttcccagatcaggggtcaaaactgcatctcctgcattggcaggcagactctttacttctgagccacttgagaagcccattccattgatacctgacatttaacttatctactcctgataacagctctttccagttttttctactgaaaatagttctgcaaggaatatgcatacatcgatctgagtatgtctctgtattctttgcctacctggatgactattgctttatattgaatc

SEQ ID NO: 32069 - DNA, 2641 bp, Bovine  19866880787120
ctgtggggccacagtccaggtgctctcacagcctgcaagaagcacccatccttccaccctcaccttccacactcaacaagcattcttctggtaacaaggtggtcttccaggcaggtacctgggtcccaggatgcggatgtccccaccagggactccgaaggcccaggctgctcatctcagctgatactgtgcaattagcacctcgggaatatccttatccaccctctcatgtgatcctcacaatagggcaggcctgtggatttcactccatgacaatttcagcaggacctgtcagatgctgggcacctgggcagctgagtcagatcagcttcccgctctcaagaagcacgcttcttcttcccactctcaaggctcagtgacttgtcaaaggctcgagccaagactggagcacgtcctccatctctcaccctaaccaggagccatcctcacatccgaggggctcctggacggcgacaggctgtgctcctcacctgcagttcagcccctggtacattcggatgccgtcggtttccctgagcatcgtcccttccaaggtgagagatgaaacggagtttctgcatctggatccatacaggccactggggcagccagccgggccagcctgggcctcccgccccggcccaccctctccctttgctttcgtttgttgtttagttgctaagtcatgcccgactcttttacaatcccatgttctgtccgtaggatttttcaagcaagaagactgggatgggttgccatttccttcttcaccccctccttttggccataccttaatcccctccctcattcaagcagtgggcatctaagcttaaggttctgggaacctacacggagtgagaggggaggtcacgggccacccagacctctggggtcaggaaagtggcctctgccggggagcagaacagtgaccctgagtgaggcatgtggagaccctgaggttctgacagctgagcacgtgcctccagaagtggtttgggttttgctgtatttcttttatctgaacaaatatgttccgctttctgctaagcagaaagatgcattctgcggaaaacctcttccccagctctgcgaaatgaataacttgtggtcctctgtgggtctcgatgagcctcagtcatgatgctgcgcatagaaacagatgcacaaacctcgactcagcatggagtggccagaacacttaggtaagaagtccgatgttttaaaagctttaaaagctccctttttaccacggactgcaaacagtgcttctgtacaatagagaggaggacttcaatcctctgtccctttctttcccatctctttacacgataaaaaggagaaagaacagcttgtaaacagcatgccagttgcagagaataagtattgttcaacgccttgaaaatgtgcttttcccttgaggcactgcctgtctcagtttattgtcacgcccttttcgctcatacataatgcagcgacatcaatccagtctttgacccacttattaaaaattctgaactgatgaaatctaaatgaaagcactttcttcgtgtataatatatgaacttattattcttatcatttcgtaaatacacacaacagaacacgcactgaatataaaaaatgagatcaacagatttggttccaaaattcctgctctgccacctgttaaacactcaggacagtttccacaacatctccggggcatcagtctcctcgtctatgcagtgtggttagtagccggtaataggtggtggtaatagccaccagccacatggggtggttttgggaagtgagtttatacctggaaagtgccacgcacaaggccaggaagttagaacacatttaccctcgccagtcctcaaagtgttaaaattctacaaccaagatcattatatccatcacctaaacataattcagagaattagaataagttagagaaacactaagcgtagtgttctttctttaaagccccctgtagtcagggaacagctgtaccagtgatttctgagtttacagagtcatgagaaaagagtgtgattttcttgctcttcccacacacctaacaccaacccccgcccccagaccagcactgctaaaatggctgtgggcgaggaattgtaaaatgaagcaagaaactcccctcgaatatttactgaattaattcattagttcacagccactgggagaggaagtgcaatcaacaaaacagaggacgtgctgacactggtttgtttcaggctctgggctgcacttggagcttctctctctctctcgttccctagaaggaaggcttcttagagacagacatgaaggaggaaggagccagaccccacagagctggggaaagaaggttctggacagagggaaccacaagatgaagtgcccagaggtgaggagtttgccaagtgcaaggaatgggactaaggccccagatcttgagggcacagtgggtgggtgggaggagaagcctgccttgaagagctggacacgggtcggggttctactcagggcaagagctcaccttgactcgtgtttttatgtttgtttaagtttttttgttgttgatgtagatcattcttgaaggcttccctcgtggttcagaaggtaaagaatctgcctgcaatgcagtagacctgggttt

SEQ ID NO: 32070 - DNA, 1315 bp, Bovine  19866880887993
ccctgggctcttgagcatgaggcccatccccccactcccggcgagcacaaccctaggctgttcctcttactgctcgtcagtgtccaccctcgagcacagctgccctggagacgcatctggactggttccagctccactatccagtctctaggagcccttcccctctttgggtaccaagaacccttgccttttaaacactcacaacatgatggatcttatgatacaatctttccccagatagtgaagccattaggttgcaccagaggaaactacagttttggcaggttaagaaagatcttggatagtggccatttcctgtgcttcaccatcatacttgctcattctcagaggcaggcgccaagcaatatttcagagacaactgacctttctcatggagggtccctaagaaattcctgggtaaacttctggcaccgctttgtccctgaaaggagagtggaaactcaacagccaccagtcttaactgctcttctttggctctcaaatgtgagcagacatcagaatcacctttaaggctggttaatagcctggttgctgggcccatcctccagagattctgattcagtaggtctggggctaggcctgagaatgagcatttctgacaagttccaaagtgctcctggtccggggatcgcacttgagaagcactgcattatgcccgagatctgcgtgagctgtcggtctgtgctgctggggtcctggggaacttgaaccgaagggatgactgtagaggccattccaggtaggggcagagttcccagttggacctctcagaggcagccagacctgggggtggatgttcattaaaaacaaggctggagaagtgatgccagattgaagagtacttggaggtcaggggaagggttgagattttatcctgcaggtaacaggaagctggggaagtgctttgtggttggttggtttgtatttaaagaagggtttatgcattcaagcaaagtgttccaggaatttagggcctgattaacgcactggagttgggaggctggaagggccctaggggatgctctttagtagaaggatggtggctgggaaaccatcccagggtagaacctgttactgaaccaaactcgggtttgcttgctgcacttgcagcaaagctgatctgttgacactgagttgtggtgaatggaagtacagtgtttttttcaggctaccatgtaaggagaatgggcatctaatgctcaaaagatctaaactgcttgatggctttcagagaagggattttaaaggcaatattaatggatgagggttgatcagctcatgaacaattttcttc

SEQ ID NO: 32071 - DNA, 652 bp, Bovine  19866881053045
gtccgacctgttgctgtttccctcaacaaggcaaccccccccccacggcatgcggataccctgcccggaagccgcctggcgatggctctcacagccgtgagctccactcggagctgaccctgcatttcagggggctcccatcggtctcaatttgaaagagcccaaatgtttctgcttcacatgtagccagaacaagcaacagcagttcctgcctgtggtcggactggatggttattttaaggtgaagccacaatactttgaaagcaatcgcctacatgtcccatttaaaatggaagaatggaatgagagttaaaaaaaaaaaatgtatgggtttcagatgaagacatccaatatgcaaggggagaaaaaaaaaaaggttccattcctgacaagcaggcagatgttggataatcacgttttcacagccaagcagtttcacttatgctaatcactatgaaacagacaaataacctctgctactgggaagccccatgccccgtcattcccaggcccgccacagaaagatgtaagcagcagccacggaaaagaaataaaaaagagcttggaagcaaaagcaaaggcaggaaaaagcacatttggcataagaggcagattccgttaaatttacttacaacagagaacatacagacat

SEQ ID NO: 32072 - DNA, 1264 bp, Bovine  19866881067134
tgctttctctggcagtcaacaatttgtcctttgtcctcaccttttccgcatgaatcaccctagtatcaaccaaactccagtggcttgcaggtccccaaattcctcctgatatccaggaggactgccctgaactgcagttgtgtttctgggtggttgttctcagaagctctcactggccccattgtctgcccgtctcttgtgcaatccacacgaggagcctggcaaagcctgtaggatcatatcagccactaatccatgtgcccctggagactcaggggcacctccctattaaactgtagggtgaggtgctcatcctgggggagaggataagcccagctaaaaggcttggaggagggagcgcagattaaggaggagccagaggtctgggagaaagtggccctggtgtaaacaatactggcaagtggtgtctaagatccactgagcctctcaaatatcctcagatttgaagcaacacaggggcaacacccccatgatcttactgtctttattttgagaagatccagtaagcagataccagtagagcgtatagacatgatttgcaagcattcctgctcatcgtttgttcattcatttgttcagactatttatggaaaaccctctattgtgtcaggaactgcgctaagaaatgggttcataaatgtgacaatgtgttaccctcagtgtgacaaatagcactgacatttggtggtgagttttcaaatttcaaggaaagcaagataagacagaaggagacaagagctgaatattgttgtaaccaggttgtcacatggacttcagtctgccaggctccactgcccatggaattttccaggcaaaatactggagtgggttgccatttccttctccaagggaccttcccgacccaaggattgagcccaggtctcctatgttgcaggtagatactttaccgtctgagccaccaaggaagcccagttatcaccatgcccaattcaatgtaataaatagccttcctttggctgatttgtttcatggatacttggtttttcaatgtgatgggaggtaggggatggggttagaattgaggctgacctttattcccagggactcattctcggcttttctcaacacattattaagtagttattggggtgttgtcttaagaaaatcaccaggttttaagatgacatttttttttccagttcccagaaattattaaacttgcttatgtcagactggaggttgtctctccgttttccccctgcctccttcatgtccatcctaa

SEQ ID NO: 32073 - DNA, 1376 bp, Bovine  19866881129851
catgtgaggccaaagttaatggcccctcctctctttcctaatgtacttaaatcagacactgagctgtctcgaggcagaataaggtttctcttttcagggtgcccgtgagagtcctctgaagttagtctgttttaaatttaagacacagggacgtccctggtggtccaggggctaagaggtcctggtggtcagaggtcccagtgcaaggggccctgggttcaatccctgctcagggaactagaccccacacgtggtaactaagaattcacgtgtcacaactcaaagatcccacgtgccacaactgagacctggaacagccacgtaaattaaatatttgaattttaaacaaataaatatttgaacttaaagaagtaagtgaatttaagacacagacagacacagacgtcccgttaccgacctgggtgtgagtgacatcattcggatgccgatatacttcttcttggtgatggctttgcctggtgggaccacagaaggaagcagaaggtcagcccagttggcggctgtgccggggacaccaggagcagtggggttccatccccccagtttgttgtgtagtcagggccatacagggatgctctcagcttgtggttcaaatcctgattgggaccctacctgcctcctctctcccccaggtagaaggtaaacagcacacctgacagggaccctgttgagcttcaaacccccagcctgacattgagcagaagagtcactaaacatttgtggactgaatgagctccttgaatctcagttttctcatcagtaaaatgggactaagtcccacctgatcaggcaaagggattgaatgacataatgaataatacagtgaaatgatgtacagaaatcacccaggatcatgcctggtacataatagactgaaccatatgaaacacgcatgatcataggccaaaaaaacagtcaaacattgatgacctaatgacatgcattcctttcccttcttgataggaaaggtgtggctgaccttcagggggtcattttccctgccctccagtttctgaggggtagccaagccccaggcctaaaatctctggtgggctgccggggatgtttgctttacctttggcttgtcggtcatgggattccgttaggaactttttaatcttatcagatggaattgcaaaggagattccagctgtcactttcagtgtgttaattccaatcacttcaccatcctgaaaagcaaaaggcaaatagcttgctgaatccaggaagattcaccccaagatacccaccgagagagagtggagaatttgcacggaaggagtcttggagcttcttcagagatatgactggggtaggaggagccggacggatggggcttactgcgtcgcagagcg

SEQ ID NO: 32074 - DNA, 1102 bp, Bovine  19866881143159
ggtcaagaatgtagctttcaatggacaaacaggaaaacatccccaagggagaagagcttatcttcttgtaggactgtattcagtgacactctaaagtgtctcagaaagagctctgacgttttgcttatggcagcagtttaggtgggagcttcggagactgggggaaaaaaaggaaggcgctctttacttgcgaaacagttcgatgtgaaccacggcaggagctatcttctccacgacatcggcaataaagttgtatttatggcgcagactgttgggatcttcctgacctaagaagagaaacaaaggcaagacacttaaagatcctgtgctctgtgctgtgggtcagaaaaaccaaaaaaggagggtgaagacaagaccccagacctgggctcagagacaaagatctttcccgcacttgaagaaatgcccactcagatgcacgtgcgtgtgtgccaagtcacttgagtcgtgtctgactcctggcgatcccatggactatagcccaccagtctcctttggccatgggattctccaggcaagaatactggagtgggttgccatgcccttcttcaggggatcttgccagcctggggatcgaacccatatctcctacggctcctgcattgcaggtggattcattaccactgagccaccagggaagccccagatgagacagcaacacccaccaaagatgacctgtttgcttggcttccttggtctcaactgtttcatcacgaaaatgttgacccagaggcatcagcagatacctgggcctcctttattattcccaacagcgggtggcccaagggtcaccttgacatggcaccgtccaccagtgtcccttccccgactcccccagaaccacacagcagccctcctcagcataccaccactgtcgaggggagctccgggttgaagctgtttctgatgagatgcccatcagatgttagagatttaagaggctactatgaataagcactaaggcaaaggcacagatagggtcttcccctctgtctgtccccaaagcaattttccattaatcattaattaatcattcactcctcccaccccaggacatcccaggccaaaagatgccttgatt

SEQ ID NO: 32075 - DNA, 791 bp, Bovine  19866881143763
aaaaaggaaattaagcacctatttcatgatctgctgaggtgttaattgtgaaagaaagccagtgcgtgtgttttcccgagtacctgttacgacacattcacgtggcccatttgtttcttggatgtggacaaacatttccgtcctgtctcgctgcattttccctgcggtctgctcattccccgcccctccggcaggaggagctagagtttgccatcatgcggatagaagccctgaagctggccaggcagatcgccctggctgcccgtagccgccaggacaccaaggtaccggtttgctgctgctgtgtgctgcctcttgagaatgttgtgtggtccagaagcttctttgctaaccgcagccaggcccggtgttcaacaaagaatatctccaaaaagctaaaggcatagctcatgcataagtacacgctgagtgcatgtcttaagatctggtccactcagttagggaggaaccaagcagggtgggtggtaaagctggttgaatggaggaaagtacgagaaactcatgtacagtcagaggagggaggaaactggaatcagatcgcaaagttagatataaaactggttagttctattcatagttaaacaggacagataaatcctaacctttgaagttcttttttcttcctacagaaatcatttgcttctctgttgatgaaaagtaatttgtagcttttctgttttctatagttattatagaataatagtaatgattatactgagaccagaccctaataaataggtgaaatagtaaataggtgaaaacaagacctt

SEQ ID NO: 32076 - DNA, 1671 bp, Bovine  19866881168281
acttggatgacgcaagccttccggtcagtgacgtgtgaggtggaagctcgtggagcctgacccgcctcatcagccctcagtgtccttttcacaaggcttctcgccaaagatgataaaggggaagtgggttttaatgcgtagaatatcctgcctcgtcgctgtcttctttataagctggtaagccaggaagctagcaagtggccaaactaaatgtaatttctttaaaagaaagaaaaagaaagaaaaatgccctgttagtatcaactgtctgaagctttgttctcattgggatgataacagtgtgtgtgtgtgtgtgagagagacactttttcctagtgaatttgacggtttagccgcttcacaatttaaaacatgaaaaatgcttataattactttggttgttttaaaaatgctactgtgacttcctattagatgttcagtctctacacattcttactggttaatattattgactgaaatattgccagacaaagatgtctaaactcgtgatgtctgtggtgctgtaaaatttatactacagtgtggacagttttgaaacgataaccatttttgttgctctggatctcaaggtgagcagtgcattttgcatagagagggtattattgaactgttagtgagggttgtgggttgtactgttggagaaaaggggagagttagaattcagataggtagatcttggacatttgtttgtaaaatcttagtcaagatgtgcagcacagtcattgctttttattcagtgaaaattatttggtatgaaatttcttggaggcctgattttcttgtcaaaatgttgtaaatagttcttctatatttgaatcagtggaagacctcgtttatatgtaaagatactgccctcagtcatgtggttgtagcctctgctttttgtcactagtaacctgtattcaagtgttcatcttgtttaggaatgttttgagattaatgtgcgtaaaagtcctatgtgattggttttaaacaattgggataaaattaatttttagtagcataagttaatgtgctaaatagcataccattttgtgttagagatactagaatgttgttattctactgtctgtgcaatacatgttttaagcacaaatttgagtatacatttaatcatggggatgtcaaaaacataagctcctctctaaaaaacatcgttagtttcaggtgttgaataacagaccagtttgaccaagtactgtttctacggttcagtcttaaacattcgctttaagaaaatagtcttgaatttcatatgctgctattttttatgatattttgccatattacagtactgttttgttttgaattcatacatgtcgctgtttctccttttcattttctcagaagactttttgtttgagagcgagaaagtgggagtggatttcttaaatcagagtgtggtccagaggttactatctgttacactagaattatcatagcatcagtttaaaaatccaaatgcataaagaatgcaccactcaacatttttattcataagctattatttttgaaacttatatttagatttttcttctttttttgcagctacatttgaaaatggtagaatgaaaaggtgttaagttgttattttctctgcagatgcatccatttcgtcggctcttttagaaagctcttttctcatgagca

SEQ ID NO: 32077 - DNA, 1495 bp, Bovine  19866881171280
ccaaataaataaataaggaaccattaaaaaataataataaaaaggaaacttcaacagtaaaaaaaaaaacctgatttttttacattggaatttgacattagaatcagggatggaagagaagccctgtgggagccccgttgttcttaatggttaatccaggtgttctttctcccaagcagcaaagccaaagagttgaaggatcgccaccgagacttccccgacgtgctttcaggagcgtatatcattgaagtaattcctgatacccccgcagaagcgtgagttagaatccctctccattttcctgataatcgtgtctttcctggaggtagggggcagggaactgttcttttcgtctcccctcaggtggctgtaaggacccttgacagaatggtccaacatctgtgtccgtcctgccggtcagggcttccgacctggctcagctcagggctcgtcggcaggaggaggcttcctggctagacgtcctcttcaggagggaatcagatggatttgttaggagtctccgggaaaaacctggctagatggggaaagacggttgaaggagcagtgtctctgagacctcaggcagtgatcctggcctaggctgctagaggcatctcttcctgagggcttctctaattatgcctgttaccagtcaggccttacttatccacacctctagaaaaatagcacagggagcatcaaagtaacagggaaagaagttgctcaacccacagtcaggttcattacctgtgaaagtgttagtcgctcggttgagtcagactctttgcagtcccatagcctatgtggacataatatccacggagacgcgctagaccagggagtggccagcagactgttcgcagaagccagatctggtctgctgcctgctttggggttaagattagattttgcatttttattttattttttgttttaaaatgcatttattttttattgaaggataattactttacagaaagattttgcatttttaaatggttgaaataatttaattaagaacagttattttaggacacttaaaaatgatacgaaattcaaattttagtgttacgtaaatgaaatcttactggggcacggccatgcccagcagattatatattgtttgtggtggcttttggactcccacgtaacagttgggttgttgttatggggaccatctggactgcaaagactaaaatacttcctctctggccatttaccagaaaactttgctgacccctgtcctaggccactaaggtgcataacagcttatttgatgctgtcacacacaagagttaaggttacagcagcaataaggcaaagcggtgcctcagtggaaccatacctgtgggcaccgtagagctgtaatacccatgacaagcaagctggccaccgcggtcgctggcgtgtcctcacttcctttggagtcagtctgtgataagatcatacaaatgcccgcacacatttctacagtggacatgattgctgatgtggc

SEQ ID NO: 32078 - DNA, 975 bp, Bovine  19866881176311
agaatatggaaagctcccaattcctggtgtctcggtaaagaatctgcctgcaatacaggagaccagagttcagtccctgggtggggaagatcccctgtagaagggagtggctacccacgccaatactcttgcctggagagttccatgtacagaagcgggctacagttcatggtgtcacaaaaagtcagacacaactaagtgactaacactttcactttcaaatcttagaaagactttagagacccatccagccaactctcttcattttaaaagtgaaggattcatatagcccaaaatacttacccgagatcatccgtccagggccaaagataaaacagagatccaaatgtactggctcccaattctgtgctcttcctactgtttaccactgtctctgttcaacacattctggatttcatccttgctatatttcagtcctcttattggtttattttaggtttaactgataaaagaataacatgtcagaagtgttaagactgatgggtgtcattacttacatttataaatcacctgacgaatataccagctctcctaggatgtagctggtatgtcagatatgaggatgattgtaatcacttggctttatgattatggtatgttttagaaaatgcagtaatccttgctgatgtatttttgcttatctcagaaagtgaaacttttgttgtaatggtacacatcagactgtaatcagtgttacaaaatcaatattctatggagaatgaaaaaataaagcactacctggaggcttttgctactttaataaagcaaaattgtttgttatgcatacagaagtaagaaaacaatgtactcttcccgcaagacagacactgtacctttgcttaccaagctggtagcttgcctgtcatgtaagctgattttgtttgtccccagggaagagaccaattttaaattcatgatgctaaataagatttttaccagatgatcatccccctc

SEQ ID NO: 32079 - DNA, 3646 bp, Bovine  19866881225754
ctggacctggctctggaatgatgagctatagggtctatccattaaggagtccccaagcgtctagtcaaggctgtggtttttccagtggtcatgtatggatgtgagagttggactgtgaagaaagctgagcactgaagaattgatgcttttgaactgtggtgttggagaagactcttgagagtcccttggactgcaaggagatccaaccagtccattctaaaggcgatcagtcctgggtgttcactggaaggactgatgctgaagctgaaactctaatactttggccatctcatgagaagagttgactcattggaaaagactctgatgctgggagggattgggggcaagaggagaaggggacaacagaggatgagatggctggatggcaccaccgactcaatggacatgagtttgagtaaactccaggagttggtgatggacagggaggccttggcgtgctgcgattcatggagtctcaaagagttggatatgactgagcaactgaactgaactgaagcctctaatgtggtgagtctagggttcaaaggaggcaagatgtaaagtgagccatcttggtggagggaaggaggattcttgaaagtcagactttacctttcagcaccctggacagtaacaggtcccgggcggtgggctgtgacggaggcagccgtggagaggagctgcctgcccattcacatataggctcaacatacgctcagtcgctcagttgtggctgactctttgcgaccccatggcctttagcctgccaggctcctctgtccatggaatttttcaggcaagaatactggagtgggttgccatttcctcctccaggggatcttcctgactcagggatggaacctgcatctcctgcattggcaggtgggttctttaccactagcgccacctgggaagcccatcactgctttacttcaattgcccacgagaccctcttagtggaaaaagctagcagtgatacagcagggcctttctgctaattgtaggggagcttttaaaactgaagcccatgcttctgctaataggagaatcccttaaattagaaaactattctttttttttcaaggccaaaagcctacttgaagcttcctacctgactctcttctgccctggggtatcgcattgaacagagcataaaagccagtgttggtgatcctggaatcacttcggaacaccacagtcaggatgtcagaggaggagaaaaacatcacagccgctgaggcacagaacttccccatggagagtgaggcgatcctggggccatcgaagatttcgactgagtcgtacgggcatccaaggatatcttccagtctaggggaatcacagcggaggcttaacagctggttagggcttcctagattttttttaaaattgcttacttaggtttatttttgtttatttatcttttggttgggctatgtgacatgctggatcttagttcccctgatcagggatcaaatctgtgccccctgcaatggaagcagattgttaaccactgggccaccagggaagtcccagggcttcctagatcttaaagcttgaaaaatatgacacacacagaattaaccatttggattatactttgaattgcatattaatacataaaatgtcagttaacctcagatgccttattagcaaaacttcttttatctctttctgaagaatgtgtgaggcttatggccgcaactcagtaatagaaacttagaaatcatactgattttagccaatcacaacttacacgaaacctcgggagatgcaaatgtacaccacacataaaatcttaacaataaagtcatcccaactgatcaacatgtaagtgacatcacagcccaattttcctaactctgtatttcacaacattcttcatacccaaattcttagggaggaaaaacttgattctgaaataaaaacaatgtcagcatgtggaacagtatttgcactttgtaattattcacagggatgtgtatgagggctgattggctgttgttgctgttgttggccccgccacatggcacgtgggatcttatagttccccagccagggatcgaacttgggccccctgcattgggagcacagaggcttaaccactggaccaccagggaagtcctgagggctgattctgaagaaatggataactgataacatgataggttttagaagtgtgggttcaaggttctcacctcattgtgggctgtgtctttagggtttcagttgacaaagataatagaatattctttgtgataggccatgtctgagtccatgggctgggcaacagtggagtgcatgtgaaaggggggctttcatagcatttcacagtattgctgtgtttgttgcatggtgcgtgtcatagtcaacaaggagaagggctttgcacagacttctccttacagctctgtacactggtgaagagcggggcctttgacatccaatggacctagaagcttggcctttggtgagtaacctctctgtctcagcttcttagtctttaactgggatgataaggacatctttattagggctatagtgacgctgtaatgtgacaaagcatatagaatacacagtacagagcctgagcacactaaaaatgtcagtttttattttatgaactgataataaaagaatggcagtgacttggaagagtttttttatgtcagagatgaagcaatgactaccatctcacttcattttaagccaacatatacaggatgcagggctcatggctggagtagttgcctaaagtgtgtgtaggtaaagccttttactgtttgcttaaaactcatattaaagaaaaagtctaagaggataaatactggtacccagtgtacaatgagggcaaagctgaaaaggacaatcttttaaaataaatttaaaaaactcctcatagtaacgttaagtcaaatacgtgaattaaaccacttattgaatttttcaaggcaatattcttatttaggtagactcttaaagggggcttcccaggtggtgctagtgataaagaacctgcctgccaattctggagacttaagagacatgggtttgatccctgggttcagaagaccccctggaggagggcttggcaacccattccagtatccttgcctggagaatcccatggacagagaagcctggtgggctatagtccatggggtcacaaagagtcggacatgactgaggtgacatagcatgcatgcacttcttgtaaagagttgttttcttacttcagagttggaatcatgagttctatgcggaacttcttatccacgtggatctcccacacgcactggatgtctgttgggtagttttctggatacagtggactggaaaatgagccagagagactagaaatgacccctccacaagagttcctttctcctgaaacagcaagaaaaaggatgtcaggatatgtccccatggcgtcacttacgtcatcccactaaggacctggtggagtcaggctgtagtctgaataaatagatctgtagcctaagcatcttctgggaaggagagcctattcagtctaattgtgatgggtcagaatgcattcgagaaggaaatggcaacccactcaagtattcttgcctggagaatcccagaggagcctggtgggcttgctgtctatggggtcgcacag

SEQ ID NO: 32080 - DNA, 680 bp, Bovine  19866881286188
ttctaacttttgcttcctgacctgcatacaaatttctcaagaggcaggtcaagtggtctggtattcccatctctttcagaattttccacagtttattgtgatccgcacagcaactttcaaatacataatacagtcttattaactataatagtcaccatgctgtacatcacatccccaggaattattttataattgaaaatctgtatccataatagttcttacaatgtgactttaattcattaaaagaagcttcactggatagatgtgatgagttagtacctcttgcctcctgcagacctgcccctgcgcctggtgggcgggcgcggccgctgcgagggccgggtggaggtccggcacgagggcgtgtggggcacggtgtgcgacgaccactggagcatcagagacgcccgtgtggtgtgccgcgtcctgggctgcgggcacgcgctgggcgccctgggtcgcggccgcttcggcctgggttcggggcccatcctgctggacgacgtgcactgtgcgggcaccgaggatgcgctggagcgctgcgcccacgcgggctgggagcgccacgactgccagcactgggaggacgcgagcgtggtctgcgcaggtacccgggctcccctgccacgccggcccctccccggggtcttcctaaggctccacccgttctttcctctcca

SEQ ID NO: 32081 - DNA, 1103 bp, Bovine  19866881375816
ggctccaggtctgaaggttatccccgctcgatgttgtaaagtccaagttgtaagtcccactgctggctatcggcttgtcttcatcgaagacggcggagaaggagtgtgacgggggatggaaaggactgccttccacggagctgctgcgggggccatcggggatggagaccggctcagagccgcatcctgaaggaacggagacaaagccatcactgaaagacacaggacacttaagagagtccctcatctcgtgccagaccatcattaccctctaacaccagagccccaggccagcctgcccaccccacaacaagcacgctgcttgggtacaaatcctgctctcaccaggcagctccaggccctggacaagcagaccctcagctttctcatccataaaatgggagcaataagagctgtttaaaggatacctttaaatactgtcatctaaaacacatttacctggacttccccaggggtccagtggctaacactctgcattcccagtggaggcggcccagggttcgacccctggccggggaactagactccacatgctgcaactaaagagccctcctgctgcaactttaaaaaaagcagaagaagaaaaaaaaaaaaacccatatgccaaaactaaaaatgcaatgaacatcgatgatcctgtgtgccacaactaaggcctgaaacagccaaaaaataaatattaaaaaaatttaaaacacgtttaccaagcgccaggtcaaagcaaggcaccactctgggcgttggggcctccataatgaacaaaacccttgccctcctgcaagttaggttctttaaggagaagacagtcaagaagcaattaacaagtaacatgtatgggctgtcagatggtggtaagtgctaaggaaaaaaagaaagtcagggtaggagtgttgcaattttaaaataaggtagttgggcaaagcccttcaaggagaaaacatttaagccaagatgagaaacaaggtaaaagtgtgaaccatggggatatctgggggggtaagcatccaaggccaaggaaacagcaagtgcaaaggccctggggtgagtccacacacagggtgttgcagaaatcccaaaggcca

SEQ ID NO: 32082 - DNA, 1437 bp, Bovine  19866881490437
cttcatatcctctggcccacacacctccttccctttgccctctaccaccaatgtcatcctcctgaaatgtgctccctcctgaccccagtcatcacgtgcagcctgccacgtggggccatacctggttttgagtttgtagccaagaatatgctctgccttgtgattgggctcccaatgaacacattttatttctcagctaagaaaaaaatgctggggcatttttcgtgtcctcatctttgcatcctgggaaatccttgagcagggtacctgactagcaggttttcagtaagtactgtggactggattcatgggtgaatgtaggctccagagacagaactcttttgaacacagtgagggatgttgggatcgatgcagtgaagatgttgttggggaatcaggttgctggtaagtggtgtgtgttttcctttcagctggagaatgggggcgacatggcccacgtgaaagacctaagcacccaggcggtgagattcgggctgctttttaaccaggtactgaccaccaggctgagcaaggggaaggaccatcccacctcgtgcttggttagagacctttgtacaatgaccgtggtcaattattacctgtggcaagatggccaaggcagaaaaggaacttgtaggtgtcgctcttgaacactcaccatctgctcaggggtaaaattcacaagacagggccctgggataggccattcagtaacttgatatacacagctacagcaccccatgaggttgaccagctgtctcagttttcaggattggagtcatttccctggggatgtggaactttctgttctaaagtcaggaaagacctgggcaacctgggatgagttggtcatcctcttcaccacaaatatggtgagctgccaaccgctcaagaagagattccactccaagcccgtggttaaggttgccaaggtggctaatctgggcagctattttgttggagcccagactcgaaccagctgtgagtcgtgagctcagctgcagagcacccgggggctcaactgccggaggagcccaaggggccagcagctgcactgtctcgggctccctggataggcgtggctctccaggaaatgactgcaaccctccctcttcactaaagccactaagaagtgacctcaaaagagttcatattttaggggtttggggtcctgaatctatcatcagatactgcccctgggtcaagcctggaagggctgggtccagccccttgcttgcagagatctgtccaagtggacagactgcagacagcagtggccaggacaccctgtaatgctgtgggcatggagggtctcttaggcccactgaattgtagcaaaacactctgttttaaaggtctgcagactgagggtcatccaagaacgtgcttaactccttcttctccccactaaggggcatgtagagtaaaaatacagcc

SEQ ID NO: 32083 - DNA, 768 bp, Bovine  19866881810963
ctgaaggtctaaactgaaatagtttagactggagcttttaaaagctgtaaatgatagaaaaactaccacttgcccatggagtcatgaggtagcaagagggaagatccaacaaagcatggttgaaagcagtcgatgctgaaaaatataatcgtcttaagtctggttctcaccaagctcagactgctcaatgacctgaggacacatggaacagcatcactgccctcaactaatgagagcaacacctgatgtggaaattcccaagggggatttactgtacccggtaagacgctacattagaagtcctctgagagtgcttccaattctaagcgtttgtgactctcctttcttcaaaaagaggttaaacttcttgaatccagaatccagatttcaatagttaaactattaaaggcgaggttgtccaacagagtaaaaccgcaactttttgaacaataaaactctcagattgataagtctgataagagtttcatgaaggaaaaaatatttgacttcaatatttttaaaactctcatgacttaaatagatttaagtgttaaaaaaatcctaaatgactttgattttcttttatattcaacagaaattccagttcaaagaatgtttacaatataaaatcctcaaaataccatcttcctgaatcaaagcaactcagctaatcaaaggcttaccaaaataaacagcaaacacatgtttgcttaaatatcttctaggaattacaaactcacatgttctttatcatacagcagctactag

SEQ ID NO: 32084 - DNA, 908 bp, Bovine  19866881917166
gggctgatccctcttcctctcccctggggctgtgggctctagatccttccttgggacttcactctctaccacgcctgcggtcgggcttgccccaatcctatactcacccccctctgtctcttggcctcaaggtttcagagcaaatctgtgctgacaggttcaagatgtgctgagaccctgagctggctggcctccagtatccatcccacgttttttttggcgtgcggcggcagcttgcacttgacctgccctgattatcttgggtgggagggacgttagtcctcagctgggaagggaggtcacgcctgacctcggtttcctgcacggcccggtgaatacgagcggcccccagtgcctggcattctgtgacatccgtgcgtttacccattttgttcacttaacccaacgcagcaacgccaactttgtgtttccagggaaagctgcctgtgctactgcttggccgctcctcggagctgcggccgggagagttcgtggtcgccattggaagcccgttttcccttcaaaacacggtcaccacggggatcgtcagcaccacccagcgtggtggcaaagaactggggctccggaactcggacatggactacatccagacagacgccatcatcaacgtgagcctgtgtgccgcagggttgggctgcagttgggaagctgggctggggtcaggaaccgggctggactcaggatcctcatggtgcttccaatggggtccttttgaacccctaaagcagacaaggcagaagggctggtcctcagcctgttggcagtctccagggactcctgtgacgggcacttgagatttgcccaagtctgcagcccggaggagttctccatcccctcggtgccctgccccagggtcagccacccctgggtcgagctgcctgtgcaac

SEQ ID NO: 32085 - DNA, 1768 bp, Bovine  19866880282614
ttcagcaatacgtgaaccgtgaacttccgatgttcaagctggttttcgaaaaggcagaggaaccagagaccgaattgccaacatccactggatcatcgaaaaagcaagagttccagaaaaacatctgtttctgctttattgactatgccaaagcctttgactgtgtggatcacaataaactgtggaaaattctgaaagagatgggaataccagaccacctgacttgcctcttgagaaacctatatgcaggtcagaaagcaacaggtagaactggacatggaacaacagattagttccaaataggaaaaggagtacgtcaaggctgaatattgtcaccctgcttatttaacttctatgcagagtacatcatgagaaacgctgggctggaggaagcacaagctggaatcaagattgccaggagaaatatcaataacctcagatacgcagatgacaccacccttatggcagaaagtgaagaactaaaaagcctcttgataaaagtgaaaaagttggcttaatgctcaacattcagaaaactaagatcatggcatccggtcccatcacttcatggcaaatagatggggaaacagtggacacagtgtcagactttattttttggggctccaaaatcaccacagatggtaactgcagccatgaaattaaaagatgcttgatccttggagggaaagttatgactaagctagacagcatattaaaaagcagagacaaaaaaaaaaaaaaaaagcagagacattactttgccaacaaaggtccgtctagtcaaggctatggtttttccagtggtcatgtatggatattagagttggactataaagaaggctgagcgccaaagaattgatgcttttgaactgtggtgttggagaagcctcttgagagtcccttggactgcaaggagatccaaccagtccatcctaaaggagatcagtcctgggtgttcattggaaggactgatgttgaagctgaaactccaatactttggccacctgatgtgaagagctgactcactggaaaagaccctgatgctgggaaagactgagggcaggaggagaaggggataacaggatgaagtgattggatggcatcaccgacttaatggatgtgaattgggtgactccaagagttggtgatgtagagggtggcctggcatgctgcggttcatggagtcgcaaagagtcggacacaactgagtgactgaactgaactgaactgataagcagtctactaatatttcatataaattatatatttattttattacataaatatataaaaaagcatactgaatcctctccccaagtgtgacataagcttctaaccaataaaagtatatttaactcctacatttttctttttttattgtaaagagctttttattgtttcctatgtgctgtgagaggtgataggcttagaaataagaacaatcagcctgagagtccagtcattatgtattcacaagacttgcatttgaaattaaaggcagagggttgtgccattacatcttcatgacaagatgctaggaagattctcaaatcagaataaaaaaatagaagaggttattcagagaaaaataaccccactcatttgtatgtttctgatatagcatactattattaaaaagatgctaatcacctataatactaaaagatagcaaattaacaaatcttgacaaacaaggtaaaaaaaatgaagtggaaaatagtaaatatggaaagataaaagaaaggaatgattcttagacaaagtatcg

SEQ ID NO: 32086 - DNA, 6855 bp, Bovine  19866880437438
atttctccctttgactttgttatttgtgaatgaaatttacatatattttataaattagtcagctaactttttggttctctaaaatggaggaataaatatcaaattgagccaggcaaaccttgcttgagttctgaattttgagacttaccctcttggcaagtacttaaactctgatcctcaagtgtacttaagtattttaattgaaaatgtatgaaagttttctttctgttcaatcataggtctgtccttctgttggttcagaatgttatgattatgaagtttttatactaaagtttttatacacacacacacctgtacagctccaatgatttcctgattatactttcttgatcctgtcccctccagtcccctgttgataaccactgtcctaagttttacttacatctcttgctttctttatagttttaccacttattcatatttagttatgagtgtatttgttgctgttgttcacttgctaagtagcgtctgactctttacaatcccctggactgcagcgtgccaggcttctctgtccttcagtatctcccggagtttgctcagatttgtttccattgagttgatgatgccattcaaccatctcatcctctgtcaccgccttttcctcttgccccccctcaatctttcccagcatcagggtcttttccagtgggttggctcttggcattaggtggccaaagttattggagcttcagcatcagtcattccaatgaatattcagggttgatttcttttaggattgactggtttgatctccttagtgtccaagggactctcaagagtcttctcccatcaccacagattgaaagcatcaattcttggacacttagtctcctttatggtccaactctcacatcatacgtgactactggaaaaagcatagctttgactatatggacctttgtcagcaaagtgatgtctctgctttttactatgatgtctaggtttgtcatatgaatatgtaagtggagtcacatagaacaggggtcccctaccccaggggtgcagatggatcacacatcaggaggtcagcagcagtcctgcgagctgaacttcatctgtcactctgccatagctctcattaccccctcaatcatccccccaactctggcttttgctttgtttatttcatgatgactcctgattgtctctctgttgttttttttttttcaggaaggtaagtgaggttctcttgggatcataggtttgaaatgatcatacactcaatagttatcgcatgataataacttgtcataagtgagactatattcattatttcttaaggctttcactttgtggcataggatgtaagtaagtaaaggtatttctggaggagtggtctcgaaatgaaagttttggaaaggtgaattatgaaaccactgaaggagaccctcttcttggttttgcagtcatatacaatttgtgacagcagtcaacttggagatggatggctgcattaaagtttctgaatgagaattgttataaagcaaggaatatgtgtaaatgtcttgttgtgcatgacaaaaatattgctagttgtttatattttccattatgtgatctttttttaaatgaaagaacctaaaatattcatcacattttttatttatttttggttattttagtaatgtgagcctgtggtatttttcatccacaaggattctgtaaatgtgaaataaatcagccagactggagttaggataaattggtaatatacaaactcaaggttttatgctgagagcactattgaaggagagaaattgaggtgtaagttgggtaatatgaaagaaaaattagttgagaagctttgggataagctttgaggatttgctgattttgactgttttctttcttgtcttctaactcacagcctaagaatgcattttatcctgtccagactatctcgtattccacttttgctcccctcctacacttaccctgactcttcctctgttttctgttctcagtgttgcctttgtgtgttagatttggcttctattgtacccggattccagctaggaggaatttcgtacctctgcatttttagaagggactacattaaactttagtacaagtgggttgtgcgcttggtggtgattaggttgtggtgcctgccctgtaggagtgtacagtctattttaggagtcacacattcacaaataagggcacccacataatatgaataagttacaatacagtagtctgccctatccacagggtgtatgtcccaagaccatcagggcatgcctgaaacttcaaatagtactgaaccctgcatatagtgttgtttttttttttctcccacatacatatatacctgtggtaaagtttaacttataaataaggcacagtaagagaatatttgaactgccagcatcattactcttgtgttttggggccattattaagtaaaatgaggcttacatgaatacaagcattgcagtacctcaccatccatctcatgataacctggatggctactgagtgcctgaagggtggggtgcactggccaatggcatgtcatctcttggggcaggatggggcaggatggggcaggatggagcaggatggcacgggaaggcccaggatttcgttatactactcagagtggcgtgcagtttaaaacttgtgaactgtttatttctggaatgttccatttcatgtttttggactgcagttgactctgggtaactgaagttgcaaaaggtgaaactgtgggtaggtgggactcctgtttatatttttaaatgatagcttctgctttcaacagctttttttgttgttgttgttttgaggttttgatcctaattttattgtaaatttctacaagcaaaacctgacttattcaactttgagcctccaacagttctttgataactgctcaaagataattagtgttggaagctaactttttctaggtcctgaattatatctcaacaaacacaaaaggtagaaaacaagcctcttttcttggtcctttgtgagaagccactcattctcggaatccttgatgatgctttggtattttaagtgtatagttcagtgatttttaataaatacgtagggttgtgcaagctctacaccagtcagttctagaatatttccagtgctcctaaagatctctcatgcccgtgagtttcatggaatgtaaatcacaacctcaataaaactgtaataaagagtgaattagaaagaaaaaagatcctttaagcaggttttcatttgaacactttctttttaagttttaaaattacttttaattcacatatagtaaaaagggtgtatgtttttttaaaaaattattgaagtatagttgattgacagtattttatttcttctttactataaagtgattcagttgcacacatatatattcctttgcatattcttttccgttctgattgctcacaggatatggaatatagtttcctgtgctgtacagggggaccttgttgtttatcagtctcctatataatagttaagctctactgatcccaaactcccattccttccgtcccttcccatcctcctcccccttggcaaccgcaagtctgttctcttatgtctgtgagtctgtttttatagatacattgatttgtattgtattgtagattccacatgtaagttatatcatgtgatatttgtctttttctttctgactttaatctctgggtccatccatgttgctgcagatggcatgcatatgttttgatgactgagtaatacatgagttgtgtgtgtatgtgtgtgtgtgtgtatacacaccgcatcttcttatccattcatctgttgatggacatttaggttgttcccatatctagccaagtgatactcttggctattataaacagcgctactatgaatacaatgatgcatgtatctttttgaagtatagtttcgtctgggtatatgcccaggagtcggactgtgggatcatagggctactcgagttttctgaggaatctctatactgttttccctagtggttgagccaatttacattgccaccaactgaacacttttgtctttatgttcagaaagatatccaggtttatgttaagaaagatacctatgtttcatatagtctatagggaaaaaccatgattgattaataatgtttcatggttgtgttaaggattaattcaagcatttgagtgatttttttttttcccttttagtcacctgtgttaagccagatacagattctacaaaaaaagtgtgagacaacatttacaaggagtaataagctaggttttcagcttgcctatgtatagagtacagttaggtaggagtgaattggctaaagagtagttgggtgattgcattctcctaaatgtgcactcatagtatttgctactattctgtgcaagtctcagaagatggacgaggagatagtctttagaaatctgttaattttaggggatactgaggaacacctttaagtaatggcatactgcagtactaaagggctgtgtctcctgatttggtcatctcttggtgggcttctgatttcccctaaacagcactcagcattttattttttattattattatgtatttatttattatttataagcattatttattttactttttataaaatttatgtttaatggaaggataattgctttgcagtattgcattggtttctaccaaacatcaccatgaatcagccataggttcacccacgtcccctcccacttgaatattcctccctcagcgttttaaatgcaggcgtccttcacactcatttacttgagataccccctttatcccatacgttgtacttagtggggggatcaaaaatgtcttgtgtgaacgagctctcaggagacataacaacccaactggcacgggaaagaaaacaggcctgggcacagactgggaaggggtgtgggtagagtacacagaggggccaccatctcagtacatcaccctcgtctagggaaaggtcccacaaatgttttaattttatcttgtggaagagatagtgttgagaataccctaccttaaaggtttacccaagagcactagcacatttttcttcttttataagctgtaagatccatatagacctatgagatgctttggggaggtaatcagtgagcctttatatccattacattgctgtaaaattgcccgcctttctttctggttcctaaggtcatatatattctgtgagaatcaggtcagtggtgtgtaaaagatatactatattgacagctggaggagcagttacgtataaattgcattaggaaatttctcataagccctagctagataagatttaataattttatgaaggattgcttctagaaaatgaatgagtgccgtagtcctgatccttgttgattatcttctactgcagcgagagagtgtgtttggcctttggtaatgtaggggctattgacatttgagagattaatgtgcagctttgtagctggcaagtgtgaatgtcagaaattgagtatcttaacttacattaaggagtttttcatgttgcctttcgaatgctcattcttccagtgtgagcaaattcttttttccgtgagttcaggttggtttttagaagagaaacgaagaggtcctgttgttagtagagaaagctgcgtcgttttggcagagaggaaagtccttagatgtgaattaagggacttgctgagcttcatggactaactttcctttttttcttaaacggatatatgtttctggtgaggcaggggagtcttggccacatcctgtgatctgtttttatctagaatatattacagatagggagacatgcgtgactcagaagcatcttggttcttagcagcctttagctgtcttttaagtcagtgacagtgctttattacttttacttttctttggcctacaattgaaaaaaatttatttggaaatcattgttaactcatccatcagtcctctacatggagagtctttgagagaagaggctagttctcattatgttatagttttttgcacttaaagtgggcccttgtaggccttgataaagctttgaattcctacaggtgataaataacaagtctgtgtctctcctctttgagtgttttggttgtagtttaacctgatatatgataactttgtatgtcagtgaatttcagtaatcttaagcagggtattttgtactggggttatactccctcccaccctgcccccgcacctcccccctctgccccccgacccctaactttaaggactacttccacaatccttctgcagaatttatggaaataaaattttaagaagtgacttgggccagattgaatttcttcttatacttggagtcatgctggctattgtggatctctcttgaaagtagagagatgaaagaagacgattatctttggttcttttataggaattaaggaatgatgcttaattatggtttatatacaaaaagaaaattaaaaaaatacatttgtgatgtgatagaatgtgtactggattcagtttagttgctcacttgtgtctgactctttgcgaccccatggactgcagcatgccaggcttccctgtccatcaccaactcccggagtttactcctgagggtgaagctaacaccacagaccacagagaaaagagacagaaactggctcgttgatgaccactcattgttgaatcacccaaccccgaagtcagccccacctctgagcttttgagttatataagccaggaaattttctgctcacttaagctaatttaattggattttcacttgtgtctaaaaacattctaaaattaacctatatttatataggagtaattattattccccattatgtagaggagaaaactcaaatcatttcccca

SEQ ID NO: 32087 - DNA, 725 bp, Bovine  19866880449734
taagaaaacagaatgcctcgctcacttgaaggggccgtaggtaagtcaaagacttcttccacccactgcccatcgctgacggcctgcagcaccgccttggtggtggtggtggtgttggagaggactttcatggtggtagcagtggtccagtgtaacaggtcggctgagttgctgcctgggacacttacttcatcctatgtttaaaaaaaaaaaaaagagagagagaaaatggcaagagtaaaaagaagagaacagagtagagagtgaaatgcgacaacttggagttatcagacatgaaattaaacagatttaaaaattcatctttaccaataacaaccccaaaaaatgtgaacgtgatattagcatactgtacctccttgaatcatttacaaaagaacattcagtaaaggaaaatacatcttaatgcattagtcaaagaatctctttcagaagtatttataaagcaaagagtgggttcttaattttttttttttactaatctaatatcctccaatgaggtactcatgtttgtttctttaacaagacattttaaactatttatggtttagattaagaaataaattattcacttcaacaatgctactgtgacccagacaaaggtacaagattctgatgatccacctttacatactgaaaggcattttgtttttcatctaaacaagtggatgattaatagcatttaaaaggtttctaatgtggaacct

SEQ ID NO: 32088 - DNA, 1579 bp, Bovine  19866880506020
ctccctgtctctgtctctctctgtctctttctctccctgtctctccctgtctctgtctctccctatctctgtctctctgtctctccctgtctctgtctctccctgtctctgtctttccctgtctctgtctctctctctgtctctccctgtctctccctctctcttttctcagcccctctcctgtcctctccccctcctccctctctccttcccatcccccactctgtacctgagtttggactggcacaaccctctactatgtggccttttccctcttcaaactcagcacctacgtatggagtgttttccctgagctcagcactttgacaccttatgttggttcattgcatcctgatgactcatgaggtagtgaccactgctcccattttgcagatgagaagagtgaggttcagggagattcaaagtctcacccaggattaccgtcagtgatagagccgaccgaaacccaggcctccaacctcactgttctttctgctccattcatagtggggtggagggcacatatcccttgattggcttcctgctctgtactctagaggcttggtacgatgtcattctgttttaaataatttcaatcaatgcctccaagggcagtgggggaaggtgtttggaagttcgtttcatgaaggcttggccttatttggataaagaaccaagatactttgtgtatgatgttaacagagtcgattatcagcaaagcttttttttttttttttataacagggacaatgtgtatcctgaggccaagtggagaagtgagacctcaacactagtgtttccccgggtaatacccactcctccaacaggagaggggagtgggtgctagagaagagtcctcgcctgacatgaccgagtcgggcaccatggaaacccagatgttatcacatctgtacagtgtttttcctcctcttcctggaaagagaaataacgagctcttgaaattcaaattcccatcgactctgaagtcatgagcatatttaaaaacagtgtgaggctgtgacatttacaatccctaaattcatgtcagagaataaatccgaaatcaccttcaatcactgaataagaagcagccaggcgtctccagccctgtggggggtcgggctccagcaatgataatattcagaaaatgctgggaggtgcaggctgggggtgaccaccctcagcaacccagcctttagacccctgcaggtgtgcttaaaaatcaggggggaacagagacccagcagcagagaagagagaatagaacccccggggggacccagcctccttgcttgtcaacccccacctgcgtgctgggctttgcctgcaggcaccggtgtgtgggcagcaaagtgaatgtcgcattctgggacaggcgtgtgcctttctcagccagaaatgcatcctcattaagacaaaataaggctcccgcccatgatgtcaggggtgcttggctgtactgccacagtggggccctttatccaggagctaaatacgctcgtcttggcagggctgacaggtaagcatgtgagagccgagtctctggccaccttccacgctgaagacacacctgccagtc

SEQ ID NO: 32089 - DNA, 1548 bp, Bovine  19866880519247
taggaagggtgtcaacacacaggaaggcctccctgtgggcagcgaagctggaacactgaggacagagaggagccagccacggcggcggcaagcgtaggtctccccaccgcagcagacgacttcaggctcatgtctctcgtgttaatgctaaaccccagatgactgccttcagtgcaggagacccaggttcagtccctgggtcgggaagatcccctggagaaggcaatggcaatccactccagtattcttgcctggagaattccatggacagaggagcctggtggactacagtccacggggtcaaaaagagtcgggacacaactgagcgactaacactttctttcttttccttttccagatacctagcatgctgcctttcacagagtaaataaccaataatatttgttaactgcattaacctagtgagataggaaaagaaggaagacaaaggatgttcacaggaggctcttgcttcctactgatttagacaaaatacttaccttcttaaagcctcacatccataaaattgagaggatacatcaccttcctcaaagggttgtcaagaaataacctgaattaagtacataagacactggctaacaaacagaagtcctcaacaaatctgttcatatttttaaggtattctcatacctactggtttcctcaacaaatctttcttcctaatctcctcaacaagccaggtcttgtacggagcattgcgggatactgcagcaaataagacaaggccactacccttatggagcatccatgctcgcgtctcctacctggtagtcctatagccccctaagccacccttccttttttaaggactagttgaataccactttctacataagaatattctcggacatccccagggaaaatttaatgtttttctccattatgctccatcaattcttcatagcttcattatcatcacttactgcccatataatgaggactccacaaggattatcccttgttcatctctctatgtccagcactggcatgacatctggtgtaaaataggcactcttgtaaaatttaaatgaatccattttaatctcatttatcacagtaataaaataagccatgccttgcgattaaaatgcaacacctatctctaccatgatctagctggttagctgttacattagaatatcttcatttctaagttttaatggccaaattcatcaacttcacctacttttaaaaagctcagcttaattctctttttgtgggctcaacaaatactttaaatgtcactattaccatgtaataataaatgtacttactactgtcaaataggaaatagtgattcaataactaaagaataataacagaaaattaactggataatgaaactctgaacattttatggaactttttttaagatctcatcagtgaaactaaaactaagtataaaaaataataaactattagctgtaccagcatcagcaattttatatattacctctaaatatcatagaactcagaataataaaggaatatgctttaaaataatatgaccagccaacagtcaagcta

SEQ ID NO: 32090 - DNA, 1373 bp, Bovine  19866880537993
tggaagggacttttgggttttattatctaatcaggtctcctgtccctaagcagactggaagccatgtaaaggatacagacatgacctaatgtgctaaaattttcccgaacctggattttcaggctaccacatgaatttcttccaatagaagaaaagtataaccttacagaaaatcagctagaatgactgtgggaaagtgtgctagagaaaaaggctcataaactaatgaacactcatgatataattaagttttctttctatattcaagcactaagcaactgtaccccaaatggaagagtactctgcacttgtgataacgtattttgtaaatcagagaataacaccaacaatgcagtgtgtgtattctgaccccactctctcttatggagaacatagagttcctctacctggccagatccatgcaggtgtcagtgaggttggtagaagaattgaagtactctctgctggctgccagaaccaagtcaatacttttttcgtaactgaccctgaattgggtttttcctttatgggctatactagttggtggatttattgagcaagcactgcagtgcatcatctgcccagccaggtggatgttctcaaggcgactggaacacagaagactttctgtaaatatctggggaaaagaataaactagaattagtgcttagaaagggaggactcaattctcaatacaatggaagctctgatatccaagtataataaattttaaaaatacatccattctacaagtagaggttgcacaataccatgaatgtacctcaatgacaatgaagcatactttaaaatgcttaattttatgttatgtgaatttcacctcaattgaaaaaaaactccctcttttagcaagaagaaataatttaactgaacaaactaatggtaagcatactttcatgtgttacaatgaacacttaagtaaaatacctaaagttcatactcactaaaatcaggtccattagacatactgtcccacactctggttgaactgtaacattttcattttttaaaagaaaatctttgaatatagtacacataattaatgactgcttaaagcacataaagtcagtctcagaagtgtacgtgaatgctcagtctatcagtcacgtctgactctttgcagccccaaggactgtagcccgtcaggctcctctgtccatgggatttcccaggcaagaatactggagtgggttgccatttccttctccaggggacccttcagtctcactaaatacctaagctaccaaatgttctccttacacttcaccactagaatgacaatacaccacgtgactttttttttttgccaatctgcaaattaaaaactatttaaatacaacagaagctacttgatg

SEQ ID NO: 32091 - DNA, 1015 bp, Bovine  19866880556207
actgtagcccaccaggctcctctgtccatggaattttccaggcaggaatactggagtgggttgcccattacttcttttacctaagttcttagaaatcagacccaatgactaagggagattccattgcttattctcccattttaagaaagagaaaactatcttagactcaaatctttgctgcccatcataaactcagtttttctgagcacggataatatacctggcatcaagtgttttggtttatagctaggttgtcattagcctgaatggatcctcatcagcaagacacagcttgccccaaaccttacctgttccaggaagccttcctaactttctaagttgcagggccccactgttcccttagggcccatggtaaggttagagtcacaaactttaaccctgtatttgcaagcctatttattcaggcattgctggagggggcctgggagcaaagcccatcaagttcatagctcatggcccagggcaggacttatcaattgtctctaaagtgaaggttttcttcacccaggggcaagtggctagctgttaagtagaagctcagagggtatgcaggtgttacagggtgagaacaatggaagccaagtcagagaggtctgggctcaaggaataatttctccagtttacagctcctccaatgagagctgtctctacagaagcaaaggtagatggacagaaggcaagtttgtgatccctagtaaggcaggcgagaatccatgagccccagatggttcaaggtggtttctaggctcacaaaggtgacgctctaagacgctgaaggaaatggccagagctttcagagccattcgaaaaaatagaaaataatttccaaaagtgagggcaggcaaaaatttagaaactgcagcccagttagtttgatgtcagctgctggcagaaatctatcaatgggggatcagccagatggtatgtgtaattggtgcttagaaatgtgctagggacagagtttagcttgtatgagcaaaacacttgataaaat

SEQ ID NO: 32092 - DNA, 1894 bp, Bovine  19866880563718
ccacatctgtagtcaggcagcattaaaccaggcatgggaaacacatcactgcagaaacagggaaccacagagacatggctgaaaggccagaaggaaaatgcaggcttgtaacctacttgcagaactaaatgaggggacaaaagcagaagcagtgaattcatttctctgggagctcattgatgaatcttcaccctgaactttcccagtctcttcctttgtttcaagtccaatgttcattgtgttttgcatacctaattaattacagcatgcatttccttactttgccaagggtgcgtaattgatcatgctgggctccggaaaccatctttggtaagttttttgagatcatgcaaattgacttgccaccagcgatgcaattcaacgatagaatccaggaggcctatgagaagctttggaagtgtactttcctttacttggagattgatgaaatcgccaagggattaggtaggcattttgctaatagttgaaataatgaagcagtatgtggtgtatttgaaatttctgagagtaagttcacaccttgctacagatgtgggtcattgaactagatggcttctgtgggagtgcgcacacatccctgtcacaaggcagcccagacagctccctttccttcttgagaccccatctctgcaaggctgctcccaatggagagcttggacccaggcttgggacacacaagcagggcaccaaaaaatgaagaaagtttgatttcatggacttattcaaaattgttaaatcttagaaatctaggaaaggctattttgactttcttgttgtatgttttgtgttcagatttagagtgtgttttgaatgacggatgtgggtaaggacagggaacaggataccatgatcttttcagagcttagggtcaccaaggactcagctggactcagtgtcagctagaggattctgtgcaggatgagatgaccagtaagactgtctttccagaacctcacagtgtaggctgtacaaggctggagtgtgaaaactgtttgaaatgcctgttaccgaatgctgtgtgagttcatgctcaggtgtgtctgatactttgcgactccatggactgtagcccaccaggcttcctctgtctatgggattttccaggcaagaatattagagtgggttgtcacttcctattccaggaagtcttcctgacccagggattgaacccaggtctctttcatctcttgcactggcaggcagattctttatcactgcaccagctgggacagcccatccaatgctacagagctcccaaatgaagccttcttactttccgtggcttttccaaataaggagtcagattttgtcagtataaatgtcaatgtaaatatgcatcttggttgtcaggcctattagtgacttacccagagggactttaccacctcagatgggttctttccgatgctggaaacagaatgagatcaggccatgctttcctcttgtaattgcttttccatttggagcataatttcaaagatgtcttgctagttttcaacagtctggtttggaggtgtcaatgtaaagggatgttctttgcatctctctttgggttttctgacttgctcgggccagatgactgttccatggaaaatatcaggcctgtacagggctaccagattattaatgctaggatcagctggtcacattctgttttggtccatgtcttatgtcaaggtcatttaatactttacatcagttgaaaccaaggctgagctggggaaatctttatggagcccaagcgattcacccacaaaggtcagaattacctgtatttagctgattagacctcaaggaagagcgctcaaattaagggctcacaaccagaaagttcccagatgactgaaaacgatgggttatcacacctcagaca

SEQ ID NO: 32093 - DNA, 860 bp, Bovine  19866880595795
atttttttgttatattgatgtattttatggtgatgccataaaaagaagattatgacttctcattatgaggcagatggaggagaagacgcagggttgattaccagagaggggagtatgttctttccaaccagttaccttaatagtcagcgagggccgtgctggacgtgaatgggaggtccaggcaaatgacttttttatgggccttgctttatagcagcttccttttgtacattttcaaatgagatccatcaaatggtaagctgatttttcagtttggctggaaaatgaaggttccacagattgtatatctttctgaaactcttattaaaaattaacagaattccctttctgcctctcttaatttagtagcaagaaactggcttacttaaaaaatccatgataattgaataacactttacatatataaagtattgtgagaatcatccatctttttttccttttaaaaatattttgtattataagaataatgcattttcattgtaataaattgaaaaaaatagtctttatatgaaaagaaaataaccaggtttgactactcatatgatgagcatgttcaccatatctctaattattgtttaaaacaccatttttatttatttatttatgaatgcatgcatgctgcactgtgtggccggcttgcaggatcttagttccctgaccagggactgaacttgcaccctcggcagtgaaagcagagtcctaatcactggactgccagggaattctctgtgttcgtttttatttttttcagctttatggaggtgaaagtcaaagtgttaggttctcagtcatgtccgactctttggaccccaggactgtagcccgccaggctcctctgc

SEQ ID NO: 32094 - DNA, 3875 bp, Bovine  19866880613412
ttcgatccctgggttaaaagatactctggaggaggaaatggcaacccactcgagtattcttgcctggataatcccgtggacagaggatacagtccatggggttgtagtgtcaaacacgactgaacacatgcatgcccatgacacgatgaagtgttaggtgaagggaagtacttttgatcatttaaagatatgttggaagagaaagggtagtggcttagctcagtttgagctgtttgtgatccttagtctctgttatgggcaccaccagctcagtttgaacttgacaaaccagtttcttagaaatcaatcctcagattaccagacaccagagggatagggagtcctggcacgctgtggtccatgaggtcagaaagacgtggacaagacttggcaactgactgaacaacaataccagacaccagagaaagcagctcctgcatgagtttactatagtgattgatgaacaagaattgtttctgtaagccagacttgacatgtggaactgttcttgttcttgtgaacctgtttggtaatgttgtctattgtaggacttgaaaaatattactagtgcctatgaagttaacctttgagctatgtaacacttgatgctaatgagatttcatgttaaattttatgctgggagttgttgacttggtttgggagattaatctatttctgctgttatacactctaaattaattagcaatatgtgactatgaatataaaaactgccagtagtaatcatttcaggagtaaattttcctaacctcttttttctttccctattacatggagttgaaataaaagtcttttccttattaatgactctggttacactctaatctggtagactgctccccagttaaatgtttcttctgtagtctaaacgagccttttgttttgctttctctataagggaggaatcttacagaaaagccttttgtcatgtacatttctgtgcattgacatttcatttacttttcagtttcagatgtttaaattttttatattgagtcagccagtccatatgaacagagtaaagtttaggtttattttatgaaatggtgtaattgtcttatagcctatattttttgatatttttcaatgaatttgattttcccctgaatgaagttatttcatgcttaagtgccatatttcttatcatgtttatattttttagtttctgtacttggattagttgataacactcagatcactccataaccctcttgagtagggagattctaaagatgagccagaattgaaaatgtgacatgaaaccttacctgaataacagttagttgctgtaagcataacatattagatttagaaaatgtttcttcaagcataggtacagtacaatcagacattcctgttcatatctacagtacaagctatccttcagtaactttcatacaccctgagcatgtagcaatcaacagacatcatctctgcccttgaaaagctgctgtctagttgagaagacagacagaaaaatcataattatggcaaatatattaaaagtaggcatgtaatgtaatgattgggaaggagaagagtatcttcttgacaggattttactgacagcaaaaataccacatttcaaggaagatacagaatttctttgtgaccttggagcaggagaagacttcatacaaaaaaaaaatactaattataaagtttaaaagctgataaattgaactaatttagaagtttgaaaacttcttttaatcaagacatcattaagataataaaatataatctgcagaataatagaaaatgtccataatttatatatctaataagggctatgaatccaaaatatacaaagaaaaaccaaaaaactgcaaatgaataagaaagacagacaaccaacagaagagtgggcagaaaatttgaacaggaacttgaagatcgtccactttcttttttctatggttggatccagaatccttgaatttctcttatctgacttatctcagtcccttttcgtctttagaagaaacaaataaaagcatttaaacttaaaaaatgcatttcagattcaaatataccttatggaaacctcttctattcccagtatcactgccttaattcagttcctgattattttatcttttttttaattgtacttttttttttttggccatgcaaggcagcttgtaggatcttagttccctaactgatcttgggtggcctccggctgcaaccacttggaacagggcttgggttcccagccacagatgggctgggtcgcggtggtaaaagcaccaggtcctagccactaggccagtggtcagtgtcaagggccctgactgaccctttggctttgcagaaaagaattgccacaaagacagaaaatagtgaagcaagtaaagtatttattaggagtaaaaagagtacattacctgaggatagacacaggcagactcagagagagagtccctgagttgctgagtcatgcctttgtggtagtttgaattactttcatggggcatttcttccgggtttcctttggcgagtcattgttatttgcctgcttcacagtccttacgtggtttatctcaggatcctcccatgtgggcacatgcatctctttgccaagatggatgctaccgcaaaggcatatgggtggaacatcccatgacatgactctcccttggcctccaaggagccttttctgcccatgtgtggttagggaggtctctgacttcgggaacaagaaatgtgtggtctgtgcagtgtctagcctcctccctttattcccctgctatttttgtcttggaatttccatcaacagagaatgaatctccaattactttaccctgggttggggggcgtggcgggcgtagtcccatctgcctcatgaccaagaattaaacccaggcccttggcagtgaaagcacagagtcctaacctctgggccactagggaattccccgagtccctgattattttaaatttggactaattcacctatctcctaatggattcctgctcctggaataagatttgtaaaacataaatctcgttatgttaactccttttgtttaaagcctcttgtccaggtgatgatggaggtgctttggtgtcatgtcagtaggtctcttgctggtcttgcctctgcctacctttgatcttcatgtgccctgaccttcatctttgtgtattcttttctataccgtcattgaatcaactcgagtttcctccaatatttcatgttggttcatgtctcttatttgtataagtctaccaggaacatcccctggaggagggaaaggctatccattccaatattctggcctggaggaggccatggactgtatagtccgtgaggtcgcaaagagtaggatacaactgagcgaattttactttcacttttcacctgaaatcatgggcgcttctctggtggctcagtggtaaataatccatatgccaatgcaggagacacaggtttgatccttggattgggaagatccccctgcagaagaaaatggcagcccactccagtattcttgcttgggaaatcccttggacagaggagcctggcagggtacaatccatggggtcccacaaagagtgggacacgacttagtaactaaacaacctgaaatcatcaccatttcttctttggaagcctgaaattctttcctgctgaaatattacttcttctgtgaagctttctatgatggtgcctctagacagaggacatagtgatttgtctgtatctctggcctccctttgtagtttctggagctcagtggctcccaagggcagaggctgtgtccttcttgtttttatcacctaattgactagtacaatatagtatgacatcaaataggagtcactcagtgaggatttgctgagtaggggaa

SEQ ID NO: 32095 - DNA, 2739 bp, Bovine  19866880659040
accatgtagaaaattcttaagacgaaattcacatctatagtccatgaaacaggtacataagagttcttgattaacccataaaaccaggaaagaaagtagtatctattgagctcattattctgtatcattccctgtaagaatcactttacatgattagcaccctaaataggaattttatctcatttatccttttaaatcttcaatattacaagtatccagaaaatagtaggtactcaataaatgatttaaatcaatgaataaataaatgtatgaatgatgatgtcaagttaagatactcaaaattactgaaaatgttactggttttcctaactctcattcattcatacagtctcacctattattctgagttacacattgttggggaactagaacctttcataccttctgttgttggaaatacttcttctccttcggttttagtttctgccagtttcccagttctcagtaacacttctgcaaagctttctaccgggatatgctgataggtgtcataggtcacttcagactagacaagagaaggagtgacatcatttgatgggatggctttttctctatgaagatattcttagaaaagataatgataggatttttatcttctcataacttgaattatagcttctcacttactaaagcatattattcgatgtaaaattgtaaaacagattttattttagtctcataacacgtaacaaatcacataaaaccaatgcaaaacatgagtatgaacaaaagaagtacatcttcaaaaaaaccgcatattttgtttgtagtaaaatgctcgcagccaccatgatagttaaatctatgttcttaggcacactgcccttaccttctacaacaaagggattggagatgacagattcataaaaaggatgacagccttgtttttctaggccttcattggctctggttccaatttgataaacaccaccaaattcttgaccctaaacagaacaaagtgatgatcagtggataaaggaaagagagctgggagaggaggtggaggaggaaaggaaggaagaaagaacaaatagatttcaggagaaatggatcacgtgtactgtgtgagccgaagagagagtgtcagagcgacactgaaacccagcggagaatattaagaatcatcaccacgttctgagcagcgcttcagcctcaccctgaggtgctttttgattcttctggtcactttgacatcactgaatcagaaacactgaagcaatcggtgtcacacacatggccagttttctatacaacagtccggataacctttctaaaacatcattctatatatgctgttcccttgctccaaaaaacctttagtagctctgaataatgcagtcagcagtatcaaatctaaactacacaaaataacattcaaattcactaaatgctaattaccattaaaggctaacactccatgcaactactttgtccgttctactggcctctgtgccctcctcccgttacaagggtaatggtccatgctgactgcccacctctgcccccaggcccgccacagaccacacctgctgaaatcacagcagctggaggcaaggtaagactgggctcccttcaccagccccaccgcccccacaactacaacccacacgaacatctttattagactggtcttcagtattcattagcaatattttagtatccctactatggttaattatctttatgctttgctctcctcaaacagactgtaaagccccttattggaagacccaacaagaagacattcacccaatcctccaattcatggagcacttacttagggcaagcacagcctaggaaacaatcaagctgctgctgcgaatgatgttaaaatagtttcttcagagaaaactatatactaggcacagtggtaaccactttatctaagacgttgttgttgttcattagctcagtcatgtccgactctttgcaaccccatggactgtaaaatgccaagcttccctgtcctttactatctcccggagcatgcttaaactcatatccatcaagtcagtgatgccattcaaccatctcatcctctgtagactacttctcctcctgtcttcaatcttttccagcatcatgatcttttctaatgagccggctcttcacatcaggtggccgacgtattggagcttcagcatcagtccttccaaagaatattcaggactgatttcctttaggtttgactggtatggtctccttgcagtccaagggactctcaagagttttctccaacaccacagttcaaaagcattacttcttcagcactcagcctgctttacttaatggtccaactctaagactttcaaaaagccccaacaggtgagacagaaaataaccctaatcaaaatccagtgtgatgcatgcagcgatgagatgcacagacttcacccaaagtcaagcccacagcccatcagtaagtggtttcttctgggtgattatcctccattctctctcctgcatatcccacgttcagaccatcagcaggtccacaaagtacaccctcaaaccaaagacttctcatgtccctcatggctaccctaatctaagccatcaacatctctcagctggactcctggaagagagaagcatctttttgcttcactactgatgactctctgcacagaagttaaacagatgtattaaaagtaaccttggatcacatgactgcattgtcgaattttcaaacaacgctgtgttgctagaagcagatct

SEQ ID NO: 32096 - DNA, 1352 bp, Bovine  19866880669549
ccttgaaatcatcagcctatccaggggaagtgttatagttactgtacatgtaatttggaatcttatgtatcattggccatctctcagtttttaaatgagtaatttagaagattctgataatttaagtcttaagatttctttacagctgtaaacagttggtcagtatttcccaccatgttggctctactctagaatccactcttcaataagaaagcgttggtgctgctgctagattacctgctgtctttccattgaatctctcaaatgcttttgaagtctttgaagttaatttctacttatggcattctacttactgagaatgtgaaagagagcatggcctctttcttcaaggtagtcaacttgaaatgaatcttaattatttcacatatgctaccacagcttgaccttcagcaactatagaattttcttatgcatattctgaatggtggcaggtttcactgactgtgtcaccaatgaggttttaccatcttgaatgctgtactgttttctctctggaaaataacacatgccatcattccaaagtggtaactaatacgttgtgtttgtattcaggtatctctgtcagttttcaaatctcttgttatggtgcccccaagttctactcttggttcttatttactgcatgtattctgaaaagaccattggaaataatgtcttataatttgttttaattaaaacctgtacttacagctagccatgtgtgagcaagcattaataccatctgtcccgtgttgctggtttccagaagaacagctgggcatgagaacttgaattcaactagacagtgcccaggtctggttttatgaagcttgtgcaagagagacacttaatttttcaaacattttgctacttttttgcctgtaagccaaatttgaaagagccctttaattttttgaagtccacccaaagagttcacataccaacgtctaactaagggaagcacttcagggattatccttaaagacttgcaaatatgtcagcttgttttatgtgtttgtatgctggaaaagaatgtgttctcttaagctttattgcatatgggatagaaataattgttcattttgtgtaacaaatacgaaatgttgaaagcaaattttgtttttaatgcataagaaagaaaacaatgcatggaaaagaaacatccagttggtatttgacaaacacaaaacaaaacctgcccttttcaagcaatgagattcatgattatatagaacttcaacactagaaaataaacataaatggtgattacaaactcatagatattcaacaaagatgaactttgaagagaggggagagaattatatagcacattcgccctcctaccaggcaat

SEQ ID NO: 32097 - DNA, 624 bp, Bovine  19866880699331
tagctttaaaagtgaggatcggaaaagatttttaatgttgcagaaagatctacaagtcttcatctggaacatataaaatgtaattcagaaagagtagaaaagtgttgttgttcagctgctaagtatcatctgagtctctgtgaccccatggactgcagtatgccagtctcccctgcccttcactctctcccggagtttgctcagattcacgtctaaatggaaaagtggctgcatggtaaatgaatcatgtgtactatttatgtaaatctcaaaagtattttgtccctgtagggaagcactactatgaggtatcctgtcatgaccaagggttgtgcagagttgggtggtcttccatgcaagcatccctagatcttggtaagtgttactaaataaactgagtttattgatttccatttgtgaatttttaatgttttgttttagtggggagtgaagtaataaacttaaccatacagagtttatatttagagacatagaaataatattatttacctattccctacctcattccaagaaagatttgaagtccaccaaaaatagatacggtaatatcataaaatcaggaggaataatgttgagggtaagagtaaagtcagtaaagttaat

SEQ ID NO: 32098 - DNA, 1734 bp, Bovine  19866880735928
tttgtaggagcacaaatgttgtttaatacctttcgttaggcctttggtggctctgcatccatgccattcctttacttctctgctctgacaacaaagaccatctgagccaattgctggatttgagaaaaacacagaaaaccatgtcaatacagatgatgtaaatcacgcactctgaaataagcatcattcagtctcactaataagataaattttcacttgttgcaatgttccaaggactaagagctgctgattgctgaaggacagcagcatcctctgtgtgagtaaccgcccccattcaggccctcgagggccatgccaaaggtcggggactagtttctttactgtgacctgttgacctggacagcattttaccacaacaaaaaggagtcaacacagtacctaacctgacttgcaccgacgccagctgcaccaccaacacttagacaactgttctctagagtcccttaaggaatggatactaaggatgacactggttgctccgattttatgctgaaattagagtctgaatgaatgctaccctaaaaggaaaagagaaagtctccctggcttgttccctaatctgcagatccagcaatcacaaagggaaagcaggaaaagtctgaataaataaccctgtggctattattgctaacataggactctcaaacatgaagttctatattatatatcacagtcagtcatagcgctaattggtgcttttcggctttaagtaaagcatttggcctttatctttactagaaactgcaacttttgtcctggcttgggcttgcaaatcatatctggcacctgactatagaagaaaccttttgaaaaagcacctcatcacacattttcctttccttatcagaaactacattatttactcaaagtatgaattctcatgagtataatgatatactcatgtcacgagtataaacctctgaatttttaaaaagttctgtgataatggtaaatcctaaacatttttgtatttaaaattctttatgcatatgtacataattaatctagataccacatggtgaagagcagcattggggttgcttgtttttgtcatgattcctcaggccccctctacctttctctgtatcctgattttcttcctcactgacacctggggaaaattcctccaagtcaactctacagttctgacttgttcttcctaatggctacacaagagtccatggatacaccctaatctttgtttactattctggcagcagcatttactttgctggtagtttttatcattagaaataacgttgcatccaacagctgtgaatgtatatccttgcatacgggaaatttttccccaatgagcttgatcttccaggaatatacattctttaaatactaaaagataatgcggaactgcttcttagagaggcagccaatttgtatgtttgtatcactcttctggattcttgctaatcagatggtataacacaatcactgtaacttttacattccacttccctactacctgtaaacttgaccttgcatgtttattgccatttggatctgctcttctgtgaactgcctattcacatacttcgcccattttccttattggctgtttacctctttcttactaaaataagtaaccctttatcatccatcaacacaagaaccccttataagtttataaggattctttatctttcctcagcattgcattaaaaacaagctttgaattataaatatgcgctaaagtct

SEQ ID NO: 32099 - DNA, 811 bp, Bovine  19866880814057
ttgatgttactactgttaactgttttgcacttttctattaaggtatgcacattttttaaacataatgctattgcacacttaaaattacaatataatgtaaatgtacttttataggcactaagaaatcaaaaatgtgtgtgactccctttattgcaacaatatcccttttattgcagaggtctggaactgagtccacagtatctcggagttgtgcctggagtggcagaaattgactatgcaataatcagtgcagccccaacttgcaaagaaggacagaagaagggaagaacagctactgaggtccttctatgccaaggcatttcatgtgcactgcttttgaactgcctcaacaatgcaacgtgttctgtattatcttcattttacaaatatgaacagactcagagaacaaagagaaaagacattcctcagtgaatattcccaatgcccagtctggctccaagaagctcagcgtgccagacagatgagcatgaatgttcagaaggggactacaacaataccacagacattaaggcaactatacacaagaggaggaaatgaagccaaaataaaaatcagaacggacaatttcttccctctgaaactgcgccaaggcttctacatccactttaatactccactaaatatgagagcaaacggctgcttacctatgcccgggatggtaaatagctgtgttgattccatgaggataatgactgctgaagctgaaacagtggctctcctgatagctctgatgtgttccaacactaaattcaagaaggtaagtaagaaataaataccattaaaccacaat

SEQ ID NO: 32100 - DNA, 1359 bp, Bovine  19866880878618
tgagaatatgtcctttaattctctgagaaaccctaaggggcaggcactgtcactgtcctcatacgacagagaaagaaagaagtcgggggattcaatcgttcgccgcagtcttcctgccttgagctagtattggagctgcagccaccccattctatttctgtttgtcgttgttgtttttgccactgtgtccctggaacccagaagagggcttgggaggtctctaggtacttggttacatttttattgaaggaacaaatgaatgaatgaatctgtggttcttggatctagataaaagcagagaaaaggccaaaagggttgctttttcaaatgaggattaagaataaaagtttatggctgtcttgcattgactgatggggtgtgggcgctctcgcacaaagcaggaagcagggttggaggctcaggctggaaaagcagagacagggaaagtgcaggaagacttcaaagcaccaacagcttctcctgggctgtgtctaaacacgtgaggcccagaagtgaggcaattaatcaggtaattccagcccccttccacccaatggcctcaattatctggctatttgaaaactacccgttttatgggtaatgagtgttaataggctattgtccggaaacagtctctcctccggttttgctctttggcattcaagaggccccaggcagcaagaaaggttcagttcctgctttcagagtcgcaatctctgtgtctttaacaggaggacaagatggccttcttcggcaggctgctggtgagattaaagagagcacagagcacctggtccagggtccgaaccctggctgcgaagcaaacatcctttgcactttggtcatcaccttcacgtctctccccagcagtctacagcctgacccggtgattacctgccttccaggcccaactcgtcttctccagttctgcagactcctcagagtgcagcaagagaactgtgggcagaagaactgctttccatcctccctgaatctctcccagaatagaacttgccctcctggggaaaaattactgagccaaaaaataaagagagagaaagggagactgagtagaagagggaactcccatctctagagttgctcgatgttgcaggccaccaattgtgctgggacctttcaaagcactttctcgtttaatcctcacagcgatcctgcagggaagggtactgttatgatcccattttaccaatagggagactgaagctcagcggtttaaatagcttgtctaaagtcaaacatccaggaagtggtgaagctgggacccaaactcagagctaatggggtcatcaactccagggattttcagatacacaaatattaagtcttaaaataatctat

SEQ ID NO: 32101 - DNA, 4125 bp, Bovine  19866880899101
ttatggtttagcttcctgtctactgtcatctttcagaccagtctctgtacacgtcccagaacaggaagcttactgtctctctatacagggagagagaaaggaataataggtaacctatatgaactattcttattgtgtcaggctttcttctaagggctttgcacttattcatgtattcatcactataaccctatgaagtaagtgatgatattatcgtccccattttgtagatgacgaaactgatgtattctacagctgttaagtaggagagctggggtttggacccaggcagtcagtctggctccagattgctcatcactataaccctatgctatatagctttcagagatagggattcttagtattcgggggtgtcctgccctcctgcatggaagaggggtgctttccattctggcagggctccccatagcgtcttatttctttaagtcaggagttaacaggcttttcctgtaaaggggcagataataaatattttagacttttcaggccttatggtctctgacataactaccattcagccagtaaagcagccatagtcagtatgtaaatgaatgggcatggctgtgttacagtaaaacttgatttactaaaacaagctgcagtcacacacacaaaaattgtggtttgcatgtttcaaatgtaaatagtatgaataaaagatcctgtggtaaatctggaaatagtctcctgcatatgcctatcccttgagattcacagttcatcctattactttaaaacttgtctctgtcatggaataaaacctatttctctcttattttatatttctcctcctcctctccctcctcccctcttctctccctttctctcccaccttctccttccttggggggagggggcagaatagcagttaggctcccttagcatcatacttcatgttcttgggacgtgcccatcttgagaatcccctttttctacagacaagtaaactgtctctggttgaagtacagctcaaacggctcctagacatgtgcaaacctacgctccttgacttcccccacagtatctgcttctcccgggaccacatttcatgattagctgtatggtctagactcttggaggaatctgctgtagacttcttcctcaactgactcacatctccacttccagttagtttctaattcttaccaatgctctcttctcattaatgtatttttctctactccatcctcattgctacttatttcccaagcatgtttgaccacaaaatcagtttctccagtttttcacagaacaaactatgaatctccaggtggaaagataaacggcatgattccagggaagaggacagggcaccttttggcagtgccttgtgtggtaactgcacagtcgctttcacatcctcctgagtatttcatcagggtatgcccaggctgtggtgtgacctgagtgagatttgtgactgtgtggcagcctgctttaaatgggggttagggtagaagagaatcagtgtctttaaaacaatgggattttagttcaggaagagatcttcattcttagccttctgattttacaatataagaaactaaggcccagagacttggcagtagttacagcaaattggaggaaagcctggactgaagcctggaccccttctcttccagtaaagcaccctttttactctgcctccagttccttataaaaacagctccgtgttactgaatgggtccttgttgagcgtcttgtaggcaaaagacctaaagccaagagaggtttcgtgatgtgtcaaccagaccaagtcaggatggaggaccacagggaagaatctccaacaacaccccattggagatccaaagccaaggtcccctggcactgtcccttcaactcagagagtggggctacctgatgatcgctcagtttccatagaatcattccatgttgtgattctctaaggacatagccttgttcctaagtggtttatgtttcaggtttttcctgtgaacttaggatctgactctcttttccagaaattcaaaggcagcatagtttgtgtgaatggctgattgtgaacttctcggagcctgacttctcagcccccctccccagcttctgtccaccctgctgaccagacgtggcctgggttccaggtcgatgtgaatcttttttattctgacttcagtctttcaagcagcggtggccctcccccaagccccaggaggggaggaaaagcaagccatgtagagcaaagtttttcagcatctcagaaaaggaggatctctgaatggtgttttgtatgaggtttccaccttaaaacctgacagggaagaagaggagtatggtggagagcagttcataaagggagagagatataaggaggaaagagagagtaagggagaaagcaagacagaagcagcagcagcagcagatgccccagggtactgagtgaagagatttaaaagcaagaagagagagtgcagtatagagcaagcagattgagggtctcccatccacatgtacctgcctgtctcatggtacaggtttcagaatcctagactgtccgagtttcaagggccccttaagagatcatctggtcccagcctcagagccctgagacacagagaaataaaagatgccacacatgcagccctatgcaccaggactgagggagctgcctctggggccagggctctctgggcagagccctgtactttgtctgttctcatctgtgtttccagcctggattcagcccatgcttgtctggggagtcgtgactgggacctgctgcctcccagcgatgctgttctgccaactaattggaagtctttcttattgccttggtacaggatatactgcggggacaccatacaaggtcccaccgacccagagtaatactgctccgcccccctactccccttcacccaacccctaccagacggccatgtatccaatcagaagtgcctacccccagcagaatctgtatgcccaggtaagtacatgtagaagcctgggtccacctcttctgcaggtaaaggagccaccagcctgggtgggtggggtggagggggaagaaaagagagtttgtggctctgatcagctgtcattcttgtgtcactgaagcagtaaccttacagcctatacataccctcactctacctcagtccacagtcagaggctcttgttattatttagtagaagcatttgagaagctctggattaagatgatccaggccctgtgtctactctgcccagagatcagcagacctgagggctgtgatggcagaaagcagtcatgtgatccaggcagtgggatgtcacctcagaccattgtctccatcgtcaacctttttgcctaaaaggaaatatatagtaagagacatttggggaagtgctctgcatttaggacatttttccagtatgtaaaatggaagcattcacaccagcacagtgcttccatgagcagagcctcagaccttgtgtccctgggccagagatcctcagacaccatcccttagggtttgagacaggctcccctcccctctctccccacctctccaaaagccggtgtgacaaaagcccctcttcccccagggagcttactatacacagccggtgtatgctgcccagccccatgtcatccaccacaccacggtcgtccagcccaacagcattccctctgccatctacccggcgcctgtcgccgctcccaggaccaacggcgtggccatgggaatggtggccggcaccaccatggcgatgtcagcaggtaagggcagcatctatgtcagtgtccattcccttcctccaggaactcatgacagtggaaaacacagtcatggaatcgactgtagcataacatgaagaatcctgtaccttgggagttctagggaccctctaactctctccacagggctgcggaagatttcaccatggaggatgtagtgagctaggccttaaaaggtgaacagaggctaatcagagagatgaaagagggaagggcagtccaggggagagaacatgagtaaagcacattcacagaatggacatggtgtaaatcgcttagaaaatgagagcatggagttggaagggtggctggagcagttgtcagagataaagtggtgggagagtctcgaatacgtaggtaacagg

SEQ ID NO: 32102 - DNA, 1017 bp, Bovine  19866880941129
gaagcatctctcttttgacaaaaaatagcttgcaggtagctacctgccttgctaatcttcagtggaatattagttccatgtctacaatatctccagtctcgactgaacatacctttttttcatgatcagaagtcactatagaaaccacattgacaggacctattgaacattctgaaagctttggaagacactaacaaaaaagcgggtggagcaataaacaatgactttcgctgtacctgccttcccttttggcagtctggccacagcttcagcattatttaaaaagtaccaagggctgctgcagtttctttcccatgaattagggattcagctaaggaaagagcattcaggcaactagttgatgctttcgtcatgttgatgaatttactattatgcaaacctgggtgagtcatataaatgcccatttttgtttggtcttttaaaacaaaggcaaagagaaacaaaccaggtaaagcaagggctggaatactggggttcttctccctctcctggctcagtcatcaaccagctggatatctcagcatcctcagtgtctacacaacaagttaggtatcatcagagcaatcattaaaaagatatatataccaaaccccactgtttggggagcccctatacaagaaacagagaaagtggagctcctgtagttgggggaccctggacttcagcctgtcatttttattcccttttttttttttttgcccctaggaggcactcttgaagcttttggaggaattaggaatgtgctttgatgtatcagtctggaaatctcttcctggcaagccccagacaacgcattcatggggatgggctaagataggatagtgagccaagttcctgggtagctttacccagaaggccctgagatgcatctggggtggctgcagggaccctggttcttcagatgttcctctgctgggctcctgcagggaggaagccaaagcacttcacctgtaagggcatacatataattttaaagtgaaaatgttagtcactcag

SEQ ID NO: 32103 - DNA, 544 bp, Bovine  19866880951398
tacttcgtgcttaaggaaatgcctcccgctctgcacttgcctttttaaatttcacaaccactaaatccactcccagcatttgttttttatagcgaatgaaagagcgagggctctgcaacggagaccttctagagagctagtctgtgagcagcatgagacaaccaggggcgaggggacccccagccccccagcttcccaactgcctctccaaagagacctaggcccatccacagagtcagccaagctggggttagaaaaatccctcccctagtaaagcctgagtcctcgttttttctctttttttggctacgctaggtctttattgctgggtgcaggctttctctcattgtggcaagtgggctactctctagttgcggttcccgggtttctcactgtggtggtttcttttactgtggaggctctagggcgtgcaggcttcagtggttgcagcatgcaagctcagtagttgtggtgcctgggcttttttgcctcaaagcatgtggaatcttcctggaccagagattgaacccatgtcccctgcatt

SEQ ID NO: 32104 - DNA, 1784 bp, Bovine  19866880976419
tctgggaagctactttgtaggatacatggaagttattaaagaagatacagtctcaacaattaaatctgtaacagaaactgtgttttataggaatactgcagaaacacagtcactaaaactggaagagactccagagtggggtgacagagatagggtcgcacatgaaatgccttcacagcatcactcaggttatcccagcaaagaaatacaagctagagtgcatacagtgtcacagaataccactgataccattaaatatacaaggacaaggatatttgaagagtaggattttcacagaacttcatactaataatataaggtacgaccacgatcttccttttgaaatagtaactgaacgaactagaagatgggctatgcagctttcctttacaaagagacagggcttcaaatttggtgacctttcctgtgatgataagtggctctcaggagtgtgccacaggtagatagtttgtgaaaaataaacacacttcatttgaccctttaaggtcaagagtgagtgaagaagtaatgcttttccaaagaaattcaggtgcagaagagcctttctgaaagcattttcatcactacgtgtttcctcccaacacccttggttatcaactataataacatttatgtatgcacacataaaacagaagtctctagcctgcttaaaatctttcaaatgaagtttcaataggtttgggacccacttgtttaaaaatgtaaaaatgaaataccttccaattagtttgtgagatgaactgcctgacatcaggaagatggaaatttactagcccaatttcaacaaaaacctctgtataattggtggatgacgttgaaaaacgagaatcataatttaataaacaaagccaccaatgcgctcttccatttggattgacacttctttgtgagaattctttttttaaccctgacagccattaaaattaagtattttttcacaatgaacttctaacttcagtaccttgctttatcatctagtgttacaatttcaaaaataatgaagtatatcctatcttaatatgtactttaaaatattatcactaattacagtggcagcaaaaaaaagtggtagcaaaaaaggacttttgcaatataatttatagtattattatctatgtcatattgcccactaacctttcaattttctatggcttctctggtaactcagctggtaaagaattctcctgcaatgcaagagaccccagttcgattcctgggttgggatgacccactggagaagggataggctacccactccagtattcttgggattccctggtggctcagctggtaaaatatgcacctgcaatgagggagacctgggcccgatccctgggttgggaagatttcctggaatagaaaatgtcatattgctctcaaacctttaaattttatatttttgtgcctattacatgaaataatacatatacaaatagcttttatgtttatattacatataataataatgataatattagttgctcagttgtgtctgactctttgtaacccctgtggactgtagcccaccaggctcttctgttcatggagttcttcagacaagaatactggagtgggtagccattcctttttccaagagattctcctgaccctaagatggaacccaggtctcctgtgtctcctgccttgaagacagattctttaccatctgagccaccagctcagcagtaaagagatctacctgcaatgtaggaaatacaggagacacagatttgatccctgggttgggaagatcccctggaata

SEQ ID NO: 32105 - DNA, 439 bp, Bovine  19866881023234
ggtttttttttggtaatagagaaatgtatgtggtcaagtttcagatatcgaattagtaactttcagttttgagtttgccaatattctgtttttatattctaatggaaaaatccgtcttgttcactatagatctgctgtttataatatttacctactatatgtggttttcatgattagatttttaaaattagctaatgtgttgtggtttcagccctgctcctttcttgctccctgatggactggttcgcttggttaataaacagataaactggcatttggtacttgcaaggtaaggatgcataaaattcacctaatgtttctctacctggattagcatttaacttccattatggttattaattttaggatccttatggcttgctctcttggttttttattgtatgtaaattccctgtgtcgcacatgattaatattgttt

SEQ ID NO: 32106 - DNA, 747 bp, Bovine  19866881028076
atcatcgtgacactgcgacagctcagtaacatcacattcctgttccatttccttgtccaaagatcgaaagtgaagagtatgaggaagccttgtccctggctcagacctatggcctggacactgacctggtgtaccagaggcagtggaggaagtcagcggtcaacattgcttcaattcagaattacttggtatgtttacatagtttgataacatgtagtgagagtcgtagttcttcccctggtggcttagatggtaaggaatctgcctgcaatgcaggagaactgggttcaatctctgggttgggaagatcccctgaagaaggtaaggttcatacttaaaggactatctcatggctgtagggcttcatattggagtacttttcactgatgacttttctttgtgaagcgttttattcaacctggaaaaattaccttgtttccaggttctgttggctctgcagctggattgttggtaccaaagatctgtgtatgaatattccgtgataaaccagccaagtacctggtcttggcctaactctttcccttcatctacctcagtcacctcagttcactgccatgagtcagggtcctgtcaagagtcaggaaccacacaggaatttgaagagggacagttttaatacagagaattattttctggtaacgagacattaagtatatgagggcaaagataactctaaggaataacctggggctgaagggaatgtttccaaggaggtagaaaactcag

SEQ ID NO: 32107 - DNA, 991 bp, Bovine  19866881047150
gaatccttgctgggatcaggtccaggcctacctgacaccaggttctttccaactccccaacacttctgaccagtaaaagtagaatctccacaagaaaaactagcattttagatggttttaatgaaagaaaattctttaaatccaaaaaatggaaaacaacagtaaaaattcccctcctactcctcccaccaaaggaatcctccatcaattactctgcagcagcaaaatattatccctccctttccttcctgttccactacattttttcccctctaacaaatattccttttccccccaaataaggtcacttggaaaaaaaaattcctgacagatgtcaacatcatagggaaataataaaattattatataaggaaaactaccccagatctcattttatattcacctacacatttttcagatttcagtcaagatacaataaagtgcgtaagttggaaggataaggtgaaaagtttgactacatagttttacccatttagaattgactgggaacttttttttttttttaatctggaccattttcggtcactgccacatatttctaccttaaaaagaaaagtgaagccctgcaccttatttacagcaagtctggatctctgtcgtttaatgctggcagtgggccaggagttggggagcgtggggggtacagagtcacgtgcaaagaggctgcaggtcagacataagaggacttctactcaccggccccaattcatacagcacatgaagagaaagggtgaaaacagactttcaatgcaacaagtactatttcagtgtaaaacaagttgcccagaattcttcccatattgttagtgtgaatgccaactggaacaaccctttcagaaagccacctgaagatgaccctgaaaagtgtacataaaatttctttgcttcaataatccagcttctaggaatccaagagaaggaaaacagtccagaagacagaacaaagatgttcacggttaacacaggacaa

SEQ ID NO: 32108 - DNA, 1863 bp, Bovine  19866881069447
gaccattagcagttcacccttcctattatgagagtctgccacagcatctgacacgaggtgtgtactaagtattcacatctttattatatgataaaagtgggaagaaaccaaactatattctgttttcctcaaagtcaccctagccactgagatagtaataactaatacagacaaaaaaggacaactataacgtatgcacagaaaacaacggccattaaaatggacatacaattagtaagaaaataaagaatggacatgtttgaaggtggagctgcaaaacagaaggaagcaggttcttcaaggattcttttgtgtgagatgcgaaaatgctgtctccaaaccagaagtgctaactcagaaaactcatagatagtttgagatattttgaacgagccatctaaagactgctgtgtatatttataaacaacagattgtggagaagattctattatttatttatcaaaagcatatatttgtcctctaggatacgcttcaaatagcatgtgctagctggatgcttaaaaaaaaagacaagacaaagccctagcaaaatgtaattgatgatgtaaggcatgccttatcttgtcaacttgtatctgcataataaccctcttctaagaaaccataaacaatctcactcaggattaccaaatgcccaaagaaaagcccactggactcggcaataggaagcccaggctcaactcctggctctgcgaccttgaacaatgctttaaggctctgtgcttctcacattcctcttccaaaagtaaggagattggatgatattatctctttagtcactttcaaattggacattaaacgaacctaagaaattatgaacctccaggagaagagaggggaagagaaaaaaaaaatttgtacatttctcttaactgaattctcccataggctgtccctactatctttctttgatctccattttccctgcctcactctaaaaagaatttgagtgtcttctcataggaaaaaagcccaggataatataaagtactattagagtactgaagttattttgctgctttaagatttaagaataatgatgaaaaatagcaacggccactgccataatcaagaccatctttgctattttaaggtacttctcatgagtgcatgctaagtcacttcagtcatgtctgactctttgtgaccccatggactatagcccatcaggctcctctgtccatgtgattctccaggcaagaatactagagtgggttgccatgccctcctccaggggatcttcctgacccagggatcgaacccgcatttcctacggctcctgcattgcaggcagattctttaccactgattttaaggtacttatcaggagagattaataactgtaaaatgtaggcacaatctacccttgtttcaaaggctggaaacctagacagaactgcataccaatgcttctgggaaaattcaatcaggcagtgtgggcagggtgcgtggtgctgaagatgtgatgcctttggtaggtagcaggaaatcacagctgtgagcattaccatctatggaaacttgggccaattacttaataagctttaagttctttggaaaaggaaatggcaacccactccagccttcttgcctggagaatcccatggacagaggaggctggtgggctacagtccatggggttgcacagagtcagacacaactgagtgacaaacacttttaagttattcagctataacatggggataacattttataccagagggttacctttaaggattaaaagatgttttcaaaataaagtttatagagcatctaacaccattctaggcccataagaagcactccacaaatcggggtgttaaaaacaaaacatacctctaa

SEQ ID NO: 32109 - DNA, 3183 bp, Bovine  19866881098109
ttgggaagatcccctggaataggaaatggcaacccactccagtattcttgcctagagaatcccatagacagaggagtctggtaggctacagtccatggggtcacaaagagtcaaatgcaactgagcacacacacacatttaagatatagtatagtagtacataagtatatataagtttaataacacatatatagtatatagtaatacatatatgtatatttttaaatatacacatggaaaaaaagttaggattttcatcccatttgaatgtgcagtagggcagggccaagtgtgggtctattgaaggggtgagcctttaagcaaaactggcacctaaatcatgcctgcaactaaatcatggatggataaacacaaatttctttattcaatcttaggattccttcagaattagatagggatgagcctaaagcaaatcagagggtgttgccctttctatatagcaggatcctatagaaactcattttcctgcaagacgagagtgggtggaagcagatgtgggttccaggggagtgaacctcactcttcagtgactcatctgagggcttctgagtgtacaagccattcctgagcaagggactcattagggcagagatgcctctgcatgactttatgggcctcttcttatcctctttcgaggtatagtgacctgcccttcaagacccagtccaaagatcccttccacaacgctgtctcgaagccctggcttgcaggtgggttccgcttcccttcaactacctcgtccacagcacatgtcactgccgctctaagggaggagagtcttaggtgtcaagcgagctatcttatcactcaaggtaagacactcaatccaagcccagcatcacatgtcactgccgctctaagggaggagagtcttaggtgtcaagcgagctatcttatcactcaaggtaagacactcgatccaagcccagcatcacaatagaagacttgagttagctgttttgggaaccaatatagcccatggttattacagcccacatcaatattgttgctgttgttgttcagtcaacaagcgggttgcaactcttcacgaccctatggattacagtacacaaagcttctctgtccctcctcatctcccggagtttgcccaagttcatgtccagtgaatcaatgatgccatcctgccttctcatcctctgttgccccccctcttcttccgccctcaatttttccaagcatcagggtcttttccaatgagtcagctgttcgcatcagtggccaaagtataggagtttcagcttcagcatcagtcgttccaaagaatattcagggttgatttccctaaagattgactggtttgatctccttgctttccaagggactcggttatgaaaatgattagcaactagagtttaaacgttttcctttcatgcaacagtgaagtcatgcctttcttatctccctcacagtgtacttgtgggaaactgactttcagatggaatgtaggacttggaattaggcattctttcaggaatcattaattgtccatctaacctgtattcagcattcttctgtatcttttacataaataagacagtctttgttttctaggcgcaaacagcattacaagatcatttgtctgctactttttttattagaatgacgatgtccgcatagtaacacctttttgctgttgtattcattctttcacccagtgtttttatggtctctcccagcttactaccattaaagaatcagaaaatgtcctttatggtttcatcaaaaacattgcttaaaaactagcaaacagttcaggactaaggacaaaactctctggtgcctggaaacaaaaattcaggtcccatttagctcaaacttttaataaatctcttgtgtgtgctcagtgctgtcccgtctaactctttgtgaccccatagaccctacccaccaggctcctctgtccatgggatttccaggcaagaatactgaaatgggttgcaatttcctcctccaggggatcttcctgacctagggagcaaacccacatttcctatgtctcctacattggcaggtagattctttactgctgagtcatctgggaagcccaaccttgtattaaaaactttgcaaggcagtgggattcagagattaatcaggtacagccacaatgctctaagaactccccaaatatggctgtgacaggggcacagcacacacgcatagtttaacatgtcaatgaccattggccatgtctagatcatatttctgccttggtccccaagatcttcagagaagtatctccatgtccaagttgcacacacagagaaggctaagacttgtttggaacctaggatggcaaaatatttcctagatcatgattgccttttgccttgggctacatctgtccagattgaatttactccaacaacgggatagctattaaagaggcactccttcagcactgtaatctaatgagatggcttcggataccattaaaagttaaatcagtcgataaatgaaatattaaaatcaccagagaatagaccctatgcacaaaatattaataccacaagcttgaaatcaaatactgaacatgaatttagccaaagccattaaaacaagactctggactctagactgaaatttggagctgtgcctgaggagtttttttcaaaatctgagttttccctcttgtaagagccttggtgtgagggagctacatgttgagggctctctcaggaccttaattgtgggaaaacccctgggaactcatagcacttaggaaatgatgcatcaagtcacagggcaagtgctttatctggtagactgtgctttatcactagactgtgatgtccttaaggataggaaatgggtctcacccagctctgtatacccagctctgagccagcatctgtcacagcataggcgcttaccacatgttatgttcaatctccttttccacaatattctctctctctctcactctctctctccccctgcctccctctctttctctctctgtctcaacatctctttctttttctctccctcccttcctcctttctctctctgggttccacaagagttccctattaaagttgtatgcatctttcatggcctgcttgcttcatcctggctcttccgagaatcatctctggtccctatgtcagaaccactctctcctctgcagtgatccctttg

SEQ ID NO: 32110 - DNA, 4439 bp, Bovine  19866881106140
agctgggtgtgttcattgctaatggggtgtccctgattatagaatttctcagcagacagagctaggaaatagatatatgtataatagtttatgtatgctgacaaaactctccttgaccaaactcttgttgggttcctgtgagccctcttcttgactagatcttgactttatacccaacctgaactttggtctacccagaacagtcttagcaatgaaagcttgcaaggtttcttgatatctaatcacctttgatatctggtcaagttcctcatcccctccccattttgattcctaagttcttgaccagcctttagcaagaatcctattgagtcagtctagcaggaatcctctattcttgatatatccttttagtaatttcccatccactgacccccttactctattggctatatgtccccagctgtatttgctgtgttaagagttgagcccaatccatctcctctattgaactacccctattgcaatagtcctgataaagttctccctaccattttttaactagctttagaataatttttattctgtaactgcatacacacacctataattatttccattactagtggtatacatactaacatatcaaaacaaatatgagttcttattgatatctctaaatctaatccagcaactcagggttcattctaaccttcatccctcttgcttatcagtattttctttctctaacagtgagaaacttcactcttattagctacagtttatgttgtcattgttttagaaactcagtcacttccaactcttttgtgaccccatggaccatagaccacaaggctcctccatccatggaattctccaggcaagaatactgcagtgggttcccatttccttctctgggggattttcctgacccaaggattgaacccacatctcctgcattggcaggcaaatttttaccactgagccaccagggaaaccatatctgttaaaccctagcagtcatatcatttcagaattgctagcctatattcagtgagaaacaaacttaccaatcagagtacaatgttggtcagtagttcttttccatctttatccttaaaacatccatccaaagtttcttaggtccttattccccaccacctccaccaaggttgtgtcacatgattgtatgcagttagattcacattcatcacaggttgtatttgatcctaggatcccctgccactctttattggtgaaggaagttctctactattcctaaattgcttaagtttatatcatgaatatgtgctaaattttcccaaatgcttttttatgcctctactgagatgaccatatagagttcatcttccttagcagctcagaggatgaggtggctggatggcatcaccgactcaatgggcatgagtttgagtaaactccaggagttggtgatggacagggaggcctggcgtgctgcagtccatggggtcacaaagaatcggacacgactaagcgactgaactgaactgaactgattgagatggtcatataaagttcatcttctttagcctcttaataagtgaattacattcttcaaaactccaaatgtgaaaccagtgttgaactcttgagatgagtcccacttgggcatgatgtatcaccttttatgtactgaagactttgatttaccagtattttcctaaggattgttgccttatattcataagacttagggtgatgttaaccttctaaagtgagtttagacaataaactcactggagaggatgtggcgaaaagggaaccctcctacattgttggtgggaatgtgaattggcacagctactatggcgaacactatggaggttccttaaaaacctagcaatagagctaccgtatgaccctgcaatcccactcctgggcatacatccaaagaaaaacatgatccaaaaggatacatgcactccaatattcactgcagcactgtttacaataaccagacatggaagcaacctaaatgtccattgacagaggagtggataaagaaaattggtccatatatacaaagcaatattactcaaccattagaaagaatgaaacaataccatttgcatcaacatggatggacctagagattgtcctactgagtgaagtaagtcagacagagaaggagaaatactgtatgacatcccttctacatgcaattaaaaaagaaatgatactaatgaacttacttacaaaacggaaagagactcacagacttagagaacaaaattatggctgccggtggggtgggacaattagggagttcgggatggacgtgtgcacactgctctatttgaaatggaataaacaacaaggatctgccgtagagtacatggaactctgctcagtggtatgtggcacgcctggataggagaggagtttgggggagaaaggacacgtgtatatgtactgagtccctttgctattcacctgaatctatcacaacattgttaactgactataccccaatacaaaattacaaaattaaaaaataaataaagtgagtttataaatgttcctgtttctatttactggaagaatttgtgtagaattgatattacttcttccttaaatgtttgatgtcattcaccagtgaaaccatctgggccttcagaatattaatcatagttatttaaaattccctgtcagatatgtcatatctgtgtcgggttctgatgattgctgtcttgggttttgtttttttttttctcagagggagggggaagtgttgcttttccttgccttttcaaacacctcgtgattttttgttgagcacagcatgaatgtgtaggacaggagaggctgaggtaaatagtttttgtggacatgcctttcctttggctgggtctccagtgtcaggggttgggctgggctgagacttgttgctgtagttaccctcagcataccatagtcttcaacattcctgtagagacagcttgtgtctagggtttaccagggcagcgtctgtttgattccaagtttggtcttccctttgtgactcagaaagggtctccttccatactcttgggctctcctgtccctctctctctcctctatttgtcactgaaatctccttagggcgggtggtgaggatgggtgagggggaaggtgccttctctggaatcccgattaggaattgacctcagattcctaatcagaactgaaccttgtacctcatccctggcttcctgcagtgtggtcctccaggtgttcctgcctcctcccttctgccactgtgggcctaggatctgatccctcccttcccccaggaggaggagtggtcttcccctctcccttccttcagttgatgccctgagtatttaatccccaatgaccatggacaggagagcagcccttctccagggccccaggttagaattattgttctgtagaggaagtggagggaggctggggcaggctttctcatctcatccctcccacgtggctcctttttccctgactcagatcttctatgggatagatgaggttcatagggcttatggaaaaggtctgcaagaggacacagacctctcttttcagcagctgcagagacctctctccgtcccagcagtccactcccagccttcacccacctgtcagtttttcctcatggtgagccacctgtggcccaggtgagcacagcgtcacctcttctctctctgtaggcaccgtctcacattcgattccctgcaagttgttccctctgtgacctcagctccctggtggtctcaaaaacagtcatgaacttgaaataggcccactatttttcatcacaggggtggttactaacactccttccagccctctacatcctggtgtagaggctgaattcttatctttttatgggtaatttttattttagttcttaaggcttcatttgaatgagctaaagacctatcttaataggaatgtcttattccagttcacataaatcttaaaactcttctaaaaacttgaaaaactatcattacaaatctaactcagagaaatctcttttaaccacaatatgcacctaactatagaatttgaaaggattatcacttagacccaacaaatgtaaactcgaacagtcctgtttttctgtttggtttttttttaagactccagaggcaattaaaatgagaataatttgaaattggagaaagcttcctttttgggataacagaaagtggctgctgctgtgtggaaatggagaaagcattctattttcattttatttattttattttttgccactttaatactgacagtggttttatttttagttcagttttaattagtggtgcagaagaagagtcggagtcattccaaggcaggaaaaaggagttattctaggcaactcaatactaacgataacctagaaagtactgcaaggagatggatttaactaactctacactaggggtgttaggaaaggaagccaaggaggttactcg

SEQ ID NO: 32111 - DNA, 746 bp, Bovine  19866881109404
aggaaattcaagtattttcagataaaaatttcattttgacaaacccaagctgcattttaatagcattaaaaccaggaaggctaaagggaaataagatttctaaagagatgaactcacaagtcacaatttataaactacaataaccaccacccattatgtcttgtaactcacagacaagagctgataatataaccttcatagataaatgcagtctattcttaccaattttagtgacactttgtgagccttacctgcatctcattgtaccatatggtacagccaccatcttccttgagtcttgtgttataacacccttttccacggctgctacatacatgataccaaacctatattaaagaaggaaaaacagattaacatgtatggtgactgacatactagatatctttgttctcaactagttttttttttttttttttttaaattttctgtcctcaaagcgtaagaaaaatagactgcagctatggtatgtgatcaatcactaccaccatcagtagctcactaactagggcttctgatagagttctttttgagaggaatccaaaagattttctaaaacagacttcaattagatgtcaatagaaaggaattctcagattaaaaaaaataacaaaaaatgtaaagtattagagaatgctatctcaagatcagtatcaaaaataaagttcaaaggttttccataagaataaaatatagcaaaaagcaaaatgcacaatatctagtttggg

SEQ ID NO: 32112 - DNA, 1759 bp, Bovine  19866881191698
ttttcatttggcttttcttgaccaatttctgaatttcattctcaatgtatttttgtaagcctcgtttcacaaatcaaaaaggagtctggctgtaggattttagattctgcgacataatctgaacacgcctgttgtctgcaggtagaattgcttgaaccatcatcgaaaggcttgaccatcagtagaaaagtctcacaaagtattgtgattggccattatcttctgggacaccaaggataccgagacacttggtttattctcttactcatttcttcattcatttactcatttatcaagagccttcttgacactcacggtgtttcattgggattggtctttgtcattggtttacactgtggcttccctgtctttttttttttgcccagtttttattacagtgtcttgaccatgtgactgcctattcctttggttctgtgacataacatccctactttattttctccagaacagctaatttgctccaataagaattccatttgttgtttttatgggacctcctccccctcagattttctgctttgaaatcgtgcatgcatgctaagttgctttagtcatgtctgactctgtggccctatggaatgtagccggccaggctcctctgtccatgggattctccaggcaagaatactggagtgggttgccatgccctcctccagaggctcttcccaatccagggatcaaacccacatctctaacacctcctgcattggtaggtgggtactttaccactagtgccacctgggaaaccctgcaaatcatgcttatttgatttatcatctatcaatttcaacctggatcaccttcctcctaacctcctggttctctttttcttgcagtcctcccccttccccaattttccagacgtctcagttttcttgtgttgctggtcatcactgtagtcagtgagtcagggctcactgctggtgagataaaattctcaggttgacagttataccagtaaacaatgcttcaggacattttccagagtttgcagagatattatcccactaacatgtctacacatacacagtttctctctcccccaccgcctctctctctctcgtttttctcttactccctcttacagaaaacatcatgtagaaaatgatggactggaagaacaaaagaaattatttttgcattgatcaagcacttcctgatctatagcagaaaggaaaaaaaaaaaaaaaaaaccaccaaaaagccagattcagaaagataggagaaatagccttccagttgagagtttgagcagttcaggagcttagtggtgctcttactggaggagggtgttattgtgagaatagagtcatcccctaccccccactctagcattgccgccacatatgcctgctgttcccagcatccccttttcttggcagtatcccaagggccacattcacatgtggaccgtctcccagtacatttagtctctcctaagagtcaatgtctttggaagccctactgaggaaggagagaactaactctgatctgattcccagtggaaacacaccttgtgagggccctgtgctattttaaaatgatgaattaactttaatgaatatttcctcactagatttctatccctattaagtattttgcaagatttttattacttgctaagaatctaagttatttcctctcatttttcttgcaaaggatgagttcaatatttcagctgttctcatttattgttaattctcttttcctactaatttattagaaggcttatttttct

SEQ ID NO: 32113 - DNA, 1368 bp, Bovine  19866881212452
gagtggcagatgtagcggatggctgctacttgcatcaccccacttcctcatcatgggggttggtggcatctgctggattgcaggcaatgagtccgttgggagccctcattcacatttggggcttccctggtagctcagctggtaaagaatctgcctgcaatgcaggagaccccagttcgattactgggtcaggatgatgccctggagaagggataggctacccattccagtattcatgggcttccttatggccctccataatccatcctacatttctacccttctattataagatacataggagacccaagaaacacctatgggaggaataaaagataggaatgacaccaccccttcccacttaacatgcctgcattggccacactaaagggcttactcttgtcctccctgcctcccacacacacacacaaattaccacttttgcccttttttttttgtataggtgatccctccatctgatatgctgtattccatgaaatttcaccactgaaattatatttgtacttcatagtttggttataaatccctgtcttccaggaaatctccccaaatctcttcatctataaagagtcccttttcttctaggttaattagttcatcataacttctaaaataacaaacatgaactatgcccagtattatcattaatctgacagaattttctgaatgataaattaggaactaagggatacagatctgaataaggtaaagtgctattctccaggagtgcaaaatctagtagacagagtttttaaatagtcataatattgtaaaataagaacaaaagtatacataatatttagaaagcagcagaaaagaaaaactttggagaaatgcaagcatcaggaaaagactttgagagaaagtagagcaggattgaggaaatgaaaagaagacattccatacttcatactaaccattggcaaagtcttgaagatctgaatctccatgccaagtttgcaattccatttggcaagcaagttgtaactgatgctagaggtcaagagaaagagatcagagcagtgacagccttgggctccacctgaaggctggaacttcttatggaggtggcagaaggtcatcgttacatttcaagcaggaacactgatcatttcttgtccatctttgtaacctagggtcaacaagcacagtgcctggaaataataataatcaaacagacatttattgagtgcttactgtatgcctgtcactgttccaggcatttcgtacgcatcagttagtaggcactgaataaaagtttgtgccattaaattaaatggaattgcagctccatcccaaccagactgagtgaaaatagaaactgtcgttagatctttagcagagtga

SEQ ID NO: 32114 - DNA, 1159 bp, Bovine  19866881257184
aggagcatgccttcctattagaaaggctgtggcctaggtgagggcagtgatcgtggtcccctcagggcacgtggagctggaggggagtctttgcatgtggttcaggtcctgctgtttatatagaatgatgatcttgggcaagtgttgtcacacttcaggtcttcagtttcttcatctgtagactctgaagaatgggtagaaagttctttttattaacacagatcagtgcttcagaggcccgtcttgtgcagaaccatggagctagttgacatagagttgtgagaggaagatgccaggtccttcatctacttcttggggcttccctggtggctcagatggtgaagagtctgcatccagtttgggagacccaagtttgatccctggatcgggaggaatcccctagacaaggaaatggcaacccattccagtattcttggctggaaaatcccatctggcctcaaagagttggacacgactgagcaacttcactttcactttcatcttctactcattgttccatctccatcacagaggaagagatgtggtatatgcaggtttttgcttgatgtgcttttgcttgcgttgcttctccttctcaagcatttgtattttaatctcttacatttcattatgacaatctggaatagatttatatcccattaaagtgatcttgtctgttcactcatccagcagtatccctcacttccagaaattgttctccttgtttttgatggccagtatgcctagttgttttatacccgagcacttaaattctgtctgcagaggccaggtagataataatgttgaatcaagtctgttgtaaattctgttcttttttggtatagtcattgttacttttcacttctgcagctttcagccttaatcttggggccataatagaaaatatgggggttttggctggctggaaagctcatgacccttctaagaggataactactacctaattccagccgattatgtcctttgggccctgtgttgccagcttttctaaatgtgcaggagaaatatcgttatgggctgccgttttctggtctgttttattttttgtggggagactaccttagagcctgttcttaataaatggttgaatgggaaataggtcttcagttagtatttcttcagttcttccagctctgtt

SEQ ID NO: 32115 - DNA, 972 bp, Bovine  19866881273537
gcttcccgaattttaatttctaaccagggattgaacccagaccacggcaatgaaagcactgagttctaaccactggaccaccaggggtgtccccgaagcttattttaaaatggctcaatcaaaaaataattttttaaaaagtgtacatatgcatacagaaaatgcaatcatggtgaaatgttaattggtgaactcaggtaaaaggtatatttggtatttcattgtgtagtcatttcagcttttcagtaactataaaatttgtcaaaatgttaaaggttgaggtgaaaaaaagaaagaataggtaagtgtggaggatataagatgagaaaagttggctgactttgaagggctgtttcagtggggtgtcatcaagtgtgtttatgacagagtctgggacaggggaggcatgaagaactgtctggtaccacgaagccttttttcactgtagcttctttgaattctctgtgctttcactttgctcctccctgaagtattggaatctgctctgctatgtatgatccttccttctctggcctgaagcttcaatattggagtctcttaaaagaaaattgcttgtgcactgacagaagaagtggggggaaatattgaattgcaaattgagggctccgctgtatgataaacttcttgaaatgctgcaagtgtattttaattacgttagtgccttttaaatgtgtcctgcagctaaactcgcaatcattctgcgtagccttcccctccttcaaagtaatttcaagctataggattagttcctcttgtcaggtggcagatattgttcgcatataaccgcttattgtttatttaaggctgctattgtgtttggggtggctattgacagaaaaagtgctgctgacacgtatattctcgtctctcaaggctgctaggttgtaaaagaggctatgcaaaattcaatagatgccttgaccaacgtttccaaattaatgtcagtgtcat

SEQ ID NO: 32116 - DNA, 805 bp, Bovine  19866881296989
tttatctgggaaaaaagaaaaaggaactattttactgattttacggtatcgcaatgagagattgttaattttaaagttaaagcttatatttccttatgttaattccagttacccttcttccctagcaacagcaggtgggagggctttgggtggtcagagtaattcctccccgacttcctgccagggagcctgagtggatcaaaaggccaagagaatgaagagacttttctccttcaaaatagctccttggccccttgaaatgaatgagcagcttctttaacagactttctcccttcctccgctccccccggccccccggctcacattccccatggttggtgaggcagaaaattcacaagaacaaagctcttaccctaaaaagatcctcttttcactctagggtcagttccacactgggggcttccagaggagtcatcttgaaattaagaaaagtaaaaaagttgcagagatgtcagggagatcacacacaccaaggtgcctggcttcagccctcccaccccgcaccacacacatgtgctccatgggaacccatagatagaactcctcaggcaggctcccatgacgcagggtgtgcaaggaatctccgaacctgggagaccaaggaatggatcatctccctgcctggtgtgagtcctgggcaacttctagggactccatcttacccttctaaaaaaaatgggccaagagcccgcaccctgcctctctcgcacagcaggatgtctggccaagaggatgtgcatttgtgatagagttctgccttctccccgccccccaggacaggggc

SEQ ID NO: 32117 - DNA, 1091 bp, Bovine  19866881302242
ataagttacagaaaacaaactaatggttaccaatgggaaaagagggggaggataaagtaggagtttgggattaaaataaatacatatttaaataaataaataataaataaaataaatacatatataaattaggtaactaacaaggatctactgtatagcacagggaactctactcgaataacctataatggaggagaatgtaaaaaaaagaatacatatattaatacatatgtatgactgaaccactttactatacatctgaaactaacaaaatatgataaatcaactatatttcaataaattatttttaaacaaacagatgccatcattaaaatcacagggaacaaaaatgttttgtgtgggaatcctcaaatatcaacaattttttcaataaccatcttggcttcttttatcaaaaaccaaccttaaacaaaggtaagtaaccacctttaaaagtggaggcaaaagcacaaaacataaaccccacagttcaataaaatgatggatgatccagggcaacaaggtaactaaatattaactataacgttaaacaagcagttaacaaagattaatcttccagtctgtatgcagtgtacacagataacacattagcttgctaattctttttttttttttttctgttattctgaacaaatgaccctctttttagaaaaaatgagtgatcttgtctgtgtgaaaaggaatggggaaacagaagtgagcatcattttctgaaggatgtccaaggtgagcggggttgatgggcattcagccagaaggaactgtggtccacaggttctttcccaacactgccaagtctatgatgatctccttaattacctgcggctgctttgcagttattttcattccaatatcagaaatcctgtaactggcctttcatctggaattttagctactagaaataaaagtatttctcttttgaaagtcatgtttgtatgctattcacatgtatccacaggaaaggaaaatcattctaaggggaggtctcactgtgggtttttctcttaactgagaaaaacaaaacatcaggcggttttctatggggtacaaatacagaagagacatgtaaa

SEQ ID NO: 32118 - DNA, 1220 bp, Bovine  19866881306034
atccgatggcagaggagcctggtaggctacagtccagggggttgcaaagtctgacatgactgaaacgaatgagcacgccaacaacttttctccatcctccaaacccagagctttgtctgctcttcttttcaccaaggatggctgggtccttatctcagtgggagggtgtgggagagactgggaaggagagagtctcaccctggctgctaattcctgcccaccccccactcattcatcctctgcccacagcctcacggtgtggacaggggagctcagagcaaacagaccccgagagcatgagacctgaggggcccacccagggttacgggacttgcaagaccaatactcagtacccatcctggctgtcagcgctcccagtgatgtctttctgctgccccgtaacagattctggtgaccacttgactccactggaacgcccagggaggaaatgccaccccctggaatgccatcaaaatagttaaaaatcctttcattggcccatggggtgagatggctggaatctggggaaaacactgcagaaggacttgttcagcaacaccgcgattcaccctggaggtcccggcccccacatcgtggctccctggggggggccttggccccgacccagtatgtcacaccttcggcctcagtgcacagggctttccacacctgtttgacacccctcactgtgatcgcaccagcctgttgccacctcccgcgtggcatagtgctctaaggtcctggagggaaggaaccacacttgttcagaactgaccaggcagagaagtgaaggctcagctctgcccaccctgggtggcaccctgcccatctgggcccgagtcaggtgcaaaccttcatacaacccataccccccacctcttgcctgggcccccccgcccccgccgccccggctggcacaacatcaaggttccattccaagcagcctcggagccctcgcatgtggcccagggtcccagcccctcattaggtggtggcagctctcacataagccctttaatgtggtgcgatggcatttttcaggcctcttttcagaaggaaaaaagttaataacgtgaaagctttattacctctcccgtcccccactgtgagacatgcccttcggtcgtgcaacgtggggctagttaaggccacagcccgggatttcctcctctctgggagtaagtgaattacacacgcggccgggccaggctgtaaagcgg

SEQ ID NO: 32119 - DNA, 1252 bp, Bovine  19866881308628
tgagagaatcgctttggttataatgtatagccaatctttcttttaaacagttggttatttctgtttctgcagaagcgaacttaataaaatcaaagtagggaaaagtacttcttcactatatgaaatatatatatatataaagaaaacacactccaaagaaatttgagttttcttttttttcctcacagatttacactccctggtgagatggacattgacaatatctcctatgaggagctttccccacctgaagaagaacctgctgagaagaaaaaggagaaggagctcaaaaagagacgagaactacttaaattagtgaacttttcaaagtaaatgatatattactgttcatttggtaatttctttaaaacagtgatctgagtgtgttccttactagtgataactgctctgcattatttctgcagctcaagtcaaatgcatttagtattgtgcccttgtgcttttgtgtgttgtcccatgagtttggggcttaatggaatattgatcatttttattctattttagatcatagagaaatgtgcttccaggtaaatataagtgacctaatatagtttttcaaaacaggttaacgctggaacaaaaggaactttgccgttgtagactgaaattattaacctacttagatcggcttgcaacatatgaggtaaagggaatggttttaatcaaagcaattatgttcattcgatctgtcattacacatgctgtggctgcctatcctgtgggatattcctggtctttagaactatttatgtgggaaaaatttgcacagaagcacattctcttgtatatcatttttgctaaaaattagggatttgtgagaggccagaagttgctttgttagtctagggagtagaaatgtgtgtgttatttcagcatttgtgtttcctagatttacaatccttttcatttatttttattttacatttaaacttttggttatggtagatagctgtctatagtagcaaattcagtatccactggggtttaataatcctaatatgaatattctgacctgctttattttaatgatttattaatgtcttgaatttagttggctaaacttcgatcctaatgacagccaaaattagacacttgaacttagagcaaacttcaaaattgtttcttcagggcagcaaacacaaatgtcccatgttggacatttcagtagtgccctgtcctgtcagatttgttagaggtgtgagaagcatttcacaaaatatacatagtttag

SEQ ID NO: 32120 - DNA, 1110 bp, Bovine  19866881414504
ccagccagccctttggcactcagctcaggttctccccgccaagaggatttccttgagtccatcccatgctgggctgccagggctctgttcatacctctgtgatgataaaaagtacccccagtgtaaaggctccctctgcccacagcctgagaacatgatgcgcctgggcagagatcctcttgttaatcctgctatccccacacacgtctgagtgcctggtattgagcagatgaacagtaaacagtgactggccaggtggataaatgagagagtcagtaaacaaagttcatggatgaggaaactgagaaactctcgctcagactttctcataaagtgttaggatgaacagaaaggaaaaaattttaactttcctttgctactacacaaaattaagacatctccctagttgtgtttctcgttatttagactctggatgacaaaattagcattctgtaaggctacctgtaatatgctgatacggccggattctcaggtaagaggggggagaaaaggtctttgcacggttgagttccccacatcactgaagcatcagtgacagctaacttgacaataaactccaagctcagaacccccacagtccaattatttcatctatcttcaagccaattgatgttacacatgcagaagaatgaacagcaaaactgtattaatgaggttttctacaaaacagagaaataaatgcaatctgcagcaaaacatactaacaaggggctcagtggagtatggaattaagagttcaccaaataactaaaaagacagagtttatacttagggtagccagggagactatggaggaaaaggttaccctctgagttgaatgggcttctcaggtgctgctagtggtaaagaactccccttgccaatgcaggagacacaaaagacttgggttccatccctgggttgggaagatcccctggaggaggacatggccacccactccagtattcttgcttggagaatcccatggacagaggagcctagagggctataatccataggctcacaaagagtcagagacaactgaagtgacttagcatggatgacttggaaccccagatcttatgtactacttagatgttcagaaattca

SEQ ID NO: 32121 - DNA, 823 bp, Bovine  19866881476787
tgtacctccgtcgtgtccctggtcacgaatcatcagtgtgtcttcctttgtagtgcgattgtgctctgatcggatcggcctcgtcaaggagtgtatttgccagtcccccacgtgctacaagcagtccaccaagctgctgggccttgctgagctgctgagggtagcaggtaagttttgaaagcttaactgctgtgcaccatcctaggaaaacactggaatatgtgctactaggtgtgagaggagctgcttttcagcaaggttttgtcttttccagcaagattggcatgttattaagatgtgttcctatgttgagctgcttggacctctgttttctaaatgaaggcagacttttttggggttccatggtcatacagggtcagaaagagaagtcagagttaccatttataaccagaaaacttaaaaagtaggacaaggcagctcaactagttcaccttcagtttccacatttggtgtaatattttctttttaatataaatttatttattttaattggaagttaattactttacaatattatattggttttgccatacatcaacatgaatccgccatggatatacacgtgttccccatcctgaacccccctcccacctccctccccgtaccatccctctgggtcatcccaatgtaccagccccaagcatcctgtatcctgcatcgaacctggactggcaattcatttcatatatgatattatacgtgtttcaatgccattctcccaaatcaacatttttgaacctgaataattacttagaacaatttgtgcatttactgttggccaggttttctcacgcattgtctc

SEQ ID NO: 32122 - DNA, 1003 bp, Bovine  19866881561187
tcctttgacctctccagtctcggtttcctcatctgcaaagtggctgttctaacaccgacttcagtggtttgtgaggcttgaatgacagcacgtgcaaagatctggggctcagtaagtggtaagctgtcaccatctctgtctcatagatgacaaggaggaggccttgaaagaaggagtctggagagcgaggcttaagtcccggttcagccacatctgctccctgggcctcgctctcctcatctctaggatgggggaaggattcccgccccattggcctacagggcagcttggagggcctgggagttaattggaggtcttaactctggctgtgcaccacgatcacctgaggcgctttaaaaatgacccaatccagtgatccacctctgatcaacctcatcagggtttgggggacaggaatccagccctgcgtgttgctcaaatgtccccagtgagtctaaggcactgccaggttgtgagtcactgagataaagatgtggtcttttccaaaccgtcgaggccttgcacatgcggggttcaggcaggaggactcccctccaggtactgctcctgctcgtggggtggggggagggtggatgggaggtttcctcggggtcaccattcctcccttcatggggttgggagccatcagcctctttgattccctttcaacacttcccaggacttctgtcccctctgaagagggaagcagggagctggcagtaaccggggcttgctgactttaacctttaaaaaaaacaagctttattgtgaagaccaaaaggtcttataaaccttaatgagcggcatatgtgaaacacatacgtgaattgcttgtttgaaaaatatttcccagctagccttcaatagcagagccttattattctaaacgggagcttgtcttaccagaggactgaacaaaaccccagttggagataattatcttagcagaattccccgtgggtccccggagaggggccgggggggggaagccgctcgaacacat

SEQ ID NO: 32123 - DNA, 1488 bp, Bovine  19866881683448
tcccacaaccaggggtggcttggagttagactggctctgatctgggcctttatcttcgttctgcctctgacccactgtgatctcttaggccagttcgctgtcttcactgaatctgcgtctcatgaggtgtaaaaggcatcagacgcacacccatttctctgagcagtgacaattagctgagaccatgtctgtgggggctttctaggtggcgctagtggtaaagaacccgcctgccaatgcaggagatgtaagagatgcgggttcaatcctgggttgggatgatcccctggagggagggcatggccacccactccagaattcttgcctggagaatcccatggacagaagagcctggcaagctacgatccatagggtcgcacagagtcggacacaactgaagcgacatagcatgggcacctgtctgtgaagtcggtatgttgtccatggtgactttgtgacaggggttttgctgcatgtaggttattactctgtgactgcaaaaaccactgtctggcaccctggaggttttcatgccaggtccctgtatttgaagcaaattcctcatgggggtgcgaagagcttctttctaaagagagaatataagtgcagcctcctgggggcggggtatgagcctctactcacactgatagcccacctccctgagaggctggccccatcaggtccccagggtgcgggggatgggggagaggtcatgaacctgcacagcagtgtagagggaaattgactaatcttatccatcatttaattctcatactctccatagccatgatgactacctttctaacttctaaaataaacttaccttccccaaattaggggcttccctggtggctcagatagtaaagaatctgcctgcaatgcagaagacccgagtttgatccctgggtcgggaagatcccctggagaaggaaatggctacccactcgagtattcttgactgggaaatctcacagacagaggagcctggcaggctacagtccatagtgccgcagatggactgccaaggctcagagatgttaagtgatatatccgaggtcactgggccagtagagagtggccggggtgaaaaactctatctaagcatgaatctttccgaagccgcccagagcagaggtgctggaggcgctgttcgcccgcagtctgatgttgctcaggcctggctctgagccaggcctctgaagtttactgaaatgttctgagagttgttgggggaaatggagctttgaacttgcctaatataacacgggctggttctcaggatcataaacatgtttctgaacctaattaaagagtctcgtgaaaagagggagagcagagctgagacatgacggtccgtctaaaacctccccgtgggccagaacgggagcttggcttttcccagactcggggagaaccagccctctctgggggcagagagttaagaggctttagaaagaagaaaaggctcttttacagtccggctgggga

SEQ ID NO: 32124 - DNA, 1314 bp, Bovine  19866881726513
gtggaatgaaaattctaggagggtctcctggttccttccctagaaactcccgccccacatttcctaagggagttttgtgcctgagagtcccttctcttttgtttttggatgacaggggggtgggcaaaatcctggtaccaaagaaagcagctggccaaaccctgattcctactgattaagactgattaaggaggaattcagcttgagttagtggttcccaggcttgtcagatgataaaaccctcttgatcagaactttcctgtgaagaacccgacaaatctttaaaagtaagagtcccttccccaacttttatcatggagtaagaccccaagggaaaaaagttgaattgagctagaaatgcaattcacaacgcattcatcttgtacttgagagatcctgaaggaatcaacactgataaaactgaaatgtaaaaagcccagcggatgtgagaaaaggcttcaaaagcactgcaaattttccacctttaattttaaatattattattttacaaacacttcatagcacttactgcaagccagacatgatgcttaacaaatatttgctcatttaattttcataaaatccaacagaagcccagtgagggtaagtcacttgcccagggtcgcatagaagtggtggaaccagatctccaaccttggctgtctggctcccgagtgttcgatttaaacttctaagctctacgtgtttataaaaatctcttttcacttggccacagggcaaaccccctcttcctaatcattgtaaatgatagaacagtttcgtcctggtgatctcaaatacttcctctgtgggctccaattagcggtgctgttttttatacggggcccgatctgcctttctcttttgatggagaaacatgcttattgttatggcaatcccaaatgccccatgacagcttttaagtacagatttgaatccctttgtttttcaccccaaatgttgaaacaaaccttaagagctctgctgagtcctgacagttttctgtggttctcagatatttcagactggtttgggagcaaaacacatgatattctgcttctttctcttgcatagtttatttttaaaagcatgcatctggctgctttttcatttcccagaaggaggagggaaattgctccccagaagacgagtattggatgggaacttctccccaaggctggaggtagctccatccgggtctagttccttattgggtgctgccccttgtctgatcttgtcctttagccctcaagttcagagcttccaggctcttccaggaatcctctgagctgctgggctccctgcacatggaca

SEQ ID NO: 32125 - DNA, 958 bp, Bovine  19866881749959
agaaccagcaagccaggaatattcctctccattccaagtcgaataagcgacaatgcacagtcaacctaaaagggaaaggagacagtaagtctcttgagttttatgtcttctttcgcatattttctaaagtaaaagctccagtatagaatctaactcttacagtcattttatataaaatcacattatcaataatgttcttatttagtacaaaaacattagacttctttacaaaatataccagcaccaaactgcctcaaaagaattaaataatctgcaagaaatactgaaataaaaataaaagacaatcatcttcaattcatagagcattacagttttcagagctgttttacatgtatttgcctacttagttctcaaaacattaataagcttggggtgtggtgtggggaccatagatattaacagtaagtgataatgggcttcccctggtggggtcagtggtaaagaatctgcctgcaggagatgcaagtttgaccactgggtggagaagtctccctggagaaggaaatgacaatgcactccagtattcttgcctgggaaatgccatgtacagaggagcctggcaggctacagtccatagagtcacaagagtcagacataacttagtgattaaaccaccaccagttcgtgataatgtgaaattaatctgtattcattagaccattctgcccccaaaagaacgttttgcttccatattcctgttcagtacctcttctttcacaatgccacccatatatgacattcaataaatacttgatgaatgactaactctatacaactatttagaccttcttagagcaaaacaaagaacaattttcctatagatgctcaacatacagcaattccactcctatcacctaatccgatttataaaatgacatatgctcattgacagcaaagtcatctaatgctgccttaacccacagtgccttatactgct

SEQ ID NO: 32126 - DNA, 1073 bp, Bovine  19866881842369
actttccttttcctttactgcgtacagttaatgtggcagcatgaatgagataataatgctttgagaactaatgttttattttgttggcttctgaatgtgtgaatttatgactttaatgctgcattaatggcttctttccatttcatataatgtgaggtaatgatcgtttgcttatcatctaactcatctttatgggcataactctcatctgccaaatgatgtttcctgtgtatgcctggagagaaggagccagattgttgttaccgcatttctgaaactcattgtagagtctgcagactgaaataggagctatttggttccacttcaatattttttcagttattgtttgataaaatatatgcagtttgaaggatgttttaaatgtggattgcaacttgttttggctgtgtttgccaggccataaatagtaatttcatcttctctgtcttgaataaagacttaaaaatagcacatggaattagacatttttagagctttcctatgttaatcaggagatttttttcatgtttctgagcttgagataccataacccagagcttcctaatgctgagtagcagcttgcctagatgtatgtgggctgaggcccccaattgtccatcagttgtccaccaggccatcaattgtccagtggcctggtggccctctgacagcacaaacccaggctggttgcctccagttttcagcagcctcatctacttacccacaggtgccatgctgttgtttagctgctaagttgtgtctgactctctgtgacccccatgaactgtagccctccagcttctctgtccatgggatttcccaggcaagaatactgaagtgggtttgccattccttcctccaggggatcttcccaacccagggagcgaatctgtgcctcctgcgttgcaggcggattctttttaccactgagccaccagtgctgtacagacacggtagtgtgtgtgtcttgataggaaaaattttgggaagcatagactgtttgaagcgccctggttttgaaatgaaacatttctctcttgaactgtgtgattcaggagcctcagcttatatag

SEQ ID NO: 32127 - DNA, 1726 bp, Bovine  19866880359880
caggcctgaaaattcatcagtggataagaatctggacttgtcctttacatcccagcagtcacctgccaggctgtgtgacacccacctcagctggagacttggagtgcccccctcccgttctgtcctcagcctctcactggggccaaaactcgtcctggtctgctggggcctccagcgtcaggtcccggtctctttcagcccaggctttcttgcatactgctttcttcccttcaagctctgttcagttgtggacatcagggaagaagggggttggtaacttgcccaactccaggagtgagggacctggcagtaacttgggggttgaggtgaattctgctggacctctgatttccatcagagcagggattctgtctggtcactccttatgtcagtagcagcaaacagcaccagacatagcaaatgctcagtaaaatccttgacaggattccactcctgctggggctttgtttctgttcatgtcctgatgcaatcctctctcctcagcactgccccccagatattgaataccagctctccagcacagcaggcagaaaatgaagccaaagccagctcttccatctcaatcgatgagtcacagcctaccacaaacatccaaatacggcttgctgacggcgggaggctggtgcagaagtttaaccacagccacaggtaccttgcattatggggcctggcttattctaagagggtcccagaaactcccacagatacgtgagtagagggagcagttcttccccctaaacaccagcagactctccaggcgctctccagaggaggcagtggggtaggaagctgtgcacgtctgaagcctttggtttggtccccgctcttccattaagtgtagccagtgactgttccctctccctcgtgtgggtcacagattcctcagatggatttgttccaaactatttgttcataggaagtttgatgcaaaagcccaagggtagaacagatgaaatctgaactgctgtggttgatggagcggggaggagacgaaacgcggcatcccgcttactcatcccactcatcccacttctctacctcccgacccccaggaggcctctgacaacctctaggctatgaaggtctctgaaatccggatttggagaattctagaatacctgttctatctcagcttatctgggccagattgaaacaaactacctctgcaacttaaagatggggaagccgaggcacagagtgatgaagggattagcaggggatgactgttgccagtaaagatatttggcaaaacaactctttttttccctagaatagcagtgtctaaatttcatcagtcataggccatataaatcagaacccatgtggggcccagggaatggcttgccttgagtgttaacaagcttcacatgaggttagtgtggagcaagtgtaatgaggattatagaagaggaatcaggcagagaagcccctgggaagagggaccagatgtgggcagagagcacagcacggtgaagaactgaaggggggaggtaggagagcaggggaaggaggctggtgtgtaattaggcaggacttgggactacagtcaggaggttggtgtttatagcaaggaaagaaagtttaaaagaaactttagttgctcagtcgtgtccgattctttgcgaccccatggactggggtctaccagtccatggtagactgtagcccaccaggctcctccatccatggcattttccaggcaaga

SEQ ID NO: 32128 - DNA, 771 bp, Bovine  19866880378761
agctcctacttcccttagaagcagatgaaatttgtgagggacagggagtcagagaaagaagcatatttgttttcgtttcttttcagaaaatgactattcagataatacaacccactgtgaaattttaaaagacaaaaaacagaaaagaattgtaaaaatgcaagccactttcaattccaccatctagtgttaactgtcgttactagcgtatatccctcgggcctttgtgagtgtgtgtgtttaaacaaaattagactcatgctttatgcataatttcctatcctgctttctttaacattctatataaagcatttcagcacgtccatgaggccgtaggcagcatgagagtggggtaggaactgtgtctcttggataaacgccgtgcccccagggcctcgcatgtgtaccatgctcaaaaaatactgttgaaaaaaaacaataataacaggtaatatttattaggggacttctaggcatcacagcacatcacctaattgcatcctcatgacaagcctatgcagcaggtgcttctgggaaccacatcttattacagacaaggaaaatgaggccaggagaggagatgtccctcccctgaggtcacacatccctgatatgtctctgcagaaacacatccttgaacacgcaaaatgccaaactctcactcgatacgttttcttgccacattccacatttaatcagggactgaggggacatctctgcttggctgagacaggactctctgtttgggaaatgtttggcccacgctttaag

SEQ ID NO: 32129 - DNA, 2469 bp, Bovine  19866880482230
tgaggtgatgttgactttgggtattggcaacccaagatgaacttttcagggcttctcacaaccaggctgatgggcactcccaaatatagtcaatctcatggaaggagctctttacaccaccacttggctggccttgctggctatactttgcatcaagctcctccctgtgcctctctcacaacagcagacagctgtaataaaggttcaagggtatggtggacagaacatgggctttggttctgccaatttctagttccatgacactggaaccccctctctgagcctcagtgtccttgcatgcaaaatgggagtgattccatgagctgatgatgcaaagtattaactctagccactcttcactgagatgcgcacagcacaccatgtgctgcccatgtattggtctgatctcagaagtgcccagtgcttaagtatggtgattcgtggcattagaacgtgggttcaagttccagtactgtctagtattgtcattgtggtcactgtcattatcaacaccatcgtcatcatgtttgactcctccctacttttatgaagtatatagtcatcccaggtttggtgagcctttaaacaactccttacatgtgttctttccaccattctgcattgcttctattcctctgtgtaaagtgtgttcagcatcctttatacccaggaaaggttgggggaactaactagtccctctggagtcagaagcagaagattatgggtgagcctagcagagcactatgggaagattttccttccaattttgacagtgtcatctgtagccatgggcccttgggaaagctggttcatctttcctcatcctccacatgggcataaagtcacttacctttaggcaccattgggagcatgaaagtgggtgccctgttgcttagcaatggttttttaattttctcagacactggacaggggactctctggagcaggagcttatggcttgatagtttgatggaggtggcattaccactgtggtcttttggggtttcttgcaggtttgctccctggaatgccaggctgccctgcagcctgctcaggagtgggagaggtgccagggccttctgtctttcctcactcccttcaccgttgggctcaatggcaaggaagacttgaagagcaagacagttttggaagagtccagcagtgagccagccaagcacatcaggccctacttgaaggaactagagaaaaacagattccttctcagcaccccagcagagaagaatgctctgagcagcagcctggcggagaagctcaggggtctctctggcaggttgggggaggatgcagagtctgagttgatgggggatgctcagctgaatgatggcgccctggaggctgaagcgcgggattccaatgaggaggaacccaaggagcaggtcaaacgctatgggggatttttgcgcaaataccccaagaggagctcagaggtgaccgggaaggaggctggggaaggggaggggggtgaggtgggccatgaggacctgtacaagcgctacgggggattcttacggcgcatccgtcccaagctcaagtgggacaaccagaagcgctatggtggcttcctccggcgtcagttcaaggtggtcactcggtctcaggaagacccccagtgcctattatgaagagctttttgatgtgtaaacacctccccatcatggagttgagtcaggagctttccataatgccctggagcttggagtgaactcattcatctgcccctgctcagatggtccccattcctcgtgctcagttcagcattgtctacaagacttccaaaccttgtctgcctctcttctgcccagatgcagtgtttgtctgggtcagtgaggagggaagagagacgtttccctctccaataggcttagtgcttggcttcaaccctacatctctaaaactaccaccagcagcagctttgctatcaattcccttgatatgactctccagtcccaggaatccagactgacctcttgatccctctggatctatgatcaagtattctgatcaatgcccctcagaagaaaaatgaacattcccctcccatgcagatatatatatatatctttctatatagatagatagcataaaacatataaaaggtagaaatttaaaacaaaatagatatataaaaaatcctaacagtttattctcaaacctcaaaagctctccctactatggagaccacgctttaggcaaaaagctcaaacactgctttttattggagcaggaattcctacgctacagagttccgtctcccagtggattaaatgttcagtcagtgtactctgagtttgcgttgtttagaaacacaccttttgaagaacctggttcctggactccagtccgtgttgataccctggacagcacccaacttctcacaggagaggatgggagtgaaaaatctttttccaaaatggttaatgagagccgctcgccttctgaatgctgaaa

SEQ ID NO: 32130 - DNA, 2380 bp, Bovine  19866880547784
gccagaagggtgctggctctctttagtccctggtttcagactctagttcggtgagttactcctgttgtctatccagagcaaaaaaacagaaaattccaccactatcacctatgaactcagggcaccagtttgtttttgcttaagctgatttgagtagggttcccctcatttgcaaccaaaacggtccagatggtcaaagaaacaaagaagagaaatcaggaaaaaaaattgtttttccctcattcagggttagcaacaccaaaccctgtttggcaggcaacaagatgtatgatgtggcagaaccctcaattatatgggatggagtcataacttttaaaaattatatttgcctataagaaagacttttaaatggaacaggtgaaaataatgtcctggtgttaagatggtccaattatcatcaggctttttttgtttttgaaaatcttctggcacgttgttaggatattgtttttaatggctttgaaaaagtaaacccattgcataaggaggcaaagggtggggggagggttgtattatatatacagtgtccatagtcagactaacctggggctgtttctatacagtatttgatagtatgaaaaattgtactctatcaatggctgaatgcataaacgaaatgcagcacatacatacaatggaacattagtcagccttaaaaaggaaggaaattttagcactgctataacttgaagacatagggtgaaacttgaagacataatgctaagtgaaataagccaatcacaaaaggacaaatacagtatgattctactcacacgaggtacctagagtagtcaaattcatggagacagaaggtagttctggttgtcaggagttggggagcagggagtcatttaaggattgccgtgcttcagtgttaccaaatgacagaggttctgtggatggatgacggtgatggtggtataacagcgtgaacgtacttgatgccactatacaccttaaaatggttaaaatgatatttatcttatgttatatttcaccacagttaaaaataaatactttaaatttaaaaattacctgctctgtgatgctggggctggagctggttagactttgccaataagcagggtgagctagagggacaccgcaggactggaggaaggagaaaagacttgcttcttcatctttcttctctttagcttctctggtggccttcctgctcccatgagcatcatccagcaatgctccttcacctcacagcagcaattcctcctgtggcaccagtcagcaaccccttctcagggctctaggttcagctccatggggcacttcccccaactgcagagccaagagctccagccagaatctcctccccagaagtctgagttcctgccctcctggccccaccctgctttccaagactcgagccccagctgagcacaccttctttcttagatacctgaagtggagtactgcacgtctcctgcttaatgtttttcagttttgatcatctcagcctcttctctttgttccctcaggcctgggtgtgatagatgcttcctgaagtgctactttcattctatcttagagatctttttataaccttttggtcatccagttaacaacgttatacttggttagcaattctctatattaaattctctctgttaaaataactagggtggtttctgtctccagcctgtctctgactgacacagttttcaactttgggctatcattactgatgctgttgtaatcacgtctgttcgtgtgcataagcacagtggctctaggatatacaggtttcctccactatccaaaagtagagtgttcccatgaaacatctcacaagctgaaactgtgtaaagtgaagaaacagttaccttaggacagatcttgctaacagaggcacaaaatgagatagactgagataaagcacagacacaggtcaaagccagaccaaagctatggtggcctggtgcagagagatgctgagtgcagttcctggggaaattctcggggaaggagccttggtggccccagtcccccctgccccctgctgcccctccccagggtatttgctgcctctgtaacagctcaccccagatcaaacactgaacatcagtttcacttttcactcagttttgtaaaaatgaaaatcaacttgggctttctttcaattcacaaaaacagttacaaatgtatatctctcataaaagtgaaatggcatcaagtgaactttagaaaagcgacagatacctgtatagcaaagagttgaattggaggtatgtgaatactcaagtttacaagaaatgtattttccaaagtggggcatttgcttacactcccacaagctgtatccaagagctcctgttcctccatattctgccacacttggtat

SEQ ID NO: 32131 - DNA, 4485 bp, Bovine  19866880551050
ggagtcagctccgggaggcactgggaggcgggtaacagactggggcgaggctggggggacgcgtctccatcctcctccgctttcccttggggcagatctggttccccagcacctcggtccccagaaccgaagcctccagccggcccgggcgcaggggcggggcgcggggtgggtgctgaagaagacccctccctcggccgctggcctcgcccctcgtctggggagcccctactgcgccgggtccccacgcttactccgcttctcagcccctcccacacacgcaacccgctggagggactcggggtcctctccgaggtccttagggcgggatgctcttcggcgcgtgcggctccgtgactcgagggcgccacctgaaggcggaaaggaagcctctgatgaaccaacctctgtagtgccccctcccctgggaagcccactcgacaaccccacaggctccctggccccaggggcccttccagctgtgttctcttggcctgcattattgtccttatctctgggagctgtggttttcactgagtgtcagcctccttcctcagactggcaggtcctggaggccagggccgcagaccgacgctcccagagcccagcgtggcagtgggtggacaggtggtagtgggacacatttcaccgtttctttccttctggggctcagactaaggtgaattaaatttcacttcacttcaattaagtgaaatgcctagtgcactaaagttaaggagacactcgctctttgggagcccaggccaagcccagagaggagctggagctgaagatcaccagcttactggaagtctctgtgaacagctcactctggtggcctcaggtggaatcctcccacctctctgagcctcagtgttcgcctctgccaatgggatcatgaaaatgcagactccaggagctttggaggggtcagcagaggcaaaccgtccggaagtagaggcacggtcctgagtcctcagccgcgtcatggtagagctggacctgtcctgctccaaaggcctgtgccatccttgacgagtaggacagcagaggcagccccagaagccaggtgcccaggcctttgaggctagggtgatggacacctgggcagggcttccagtgctgggacgagtgggagggtgtcaggctcttcctgccttccagaggcctggcctactgttgttgctgtttagttcctcagtcaaatccgactctttgcgaccccaaggacagtagctttgggattttccaggcaagaatacctgagtggttgctattcccttctccaggggatcttcctgacccagggattgaacctgggtctcctgcattacaggcagattctttaccatctgagccaccagaaaaggcggattgttgggagacttcagaagagagctgtctgtggcaccagactcccaagggaatcctagctccaccacctttgtgtgaaggggcccctcttggagctatttcctcatctgtgtaatggactcagtaagggtaatgggattagatgaaatgttccctatacaacatcccaccatgtccaactcaatggacatgagtttgagcaagctcccggaagttggtgatggacagggaagcctggtgtgctgcagtccatggggtcgcaaagaatcaagcatgactcagcgactgaagtaaactgaactgaagggtaatgggaccagaagaagtactccctataaagttttcacagttcccttcctcagcctttgcctttgctgttccttctgcctgggacactcttcttcctgagaccccccagaatgtgccctcatatccttcacatatttactcaaatgtcaccttctcagagacaccttcccatggcatctttttaagactagcagtaccccagcaccctttactccttaattctgaatttttctccacagcatttatcagcttctgacatttgcttatttctttctttattttcatcaccactaaaatataaatgttaggaggcagagactttgccttattccctcttgctatatcctcagatgctagaaaaggagccaacacaaagggggcttttgataagtgtttaatgaataaagaatggagaaaatgagcatttattgagctcctattatgtactgattaatcaagacgactccatccccatcctaccttctagaagttcgtattctagtgggaggaaaggataagcaaaggtaatattgccacaaagcaaaggtaccctgcaagctttcagcaaggagctgaccttgtttgggactcaggatggctccaggttctcctgtagaattgagggctgagctgagactggaaggatgaataggagacagccaggtaaaagagagcaaggaagcgaggcccagcagagggactggcatgggcaaaggctctggcgtagaagggagtgtggtgagtgtgaggctttacggaagacaggatggttgccctgcagggctcaataaggaacatgggacatgaggctagactatcagtaagccaggtcactgcaaatacttgtaagccaagcagttggttctttgtccccaaagcagtggggagtcattgatcaatgtgaataaagggttaacaaaaacttttcctcttctgtgtgagaatttgacctttggttaactgtctagctctgtttccttggaaacagataaacatatgtcactatgttacctggcaacattgcaatgataaaatatgaccccggaggaggagcctccaatgatccatgtggtaatggatttgagttggagatattagtataaattcatgtttagcataatattgatacagatgattacatacttatgatacattttatatacaactgtaattgtgtatacacacaagttagtatacactgtatttcctttctctgtcagctaagaggacctggctgcatgatattgcatagtaataagcacatctactgcccagatcttggtttctaataccactctccaataaaaggaaccagaggaaaatggttgatgctaggactggagccgaaaacatacaagacaagcctggagcatctaatagtgccataaaataaagaaggaaccaacaacacacacacacaaaatgatgggagtatgtcaaaagacataggggttgactgaaagagctgatagccaaacttggaaaaatctgataaaaaataaataaataaagtaatattgaactataacctaaaatatgataaatgcaaaaatgggggaaaagataaatctctgatgaagaattccaaatactctatcctcaaggaagagaaatataactcccaattctttttttaagaattctgtgtagagattttttaaataaaatttgtaaacattactttccatttagtagttattaagaaatattgactaaattccctcagtttgtgcagtacatccttgtagcctatcttacacacaaaagtttgtatctcccagtcccctgctcctgtattgcccctccccctcctggtacccactagtttgttctctattatttgtgcgtaactccccaacccttaaacgtgggctgagcagagtgactttccgagagtgcaaagtggaagtgggggtggagaataactttgaaaaggagaaactgacaaccctgattaccttggccaagaacaaggtcaacctcggcagtcaaattatgttgatcgtaggtatcctggatatgatgtgatgacagtggcaatttacttctgtgatctctctccccaaacccataacccccgtctaaccatgagataaacatcagacaaatcccaactgagggacattttacaaagtacctggcctcaaaactgtcaaggtcatcaaaaacaaagagagtcttgagaaactgtcacagcctagcggagccttaaagaggtatgatgactatacataatatggtgtcctggatgagatcctggaacagaaaaaaagagcattaggcaaatactaaggaaatccgaataaaatatggattttagctaataataatagatcaatatcagttcattaattgtaacaaacttatcatactaatatacgatgttaatcatagaaattggcacaatgtcacttctgctgcattctgttgctttagggaagctcacaggccagcccagagacaagggtggggaggtctacataagtgtctgaatactgagaggcatggatcactggtgctattattttctctattttaagatgaggaagtggaggcaagaatgattaataacttgcccaaggtcacacaaccagtttacgatgtttctggggttcaaatccagaccccgactcagtgctgataaccacagttctgagttctgtcataattttcaaagcatgtgcaaaattcctgagctgttgttattccccctgacccccccatttttttttttttcctggttgcacctcaggttttcaggatcttagttccctgtccaggggtgaacccaggacaccacgg

SEQ ID NO: 32132 - DNA, 1749 bp, Bovine  19866880670209
cctcaatgtggctgagtcttctctttattcacgcatactgaacacctactgtgagccagggcctggtccagatgctatggaagcagaagtgaacaaagcagaaaagggctcttattccatgaagcttatgttctctttcctctgaaagaagagagattcatctagggcaaggagtgaaaattttatctatttcctcttcagaagcatcacactgagaagaaattcctatagcacaggctcagtggttactctgatggccctgcttggaggagatgcctagaggttgggtgtttcctgggaatctgttaagaagaccctcctgtgattcagggattgactcacacagtcactgaaggctcccagcagagctgggtcatctcagaatgtccctccccagggaagaggttcatgtgggtgacttaggagcagccccactgaggtagcaacggtgatcatttagagcgttctgaccaaaactctggatcctgggctgtcagcagaggaaggacctttagacaccattctcccaacctcccacgtacacatgggggcctgagggcaagaggtataggggccctgaccacagtcacatggtcagtgaggggatccttccagaacccaatctatttcaaagcgagtcttcttcctacactggcactggaactcaattcatggaagaacctggcacataggatttgaagaataaaaattccttgaattaatcatggaataagttcttttcatggttttcccaaagtttctgaaggcccctcacattcagattctgagcctgatgtgactggaaaccactcccttacttttagcctcatgattccaaatccctcattccatatgagcacctagagctgccctgttttccaacagctacctaactctcagcatatggagacagcatcattcatcttacagtttcctgttgatggacactaagttgttcctaaccttgggctactgaaacagtgctgaggtcgataatctttctgtctgtcactctcctcaaaggggaggtaaccactggaagtggctttgctaggttgcagctgtcgactgaaaaaaaatgtacaatgtgagagttgtgggtttagttttatttggagcaaaaagaggactatagcctgggagacagcatttcaggtagctctgagagattgctccaaagaagttggggggtgggggcaatatatatgtgcttttggtgaagggagtacatgcaatcaagcacacgcgttttgcagaaggtttatgctagtcacaaggaacagatgtcaccatgaaagattttgatgcttttctagatatgaggagatgcaagaactgggctcataaaatcatctccagaaaatatctaaggatctgaaggcctgttctgccaggtttttccagatcacagagtgcctcctttctgatcttctttcaggaggtgttgaaggtcagcagctacagtggctcatagtttaacccttgtaaagatagaaagcaagtgtcaatttgtatgtgactaaggatacgtgtataatactttgagtggatattgctaaatttccctcttagtcatggtagccactgagcctcctcaaccttcagacatcagcagggaaggtggttttttcctgatctgcagctattacttagcttcctagatggtgggtcccttgctcaacctcggtcacaagtagtaagtggttccaccgccactcagatctgcagcttcccggaaggtggatcatc

SEQ ID NO: 32133 - DNA, 1317 bp, Bovine  19866880939472
taagtctactgattcataggttcttaaatgacattcaggttcaccttttcctattgaatgtccgcagtgcaaaagaaaggaaagattaagatggattcatcattccatgcttccgtccaagcatgcattcactcatgcacttacttatgcgtgcatttgttaaccaatacctaactcctctatggtaggccctgagcagaggacctctatctttagggagcttgccagttcccatggtgaacttcctataatacttgtctgctttctttgggctgtgacagtcccccctacagtgactgtgtcccagtcttcacactccttggacatggtgggcagttacctgccacgtgcagagattctatccacagaatgtgcatctcagctggttggagaactgccatacgttcaagagagctgtgcaaccctcgtccaagcagaatagtgatgggacctacaccttggaaagcttgcatctggtgaatgcctcagtgcgggagtctgaacgtgtacttacctgtaaagtgcagcatgagacccagcctcccatccaggccagcctcatactgtccacagcagtgcaggacacatacaaattccttgggagcacaggtaagcttacccctacacctgtgagcaactgggtggcctctgtctccaagtggaatgaggtattaactcacagagtcccgttttatatctcctctgccccttgtcacttaggtccagagatgcctgcccttatcttgatggctttcctcctgggcttcaaagtggtgctggtgatcagtttcatagccgcctattttcacaggtggtggaacctgtaacaggtgaggtggtggcagtcttattctttaaggaaggagatcagagccaccttcctggggtggcaagaggagtcaaggcaagctcaaatatcttatggcaatccagcttcaaaggagagatgggaacagacttattttctccaaatgtgtcttggaatttcagaggtttccaactctcattattctgtgcctgggaatttgaagtttttacaattaagttagttgggacctggcaggtgagagtccaaggtatgtaggacactggaggtgagggtccacagtcaaaaaagtttgagacccaaactccaaagagcccttccatagactgttgtatattcatttatcacatggtgtatcctcggaatgaataaggaaagtgttactaaaatcaacttatggaacctatcttggggacttggatgtgctatgtaataatacagatggatgtgggatgggagagactttagaactcagaaagaggtgtttgggg

SEQ ID NO: 32134 - DNA, 1544 bp, Bovine  19866881028032
ctatgacaaatctagacagcatattaaaaagcagagacataactttgctgataaaggtctgtctagtgaaagctatggttttccagtggtcatgtatggatgtgagagttggaccttaaagaaggctgagtgccaaagaattgatgcttttgaattgtggtgttggagaagactcttgagagtcccttggactgcaaggagatccaaccagtcaattctaaaggaaaacagtcctgaatattcattggaaggactgatgctgaagcttcaatcttttggccacataatgtgaagagccgactcattggaaaaggccttgatgctgggaaagatagaaggcaggaggagaaggggacaacaggggatgagatggttggatggcatcactgactcaatggacacgagtttgagcaagctttgggggatagtgaaggacagggaagcctggtgtgctgcagtccatgggatcgcagagagtcggatatgactgagtgactgaacaacaacaaggagtgtacatttcagcagggaagaacttgtaaagcaagcaagtatgaaaaataaatgaagagttactccagagatgagtgtaaaataaaggaagcagcaggggtggaggacaggggcctgaagataccactttgaagctgagatctgacagaggaggagggattggccaggtgggtgtgtgcgtggggactgggagggttttcagcggaaagagtagcatgggcagaggtgaaaggagcactgtgcacaggagagtctagaggaaagccagggtgctgagcaaggacatggagaggaagcttgatcctgcaagatccgtaggccatgctgtgatgggtgggctttattttaagaacaagggagtaagtaggggattttaagcaaagaagtgacatggtcaaatgtgctgaatcagagttttctggaacaagatgatcaggcatacgtatttctacgtaaacctccaacaaagaaaaaaataccacctttgatcccatctcttagtgatagttgcaattgcttgtagcatgtctcttcccaggctgggttctctgcttgtctctgaacactgaatgatatgcttttctcaattagcattatatgtcttaagcattttttacatattcttcataagtgtcatttataaatctatataatcataatagttcacaaattggatccactgtaatttactcaagtatttcctgataataaagggattgaacaacatcacgtctgattttcctgtgatacctttgctctgttgtcattaatagtacttctttcatttttaagagagccttggataaacaattatatggccacccttcctatgggatgaacatttgagttgcttacattattattaatagtaatgttattgctgttgtgaataacccagtgatggatatatttcagccaatcagcttcaacaaaccatataatcacaaacaatccttgttaaaaggatgctcagaatttctctgggtgggtttctcaaacttcaaacattcacatgccatctgctcagccac

SEQ ID NO: 32135 - DNA, 1460 bp, Bovine  19866881037540
atatcagctagctgactgcactttttcagacatgcgatggaatcaaatcaccaactattgatcccgcttagaagatggaagacatctaataaatacaataattgtgcaagaatggcccgagaagtgggcagtgggtggagtgggagagaggatcaatcaagaagacacttcaagcctgaggcaggagctgaagacataaaagtcttctgttggtgtggagagaagggagggggcagggaggggagtgccagccccacaaacagaagtattagacactacatcacatttcctggctgtagcacacagcgtgatgcagtgggatgataggctggggggcggggatggctccatttctgacactttgaacagtgaaaacttgaggagtcacaggagcatttgctgagcacctactaaatgccaggcatcttactgtatctatcccatgagaatctcacaataacctcaggaggtaaaattactgtccttattgcccagaggagcaattgctcagtaggaagcactactgtaggcccagtcacacagcaaatgagtggtggatctgggacttgaacccaacactgtcttgggtgttgtgagatgctcatttagatgtcaaatgaaaatctcctggctcttcaagaccctaattcctctccatatgcttaaggggacaagcctcagagctggtccctttgcccactctactaaaaaacgtgctagattctgctaagaagtctctgtggttatcccctcccagctgtagtggaaacacgggattcacctgccacccatcacacctctagctcctctggggcaaagcagtgggcttgagatcccttcagcaacctcccccaggcagcacagctcccccggctagggctgctgcaacagctcccccacgcagatctcaaagcctggagataaatgacctgtaaaaatagaacaaaagacaaggtgggggggcactggggggggagaaggtgagggaaagagatggaaggtgcagtggtggctcaggggtgcagggggagaaaatgcagagaagaggattgacatgctgtaacgtttggcaacagatcttcactggaaagcctgtcaaattagaaagacaagacttgtatattttcccaacccttggggaaaaaaatggtaatgaagacttttggtctgtgggaagggaactgaaatcagatccaataacctgaagaggttgtttctcttgggaagcttggaggtttaattaaggaatgtttgtaaagcttggagagattctatataaaagataaccaggaaaaagtctgaggtcacagaacttactattcaatctgggagtcatcagcaagttccccccccaccaacccccaaagctcaccagccttttttgcaagtcaaactttgagattcaataatactttctttgaatgcagatatctttttaccagagcaaatgtctttcccgt

SEQ ID NO: 32136 - DNA, 864 bp, Bovine  19866881050561
cctttttcatctgtaaaatgggtaaaataatcatattacctcctcagtggggttgttttgagagtgaaatgaacataaagcacttagaaaattacctggcacatagtaaatgctcaataaatagtaactcttattatctacattccacataaactacatttttaaaggtctattcatctaagaaataagaggctagttctgtctaggtcagaattatttctaagtcactggttcccaaactcatatgagcatcagaattaattgtgtaagaaagacatattagtcagcgcagcaggtttggggtaggcctgggaataagctttttagcaagttccctgcattctgttctgacataggtggtctgaggccaaacacaaacccactgctccacaggggcataaaggagagctttgccatggaaacactcccgtaaccagcctatcttcaccccactccactgcaccagcagggaagtttgggaagtggcagagaagtcaaagccctcctctgagacaggaggcctgggttctaatcctggcttccttcttctgggccagtggcctctgctctctgtgccccagtaccttctctggaagatgctgaatcccacctccctgttgagagggttggaggcttctctccatccagaggccccctgagagagacacagtgagggctcagcaagccagggcgggtgttaacttcacccggctgccgtttgtcttctgaggcctgctctccctgagtgttttattttctggtgatggattccggctcatgtacaggaccagcacctgcatacaaatgccaagaggccagcgggccccggaatctgtcctcgcctgctctctgccaggcaccagg

SEQ ID NO: 32137 - DNA, 1460 bp, Bovine  19866881083568
cccttcctgctggagaacaggttctggcagaactgctaattgggggagcaagtgcaaattccacttctgccacccactcacatgctgcgtgaccctgggtgggtcattctccctctcccaggttagatctcagtgctctaagtcacacgggtgggctggacattcattttcatctcaccacctttgcaaaaaggatcatgggaggaaagaaagggtctgtctggctcagaggttttgagcctgtgatgtggggcatcccacagagaagccactggggtttgccaccatttgactctgattttgctgtaaaattgtaattaaaaagcaacatgcacaggcaagtgtgctctgcatcacatattagcaggctggaggctgccacgctgcaagaattctcactgccagatgaacgcttggtgcctgggcaggtattgggtttttaggtgagtggtacccattagatgtagcagctcagcatctaacatttgaatggaggctgatgggctgccaagtgctgggacatgagtcacctcagggagtccaatgatgggacactgctcatctccattccacactaaggacaccagatgactccctaaggtcacgcaacgggaaagtgctagagctgaaattaggatatttcactgcgagtatgaggtagagggtggcagacacctccggggactgacaagggagagggggtgtctcattaggatagaggccaagtgcagtgtggtctcaaacatggtccctggagacccactgccatgtgaatcctggcaccagcactcaccagctgtgagacctgaccaagttctataactctcccatgcctcagtttcctcgtctataaagtggagttaggtctgtggtgacttcagtgcctggcacatcaaaagagctgactgagggccagccatcactgtcactaaagtctacatttgagacctggactctgcacacaagcagacccaccattcagggctgggtggccttcaccagcgtctgcagctctccaacccccatttcttctccagaacactggatggctgatacccaagcccacggaaatgagctcctgtgtgctagagcctgacgtggtgcccagggataaagctccaaaggaggctggggctttatgaacaggcactatgaatgctccatccaagggctggcttgtctcccaaggtgggcaagagaccctgtttccccatccaaagaggagtcctgcctgtgtaggggctccaggaatgttagggaaaccatcctgcagatcacctggaagaacctcttctagattctagaggtgccagccctcccaaatgggagtttgaggctcaggcagtctctcagggctgagtcctccaggcagtccagcggggagggaaacttgggggccagaggagagggggtgcaggaggggtgtgtggctgaggcacagaaagcccgtcaagctctgt

SEQ ID NO: 32138 - DNA, 719 bp, Bovine  19866881122568
tttacagaaaaagcttgctgatccctgctttcattattttatagcccttttataattctaattattctaacagttttgaagctgattttcttggggaaatcagagactaatcaccccctcctcccagcccctgtcttctcatctgtcaatgggctgtgtgtcgcctgccatcgtggctccattcggacccctggacggacccagtaaaggccagcgcaccatagatctttcttcaccaagggcccagagttccttcaaaggtaagggactgcttgccctcttctcccctctcaatatttctaccttatagttagagggctctgaggagcagcgagcattttcatttaaaaagccagcaaggaataataatggcttgatttaacatcacaattatctctctgagcactttatcgcatatgattatccctatttgatagaagaggaaatgggaaaaggtagaaatgaagtcacttgtttaaggtcacaacatgagtcaggagggaaatggagacagaattggagcctcccacacccaggccacgactccagcaagcgctgcgctgccagtttgggccagaccccagtctcccatggaccctccagggtggtgctagtattataggctcaggctcctggtggaagagggaggaccatgtggacagagccccccaccccccaccccaacgcctaagcagggtgtgtagctgagacagaactca

SEQ ID NO: 32139 - DNA, 1944 bp, Bovine  19866881155742
ttgagggggacgctgaaaagctgtgaccttgtgaggggcctgacatccctgacttagggccaccaaggaaggctgcacaaggagaccaggatgtatgcagtggccctgggcctgctctggctatcttgactggtgagctcaggcccaacccctctcctcaccgtgcagtttcccagagctgcctttgggtcagctggtgccaaataaaggtaactgagctgaacaccaaaagtgatccgtgaggggctctgtgtcccaggctgctcccagaccatctgaggggaggacccacattgccagcgagtgttcccagggctgcagagccatctcaagaatatactgcattcttgggagtaaacagcatcacggacccttttgtttcttaacaaagatgagtgatcacttgggagccaggcaggtgtggccaagctcatggccagaataacatctttctcttctcccccttcccttcccaccagttttgtatcctaacctggcagaattggaaaactatatgggtctttccctctccagccaagaagtccagcagagcctgcctcagactccagaaagtgccagtgtaggtatttgtctcttgcctgatgcgggccctccttcctcggtcttgccatttaaacagatttgaatctcctctctctgtagcatccctgaggctctgtttcttgatgacacgtttcattttgaaccttcatgagaagtgccgtggggtttcatggtttcctgcaggccttggggctagacggccactgcctgccctttgacctctgacctgctggcctgagcctgctagatgagaagggaggacattaaacctggcgtgagcctgggtgcttctaatgagggggtgcctgtgacttgggagcagctgcatggttaggcagagcctgtgaggaggagcttgtcagccccaagtccccaaatgaaaaaataatgcttaactcttgctctctatgacttcagggagcaaaaaaaaaaaaaaaaaaaatcataacgtagaaatattcactcctgaaaatatattcacttatagaatcagtcccaaaactgtctacccatcagcttcaacattcctgggtggttcattgcgctggtccagtgcaaatcgactgcaaagtgcaaatacaaatcttggtaatgccgtgggatttcatgaaattgatagaagtgacgatgagagctgccacactgacaaatgaggatttcacaggagaaaccagcaagggatgaggacatgtaggatcctgagcaaagctggtgacaccctggagtggttttccaaaatgacgcccttgacagtcatgtaggggagcacacacaggaagcaaagtaggtcacattgtccattttaatccattgattgatctctctttggtcaatagcccagacaacctaaatttgatgggaaaaaaaaaaaagacgacagataatgcactttcataattaaaatttttaattattttaagtttttctttttaaatagtcggagattcagtcaggaagttgccaagacaagagaagtcccttgtactcttcactcagttttccattttatgtaactactataaggtcaaaaccaggcatgttacatcagtacaatgcgtctaaggttctgtgtgtttttatcacctgcagccaccagcacaatcaagatacagaactacatcatcacacagaagtctgtgtcatgctgcccctttatgatcacgcccagcctccccttcagcatcctcagccccttggcagtcactggcatgtttttgtccctataattttatcattttagaaggttatgtaagtgaagtcacatggtgtgtgaccttttcagatgggctctttccactcagcattgtgccctggagatccttccaggctgtcgcctgtttcaacagttcattcttttttattgcaggattgcgttccatg

SEQ ID NO: 32140 - DNA, 1105 bp, Bovine  19866881238220
ttcctatacgggtggaggacatggatgagccgttcccaacagaaacacaactgctgatcacatgtttggaccaaaggacttttcacaatgcactactttttttgtttgtttgtttaacctactttattatcaaggatctttaaaaactgtagtactcggtgctggggaagctgcggtgagactggcaggttcacgaactgctggtggaggggctgaccggcataatgctctctggaaacagcttgtcaaagtcaagagcttggaaggtgtcctcatcttttgactcataactgcacatttgggggtattggtattcaaaatatagaaaaagctttatgcactaaggcatttaccacagaacaagatgggagagggaggtttacatctcacagctccaccaattgggactggttaaggaaatcaggatagattttgtagataaagacttaagaggtttatgaggaggctttctttttttttattacaaatgattacattaaaatgataagcataaaattctctgtggaatgaccccaattatgaaaaatgtgtggataacactggaaggaaatctagtaaaatgctaacagcagtggtcttggggtggtattttttcttctttttagtttcctaatgttctatattctacacacctaagtcttatcattaagaaaagaaaagaggagggccatgtgttctgattaatcaaagaagccgttcatgcacttgattctgtaattggaggctgtggcttggctcactgcagggtcacagtcaaggtggtgagtaaaccagagtcactgattcggcagttgtgtaaattctcaagccagccactctggggacattagcctggctcatgtcagaaatgagcaatggggcttggcagcggggttattaatggatttggcatgagtgcttggctcagaaagcagttctggggcatgacgggccccacgtggccacagcaacagccctctgggagtagggacgctgtctggagaagactgctcactcggctccatccatgcccctcctgcttcccacctgtctgggtccccgctgactcggttcaagtccaacacctcgacctgcttgtaagtcc

SEQ ID NO: 32141 - DNA, 885 bp, Bovine  19866881263351
attttttttttacttgttattctaactagtttaagcctcaaaatagtcttcacattttacaggtgtggaaattaagactcagagaggttaggcaacctaccccaaagtgaggagttggacaaaacagcatttgaacccagttcctctctgacttcaaaagccagtgccgtttcttgccattttgtcccgatttgcgctgttgggttctatgcagttttctgtgtctttcctgtgtgcttcttcccttccccctctgactttgaaactcctgtcttttcatccacatctcttcatacttagcagagaacctgacctatgggcaaagatgaggaaatttttgtggaatgaatgactcttctccttttgtttgcattcttaatgtttcatgccttctctagtccacacctgtctattaagtgggaggtgtgttaccagcagctcaggtgggatttaaatcaggcagctgttaacagtgagatgaggcctctgctaccagaggcgtgaggagcatggagtgacaccaagatggaggtggttcattagagaggaaaagaggtggttgacatcatgtaaacaagatctttgagggattaaaaaaattttttaagtcctaggacattgccaaggggctattcaacttcagtagtcatcaaaaaattcaaattaacaaacaaaatattagcataattaagaaaacaacacaggcattgatgaaagtacaaggagaaggtgctctcatatgctgctgatgacattataaatcagtactatttttctggaaagccatttagcaaagcttatcaaaagccttaaatatgttcatcccattgactcagcaatttcacaactagaacattctatcctaaggtatatcggacagggcac

SEQ ID NO: 32142 - DNA, 1559 bp, Bovine  19866881365017
tcccagggaatcatcgtctgggaggaagatcactgccagaaaggtaggcttgtagagctggggtgggctggccgctcaattaccggggagtaagagatggtcaccttctggccctcccccgtcagaacccctggttatgaagggcagtagagggaaacgattccctctgtaagtcctggtgtgactctgggtttccaaccgcttaaagaagacaaactccaaacagggatcttctttcttgagttctcctggccaagctctggtcttccccttctcggtggttcttggcctctgatcatctccaaggcccaagggccagccaggagcagcccaccagggagtccagcagttcctgcacctggtggggaggcggcacagaggcctgcttctgtcctcatgctccctgatccaggagaggtccccagattctccacggaggggtaggccttctctggggaagtgaggtgttataagcagaactaagagatgggtaaaagaaaaaagacagggaaaataaaggacaaaaacaatatagttccctaaccccttataaaaattaaaaatgaaatttatacatatgctttgtccatattgagtttctttaaagaaagtggtgcctgtccacagcataacttcctgctcttctgaagtcttaatcatttaaattaaaaaaaaaaaaaaaacaaaggcagggggacaaaaaataaaaaataaagcaaaagtaagaggagggggaaaacccaaacgaaagcttcacattgctggagacccggctgtcaggagatcaccaaccggccaagccgccacctgtgccctctgctgaattctgtgcgagacacgatgagactgtgggtcccgagggtcaacctgaaagacagaaggcagggagtggacgtgggtcagtgggtgtgggtgcctccaagctccagatgcctccctaggtgccagcacccaacccagatgaattcaggagctgtgcaggggcggggtgggggagttggtttcactctcaggggtgaatccagcctcactacagacaccaggtgccggacacgctatccccacctttccagatcaactgtgatgcaggctaagcaccacacgtcagatcacctcactgcctgaggggcaggctccggctggaaatccacatgtgaggccctggctacaaatttgagtccctctctcctggcttccccaccctgttcagagaagatgaacaggatcctagtcatctgtccctgagccgtggcagccaggatgccctcatccccccctacccccccttccctagtgactaatcaggctgccctgagcattcacagcaaccctctcatcccatttcagagacaagaaaagtgaggctcagggctctgagaacctgcactaggctacccgcccaggtcataaggaaggccagagtcccacaggcagtggcgctgttcatctcacagccacccgctgggccctgtgctcaggacactgccgtgcttaggaaggaggctggagccagaactgcggcccagtccacaggctctgccacttgactgtgagcaaat

SEQ ID NO: 32143 - DNA, 1499 bp, Bovine  19866881494740
atatttaccttagaaaattagaaacttatattcatacaaaaactgtacacaggtatatgcagcagctctatttttaattgttaaacaatataaatgtctttcagggggtagatggatacataaactgtggtatatccagacaacagattgctacttaacaatacataggattgaacccctgatacatgctataatttgtactaatctcaaagatggaatgcaagaagtcagtctgaaaaaaggttacttactatatagttccatttgtatgacattcttaaaaagataaaactatagtcatgtagaagagtagttaccaggagttagaatgggggaagggtgtgactacaaagggttagtacaagggatttttttggtaccctggttctgatggtgctcacaggaatctatacctgtaaaattcattgaactgtgcactaaaataaaaaagtcaatctttcctgtgttaattaaaaattaaaggaaattttaaaaaagggaattttgacatctaaaacttatagttaatacattcaaaggggccatttagaatttagtctgtagcataattccagatacaatagtatggagctcacagagcattacatgaaaatctcttaactcaaacttcaactaagaaagaaaaactttggttttaatgtcaaaaatgctcagtatacaccatataaagaacatttattttagttaccttcacttgaattatagctgaaaacaacatgttgaataagcatccattaattttttctaatgttagttttgctgatacataaatgatagccataataatcattaatagtaaataaacaggttgcataaactataattagactaaagccatattatattagactcatataatttgagactaagaaaaattttataactcttcgattaagatattagattaaaagccagggcattatataaaaccaagagtgatatgcattataatcaaataaattattgttgtggagaaataagaaagtgttaattattaattactaatatgtattaagttataaaatttaataaataatccactttataaaaatccttgaagacataaagtatttttaaaatgtatcctaaatacaacattcaagtcaaggaaatggtaaatgatatgcattcaagtcaactaagttaaaaatattacttagctacagttatttctggaagcatataggtttctaattatgcctatgattattctgaacttacaaagaggaaatatgggctcaacctatctatctatgaaatatgagctcaacctatctatgaaatggatcagaccttcagctgcttccagacagcttctgcgttaaactgaacaatctatacagaaattccaatgatgacataaatctgcagtgttctggatttccttcacattttagggaacattggtcccactgtagctagtaagtatctgcatagggagcactcggctcagctcaatagccgagtttttttagcat

SEQ ID NO: 32144 - DNA, 1224 bp, Bovine  19866880413075
gcagggtgatggctgtgcagatggctgcctgcagtcaggaggagcagaggggtgcagggttccccggcggctctccgttctgctcaagccacggcagaaccgattcccatcactcttccaatccacgccggtgccacagcatctgccccaggacaaaccgcccttctgcaggccaggaggctctgttggctgtcttgtctcaggccggcgtccactgaattcctgacggtcctcgggtggggaaaagccccagcagatgcgctgcctagtttggccaagtagagtcacaggcggcatggcatgttcctgcctggccagggccaagggtacaggaagctggcgcaggggggtgtcttccgttgggctgcccctcccaggggtagcactcctgcccgcctttcgggctggggtctcagccggaggcacgagccctgaaggacgctcagaatcctcacattttgccagtaagctgggccttcaccttggccttccccttcctcctccctttctcctctcccaggcttagtgtgctggtctcctgctccatgtaaagtgctcccaggaaagacctgggtgttgagaataatccccagagcctggaaggaaggtcacgttaggccagaggaaggaggtaacgtcagggactgaagcccaggccggccctgggctcagagagtgagtgtagatgcccagagggacactgggcagagggcaccccaggtggggccctgccagtgcgggaggggcaggtgggcacacagcagggggtgggtgagggacacatccagtggaggggaatggttaaggccagacacagatggggtgttgttacctctctgacctgtgcactttgaaaaagcctctgatacagagatgttttctaaagctttggggggacattttgaggtttgttctcagggaatgaacgggtcatggtgggagccagggagggaagtggagggcaggtggctatggaaggtcatcagagggacagaggacagggccccaggcagggacaggggaagtgggagggagggagggaggaagtgcagggccggaaggtgagcagagtcgggttacagggatgggaggaggcgaggcctgggcgctggagtgaaggagaccaggtttaggaggagagaggagagaggtgacagggaggccaggagagcctgggcctggccagaaggggagagacagatctggggacctcggtagcatccc

SEQ ID NO: 32145 - DNA, 1820 bp, Bovine  19866880423746
tatagctgcattattcacaagagccaaaaaagcacaaaaaatctaaatgcctatcggttgataaatggatatcaacatggtacatccatgtgatggaatgttattcagcctttaaaagggctggaactctggcacatgctacaacatggatgatccttgaagatattacactgcatgaaagaggcagacactaagcccacacgtataattccatttatatgaaatatccagaataggcacatttatagaaataggaagtagattagtgatttccaggggctcaggggcagggaaggatgggaagtgaccgctaataggagcagtgtttctatggggaggtggtcatcttctgggattagatggtgagtgggtagataaatgactttttgaatatacccaaaactactgaactgtacacttgaaaaggatgaaccttatgatatgtgaattatatatcaataaaacaccctagacctatctctaatatttgcaagagcataaatggagatccacacaccatatgcctaaatatttaaaaatcaagcaaacaagctgttaaataaaatatgttcccttctcttaccttaacaaatatacctccatagtggtaaaattgaaaagtatgtataaagctatgctttgtatatgcttgaaagctggtgtgtttgggtattctgctgattgaacggctgtgtttggacaagtgataaagacatgcattattcataaattattatagttttattccacaaaaaatgttcatgccttcatttcaccaaaaatactaatttgtgttctagtaaaaggagtgatctgaaaagactaaagagacaaaatatgttttcatgacaatgatgaattatagtaaaatgtaaaaatgttttaatatttttcaaaaaatatatatttctaacatattaaaattatttattgacattataaggcagaatacaaattcagttaagaaaacatctaagtcaaattttaattttttaattaattaaaattaaatgttataagacattaaaaaaaatactctcagccattctagtgttcaatgcccatctacttggtaatgtaaagaatcagtatcatactccactcacgttatatctaaatttatctgtacggatttaaaagtaatagaaattgtttaaacattgcaagataaatgttcctcagccaccacgggcatcgttgtggatacggcattaattcacaggaactgctggaaccaagagttactacgtgaaaaagaaccagaaaacgactctcgccccctggtctgagggtgggttcattctcacgaatgtttccatgcagctggcacccattctgcatggttgtctaatctatgtcttcggagacgcagaacgtctgagccaggagacacctgggggctgcttcaaacgctagcccaacgcctgttccttctttctggcttattgcccactcctccacactccactcctccatgtagcacagtgtggcttctcaaaccccagggctgacctccactcaccccccatcctcctctctcttctctgccgttcacacggcagctccgaagcccctccctgcccagccaacaggcctggagccgtgcaagtcccactccctgggaaccctccttccctccctttctctgtcctcacctctcacgtttccccagctctcctcctctggaatagaagctctccgggctgacctgagtgtgagcccttggagggcagggacctgttgcctggctcagggctccttcccagatcagggccttggccaagttggctgagcaaggaggccccagcccaaggggccag

SEQ ID NO: 32146 - DNA, 793 bp, Bovine  19866880447225
gatcatttttttcagtggccagtttgtgcagttccagttgtgactgattcacacttctctccaagcacagcgcacattccattgcagtcagcccattctcccagtcatcacggtctggtttctgaacgagaggagcttaggtcagtgtacctgcaacctctacataaaaacgccaaaccagcaagcatctagtgtgtaacaaacaactgcgactggcaaaaggaagcgcgccaaggtccccctgacaacggtttccaatttaatatcctggcccactttagcttaaatggtaagcttgaaaaagcacaaaagactaaagcccaatgtctcatctaacgatgacaactgctggcatcagggatttctgatactcgaggattgctaagacaacccaaggatctttcgtttaccttgatatcctgaaggaagattcggccgcctcgctggttctgcagcttcatcagtctctcagcatgttccctctcctcatgagattggtgaagaaagtatttggcaaagttcttcaaagccacatcatcacggtcaaaatagtacgactgaaagtagaacatgaacatgttagacacaaaagaaggcagtctgctagctggtttctcaaaacccagcaaggctctgagcctaaggagactggagtagggtgtgttcctggattgaacaataactcatttttactctgaaacacaaaaatgaaacttggtccttgaaactgaagtttgcttcctgtagaatagcatgggaactgtctctaccacggaactcttattaaacactt

SEQ ID NO: 32147 - DNA, 2528 bp, Bovine  19866880497858
gagtgagaaggagttgccttttaagcacgatatcagggaaggcttcacagagcaaagacagggaggaggtgagccacacggacaactgggaagaggattccaggcagtggggagccagtgcaaaggccctgcggcatgttcacatctcaacacacctcacatttgtacactcgtgcccacagtgattccccggtggctcagtaggtaaagaatctgcctgcagtgaaggagactaaggagatgtgtgcttaattcctgggtcgggaagattctctggaggaggaaatggcaacctgctctttgtgccgggaaaatcccacggacagaggagcccggcgggctacagtcgataggattgcaaacagctggacacgactgagtgagcacgcacgtgtgcctgcagtgctcgctgacccaaggcaggcccaggccagcacacctccccatcagctccaggtgaagccagtccagctgagcgaactcggtgtaagccagtccaactccgtcaccaaaggcagcccactccaagttagcaaagcaggggatgcgtatcttgggaaagcccctcaccctctctggactgctcagagaggagctcccagctcccccctccctccaagaccacagaccccaggagaagaatcatggtggggagaagggagcacgggggactgaggtgatgaagaagggagtgacgggggtgggtccccaagctcctcagagagacagaggctgtggttgtgcattagtggggctggagggatctaggtcagatggaggaaaacctttcccaccgatgagcaaggaggcagggagaggccaggaagccctgaagcccactgtccatggtccaggccaggggctgcttaggagccaattgcccctcgacccagggttttccctcccttcctccagcctcaacagtcttggggtctcactgcttctgtcacacaaccctgaccatctgagtgaggggtctgaggtccagagaggtccaggggctggacagcagtcacccagcacagtcgcacgtgaagggtcaggccccccagcacacagacaagaggccccctcccgccccactccaagctggcacccagctgtgatgggctgcaggtcaggagaccggatcccacccagctctgccaccatggctgccctgagtgagcctccccatcacctcctcctcctgcctcagcagccccctctcagaagtgaggggacctcagccgcacttccacagggcccctgagagacaacacacgcctaaacctctggcctgggtgcggctggcaaagacaaaggatggtcaagccccttcccccagccaccagcccgagttcctcatctctgagctggagggtggggcaggccctgctggaggcactgggaaccaggagtggcatcagggccaggcagggccacggagtggcctctgagtacagggtgctccacaaggtgacagcttcccttcagccctggaatgagcagcccagagagggtgaggggctttcccaagacacacagcgccagccacaggccccagcctgacgctgggggtactgacctacccttggaccgataaagtggggagcatagtacctggtgtgagcctcccaggggagagcaatcacagtccaggccacaggcaccccaccaggcaccgtcccagaccccgtttatctaatccccacggaaaccctgagaggcaggtacgacgcctacagctgtgttgccattctacagatgggaaggtggaggcacaaagaggtttagggacaggaccaggagaaggctaaggacagacccacagcccacctcaatgaatgcagagacccacatgggttcaaggggctgcccaacatgctggcagcaggggctggagaccaagatgggagaggatacctctccatacacacacccaggctgtgggggaaactgaggcccataggagggctcggtgaaaaggaagaaggtgggagaaaaagggcaggcagcctgggtagggcggggccagccccggttaataattcagttaatgatttcttctctccatccttatcgagcgggcaaagtccaagggcagcagccaatcagcagcccccgctgggcagttacccagcggcctctgctgccagggctcccagtcctgcgaggaatcagagagcgggggccaggtccccaggagggggccgttttgcccagagcagcctatctttccccccaacaccctgcttggctctgcctaagacccccggggcccctctgcccaggccctcagactcaggagaggccctggggtcggcaggctggaagcagcctgctccgctcctttgtgctgaaccaggccccccgaccctgcctctgtttacatggtcattgttgcttccatctcctgccctccccccaccctgtgcggccctacactgggtgctgggaacagggggatgagtcagtcgctaccccccaccccgcccccgctacctaccacttcccttccagctggggtcaggacctagggaggtggg

SEQ ID NO: 32148 - DNA, 3301 bp, Bovine  19866880627416
aggagagaggagggctgggagggtagacatcctggggccgtagcacaggacacgcgtctggtgtgtgtgtgtgtgcgcgcgcgtgcgcgcacgccaggctgtgtctctctgggtacctgagcgactgcccgtgcgtgttgttcccgagcgtggctgtgagccttcgtgggttggtggtggtgtgtgcttgtgtagaggcacacgcttatggcactgaatttctgtgacacctgtgagccttggttgttacaccatttgtgagcgtgccgtgtgcctgtttgtatgtgggctctgtgcaccaccaggggggtttcagaggaaatgagaatcagagtcaacgctcattcaggcttaaaacagacggaagttctgacatgctacacatggatgaaccttgaagacattatgctaagtgacaagtcagtaacacagactatatgattcctcttctaagtgtcaattctttctgttttttttttttttctggccgagctgcatgacttacaggactttagtttcctgaccagggattgaacctgtgccctgtgcagtggaagcataaagtcctaaccactgaaccaccagggaatttccttcaagtcaattcacagagagccgtacctatggttttcggaggctgtgaagtgagagtcgctcagttgtgtctgactctttgcgaccccatggactatacagtccgtggaaattctccaggccaggatactggagtgggtagcctttcctttctccaggggatcttcccaacccagggatcaaacccaggtctcccacactgcaggcggattctttacagctgagccaccagggaagcccaagaaaaccggagtgtgtagcttatcccttctccaggaggtcttcccgacccggagtctaactggggtctcctgcactgcaggcagattctttatcaactgagctctgagggctgggagaggtagaaatggggagctagtgtttcatggggacagagttccagctgaggtagataaagaagttttggagatggatggcagggatggttgcccaacaagtgaatacatttaatgtcactgaactgtacacttcaaaatggtgaaaatggtcgattttatgtatgtttgactacaattaaaaagaaaaaaaaaagttaatgctcttggctctagagccagaaaggtctggagtctcatcccttgggtttgccccctggatttgcctagttccaggcaggagaacagacttgctcggggtcacggtgagcggggtcagccaagcacagcaattttcctcttagctccccggccaacactccccaggtggccagggccatggcagcttcctggggggccagcctcccctcgaccacctgtctccccggggtgctgcccccccccccatcagagctcttccctggagacagatctataccaatacagccctgtcccctactgtgagctccagggaggggccccaagtcagccttcccaaggacctaggttattccagaagctacacccttggagcccccaggtcctcaggctgctctgggccaggaggggagagcagctaacaaggaaaggggaaccccttgggtgaatcctgcaggtgcggcctctaggtgggggctggaggggcctgaggttcttctgagcccggcacaggatggtgtgggggatgtcgtgcagtaatgcccaccaggtgctgctagtctcattagcgagaggacaatagcagccagcagtcaccttcctgaggacatcccccatcccaactggccccagacactgcttccgcagtccaggcttctggtcagctggggctggctcactcagaaagtccaaggataaaaacccgtttgcgaacgacagtgagccaaagacatgagggctacatcaggaaggctgagccctaggtgtgatgttcaagtttactcacagttcagcgctgtcgagcatgaacgatgggggtcacttcctgaccagtccctctcctctttatctttatccctcagccctttatcttgcttgaggtcgctctcttcctctaaccccttctgctttgcaccctgcccccaccccccgccaccattacacagaataacaggaatgttagattgtttattaaacttatttaaaaaaaaaacaaaacttattttgtcctcctgcttttcaaattagagaagtttaactgttcgagcatcttcaggctgtgtggtcttcggtggattttttttttttctcctggtggcccagtggtcatcaattgccaatctcctcactcacacgttactcactgcttatgtttgtaaaagctggtagatctgacatttgtgaccctgtagaaaagcatgtgattttgagaaagctttcccgctatcttttttggaaaagtcaaaccctttcatgaacggaagcagagtgtttcagggaaaactttctgtaaatccagattttaaaacacccaaccaagtttgaggaaaggccccatggcagggtgaagcagctggagtccagtaggtgaggggtacccaagcagggcacccagggcctgggaaggaccagggaggactcatgggcaaggctgaccgtcattcagttgtgactaatgaacaactagctgcctgcctgcctgtttgcccttccatcagcagcccttctgctttgtctctgcctgctgcctctgggtgctgacccagctgtctgtctgtctgtccacctgactctctgctctccttcaggatgccttccacgccttccaccaggacctcagttttgtgcgcaagttcctgcagcctctcctgattggagagctggccccagaggagcccagccaggatggaccccagaatgtgagcagggccctggtggaggctaagcccctcgtgtggggctggaagaatgggggcattgctggtaacagcttcatggtttgccagccctcccgagcagacagttgctggcagagctgtagggacgcctgcaccagcatttcctgggggactccaggaagacccccttccttgctctgggccctgcatccccatctatgatgaggatttagatgaactgagctctaagggttttccctgcttctcaggctccctacaccttttgtggggatgggggaaccccaagctggcactccatcccctttggccacacaccttggaccctaggaggagtggctgtggagggtggtggggatggagggtgggagtggggggcctccctcgcttcctcggctaaccagctgttccgccccgacagacccagctgatcgaggacttccgagccctgcgcca

SEQ ID NO: 32149 - DNA, 1297 bp, Bovine  19866880640409
tctccaggaagggcagggtcaaggctctgtccaggaaaaacgaggcagagcaaagcgaagagcaaggccagcagcctgagcagggaggccagagaggacgggcacaaagcctgctcccagcaggacgtcctgtccctcaagaaacccagccagggtccccacaaacccgccagaccggttagcggccacctcactgctgccggtcgcctgagggtgccaaggtgggggggccccactgagcaagatcctgcctagcgggtgcctcactgtcgaccccgcccactccgttattccgttccctcccagcctgacacctgcccagggaggaccatttctggacccaggtgagggcagggagatgttctgagtatgctcgaccctctacctcaggtgggctctcagaccaggggtgggaaagctgacaccgcccctgccccgccccagccaatgcactcaatgggatcttaagaaggagcctaggagctgtgaacgtgaaggtgacaagccccaaccctgaggagctcacggtgcagaatgatgaggacacccacacgcggatcagtgaatacagggctctaatgccagggaccccacagcgaggacagctgcttagcccaaggcaagacagacaaggcttcgagctgggtgctgatgctgagtaggagttcaccaccaggccgaaagagggggtaggcacttgtcactcttgtcctcccccttctcctgtgcccatacacactagcctcccagaacccctggggggcaaacacagtctcagcattcagcctgccacactcacctctgccctggaggtgctctgggctgagcatcagggctagctcccaactcgggcctctgggttgctgccaggcagggaagctggtgaagggagagacccagaaacccatccatttctttcaaagagcactgaagcgatgtgaccacaaatcccatgagtttactgaaatgtctttaaagcaaacggcttgaatggatttctcccacccttctctccactgaggcgctcactggaaaacagcagctcacaaggtagagacttggggctgctggggcctgatggaaacaaagtctcagctgcaaagccaggcaagaggcactgggataaaggcagctctgggcaggagatgaaaaatgacatcgaaccacgggcagggcaaaggtgatggaggagggctcgtgggaggccagtatcagatccagaaacgctcggatactctcaagccctcgactactggtggctttcccagcaccacgggtctccctctttcctgttcct

SEQ ID NO: 32150 - DNA, 1417 bp, Bovine  19866880661311
ctggagtgctgatcctgtgtggccctgggcaaggttcccaccttctcagggccagtatctccttcacaattaagtgtggaggtggccaggacccggttggtggcttttctgaaagttgcagccatgggaggacagtttaaattgggcatgggggtgtgaggagctccggctggagctggaggggtggctgtggggtttccccctttcccagggcgctgtgcgtcccccaacccccaggactgatccagccccaactcctgccaggcctccaatccaggccagtttgagagtgatagcgaggtgctgtggcagcgggcgcaggtgccggacacggtcttccaccatggccgtgtaggcatcaacacggaccggcccgatgaggcgctggtggtgcacggcaacgtcaaggtcatgggctcgctcatgcacccctcggacctgcgggcgaaggagcacgtgcaggaggtgggggcaggaccgggggcggggactccctaagcggggaggagccgatggctggggcggggctatcttgtgggcggggctccagggaaaggccttggaggaggttggccctgggtctctggatcccccacactggtggtagcagggtctaccccctccacactcctgccaccggatgggcccaggaggggagaggttcagttgggccctggctcccgcgcaggtggacaccaccgagcagctgaagaggatctcgcgcatgcggctggtgcactacaggtacaagccggagtttgccgccactgccggcatcgaagccgctgcgccagaaacgggtaaagatctaggggctggggtctggcatctggtaaccccgagccctgtccctgtcctctgggaactctgcttccaagaacccctttcctcgactcatggaaccccgcccctgggaatcccggccctctgggagacctttcccctcgccctgagcccctgcactttgacactggacgtctggcacttgtggtgccgggatccccgctcctcttccctgcatgaatcttgcctttattctcctggatctctgtcccctttcccttgtggtccttacttctgagaatctgcccctacccgcacctacccctcggaaccccacaccttggtccctggaactgccaccctgctccagggctccctggatctcagatctctagctcccagaatttcaccctcaccagtcccagcccctgcctacattatggtgctgtgggcacaccttcctccaacacacacttggcttgtccctccccaggtgtcatcgctcatgaggtgaaggagatcctgcccgaggccgtgaaggacacgggagacgtggtctttgccaatgggaaaaccatagagaacttcctggtggtgaacaaggtctctgggtgggggaactggaaggagccca

SEQ ID NO: 32151 - DNA, 1747 bp, Bovine  19866880671230
tgggatctcatgtgctcgtagccggacatccttcctaatgcctaacgtcagtccctctggctgcaggctttccattcccctgaaccaccgagaggcactgacgtgcaactggccttcccaggagctcctcgtgatctgcctgtctggagcctggagaagccaccgggacccccacgcgcggaaaggggagctcacccagcacgaaggagatggggatgagctggatgtagctgtcgcaatacagagtcagcttctcaaaaatcacttgctgttcatctgtgagggccatcctgggggagggagggggttggggtaaagatgtgtagacactaggaggagatggctgagacccgtcccaggtccggccagtcccaggataagacagtgatagcctcatttcctccctgtctctcattggcctgcctggggcccctcctctggcctgagctgggtccctcttctttctcccaaagcccccaaaccccaaaggggcctctgctccatccctggaggagaaaccctcaggaggttttctctgaggtcaaggaaggtaggtcctgctgaaggagtcagttttaggcactgccgacccttttaaaggatccaaaagacagttgtttgaaagcaggttgagggacttccctggtggtccagtggctaagacttccacctcccaatacaggggcccaggttcgattcctggtctgtacgacactgtaatggtggatgcaagtcatcacacatttgtccaaacccatagagtgtacatcaccaaggaggaaccctaacgtaaactatggactttgggtgataatgaggtgtcagtgtgggttcatctattatcacagacatcccactctctggtaggatgttgatagtggggaaggctgtatgtgtggcaggagggggtggggtacatgcgaattctgtaccttctgctcagtcttgctactaccgtaaaactgctctaaaaaataaagcctaattttctaaagtatattggtgccctagtaatggcaccccactccagtactcttgcctggaaaatcccatggatggaggagcctggtaggctgcagtccatggggtcgagaagagtaggacatgactgagtgacttcactttcacttttcactttcctgcattggagaaggaaatggcaacccactccagtgttcttgcctggagaatcccagggatgggggaacctggtggctgccgtctatggggtcacacagagttggacacgactgaagtgacttagcagcagcagtaacaaccaaagaaaacaaatgtgctctgttattagtattatccttatgaactcaagaaatttatgtatttggtatttttcaattcattgtcatcattaatgcttttcttattaaaaatgctattatatattttgtagttttattgaccacagaatatattgctatattgcttaaataagtgtttgtattggggaaaaaaaagagcatggtctgggcctgtgagagaaaccatgtgggattcaggaaaaccggctaactggatgggaccagataagggccctccctgggatggaggaaagggtttctgagatgctctgacctgtactgcgtttccctcccaggctgtctcctttcttctccccagcccccaggtccccagcccctggccctagggcttttccacaagcttagcgcagccttataggtctctgtgcattggcctcctagatcgctgaggtccttggagctccaag

SEQ ID NO: 32152 - DNA, 1715 bp, Bovine  19866880688350
cgcaacgggggataagggaggtcatgtcccccagtccagggcttgcggagggataacaaattgctaacgacccccccagccccgccggccgcccgcgcagactcacttgactgcaccgcgtctccttaactgctgttgcgatccaagtccggcgaccctcccaacacaaatcccagccggcccaagccccacggctcccggcctccaaggcttgcggctgcagtgaacaaacggggcggtacagcgcgggccaaacctacgattttcaaaactgaaggttcgaccaatccccgtcaagtttgtctgggcggctgcaaaactctaagccaatcaagtaaaaggaagcaccagtcaggccatcgattggctacgtggattggcagtctaccggactaagaggaagggagaggaagcgttgaaactttaacctgtacagcttccgggaacagcggcgcgcggcctagagaggagatcgctcgaggtgggggttgcgcgcgcaagacctcacacgccagaactacaagtcccagcgtgcattgcgagtgccctgagggacctggaagatcggtgaggccttatttgtggatagtgctcttttcgggagtcttcactttgccatttcttcacccaactgtgtcctcaatatgggccgacctcagccattttacagaaataatatatacgatgatgtttcttaatgatttcaacttaaaattacaaagcaagacagcaagatttataatacagagaaattgtttccataacaattaacactgtctgagtcacaagtgaagccaaattgcttatatgctttccatgctgtcaaaggttaaattaagaatccacatttccatttccacacaaattgccaacctcaaactgcagttccagcatactttttcagactttgatgcaaatgcagaggaaatttccattatttcataatccatttaactctgttattcaggactttccacttaatctccaactggaagtcattaatctgcaatgcgatgacctgctaaaaggcaaatatcaagagaagaagctaacaattctacacatacctttctggtgatagttaagtcgttaagtcgtgttggactctcctgagactccatggactatagctgaccctgtggactgtagctcaccaggctcctctgtccatgggattctccaggcaagaatactggagtgggttgccatttccttctccaggggacattccccacccagtgatggaaccctggccgaccactgaaggcagattccttactaactgagcccactcagttcagttcagtcactcagtcgtgtccgactctttgcgacccgctggactgcaggcacgccaaggccttcctgtccatcactaactcctggagtttacccaaactcatgtccattgagttggtgatgccatccaaccacctcatcctctgtcgtccccttctcctcctgccctcaatcttacccagcatgagggtcttttctaatgagtcagccctttgcatcaggtggccaaagtattggagttttagcttcaacatcagtccttctagtgaacattcaggaatgatttcctttaggatgtactggttggatctccttgaagtccaagggactctaaagagtctcctctaacactacagttcaaaagaataaaatcttggactctcatcgttctttacagtccaactctcacatccata

SEQ ID NO: 32153 - DNA, 1067 bp, Bovine  19866880708159
aggtgggggacaaaggctactcatccccctagcaggcagagggggcgggaagaggaaccgggagctgggggagctagaaggtggggaggggagggatgaggaagtgcttctaatcagtgagctgggagaggcaccagctggaaaggctccatgaggatggggaggccccagtccagcctgccccccatcctgcccaccctcaccttgctggccaccttggggggcctcttcttgtgggggacgctgcctgcccggctgaactggctccctgcatggctgcagcaagaggaccaggtcagaggtgcccctgggaagggggtcaggccctcccccggcctgcgcccccacctgaaggcgcccgagctgccggtggacttgaggctgtcgagacgccgcagcttggccagcttgtggctccagcgctccagctcgtcgatgcgcgtctccaggttgtccgtcagcttgcacagctccttcacggcacccacgttctccatgaagatgcgctcctgccgcaggcgatggccagtgtcgagggcacagtcagcccctgggggccccaggccatgggcccatggggagcaggagggagccctcgaagccccacccaggccagcctcacctctcgtccagcctcagctccccctgttccctgttccctgctccctgttcctgcctctgaacaccatcccacctctgcacctttccccacccgtgttcagaacccgtggtcctcagagcctctcgcctccatctccccctttgatggacgcagtgtctaagacttcagcagaggccaagacctaggacatgctcactggcacccagcgtcatgccaggaaagttacaaacatcatcctcaacaaaccacgtgtttaaactttgccataaccctatgacagaggatgagatggctggattgcatcaccgactcaatggacatgaatttgagcaaattctgggagatggcgaaggacagggaagcctgaagtgctgcagtccatgggtcacaaagagtcggacatgactgagccactgaacaacaaaacaacatgagacgttctcag

SEQ ID NO: 32154 - DNA, 1285 bp, Bovine  19866880760025
aaatctgtggctgcctcctacatgctgtttgataagcttttattgtcacctccctctggtgctgtatccccaggtcctggggcagcttgtttgccaggaaccaggatgctgccaggtcagggggcaggggcagtgggtggcacagagccctggctgggagccactacccagctgtgttcctttgagcacaaggcttgccctttctggtctcacctggaaacagctctccataatgtgacccggcttctctgtctagcagccctttcgccagtccactcctgggtgcagccccaagtctgagacaaagtaacccattcttgggtcactaagccagccctcccacccccagccctaacccttggcccaagcaatcattccaggatcctcccatctcttccgggcagagtctcctagaatcccttcttcattgctgcccctctgttttctgagctcccagcacaccctgtctaggctcaccctggacagtgtcttgggccactgtgcatgtgggtgctccacggagctggggctgaatgccctacacaagcctgggacatagttgatcgctatagatgtccattcagtcgttaaacaaacatcgcttggggcaaactataccccgctccgtgctgggtagtggatatggatattaaaagctaataaggcaccgctccttaccctcaaggagctccaagtctgctgctgagaaacacagctacatagcaggtgattcgcgcactagcaggggaagcccaggaagcagttgggagcacacaacagggtgtacttgaccctgggaaagccaaggaaggctccctggaggaggcaacatcgaaactgacttgaagaatcagtagaagttagctagtggagggaaggatttctggaagagggagcagctgaggcagagtctggagtatagaggaagcgtggttcattctggaaactaagtatttcggctagcctcctgattgcctggctctttcccacccctctaatatcaacaaaagaaagatcattctctcccatggattgagtttcccaaattcctctccctgcttgaagagaccaggggactcccaagaggctgaccattggccccaagccccctgagctgccagtcacttctccactctgagcttcagctgcctcatctgttaaatgggctggggccctccggcccacatggttaatattttgagagacccaaaggaaaacagagcaggcacagtcctttcctggcctggccagggggtgcagcccggattggggactgaatctgcag

SEQ ID NO: 32155 - DNA, 1235 bp, Bovine  19866880782350
agcccactggtcacagggcaccccccccttcccaggagcgtccagaggtccgatgcagagttggctcaagactcaagctgccagcccatgagcacaatgggctcctgacacccacagctgctgagccctcggagtcacaagtgggtacctgccctcctggggggctccaggccctgctcacctcgggcccagctggggatgggcttccggggatgggcctcgtcatcggtggagtcatcactgtttagatccatcccgtagtcatccgcattgatcttggggggggccctgtgcccctgaggggtcatctgatacgaggtacaagctggagactggaaaagatgaacatggctactggctgcccgccctgcatgctggcctctcctgaagctgagaagcaccaggctctggccacctcccctcatttcacagggaaaagaaagaaaaaggttcaggggtcgctttttgattgggggaaaaaaaaaaccatgccacatacatgactcttgtgtcttcctttttcatgtaaaagtgtgttacaaacgttcttccgggtcagtgtgtgtgtgtgtgtatgtgtcctttgaatggctgcagggcgctgcactgggagcgccatggtttgtaatttaaccacccggttcagcgaccgtccaagttttcagcatcctaaactatattgcaacgaaaacctttcctcacactatatccgtctgtaacagcattaacagcctaaatgcttgtcgggaagggctgattaaagaaactctggtaccaactaagtggaacacagccagcaaaggaaattaataaatggtgaaacaggcgtgtacaatacattaaacacgcaaaaaaaggaggggaaacaggcgtgtacaatacattaaacacgcacaaaaaaggaggggaaacaggcgtgtacaacacattaaacacgcaaaaaaaggaggggaaacaggcgtgtacaacacattaaacacgcaaaaaaaggaggggaaacaggcgtgtacaatacattaaacaccaaaaaaaggaggggaaacaggcgtgtacaacacattaaacacgcaaaaaaaggaggggaaacaggcgtgtacaacacattaaacaagcaaaaaaaggaggggaaacaggcgtgtacaacacattaaacatgcaaaaaaaggaggggaaacaggcgtgtacaacacattaaacacgcaaaaaaaggaggggaaacaggcgtgtacaacaca

SEQ ID NO: 32156 - DNA, 1304 bp, Bovine  19866880811709
caagcagcttgcttgcattagccataaactagacattattttacccatatcatcttgataaagttgatgagggttggttttggttcctcttcctgccgcatgaatcatttatagattttcctgccaggctaacttcaatccgctcacgtgttgagggtgtaaaactgcagctttcctacagatccatcagtttaggctatatattgacacggcaagggcaagtccttggattctgcagtgttgcaatgattctgcaatgttgattctgcaacgatggccatgtttagtaataactactcctcttcagcttcctttaagaataaatctaactgagatttctctggtggtccagtaattaagattccacactcccaatgctgggggcaggggttcgatacctggtctggaaactaagatcttgcaagtcacatggggtggccaaaaaataaatagtaattgttcttttggttgcaggttgtgggagtaatatatttgtttttaaaaaatttctcccagattcacagtttagtttataacatgatcaggaaatggggtctttcctctgggcttttcaaaagtacgaatgctaaaagtaatatagtgctaataatacatttcttgcttttaacttgtttggctttattgagatacattttacatttcttatttaaaaaaatttttttttactgtatttaattttaaaaacctatttatttatttggccgcgagagatcttagctgcagcatgcacgatctttagctgtggcgtgtgggatctagttcccagaccagggattgaacctgggtcccctgcctttggagtgtggagtgttagccactggaccatcaggaaggttccatgcacattacattttcactttatacagtttgtgcataatgcttctcaaactcaggaagcttctattcattacactggcctccttgcatttcagagtttagcatattcatagtgaaaaaggctgatcatataattatatatttatctaactagggctggacgcacttctcctcatcctctttcttcaaatgtaaaaatccttcttagcttgaggtctgttcaaagataagccacggccccagtgtggccaggcagaaaagaaaaaaaagacaaaaaagaatcccatgacattctttcatttctctaatttttttctgctttcccgaaacatgagtcacacagatatgtgctctttctgtggctgtgatcagttcatcttgcattctgctcttttaaaactgaatgtacatttctgtgtgctgacagctcgaattcttgggatcgc

SEQ ID NO: 32157 - DNA, 1401 bp, Bovine  19866880892720
gggaccctgcgggcaggggtttgggcttccggcaggaagttcttagaaagcttggaaacccagagggcgctgcatccagagaagtccctcatcaagacatccctgggtcctggccgccaggaggcaggtctggggggctccctcccaggtccttagagactcggcccattggaggagaacgttagtctcttctggcacatggtgggttggccatcctgcgccttctcctgggtccctcttcctggagatctggggaatagccaccaaggctttggggtccagttcaggggcctttccttggagaatcagtccagaaggcgccaaggggcaaagagagagagagagagacagaaagtgcaggaagctggcaaggtctgtagagagcctggcaggactcgagggacctgtgtccacagtcagggtggtctggaggaatcgtgccctgaggaaggctcagttcagatggcctaggaatcatcatgtgggcagcagcgtggggccagaggtcaaggggtgacgtcttccaggccagcttctctcagagaaccgctgggcggttgttgggctgcctgccctttccaggggtgaaaagtgcccctctgcccctctagtccattgcagtttgtaggtttttctgggtgcttggctgagctccccctgctttggcttctcaactgaacacagggagagcgattctcagaagcggcaggcaagccaccaagggaaagatggccagcctgatgggacgtcccagagggtgggagtcctgggccaggaggtctcccgcttcaaccaccgtccaagagcacgaagaggttggtcgccctggagagttgctggagaggtcgtcataaaggcgagtgatacatgacaacagaggggaaggggcgggggtcttagaaagtgggggaaggccgtggggtctggagccggtggatgctgacttctttgtctttgcatcttcgtcctggccacggctgctccaggctgacacctgcaccggcatctaactttcggaaagaacgcccccctttcctcaggacgaatcctcgttttttcctttgttccctgcccactggtactgtttcacagttggtaaaattccatttgactgcctggaagctggttgtgctgggggaagtcaaacccaacgaaaacaacatgtttttccctggttaatgcatttttcagatactccttttgctcttcttaaaaacaaaacggctgctctgcataagttcctggtttgtcattctccatggcatcgcaggccgcagaggcacgagtgaagggcaagaggaagagatgtggggagaagctggcggtgttgagggggggtggtcacatcctggaagcaggaggaacgccttctccctgcaagaggtagtgggatttgggggg

SEQ ID NO: 32158 - DNA, 1847 bp, Bovine  19866880947772
cccagcagccacacagagaacatggacagctgccccctctcctgggcagtgctgggagagttgctgaggctggcttggggtggaggactctggatacttaccaggtctgcagaagagagtcagggtgaccaggacgatggcgatggtgagcttcatggtgggcaggaggctggtgggggaggctctggccctgtctctggatctggtctcatgggtgatgtgcccactgggataccttcttatactctcttgcagtggggagggcagggcatgggatccacttacgggatcacattgtttacttgggcatcagctcggtggaaaaagtaaatattctcgtttctcaacccagtttctgtccccagtgaaacagagctcacacaatgggccacctgggcgaggggaaccagagtctaacgtggaggcagtgagagtgcctgagtcataggttttggagagctggccgcctttgcttctcccttcggacctgagtgctgggcagtgcagatggacagacagcagagcccgcctgatcctatcgtcccaggagaaactgaggcccaaggccccgtaccagtggcggtgacaggactaagactggggtttcctgatactccaatgggctctgctccaaggaagtggctggacttcaagcctctggagtcatgcggtccagagtgtcttgtggtcagacttgggcgagaccctggactgaagcacgttgacagattaagttctccagaaacctaatgcccaggtcgggttggaggacgcactgtgccagccgggtctggagtcctgccttcctgatgacaaatccatgggcgcttcaggcctcatagcacttgacctcttcatggccttaacctctcaccatttccttcttggattgttctctctcctgtgctcccacgactctctgctttcctgttttcctccctggccatccttgttctttgaatgttgattctttattgaccgagctcctgtgttggtggctccaggctgtgaccgtggccccttctgacaccatgtcagtggcagcctcctttcttctccaaagcctgtgccttagaacacaggcctccccgactcagagtcacctcctaaatggccttctgcctcctggctcttcctccttggccatcctgggaaaggccactagaatgatctgtctaaagtctgcttatcgtatcctcctccttcttgaaacacttttaaagctgccttgggcggatgcgataaaattcaagtgcaacttatgaggcccttgtccactggcccttgcttaccatttgaatctcattcctctgctctcctgcgtggaatcttttttcttttttttcccagaataaattcgataacagaattgtggacttttcagtttacttatcaaactgctgctgctgctgctgctaggtcacttcagtcgtgtccaactctgtgcgaccccatagacggcagcccaccaggctcctctgtccctgggattctccaggcgagaacactgaagtgggttgccatttccttctccaatgcatgaaagtgaaaagtgaaagtgaagtcgctcagttgtgtccgactcttagcgaccccatggattgcagcctaccaggctcctccatccatgggattttccaggcaagagtactggagtgggttgccattgtcttctccaaactactagaaaatttaattttacataatttataaagtctccacatcactatcctaaacttcatttaattttcacttaagtttctgttttaaatttatttttacttgattgatcaatactttacagtattggtttgatttctgtcatacatcaacatgaattaaccata

SEQ ID NO: 32159 - DNA, 922 bp, Bovine  19866880976462
ttcctttgagggcacctttcttttgctttgtattcttttataaagttcaatttctttttttttttgaactactttctactttcagaataaagaacaatacatatatcaaaaatagtggggggagaaaaaaacacttgggccaattgtatccttcctgtttctcatgaaggaaagtgaaggtcgctcagtcgtgttcaactttttgcgaccccatggactgtacagtccatggaattctccaggccagaatactggagtgggtagcctttcccttctccaggggattttcccaacccagggatcgaacccaggtctccctcattacaggtggattctttaccagttgagccacaagggaagcccccctctttctcatggtcctaatatactcagcctgtgcctccagctcctgggaagagaatcatcagagacagagggccctctccaccctgacgcccagggctcacctgcacgtccacggtcacattcaggctattgctggcagccgcggcctccttggccttcttctcctgttcctcctgtagccgctgctcagccaggcgctgctgctcttcctggggcccggagacagcaggaggcaggatgtcacagaccaggggagtgcactcccctcctctgcgccaaccccagcacagccaggcgggcacagcagctcctgcccgaaccactggagccaggcggccccagcccagagctcagtgcagagcccatgggagccacacacccagccccccgttacctttctcttcttctcctccagctcccgctgcagccgctccttctgtaaccgcaaggccttctctctctcctgcagctccctgaggaccaagacagagcaggtcagggcgggaagccgagcccctgttccgtccctgccagggaagccaggccccctggccca

SEQ ID NO: 32160 - DNA, 1725 bp, Bovine  19866881131318
cgttttctgtatttaaaaatttcttaaaaaaaaacaaacaacacaatggatttggaggtgggtgggacagttctagctcctgaccagaattggagaaactgtttcagggggcctgaggggcctggcctttggacatttttccagcacgtgtgggcagaggggctggctggggtctgggtgaattcctggagctgtcagagcccctcctggctcccaggtttcagtttcctgcctttcgggggagtgggaaaaggctgagaggccccgtgctggggctgaagctaattcattagtgacgcctcgacaagggctgggcgcccgcagcgccggcgtgattcatcaacacgattgccccgctgccagcctgcgtgggcccagaacgacagcgcgctttacctttccccactgagaagggcctggtgggaggcgaggtacagcatctaccgagagcaagaaagaaagaagagggctggtcccctgtacccttgagcccaggaagctctgccaaggccggggctggggtggcaggggcttgggtgtcctgccagtgctggcagagcccaagagggctgcctggtgctgcagtgccagccccgagcatgtggtgaggggggttggctgggccccctcctccgcagcaaatgttcccttggggaagctgctggcgggggtgggggtggcaccaggaggtggggtggatggggaggcgctctttcctgtcccagatgcctggctgggttttcctcagctttctggtctctgaggtgtcagctcttcccagaagttctcccaaatgagtagaagggagagagttggtttggggcttaggggagatccagaaggagcttgaaatcctgctgcctggggctcagaatcctcctccatcccagatctggtatctcagccctacttatcctctgcctggttcctctactcagctcggatcttgttagtcttcattccagggcagctagctcctggctcagagcaacacctgcctctgtgttctccatcatctgtttgccccgtgacatccctcagctgattacaactgctattgctctgcccttctgttcccttatccaacacatagatatcaagcatctgagcaaaagatgccaggaccaaaaaaaaaaaaaaaaaaggtacacacggaataattctatttatatgaaattcaagagcaggcaaacctgatccatgatgatagaggtcaggatcaccgttgcctctgggagatggggattgtctggaagaggcaggtaggagggaactctgagtgatggaaatattacacggtgtttacatttgtcagaactcaccaaaccgtatacttatggcctaggcatttcacagtatgtaaggtttgccttcatcttttaaaatgttgacaattctcattgaaccaccactatgtgccagaccctgtgccagcagggaaggagacaagcgtgcctgccccacccagcttatatttcagggcttgtggtttgcatccttttcttgcatcagccactgctgtctgcccttggactggcctcctgccctgcctgtagtgggaaaaaatgggatgggtcaaagggcaagatgcagtctagaggtctgtcccatcagccaattatctttttttttaatttactatttcatttatttggctgtgccaggtcttagttgcagcatgcaaactcgtagttgcagcatgtgggatctagttcccagaacagg

SEQ ID NO: 32161 - DNA, 1004 bp, Bovine  19866881143548
tggccctcacagtgtatagccccaatctgccctttcggccggccctgattcttgtcccacacaccagccagcagcctctgcccctcacttgtgcccacaggtggaggggttggtcttggggttgagagagaagacctgctgtgccaaggccccctggcccgtggggtgttctccacactccttaggaatgacgtacccggcagagctgctgtaggggggagcagagtccgctagcaggtggacagacagaggagactttaagtactactatccccaaggacaagttcagggagggctggggccagagctggcggccctcaggacctgaactctctcccagagcgaccgcaccagcccaggctttccttctctggccttgctcactcgctcaccgcaaggtcacctatccctgcctccctctctgctgccgtcctgcctgcccactgcaacgctgacccctgtgggccggccaaggccctgccctgccaggggacagggacacagagcggccaggccagcccagcttcgggatgaacagaagatggaggccgtgggccgggagagggctgcctgtctacgggaaggtggaggagagcttgcaggcctggctgggaggggggaggcggggcagagtttggagcaggaatgatggaggtgtggggtggggggctggtcttccttcttcactgggctcgggctttgccccacagttccgttgcttcagccaaggaagagaattcagatccggaagagaatggcctgtgggccaggggcccacacaggcttgcctgtcccctgttggggtaatggtcttagcagtaggctgagccatgtggggacttgcagagggcatggattacaggagagagtaccacagggaccttctggaaccagccgggggcagtggggagcatgagaggacaggagacaaagatctttttttgaaaggattgggccgcaggtgttccacgcagtgggatgaagtgatgaggatgtaaaaggtc

SEQ ID NO: 32162 - DNA, 1480 bp, Bovine  19866881207269
gaatgggaatttggtggaagctaaagtggcatttcattgggagggagggcaagaatgggttcaaatgatgttgaaacaattgatagtcatgtgggggaaaatgactcagtatttcaaaatatgttctagatggattaaagatccaagccttaaaacaaaccctataatgtcaccagaagactatatagaggattatcttttagaacttgggcgtagggagtgttcttctgaggctgtcataagaaagaagccagttggcagatttgactacttgaaaaactgggcggctgactggtttggtgatgtggatggtggaacattctgggctacaggaggggccaaggtcacccccactcccaccgcacctcaccccagcctccacggagaggcgatgacagaggaagaaggaccaactattgaacgcaaagcaaaaagaccaagtctttggaaaagaaagaatctgccaaactagagaaaacaaaagacacctcaagttcctgaaagagcttcaaaaagtaacagggttgcagagcagaatgttacaagagtgccttggttatctggtgcatttaattacaggaaagagatgaattcagaacagaactgggctctgcaagcaggagtgaaggggaaagtaacaaatccaaaatttctgggacttgtagtatttaagatagatctctgtttttttcaattagtaaaaaataaaatcaagaaatactttgagtaacaaaggctgattaagatgaatcctcctggcagtgaccaaatcaaggtcatggatgtcacatagtttggtaaaatgtcttgaatggatcaagggtagttgcaaggaagttctttcagttggaccaagcacccagggaaagagaacaaagggtgtgattccaccaaagcttgatgaattcaaaatatgtggagttatatctttgaggaggcacacctagaaaaatattctgaatctaggaatatgaagctgactggtaccaagcaggttaagagccaacaaaattcttttctttgcaaaaatgagtgatttttcattttaaaaaaattaaggtataattaacataaataaaatgcagaatcttgggtgtttcattaaatgtgttttgacatttgaatacagctgaaacaagatgcagaacattttcattatcccagaaattcccctttgaacccctttccagtagatttcccccacttccctcaaaaccaccactcttctgatattttccaatattgattaattaactttgcatgttctagaatttcacttaaatgaaatcatacaattataaaaatgaaaagctgtaagacaaaagatgccatgttgttgtatagtcactaagtcatgtcagactcaggggctggcagctcacctggctcctctgtccatgggatttcctagacaagaacattggagtggattgccatttccttctccaggagatcttccagacccaggggcgaacccaga

SEQ ID NO: 32163 - DNA, 1240 bp, Bovine  19866881329897
ctaaaaagtgcttagtgcactgcctgggaagatccccctggaggagggcgtggcaacccattccagtgttcttgcctggagaatcccatggacagaggagcctggtaaggcttcatacagtccatagggtcacaaagggttggacgcaactgaggggacagcacacacacacgcactgcctggcgcccagtaagtgctgaagacatagaagaaaccatcgtttcctgttcttttttcctcctacaatgcccagcacaatttcagccaatggttagtgcttgcttgcggagctgaacctcagcaatcttctggaacagtggagacacgctactctgacctgcccgtacatctcagcaacgactctaattctctatgactcaaggcaagtcaatttctgcctctacactttggtttctttgtctacagcctgtgaaactgcttacatgcccatttgacagatgagaaagctgaggctcctgactcgtggggaatgcctaacagcaccttgtgctctcacagccagtgcagtcccccttcaaggccgctcttccccctcctctgccaattagccccactcctgagctggtgggttggggggtgtggatggggtctatgcctcacctggtggacctcagggggacacagtccatggggatggggtaactcggagatcccggggttctccccagtgctgtgatgagtcctctcacttcgcatcagtagttgggccggctctggcctattccatgctattccattgtcattagcaggacggagcttggtaaagctggatctgagtatgtcccagcctctctgcctctcctggtccctgttgtcttcctgcagtagccagagctcatgtgttcatatctgtgactgtggagtctgtttgacccttcagggatcagggctgctgtctccagggtggaggtgtcgtcaactgtcttgcttccaggccccaggctggcaggatccctccactcccctgtccagctgtgccaagacctcacctttcctttcttggcttctgccctgttcgtacagtgattggcccaagaaaggggtatgggctggcaggtgccctacacagagcctggaggcagcatccaggcctggctgacccacctcagggccccctgccagtgtccccagccaagctgggtcccctccttcctgcccagctgagacagggcctggaagggcacagtggcaggccctctgtgatgttcctgttgccacg

SEQ ID NO: 32164 - DNA, 721 bp, Bovine  19866881362159
tcagcgctcaggctgctcattcggtgtcgttaccgcatgcccttcccccaagccaccgcgcctagcccagtcacgaggggacactcacaaggctgccagcgcccgctgccacctcccggggtgaggcggccacatgcacctggatcctccccaccaggggaagaccactgcctgacttcttccgtccagtgtagcaggagggcgtgttgggggctcttgatcctcttggccatggtgaacccccttaaaacaactcacgggctggccctccaagtgagaatgcagccatttccatgaaaacaacagcccgagggctccctgagagctgggctctggcccctccctccgccagctgtgcagagtgtttggacaactggatggaatatttggcagggagagtcttccccggatctctgagctcagatttcaagaggaggggaaagagaggatgctggctccagaaagaggctcaagaggtcatttgtgggcttggaggccccccacccaggcctgaccaatactgccaccagcccagccccctgtgtggtggggagctggagtcaggcccctgggggaaggacgggacagagggtggaggcagcagaatggtgtcagaggtttgctggggccagttgggtgaagtcaggcccaggggacagtctgggctcagggagtggcagggccaggacagcgttttgatcccacgaccatgatctgtttg

SEQ ID NO: 32165 - DNA, 1876 bp, Bovine  19866881383372
tgatggggcaatcagaggcccttaccccttcctctttccttggaaggcgccctccatttgccttcctgcaccagaaactgtccaaagacatagccttgagacgtggtattgagatcatctggatggtatgcatggctgaacctagataaggcctctaaataaacttttcagattctggtgggcacgaacagagggctacttatccagcaagacaagcctctagtgtatgttcccatgcttattagatctgccacctaccaatctggagtgatttgccttttcctgcagtctctccatggcctcactccctccattcaaatgacaccctgaagctccaaggttgccatgttttgtggggtaagcagtctattcccttaccccataaaaagatgtaataaaacagcctcttggtatgtgaaatccagaaagcagattaaagaagaaagggtgaataatgaattttaaaattctttaaagcaacttgttcagtcactaagtcttgtctgactctcttgcgaccccatggactccccagaggagcccagcaggctcctctgtccgtgggacttcccaggcaagagtactggagaggattgtcatttccttctccaggggatcttccccacccagggatggaaccagagtcttccgcattggcaggtggattccttacccctgagtcaccaggcaagccccaaagcaacttggtcaacaggtagaaaaactaagccttttcagcatattaggtaagagatccagcgactctttagaaaggttctgtttatctggcgtgggaagctgaacccggtgtggcgctggtcactagccgcggtgcacatttacctgcgttgaagtcgggatcgtcttccagcactgtcacggctccttccaccgcgtcaacggcgctccctccctgcttgaggatgttgtaacccacggtggcggctctgaggatgccctggcgcacccgctctttccggtctttggagatattgctggctccgccaccgtggaccacgacgacggggttcatggcgatggatcctaggggttaggaagacgaaagcgttctttcagacgggtccaagagaaccgcatggggcttatgtctcccgctggggacaaggtctggtttccactgctggacaggggcagtttttacaacctcaggcgaattcccgagacccagggagtccggcgagcagaagaggcggctgggtgtgaactttgcacgaaaagcccagggtgcccttccttgcccggcccggggcacctgcccgcctcgcagcagcagtgcgatgctccgcgccccctccttgcccgctgacatccggcctcagtttccccgaggaaccccggctcaaggcccgggccgggaaggggcggagatggcaccccttccagccacccacacctaccccgacccggggccgcagctccagccttcctcccgggccccacgtcgagcctcagtttcccgggggcctgtccgcgctcccacctgcgccgcggggccagggggaggcctgggggctagaactcgctagcgccctcccactatcggccccggcacccacgaggtgccttcccgggtctggggaggcggcttcccgcagggcccgtcgacttaccgagcacgccgcaggaggcggacgccggggattcaggctcgggcgagccgccctggcggcctcggaacctgcacaagcgggtttctccgcaaagctgctctggaaactgctccgccggcaaccgctcggcgggcaacggctctgcgcctgcgcacgagggcggggcagcgagccccgctgaattaccgcaaggcctcaacgcgcggcgggggagcaaggactcctgccctcgtagccagcgcgcg

SEQ ID NO: 32166 - DNA, 1080 bp, Bovine  19866881403496
atgctatacagtaggtcttttaaatcctatatgtaatctcagtagaaagaacagaaaaactaaaagagtacaagctactgcccttgatgatgctatatcttagaatgagcatgaaaaagaagacatgaatccactgtgggccaaggactccctgcttctgatggtgagagctgacagcatgtcctgtactctggggaaatttaaagaattttcagggaaaaatattgattctatgtaatatttatcttatggcttatgattatgatctaaccacagagtaaaatgcatttcccatagagtgaaaggggtttccctggtagctcagctggtaaagaatctacctgcaatgcaagagacctggattcaattcctggatcaggaaaatcccctggagaaggaataggctacccactccaggatttgccgggtttcccctggtggctcagacagtaaagaatccacctgcaatgcaagagacctgggttccatccctgggttgggaagatccccgggaggagggcatggcaatccactccagtattcttgcctggagaatcctatggacagagaagctggcaggctacagtctatggagtcacaaggagtcggacacgacagagcaactaagcacagcacagcacagaaagcccagtgaggtctgggtaggccaggggcacacttgacctctcccttaggggacgtgaagtttgggggaccatgcagtccatgcagtgagggactgggagagacctaccagaggctcccattttacagataaggaaagggaggtgcagagggaggaagagatcgcccaaggtgagcccaaaaggcagagctgagtgtagaacgtggggcgcacagctcccagtgtgggttgggcggttgttctggcgggggctctgggctgcgggagaatggctggccttgaccagtgagggtctgacctgtgcatgtcctctccaggggcgcccacccgcgatgtcctgctggtctctgccatcatcaccgtcagccttagcgtcactgtcgtcctctgcggcctctgccactggtgtcagcgcaaactggtgaggctcttaa

SEQ ID NO: 32167 - DNA, 796 bp, Bovine  19866881473900
tggaggtgcaggggagccggcgggctgggggacccgtgtgtgatgtgcaggttgatggagcacccaggacccgggttgagggaggaggcagaccatggggggaatgaaggcagccagagatagggctgggggccctggagccttgagagggttctgggaggcacgggcagagtaggtggggccctggagtcactctgaggtgctgggagggcgtatatgggcgtgcgggcggagagagcacagcacccaggtgtaaaggagaaactatgaccacacccgggggctcctcccacctggactgcctgcgtgcccctccccagactcgaagcctggcacctacttgatggccttcttctcactgcgcccacgccctgagtctggcgtgcccaccgtctccaaggagttcttgtagcgtttgccctgtggagacagcaccggggtcagtcctgggagacagggcctggactctccctgcctccccagagcaaggtcccagcggggaggggagtggatgggagcccagcctcagcagcaagggccagggccaatgcctgagggtgccaccagccaggagtgccggcccccacccatccctgctccccggttggcagttcctaggctccatgccccgccctgttgacctgcaccacatccctgacccctggggacaaggcccctcccgcctgcctgtctcctggggctctggctcggctcccagaaacatatctccctctgccatggacagacggctctcaggcgcctggccacgtcacacgggccacgtcactgcccccag

SEQ ID NO: 32168 - DNA, 640 bp, Bovine  19866881485611
gaatctgcctgcaatgcaggagacccggttccatccctaggccaggaagatcccctagagaaggaaatggcaacccactccggtatccttgcctggaaaattccacggacagaggagcctggtgggctacagtccatggggttgcaaagtcagacacgactgaatgagtaacacatggatgctcgtgtgtgtggagaggacaccgcagggaggtccggcttcaaagcctgacttggcccctcgctcagtaggcccctcggaacctcagtttccccatctgtgacatgaaaacagtcctacctacccacaggctcctagtgatgggagtaggaggcacctccccgggtccttcaaggctgccctggttgtggggggtggcggtgcaggaaaggtgctcatgagcctgagaccctggttgggggcggtgcggcgtcgggtgggagtagagacagcagcgtccccgccactgccccaacgcgggcctcaccaggcacctgtttcgtcccagggcttgggcgtgtgaggacccatttcttgccgaaatccgtccccagccctgggcaggctcgcctctgccttctgctccggcacagctgacgtgtgaaaagcaacagctttcgggccccggactccggttgcg

SEQ ID NO: 32169 - DNA, 1523 bp, Bovine  19866880372037
aaatacatatgaggaggaaagaatagagaccaagcccagggagacagggtaaatagaaatcaggaatacgatgcgtgtgtactaacagtgagggcttcccaggcggcgctagtggtgattcagctgccaatgcaggagactaaagagacgtggcttcgatcctagggttgggaagatcccctggagtaggaaatggcccctcactccagtattcttgtctggaaaattccatggtcagaagagcctggtgggctacagtcgtggggtcgcaaagagtcagacacaactcaacgactgagcacacacatctatataaaaataacttgaacataaaatagactacaagattatcttttctagagttggaagatgaatttagtaagtctggcatttttgcattaaaaagtatataatacatttgtgtgaaattagagtagattatcagtgttctttctgagtagtccagataattagaaaaagaagtgggcgggagggggaacccagtagaagtaagatttaattttatatgtaatcagaagaaatattctaagtaattcatcactaattcaaagagtcaagagaaatctaggaaaagtcctaggagacataattagctatgcagaggttgaaacatttgcaaaatgtcacagttataaattgtaactttttccctcatgagacctgaataatgtttcatccacaaatctcaaaagaattttcagcaagtctcaacaagaaatacttgcacttgataaaggagttttcacctcaacagaagagtctggctttggaaggtttgcttcttgttttttggaaagctttctggaagtctgccccttacactttctgggcttcacttcctctttatgaaaaatgggggaaccatgcctgtggccagttcacccccaagggcgctgcagagtgactggagtccatctgctcgcagtcctgggctgtgagagggctcagtcagcgccagcggccaattggttctgggctccgcttccgtggcctcggtgtgaggcctcctgcacgggaccgggggcaggactaggcaggactgaccctgcttcagggtgaccagccttacagataccctcagacacgggatgtgggacgagccctggtgaaaggtgagcgaatcccctgagaggaggctctgtggaggggctgatgtagggcctgctgagggcgggctgtcatcccgggggcagtgggcacggaccgcctccgtggcccaggctgtccctctgggggggtcacttggcttctcaggccttcggccccgcagtctgctggtgggttgatggtagcgtgggctgatgagtcatttgctcagaacagggcagaaaggggttagggcctggggcggggcctgggggtccagtggagacgcgcacgagcttggccttgcctctgcccctggggaggaggcatggagcaatgtgggtgcagtgaccgctcctgtccccaggccctgcccgcattggcccctcaggctccgggttggggagctcgtgggt

SEQ ID NO: 32170 - DNA, 2793 bp, Bovine  19866880392593
tactcggtagaataatcgggaataatcgatacctttccactcttgtcctcagctttataacccaggtcatcacagaaacacttgagcatttttgctgttttctaagaaggtggggaaatgtgcaaagtgggaaaagtttaagaaagatgctgtcaagcgttactaaaaagtgctctggcgtgggagaccggggagattcttgggagggagaactcgcggcctccacagagaaccctctccctgtgtacagctcagggcccacgggggactgggaggagccggcaagggagtgggaggagcccgcgggggagtgggaggagctggtgagggagtgggaggagccggcggagggagtgggaggagcccgcggggggaatgggaaggaaccggcgagggagtgggaggagcccgcgggggagtgggaggagctggtgagggacagggaggagccagcgaggcgtcctaacttgctgtgttcctcctgtggccccggggtcgctgaccccgtcagtcccttgggcagagctgtcgccggagccccacgtgttgcggggacctcaggagtctggcttttcccttcggaaagcttgatggatggactctgtagatgctcgctgggggctgtggtaccagagcggagggcacagtcctctctttgtgaggcaggatcagcggaaaagaaaccaaaacccaaaaagcaacgacaaaataatatgtctgagtcacacaccctctttgcatttttttctgcttttgtttcctgctaatacagagaacataataagtcaggagtgggaaggttgctgtcctgtgactggtgtgtgttacttatgtgtaaaacgttcagttccttgctgtctggtatataattttgtttctttctttattcgttttttaagcagaggaatcttgtaaatgcaatggctggaaaaaccccaatccttcgcccacgccccccagagccgacctgcagcagatcatcgtcagcctgacggagtcctgccggagctgcagccatgccctcggtgagtcccgcacctccgggagaccaagcggtgtcccctgagactctgccctgctgggctcggcgggttagccagacttgtacacctcgcctctgaggaggccgcaacacgacccctgaacctcctggtgctgctgggaggcttctcgtgggaggcgaatcatgccccgtgtgccctcattcttctttttcttgaatttatcgcctgtgccgggtcttcgctgcggctcaggcttttcttgagctgtggcaagcagagcctgctctctgatcgcggttcgagagggcttcccatctggcggctcctctggatgggcttcagctgttgggctcaggagttgtgacactcgggcttagcccatctggcgcgcggcatcttctgggatccgggctcgcactgtgtgtcctgcgagcggattcttcgcattctccacagccgctttcatccctctttgtctccgctcacttttcccaagagctgggctgaccgctgacgggggcggggcaggggattgccaaatgggacaaaacgtggccgctgaactagttaggataatacgtagcatgtcctgattcactctgattttttttttttaattcttttctgattccctgaactttctgggagtgcttcattttatcttcatattctttaatttcctgggtctgctatctcttttcttccttggaattgtgtttggtaaatatttacttgtctcttccctttcaacgttcttatctgtccctgcaagctaatcactgtcagcctagccagactctgccgagttagttaccaggactgtggtaatatagtctgtgtcctgatactagttttaggacaaacattttctttttaaattatattctgtctgagtggataaaggttactgagtagttttccctagatattcaaattcagattcacaagggatcctggactgttgtccatacttttctgccttcagtcatccggtctcccgaagaatggcgccccggccacacagcctaatatacttttatcttttccacctgcccccttgtgaggggtgggtgctcttagccatcatctttctctcaagcttcccgctcatctcagatggagcatcagccttcgttagccagcagttaggtctagtttgaagtgtgattgtgtgttcagctagagagggtttcagtctgtatagaacaaagtaggaaatagtgcgatctcctcaggaagttaccacaccagagtgacctgaggaaaggaactggagacactcagttaccacaccagagtgacctgagaaaaggaactggagaaactcagttaccacaccagagtgacctgaggaaaggaactggagacactcagtctcatggggaggtgtaaatgcacctacagtcacatcaccgtgttgatttaactggtgtctcttctggctcttgaagcagccagtgcaaagcaaagaggccaagagtcacaggaccgtctttgcttgtaactcaccttttccacagtcatccctgagtgatgccctttagaattgcctcagggaatgtgacgcaatagagctcctcaaacactggacttgaactggacttggtattgattgggaaatcctattatccttcaccaattaacatttaaaaacagagtcttcttccttatttagctgagcagattgtctcctttccgagcacacaggaatgcccaaaggcagaaacagcctttctcaaagaaaagctgactttggtctctttttatatttcttaacaagctgtaaaaa

SEQ ID NO: 32171 - DNA, 2531 bp, Bovine  19866880392597
ccatgttatacttggaaacaaaaagataaaatggagaaatgaaagtatgttgccaatggaaaccaatgtgctaatggttaaagccattgatttccatgcggaactcatattgaaaagaacagataagttcatttattaggagttgggaaacttacattttgcacaaagtagagtcttccaaaaagcccctccttgcatttgggaatcagagcaattagcagagaaatcgggctgctctgctgggcttacggacattttctaacaaagcctagtgtgaatacgaaattcttaatcaacactccaagagcatgctcacatgggggcagtgtgcccagggtgcttggaggagctgctttgtttgagtgaagttccctcgtattaacagttggatatttgcagattaagtgcagacaatacttagacagtcaaaaaagtaattttttaatgctttcactagcagctgctgacagattatctggggatgttatccaggttccttcactgtagctgataaaacttcatgaaagaagcacatgaatttctatattattgttaattttgctagggaaagaatttgggaactctgttgctcttcttttatgggttgtgaatcagctagtctaggctttccttgctagacattgcttctgttgggacgaaacattttattataagcaattaattaagggaaaaccatgcaaaacaattattctagttgtctctctggcatccattctgtctcatttcattttgttggccaccgtgatccacgtctcctgcattgggctgtgaatagccaaagtcaccagggttatctgatgtcccccgctataaagattggtcagagtcagaattcctgatctgtaatcaattcctttgattacaggagttggccacagggatgatccatttagagtaaagtttaggggttttgttctattgttatgggaaactataaagcctgaatacgtttgagaaagaattgtagctcctgtcttatttagcagtgctcctagttgatgaaaaaagccaccttcaagataccagttgatcatggtgtatgattctttgaatgtattgttgaattccatgagctagctttttgctgagaaattttgcatctatgttcattagggatttgatctgtaatttcttttttggtaaagtaatgtctctgctttttaatatgctgtctaggttggtcatagcttttcttccaaggagcaagtgtcttttaatttctgtggctgcagtcaccatccgcagtgattttggagcccaagaaaataaagtcagtcactgtttctccatctatttgtcataaagtgatgggaccagagtgccatgatcttaattttctgaaagttgagttttaatccaatttctcctctcctctttcattttcaagaggctctttagttcctctttgctttctgccataagggtggtgtcatctgcatatctgaagttattgatatttctcccagcaatcttgattccagcttgtgcttcatccagcctgacatttcgcatgatgtactctgctgtaagttaaataagcagggtgacaatatacagccttgacttcttcctttcccaatttggaaccagtctgttgttccatgtccagttctaactgttgcttcttgatctccataacctataaatgtatatatgttattactttaggttgatgatctcttaagatcaaacacattctaaaaaaactgcatttctatatctccccccatgtttaacgttttcaatataatattttacatctttttattttgtgttaccccttaactaattattgtgtctatatataattttactggtggcactagtggtaaagaacccacctgccaatgcaggagtcgtaagagatgtgggttcgatccatgggtctggaggatttcctggaggagggcatggaaacccactcatgtattcttgcctggaaaatctcatggacagaggagcctggcgggctacagtccatagtatcgcagagtcagacacgactgaagcaactcagcatgcatgcatagttgtattacttttgtcttttagctattctactagttttatgggtggttgatctactatctttactgtatgtttgccttcaccaatgagatttttctttttgtaattttcctgtttctagttgtggccttttttttactattattacagaggtccctttaacgtttcttataaaaccaatttaggggtgcattagctctttcagtttttgcttgtctataaaagtctgtatcgctcatatatatcttgctggtagagcattctgggtgtaggattttttcctttcatcattttgaaaatattgtgacactccaggatggcttgtaatgttacaactaaaaaatcaactgactctcttaggcaagtaacctcttttttgactagttgcttttcttttactgctttaagattcttttctttattttttgtcattttaattataatgtgctgtggcatgaacttttttgggttcatcttgtttg

SEQ ID NO: 32172 - DNA, 1871 bp, Bovine  19866880410218
gggcagttttccaccagagggtatttgacaatgccaagagacggttttgatgtcacactggaggagagagttgttcatgagttgaggccagcaatgccgctgcacatcctacaaagcacaagaaagcccccgaaacaaagacgtgtctagccaaaatgccgatgtgtcactgttgagaaatcccgatctaaataacagtgtctgaggctctcttgcttcttagagtcttgtattggaaaaatgttagcttcacattttgaggtagcatatggaactaaattgtctggtggaatacctgattaactacatatggctatcaggcgcttgacgtgtgactagtctgcatgtgtaaaacacacactgggtttcttagtatgaaaagaataatgcaaaatgtgtgtgtgttaagttgcttcagtcatgttcgactctgcgaccccatgggtgtagcccaccaggctcctctgtccatgggattccccaggcaagaataccggagtgggttgccatgccctcctccaggggatcttcctgacccacggattgcacccctgtctcttcaccactagcaccatctgcgaagcccaaaatgtaaaatacttcataataatttaaaaatattatttacatgttgaaatcataattttgaaatatggaattaagtaaaatagatgattccatttgtttctttttcctttctttgtggttactagataatttaaagttgtatatgtggcttccatttccattggacagctttggtctagaaaaaggaggaagagttgagttagattttagacattaactaccctgatcacattgaaaataatgaaagctaaaagaagtggtctttcatttattcttcagttgctccatccaataggcatttttgaacataggctgtgcactcatcactgggcatattaaagacaagtacatcttcctttgtgaagagctcataatctactgaagaagtcacagagctaaaggagggaattgcagaaaagtatgtacatcggtgtgtgttgctgtgtcgttgttcagtcgctaaattgtgtctgactctttgccacacgggggactgtggcctgccaggctcctcagtccatgggattctccaggccagaacactggagtgggtggctgctcccttctccaggagatcttcccaacccagggatcgaacccaggtctcccacattgcaggtggattctgaagaaaattaaacactgaggggagtgagatgcaaactgttaaggatttgtacgcagtttagtgtacatttgtatagtgtttatcaactattggatataaaaatactattttttatataaaaacactattggatataaaaaataatgccaaacaaatattttgtgtgaataaaaaggaaaagggtaatatttaaggtagcactgacaacatgcatacaccattctgttgaaaattaaaaggtataagatcaatgtcatttttcagaaggaagaaagaaatcttgaacagcttcagatttagaaaaatgaagactccaataagtacgttaaactctattaataagagtagcctctacttttctccagaagaggggaaaaagggagattctgaaagtttattaatccaacaaagggcagcaaagagaaagcgggtgaaaaggaagatggtggagaaaggagagttgtgtttacaacacgacccctgctcattgctctgctggccgcagcagtctctcagcgttgcctgcggaagtgtggaaatcagatcatgtgacctcacataccacctgttcttaatcatcctgatagccctttgactctggtctcagggagaatgctctagcaactctccataatcctactcagagatgcgctat

SEQ ID NO: 32173 - DNA, 1215 bp, Bovine  19866880479756
tatttttcacagagctagaacaaataatttcacaatttgtatggaaatacaaaaaacctcaaatagccaaagcaatcttgagaaagaagaatggaactggaggaatcaacctgcctgacttcaggctttactacaaagccacagtcatcaaaacagtatggtactggcacaaagacagaaatatagatcaatggaacaaaatagaaagccaagagataaatccacacacctatggacaccttatctttgacaaaggaggcaagaatatacaatggagaaaagacaatctctttaataagtggtgctgggaaaactggtcaaccacttgtaaaagaatgaaactagaacactttttaactccatgtcttggctattgcaaacagtgcttcagtgaatattgtggtgcctgtatttttgcaattagagttgtctccagatacgtaccaaggagtaggatttctggatcatctgtttttagcaactaagttttaactcataaaatcttccaggatgacccattgatgtatctcactttaaattgaattgtttaaaattgagaagcttcttccatttcatttttatttttttaaagaataacaaattttaaagagtgactcttgaaaaacaaaaataactcctccaacactttctgagagttttcaagcttaaaaggcacttgctttatgccctgtagacttgaccttaacattctaagagtgttactgccttcagttgactccaatgtatgacaagcgattcctcacattttatcagcttttgacaataggcacttatggggctgagtgatctaaaaaagattaacaaggtcctaaattactttaatgaataatagagaactttaaattttattttgttttttaattcacttaactgaaatccatttagcagccaaaacactccctcctgaacatattagaaggaatagtatgttgaggttttattaatttattatgtttcagttcacttatcatttattcttttattaatttattcactgaattgagtttcaccttataaacattgtagaaatcaataactttgtggggctttatgtgcaacaaaataaatttttagcaggttatccagggaatttggaatctatgagcaagaacaccattggtataatgtaaaagtacagttagcatttcaaagaacataagatgtcagggatgcactcaagaatttttattccat

SEQ ID NO: 32174 - DNA, 2724 bp, Bovine  19866880671237
aaaaagaaccctgctgtgtaacacaggaaatgccactcagtactctgtaatgacctacatgagaaaagactctaaaacagagtggatgtatgtacccacatgaccgattcgctttgctgtacacctgatgctaacacaacattgtaaacaaactctagtaaaaagtttaagaatacaagtggctattaggaaatgttaagttacagacatgtgctcacgttctgttcctattgatgttgctgcactagagtttaaagggaattcacccctccaaacccaagtcttcactatggagcctaactgcttaggtacagaagagtccccatatttcttaaatgcttctaagtgatgaaagttatacccaattgaaacatctgaaagtctctggattttgctcacttgtttctggatttttcatgttggtgggaaagaacagtacttcctacatgtgtacaaatatcacaggacatgctgaaccccaagtgcaccgtatttttaacgtgtgcgggaccttcagcccagtttacgagagaggacgtactaagtcctgagaaaacactcagcatcacccctgatgccagcagcgcattttctgccaagtgccccaagctgctgctacctgccctccgccttggcctccctatctcccttccagatgttccagccgccactgttctctgagataagaaggctcccttcaaaacaccttaattagaccagacggctgctggctcggggaactcccaagggggttggccttgcagcttcaacaaagtatcagctgcaggacaacctcgcagggagtgactgccaagccaattactgtggcagctataacccgggcatgggggggtggggagctcattccccaggagctcatctctacagagcagcagcaccaagagagaaaaggccgcctcagtgctgccgacaagctgaaggcataaaaatggtctctgccccggcagggtccagggtgagaggtcagaggatgcagaagccaggacagaaggaagcagaactggataaacaagtaaccatgacctagatggcaggcagacagggagcggggtgctccgggcctgaagagtcctggttggcacccagaggagccgcagcaggagcgccaggccctccagcaggacgctgtcaggcttaaaatgccagagagtcgtgcttccccaagaagttagaccagtggcagggaatgtcccacagcaaaaacatacagacgggattagggagtaaaactgtgactccaacattacggcactggctaaaacaggcacttgcatacacattcccgtctcagcctgtgtgaggaagggatttattgctcccgctactcagaagagaaggcagaaactctagacgttaagacacctccctgcgtttgctcagtctgccctgagaagcaccgagtgcgttcaggccctgtggttgtgcacgtgtgtctgtctgttctgctacctctctgttccaggctggacaaaagcaaaacgttcaaaggttaagaacaaaaaccacagtgggatacaacttctccccaacgaggatgaccgcaatccaaagagcaggtgatacgtctgatcatgaagacacacgagtccttgggcactgctgaaggggcctgtaacacggagcagctgctttggaagacaactcagcagtttcataaaaagttaaactaacagaaaacccccaaataaaccctcacatcggtggtcaaatgatttttgacaagggggccaagaccattcaatgggaaaagggcaaccttttcgacaaagggaaaaactgaatattcacatgcaaaagaatcaagttgttggactcctccatcatatagaaaaactaacctcaaatggattaaagacctaaaacaatgaaactcttaacagaaaacataagggaaaagcttcttgacattagacttgttgatgatttcttggacaggacaccaaaagcatagacagcaacaacaaaaacacgacttaatcaaaatgtaaaatttctgtgcatcagaagaacacagagtgaaacgcagtcaaatcatagcaacaaggggaggttgccaggaattgagtaactgaagctgtggggagctgttgttcaataagaacagagtttccgtttgcaggatgaaatacactagagagacaatgattggttgtacaacagggtgaatttctcaacactgctgaacttaaaaatggttaagatgataaattttatgtgatacgtattctaccacaacttaaaaaaaatcattttcagtaacattattcatattagccaaaagtgaaaagaacccaaagtccatcaacaggtgaattcataaaatggcgcatacctcctggaatacgacacggcagaaaccagcaatgggatgatacgagctaccacagggaagagctgcaaagcattatgcaaggagccagtcaccaaaacatcgcatagaatacatttcagttatataaatctccagaaaaggcaaatgtatggaggtggaaagttgactgggcttccctggcggctcatcggtaaagcaactgcctgcaatgcaggagacccgggttcgatccctgggttggcaagatccgctcgaggagggatggcaacccacaccagtactctcatctggagcatcccacagacagaggagcctggggggctgcagtccacggggttgcacagtcggacccggctgagcagcaacagcag

SEQ ID NO: 32175 - DNA, 1522 bp, Bovine  19866880861339
cctagaggctacaggctgaatattaataaagaggtgtctggagtaaatattgatcatgaatttctgcttatgcttagagtatttgagaacctgagatcaaaagagcaatgaaaatgagaagggctaaccttttctagaatattaactaatccaagtgtttcctatatacaacaaatcagcaatccttccaaagaattgtatcatcacacacaaaggatcttcaacttggtcttttcagacctttcccagcaaagtctgaggagccccgaagctctgagtgagactaagaacagtgacagcagatgggatggttggacggcatcaccgattcgacggacgtgaatttgggcaactctcggagatggtgagggacagggaggcctggtgtgctgcagtccatggggtcatgaagagttggacgtgacttagcaactgaacaacagcagtgaaaacagtgaacaatgttgaataaattaatgattgaaatatgaaaaaaaaaagtaaacaagttttttggtgatggacaaagcttaaagaaaatgtacagatttaaagggatggtttgagaatctaataaaagatgaaagtaaacccagacacgaataccattacatcagtattttagaatatgacgacatgtttttctaaagaactcaaagaggctcacagctatgacgtcatggaacctcagcaccacagggagaagggtcttaggaagtcatttgcctaattcttccccatgtgaagctaggagtctcctgccatctacctcggggaggtcagctgctagaaaacccccagcttagggtgctcgctgagtccttgggccagttcatattcagccgctgttgtggttgggaagttctttctaattttcacctgtgatctgatcccttgctctttctacctattgaccttagttctgctccgagagtacagtggctcttccctgctcttcacaactccccaagcttcacctgtgatctgatcccttgctctttctacctactgaccttagttctgctccgagagtacagtgactcttccctgctcttcacaactccccaagcccttggaaatcacccacgcccatccctgccgcccaggtcccaggtccagcctcatcgaggcttcagtcctgcctcgcacgcacgactggaagaccctatctcaagttactcgtatctttcaaggcttgctcctgtgtaacaatacacttctaaagcacggatcccaagaccaagcataataatatccaggggaggatctgtccagtatgtaggaaaagagtacaaccgtctccctattttggaaattattctcccgttggtattaaccatagacatgttagcttttcccaaagatatcacaatactgacacacttcaaatctgaatataactcagattaaaggatgaaggaaacctctcttaaggagaagagagtgaaatggggaaaataaacatataaactcataattacagtatacaactagctgttcaatacggcaacaactagtcatg

SEQ ID NO: 32176 - DNA, 1352 bp, Bovine  19866880912281
tcactatagcagaagtcaacacatttggatcacttaatgtctttgtaagagaaaagtgaagacttcatcctttcagtcagtctgttctttcaggcccacagtctctcctgcagtcctctacgtggttacctctgtggacgctggcgcgcttctcccagtcctttgcgccatgttggtggctggcaggccattctaggtacagcactcatcggaagaggggaacctcacccaaggtgcatcccctcccggggcggcgctccgtcagcaaacggctggtgctggattaaaggcgggctgactcgctgagagctgagaccgcactgaatggccatcacaggccctgaactgtgcagggcattggttaaggacctcgtgggaactgcatctcagttcagtccctcttcctgcctccatcacgtccctgcagttaaccttaagggcgctccccagtagcatttctatatgtgactgttcctgtcagaatctgcatcccagggaacctgatctaagaaagttaccctctaaaaaagagtgcagagagtcccctatgttttaaaatgtcttgtttttataaatctaacatcacctaccacatccattgctgtcttatgcattgtctttgctaccaataccttgcctgtgaatgatggagggaatacattccatgtggggtatcagtactttatctgtacctttgcttgggaatttctacaattcagttgaagtagttttctgaacttttctatgtattataggttttctaaaagatgttatttttagctgagggaaaatattatttggttctttttttgtgtgtggttcataaaaaatagttcttcatgtattttgttattggaaacagaatccagaaaataccataagctgaaatgtgttagaaatatcagtgcttcatacaaatacatagcaaacgttcaacactatgtaatttgttccaacagttgttcctttagtcttctataatgctttcacatgtcatgcaacaagatttgactaacaaagatacacattttgggtttcgccgtatgcttttttggtattatttcagccaccttaactgtgacagaacaactatttcctcactggatgtggctgtgcttttgtaaaatgccttcgatttacatgagaaacctcaaaagaagcttctcagcatgtatattaccacatttcatgacactgtagagttctgtgtgtgctgttgcatgattgtagaaatccctgaaaaactgtaagcgtttttcctcaagtctgagatgcttcgttttaacctattccgttcatctttatggcatcatgctaccatttgctatgtctggttctggcaatatgggaaa

SEQ ID NO: 32177 - DNA, 2578 bp, Bovine  19866880966579
atgataaaaatcttagttaaattctgatatgcatggtttgtttaaacaggggcaaccggctgtcaagaaccacctaaaacaaaatctcaacaatacttcttttaggagacatggaggagctgttggttttgcttcttagtatttccggcaatctatttgttgggctatccctgatccctcttcagtggctgggaagagtcatggaaatagtgctgtccaatgaggtatgagcagaagcagtaagtgaatgtcacttcaaggtcagagcatctaactgtgggtgtgagatacccgtaacacctagagccaccagcagtatcccagtgctggctgctccatccacttggatctggggttcaagataatacaagcagaagcccttgctaatctacagcagacatgagacgtacacaggaataaacctttgttggtttaagctgctgagatttggggcttgtttattactttattataaccccacctatattaaccaactgaaaaatgaacaaaataaagatcttattctccctatcctgaccaccaaatcatttttaacacagtgagaactattaaaagaaaagatcagtacacatgatctagaagtaaaaacagaaaatgaaaagccaatacctcaggagcaggactgaacagtctaccttcagagcaagaaagaggtctgtgctgaaccctgggcgggtgcaggggccacctgctcacgtgtgcacatgtgtgagctacacagtggcgaggaacggagagccaggagccaaaaccatggtaaatggtgcattaatttttggcagaacagaggtaacgataatggtgaaaactataagcataaaagcaatgaagcctcaaaagaaggcaatgaggcagaaaagagatttaacaatagactgaaagggtttccccccgccccccccatgcaatggctatctggtataagacttcctggtaaaactacattgcagacggactttatcactctgtttgtaggcatttccctgtaacacttgaatacaatttttactacatttggaacgtttgaatttgaccatcatttttagggcctgaattacttcgttttaactgaagggcatctcaaggtctggatatgttcaaatttgtgtttgcaaaggccccactgccagacacaaagcgattgctgggacaggcttcctgctgaggcaaatcagcgagcgttcacacggccttggcactctatgtttgcttttagggatgcttaatttttttctgggggttgttcaaaaccataggaaatagaaaacacataaagggtaaaaattaaggcattcaatcttatattcagaaggaattagcgtggtcactgttttgaaaatccagactctttttctggcatccctatacatcttatatatctttctatctatacattttcatgtgtctgcaaagagtcggacatgaccgagcgactgaactgaaatgaactgatacatcttaatgtgatctttagtacttaggtccctgcatttttctttacacaacgtttaataatgagaaatattctagaagattaaatatatccctaaatatatatacaatcattttttttctctaatattttcaaggttgataactttttatgattataaataatactaggatgagcagaaataccttccacgtttctgattatttcacagaagaagaattaacaaaggaaatgatggatgttgtaggaatcttaaagtaccaaacttggttaattttcataattgccatgaactcttctactgctctgctcatacctcgttggacagaactagttccatgactctctactcctatatgtttatgagagtgccatttcctcactctctatacacagaaaattatacctttcaaatgtttaacaatttgtttgatcaaaaaatgacactgcagtgttgtattaatttgctttaatttttttgactaatagtcaacataaaaatttcctcacatgtttaaaaataatttgcatttcttacattttgtttgaacttgtatgactatttcatttttctatttagagtactagtctcatttctactggtttttaagtttcctatatacagttaggctattaaccttttgcatataagatttcagagtcaggatatttagggtcagtaagaggagttattatatgtgaaagttgtttttaagcatacagtactatagaatgattgggttttgatttttttttctttagattttcaaatcttggatttctgattcatttttcttttgacattattaaccctaacactgaaagtgaaagtgaaagagaagactgaaaaagttggcttaaagctcaacattcagaaaactaagaccatggcatctggtcccatcacttcatggcaaatagatgtggaaacagtggaaacactagctgactttactttcttgggctccaaaatcactgcagatggtgatttcagccatgaaattaaaagacacttactccttggaaggaaagttatgaccaacctagacagcatattaaaaagcagagatatcacttagccaacaaaggtccatctagtcaagg

SEQ ID NO: 32178 - DNA, 1004 bp, Bovine  19866880988519
gaaatgcactaatttgatttgtcatagaaatgttctttcttttaagatccaagataaatcagcaaatgctttcaaagctgacatttaatccatgaattcaaatcatttccaagacttatgacccattagaaagacagtttcaatttcccttgcccttgtgagagtctaatgtatagctggcagaaaacacatttacatggcacaccacccaggacaaaagtaccatttattgataaggcttttcaagtttaaaaaaaatgatcttgctagtcgtgttcattttgatttgtttatctgtcagtagatggatgatccactctggtgaagtttcctaagatgtaacaggttaacagatgtccatgtgacaaaggctgcctactggagactagaagaaatctcccacaatcatcatgatgacttcataagtagatgggaatatctaagctggctagatgtccatatatagacatagactgatacagaaacaggtatagatataagtaggataaagaatcaaactcacaaaagagttggatgaacctatctccaatttctcttctttctctactctattctttaccctttgttctaaatatgatgattctgcctcaaaaatatcagtaaaattcattgaaccctctagcagaagttctcaaaggacattaatccagatttaacattcagagtcagtatctgtggatacaatatccattagagaagatgctctttttttccagcaactcatgtttgtaatatataattatgaaattgtacatatatcaattactgtactaggaaaagaactctataaagcataactataagttcagcctttgaggagcttactgtgttagtttataagtggaatagatttattactatatctgtggttaaacataggaaaaaaaatgttctctttaaggacaatttgtccctggcaccattcacttcactcgctcagtcgtgtccgactctttgtgaccccagaactgcagcacgccagg

SEQ ID NO: 32179 - DNA, 1686 bp, Bovine  19866881019400
aaaatttaaaattatatcaacccccaatattacaaaattattactatttaatagatataatatcatgggcctttctcactgttggagagaagatgcaaactcttaagttttaaaatttcagaccttaatacatgttaaagaacaaagaccacaaaaaggtaaaactaaatattcacaatagccacagtcttagtttttttttaatgtacaaaatatattttaattgttaagacttctcccaaatctcagtttaaccaatattttctttctaaaatatttttcattactaattagctctctaaaaagcaaaggtatctcttttgcatcaaaggttgtaattttccatagctttaacttttaataccctgtaaagaactctgtacatttttgctgaatttaaaattctaccactctgtaaggtaaagaactaagtgaaatgtgaaaccaaagtcttccttgaaaacgtgtgcctctgagaaaaataaataaataaataaatgtgccagatatatcaccataaagaaaggaaagacattcttcctcctgtctactccaggaataacctccccagggagaattttgaaaggatttgagcgttttaaatgccctgatctaaattagttaattaaaaatatgagtgagcaaagtccactaaggttaaaaggagaagaatagtcagcaatcatctatcacagtgccctgttcaaggatttcaagatacctgattaacagtggcaattctcatttagattccctatctgatgaagcagagttgttattgatccaacagttgacctcactgcaggcttagggtgtgacaataataatctctccatacagtgtgcctgcagtcattgacagctttgagtaatgattagatgaaataaatgattaaatagctaattcctaaaaacacttattccatttctattgacgtttcagactttccacatacttcatatcttcccttatccttctttcttcatttcttcctttaaaatgatttatgaattttttaaagtgttagttgagttaaaattgttagggaggaataagttttcctctgcctctcagattcagtgactagaggcatgtaaatttaactgacgaaagacacattaacattaaaaaaaaaatgtattaatattctgcatccacaggcgttcaaagaaaaaaaagtgaaattcaagcagttagactcaagtgtttatataccattttaataaaggaaaagcagttattctttgaggaaaaataaactacagaaaagttactaggaaatatatagggaaaactaatggaagagaagtgttattataataattttgttgatgcaattcatctcaatgcagttcctcgctgagaaaaagttgtgcttaaaactgaacaggaccctgggttaccaagtccaagcttagtctgcttgccacaatggcaggccagtgactctgagagtcgaggtgttgaggcaaagaatatgactttatttggaaagccaagaagagagcagactaatatctcaaagtaagcatctagccaaggtctggatgctaaattctgttctatagccagagagagaggcaataaggaactaaggtcaaaaggcagaacagagagggaggggcagtggggacgtgaaatgaagagagggagagggagccagcacaggaaagggccttcagtctc

SEQ ID NO: 32180 - DNA, 2251 bp, Bovine  19866881051407
atagaggctgaattgagctaatgttcatggtgccccaagtgaaatgattgtctctgtgataatgaaattgaaaccatgatagctcagaaccccgaatgttagatactgtcagaattcagaattcagcaagtggtaggagacttatttttggctgcaccatgaagcatgtggggttttattttcctgaccaggggtcacactgatgcccccacattgagagcctggaatcttaaccactggaccaccaggggagtcccaagtggtgggagacttaaatcaagtgattcttagctaaaaacagatttcccctcagaatttgaggagctgttagagaacagttccttcgttttcattctccatctgttaatctgctagggctgtcgcaacaaataccacaaactgaatggttaaacagcagaaattgatcgtctcttttttggatttccttcctgtttaggtcaccactcagatccgctttgctgttgcagtagaaactgacacagtgttgtaaagccactgtattgcaataaaaatcaatttaaataaaattaaaaaaaaaagaaaaacagaaattcgtgattccacgatggccagatgtgtgagatcagggtgttgtcaggctggcttccttctgaggctgtgaggggccttttctccaggcccgtcctggcttctgggtgtgtgttggcaagtctttggtgctgctcgctttctgctgcgtcaccccaatctctgccttcaccttcatgtggttttctcccgtgtgagtgtctctgcccccgcgtccccttttataagaactccaggcatattggaccaagggtccgtccttctccagtatgaccatattgtaattattctcgcagtgaccctatttccaaataaggtcacctcttgaggtactagggttaggactttaacattagagtctggggaggatacaattcaactcatagaccccggaatctcagtaccaatcatgatgaatgctggttatttagaaaggctcttttatgtcggttaagatcccttttttggagtaaggccatgattaaggatttacacgtttttctttactggatttcatagacacactttacattctgttgtgatgagatctcactgttctctgtggaatagtcctgtccaacagaaatacaatcatcgtcatgtatttaaaattttttagtagccacattaagaaaaagaaacaagtgcaatgaactttaatagtgtattgggaattccctggcagcccagtggctaggactcagtgctgtctcagctgtggcccagattcaatacctggttagggaactaagatcctgagagccgcatggagcagccaaaagtgttcttttaaatagtacatattgtactattgtatgtacatatagtacacagtgtgtatctccaaagcattgccatctcaacaaggaatcagtataagatggctaattaaatgttccacattctttctttgggtactgcctaaatctttgaaattgtgtgttttacactcacagcacatctcagtttggactggccacatttccagtgctcagtggcagctgctatatttagaatgtctgtttttcccctcgattgatgtcctaggttaccccacatatggcgttccaaccattcggtcggatattcctgcccccctaattcgccgagtcagcgacaggaccagttacggtgaggagggaaatgcctactcactgctgcatcctaccatctttgcccagaaaggggtctttgaaagggacttcttcaagaccagatccaaacaagaggtaccgcatgggatttcaaaagggttgaaagaaaggccaactttacattggcacacaaagatggaaaggtttatttgtttgagctcttgtattataaaagtcatcaaggagcccctcagattagggttcctaaggatcatgtgtgatttggttgtgatatttggtacaattcttcaagtagaacttattctgataagatgcatttcactcatgttatatatttaccatgacctatgtctaaaatgaaaaatgttttcctaacattcaacattcttctttgttgagtaaaagcaaagaggcccaggagttccctggtggtccagtggttaagaatccgcctgccaatgcaggggacgtgggttccatcactggtggggagattccacatgccaggatgcatctaatcccgcacgccgcatctgctggcccgcgctctgcagcccacgctctat

SEQ ID NO: 32181 - DNA, 1281 bp, Bovine  19866881059121
cttttgcttgcccttttcctagtttaaaaataccattccttcagtgatattgatacggatccagagcaacggatgggaatgaggatctattacatatcctgatgttttgtttgtgtggctttttagaaacatatttcgccatagaaactcaaagccccaaaatgatttcaaaacagcttatcaacaaatttttagtttgctagaattttatcaacaaatttttagtttgttatgcctttttcttcaaatatcacaatggcatgttccctgagtgatcagtgcccgtggttatatgtgctgtgctcggtcattcagttgtgtctgactcttgtgaccccatgggctacagtccaccaagttcctctgtccatgggattctccaggcaagaagacttgtgtgggttgccctgccctcctccaggggaacttcccaacccagagattgaacccaggtctcccgcattgcaggtggattctttaccaggtgagtcaccaggaaagctgtggttataaagacccccgccaaaaaatatgcctgtaagaaatgaattttcaaaagtagacttgaagcaatagcaatactgaacggtactgttgggtttattttacattactagatacttctctttagtttcacttacatcaaatataatacaggaaataatgttggttctaaagggacaagtttctctctcaaggtagattaaaagccttttgcaaacttctctgggcacttttctaaggcagtgaaaagaggcttttaagcatttgctatagattgaatagttttgtaaagtcctgaaatgtaggctgcattttcaggtctctttctcagggggaatggtggaggctttacaatcatgaaaatctggtcaagtaaaactcccttctcagtagtcccagtgttgggcaatacttttgttccatccacgtctttatgcaaagaaactctgtgatgagccttcattttagctcaggatattaggatggatactagtgttcactgtttccctctctcttttgttctgtttatgtcgttcaggcctggccctcatctaatttggaaataacattctgaatgtggtccctggactgtctgggacaacttcccgcctgacatcagaaggatcctgcacagctgggatcctgcactcctctttctcgggtctttgttgagcagctactatttgccaggcattgttcactgatgcagagggtcgagatggctcttgtaccatcttcctgggaggacaggtactgcatcaagcatgtgatgcttga

SEQ ID NO: 32182 - DNA, 1366 bp, Bovine  19866881119956
tcctctcttactcaataatattttctgagtgtctccacaacccattcttgagaacatactcttaaagttatagcataagacatatttcctctatgtaatttttctgttaacctctgactctctcattgagaattatgtggtagtggatggaacattaaattggcaagcacatacagcatggacccaaataaatcttcatttgagacaaagaagagtccaaaccacaaacgccacgatcaacagaagacaagatgagagaactaatacagagaaattggccagtggaaacatgaggaaaacatttgtattgttctccagggtttggaatgaaccaatttgaaggaatgaggttcttctctcacctcagaggtgaactagaaaatcagagtggtccttcgtccattcctactctttaaggattaatgctactgtccaatacaactagcctcttcattcccaacacttagtatagtaggtactgaataagtattccatcaacaaataagtggtcaaatgaaactgtgatgaaagaaaatgtaatttacttgatcactgaaaatcaaaaataaagtttggagtcatagcaatttggatttcctaattcccaagtattactaatgtcctcattttacaaataaactgagatctagaatgattaggtaattttctcaaaagactaaatttcagaaaagtaatacaaatgacccttaactatatgaagatataaatgtaaattaaactatttttcgcctatcagactcttttggcatggtgtaaaaggcacgttcatgtatcattgctggcagaagtataaggtggaacaaccaccaattttgcattatatataaaaattacatatttatataactctcaacacataaaatctacttttggaaattcatcctacagaaatacctatacctatatgaagtagtatatgaacaaaaatatccattgtggcatagtttgaaacagcaggtggttaaaagaatcccttttatcagtccacaggctaaaacctatatatttttttcttttactgaatgtaaggatatctttataccttaaatttgatgagatttagatctaggtaaaatgaaacaattgtagtaagcacagagatgcatcatttcctttagtattaaaatttcatgaagatgataccttaaagcacaggcaacaactttcctttatcttcatctctgtcttctaacatcacaatgttaagggtttatgagataaactatttttgatgaagacactataaaatttgatgaaaactctgtaaaatactaggcttcccagatagcactggtggtaaagaatccgcctgccaatgcaggagacacaggagactggggttcaa

SEQ ID NO: 32183 - DNA, 1942 bp, Bovine  19866881196536
ttctttggattcattggagagtatataacttcattgctaacactagcaagcgggtactctctctgcccccttctgatgcatatgtcagaagctttctctatctcctttatactttaataaaactttattatgcaaaagctctgagcgatcaagccttgtctctggccctggattgaattcttctccgggggccaagaatcctggtgtcttcgcgtcattcaacaacaacctttcaatatcttggccccaacacttactagcaggtttactcctggcaagttacttaagctttctgggctccactttcccattctgtcaagccctgtcttgaaaaggttatattaagaattatcgatatctgtctttgatttcaaataaaaataaatatagtaagcacttacgaagtcctaaaaaaaaaagaagaaggagttaatatgaataaggtgtgaagatttaatgcagtgatacaaagattttaaaccagtgcctggtatagtaaccctaaaaaaattgtaactcaccactgtccatcaatatttaagataatttgtccttcaaaatagactattattttgagtgatgctaaggaaataatataaaatgatttctctatctttcctacttttgtattatgtgtattatttggctaagtaccctgtaggtatattggagagtgcatttgtataatatttatagcaatattataatatcaatgtaaaaatctattttagtatcaatcagtgtaatacaccacattaacaaattgaaaaataaaaaccatatgattatctcaatagatgcagagaaagcctttgacaaaattcaacatccatttatgataagaactctccagaaagcaggaatagaaggaacatacctcaacataataaaagctatatatgacaaacccacagcaaacattatcctcaatggtgaaaaattgaaagcatttcctctaaagtcaggaacaagacaagggtgcccactttcaccattactattcaacatagttttggaagttttggccacagcaatcagagcagaaaaagaaataaaaggaatccaaattggaaaagaagaagtaaaactctcactatttgcagatgacatgatcctctacatagaaaacagttcccaggaaaataaaattctaaaagtttgtaccttatttatgcttcacgttgatttaaaaaaatattgccactatgtgaaagaatttctggtccaggtatgtttccgtggatgttatgacttttcaaagcttaatctactatttatgttataaaattattaataccttgtatctcagcagaaacagtaatataacataatgagaaaagttgcatctctgatcctgatactcttaataaacacattattaatttttattcaatttaactgcaaatagctatattgaaaacattgccagaggatacatttctattttaaggtgacaggaaaataactcctgaagagtcataagcgagaaacaaaatataatttgtatagtagatagaagaacatgaaagattctgatatctatgaataactgtatttcccagaggagtaaacattaatggctttaattacgttataactgctcacagagcgagctcttgcatgagataaaaatacctgacaatgcattacactgtgctttcctgtcagtaacgtaggatgggttaatgtgcatgccatttaaaggcgggcactccctaaatgtaaactaagcccttaataagtgccaacatgatgaaaagccactcttataattaggtcaaattcgattccatcctgaccattttgcatcacgttgaggtttaagacaggattgtttctacagaagactccagaagttcctctcttaggaatatttcttatttcacaaagggtataaaaataaacaaatgagaatatttttctttttgaaaatttctttcta

SEQ ID NO: 32184 - DNA, 995 bp, Bovine  19866881269068
aattgagatttttccttacttcttaaatgtaccatcaagcaaaattagggttcaaaacatagatacaacaggtatagatacaattaagccagtaattaagttcacacaatcattgcaaataaaaatggtccttactatatataagattttatttcctttatcaaaagaagccttaaaatcatatgaaaatgtgactaaaacatactgtggctgcattttttaaaaagttgacctgaattttatctttgaagggaataacaacttatttcaagtgactcatgacttgactagtgttatcatttatcagttaattttggatgatttctttgatttgtcttttgtcactacaagtttttctgttttaactcacttgggtcaatcccaaaatttaaccaacataataggaagtttaattttatttttgcattcgacagaccttgataatagcaaactaatttctgtagctgcatttgatgaaaatatgctgatgaaactcatatttcacatcattgaccataatgagctattttatcaaactgtccttatgacagcattatagagaaaatgataaatttactaatttattcacttgagattccatttgaaaactttaaaagaaaggaaaagatcaatgaagtcaggtaaattaggctctcaacaaataatatatctgggtctacatgaaacaatagcactaaccacccctgctcttaatgaaatgttaacactaaataaggattaattaattattacttttaacaaaatactacaaaacaaaaaagtagctgtgaaatgccctgttgtgaacacataagcacaatgttactcataatcagtataattactgccatgtttttatacagaattggtggggtttctgtcactttgttgaattttttcaaaatttttactaggcttttaattaataaattatcaataagtagctatatcaactgatgagagttataattattttgtaagacatttcaaaaatt

SEQ ID NO: 32185 - DNA, 2587 bp, Bovine  19866881280575
tctgactttctgagaatggaatccagaagaagtaagacttggtagaaaaggagaaatcacagcccaccttcccagacccttaaagaagcagtggcatgagctctgggtccccctcagctgcacataccatggctttaagaaaacgagtcaaactcgtgagtggacaggattagcatacgccttctttaattctaggttcccggctggctctcagcctcctgagcaccgttccccatcacagcgctgtctgaaacaccacagaacctgatagcaaacccaaacatctccccgatttgtgacaagactaccaatagtcaaatttctggccagtgacctttggaaaaatttaagagatactagtttataaaaattctccatctccagttaaaaaccgtaacagtgtcctttaacctaattcaatggctcaagaaagtaatagaataacatttcttggctgaatcaatactgcattaaagaaaggtgctatcattgaaagttatgaatacaaaacagctcaatgacatattactgtcattgttggctgtctctttcagtttgcttgcatcactgagtgtgaacagaaagaacccttctcgtgtttgcatttgtcagtggattcttttggattctgccctgtgcaaaggtgtttcccacctttcattcaaagcactgcaggtgcaaaagaagcaacctaaaaattgggattaccactgaagcttatttgatatttgttagtacattcttaaagagttcatgttttaaaaatgatttagtaaattgtttatcaaagaagacaaattattcctgccactctttgctttgtattccaggaaatcaaggtcacttagcacaatatgtacaaagtttataaaaattaatctttttaagagattcatatcactgatagaaaaagaactctaaaaatcagtaaggtagacacaaacacctaactggaaattataacacctggagggacagcaggtttattaaaatagacattctttaatgtcgctgttgagtaattagcaaaattttctgaaaacgtttcaccctatgataaagcaagtttacatccagtttaaaggaggaaaagaggaaaacacttcaggcataagtaaaaatgctgatgggtgatctctgaaagtattaattatatcattagattcctgggaaattagactctgcattagaaaccaacagtaagttatccagaacgggcattagaggtcactatccagcacgatacctggcacacagcaaaagtttaaaaactatttgttgactgagtacagcacgtaaataaatgttattcattttaaaaagggatagttggggagtttgggatcaatatgtacacactgctgtatttaaaatggataaccaacagggaccctctgtacagcacggggagctctgctcagtgtcatgtggcagcctggatgggaggggagtctgggtgggaatcgatccatggttatgtgcggctgagtccctttgtccacctgaaaccatcacaatattgttaatcagctattctccaatacaaaattaaaagtttaaaataaataaaataaaatccagtgttactcaaaacggcatctaccaatgggcaacaccagctctacctgtgagctgacggggaagcatgcctggggccccattcacacctgctcattcgtaacttttgaggaaaccagtttttaataagccctctaggtgagtctgctgtagcaaagattgtgaagcactagaatattatgcagttttcaaagatcaaaatctcttggcttcaatctatttttaacaacctttttctctaccaccagagtaagcaatttgattctcccagagccgaagcctagttcctttctaagcccagattcctctggaaacccaacacagaaagaagctgaaaggtatggaagactttattgaattttccttgccaagttttattaggatcctgccagccaattgtgattgaaaatctccagattctggagacagtcagaactgtgttgaaattctgactggactacttatttaacttgaacaaattatttaacttctctgtgtttcaatttctttagctacagagtagagctaaagacacctaggtgccaacccttgagagtggccatgaaatatcaataatataaagtctataaagctccttgaatagcatatattaaatctctaataaatattaatccctttcccttagatcagtatttgttcccttaagatactgtatctgtacttggtaaacaggaggttatataaacacatatcttaccattttgggtatctgtcgcagtgtttgacacatgtttagttattcataaatattcaatgattggctgattgacaggtgtcaggcaggttcaagaattcagtcctttgaacctcactgcacagtatgaagccacctgagtgaaaagaggcatggttaaacctgtcatcaccaaaagaaccgtgcctgtgggtgcagtgtgctccacaccgctttaccaggcgctgccatcctctgccgtctgtgcttttcttctgaaaacaatcaggtctcttcaaatatctagcaggctgc

SEQ ID NO: 32186 - DNA, 1596 bp, Bovine  19866881335496
tatgaggctacttactaaaacagcttttgttgagtttgtgtttttataactttttagttgttattattggaggtgagtgagaatattttccttcatttgaccaactcttcaaatcccacaattccacaagaataatggtgtgaactatttattttggagctgagatttatacccaatatgccccaaacttgatagcctgctgagtgctgcagtaagaaagcaccgtgggctatatccaagttcaatggcagagtttctagaatgatcagtaacgtcccccttggaagtggccccagtgctgcacgcttagtccttcacagaaaaccctgttctctccccatttcatgacacttctctgtcaaactttgcttgtgccaagatgtgtctgatgtcacggctgtggacacaaatgcagccttcggaacattctgtaactgtgaaacgcctctagcattaagagagttttttgcccacatggcagattacattcatggccaaattccttcccctcctgtctcctgcttctgccatatgattctgcggctcttcctacaaaaggagtcaaggccatctcctcaccccttgactctgagtctgaccatgtgattcgcttccgatgacaaactaaagcaggcagcatgctatgccagctacaagcttaagctgcaggaaactgcgtttcttcctgctctctggtgcttctgccatcatcataaggccgtattctgccccaaggaaaggaaaagacacccagtggtcctcaaaggagggtgagaattacgcaagcacagcctgtcggagacgagccgtatcagccacctcctaggcagcacacagaatgagtgagctgtgacggtaaaggatcacagtttgagactctgcatttcgagttggtttttacacagcaataacccatgcagctcagagggagttccagccattagatccctgacacgcacagagcgcaggcgacctgaggctccctttggcactcctcagataacggagcttctcaggtgaatcacagccctcgctgatgccctccgagcttacctgggtttgcctcaagcccggacgcgcctcgacaggacggactggcgctccctccgttctgctgttcaagggaagcggagcttgaattgtaggaaactgtcccggccacgggaggtggactgataactgccccaggagaaggaagagaaagcattaaacgcgtctttcttcagtggtaatgaaccaagtgcacgtgagaccacccactgctgcccagcaccccaaaggagtcatctctaagacagaagctacgcggccagtgtgagcttgatgatacagacaagggtagtcacaacccgctggataaaatgaagacatttgagtccaaagtgataaagtaagaaatgaacaaataaataatggggagaaggtaaaactctccttacaggagaatggcaagaaataaggaagcaatgatggaagttggggagagaggggcggttagggaacagccagcacataatgactgattcagggaagaatcgtctgtatacactgaatcttgtactgtaattttataaagatagaatgcctcaaagtatc

SEQ ID NO: 32187 - DNA, 685 bp, Bovine  19866881404259
ttcaaaagcatcaattcttcggtgctcaactttctttatagtccaactctcacatccatacgtgactactggaaaaaccatagccttgactagatggacctttgttggcacagtatgaacactcattgtaagggttcaaatccaagctcacagttttcaggtcagattgtatatacttcctaaacttcctaatctgtacagtggaaactatggtaactatgatattaagggggcctaaaattgagatacctgaattttaaccacagtaaacccaccagctacctcagctgtctcaaacctgccctagaagtttagcctgcaccttgtgtgacaacctacatccctttttatctcaggatatggtttagatatttatgcttaggatatgaatgtggccaggtatttgctttgtaagaccaatgtgattttaacacactttatttcagaagtcctgatgctaaatgttggttgagacattattgctcagtgtattatcacttgaatcatgataacaggagcagcatcttgatccagagaggaattatttaatgtgctgactggcaaatatggtaatatataaaggacataaagataagattctgaatgaaaccccaaatataataacttaattatttatatgtttccctctcttatttatgggttctactgtttgctatgagctatg

SEQ ID NO: 32188 - DNA, 1663 bp, Bovine  19866881429523
aaaaaagactgtcaaaccaaaatatgccccccagtataacttgttttaactatatttactgtgtgcaaaaaaagctaatcttacctattgcccatgaatatttcatttacattcattgatgttttagctgatgtctccataaataataaactgttatcatccgcatagggactgtgcctcctgtttgcgtaacaaaaaatgagataaatgagatacttttacacatactattgctatacctcccttatttttgttatttaaaaaaacagaaaaaaaataaaaataaaaaaataaaacaacaggcttccttagtacaactgtataataagcaattacttatagctgaaacaaaggtgagggtactgcagttataatttccttttcctgccttaacttctcccaccatcccagcctgcttcatctggtctcccatgaaacctgctctcagatgacgagtctgagggaggtggtagtgtcgtcactgagcggcgtttgactctttgccaccccctggactgtagcccgccaggctcctccgtccatgggactttgcaagcaagaacactggagcgggttgccatttccttctctgggagaaaggggaggccattctgttctaaataccgtaaaactctctttgatctctatggcaatttcattttacttatgctcattatatgcaatgaagacaaagggaaacccaatattgaacactgacttccaccgctaaatggtaccctgtatttctttaatcctggatgacttccacaagcactattttgagtgtgtcatgagtcatctttgaaaatcttgttactacttcacagtgccatgctttaccgtttacttgtgttactgtttttgagcctcatagctgttgtgaagaaccatcagtcatctttccaatttgataaaaaaaatacaatgaagctcctttgaaatgctatgtgacagggccacttctgactctaatgtgactgctctgcctgcacctctgtgctgaggaggtgacgatctcagaaagagcagcagatgacaccatacctcacagggttgttacagaattaagggaagccacacgtgcgcacgctcagtcactacctaacggagcaagaaccagtgctctttctcccatgtgaatcactccaacaccaaataagaaaattatcccatcactgatcatatatgcacttagtgaccacacttctctggtagagaagctaaagagcgagaggatgggagattctaaaaacgtctaactagagacagctgctttattttaaatgacttttgcagcaaggaacattcttaattagatatattagaaaacatgcaaactggatttttaaaaaacttttatttttgaagaccctcttaagaacaactacaccggtgcatgtgactatgtgggcatgcattatgtgtgctgatatatatataggtaagttttttaaaagttaggaaggatactgaagtgtatatgagggttggagggattaaggggtaggaggcaatcattttttcctttatatacttccatactgtttgtgaacaaattacttccttttgtaactggttaggtcaacaaaaatctttgaatcagcttatatattacaattaaataaagatattttaaaattcttttattatgagtttctttaca

SEQ ID NO: 32189 - DNA, 1637 bp, Bovine  19866881612414
ggcagctggagcagttaacaggcagaccactccagctcgggccgccatctactctccacattggggtcccagggtggctgggtcgcaagctggcttcacatcacccgagtccctgacttgagtgaattcgtggcttcaggtttgagcacgcctcacttctgccgctggagtgtccctcggccatggacttaggaatttgatcaaatgcacaaaaaaggtcttggctttcacacacttaacatctggcatttttgactaaacaaggaactattctgacaggccgtgacgcaataatctgtgattttgctaacgcatcactttcaacaacgggcacgtggcattgtgggtttagaggcagtcacttgcccagtccctgagcctaagcaacctccagttctctaatcacgatctcaaacacattttgtccgaaaaaatcaaatacagcgatggtataaggaacccacaagcagctcagtgtatactctactgtgaacgacaaggattcgttttattcaaacactgtacaaagagtttcaaaaggtcttcagtctgtcttcaaaaattcattcagtcatagtactacccacttaagggaaaaaaagatgccttataacgaaaacatcttaatttggagaaacatgattaatttcccaatgttggtataagatacatcaattaagtttttggcaatataaaaaaatctaaactacgatagtgcttcagtccaattacttatagctagaagaaaaataaaccaagtgtatcaaaggtttaggaagacacatcacttttgaagtacagttttgaagacatgttcatgatctatagacttgtcaagagaatattctatggcaacagttcaaccattcgagtacttttacagattccctcttggcgccacagaagcgggtgcaggatgaatttcaatagcatctaacacaggcttcattgtacttgcttcacattttttttttagaacagtgtctggaatcttttttctgcttgaaaataggcgaattcaagaaacacaaatccgtgaaagggtcccctctcctcagtttcctgtaagagcagagagaactcttaagcatgaggataagcatcccaatactaacttactcttcagtttaagtttattgtagatcatgccattgttaatattctcacttcagtttttcaccaaaacagtgtatttcaaataaggctcaccctttaatgaagctctgtaaccttactctcccaggggtgtcattaaaagtgaattcccacaagccaaatacttacgaagcgagcgtgggttccttatagttcacgacggcggctgtgcacctacgtttacgtaaagacactggtgggctttctacattcttttttggagaaagagaaagctttctggctttcatcacaggatacaaagggacattagtgatatccttcaggctaaaatgaggcgactggggagcttcaggtagtacacctacaaaaacaagaacaagttttattgagtacgcttccaaaaatcagacaaacacagggactgaagccatgtgattacacaccgtagatgcatccaaaatctgcagaggaaggaaaactcccaaactcattctacaaggccaccctacccgacaccaaaa

SEQ ID NO: 32190 - DNA, 666 bp, Bovine  19866881928767
atggaatgtgttttgcctcaatttgtatctgcctcacatttactctatactaaaatatttatcttgacctgaaatcataggaatccttacctccacatgattatgtgaagtatatcatgccatttactgggtttccaaagctctaggacgtggaagataattggatgctggaaaaagcagtcttagttccaaagtttcccctctaccatacagaaagattggcaatcccagctccatcccccagaggccacactgaatctggaatatcaaatgcagttggaatatctctgtctccagtggttggaaatggtcattgacattcagacggggagtctccttttttagcatttcttttctctagaatttaccttcaatatgactgtcatcgctgaaaggacctaggaaaacaaaaaggatgagaataaagaatgagaatgcaggagcacgaaggagggctgagcaatcagaacatgactttccataatgtctgaaaggttataaggcagctatctttcagaattattttatgtatatacctaattgattgccatgtcattaagtagaagttttgatctatttcattttttctcaagctgctacgtgaaatcatattcatcatgtagctgagagaagctttcatttttcatggatagtacaaggaacaaa

SEQ ID NO: 32191 - DNA, 1516 bp, Bovine  19866882052754
atttgtatgcatattaatgattgagaaagccaattgagtctttttctaaaattcaccctgctgcaaaagcagctgactataacatattcttgtgtttggaattctgattcgttttatggcttaatgtgtattgcctgcacctggtgtgctagatgctgcaaagacatttcagaccacccagccattgttctatacttgtcttactctaaaatcagaagataaaaacaatatactattttttatttgtgcttcaaatgtatgtacacataaaagtatatatacataaaggttgaaagaagagaaaaagtgggtaggggagacaatcagattagaatcccattccaggagatgtggttcattgttaaaataagagcaggtgaagatgttcatatacatacagagaaataaaaggaattccatcaacgtctagatgtctgggaaaaggaaatgtctggatggctgagttttgtgaagacaaggtagcaggattattgcttgtgttttcctctcctcctccagatgttttggtactgtgttgacacagcccaagcctattactctcagacattttatgaattcttagtagagaaagttctgaaagcattgatttcatgtctacattctattcttcatgaaaattacagtcttttaaatgtaatatttagtcaagttctctattcttgtgttaaattaccattttgtatagtgaatgtagaagacattctcagtcactgtcattaagatacggtgacattgaaatcatgcaactcagattgggacttgaacccatgtggctgagactcaaacctggccaaaattcatggttttctaggtaagatcacctgcctggtttcgagacttaatgaagctcaggttcttggtgtatcatcccagaaaataattcagtgagagacaaagtgataggtaagaactggattcattttgagagaaatatacttcacagactgaatatgggccatctcagaaggcgagagcaacctcaaaatgtagtgtagttagctttaagggctgggtaactttacaaactaatgtgtgggaggattattccaactattttagggaaggggcagagatttccaggaactgggctgtcatccacaatttggtcattgataatcagccttgtaactgtcctggtgcctgtgggggtgccacttagcttgctgatgtgttactgtgagtgtttactgaggctccaggtctagtggaagctgacgtgtctgccgtcttggacccatttagttctaatattctgtcctcaagctgtgtcatttttttcaaaggttaaaactgctcccttccttcctgtttcaaaatgaaattaagaattttgaaggggtctagaatctgtctcccaaatgtgccactttggcaaaataactattttgagttgaaggcaactgaactgaaggcagttgagaacagatacaggaagagtttttttaccttcccttaatctgcctaaaacagatgtttccaaccatgttcccaaact

SEQ ID NO: 32192 - DNA, 1980 bp, Bovine  19866880352106
ccatttttggtagcaaaattcccagagctccactccccacatagcacacttacagggatatgtcccaaagacatagcgtgttctgcagtcttttctaggaagtatccttaaaattgggtgaggtcctatttcctgctcctccctcccctgcccagtgccccatacaaatgcttccacagtcttacttctttgtgtttcttccagagctttctgggaccctctgttctccctagtgatatctctggccagcttccccatttatcacttctaaatccttaaaggtcctgaggcagctgatgcccagccagaaacctgatccacataccttccctttccctgaatctctggcagggttctgctgccttcggcactggtgaatgtgagtcaagacctgagctgtcagtttccagaaatcagaggccaagcatttatgtatgcatgtacattgaaggcatggaattgattaatcaataagcactcatgaagccctgaatccctgtggttggctaaggtctagagcctttaagatctgttcaattcagttcagttcagtcactcagtcatgtctgactctttgcgaccccatgaactgcagcacgccaggcctccctgtctagcaccaactcccggagtttactcaaactcaaatccatcgagtcggggttaccatccaaccatctcatcctctgttgtccccttctcctcctgccttcaatctttcccagcatcagggtcttttccaaggagtcagttctttacatcaggtggccaaagtattggagtattaggaggccccaaaagaccttagagaaaatattaacaacaaaataatgacaatctgttctcagagtcatgcttcatccttcccttgaaaggcaggggtgacctctgcagatggggtttcccaggctcacgtgagagatactgattcagccaataggaggcactagagggggactggagggtgggacaaagggaaaagccagggtattcctgctccttcagctgtcttgacatggctgtatctaagctacagctacagttcctgctgtgggtccaggttcggccagactctgggctccagaaacaccaccatttccctctcttccccctgctaaggggtcgaagacttcttgctgcctaatctctaggttgtttcactgcctcctgttggcttctcagcctctccatcacctctgcattaagttccctctgctttaaatatgcacagtggtttgtcttcctgattggatcttgactgacagaatagttaaaacttaccccagtacttacaccgcttggagcacagacactgctccaaatgcatgatgtaaattaacttatttaatttaattgtctgaggcatcattgtattttacagatgagaaaactgaggcagagagagtttgacctaccctagtgagataccaaatctggatgtgttatcaaaaactaattgcccaggaagaggtgggcttccctggtggctccttgccaatgcaggagacacggttcgatccctgatctgggaagatcccacatgccatggaccaactaagcctgtgcaccacaacttctaagcctgtgctctagagcccagagccgcaactactgaagtccgtgctctgcaacaagagaagcctctgcaatgagaggcccacacactccaactagagcagcccccaattactgcaactagagaaaaacctacgtagcaatgaagacatagcacagccaaaaataaataaataaacaaattaaaaaaaaaacaaaaaacagaggaggtgatagatgccattctagccctactcaattggattcatcagcccatgaggcccaggaatctggagacttattaacaagctccctaggagattctgattacactaacccagcacccctccatgaactggtactcaggaaaccctgacctcatttggtgatgaggacacttaagatccagatcagtcgtacagcaag

SEQ ID NO: 32193 - DNA, 1867 bp, Bovine  19866880356189
cctccccctgggcccacccccacttgaagaaatgagtggtggattggccccaagtaaaagcacagtgtatgtatccaatctgcccttttccctgaccaacaatgacttatatcggatattttccaagtatggcaaagttgtaaaggttactataatgaaagataaagataccagaaggagtaaaggggttgcatttattttatttttggataaagactctgcacaaaactgtacccgggcaataaacaacaaacagttatttggtagagtgataaaagcaagcattgctattgacaatggaagagcagctgagctcatccgaagacgaaactactttgataaatctaagtgttatgaatgtggggaaagtggacacttaagttatgcctgtcctaaaaatatgcttggagaacaagaacctccaaagaagaaagagaaaaagaaaaaaaagaaaattcctgagccagaagaagaaattgaagaagtagaagaaagtgaagatgaagggaaagatcctgctcttgacagcctcagtcaggtcatagctttccagcaagccaaaattgaagaagaacaaaaaaaatggaaacccagttcaggaggtccttcaacatcagatgattcaagacgcccaaggataaagaaaagcacgtacttccgtgatgaggaggaacttagtgattaaaaatatacatatattatgtaaatatcattaaattttttttttaagtcttggagtaccaagttcccttgggactaaaaattacttttagaatttcaacataagaacacttagtaccaaatacttttttactttagatagttgataggaaatggtaattttatagtatcatgtttaccttgcatcaagatttgctaataatcattaatcttgaaaagttcatttgaataaaaaagaaaatgtaatactatcataacaatactatcccaagaagaaagtcaaagtcgctcagtcgtgtctgaccctttgtgaccccatggactatacagtcccatgggattctccaggccagaaattctagagtgggtagcctttcccttctccaggggtcttcccaacccagggatcgaacccaggtctcccgcatcgcaggcatattctttaacagctgagccagaaagctagatagtaaaaagatttgagatgttcattataaaagtttattcatgattgatttatataagagcttttgaaataaatttcatctttaaaacaaaaacttcataaagactgtggaaagtctggagtgatttattgttattcatgttaataaagttttctcaaaagaaatttaaaaaaaaataagggtgtggatcatttctatttttgacttggctattattcgatgatgtattcaccttgtgattacttattagactgtggcaccaatttgtaaacatttttgtgtattaaaaagagaaacataaggggggagtagtggttacaaagggaggtttggattttcacaatgtaaaattattgacttgttaggctttcgatctcttttctgggtttctgtatatccaactttgatctccagaatttttctaatggacggccaccagtggccctagagacttagatgctgttggcagtttaggcccagggaatcacttgctttaaagaaaggctatatttctccaactttccatttccctatccatctgcaaccttgctgaaggagattatttcctgatgtaacacaataaatataccataataaagccttcccccaccacagtgaacttggtattgctagctcatttggtaaaatgaatgcacctcccttgtccccagcctggacagaaataataaataacttgctttcatttcacaaaaggaaag

SEQ ID NO: 32194 - DNA, 1342 bp, Bovine  19866880375460
atgcgaagagttgactcattggaaaagactctgatgctgggagggattgggggcaggaggagaagggggacgacagagggatgagatggctggatggcatcactgactcaatggacgtgagtctgagtgaactccgggagttggtgatggaccgggaggcctggcgtgctgcaattcatggtgtcgcaaagagtcagacacaactgagcaactgaactgaactgattctgttctttactgcatagcacataccgactaacatgctatatatttattttccttataagtatattattttcctctctatatatttatacttattttcctatataggtatataaatatgtatatatatatttacttattttcctcacaatctggaatggaagctccaaggttgcgggtgtgtttgtttcattcagtgttgtatctccagtgcttggcacacagcaggccgtcagcaagtatctcttaattgaatgaacgaacggacggctaggggagctacagggaagccagcagtgtggtccatggtgcaggcagaagagctgactctcagcttctccgctccccacctctcccccgcccggaatgctgagtgctctggaaggagacggaaatgagcgcgctcaacagccctccagtcgggtgtttacttaattagggcctgtatcccgacgctcgttggtgtttaactgtccgcctaatggcttcatctggttccgggcgggcgcggggatacctgcgaggcgagggtaggcggggccccccgggtacagtctagggccggcgccgcctggaaaagcctctgctcgggtatctaacctcccctcgggcacggaaagcgacccctacgggagagagaggcgcgaggcaacgggggctggtgctcagcagatggatttgggttttaaccgcgcgtggccctccccagccaccagctgccgggaccacaggcccgataaccgagcgctcccctgataccagatgcaattgctcgctttaccagcagtcgtgaacttgaaggattacagcgtttcttattctcttagtttggggaacctgagggtactacagagagaaacggctcgtgaggcaaaggaaggggaccagtgagctggatcctaaagctataatatcaggcaacgtttgggcacttgctctatgccaagtgctgagtttagcattttaaacgtgttaattaacttaatcctcttctatttgcattaattcattcaatcctaggattttagagaccagttagcacaatagccccactagaggcatgcaaaactgaggctcaaaggtgttatttgactagcctgaggccaccacgctaata

SEQ ID NO: 32195 - DNA, 1783 bp, Bovine  19866880465826
catctggaactttctgaataagttacatataaacttaccagaagactaggtaagcccactcctaggtatttacataagaaataaaaacatattgacacaaagacttatatgtgaatgttcacagaagctttattcataacagctccaaactggaaaaacacccatgtatccatgagctgaaagaataacaaactgtagtatatgcacacaaaagaattctactcaggctaaaaagaataaactggtgatacacacacaggagtctcaaaagcatcatgctaaatgtggaagtcagacaaaagatactatatataaattcatttatataagattcaaaacaaggaaaaagtattgaaatagaaaatagatcagtgattggctggcatctgcgaagaggtatgagaggaagggactcactgcaaaggggtacaaggaattttggggggatgatgaacatattccaaaccatgactctgatgatggtaagctactgcataactttttaaacttattgatttgtataatgaagtgctgaattttatttttcatttaatattcttcaataaaagtgattaatatttaaaaaaagaaaaaactgaatctgcattcttgaggaagttgcatggtaaggtctgctcacccactgagacgaggtggctgtagttctccagcattacatctctgtacaaggtcctctgagcagagtccatctgatgccactcttcctgggtgaattccacagtcacatccttgaatgacactgatgcctgtaacaatatatttctactcaatctgagggttcagaatcaggacatagaaaatatttttgaaaactaactcttactatattttctgtttatgttttaatgattattttatattggtctataggtgttttacaatattctgtaagtttcaagtgtacagcaaagagatttatatatacatatatattctttttcaaattcctttctcatttaggttatgacaatactgagcagagttccctgtgctatacagtagcacaacatagcagtgtgtatatgtcaattccaaactcccaatttatccctctctccccacctttccatccatgatgctgcaaatggcattatttcattttttaatggctgagtaacattccattgtatatatgcaccgtatctatatagagtctttgatgaacacttaggctgctttcaggctgtggctactgtaaacagcactgcaatgaacactggggtgagtgtatactttcaaaccatggttttctcctaacatatgtttaactgtttagagtttaaaacaaaatgctataaaagatgagcaactccgcctttacactagaacagggtttcttcaatttggcactactgacactctagaccagataaagttatttctgtggaagactgtcctgtgtatttcaggatggttaccagcatccctacttctactaatcagatatcaatagcatcaatcaaaaatatcttcaaatacttgcaaatgtctcctaggaagaaaaatctctcctcattagaactatcactctatatgaatagtggataatatcttcagcaacaaaacaaactacccaattttagggatgatctatcctaaggcaaagcaacagagataaagaaagggaattaattcttagaggaaaaaaatctggtcactattttttttttatagctatacaaagaaatgctccacaaccaagatagatgctgatgccatacacagagactggaaaaataaataagaatcacaagttgggtca

SEQ ID NO: 32196 - DNA, 1607 bp, Bovine  19866880492874
ctgttcttagagtggacagtcccaacaatcaaggagacgtcaatagtcatgttctccaggtgtacgtgcctcccactcagactgcacatttcagcggcaccagcaggcctggtcccatcagctctcacccacgttcagcaggatgcagaatacaatcaaggggcaggagtcaggcaggcaggaacaagtttcaaagacccactccgcccgagacacccagctaagtgttttcctatccaagtcctcaaaaaataacccgcaaggtggctgttaccatcctattcggacaactcaggaaacgagagactgccctggggttgaaatgtctcaggaaacagtttcagagaggagagcgaagtagatgaagccccgcaaccaggaagcggcaggaccagatttcaaatctgagaggcagaggcagatgagtaacaaagaatataggatttggggacttccccggtggcccagtggttaagaatccgcctgccaatgcagggtacacaggttcaatccctggtccagggaagatcccacatgcctcaggccaactaggcccatgtgccacaactactgaagcccacgcccacacacctagaggctatgctccacagcaagagaagccaccgcaatgagaagcctgcgcaccgcaaccagagaaagtcagtgcagcactgaagacccagtgcagccaattaataaataaataatatggggtttagaggccaaaagacgtggttcacatccaatattatgtgaacacacagaagctgttttctcatctggaaaatgggaataatacctagctcataagattattgggagaaataagtggcataatgttcacacagcaatgagcaatatgtctggaccagagtcagccctcaataaaagggacctttaggtcgctcacaactaaccagggtttctgactccacgtctaggcctctctctgcaccatagagaaaccatctctcaaagcaggcatggggttagctacagccatgtagctttacccgaaggcggaaacatcgagaggagaaaggaacacacaggaccaaagagcgtcacagggtggtggctcagtccgcacttggagaggactgttctgtagggggtactccagggtttactgggagaggtggaagatggcactctcacagtcaagctgacccgcccagggaaacttgctgaggcacctgtagaaacatgagcagttttctccacaagccgtgagtcacacagaggctggtaaacgataagccccggggcagatcattacaacttcctcccagatgcttcctggcactgctggcttgtatcactggtttcaaaatgaaattgatctgaaaccaggtctcatcattactcatcccccttctccccttccttctaacagctagtgaagtaagctgattcccgttcctgattgaagtctatctccacaagccacgaatcttggcctagtcatggaggcgtgaatgggcttgtggcaaactgtttctggggcaagttggtgagcactgatgagcacatggggcaacagtttagattgtaaggccgaaaacaagagatctaaacatagctcttacttccacacccacatagga

SEQ ID NO: 32197 - DNA, 1808 bp, Bovine  19866880559961
ttgtcgtattctggttagaattctaacatactggatttgaggtgaagacacaaacatttagtctatagcacttggagtgctgctgctatatctgagtattgtaagaaaagaaaaagtattacacggtttccgtaggatactggagttgtgagagtgaggaaagaaggaaggaggaagatgaaatgacttggctctattgctgaaagctgtgctagtttatcatccacgaagacgtctttcagagctcaataatcttgacctttattgaaacttggggctgcatgctctttagcacatatgctaaagatatttgatcaatggtcaaatttgaaatagatttttagaaccaaatggagagggcagtttgggctacaagagtgtatcacaccatgctttttagtaagaccattgattggtctacttgaccagagtgtactatacaagggaagttcttagaagagtcaggctgttgaagattctcaggcttaattctgcaaaataattcatttctgatgttgcttgaaataccaaatttggggacctccctggcagtcctgaggttgactccatgttcccactgcaggggacacagtttcaatctttgatcggggaactaagatccagtatgccccacggtgcagccaaaaaaggaaacaccaaatttgcaaatgatctgctttttgtaaaatataaattgaaagagattcaaagttattctcatgtcactcttacttgcattccaagcgtgctttctagagaaaaagaaaagcagtagaattgcaggtacctggaaaaattacttgtgactttggttatccccacaggaatgtggatctttatcctgtgtgtgtgtcttggtaaaaaaaaaagttcagaaccattgactcattagactgaagttagggtgatggactttgacacttcagccaagctatttgttttccataagccacggtttcctcctgtagaaaatgaaagcttgtgtgaagattaaataagagaatgattataaaattggcataaaatgctctcagtatattattattatacctgctgctggtgtccttgtaaccttaaataagtcccttcatttctctgtcctcctatttttttccttccataaaatgaacataataatacatgttcaactctgttttttagaactacttcaagaataaataagatagtatctataaaatcgcttctagctcattcatccttaaatttatctcagctctgtcaaagggaatgtcatgacaggtaacacaactgcaatgtttaaagccatggagagaaacagttcatttaggaacaataaaaataaattttatcaggatatctgtcaccaagatatttatcacattgtagccctaattttttccctaatgttttattgtgaaaatcttcaaacttaggcgaagtcgaaataattttacagtcaacactcatttttccaccacctagattctaccattaacattttactatgtttgctttatcacaaaataggcccatttagccatccatcagtccatcttatatttttgatttgtttcaaagtaaattgcatacattactatgcttccctctactcaaacatgcatatagagttcagtgtttttgttgtaacttttttcttttgagataatatctacatacaataaaatatacaaaccataagttttgacagatgcattcaattgtgtgacccaagcttgtcaagatacagaacattactcttaccctgggaagttttcttttgccctccacagtcaattctctctcccaccgtccaaggctactcctgt

SEQ ID NO: 32198 - DNA, 4580 bp, Bovine  19866880672074
atttacacaggtgaagtgactcgcccaaggtcacagagccagcagacaggcagagctggaaactgaactcgggccgcttaccctgaagctgtcatctccacctcgccctactcctctgatgtgttctgtcgctatgtctcctccctggttgtctctgccttttctctccatgcacaaagccaccgaaaggcagtgtcgtgttccagatgggagcactttgttcctgagacagccattgggcatctcattaaacctgcagtgcaggtggaaggctaaagtgctgacaggcaggcagtgtgcagacatctgaaaagacctttttagacgaggtctttggggagtttccatggcacaggaactggctctgagagctgcaaataaagctggctcaacaccctggctggtaatggggctcgctggccccagcaaaagctgagcatccactggccatccccgaaggccttaacttgcttaaacgagagcatcacctttgggtgttaattcccagagaacttcctgctttctaacataaaggagttagagctagcatgccaggactggggggaaaagccctccctcagtcagtcaagcccacgagaggactgggcattaactaaaccccatacgacagggccaaggcatatcactcatgccagctttcatacttcccctctcattcttaatgcgccatttctgctgactgggcaggaggttggagaacccgtcgggctacagctttctcttctaaacacccttttaagccattagcttaggctcatctgggaaagtctgcctgcctgcctgccttttgattacacaatatctcaaacttatctgagtatccattttcctgggcagataggtggctatggcttcctggaatcccttctgtttatgtgaagcctgtgaaccaaggttcttcagagagcagggtggtgcagacccacccagcagctcaaggttggtgactaacagctcatagcagcaactctcctcccgccaagagctttctgtttcaccaatgatcttattttctcccccttggcattttattttcaaactgagatattaattcacatagtttcaccaactcaaagtatacaatttcagtggttcttagttattccctatgttgtacaaccagcaccactgtttaatttccggaacatttccatcatcccaaaaggaagccatgtacccatcagcagttagccccaattcctctctttccctggcccctggtaaccacttgtctgttttctgtccctatggatttgcctcttctggacatttcatctgaatggaatcatataatatatggccttttgtatccagcttctttcacttgttttttaaattcattcatgtcacagtgtgtattaatatttcattccttttttgtggctgaatagtatcctattgtatggatataccatgttttgtttacccacttactggcagatgaacatttcggttgtcttcactttttggctactccgaataatgcaatgaacagttttgtgtagacatacatttttaaggctcttgagtatatacctaggagtggagttgctggattatatggtaactatgttcaactttttgaggaaacgtcagacgggttttccacagcagctgcacaattttacattcccaccagcagtgtatgaaggtcctaattcctccatatcctccaaaacacctgtcattttcagtttgcttttaggggtgttatctcactgtgactttgctaatgaccttttttaaaaatttattttttattgaagtatagttgaataaaatgacttctttttttttgaccagggatcgaacacaaaccctcatcagtaaaagcatagagtcctaaccacttgaccaccagggaattcccactaatgaccttttaacggaacatcttacttcctaacaaatatttctttgagtattatcacctaacaaatactattttgaaggcaatcatggctaaagcctttggtggtcgtcatagtagtcgtaagaatactaacagttactactactgccatgaacaccactgacactttccgtagcacatactgtgtggccaggctcattatactagacattgtatcctcacaataactggatgaactaagtggtattgttttctccatttcacagatggaaaaactgagggcagaggggttgagcagtttgctcagggtcacatagcttacaagtcacttgtatgaacctggaatctgagcataagcagtctggcccagagctctggagcactgctttcatgtatgactttctggcacaaagtctgttgggaaagcctggaggtagcacaggaagcacactatcaacatatctgagcaccacccaaaataagcccaggatgattcttcagcccaaggtacaaagcctgtacacaccaagattccatccgtgacgggcaggactatcagcacaggatgtgggaccgaatggtggtaacgtgtgacagctcagatggcagacacacctgggctgaggtgtcagctcgaccactcagacctccaggctaaagtgaagccatctgccctcccccagttcctcatccataagaggggtctaatggggacctcagaggactgtagcaagacatactgacagaacacatcagagaaagtacaagaaagagaccaataggcttgctgacattcaagcctggcagactcagattctacccacatgttgttttgcaaaaaaccatgcatcactcaaaaagcactaagttttcccttaaaaatagatgtgaaggattcccattctttaaaagttgcacataaaatgacactttaccatgaggggaactccctggcagtccagtggttaggactcggatcttccactttcaggggcctgagtttgatccctggttggagaaatgggatcccagttttttgatggtacagccaaaaaaataaaatgagactttcctatgcaaaaccttagagtgcagtttcaagtctgactgattcaaattcacagaatgtgagtgccgtgtttcaagggttaacatccaactctgtgtgcatcagacatcacataagcactgagtcatttaggtttaggaaatggagatcgcaattatgcaaaatagcagaattatatgaactgcgcttgctacctgtcattgtattaaaagaatgtaataagatagctctattgggggacttttttactttcactgctaaataacccccctttgtgatctgtggaagacataggaagagaggaaaggggagtgtttagctaaaaagaaaggccaagtatcagaagtgagacctctggaagagcctcacatctgagcttatacggtcttgcccttgaggtctaattccagggtctattaaatcataaccctttgttccttttgaaagaaacatgctgacaccgtcaactcggttcacccttagaagcctcagatctggaaatgccagctaagctatactacaggggagggaaatatagtaggtcttttaaaattacaaattacaagtttgtaaaattaaaattacaaacttgaattccttatatggctgtgtgtacatgggtagagcttacatgaaactcgtgtgcttataaacacaaaacagaaaccttcccaacccacccctcctagcgtccaacagatgcttcaagttctgcccaaaagtgatggaatcaaaggaggctagaaggctctgatcggaaggcaagaagccatctttcttctctcactgcctgctgtgtacacagtgggggctatgatcactgaagccagtgctttaaatggctagagtgtaagagtctataataaataagagacattcttgagattcttggggatatttgaatctggggcatctggggcagatggttagatgatattgtaaattttctttgctgtgataatggttcaaaatgagagcacccttactcttggacattgcagcctgaagtatttagtagtgaaatgtctgtaatatactttcaagtggctcacaaagcaaccattcgcacagatagtgccaacaagatagtattggttataaaatgagggtattcgggtgttcgcggtactttctctcaacttttatgtatttttaatgtttttaataattaaaagttctgggggtgggaattaaccaaattaactgaaaatgtattcaggactgaccgatattcagctagttttcactgacacagatggtccaaatattgaaagagccccctttcagttggtgaagagcctctgccatgagcatcatgggggttgcccccaaccccaggtagtgggctgcccctatcctccagctgatgctcaggaccctagcacctgcttgactaccaaactgcaggcgttccctttgatcaaagggtccatgctgcatgggtcatcattaaacatttcaaaacgtgagttctgcaccatctcaactaccggccattcaccatggaccatgctctccttggggttccagaatctctcctcctggccaaccctgtccacacgacttgcttactcgggaatgcgaatgggagagccctgtcgcacagagcttaaaggg

SEQ ID NO: 32199 - DNA, 1244 bp, Bovine  19866880712924
tttgagtgctgactcatttgtactggtggctgatggatttatagaaacagtgttttatgactttccactatctcaaaagccatactaaaagttgaggacatattcaggaaaagatgacatgggtttttagccgtggctttgccacagactgcagcttggatgaagttttctaaatttctttgagcctcctttttcttagagtttcagtttagcatccttaaaaatgaacagtttgtacaaatgatcactgaggtctcctctagctctgcagttttataaattatttagattagtatttgtccacaggacactctggacggctgtgtgtgtgtgtgtaaggagtcaaaacataatgcatgtgaaattgatagctatttcattcacctctaaatatgatcatttatttaggctatattgactgtagctctataattcaagggtacatactacactctacacttgtggatctttctcctttcctagaataatctctgggagagaggtggatttagaatgcatgaagataaacataatctcaagataagcactcttactgattataggaagctaatattaacacaaattgactgtcagttgcaagggcaaactctcacatatccaaagatgcactatagtattacttagtattatttgacatgaacgcttggcatgaaattttggaattacatgtagatgcctttaaaatgaaaagggcttccctggtggctcagctggtaaagaatctgcctacagtgcgggagacccgggttcgatccctggagaagggaatggcctctagaatgacactgttctttggttttgtcatgattctgacctctcaaatttactctgacttgttaagaataagtaaaactaaaagtgagtggagggaaatgaaaagtggtattttcataatcggaagggtacaaacttccgattataagatgaataagttctggggatctgatgttcaatctgatgactatagttaacaaaactgtcttatatacttggaagttgcaaagagaatagatctgaatgttctcaccacacttaaaaattgtaattatgtgaagtaatagatgtgttaactaaccttattgtgggaatctattttgaaccatttgaatcattttgtaaaatatctatcaattttggatttgtgtcacattttatcatgaacaaatggaccttggtgtattttttgagcaagaatactacagaagtgatatatccttctcagt

SEQ ID NO: 32200 - DNA, 2339 bp, Bovine  19866880910808
cacattcttcctgagatgaacagtcacaatgttacacacaaatggaagtcagaagttgcattggatcctgcaatacattaaactcaatactcacacctactgtgagagaatcatcgctcacaatggttcacttgcctggtatgtttcagatcatatttaagacaaaggcaaatatagaaagtctgctgttcttcagaggagagaaaaaaatcatctttttaatttcactctcatgagatttccctttcagttatgaaagaatttaagtgtctggagatctaagttctatcttctttagccagaagggtcacccagaaattaggaaaattaatggctatatccatagacatgatgtatgactatgtgaaatcttttgaaatccttggaagtactggtgaaggaagaactcagtgagatttcgtgataccagaggcaaaaaagctagttagttttccaaaattttcccctagtgagtgaagagtaaaatttaacccttacaataggcatatgaggttaagtgttattaatatcttcttattatatatgaggacactgacacatcaggaggtcaagaaacattcctatgatcaaaagccactagcaagcagcttgggatctgatcccaggcagcgcgactctggagcccacagtcttaatactcccagctcatggctgtggttttgagcaacttcctttgagttggcaggttcacttcttcttttttttaattatttatttggctgtgccgggtctttgttgtgtcatgcaggatctttagttgcggcatgtgaactcttaattggggcatggaggatctagttccctgactaggaatggaacccaggccctctgcattgggagcatggagtcttagccattggagcaccagagaagggccagcagattcaattcttagcactactatttaccagctgaatgagtcttgaacaaattgctgaagttctttgtgccacagtttcctcacctatgaaatggacctaacaatagtctctttatagaatgtcttgggaaaattagatgagatcataaatgtagatgcctaaggacacaagagccatttaaccagagttagcacccctccttctgacattccccttcttttcttgctcactgctgcttagcaagtgggaagcctctcatcccagctctgaggaaaatcatgccctgacatagctcaagggaggagactaagccattgcaagagcatgggcactactgggccagtctcttggtgtgcactgaacatttgctaaatccttgaacataaaatagttcatcccagctcccaaactgtcctccccttgctagcataacaagcctccaaggtgcaccgacttcggttccacagccacaccactccctgaacccatttcagaggctggaacaagaaaactcacctaatgccctgacgattcgcatcaggatttcccccactttcattctggtctccggtgtgtgcctgtctttactgctgtcatactgagccagcaggccaggcaagattttctcagggtacacgtctgagaggagggcaacccctagggttaaaaatagaaagaaaggattcattactgtttagcgctgaaaagaaaataagcccagacagcttgtggtgggatgaacacagaggcatttaaatccacctctgtaattccaccagcaagagctgcccttcatttggaatgacaacattggtagtggaaagaacatgggtcttagagttcacactcctggattcttctggtctcagccctatatgatctctaagatcacattcagcactgacattctatgacctatggattctagactctagaagctgaggctagatgattacataacatagcagggatccacacagccatggggacagactcgatcaaatgccctggagggagtctttccagtctgagtcagtaaggttcaaagtctagtatcgctcctgccaatccatcagcctggagcacagtagtgcttcctatctgcgctgcagttctttaccctagaatgagtttcctctgtaaaactgtcaatgatgagagcaattcccataaggaaataaggaatgcaaattctgggcatgatgaggaatagagacctatgcttccagctgagtttcctgatcagaaggagagaagatcctgctcctgattcctccttcatagtacgtgccgacaccctctctcttcatacagcacccctagaggtggaatctgcagtagtggtaacattatctgagcccagatccatagcaagcaaacttcacagaagttgagagaagaagggagataagactaagacaggaccagaaataaaaa

SEQ ID NO: 32201 - DNA, 1420 bp, Bovine  19866880926199
attagtattcctcgacttagtaattctgaaaactgaatcactttgcaacctaaatatagaaaagttattattatggtctggttcctaagcaaccatttcattaagaaaagctccacttgggaaaaacatctgtttgtcagtaaggtttctgctgttatcatataatttcagtgaaaaagccatggtcaccccgtgccttagtaatccctagttgtgaaaaggtcaacagagggtactataacagagagccatctgtttcaatctgggatagtccttgaaacttgttaccagctttcctaaaccaccacataatttaaaggccattatcttctggttataaaagcaataaatgttcatgctagagaacatgaaacctgtaagaaaaaaggcacaaagaaaataaaagtcatttgagtttttgatgccttcatattagatctcactggaaaaatgtattctgctgctataaaaaaaaattgaaaaccactgacctaaaataactccgtatgttttgcctttgtcatctgcaataagagtattttttgtaaggtttaggggctgtgtgttggacaactgaactgagagatttctacagtcaaacattcagtgacaatctgacggggcgagaaggtgatgaaaggtatgtgtcatatgacatatcacatgtgacacggattataaaacttccttgtcaggtcatgtagatggcccaggacagtgattttttgaatcttttgttgttattttgaaagcagcagaatcttgttttcccatattttttagaggaggctcaatgaaagagagaaaaagaaaagagcctacccagcccaccccttcttcactgatctttggggtcatcgggtctgcaggctcctcccctggtacagcactgctacttcactgtgccctgggtctggatcactggtccctcccttcttcactaggcaccagatctcagctaaagggtcacttcctcctacccctttctgtcaggtaaaatgtccccaacacaggctctcgtatcactgtgtacctttcttcccagcatctgtcaaagccacatttcacatttgtgtgacttttttttaacttttaaagactcttttttccctttgatgtgaaccatttttaaagtctttattgaatctgttacaatactgcttctgttttatgttttggttttttggccctgcggcatgtgggatcttagctccccaaccaaggatcaaactcacaccccctgcactgaaaggtgaagtctcaaccactggactgtttgaggaagtcccatgtgtgtggttttttgattagcatttgtcccctgcatctcctccctgcctcagactatatattccatggaggcagggcacgactgtttttcctcagcagtatactgagcacagcacccttacacagaata

SEQ ID NO: 32202 - DNA, 1156 bp, Bovine  19866880952142
gacagatggtaagaagaacccccttaagggtggtaggtagagtatcaataatcccaggcatgctgcagcaatggaattgactgttgctgttgtttggtccctaagtcatgtctgactcttttgtgatccatggactgtagccctcccagctccttctgtctatgggatttcccagtcaagaatactggagagagttgccatatcccctaggggatcttctgcacccagagatcaaacctgtgtttcctgcattggcaggtgggttatttacccctgagccaccagggaagcccatttataaacaaccaagttctctagattatttaccttatgtgagacacactctggtagaacagtaaagacaaaagagcactcacagagcagaagcagggaatccaccacaactgttgacgtttcattctcgacccctccgcacacctttacatacaccctcagtacatctactaagttcttctgtcaccaaaatggtccctggcaccatgccactctctggcatctctgctgtatttaaacatcggtgaagagaagctaacactgcctgaagtactttcctgccagttatggccattccctccacatggttataaagctagtggtggccactctctgaaattgccgtgctgtcaagctgtctggaacatgaaatctgccccatatctggaggaagatatctctatagtaatcctctgctgaacgagactgctggggaccagaggctagaatctctgcagtcagggcacatgccttccattcggcagctatgccctcagcatcgctctcaccaggctcccccacacctgctccttccaaaatgccccagactactgctgaaacaacactgggccttcttaacttttcagacaggagccacccacatagatgtggaagccaacctggggcctggtacctcatgtgagtcttcccatcagtgcaggtggataagtcattcctggatggctagtggttgatacacttgatccaagatgtctctcagggccttccttgatagtgctctttcctcctcaatggacacctcttcctcaggattctaccgtgtcttcctgggaacgtgtcctccgcagaatcccagctgatacaaacctacagtgatagcccccaaaatacgtgtgcttag

SEQ ID NO: 32203 - DNA, 1977 bp, Bovine  19866881067612
accatgacgatgtggccctggagggtgtgggtcacttttttcatgaattggccaaggagaagcgcaagggcacggagcgtctcttcaaactgcaaaaccagcgtggcggccgtaccctcttcctgaacgtgcagaagccatctcaagatgagtggggtaaaacccagggatgctgtggaagccgcccttctcatagagaagaacctgaatcaagccctgttggatctgcatggcctgtcttctgcctgtggagacccccacatctgtgacttcctggagaaccacttcctagatgaggaagtgaaactcatcaagaagatgggtgaccacctgaccaacctccgcaggctggtcggtccccagcctggctggtccccaggctgggttgggcgagtatctcttcgaaaggctcaccctcaagcacaactaggagcttctggagagcagcggcctttgaagaacccacctaacatcagggctgcctgaagctcctctctgcagccactaggcagctttttaacaccctggagccctctctcaagccttggaccaaatggaaacaaagctttttgcagcattaaaaaaaaaaaaaagaaaatcagagataccaagggaacatttcatgcaaagatgggcacaataaaggagagaaatataatggatctaatggaagcagatgatattaagaacaggtggcaagaatatctagaagtactatggaaaaaagatcttaatgacccagataaccatgatggtgtgatcactcaactagagccaaacatcctggagtgtgaggtcaggtgggccttaggaagcatcactatgaacaaagctagtggaagtgatggaattccagttgagctatttcaaatcctaaaagatgatgctgtgaaagtgctgcactcaatatgccaaccaatttggaaaactcagcagtggccaggactgcaaaaagtcagttttcattccagtcccaaagaaaggcgatgccaaagaatgttcaaactaccacacagttgcactcatctcacatgctagcaaagtaatcctaattctccatgctgtcttcaacagtgcgtgaatagtgaacttccagatgttcaggctggatttagaaaaggcagaggaaccagagatcaaatggccagcatccgttggatcatcgaaagagcaagagaattccagaaaaatatatacttttgcttcattgactacattaaagcctttgactgtgtggatcacaacaaattgtggaaaattcttgaaagagatgggaataacagaccaccttacctgcctcctgagaaagctgtatgaaggtaagaagcaacagttagaactggatatgaaacaacagactggtttcaatctgggaaaggagtacctcaaggctgtatattgtcaccttgcttatttaacttatgtacagagtacatcacatgaaatgctgggctggatgaagcacaaggtggaatcaagattgccaggagaaataccaataacctcagatattgagatgacaccacctttatggcagaaagtgaagaggaactgcagagccttgatgaaggtgaaagaggagtgtgaaaaagttggctgaaacttcaacatttaaaaaactaagttcatggcatctgattttatcatttaatggcaaatagatggggaaacaatggaaacactgacaaacttttattttcttggcctccaaaatccctgcagatggtggctacagccatgaaattaaaagatgcttgctccttggaagacaagttggcagttctagacagcatattaaaaagcagagacatcactttgccaacaaaggtccatatagtcagagctagggtctgtctagtcaaggctgtggttttccagtggtcatgtatggatgtgagagttggactataaagaaagctgagcacagaagaattgatgcttttgaactgtggtgttggagaagactttgagagagcc

SEQ ID NO: 32204 - DNA, 1467 bp, Bovine  19866881080302
tcctccttctcttctcctgcctgaggctactctgaacctcactgccccacctccatcctcttgctgacctcacttcattctttaatccttctctttcctgtatcctcaactattcatatacaggcttttccctacgaatatttttaaaggtcctaatctctcccaatttaaaactgtctcccaacgctatttcctttctggttttctctctcctccccttcaaaactgctaacaagagttatctacatctacctcccacacactcagacttccaccctgctgctccattgaacctgctctctctaggattgccagtgacctctttgttgctaaatttggtgttcatttgttcagactttggcttactagactgttctacagcatgtcaactcaaatcctccatgtggcttctgtgcacactattctttggttttcctcctatttatctgttctaacctttccttctgggcccttcttcctctacttgtcccttaaatgttggcatatctcaagagatttttgttttctctttcaccctctctacagaagagttcggagaaggcaatggcaacccactccagtactcttgcctggcaaatcccatggacggatgagcctggtaggctgcagtcaatgaggtcactaggagtcggacaggactaagcgacttcactttcacttttcacttttatgtattggagaaggaaagggcaacccactccaatgtttttgcctggaaaatcccagggatggtggagcctggtgggctgccatctatggggtcgcacagagtcggacatgactgaagtgacttagcagcagcagcagcagcaacagaagagttacattcatttccatagcttcagttatgatgtatatgttaagagcctgataacttacggtactttctccagatcacatctctcaaggatgacaggctctcaggctctgtctttttggtttgaattaggttcagagtaatagtatccatgatcacttcttctttggcctgaattcattactcccatatattaaggcattctcccaagataagctccaaatcacccaatggacatctcacctgatgtcccacgcacctcagacttatctcctcctcttcctgcctaagcctgctcttttactattccatacctcacaggaaagcaccaccatccattcacctagttatccaacacagatacctgaacatcatccttgactcaccactctcctcctcaccctcagcttatcacacacaaagtcctcttaatatttctttctttttttttttggccatgttatgcaacttgtggaatcttaggtccccgagcaggggatcaaacccaggtcccttggcagtgaaagcagtgagtcctaaccactggacatccagggaattccttgaatatttacttccttaatacagctcagatacaccctttttcttcttcatggactctgtgcttg

SEQ ID NO: 32205 - DNA, 889 bp, Bovine  19866881094312
ggacgatggacagcttggccaggatgatggctccccagatggcagtgggtacttctttagaacactcgttacccagattgacatgtccgttgtaatccccgatggcaataaatgccttgaacctggtccacaggccagcactgggctgcttttgcatgggcaaaatcttcaaaaccttatccttgaaggatgctcccaagaaaaagtcaatgatctcagactccttgataggcagagagaaaaggtagatctcctccagggacttgatcttcatgtccttgaccaggcggcccagcttggtaacggggagccactccttgtcctcagcctcgcctccgctagcttcgtggctgcgatcccggccctggacgccactattgacgcctccacggaagccactgcggcctcccattccagggcccctggggcctcctggccctcctgtagcaccagggtcatcccatttggtgttttcactaagacgaaggcaccaataatccctaagttccctcctagcttatggattccattttctaatttttgccataatcctagaaagagtaaaaccacgttcggctgatgactacttgatcttaggctttctcagccatatctgaaaagccatttccttggataggtaggttagaaaggaaaatacaaagggagtttatgctcctatccataccttggaataataacaatggttaatcttcatttgtgggcttcccttatagctcagttggtaaagactctgcttgcaatgcaggagacccaggtttgattcctgggttggaaagatcccctggagaaggaaatggcaactcactccagtattcttgccttcagaatcccatggacagaggaaccttggaagtttacggtccatggg

SEQ ID NO: 32206 - DNA, 1322 bp, Bovine  19866881101093
catcctctgtccctggggaacttagcaccagagtgtggatggggctgttgtcttggacagacagctggtgaggctcagaaggttagaaccagcaggagccagatagagctctagtcgtggggccagggaggggttgaggggacatgctggccaagctcagtttatcttacctgctccttcagcctggccccccaccatctgttctcacccagaaatcaaagtgatctttctgcatgcaaacctgagcaccttccaagcttaacacactttcattgcccccagaataaaatccctgccctgagcccaccatcctctcccaaattctctgctagtctcctcctctgcttgtggaggaggactttcctctgtggtccctcagagcaggcctttcctcgttctgtcccctcgtgctgaagtccccccgccttgtttggttgatagctcctcagctgaaaagtgtcctcctcagggaagccctcctaatttcccccagcgttcagtattagggcctcctgtggaagctcccagccctgcctcccaggtgagctcggaaggggctgggacctagccacctgcatactgacaagggcaaggggactgacacatgtgggcagcaacgaaccccaagtgtgaccctccagagggagatgccaaatatggttgcaggatgttggggtcttatggtcggagggggattgtccaagaggcaggcagtgcctggaacatgcagggctgtggccacgtggaccccaagctgaagccacagctggacaccattctcgaggaaggcagggggaggaaagaaagaggtcaaggacagacttggagacttatcccatttttggcttggtgaggaaagaggagccaaaaagagcacttgggaaaaggcggaagaatgcagaaggaaaaaaaaaaaaaggaagctaagatatagcactgtttttatttagttctcagatagtcttaattttttttgtttcccttagaatagctgaaacaggagggccctacgtggcagtccctgggatgagaaaaccgtgtgtcaaagctgctgccgagtccctctctatttttaccttcctcacactacctctttgagcctggaggaggcatcctggcctgaggtggcccgagctggcgtctctgaggcagattcagccagccctcagctcgttctccagaaaccaccaccaaaaagccaggtattcacttttcttgaccagaaataaacgtgttagacaaatgtccacaggcagtcttgagggatgtgaacacggaatcaccccataaatttactttttgttttctttccttggttcaaa

SEQ ID NO: 32207 - DNA, 2063 bp, Bovine  19866881101716
tcccagggaggtctttccaactgagcaaggttaggaaacggctgcctgggcttccccactggctgaagcagggttatctcctgaagagggaaagacaccttcagcgggctcatgaagacagactgaaatccagagtgttcactgacaggcaggcccagggctgccccaggtgagcccatgtgctgacccaccagaacacactggaaaggaagaggtgtgggagggcagggttgaggggatcctgtgcttcgagggaatagacagcagtcactacggcttgagcctgtgccagggctccagggctttttctaagtcgtctgagtccactggcaagtctcaaaggcccctgaccctagacggactgcagaattaagacctgtctcacagccctccctctctggcgctgaggaggcccttgggcctaggaaggcaggaagaggtaggtgtaccaactcttatgcgagggtacaacttggccaaacagccaagacaaaaaaatctgcagcaagctaattttaggtgggtaccgtatagaaaatttaaatattggagtacgcaacatgctgtcagcaagactgtgctggtacgtaggtgggcgaccacagcagctgctattcattcaagcaatgggcatatgtgcagaagggcaggaacagagaagggggaacagatgctggaccacaaatctgggtcctgggtgtcagtttctactcggtactgagatgcataatctttgatcagttttctctaggttttgttatatgaaaactggagccgtgttaccttgtcaacataataaaattttcaaggaggtgtcaatgcccgcttcagctggaagcgaggcagggtctgttggggtcctggccctgccaagatggctgcagcactgagctgggggctaattcgcacgtgtgtccctccacctcacagacaagaacctgacaccagaaagagtgagacttttcatcaacccataactaaaactatctgagtgctttggagcatgattcttttttgctcttccccacactttatgaagaggctcatccccgtgctgtcaatggtgaggcagtattgcacaaggacaaacggcctgggcccaactcctggctctgctcattactgctgtgcgacatgaggcaagttaggcattaggcagctgcactgcaggctcagtttctgtaagtaaaaataagcacggtacccatcccctaggaatattgtgaggattaaaagaactaaaacacatgaaatacttataacagtgtctggtataaagtaaatgctatacacttgtttgccactctggggataccaatccacagacctgcccagagtccagagacctgcccagattcactcagctaaagcaccagcagatccaagattcccgcctaggtcttcttgaccccaggacagctgtttaaaattactgtgtttactgccttctgaagtgtaggggaggaaaatacaagacacagggcacccagactggacctaaacttccccaggagagtatgcctggctggctgaacacatccacacatccacacacacctagggaagcaccctcacctggatgtagtccaccgaatcaccaagggccttgaaggccgtgtacatgacctctcgcttgcctccccacttctgcatgatgcacgagaaggtgctggcccgcaccacgtcccgaacgcggtccatgccctcctgcaggctggcctccgtctcaccctcacccgcctcatggaagttgctgcgccacacgaagaagccggcttgctcggtgccaccgagcacctcgtggaagatgtccaacatgtaggcatcctcctggcgattgccatccaccaccaggaccactttgaggtcggggaaggcgatgcgctgggctgagcgcaggcacttgcgcaggtagtcggggtcctcctggtacgcagcgatgcagagcgccaccgagcgccgcaatggggagggcagcttcagtgtccggcctgcccgtcgcatgcgccggtgctccaggaaggcaaacaggctctggatgagcaggtgcaggcccaggatgg

SEQ ID NO: 32208 - DNA, 1738 bp, Bovine  19866881109947
ggggatgccttgtcccctgtgccctggacaccagcctcctcaccctcagtaagctgacaacccaccctcacctctctctttcaccctctcatcgggctgacctgcccctagaccacaggctggcacgcatctggaagtggacataaaagaggcattcctctccagagccatcccaacctgtgcggcaatcccaacctgtgccttctccacgagcagtgaagagctcccacctcatctctcaatgagaaatttgttaaggagggtctttgtccttagatgttccccatactatcccccataggctgtatagcatctctcccctaccagattcttctgaaaaatcccctgtgtgtttgtttttcaaaataaaattaatcgacaggaactatttagggagggtttcctgaggggaagtggaaggaatctctgcaaccttgagattacagaaccttttcttttctcaaaagaaaaacatgtcagagcactggtattctgagccagaccttgttttgaaatatgctcccctctgtcctttaacaaacaacagcctttctccctctttgaaaataagatcacatcaagtcagggattagaaatgggaaaaattcaatcagaacctccctctgccagttatacatctcagtacactcctaggcgagcagaatcagctcccactacaacccagctcagcatcatcattcagaacgcaccggtaggaagtggtgaaacagaagggcctttcatcctgagtgagcgaggcctgcagcactgctcttctagctccggaagctggcggtgtctggggccagtggagtcagggcctgttgcttaaataggcagtgggagggtctggggggggggcgggcatggaaagtgggccatttacccagcacagccaggcagtgtctgccgagccagcagtggtcctaagcacgcgcctgcctgcttgtccaccgtgaacctcaagcccacaggtccctagaccacagaccagcacctgggatgacccctgatggacgtgctgctccaagtgagaccacgtgcccagacacacggagcttggtccgggttcctggatacctcttcctgtcctgagacacagcctgtctgggcagcagaaccaactgtggagttggatggacctgctcccaagaccagtaagtagtgggcatcaagcagggtatctcaccaagtctcggtttctactttcttaaaatgaggataacactgacttcataggttcagaaataatgtttgcaaaggttctagcacctaagaggctgatttatttatccacatgatgatgctggagtcaggttactgtcaacaaggttcaagtctagagaggtttggtaacttacacaaagtcacacagccctttagctgagtgtcagagtcagacttcgtgcagacctgaaactaagttgggctggcagaaaccccttgaggtgaaggtagggagcaactgctggccttggggaaatgtcttgactgaactctggtgaaggagttacccctagaaacccaatacagagataagggaagaggcatggctggacaggcaagctgagatggccagtctgtgcatttggttgggaccttagtggggatgcagaagtatcctagaggaactactaggtgtggctagtgagaggagtttgtttcttctttccacttgtacagagcaaatcttgtttcagagcataactaatacatgggtagaattgcacattttccc

SEQ ID NO: 32209 - DNA, 802 bp, Bovine  19866881112496
gtggtcattgtgctcaacatggaacctgaagcagttaacttcagtataacccataggggcttccaaaattgtgactctcacttgccctctgccccacgccccgtcttctaagcctcgaaccctactcaccctgcaaagcgagcaagcaggtagaaatcccccgactgctgcacgcgaaggagctgtgctttgtgtagaacacaaaaagctaaacctaaagctataacagcagaaccttcctgctgggggtaaaaaaggctcagaagacaatactcgttaaattaaaaaaaaaaatggtcaaaggttttaacaattttgacaagctctgaattccgcagtggggcgctgatgacttcaaggctttcaagagctacaacggttttgcaagaaccttgaaagttccctgtgtcctagagccaaaaccaattcctcctccccttttttacacctttacttccgacacccacgacttcctaaattcccaactgaccttatcaccagaggtttctaagttccctaaagctgacgctagacctgggtgaggtgaggtggggtggggtaaaagttgggcagagatgagttcttagcattcaaggaaggaagtttacaatcagctgaacacaatggtttctaaatctcggaaaatcttggatgtattataattgaagactagtaaaaaatgaatttacatatcctggatacccctgggacaactgctatgaaaatttataggaatgtgagttgcagtctgcaagttgctcctctcagaagtactgaggggctcaccatgactcacactggg

SEQ ID NO: 32210 - DNA, 1310 bp, Bovine  19866881132419
ctgaccttaagggacttgagcatctgtggactttggtgtctgtgggaggtcctggaaccaatcccctgtggatactgagggaagactgtaatattttattactgtggtggtggtggtctcagtcatgtctgactctttgcaaccccatggactgtagcccgccaggctcctctgtccatgggatttcccaggcaagaatactggagcgggttaccatttccttctccagggaatcttcctgacccagggatcaaacctgagtctcctgcattgcaggcagattctttaccgactgagccaccagggaagcccattttattactactattactgttaatttccttgttgccatggccctgaagatacagctggaaccttcaaagtttcctccttgtgtggttggctgcttgacagaaaatatgccctgcttgctctcccacgtgaggggcagggatggtgcaggggcctccatctccgcgcaggactgtctgttgtgggctgctcgtgcaagcccaagtcacaggcctctgcagaagccagatgtaggtagaggggtgataaaattttcaaaaagaaactttccaggggagctattaatgcgtcatgtggtttctgagaataggaacaggctgcaagcagctctgtggcactccttcaatcagtcagcctcggcatttccatgtcagagctcagaaagcccagataaagccaatttttgcatgactggaaagcaaatcttaagcaggttggaggtagatgcaccagggcgccccataccacctagtgtttaaaattgttgtacatctgggttcaggactttgtgctgcaaggtcataggtcagttgcccttggggtgtgggctccatcgtgggagggggctgagtttgaagatctggccacccagccctctatggcctgccattccagaatcatctattggtaactgaaaagggggccattaaggagaaggctggatgatggctgatatctaaatccacatctgagccatcctgagtggcatcttctcttcttcccatttacccttatcttaggctcaagcatctgtctgcagccagatctgtctgcctagagtctgctgagggctggagttcatatgtgcccaccagtcctgtgccctcatggtggctgagcctggggtaggggtgttcttgggtgatgagggcttcctgcacgatgaatatcaggtctgagattgccccattcacagggtctgctccacttggctttgactggacaggactggagcaggcagttggactacggagagaccacatagaacagccgagcat

SEQ ID NO: 32211 - DNA, 914 bp, Bovine  19866881139054
caagcagaggctgggcagcaacaaaaaattagtgatcagcttggtgggaagtgaatgtcccatttaaaggggatgtccctttgagagagatggcccagcatggccaggtgctctatcgttaggagaagccagaaattcagattcttatgtgaagtcttctcctactgaagtgttagctactaattcaaacgttaaaaaacactccacaggtcaggccaaatgtgtctgagtcagatccggccaactggctgcttgcaagtgacctgtttagacaattaaggaacagagcagccggtttggaaagatcccttctgccctcagcaacacagcagcatgacttctccgggtgcaagtttcctggggctgctccgggatcatctcatgcctagttaatttccaagactccaaatttgtcccacaggcttagtgcctaactcactcagctggttccagggacgtttataggtggtgagctgatatagcaccacctcactagtcaattaaaacctctgaaataaacagcaggcccagggcaccattatgagaacagtaaacactctgcccatatccactggcttgaccccctaaatggcttcccctggtgagcaaattctctttttctggtcttcagggccaggcaacctagtgtgatcgggcagctaggagagctttacccttgtggccaggcagaatttgcctgtaattaacatccactttgctgggccctatttgcattagtctcttcagggggaggtgggttggggaatctttaaggggctgataaaacaaagctcacatttatctctgcttaccactggggatttagaaataggaataattccatatacaattacttaaaaacgtatttcagagggtgctaactagctgctacccagattccagagggtaagcct

SEQ ID NO: 32212 - DNA, 1632 bp, Bovine  19866881318999
atgagttagtatttgtgaagtgcttagagtagaacctgacacacaatgttcttaaatgtttagatattaagaaaatagtgaataaaaggtagttgaagctgttgaatctagtttttgatggtgatgatgatgttattgtggtgaaaagatcttcccatttagagatggccagtgggttcttggctcttgtcatcaggatctagttttgaaatcaagtgaccaaatgactggtttaggaaaggacaacatgctgatttaacacttagttctttgctgtcttttttatttaactttttattttagaaatgttcaaataggacttccctggcagtccagtggctgaaacgcttccactgtaaggagcaagagttcagtccttggtcagggaactaagacgtgttgtgcagtgcagacagaaaaaaataacactttttttttttaaaagaaatgttcaaatatacccatcttcatatactgatctggtttctacagtttgccagtcttgtttcccctacatgctggcgttagtgtgccctgtggctctgaggcactgtccagcccttgccagggttgaagccagcttcccagagccttctcagaactggagatcccctcagtcatttctgtaatttctggctaatcggcccagaggctcaggttgcacagaaagataatgggccttaatgagcacctggaaattcaggttgggcctgcctgtggcgcgttcattacttatgtcacttctcacagggcagggcttagccaccattaagccaagatgccccacagcaggttaagagccttgcattaagttatttgcaaaaccattttcattttttcaggctgccactcttggcaagtccaatcatgctcgtcccagctctcactgcccaggtctgggccagctggggaacagaattcagtgtggaaaatgagggcagctcttgttccctgattatatggccagccccccaaacacagcccagtggccccattgtttctgctggggtgtgggtgggagaacgttgtgagcacattcactgtcttgtttaatctcacaaaaccctgaagaggtgggctcagtcagtggtatccttcaggtgccagtagaaaaaactgaagcccagagaggttatgcattttgtgtaaggtcactctgcaagaacgtgaaaaaatctgggtttatataatcattccagtcacagactctgaggctgttcttgtcaacctcttcctgtcattttaaaaaatccttgccatgctcacccctccccaaccccttcaaacttgggaaatcagttgtagaaccagactaaaaggtgagggtaggcatgtgacatggttttaattttttttttttttaaacaaactggcaaaggagggttcaggagtgattgagactaggttactcatattaagggccatcccaactctgctgttcactagttatagggatcaaacaaatgtcttaacctctgtgagcctcagtttcttcatctacaaaatgggaataatccgtggtgcttatcctctgccccctgctgctgctaagtcgcttcagtcgtgtctgactctgtgcgaccccatagacagcagcccattaggctcctctgtcccttgggattctccagg

SEQ ID NO: 32213 - DNA, 1392 bp, Bovine  19866881332087
tggtatctctttatggaggttttagaatatttttgtggtgcctaccaggagctgggtgggagcaggatagctggtacaaggtatagaaaattttcgttttatgacgtataattattaccatatatcttgcaccatgttttgcaaagaattcccaagtcttttctgttatagaactgtcttttaaagtaaatgaacactaaaagacccattccacaagtgaagatgcccaggcagggagtctcagaaactgatccctggtgattcccttgggccatacactggacttgtaggatggggtatctggatgcactagaatatcagtttgaatatttatgtatttctctatccctggactgaaaatttcatcagttggcacattgatcctcttgccaggccttgaactcgaaagcctgcttggctcaatcttaaggggcctcaagtccctatacaccaccgtgtttcagaccagtttttctttctttgacttgatgtccccaaagtggggtaggtaacagttcattcccactttggaggagatatttacctctgaccatgcctttattatatgcacgtatatttccttcccactccctaatctccctcctgaattccaaaccagattttgcccctttccagaaaagccagactaaatcaaggtctccaccaccagatctctccctcttcatggagaatgaggaagcagtccatccctggctaagccagattgtttgcaatgaatgtgtagaaagtggaacacagttgaaaggctttaggtaattgtgcaactctgatttttattgacttcgtcttctctcaccctcctaggtaacagcttgtctgattgctgtggtgaaaacagaccatgaagttcaagtgcggagagctgccatccacgtgattgtgctgctgcttcggggactcagccagaaggccactgaggtaagtcagtctcttaccatttgcaaatcccctccctctttgttttttatctgttcatcagtcttcctttcaccaggacaggcctggaacttttttcctgggtgaattcatacagatgaatcagtcatcagggatttttatagcaggaaaattctgttgtttgcatcttcagtaagagtctctattttctctgtgtcacattgggcaaactgcacactaacctccagaaaaaccaggacacaagtttataggttgaggtcctgggcctcagcattcccttcagagggacaggttccagggtgagctatggaccgcaccaagcctggtttttatagcgtgaacttgagtgatttgtcttcctgactcatttcattgttcatatggaatcactaaagggcttcatttcaaatgtctcctttctagctgtgagtgcaatccatagatttagtcatt

SEQ ID NO: 32214 - DNA, 863 bp, Bovine  19866881397270
ttaacagtgtggtctgcacctggcatctaacattaccttcctttacgctcccaaagtgaaatctggtcactttccccttaatgtggatgttccacatccctgacttatatccagaattcagtgaaccacaaagggacacggaaggctgggctgattcagccaatgctgcaaagcgatctcttggtgccagcactgacaaggaccaaatgcactagggggaaaaaaccctcgcaatgaaatcacaccacagatggaaaaaactgttggggccggttttcctcctaatcgcgtgcacactaggctggtgacaataccaactgaagaagcaacaaaaacacaataggtaagttgttcctgcccaaccaaggggaggatctgactgccctacctctgtgctctaatacccaaatgttgtggaatttccttggactatgcttatatgcagtctgtttctagtgcacagtcttccctgctcactaggaggcaaagtgggatggggattcaagttctgaaacacaatctaatacttgttatcttatttcttcctgtgataaagatgttccacatcatttggaagtttcctttttttagcagtaaaactatcaggtgtgttacacataggattgcttgtaaatacttccactgacctgttgagagatttaacatgaatcaattgacttctctgaatcttagtttccttatctgaaaaataaagtagtagtagtagtaatgttagtcactcagtcatgcccgactctttgcgattccacagactgtaacctgtcaggctcctctgtccatgggattctctaggcaagaatactggagggactcccattcccttctccagaggatcttccgac

SEQ ID NO: 32215 - DNA, 847 bp, Bovine  19866881406535
acatgtgtatacctgtgtatacctataacgtatggcactgagaaagcgtctcttccacttaattttttttaaggctctcagaaagtactggttggttcttgttatgagtctaatccaaccatcactgttgtctaactcactagaccagcttctgtatcttgataaatgttgatagagtcactccattgaattagcagctgattatatctgatttaccctataacagggttaggtccatttcctggcatgtagcagaaaggcctgatggtcaccaagctgatcacgattgcttcttaaattgcagtccagatgggtcatgctaacaggtcccccaactaagaaggacatccaaggagacctgcgcaagacttgataagaagcaccatggcttccagtacctccatagagcccttgaccctcacccaggaccacatcacccatgatgctgacatctgagggtgcccccttccagagaccacttgccaaaggcaggaggtgagaccaggatgctctgtgacaggatagattgagaagctctctggtttcagaatcagatggacctgggttcaaatcccaactcctcccttgcgatctcaggcagcgtgctttacctctctgggcctcagtttcctcatctgtgaaatggttaacgatagcagttgacctgctacgatgtcagatgggggaggtgtggcgatgtcaggaactcagcctcagacccacaaagccgatggctttacagtatcacaggcctcaccgacctgctgcgtttgtaacaaggtgctcctctctggacgtggtcatttcagaagcgatgacgatacctggctgctggtcaagtcctctg

SEQ ID NO: 32216 - DNA, 1594 bp, Bovine  19866881699134
gggtgtgatggggagagtgggagggaagtccggagggagggcatatatgtatgcatacggctgatttacttcactgtacaggagaaaacgaaaacaacacggtaaagcaattgtattccaatttttaaaaagaagacaataaacaaagtaagatgagcttttctttgttaaaaaggagagttgtaaggcattctggtcgctagggtgctttttctttcctggtgtgggtaggaattttttcttggcactgctgtgtccttaaaacaacaataatgcttgtgcaaacaccacttcatacttgaggggtgctgagtcctttgttatcagttaccggatctccttttttaggtaactgagtgttaggaaaaaggctccttcttaattaatgggtctgtctcagcaacccgccctgagacttctccccaatccctatagcgctgaggatcccacacatcacaggacttcctccggactccccaaggatcaaagctttccgccagccagggattgtcaccaaatcccgtggatcaggggctgaatacaaggagagttcaaaggtaaagttactcacaggagcctctgtggtgggcaggatataggcaatcccacagaggaaacctctcattaagagttcaacacacctgctctcatcgccccacgcagcaaggccccaggactctagggagaggtggtggagggtgtgagtagggtgggtcagggatggcttcaagaagtacccggattcctagtctaaaagctctttggaaagggatggggttcaggtggtttttagaaaagaatgtagagtgtgggtgcaacacacacaattcctctcccccctcccccctcgcccttgcaggggccagttccctggagcgcacaaagctgatgcttcagggacacaggcagtcttcagggttagacatggcttagaaaagccagatgaggcacgaccctctgaaaagggactgtgtgagcaaaagactgccttgggcgcacaggtgccttttcaatggaaaaccaggaaaactgtttgactctttcaatgagcttgaccccaaacacgcccagagtggtggttatgtctctgtgttaagatcaaaagaagaaatacatggcgaattgctttcttcactttaatttctaagcttatttatatatttgattataaagacaatataaccacaacccagaatatctgggaaacaggaaggaaaaaagtctctagtcaaattacctaacacaaactccatgagtaaatacatttagcaattagtattcatttacatttaaaaattattttaaaagtcacacttccaggtgattttacaaatgaaactaaagtaagtgaaattactattcttttgtattattatgtgagatcagtaagacatacaaatggccacagatgagacatttacagaaataagaattccagaaagcgtaatctagaggaggactttccatctatatttttgtaatatttaaggaaaaaatggattactaaatatgaaaggattaaaaacttaaatgctagcacacactaactgtatttagaaattcagtcttctatagagctagaagaattgtgatt

SEQ ID NO: 32217 - DNA, 3097 bp, Bovine  19866880361388
caaataatagaattctcagattcttcagagttccacaccagaacttgaaggcatgagcagagcaaacccccctggtgtgcagtcagtcccctcttttaaacccactcttgattctaaacagcaccacagaggggcctcatgcatgtatgtgtagacatttggtatgcacatccaaattcttttcatgccccacctgactcacagcccataaagagtagtgtactgagcattcttcaggccttagagtgtacctaccagcaacaaagttggtactcagggaatgaacactgtgaagaggactctgcaactctcagtgcaagttctgggccatttggacaaagaattctggcatgctgggcacccagagtgtagtctagggtgtaagctccagattggcacattcccttggccctgctgctgttgctgctaagtcactcccttggccctacacattccttagtccttcataaggagtgagacccagggctctctaagcatgggactctcatctcacttgccctagtctatgggcaggtgtaaaaatcttgatgttcttccaggttccatttttgaccttctctttttcacattttacctatgcctttgtgatatcatctatttctatggtttcagaagctaatttctattaaccgatgattcttatatctgtatctcaagcccaaatctctctcctgattttgagactgtatctcagtacttattagacatgactattactcatagtcttccccaatctgaattcaccatcttttctatcccattgccatccactaagtttcccaggccagaaacctgggcttaatacttaacctctttctttttctcattctgtgtctagataatcaacaagttctagcaacattttctaaaattttctccattccatctagttttctccatttccactgctactctcctagttgaagccacccatgatctctacatccctgtagcaacaacttcctaaatcatcttgctaaataattatctagttagtcactttcccgtttaactctttcagttcttacctctctcaggataggtttcaaattccttagctcttgaataagccctatattatcagataacaactttctcatctgtttccattctcagccgtatgcaaagtgttagtaatccctaggatgagtcatgccctcctgcctctgagccttcctaccagtttctccaacccttacccttcctttactttgctaatatctgtcattacattcattctgtggtgtcactttcttcaggaagctttcttttattaatactgtgagttttgtattccttagttaaccccataccacatatcacactgtattataaataatctctaaattgttgtcacaccctctaaacagtgcttccctggtggctcagtcggtaaagaatcttcctgcgttgtgggagacctgggtttgatccctgagctgggaagattcccttgagaagggaaaggcaacccactccagtattcttgcctagagaatccccatggacagaggagactggtgggctacagtccatggggtcacacagagttggacactactgagtagtgactaagcacagcacagcttaacttttaaactcttgacactgtaatatcttaattgtatgctatgaaataattactcatattttttttcaattttcattactctgatcattaccttcctctcatctgggagaccttccttcaaacctgaaataatactagccacataaaagtatttttccagaatacaattctatggatcagtgtacatgttagtcaaagtaagcattagtaggagaacacactgatttaatggcagaatttttaaaagataaaatactgtgtccaaagctggcaatatttgaaggagaaaaacctaaactattattttatgcaccaaccctttaattggttaagcttagatattatgttgatatacaatattgaagtaaaattaaattagttgaagtaaatgttaaaaagtaaaactacaaatctctctcagtcaagaaaatatatagagaaactaacagtgggtgttcatatagtaataacgtatgtgtttaaataagaaaggggtgatgcaaaaatgaatgattatccatttcaagaagcaaaacaatgaaacaaccattttcaagtttataataagtaagtgctttgggaaataccctatttttatatagccctaaatttcattcagtttatcaattaaaccgttaaaagtattttaattgtggcatttaaaatttttccagaatgacatatatttggtctataatctttctctaacatagcagctaaatcaaccaaattaaccatacatgatagtgagataacacaggtgttataaccgtatcactctcgtttttatgatctttgaggcttggtcactgatgtttaaaatatgcaaaaacaaggaaatctctgactatttttacctggtatttcttctttcttctacagtttctgagctctagacaagtggaaactttgatagagaatgaaaataagataacacacactcaatcatacctttcaggcgagatgaattttcatgatggcattagaacaagtgcaaatgacttgtgacatttttattactaatcctctctgtaggttaagagtatttgtgagtctcagcagaattaaagagcctaaatacttgatctaaagaatgatacaccatattatggaaaatgaaagtgattagttaattttgtacgtatatatccttagtcaagctattcattgtgttgtattctttttttccccccctttttccttttctccccctcttccattcaggagaaaagatcatgcgattcagctacccagacattcactttgatatgaacttaacatatgagaaggaggctgagctgatgcagtctcatatgatggaccaagccatcaacaatgcaatcacctaccttggagctgaggcccttcacccactgatgcagcacccgccaagcacaatcgctgaggtggccccggttataagctcagcttattctcaggtctatcatccaaataggatagaaagacccatagcagggaaacctc

SEQ ID NO: 32218 - DNA, 1689 bp, Bovine  19866880410203
agaaagatggtaacaataaccctttgtacgagacagcaaaagagacactgatgtatagaacagtcttatggactctatgggagagggagagggtgggaagatttgggagaatggcattgaaacatgtaaaatatcatgtatgaaacgagatgccagtacaggttcgatgcaccgatacttggatgcatggggcctagagcacctgggacgacccagagggatggtatggggagggaggagggaggagggttcaggatggggaacacatgtatacctgtggtggattcattttgatatttggcaaaactaatacaattatgtaaagtttaaaaataaaaaaaatttaaaaaaaagaacctaatactgggaaagactgagggcaggatgagaaaggggcaacagaggataagatgattggatggcatcatcgactcaatggacatgagtttgagaaaactctgggagatagtaaaggacagggaagcctggagtgctgaagtccatggggtctaaaagagctggacatgaccgatggactgagcaacattaaagacttataaagtgccaaacttctgcgtgtatataaggactgaagggagtgtggtaactggttttaaaattaagaacagagaatattaaattatctgagcaacactataaatttacagttgagttttttattatggccggttaaggactggtggtatacaataagaatacagagaaagcagtagaagaaaacaaggtaggagagggaaaaacaaacctggaacccaaaagaaatggctgtatcaggaagcagaaagtgaaacaaattgaaaagaaacagtcagagagaaaaaaaaaaaagggaggggggttcccagggaaatgagttgtcccaaagtcacagcttaattttcctttgaggtatgttactctggaagattagtgattatcattttctactcacaattgatctgttttttcttactgtctaactcataatgctagaatattttctcctaatgggctaactagtgaagattatgacagagaaattgttccctgggttgcagtagtagttatcagggcagctgtctttccaaaggctgcaaataaattcagctgaaatctagattttgtctttgactaagagtcaaatgtttcccatgttttcttttccttgttttcatttagcgaaagcttctctcttaaccttcacatagtcattggtcactgtaggctgcgcttacagtacctagactgttcagagatcccagattgtgcaccagcagactagcacaggctgttcctaccagctgaggtccaggatcacaaagcatcaaaggagtttgttattcgcccttcaaaagcctgttgtgtttgctactgtgaaataattaaaaattaatcaaggtgatgaaatatgagtgtgataagcagaactgctatcaatgaaaattaaattaatgctgcagaaaagtgaggagatcatctgagtgtctcaagctcttgttttagattacagaaattacaaaattgaacttgttggtgatgcattattggaaagaaatatgatgtagaattccaatcaacagtcacttaatcaaagaaaaagtcatgaccttacatcaaaagactgggatgtgagtgcagatgaactgttttaagttgaaatagactatttaaggaatgaatgtatcatta

SEQ ID NO: 32219 - DNA, 829 bp, Bovine  19866880463255
ggaagtatggagagtaaaaattaaagaaattcagtgaacaggttggtagacagtttgcagggcattatatttttatgtcctcttttccacagctaatgactttcatcttactgtgacttcatctattcacctttgctgccaaagacaaacttttcgaagtggaaaagagtagagagagcataaaagtttctaaattcctaagtgacataggagaggtaaatattctttaattatcttccaattttgcttccattggaatatatctgaaaacaaagaagtttctaaaacttaatgtgagccactagtgttcatctctgcttacgtatgcaaattctcatacaatttttaaaataaaaatgtcacaattccagaagttaaataccttatcattgatgctgatgtagtaagtaatcatataaaatacttgcttcacagaatcttcatgtgtaactaaatttcaaatactttctttcatgttttgccactctaattttttttcttcgttagcctcaaagtgtagaagcagtttccaatatcttacaaatgcatttccttccaatccaaaatgaactttaataatgttagcattagaaactagttccatagcaagtgttacaggagcttttacatggacacacttttctagagaaattatgtgtataactcacaatactataaacaaacttacacagaattttcttttgtgcctggtaggagaaataggagcacttcaaatatcctgaggatgtttcttaacagctctcccttggtcaattaagttgtattattttgctaccaagttcaaaccactttaaagcaagattcagag

SEQ ID NO: 32220 - DNA, 1020 bp, Bovine  19866880464970
tgctgggagggattgggggcaggaggggaaggggacgacagaggatgagatgactggatggcatcactgacttgatggacgtgagtctcagtgaactccgggaattggtgatggacagggaggcctggcgtgctgcgattcatggggtcgcaaagagtcggacacgactgagcgactgatctgatctgatctgataggtaccacaataataatgaatgttattctaagtatttagccctttgcttgtaatactaatccagtagatggttttccatacgaaaggattacattttataagatcgcaagctttcagaattcaagaaagaaatgcaagtataatctgaagaaatttttttcaaaactgcgattcttaactcatgtattacacggaggttatggtgctttcatatttcattaaaatgtttaaaaaagtttatatgatgtagaccaattctgcaagactatagaaatgaatatgaatggttaatcatgaatttaaaaatcatttagtgtctatatatcatcccattttttttgccattaaaatattccctgtttctcatcaggagaaagtggatcctaaagaatgtagagattcagataagttgttttttattaatacaacctagattttatttatataaatatttcttacaatatacaaagccctaaaacagtaaagtacagaatttattaggggtttgaaggtctaataatgcatgtataatttgatgcaatgaacacagctataattatggtctacaggaaaaggattttctgtacttaaaaaataagtcctcaattatcacaaaggctacattatctttcattaacttaacaatataactccactttaaccatgaaaagtaatgaaaccttaaaaacacatcaataattgagtcaaaattgcaagcatgagaagagtaatgttaaggccaggcaaattatgggttcagttaagtgactttcaaattttaactttttccactagagtgattatttcactctttttattaggga

SEQ ID NO: 32221 - DNA, 1479 bp, Bovine  19866880522400
acccctcacaaacagaataggtttatttgtgatttgcattaattaggtaatttcagtttcatttctttagtaactgatttgaatacaacagaattaataactgcctcatatctgcacacacatttattttcaaacaaggacgacctaacagcactcagacagatgaagagcaaaaatattcagtggtgcaggtatatcttgggttttatcggcaatagctttggactacttttttaaaaaatggttgttgattaaagacagctgaaaagcacagcctttggagaaaactattgatacaaatgtatgtgggatctttttcttggttatttgattcaagctttttctcatactctttttatctaacaatcaaataatagccacaattctagttagcttaccacatgccagtcatcattctggagactttatgtatatcatttctaatgctcgccacttctctgacaaggcagattattaatatccctagtttacaaactgagacactaagagatgaaatatctgtctagaggttacacatttgatatatatcaaggctcactttttttatactacataggaaggggaagaagaaaattcatacagatctgtatttttaaaactatatgttcattattttttagtaacaaataaaatgcttaagtaatgccaggaagaagagattcctctgagactgcttaaataaatattaagatcaagttttaatgagcatattttatgttagatgtgaaagcattctgaatagtctaaaatattttactgaatagtttaaatatattttatttaaatatattacttttaatagacttaaatctaatttattcttaaggcagttaaacatataccctgatcttgtttgcattatttatggacttagcaaaccctccccttcaacaataatacatgtgtaaacttcattctcacatctgataatttttatcacaaggttaattttagaagagtattccagtgggtaacagttaatctgggaattctaaatctctgacagggtatgatctcaagaaagtcttttgaaacagtgcttgtgtcttagatacttcaggaggaaaatggaaaaatgagagatcagagaacaaaaactggatgcaaaacccatcttatctgctcaatatcaagttccttcttcactgtcacctcccatgacagtaaaaaggaagaaagcagaaaaacttcttaatgtttctggcaggtttatcgtcaccctaactccctaatgccctttcccactgaagggaagttaaaaggcaactggggtacaaaaccaaaatttactgcatccatgataatttaggaacaaaagatacctctcagacacagcatttatttcagtcacttttgtaaaagataaaaacaatagatgattagtccgagatggccctcagtaacacccctggtttacaacagaaaacaatctattctaggtactaccaactgctacta

SEQ ID NO: 32222 - DNA, 1713 bp, Bovine  19866880547335
cttcatgaagaggctcgttagttcctctttgctttctgccattaagagtggtgtcatctacagatcttgattccagtttataattcatccagcccagcattttacatgatgtactctggatatgggttaaataaacagggtgacaatagacagctttgacagtatgtaaccagcttttattctgaggtaaccagaattttccttgaagacttttaattgtatgtgtcctgattttgtaaatgcatatgcttgattttttatagtgaattgtaggattttttatagtgaattggatgtggaagtgggctgtgttgcaggcttttcttaatttaaaatagcttatagaaattttcctgaacatttgaaaatgaataaccataccatagtattgaggaaaggaaatgacagtattccatttcccctcatttatgtgttaaatatttaattcctgaactgtcataataactgtagttaatacatttgtctttagagctgaaaagtatttcacatacattatctcatttgatttaattaaaagactagtgtacaaatactgaatagatagatccatagatgctatgtcagtgaaactaaattacaagctgtcatttaattttcagattagcattatatgctcaatacacattatttcctaatagttctgtctcatttatgtcttatgtatatcttatatttaggaattctattattattttagtaatggcattatgtcattggaatcctttcatgtttctgtatattggaacaaatggaacatcttatctacaagtgggtttctctgtgtaaatgaaaaactgtgagataattcctatgacacgttcattcctgaaaagaatcttgggttttatgaggcttaattcattttttctccctgtttgcaaaaatctagttttagcttaaatgttctcatgtgtagaaaaggtttggaaaacacctatattgatttttacaaatagcaatttaaaaaatagtttttgtgtgtctgtgttctttaccatgtatatgtgaattgctgtaatgccacaactcctctgcattttgctgtgtgccattaacctaaatttggtaaagtctagtgcctagatggtggcatatttttagtctttgcttttaattactttatgcccatgaggttgaggttgtgttgtgcttagttgtgtctgaatctttgcaatcccatggactgtagctcgcaggactcctctgtccatggaattttctaggcaagaatactggagtgagtcgtcatttcctactccaggggatctttccagcctagggactgaactcgtatccctggcatctcctgccttggcaggcagattctttaccactgtgccacctgggaagccgttcatcccaggtgaggaaagatcataaattttctttccatattcttcagattgtatgtcagtgcttgaattatacccagatagaagtcacatgaagacattttatgtgtatttttcacccctaaggagtattaaaataagtttagtgtttttagtatacattacctaatggttattttgttaatatttctcaattaaggaaaattaatcagctatttcctttgaggacactagttttatttttaaagaaggtttttatactgcctcagaaaagcaatatttgtactagaattgtcaaatgacagtcaatagataatatattttaaagatatccagagca

SEQ ID NO: 32223 - DNA, 868 bp, Bovine  19866880556686
acctcataatatctttgaaaaatgatgcttgaaaatgttaaatgatctgactatagttaaacagttagttccctaaattgatttttccaaagcaatgatttcagcatgtgatcaatagttaaaatgatatttagccttaagtttatattaataacatgtcttagttaatcatttctttcaatttaatagttagtaaatttaaaatatacccttttaccattttgtatgttgaatttctacaggtatcgctttagttataataatagtggtagattcagaatgaataaaagactagatattgtgacataaaaacttctactttaggcaatgaatattctagaaaatacatgtgaaaacagtgtacacaaattctatagtttctgaggaaaaaaattttctaaaaatgtcaaatatagacaaaaagagaataataaaaatagaacactagttctaaaagcaatctcaccaacaggaaaataactattcagtagaaaaacctataaacagctttttctgtattagtttttctttccctgccttggaaatacaacaattttattctctaattctaataacactgtatttgataagattatacaccagttacctatggttgttcaattcattattttgccataagtgtaatttattggcacacttttaaaaaaatattctagttttaaacgtaagcgtcagctttaaaaaagaacagagcattatgaaaaaaatgttatcaaaatctacaatttgatgttaaaagtctgcgtgagaaagaaagtcaacctgggtctccaggaagtctgagaaaattaaaaattgaggaaaagctctcaagtttcaaataggataagtcttaaatacaaacaaa

SEQ ID NO: 32224 - DNA, 765 bp, Bovine  19866880592782
ctggaatgggggtggagcggggaggaaaagggggcacccttccatccctgtcagtcaactattattaactattatgctgatggaatggaatctaaccttatactggccatgcctggccctcttccaggttcaacgggatgggcaaaggagagactgtggttttattaagtgatcaggcttttgcttcttcaagatagctctgttcatgtaatagaaagagtcttaacataatattctctaggatacatttactctgttccaaaaatagttccataataactggtacacttgaagtaatcttgggtttaaaacaaaatttagaagatgtcaaaggaatggaaaacctgagcaaatcaaaggtcttgatatgtaacatatggtaagatttaaccctagtacagcagcccaaaaaaaaaagtgatctaaatgctgtctgcttctgtatttgactcattatttctgtgggaattttgatctgcataaaggtaagccagatcttatgagacaacaaataccaactcgtatcatgaccatatttccaattcagaaaaccccctcaagggcttataaaatgtagaattctgattttaacactttgcagttctttggaggtacaaaaatgctaactaattttaataagaaaagatctcttttatctatatatgtgtaataaacatcaattattattttgtcattcataccttgtatcattgctaaatatttcaaatcagcttaaaaattaatattctgtttgtcaaaaataat

SEQ ID NO: 32225 - DNA, 1371 bp, Bovine  19866880637676
acacacacacacacacacacacacacacacttgcagacccagagcagaacttagaagcctgatatttttaaatgtgattttataggcaaaaagcagagaatgaatcagccacatccttcaaaccaccattctacagaagaaagggaaaaaggttcaagtttattccatctcaggatgttctctgagtcaaagaacaagcccaggtccttggtgacctctagcctactctttaacaggttgccatcaatctaggtattgggacagactgggagctacaaaatgacaacacatttggatatataattgctcatataaaacacagatgtcatgaaatgaacttttctctgctttcaagcatgtttcaggttctcgcatgagagcaacctattgtttcctgaaaaagcgtaccagaaagcaaacaaacaaaaagagtcctggacttcagccttcttcagggtaggcctagcctgtgagttttttctagacaaatctacttgcttatgagctgaccgactcagagatctccgccagtcttgaaataaagaaggagaattcaggtcccatgtaggcagttccttagctcattgctaagtcgcttcagtcgtgtccgactctgtgtgaccccatagatggcagcccaccaggctccgccgttccctggggttctccaagcaagaatactggagtgggttgccatttctttctccaatgcatgaaagtgaaaagtgaaaatgaagtcactcagtcgtgtccgactcttagcgaccccatggactgcagcccaccaggttcctcggtccatgggattttccaggcaagagtactggagtggggtgccattgccttctccggtatgataatgctaataaatactaaatgacctttcaggcattccatagggtggaattatttaaacctctattccactcttctagcttaactctgtcactcaaattacttgctttgtccttgcctaaataattttctctgtgtttgttagggcaagtattttttattttgtttgggtgtcctaatccaaacccaagtcatgatacatgcttttaagaagaattgatgctttcgaactgtggtgctggagaagactcttgagagtcccttggacagcaaggagatcaaaccagtgaatcctgaaggaaatcaaccctgaatattcattggaaggactgatgttgaagctgcaactccaatactttggccatctgatgcgaagagccaagtcaatgggaaagatcctgatgctgggaaagattgaaggcaggaggagaaggggatgagagaggacgagatggttggatggcatcattgactcaaaggacatgagtttgagcagactctacgagataatgaaga

SEQ ID NO: 32226 - DNA, 795 bp, Bovine  19866880672091
attttaaaaactacaaggttaaaggatgaatgttttaagtagacatggcattaaatgaacactgctgtaaaacaaattttaatgtgatatttttctctccctctcctaaactcctatgttgagaggaatttaccagaaaaagggaaattttgttcaggcttctgtgtcctcattatttcattcatcactgaagtagtccattgcctgctgacaaacttcacacatcactacctgggaatgattgacagctgacattatctgcaagacttgattgagctaattgacattcacagtctgagcataaaaatgagagtgagggaaagtcttcctctttacttatgtgttcttgcttgaccttcatctgtgtttgcattgtgtggctttagattgtagagattatacttgcaaaatgttttcacaagtatttaggcatttttaggaatactcctaaaatgaataattctttaaagtttattctgtatatgactatatcaagcaaataattcttctgtatttaaaagctatgcctgagtcattctttactttgacccacatcaaattaggctaaagtaaaaagactaacaaaaataaaacatacaaccactaaattatcacttgagaacccctctaggttgccacattcttcaagtatatttctagattaacctacttatttgtgccaaatcctcacaatagctctgcatgttgggtatcgtctctctttgacagatggacaaaaatagagctcaagtaggagctggtcagtggagtattcagctaattgctcagtgatag

SEQ ID NO: 32227 - DNA, 1634 bp, Bovine  19866880680520
ttcctcttactttctgccttagagtggtatcctgtgcatatctgaggttgtggtatttctcccggcaatcttgattccagcttgtaattcatccagtatggcatttcacattaatgtactctgtactctgcatataaattggagaaggcaatggcaacccactccagtactcttgcctggaaaatgccgtggacagaggtgcctggtaggctgcagtccatggggtcgctaagagtcggacacgactgagtgacttcactttcacttatatatgtatatataaattgctgttggagttcttggcagattgcattaacatgtagtgcatagcactgaatagaataaaactagaaaaattaatttctatttggcatattactaaaaatcctggatttttcatatactggataacttgtagtcaacttcacttataacttgattctgtgttccactacttctttggatgcttttattaggtctgtggtttagtttagttctagtttagttctcattaaagtatatttagtaatctgtcttactttatagcctgacctctgactttaacggctgaatatccttaacagactgagattctggaccctaaccagagaggacattaggagctgtgtggtggagaattacatttgttagtcctgctctgaccttggtacctcagttccttagggcccgagtgtgtggtttgctttcagggttttgagtttcttgcccttgccccataactagcttcagagcagcaattgtttatactctattatttcatactcatactacattcatacatgttgttccctgttcctggatgtcttcccacacagtttggcaaacctcatgtttcaagatgaagttttgtcatattctttgggaaaccttctttggtcttccctccctttatacttcctcccatatctaagtccgcttatctatttgcacgcatcccacggtattctcactatttattgactttctgtctctaccagactttgagctcattgtagttcagtatatatttaaaagaatgaatgacttctgctacttcattttgaatcattgcccatcacctgtcttgcatctgctttgagagtattatggatactggagtggaattgaacctaataatgatatactcatatacttttttttttcccttctattctggctaatatcttgatttcagtgtacctttggttcatgtcccagtttgagtctttggaaaacactggccagctctgtgtgttgtaagtcttcctaaactatttcttacactcttcccaggcctgatatgtctgctcttgagttttatgggcagtggttctgcctcattcatctttctagcctctgagtttatgaatttgcctaggttaataaatgttgggaaatgaagaagaattctaattactttttatcaattttaataaatttatattttaaaaaatccagccttccgcttagaaaatactctttatgaaaggaatttttaatgatcaggaatgacttaagaatacatcaagactataccaagcatttcatcttcaactaaatttaggattatggagagaacttagtaaagatcttatttttcctccatgtgtgttgcagttattaatgtgatcaaa

SEQ ID NO: 32228 - DNA, 2778 bp, Bovine  19866880682889
tcttattgagtgaaattcaagtgacagaaaaccaattctctaataaatacctaaggagagataaacaggtatgttgatggccatatttatgagtttaattacagaaggtgctgatgggagattttgtcagacagaatatagactgaagtgaagcatttggagagtgtaagagatagaacactctattaggccggctgaatgatataacaagttctaatgtaaaaatcataagaataaggaagactacttgaatttacaggcagaaaaagtagtacggaactgaattaagctattcaaagttttaaacaacttgagaaattcctgctaggtactgttaagtttccttttcaaaggtgtatatgtgtgtggtcagttgtgtccaactctttgtgaccccatgactgtagcccactaggttcccctgcctatgggatttcccaggcaagaatactggagtgggttgccatttcctactctacgggaccatccagacccagggataaaacctgagtctcctgcattggcaggcagattctttaccactgtgccacctgggaagccctttttgctttaaaagttgaccttcatgtgatctgcatgatctgtaggtagcttggaaccagaaggaaataattgatcaggtgtgaatttcaggtgcctctcatgattcccttagtgagtagagaaacagaggtggtcatagtaagtcatataccatatcaatcaagacagagtaggcaaaagaccagggaaaaatggacaagcaagcagtcaagaagcacttagtgaaattcattcaaacaccgtacagggcctaattcttatttttaataacagttattattaagaaataaatatatattgaagaagacttagaaaacatgtaaagatgtatcaaagaaaataaaagtcatccttaattacatagctcagaaaaaaattttctaacattttggcatacttaagaaaattaattctctctctcctactctctcagataatatgcttacattgatattatctcaaaaggattatattgtatataatataaagtttcacttctgcttttatagctaaaataacgttggggcatttttcttgttataaaaattattgatgctttgtacttatttaatttattaacatttattgcttacacagtaaaatgataatttaaattttttcccattccctaattttctaaactcctacttcaattacaacattttcagatacatttttgtatgcatagcacatcatatatttgatatataacaaaccaatttcttctttattattttctgttatgaaatcatttgtgtcatttttcttatgtcttacactgcctacaaaactttaaaataaattttgctatatcaaattataaaaaagagttcatggtgttaaaactttaggaatgaatgatggtagatagtattatatctgattttatgggatatacatttaaaatttcagctttaaggaagatgttgcctgtatgtttgaaaaagataattctcttttcattaagttatattttttctattgctttttagtaaagagttttatctcacatgctagtaaggtaatgctcaaaattctccaagccaggattcaacagtacatgaactgtgaacttccgatgttcaagctggatttagaaaaggcagagaaaccagagatgaaattgccaacatctgctggatcgtcgaaaaagcaagagagtttcagaaaaaatatttatttctgctttattgactatgccaaagcctttgactgtgtggatcacaataaactgtagaaaattcttcaagagatgggaataccagaacacctgacctccttcttgagaaatttgtatgcaggtcatgaagcaacagttagaactggacatggaacaacagacttattccaaattgggaaaggagtacgtcaaggctgtatattgtcaccctgcttatttaacttatatacagaatacctcatgagacacgttgggctggatgaagcacaagctggaatcaagattgctgggagaaatatcaataaactcagatatgcagatgacaccacatttatggtagaaagagaagaagagctaaagagcctcttgatgaaagtgaaagaggagagtgaaaaagttggcttaaagctcaacattcagaaaactaagatcatggcatccggtcccatcacttcatgacaaattgatgaggacataatggaaacagtaagagactttattcttggggctccaaaatcactgctgatggtgactgcagccatgaaattaaaagacgcttactccttgggagaaaagttataaccaaccaaggcagcatattaaaaagcagagacattactttaccaacaaaggtccatctagtcaaagctatggtttttccattagtcatgtacggatgagagagttggactataaagaaagccaagcccttaagaattgatgcttttgaactatggtgttggagaatacttgagagtcccttggatggcaaggagatccaaccagtctatcctaagggaaatcaatcctgaatattcattggaagaactgatgctgaagctgaaactccaatactttggccacctgatgctaagaactgatggccacctgatgctaagaactgactcatttgaaaagaccctgatgctggcaaagattgaagctggaggagaaggggacaacagaggatgagatggttggatggcatcaccaactcaatgggcatgagtttgagtaaactctgggagttggtg

SEQ ID NO: 32229 - DNA, 1103 bp, Bovine  19866880862904
tggggtcgcagaatcggacacaactgagcgactaacacatacacccagattcctttatgggcttccctggtggctcagatggtaaagagcccacctgcaatatgagagacctgggttcaatccctgggtcaggaagatcccctggagaagggataggctacccactcctgtattctggcttggagaattctatgaacagagtagcctggtgggctacagtccatggggttacaaagagtcagacaggactgagacactaacccacagaagattccttttggcctttagttttcttcaatatatccaaatcctaaggtaaatctttcctttacttaagatcagacgacattagctaaataaaatgtcaagatacttggcttttggctagaattacattaacagaactgagaacactgataatttcttgctaatctttagaactttagatgaactgtcctaacatcttaggaatttttgtggtttgaggggaaaagtgaaaacagaaattcctgtcacagcctttcctataacaaggaagagatacaagcaaacaagcaaaatacgaaacaataaaacaatgatgttttcatattcagtttatttaacagttttaagaatcattaatatatgttaactaccagtatgatgctaatgagatcaaaatgcacattttcatgtttgatttattaattttacaaatatttattaaggacttctaatatgcaaagaaatattttgaaagctaggagcaacatggaaatatataaattgtagtctttgccctcaaggagctcaaaaactatgcagaaagataagaaatagagctaaataaattcagtgcaagacagcacatgttgagattcagataaatggcaaaaataaaacattttagtagatgagtataaatataattcagaaagggtgccagttatgatacttaactagccgtgacaataaaggcaatttattgactctcagactcagaatatcacttgtagcagaagttgcaagcaaggcttgatccggcagctctgtggtattcaccaaggagcagtatgtttctctctccagtttactttctagagggcaaatgtattccaagg

SEQ ID NO: 32230 - DNA, 1671 bp, Bovine  19866880864229
atgttgacatacctttttttttatttttaaatattgttactgtcgttaattcttattttgtggacgcagtgtcatttgctctgcctgattacaataaggaagaaacggaagagagaagagacaggggacattgttccttaacagcttgacttgtttattgtgtgggaatttaagagcagttcatttctgccatgcatagatataaggtatatcatgctttgagaaaaaaaaaatcacttgattcataaagattcatctaaggattctaatttgccactgatgttcaggattgtgcaaaggcaggaaagattagcattttctgggttggactttcacagttttaaataggataagtaattttattggtcaaagaagaatttgtttcaaaatgtaaattgttttccttttcctctagagatcatggaacacacacacgttattttccatgataactccttggatgagtagttgttgtgggttctatgtttacttcccctgtggaatttataatacggtatgttgtaccctgtaccatatagaaaaacttataaactacaggtagttaaggacagctacaatacatctgaggtcctatgatcttatttttctaaacttaagcactgtttttccatagttttgatgacttgcattttatagacacccggcagccttactttgaacacctttaacaaatagtgtttttatctagttttcagaataacatatggtctaagagtggctaagaggcattcagtagttttcagaagggacctctgcttttcttaaatttgtttgggaagttttcttttacagctgtaatgtgatggcagcatagtatacgtattcctttctaaaaagtatgcttacgattgtcactttatcagcatttaatcagtgttaaccagtcagcagaaaaatatcaatataattaggctaacagtaggggggaaaaacccactcagaaatcccttttctggtatttctcttttcactagttttatttttcaagctttgaccccccagtgttttgtccatagtctgttcatcttttattcttctggtggaaagtcttaaaaatcttgctgtaggctatttctttcaaaatctcctcagagcagttgctaatttgacccaagtatggtaacttgaaccacataaggttatgaaactagggctatttattctagtatttcttcaataataatatttacaacttttggtacaaggaaaaagcaacttctttgtaaccggtgcattatagataaaacagaagcttatttttaccattcttggagtctagaatgcaaccgaacctccaagctaaagtgttcaggtccacacttttctgtctcgaaaacatgaaactattaatatatataagctcttatgaatctcagtcccttactaaagaatttttcttcttttaattcatgtatacgttggcatatttcatggacagattttaatttcatttatatggggtgttctgttttttctttgcagtttaacagcattagaggggaggaactgagtgaaattgattaaattcatgtgtggggggcccacttggagggagaattcgctgcttgtgtttagagaggacaggcctgaccacgactggattgtctgataaccatttctgcatgttaaaattacattaagcagtaagtg

SEQ ID NO: 32231 - DNA, 1900 bp, Bovine  19866880866911
cacagtgtattggctaatggaaatggacccataatgttgatttgaatttctgagcaactcattcactgaccaatcgaatgaataaaaatataatatggaattattggaaattagcagttagaaactcgcatggcaattcatagaccaataatatgtcaatgttttattaaatagcctgggcttacagtgaaaattactggtaatatatatatatatatatatatatatatacatgtataagacaaaaaatttataaacaaatttattttgaagctgtactggatcatatctgatatgacttaagaaaatgtaataatcaattgaggataagatagtaatcctccaatagatacagaaagaataataaaaatacaaaataatatatacccattgtttataaaaatactagactattattttaatgcttttaaagttacattcaatgtatcaatacaattatgtctcccacaaaatcctgtaaaataggatgtaagtatccctataggctatttgagagaataaaatttccaaggtagtgtcttttgtatctaaactaattcattcattctggcctaagggaattactgtccagtctcttctcctcactaattacaaacaagcagttataactcaagggttttacagactaatgcagcattatgttgatggatgatggttcatggggttatgcttatcagagaagcagaaaaaggattccactgattagatcctttttccatggaaagggcttccctggtggcttagacggtaaagcatctgcccgcaaggcaggagacctgggtttaatcccagggttggaaagatcccctggagaaggagatggcaacccacgccagtactcttgccaggaaaatcccatggatggatgagcctggtaggctacagtccatggggtcgcagagagtcggacacgactgaccgacttcacttcacttcacttcacttccatggaaaaggatctcaggactagtaaaaaggagaagaaaaagggaaaataaagaaaatggcaaaaaacccgcccatatgtgttatataggtgtgtgcatgcatgaatagatattgattagatgctgacctgttctgaacttcataatttgttctctggttcacaacagaccaagagggcataaagctgacttgataaagcttaaaaatttttgatacatatgtgtatgtataatatatacatatataatgagcacatgggtggttctcataagtaagatgaggtattaactcaactagtgcagttaacactatcttgcagcctaggaacttactcacgtgtcactgaaggggcttggttcaagacgttcattttggcacatgagattttctctcttactgttctcagcttcttcagtaccaatatctctagcacccttgtcacaattattctgatatagaatgttccttgcttccttgaaagcttggatttgcccttacccattaatttgctataagcaatgagcataaataaccttggtttagagatgagtgggttgatacagaacattaaaagaacagtcatggaaactaatgtgggcataaatttgactgtaagtggtcccaccagggttgatgaaaaactgaataaacaagattagacagcttttttctgaacagttttatagtgaaaggatagagagtagtatatcatctacaactacagacaataccttcagtaaactccaaagttttatttgataaaaaaaaatattcaaacatactaaaatgtatagttatttatatcttaattttcaaattatggtctgaggaccagcagcataggtatcaccagagactttatggacttccctggtggctcagatgttaaacaatccacctgcaatctgagagagctgggttcgatccttgg

SEQ ID NO: 32232 - DNA, 2810 bp, Bovine  19866880996640
ttattcagctgtttctctcatgtggtcagtatggactcttgttcttgtggccataggattaggcaactaaccaaaactggatcacctaggatatccaattctgttcagaacagcatctggcctaagctaagcacatctgagtacctacctgagatctttcaaatttgagttgaggggatgggatatagtgccctttttattgcggtttgtgtgtttatgagcttggaagccctttgaccaaatatcctatggctgagacaatgaagaaatgaagagagtagagatgagacaactaacatggaagcctctgcgtgtgtgtgtgcctgttacataccaaagctgaagtgtgaaaattttccccttttcattatgttgctttaatctagacattacaatgagtttttatgtaagagttagtgaattcattacatcgctgaagctgcaggaggtctatagttcagtcaaggtgttaattggctggcactaagtgtggtttgaggttggtgtggcagatggaacccaatgaatatagagctttgttatacaaactatagatgtacttaagctttctacatctgtgctgaactttttttcaaatagacataggtgataaaacacctgctacctaattaacaccctttgtagtcactcacaacgttattctcaaacctgctctgccagctgtaaatgttaaaacttcacttgctattcctggatatttttcttccctttattttataaagtctaaattgaaaaatattcaagtctatcaaatgaaaaagaataaaaatggttaatgaatgagtgaatggacagataggtaaagtagaaaagttctgaaattttgagctgataattcaatgaaaacagtagcaagttaaaggaattttttcagagattagacatttctgagaaaatagcaatgtttaaatctcttggctcctttatactctcaaatccagcatgttctacctcctatgagccaagaaactgtgattacaggaaggaagggattatttaggggaggcaacttagctgtcaggtctcctttggtcctgatgaagatcactgggacatgacttgtacctgtccaggcagatagagtctagggcctgggatgagccatctagactgatggttagattaggctgagaggggtcctaagagttctgtcaacagagctcctcagagttgggtgaagttgctatgcatttcattggtatctctagtccagccggcctttagagctttgagaagagctaaaagtttctctacacaactaagagcaggagtctataaggagatgagtgagcagagatgttttccttctgggacctcaataggaactctaaatctgcctgttgttaatcaaagacccacaggagcagagtaaatgcaccattcaccactctacggatcacctccatatatgctatgccagcagctagacctaagtcctaaacaaatggagaaaggtattagcatattcctaaggagggctcaaaacagagaagaaagaactgatacctagaaaaataacaatctagaataaacaaatagcactttctgtcacatgctatggtatacagaatgtgatcatccataggccttggcatgtaacacttccatcattgattcatacatggccctctgtatttattaattcaaccctttttagtagtataataagcaactaagagtccaccagacgcaatgtgaaaggtaggattcaccaaacatttacatctgtttatgggtctttctcattctgttccctctctcccctccctcaagctccttctgaagcttgtttttcatttctttgttttcatcttaattactaaaacctcttttctttttttaagcttatcttcatgttaattgtttatgtataaattgctcaggtttatatggtttatattgttaaaattcattcctaccattgtatgacatttgtattaggtcagggttctccaaaggatagttcaaataaaatagagagatatacttaagagaagatttattacagcagttgacttgtgattggttcgtgaggtcccaggatctctaatccacaagctgagaaccaggaaagccagtggtgaaattcagtctaagaagggaaacctgagacccagaggcatcaatggtgtaagtccatgtccagttctggaggcccaagaaccggaaacacagatgtctgaaggcgaaagaagactgatgtccctgtcaagcagagatatcaaattcatccttcttccaacatttctgttctattcaggccctcactggattgaatgatgcccacccacatgggtaaaggcaatctcctttccttagtttaccaattcaaataataatctcttccagaaacccctcagaaaattcagaaataatgttttaccagctatctgggcatcctttagcccagacaaattgacacaaaaattaatcatcaagccacttctgtagtttatttattgtattgctttttaacagtctattccactatattcagtcacacttctgctacagaagcatacaatttgccaatctatggaagcacatcagttcagttcactggctcagtcatgtccgactctttgtgaccccatgaactgcagcaagccaggcctccctgtccatcaccaactcccggagttcactcagactcacgtccatcaagtcggtgatgccctccagccatctcatcctctgtcatccccttctcctcctgccccaaatcccagcatatgagtcttttccactgagtcaactcttcaaggaggcaataaataaagaaaatctca

SEQ ID NO: 32233 - DNA, 972 bp, Bovine  19866881122137
tgctggatctctgaaatctttaattaaatataggtggattatatttgaccaacaaaaaaaacagattttgcagtttccttgatacctttaagaataaaacagattacccatctctctcttatctgccagaagaaatagttatctttctcacgaaccctccccctctctcgaaccattaatttagagaaggggagctcaaaagttttacccaataaatagtgagcctacacatccacatgtggctattcaatttttctagttatttccattgataactgctcatctctgtcttatctgatttcttcatagcatagctgagacttgtcagctcaccaggataccattcagttgctaaaaggggtaaaaagttatcatcattaagtagcccacaatgaaactatccagtgggtcgctgctaccaaaacaaatcacagaagcactggacaactgggccatctacaggatctgaatggatatcctgatgttaaatcctaaagggagcggtttttttcttaacctccggatgttcccctatggaatttattttcacggcattctgtgcttaagaaaaccactgagtgaaaggagggttggattaatttgtggggctactttaaacaaaattgcaaagtttactgagtggtgactacgaactttttccaacaggaacacatcagcctacaactacaacaaggcgaaaaattacagtgggcaggtttccggggtcgcgttgtcggaaagatcaccgtgagatccaacaggcgcctctaccagctggcggaccccaggcttcaaagggcgccctcgctcccaacacccgttaccgcggccagagtctgggtgccccgcctacacgcgaaggatacgctccaggtagtaggcaccctcagcagccaccgcctccgcggtgtccccggcagccgacaagcccatgcccaacgcttcttccaggacccgcagagcggaggaggg

SEQ ID NO: 32234 - DNA, 576 bp, Bovine  19866881326282
taaagtaaacagtctctctactactccctgagactctaggtttccaaaggggtacacacccaatctctctatacatataacatgtttgtatactgtgaaactagttcacaaaagcattatctacaatcccacaggtcatgataaaagtagtaatgacagttaacactttaaaaacttattggagagagaaatctaggaaaatagtgtagtaagaatcatcaagaatctgttttcccacctagaaaacaattgtactggcagaatctgtctgatataaccattttagatctctggcatctactgaagctttgcaacttccaggggatggcttggacagtaaattgtgatcaatttcagtcaatttgggggcttccttggtggttcagatggtaaagagtcggcctaaaatgcaggagatctgagtttgatccataggttgggaaaatctccttgagaagagaatggtaacccactcctgtattcttacctggagaatttcatggacagaggagcctggtgggctacagtccatggagtcatatagagttggatatgactgaatgactatcatacata

SEQ ID NO: 32235 - DNA, 670 bp, Bovine  19866881439803
tcttccccttactatactagatgctcagtgaatgttcttgaactcttgttgcagctgatttacctatcatatttcttttttttttaagttacagagactgcacataaataattataatagagctaggtattaaacacaaatcagcaacataacattaattaaagggccactgcataaaagaaaagactttaagtgcattatatacatcactgatataatcataacagctgctctgtgaagcatacaatactaccttcatgttacagatgagaaaactaaagctcaaaatgggtgaagtaacttgtccaggtcacacatctattcagagccagatctgaaactagaactgagaactaaagaccaaattctttctatttcccctgtgtcatcaaaagcaaaatcagttaccagttaacagtaaaggaaaacagggatgccagtatgttaaggaagagtaactctggatcggtgtgtgccatctgccattttctctactgaatgtagaacacaggtgtagtagtttgccagctttgagtaaagagaaatttgtctgagagactgttctggaagaagaccagcttccattgccagattttctgagcatggattttatttcatataagagcaatctactttgaactggtgtttggcaaccatctgcttaacataa

SEQ ID NO: 32236 - DNA, 1163 bp, Bovine  19866881457485
atttttaaaaattatagatgtaattaagatgaaggtgactaggattcttataaagaggggaaatatgaacacatgtgcactataagagaatgccatgtgaacatgaaggcaaaaatcaggaccatgtagctacaagctaaggaaagacaaagatttccagcaaaccaccagcagctaggagagaggcatggaacagattctgtctcacagccctgagaaagaatcagccccacgaatacagtattttgatctcagactttgagccttcagactctaaaacaatcaatttcccttgtttaagtctcccagtttgtattactctgttccagcaccttagaaaattaaaacaagctcagataaggtcaaggagatgcagaagtgatcaagaaactactcactactgtaagaaccttttgaaagactatagagaagaggaaaggggccacagcaccactggtggggtaattttaaaacttttaaagtcaagggacgtgaattctgcaaatgagataagtaagcttatgatgaacctattaaaattagtaagcaaattagctgtctgtgcaacaacgtttttaaaagttctaatatgggttcactaaggatagcacttttattattgattcaattaggctggtagattaaaatacatggactttgttcactctgaacttacaaatctgaagaaacctttccgaatattcttaaggtccaaatggagaaatatgcaggaaataacatgagagttagatacctacataacaggttaaacaaccacacccaaaaagtgttgattaatgaaaagatgttaacttgaagaaaagtctcaagttgtatgccatggggttacattaaccagattgaaaagaaatatgtacagcatgtttgtcaaacctgtggatgatacgcagctgacaaggatacctgatcctctgaatggctgagtctggattccataaatcatcccactgaggaaccactgaaggaactagagatgtttaatgaggagataaggagcaatgtaagggtaggtaccaaagttcaaggctggaaatatgaagacgtataggagcaataaagttcttgcagcaagaatttgacatcttagtgaaagaaagaatatttctctctactacgatcactctagctctaattactctatg

SEQ ID NO: 32237 - DNA, 1018 bp, Bovine  19866881756245
cttgtaccccccccccaatatcaggggttttgtagaggcccatttattcacaatacataaatcagcttatatggatagaagttacatttaacaggatgctgtctgttctatttctgcttcaggcagtgaaatcaggaaaaaaaaaatgcaacactatgaatttgttaaatcactaatcccaatcactttcattttatagaggtatctgggaagatacatgctgcttcacataataagctgtggtcaaagaaaagaaaatgcaacctcaagcttccagagaactgaacattgtatttacactcaaaatcatgttactgtcatggagcagttacctggtataggttaagacaaaatatgttttattaaggtagttttatcaatcttttactattaatcaggaagttgatacacaactcttttagttgctcagagctaaatggaccaataataatacatgtctgtgaatagagcaggtcaaatattacacattttacattcttcagaaacaacagaaatattttatttttaaatactttaaattcaaatatgttcaatgaataaaagataataatgggtaacatttcttgagcatatatgttccagggaacagaactagtgtttttcatatgccttaataattaacctacaaagtaggtatcattattatacccattttgcagatgagaatactgacacgactagcaaatgtgaagctaagattctcactttagcagtttagagcatgtctaccttgccacaggactatgcttaaggtttctgctttttggcattatacatttcactctttcaacagtgcaaaggcagtggcaatgcacactctctacattattccaccccctcatcattttcagcaactcatgaatccctttcatcagtctacccagtaaacggaaagggtgctttaccttaccaatgtatgatcgccatctagtggtaaaaacttaatcatgattatttatccatgtcattcctattaacagtgtctttttttttaatt

SEQ ID NO: 32238 - DNA, 1076 bp, Bovine  19866881890568
agtaagtatcttttaatttccatggctgcagtcaccatctgcagtgattttggagcccagaaaaataaagtctgacactgtttccactgtttccccatctatttcccaaaaacataatttgatataaaaggacaaattataattgtataaggaaagcagcacactatgacagtatccaaaagtaggaattagtgattaattttgtagaagttattaggttgtttatttaaatatatatttgctgtcaagctagttgaataatatacctggagagctactgaacttggacttatgccatcattttccagcctgttagaaaatattttataattgtagagaattaaaaaataaataaattgcccaaaccatcgttaattggaataaacaagccaagaaataaatcagcattatgccagaagtatatccacattttagggggttaatataaccatcattattgtaccaagaaatttccatttgtaaattcaaaaatataacttcttttctttctcactcatcttatctatcatctatcatctgagagttcagttttttctttaccaatcctttcatccatttttatattaattgtcacagtgctgttaggcataaaaagttggagtgctcactatttaaaagtttctgataagttgtataaacacctaaattattccacatatgaaaaataccacagttcagctgccacgattattaacaaaggccatctgactttaaagttcctttctgctgtaacctccctccagagactagattattttctactaagcctatggaatcattacaacagaagcacaaactgtaatcaatctatatcttatttatgagaaatgaaagtttttgactttagaagaaaaaaaaatctctctcacaattgaatttacttccacaccaaaaaaagattaaatcaaaagtataacagtttcctctttagagttgatctttgctcaatgaatcacatttaaaatcctcctgatatgttcgaaataatgagtttgaaaggaaaagaataagaagaaataaaaccagtggtagaactataagtaaaaaacaaaagt

SEQ ID NO: 32239 - DNA, 1266 bp, Bovine  19866881943618
cacaaatgtgaactttataaaaggcttttccagccagattcatcagctccattttagaaaatgctgtagaatgagggacgttgtcttgttcatctaacaggtgatgcctactgacgagaattgaatgttccttcctgcccacctgcactgcttccttcttaattgaaaaattcattgagcaatatagcccccagaccggatgagagaaacagaatgatttacataaagaaaacagttaaatttaagaaaaaggaaatgtgaaatactaagattctcatatgataagttatcttcttttaatagcatgtactattaattttttggtcaaataatgtgccgatgtgaatttatttctttaaaaattaataatgatgagatggcaccaaataagttacaaaatggagtttagtgtttgtattttattaataatatgcatcctgttctttatgatacatatgctaagttgactctattagagatgaagggcatattgtacaacattaatggttttaaagcataataatgtaaggaggatattgagattcaagggcatgtattgttggtacattaatacctgtcttgcattataaaacctcccagctttctgccttatacttgtaaaggaacccaaggtatatgttaatagattgctaaagcagtacttgaaacataattaggttacattaaaggaaatggtgacattataaaattgacctcttgtgatcaatttatcctgttccacagataataaatcaattactacatcttgggttttcatttatattcaaatgaatgattccctctagaaatacatattttgagtgatagctaagtattattgaatataaatacataaataagtccataaataagaaaaagaaaatagcatattatttgcactgtcatgctccctctaaaccagtgcataattaataagcactatcaaagaaatatctactgatgaagaaaagtatattaaggcttaagttccaggtttcattagcaagttaaacattgattgacttatcaagaagctgtctcgcaaccagtgttggctttttgtgtatgcgtgaagaatgcttcaagcatcagtgtctactgcaataagcttgatgtgagcattcttttacctcagtatataaagacttgactaataaaagagataacattaagaatttaacatttagctctttgcatttataaaacaaactatttcatgtaaagagttatataatctgtatctattttcactaaataaggcatctt

SEQ ID NO: 32240 - DNA, 3187 bp, Bovine  19866880285395
atatattcaagaagtatttgaaataagaaaaatttattcttgcaacagaaacttttccttgtcaattgcttttatccctgttgagaaaatgaaaatatagaaaagtggtttctagatagttgtgcctttgtttgagaggacattttgacacaatgtatataatattcttcagtttttcatcataatttgaatacctgaatagtttatagcttatacctcatagcttaaatgattcagaaaaatttgtagtgcacaaatacagacagcaatattttagtactgaaaaataccacagtttagtagattttagggaaaaaaggattaaaattatgaaaaataagaaatttattttgtcccccatttctttatgacaacaggacatgaaagatgaccttgatcactacactaatacttaccatgtctactctgaagatcttaagaattgtcaggaattccttgacttaccagaagtcatcaattggaaacagcatctgcagatccaaagtaagtaacaggaatggactcacctctccatcctagcaatttcttcttgtcgtctacgtcctttctccaagctccagaccctccacctgctgtcaacagttttgttgttgttgttcaactacaactgtacatgtaaaggggaagaaacaccctccaagcttgtatgggtttctatagaggactgtacatagtccccggatagccaagatttgtgccacactttgcagacataagcaggatatcttaggatggttgggtatcagagcagagctttccccagagaattctgttcttagatcacctctcaggtcacagagaacagctgtcatggttatgagcaacccctccagagtcagaccacctagaatggcatttgcctgtggctttgctatgtgatcctagccagagacattatctgagatcatgatttaggtatatagaattgagaataatcagttcagttcagttcagttgctcagttgtgtccaactgtttgtgaccccatagactgcagcatgctaggcctccctgtccatcaccaactcctggagctttctcagactcatgtccattgagccaatgatgccatccaactatcatcctctgccatccccttctcctcctgccttcaatctttcccagcatcagggtcttttcaaacaagtcagttcttctcatcaggtggccaaagtattggagtttcagcttcagcatcagtccttccaatgaaggacccaaaacgcagcagtgttgaaaagattcaatgaaatcttgaccaggaattgctgagtacaatgcctggatgtttcagttcatttcactgcataggaaagctcataaatctgtgaactgacaggtgggctgggcttggcaaggcagttgttctgttggtctcctctgggttttcatatgcaactgcagtcagctgatgggtgggccatgggctagtttctctagcatggcctagcgtatgtctgaatgatggtctgactgtcagggctggctacttgtggtcatacaataggcgcacacctcctcagcaagctagcctaggcctattcacgcggtgttgatctcaaggaaacagaaatgcaaagacatggtgagccataacgtgctagcatttttaagcccctccctgcatcaatatactctttcccaatcggtgaaatccagtcatatggccaaggtcagatgcagtgcaggagggggactattccagggaatggatacaaggacatgtgggcaaactgaggaccatccctgcaatcatctctgcaatcatctaccatactggaaacacagtaagttctccatagatggtggcaactctaatgatgatagctcaccttctttggtcatcagaaccacacggttatgtagcccaggaaacttaggtctaggtatgaccatgactgaatgaattcctagacatgttttcaattttgtaaaacaaggaaaactgtacagatcttgactacataaccccagtcatacagcagcaccaccaacgtgtgagtggctcagacctgtccaactctctgtgaccctatggactgtagattttcaggctcctctgtcagtggaattctctaggcaagaatactgaagtgggttgccattcctttctccaggggatcttcccaactctggatcgaatccgggtctctggcattgcaggtggattctttactggctgagccaccagggaagcagccccaagtctatccccaaagttctctgtctataaatcctcagatactcctactccactggagagcttttccttagaatggacttaaatcatggcatgtctccttataatcccatctaggtacacagtccagcctgaatgaagtaatacaaaatcttgcagccacgaaatccttcaaagtcaagcgatcaaaaaacattctctacatggcatctgagacaataaaggaactgactccgtccctgctggatgtaaagaacttaccagttagcgatggcaaaccaaaggccatgtgagtttgataaaagctactctgcaccacttacacctctcatacgcaagtagcctccagccttgtctgcctgcttttaccctggctccccacaatccatcttcttcaaggcagccagaataagctttttgaaaaaatgtaattcaagccgtgtttctccctgcttaaaataggccaccaggccctctcctctggagcatgtcaggcctgcgctgccctctctgacctgtcttgcccttctagctcactcagtccagcagcagcagcctctttctcgtcctccatcctcacaagctcagccacagtccaggactctgtgtgccctctctcctcaccgcctctctctctctcaggacaatagaggtggggacagatgcaaacctctaaactcacagactgtgcttttctcttggaacacccacagcgacccagagatgtttaagctctcatctgcagatcctagccacgcggctgtggtgaacagattctggcttttcggcggcaacgagaggagcctgaggttcatcgagcgctgtatccggagcttccccaacttctgcctgctggggcccgaggggacccctgtgtcttggtccctgatggaccagacgggagagatgcggatggcaggcaccctgcctgagtaccgggcccaggggctcgtcacccacgccatc

SEQ ID NO: 32241 - DNA, 907 bp, Bovine  19866880449715
agacttaagagacgcaggtttgatttctggatcgggaagaacccctggaggagggcatggtaatccactccagtattcttgcctggagaatcccatggacagggtggcctggtgggccatagggtcacagagagttggacacgaccgaggagatttaacacgcatgcacatgtgggatcttcccagaccagggattgaaccgtcttgcatttcaaggcggaggcttaaccactggactaccagggaagccccatcatttagttttagaattcaagggaagtgcgacctccaacctcaggcagctgtcaactagcaattttactgcttgtaggaaaccatgaacttagtctgtgattcaaaaaacactcaacagaagtagctcagcacaggcaaaggacgcttaaacgttcccacccaaagaaacggtccacctcaattacgtagaagtgtgagttaaccagcagtttatttcaacgttaatctggtggtgttttagaacttcatacagatgatggtgtaatcagctgcccagttggccagtgacagaggcaaagctatgtatctattaaatatcacttagtttttctatgtctggattaaaaagaaggctatattccccagtctccattacagttatgttgaagtcatgtgattgggtttcaggtgaatggcatgtgggttgaagtgctatgatccaacctcaggccaggtaatttaaagcactctatacaacttaaaaaaaaatttttatttgaagtctagttgatggacatatagttgatttacaatactgtattaatttccggtccacagtaaagtgattctgttatatatacactttcctgccggggtccagccccggctgatccagggtattcgaagcggggacggtgtcggcgacctattt

SEQ ID NO: 32242 - DNA, 2003 bp, Bovine  19866880456396
atatgcatatgatgccactcttatggccaaaagcaaagaactaaagagcctcttgatgaaagtgaaagcggagagtgaaaaaagttggcttaaaactcaacattcagaaaacgaagatcatggcatctggtcccatcacttcatgacaaatagatggagaagcaatggaaatagtcacagactttattttttggggctccaaaatcactgtagatggtgactgcagccatgaaattaaaagatgcttgctccttggaagaaaagctatgaccagcctaggcagcatattcaaaagcagagacattactttgccaacaaaggtccgtctagtcaaggctatggtttctccagtggtcatgtgtggatgtgagagttgtactataaagaaagctgagtgatgaagaattgatgcttttgagctgtggtgttggagaagactcttgagagtcccttggactgcaaggagatccaaccaatccatcctaaaggaaatcagtcctgaatattcattggaaggactgatgctgaagctgaaactccagtactttggccacctgatgcaaagaactgactcattggaaaagaccctgatgctgggaaagattgaaggcaggaggagaaggggatgacaggatgagatggttggatggcatcaccaagtcaatggacatgagtttgagtaagctccgggagttggtgatggacggggagaccttgtgtgctgaaatccgtggggtcacaaagagttggacacgactgagcaaatgaactggactgagcaaatgaactggactgagctatactgacagtggtgtcaaggcgtgcccgagtcattcaggtgacggaatgtgcatgagtcattttccatgcatcaataattcatccattttgcttcccttgttctgaaggtgaaacatcatttcaaaatgcccttcatggagaacagcactgaggtgaatgagttcagactcttgggactgacggatgccccagagttgcaagtccccctgtttataatattcacgttcatatatctcatcactctcactggaaatcttgggatgatcacgttgatcctgctggactctcgtctccacacccccatgtattttctcctcagcaacctctctctggtggattgtgtttactcctcagctgtgactcccaaggtgatggctgggcttctcactggagataaggtcatctcctacggggggtgtgttgctcagatgttcttctttgtggcctttgccagtgtagactgtctgctcctggctgtcatggcctatgaccggcatgctgccgtgtgtaagcctctacattacgccagcactgtgaccccctgtgtgtgcgctcagacggtcacggcctgctacgtctggggctttgctgagtctgccatccacactggattcactttctgcctctccttctgtcattccaatgtggtccatcacttcttctgtgatattcctccaatcctggctctttcctgctctgatatctatgtaaatgagatggttctctttattctagcagctttcaatgtcttttttgccctgatggtaattgtgagctcctatctgtttatattctttgccatcctgagaatgcgctcagcagagggacggaagaaagccttttccacctgttcttctcacctcactgctgtcaccatcttctatggaactgtgatcttcatgtacttacaaccaagttctaatcattctatggacaccgaccagatggcatctgtgttctatacaataatcgtacccatgttgaaccctctcgtctatagtctaaggaataaagaggttagtaatgctttcaggagagccattgagaagatgaagcttctgttcagtacacagatttaattaaagagattatacaatatgtattgctaatccattatctattattttgtgataaactcccaagccccttagggctaaagtagtagttaaaggaaagtgttcattgttcagacgtgtccaact

SEQ ID NO: 32243 - DNA, 1926 bp, Bovine  19866880493041
actaatacagagaagaatgtctgcttgaggggaaaaactgcaataaaatgcaagtgttggggtggggcagggctgcctgtgtccaaggcccaggtgaaaagggcagaagatatgggataaacagccaaggatgctcctttagagggttgggagcagccagtgactaaaagactggtggggtgtgtgtgtgtgcatgcgtgccaagtcgcttcagtggtgtccgactctctgcagaaggtccaaaatggaatctccaccctttctctcattcctgctgaaccgtaaagccctcaggtgggtcccaggaaattctctaaatacatacagtgagcagaacgggaagaactagaaaacgtgttcaagaggggccgtgggacccccagtcctagggagggaggtggctctcctttgctttagcccattcatccctctgagccagtgggtgctcagatacctggaagtgggttaccagctacattcgccagaaaggggtaggggatgagagtccacttcctttctaagaggagtggaccctaagaaggggcctccgttagccaggcagaggaatggatgggaggatgagagagaggccggagactttgagagactagattgttttgcttaagaacatggagaaaagagatgaaagaaatgtgaaaccttcccccttggagagaaaacatacatgactaatagggatttttattgggttctgtcatagatcaaaactgcctccccaggattcacagggcttttcagtctccccaagacactttcagtagaattgacactattcatccatcctgtcacgttggatttgctttcagggaaatgataacaaagttcccgcaccaaggcgggtgttgggtcaagaacagaggccgctcacggtgcccagaatagtcacaagaatggcctattgtgttctacggccctggagcccttatctcctcccagacagaacgcagaaaaatgtgcgaccttgagagacagagacgggttctctctcccaggtgaaaccaagaatccttgtactgttttagaaacaaattcactcccagctggcaggcagacaccaaaggacagttctttcaaaggtaaattaatcctttgcacaaacaaccaaacttgaatacccagactagtgtggacccacatacccgctcaaaatctctcccccgcttggtacaatacgccccattctctcactggaacaatctgtttatctgaaaccacccgcgtctctgatcccagaactctgtatcttccattaaccatttcaggagagcttctttcccagacaagatgtgcgtcacctaattaagttcccctggtgcctcagacagtaaagaccctgcctgcgatgcaggaggcctgggctccaccgctgggtagtgaagatattccctggagaagggaatgactactcactccagtcttcttgcctggagaattccatggacagaggagcctggagggctgcagtccctggagtctcaaacggttggaccggactgagcaacaagcatacacagcaataaaaacaggaaaaaggaaatttttaccatttacaattacgttcaagacttaaaatatctagaaataaacctagcccaaaacaaacgtgtacgacccccaacagaaaactacaaaatatgatttagacaattaaagaaaacctaaataagttgatggatacgtgacactcatgttcaatatattcagtattggaaggatgttagttttccccagattgacctattgagtcaatataattccaatccaaatccagcaaaattttctggaaagagacaagctcagtttaaattttatatagatttcattaaaaatgaagagcatctgttctttaaaaaacatcaagaaagtgaaaacaccaggaggcctaaattgacctttctccaagaa

SEQ ID NO: 32244 - DNA, 1824 bp, Bovine  19866880516644
actgtctatttcgtcaggagagaaagcaagtgagagggagcataaccgctacattctcttgtccttggtggcacaacggctcccacatgcggggaccccactttgtcgagagatggtcctcaggtcatgcacggacctcaccgtccaccgagaaagctcctgcagcaccttcaggccccacagcttcttctcaaagagaccagcgtccccagggaggaggggcggcccgccggcctccctggggggcaccctgtgctccagcagcaccatcaactcctccagctggtacgtgaaggccgccacctggaggaggacagcgtgtatcgcctggtggaagtcttcttcggccggggtgaagtgtgcccgctggtcttccaacagccgggccaacatcccgtggaaggcgcggtaggcctggaggttctcttggagccgctccgcctcagtcagctcgctccacctgctggagctggccgtcggcacgccttccagagtgtccaggttcatgttcccgttcagaccctgatgcttcatctggccaaggatacagagaaacgtcacccctcctgcactcactccaccgttctcacgtcacctctaagtcccacacgcacgctactcacgtccctggtcaagggtccagattgtaaagaaaatagtctacaagaggaattcttcctttgggatccgtgactggcatcccagaatttatacacaccgcttggatacctgttcacttttcttgggggaatcgtagcttttgctaggtgctaaaggctgaaagccactgtctggtctagaatagcttttcctccccactcgacactccctgctggcacctagaatattaccatcatactggagtttaagtattttaaatatacctaaagacactggccatacctaagcagctctaaaatacagccttgaaagaattgttctaacagctctctccactgcccactctcactggtgaggagagtcatttattagagaagtcaatagctatatatatatttaatctgtattttaaagtctgatttctgaatgttggggctttaggaagagaaacccactctccgagaacttaaattcagagctctccacaggagtctgcagttcccacggcaggccctaggtgaagactgacgggaatcttcctctacagaaaatgtacctaaccccatggtcagcgccttaagaactggacaccctccccagttccccagggtttcttccaggagactttttttttaataggtgacctttctatttagacacacaaacacttctgattgtatagggccctaatactgtaataggaaaagctggttggtttatactgctcttcccccagctctatgcacctccctcagccttatgtttacatagttaaaaagtcagaacaacatatacatgaagaacccacacttgggagggctcacggttcatctactctggaagaattcagacaggtattcaaattaggaacagcctccaagacatacagacaaacctacctagaaccccacgtatacttccttatttaaagagcatgtttcctaaatagcatatagaaagaaacgtcttaaaggacttctctccagggaaagggccgtgtcaaacgacaggtgcccagtgtttacaacaactgcttggttagggcttctgtaatggataacggggcggaaatacgatgcagggcggggtcagaagagaaagaagtgaaaacagccaacagcaaagttggcaacttacgtaagagtccaccagagcagtcaggtctgaacggatcttccgtgctagccagatggagcggctaca

SEQ ID NO: 32245 - DNA, 1774 bp, Bovine  19866880584352
aaactcacgtccattgagtctgtgatgccatccaaccaccttcatcctctgtcatccacttctcctccctccttcaatctttcccagcatcagggtctttccaaatgaccttcttcacaccaggttgtcaaagtattgtgtgatataagactgataataatctctttctgcacctcagtttgttcatttgcacaagtgggaaattgacaatgtaatgtgcatggctctttcagcttcaacagcatgtaactgttagataattcatttgctaagttttttattccaccctatgctttatttttccccccactttttttgactgttttgagtctttgttgctgctcatgggctttctatagttgtggtgggtggggtactttctagtggtggcacattggcttttcattgccgtgatttctcttgttgtggagtttgcgctctagagtgtgtgggtttcaacagttgtggtgcatgggcttggttgctccacagcatgtgggactctcctggatgaggaatccaacccatgccccctccatcagcaggcagcttcttaaccactagaccaccagggaagaccaaaactatgctttagatcagagaatcaagaagaataatttattgccatcataaaatgataaaataacagggtgtttatacaattccagggcaaactctttgctgtttaccagatgctctttgctttttcattactacagagaatttagaaaattcccatggagaatggcacagaggtgacggacttcatcctggtgggtctaaccaatgctccagaacttcagatccccctctttattgtgttcaccctcatttacctcatcagtgttttgggaaacctggggatgatcacactgatcctgttggactcctgtctccacaccccaatgtactttttcatcattaatctgtctttggtggactttggctactcctcagctgtcacaccgaaagtgatggctgggtttcttagagcagacaaggtcatctcatacaatgcctgtgctactcagatattctttttcgcagcctttgccagtgtggaaaatttcctcttagctgcaatggcctatgatcgccacgctgcagtgtgtgaacccctacattacaccatcaccatgaagaagagtgtgtgtgcccatctggccataggctcctacgtctgtggattcgtgaatgcctccatccacgttgggggcacgttcagcctttctctgtgtgagtccaagctggtccatcactttttctgtgatattccagctgtcatggctctctcttgctctgataaacatgttagagaggtggttctcattttaatttcaggctttaatgtcttttttgctcttctggtaatatttatttcctaccttctcatatttatcactgtcttgaagatgcactcagctaagggataccaaaaagctttgtccacctgcgctagtcacctctcagccgtcagcatcttctatgggacaatcatcttcatgtacttgcaacccagctccaatcactccatggacacagacaaagtagcctctgtgttctatgctatggtcatccccatgctgaaccctatagtctacagcctgaggaacaaagaggtgaaaagtgcattcaagaaggtttgggggaaggcaaaattctctctaggattttaatgctgcatgatgtacaataatctagttttgttcctcttaagtctttccattcacatttttagacttgaagtacatttaatgctaaagttatattctta

SEQ ID NO: 32246 - DNA, 1866 bp, Bovine  19866880645973
gagtgggattgatggatctatggtagatcctgtcactggatctcagtcctaaatttgtggtaatttgttacaacaataataggaaactaatacagcatagatctaaaatcttattgaaaatatgaagttatgctatacaactcgacttaaccaagtttctgtgataaaaagctagttagaaaaccaaactttcactgatggccacataattgaattcagtgtagtacctcaaagcacttttaagggtacccaagaccaaaagtaatgatgctgaagcattttgaaagatcctttgggaaactttgtaggaagaagagaagaacaccagagaagagacttccaaggaggcattttattttcaaattagaagcatgaaaaagcaaaattcttccctgaaagaagtcttcttcaaagaagaaaatgggatatgttagcactaatgattgacactgggtaatttcagctctgagacattttttaccgtaaaggaaaagcatgacagcaaggagctaagcttctaatgttttgtaatatacaagagaaagaagacaaaactattatagcagtgtggcctgagcagcgcctgagccccagataagcggatgggctttgttgctcgtagactaccacattcgtttgcactgacgttttttttttcccctgataagaaacacttgaaatggacaatggtaccatcaacaatatttctttggggtgcatttccactgatgccagccacaaagaacatttttgaacccaaaactgagcaatatctgttgagttttttctttatcttttgccacatggatataaaacggtatttttttttttttttttgaaaaaaaaaaaaaatgctatactgtggcaacccatttgccgcatgtggccttggcctcggtatttggggaaagtgtaacccattcttatctcacaggactgttctgtcagaaaccaagagatggatttcccttctgaactcagaacaccaaatccttcaaaattctggagacagcattcaacatatttcaagctcttctcgttttttcccaactcccagtgctcattcacaagtcttgcatgcaagacattcaagaagatgttctgaaaggtttctttcctgtgaagaaaagaatgtaaatgtattcagccaacatttagaaagcaccaggatggcagaaaatatgacacctccctttccttaaggatccacaacccagaggaagaaatagatgtacactccacacacacacacacacacaactatttacatgcctgcttcaaaatgtttccaaataattgaaagtgagaaaaatcctcggtcgtttatgatacatttaatagcagagagttggctagatatagtatagcatatctcaaaaagtccaaccaaacatcccatcaaaggagaataacagtgtatgttcctaaaagagcaaggactataagcggtgcaaccttccatggggctgaattttctttaaagtttcttgtatgaaaactgtggcattgagaggtacaagctacgatgtataaaagggataggctacaaggatatacagtgcaaggaaacatatttattatgttgagaagacttttaaatgaaatatagcctaaaaaatattgagcctctatactgtacacctgaaactaatataatgtaaatcaactaaacttccatttaaaaattgagatgtcaaattatacttcacaaaatatctaaatacacaagataatgtttcttccaacagatagttcaacaaaatgtacatctcagggagatgagagccatgttgatcttatggcttcatgtgtcccgaaacccatcaccacataccactagagaagtacaaaaatgcagtttcagga

SEQ ID NO: 32247 - DNA, 2167 bp, Bovine  19866880674189
tacttttcttcccctacgcacgtgtgtctacaggccacaggtgccctcctgtccacgggcttgcttcttttcctgctttgcctgtgtgctctagcacatgccgtaggtaaattgcatgttgaacatgttaatgtccttaacaagctttttgacaagcagaaccacaatattttatgcttctctttggccaccctcatttagttgttagatttctgaacacgtttccttattctagacaatatactttagaaaaaaataagggtgttattcagcacttaatttctgcatgtgactcagtgaatgggaaaaatgtgagcagagtaaaactggatcattatgtattctaaaatgttaaaatgacaatcttagagacaatcttgccttctcaatcatcttcttgaaagcactcttaacctccttgttcctcagactatagaccaaagggttcagcatggggatgatcacggtatagaacacagacgcaattttgtcagtgtccatggaatgcctggagctgggctgtaagtacatcgtgataaccgtactatagaagatggagactgctgtgaggtgggaggcacaggtggataaagccttctggtatcctgcagaggagtgcatcttcagaatggtaataaatatgaatatgtatgatattaagataaccaggagagcaaagaagatgttgaaactggctacataaacaagaaccatctcaccaacataacgtatctgagcaagagagaaccatgactgctggaacatcacagaaaaagtggtggatcaccttgggcccacagaaagagagactgaaggtgattccaacatggatggaggcattcaggaagccacagacacaggggcctgtggacagaccagcacacatgcttgtcgtcatagttgcggtgtaacggaggggcgtgcacactgctgcatagcggtcataggccattgctgccaagaggaaattttccgtagtggcaaaggctgcaaagaagaacatctgagcagcacacacattataggagatgaccccgcggcctttcaggaatccagccaggactgtgggaatgacagctgtggagtaaccaaagtccaccagagacaggttactgaggaaaaagtacatgggcgtgtggagatgcgagtccaggagcaccagcaggatgatgcccacgtttccaaccacattgaccaagtaaatgagaatgaatattataaagaggggaacttgcagatttttggtgctggttagtcctaggagaatgaactgtgtcacttcggtcgtgttctccatccgggttacttaagaatcagatgtctagagcaaagagaaacaaaggaacagagtgtcaaatttagctaagattgcagtaacagcaaaactgaaatgtttatatctcatgaacattttttcgttacagaaatgatacatgcttcaagagtctccacatctaaagcatggacttatgagtgaaacttagtgtattattcatctagaattccaaactattgaatgaggatcgtaatgaatcatctctccagtttttaattctttcagatatgtcaacacgatcattttggagttaatacctctgacagttcagcttttcctcgcctattaaattcacacacttctctgctctttatatgccaaggcccttgtagacacaagacgatgagtaatttgtatttccacaaatactcactggcaagtcaaattctgttctcagataaagcgtttctcaagtttgatgtgtctttaccaaatttaaattaaactcaatttagctctgtttaaattatgtattgtcttcattggtccaaactcagtgttagaggctgcacagagaagtaactgagacttagatgcatagtgtatgtagtggggtaactggaggagtggggcgtgtacagccagcagacgcagttctcaaaggaagacacggcattaggtggagagtttggactctgagaagagcccaagttaacagcctgagtctttggtcaccaactgacattcctgaacgagttgttctccaactgaaaaattaagatagtaaggagacctaactcaaggtgttattgagaattaagttagataatacatgaaaaacaatgagcaaaaagctgaagcacagtctgaagaagatactattactactaa

SEQ ID NO: 32248 - DNA, 893 bp, Bovine  19866880847163
tgtttcacagagaccgttgtatcatgcacacacacacagacacacccccccaaacatttaattgttgatgcttcgctcatgtgtgagctcctgggggatgggctaccccgtgcttcagacttcaccctgtttccctgctatggacggatgtccctgaaggctgctacaatgatcctccccaaggccagtgttggacacgcatttgtctggtttgattttctttttcttttgcactcaagttgccttgaatcttggagtctgagctaatttgctccctctctgtatccacagtataaattattttcacaagtgcttgccttggtatccgctacagcaaatcttttctgagcacctttaatctatttattcattcactccacagtgactcaactctatgtcttaggcagaaagctatgaacagcacagataaatcccagctctcgtagaaggtacttatacattccagagggcctaggagctgttttgtcttcctgcagcttctttgggtttacaaaacctgtgcatctatgttaatagctttttatttgttgtgtacagggtgaggtttactggaaggaaggaaaactttatttcattggtgataatcatctttttctgtttttaatcctttctcctgttggctggagagttgtttcctggtcccttttgtttctctcttcctgttgatcctctaaagacgtctataccccctggatcctctggccccttcgagtgcatgcgtgcaccaggtgtatcctagcagactcaagcaatgtagacagcgtgatccgtgccctacccggagcaccaattccatcctccctacagcctgaggatccataaggttgggtatcacaggaaaagacttttctaaaatagttaacttcaaatct

SEQ ID NO: 32249 - DNA, 780 bp, Bovine  19866880861326
tgggactgcttgcccgtcgtcccaagggcagttgactccggggcaccaccaggaaggagccccttccagtggcttgttctacaagggagtccacggaaatgtctgcacctctctcacacaacaacaacaaagcctatccagtaaattagtctctagcactcgggacacaggcaaagcattttgtgaatgataccactatgtaaatgtgattggtgtttgttacgtcaggagatgaaggatgacctggattattataccaacacttaccacatcttcaccaaagctcctgacaagttagaggaagtcctagcgtgcccgcaggtcatcaactgggaacaagccttccagattcaaggtgaccggtctaaattaaagccaaagatgtcccgtttaatttacagtagatatgaaagggggggaggaatgatgcttgcttttctcctctctacaggatgtcaagagagcttgggcgaggcaatacaaaaagttgcagcttcaaaatcagtgcaggtggattatctgagaaccgtgctctttgtgtttgaaaaaccaacacttgaggcatcgagtggtgacaagatggatttgatgaagttattaaaaattcctaaagtgcttgaagataaaaggtgagatttttaccttttgcttctgaaatttctgataggctagttcagttgccctatgggccagacttgtaaatgtaggatctgagactaaattataatggtggttcagagctacacaggtaagaaagggaaccgtattaggtaatgtttg

SEQ ID NO: 32250 - DNA, 1202 bp, Bovine  19866880889924
ttccctcttggctctagaatgctgggggcctgaactggaccgtccagtaagtgtttggaagattcttctatgagaaatagagccaaagaagaaagtcctaaagataaagacatggagaggctcccccaagaagtgacctactcagaccaccgtaggggaaagctcctaagtcacactcacctgcccagaactcctgcttgatcctaaagtggctcagatggtaaagaacctgccttgaatgcgggagacccgggttcagtcccttggtcgggaagatcccctggaaaaaggagtggctacccactccagtatgcttgcctggagaatccgatggacagaggagcctggcgggctacagtccatagggttgctaagggttgggcatgactgagcgacgaacactttatactttgtcccgaggagatgatctaagattactagacagttgagggaagcctctagtgtggaacacagacagcacaatgaacagaagaaagcaacttggagggaatggagactatatagggggaggaggaagcagagaaccaaaaattgtaaagtcagtgttgttagagaaaaagagattgtgtttatgtaacagaatgttaaaaattcagaattttttttaaaaggacaattagaaattaaaaacatgatggcagaaatgaaaaaactctgtgaaagtgctggaagccgaagttaacgaagttgcctagaaatcagaacaaaagcatggagcatagaggggaaaataagagagaaaagataaaacatttaacgtatgaataatgttagctctagagggagagaacgaaggaaatggatgggggaaaaggaataaaataattctggaaaacttcccaggttaaagtacacgaatgtggatgctaaaagagctcaccaaatgccgagtagaatgggtcataatacagccaaccaaggcacatccttgtgagatttcaaaacctagggaaacagagacgatcctaatgtgtttcagagaaaaacacacacacattcaaaggaccatgaatgataaggtctttagtgtctcaagaagaacgtagataagaatggagtgatatctcataaatgttaaaggaaagaatctagaattctatatccagtcaacttatcaatagagtgtggattcttagaaaccccccaaagaaagaaactccaaatatcacaaagtatacgtt

SEQ ID NO: 32251 - DNA, 1235 bp, Bovine  19866881057744
tgtcaagtgttcagggcagtttggggaaattgagcaatttagacttaagtatttactaggctgagaaaaacttaattaacagatatatttattcaagatggctcatcttagtcaggacataatattttctacatctcagttcacgaacttacaaaatttaaaagttggaaaatggtccatgaagacccctcagcttcaacagtgtgaaactctacagatactttgtggcttaaattttgtttagtctgtacttcagatgtggagaagttcaaattatcccattaacgaaatatttgtatatgtgtatatatgcacatatgcacaatgctgaattaatttcactttcaatctcccatttgtttatcactgtgctcctttctttttctttgccataggacctcctgtgattcaaaaactgcatccatgaggaataatacaggagtgcctgaattcatcctgctgggactcaccagtgcccccggactgcaggtccccctctttataatattcctgctcatttatcttgtcaatgtggttgggactgatcctgctgattctcttggagtctcgtctccacattcccatgtacttttcccctacaaatctgtctctggtggacttttgctactccacagctgtcactcccaaggtgatggctgggctccttgtaggagaccaggtcatctcctacaatgtatgcactgctcagaggttcttttttgcagcatttgccactgtggaaagttacctgttggcctcaatggcctatgactgctacgcagcagtgtgcaaccccctatgttataacaccaccatgacagcaagtgtgtgtacttgtatggctatgggtccctacttctgtggtttcctgaatgcctccgtccacaggggagacattttccggctctacttctgtagggccaatgtgctccaccactttttctgcaatattccagcagtcatggctctctcttgctctgataaacatatcagtgagctgattctccacgtggtggcaagtttcggtattgagtttgccctcctggttatcttgatttcctatttgttcatatttaccaccatcttgaagatgcactcggctgagggatatcagaaggctttatccacctgcgtgtctcacctcaccacagtctccatcttctatgggacaggcatctttatgtactctcagcccagctccagtcatcccatggacacagacaaaattgcatctg

SEQ ID NO: 32252 - DNA, 1845 bp, Bovine  19866881132573
cgttggagaagggataggctacccactccgtattcttgggcttccctggtggctcagatggtaaagaatcctctgcagtgtgggcaaccggggtttgatccctgggttgggacaatcccctggagaagggaaaggctacccactcccgtattctggcctggaaaattccagggactgtatagtccatggggtcacaaagagtcagactacgactgagcaactttcacttttacttaaaagtgaatagctagaaaagtccaatttgttcctgttttacaggaagtcacactttttgtctaaggtcccacagggcaatggcatctgactcaagactgtcctgcctgtatcttccttgcgctgccttgggacaattgggggatggcagtgctgggcacccgtagacccttttaacccccgagtctcagccaatgctgcccaggctggtaagaaaacatcctcacagttttccttgctttcctcctgctggcatctgagccccactggcaggtgctcagctaccactccaccgaagcaggtctatctttgctcggctccactgctatcaaatgtaagagctgccacccagcatggtaaatacccagcttcttttgaatttatgacatgaggtgcttgttcctaagtcacaagtccagaaagtgggaaagcagcctgaggacttgtccttgtcacaggaagatacactcagagctgggggagagctttactgcttactctgagaacagtcttctccctagcaaatcgtccctcccaaattatcttatgataaaccggtgacacttctggatcaaagaaatgcacacataagcacacaaagagatgggagggaaccccatgggggtagacggggcactaggctttgcattcacaccaactcaaaaacgcagaccttgagccagcccctgaactcattccactgagtgaacaccctattttgtgccagaaaatgtgctgggcatctttcatcagtggctagaacctgaacagctttgtatcgcttttcatcgtggagcagacaagggaagcagactcggaggagaaaaccttaccagtgggagcacccaactgatgaaatgacagagtctgggctctgactcagatctcgggaaggtgaggctggtatccattcctcagggaagggagtcttgcacctcccacacaaggtagggtgaataaacctctgctcccaacacatcattgccaacaggtgtaactggtagggacatcactgggtcaggtgattccttatgccctccccaagagccttcttaggaccaaaagtcctaggagagacaaaaaccaagaagaccccgaaaggcagctgcagcgccgagcgagagctgggtgggcccacggccgggatcagcaccatcgaggcggtgaagcaggaggtccaggttccacagcagcaggctggtgattcaggccagagtgctgagcacctccagaggtgcacgagagaggcaggcccagggcaggggggtctgagttggctttcttgagcctaggatccagctggttgaagaggagctggactgagctcaagagcgcctggcccctgccctgcaagagctggaggaagctgagagagctgtggaggagatcgagagaggtatgaaggtatgaaaaccgagccttagaagatgaagaaagaactggaattccgggaaatccaactcaaagatgctaagcacactgcagaagaggcagacatgaagtaggaagaggtggctcataagcttgggatgcaaagaactgactccttggaaaagaccgtgatgctgggagagattgaaggcgggaggagaaggggacgacagaggatga

SEQ ID NO: 32253 - DNA, 1074 bp, Bovine  19866881216116
cagcacatgccaacacagcgctctacaacctgtgtgcgggaccagggcatctcggctgtgaggcaatggaggaactgggtgagtgaggagcttcttggaggagcaactcgaagggattgaagactcggctgccatttccatgtgtggtggggtgtacttctagccagatggaggatagtgttggaagattttcttttcactgctttcctgacctcagaccaaccaagagtgaagcatgaggaactatgttattttggggaactatgggtttgctgtttttagaggcacaataggcaaagaatttggtactaaccacagagtcaactctgcacaaatattttcgaactgaattgtgcttgaaatcgtgattttgttaggagcattttagctccttggggggctgcgaggagatcatagcggggctacagagtcggtaagttcagaaatgtgatttggggggggggagaaatagggggcactgggtaaagggtgtcacaaggagaataaacggactagaagtgtgagaatgagggatccgcaaagggtggagaaaggccagagtttttcatctgttccatcgttgagcattaaatcaagaagacacagcactgttactccaccgccttcattgctaagctttttactgagagcagctctgaaggaacagatgaccacggcctgcaaatacaatacctccttccacgccaaagcaactgaaaccagcactgaaaccgtgggccgcattgctcagagagacccctgatttcagaccttgggcgtgccgtcaggcttgtcattctcgggactcatgccatatcctttgccaatttttgttgccatcatgcttacaaacactgagtcactaaactttacccagtgtccaagctgtataattccatggtgtcttgggtggtagtatgtcaaaagtgcaaatgacagcaacaaaaaaaatcttgcatattgtcttttttttaaaaatgtgttttgagagctagaggagtagaggaaagaagaaaggcaaattacagaagggaagagatgttaatgaaaaggaaaagggtatttaatattaaa

SEQ ID NO: 32254 - DNA, 765 bp, Bovine  19866881297207
agaggtttgattgcacagaaaccattataaatcagtcacttgcagactcatatcaaaacctggtcagtgcgtggcaagtggcaattaagctgcatccagtggcaggctttgtagtggcaagtgagttgatgtacttcagttgtacgggcatctggtataggggcacaggtgtcagaacctgacacttattttggtccgtgcaagttccacccattattttacttacctcttctatctgtgcctctgtcccgcaccatgcacttgtctcagtcacagtactggtaagcccacaggttaaccctagacaaaatgagtaagaaataaatgtcaccgggagcttctttgcaaagggggtaagacccagtgagacagcagaagactccccaagactgccaacaaaatgaaacctgcattgaaaagaaaatactgactcctgcttaaactgtggcttcactgcaacagatgattcacattcttctccatgccagttttgcatattatgtggcaaccagcaatgagaccttcaaattgcttcaccacttggagaccaagcaccctgcattaaaagacaagcctttagagtttttaaaaagaaaaaaaccatgaagaacagagcagttattgaaaaccactacttcatcaaatatgtatgcactgagagcattgttcttaatggctaacctcattgctaatgctaaaaagccctttcctactggtgaagaagttgatcctgtctgcttcttagaatttgtcgtgaacttttag

SEQ ID NO: 32255 - DNA, 874 bp, Bovine  19866881327523
ttatgtgtcattcaactaaaaaaggaaatatttttaacctttcctcccattgagatatcttttatgctctgagatagaatagctctgaatgtgggtttgtgggtttctttatttggtttttttggtttgttttggaaggtcacagtgaacaactacttggtttgtcaaaaataaattttaagagagtcttgatcttcatactaggattgggactctggcccaatcctttgtgaccctgagcttcctgtttctggctggctattgtgtcactgatgagtccaagcacagaatgaggaagcatcgctccccatgtgggtacttgcttggaaacttatagaaaaagacaaatgctgtgaatctttcataatatttttcttcgattagatttttttcctccaaaaggaacatttttattttctgcagcccatatcaagaaagctagctgtacccacttcagaaacaagttattgccatattgccaacttggagtatcctctttattgttttatttttttaaagtgagtatacaatttatttaacattcagacgtcattaagacgtgcaatatggcagttttactaagggtttaactctacctgggatgattgcttgctagggcttagcaacagggtctagttcacacttagtgctgattaaatattttactgaatgattataataccaagcaagatgtattcaaaggctttcataaaaaatcaattttaaaggccttcctattcaggctaatgacaaacacaatacggcagacatgtcagttcaacataattgactgatattatatatcacttatatcttttagtccatcagtatattagaaatatacaggacatctaataaaaccatttctacagag

SEQ ID NO: 32256 - DNA, 1291 bp, Bovine  19866881507844
tatctttaggtattgaaaatgggacttgtatttgtgtggtttttctatatcaatatgtataaataggtttataactagagataattagactataagctgtatacacgtgagaaatagaagagagacactgaagagggctctggcaatcagcacagaacccgctcctcttgctcctgaatctcctccggctcctctcactcatggctgttgcctggttgtctctctaggcttacgtgtcttgcatgatgttcctgctgcaaggtgcccagatgctgcagatgctggagaaatccttgaggaagagccttcctatgtccttaaaggtgagaatggcaaattcttggggaattttccccttggggagtgaggactaggaagttcctgcaaatgaagaagagagactagtgtttgctaagtgcctattctgtgccaggccttagagcatgtttcctctggtttaacatgcataacctctctgcaagatgttcgctgttatgcccacatcactgctgtgaagatggaggcttggtgaagtgatttgcccgataccccacatagtgagctgcagtgctatggtatgaacataggaatgcctgagacctaacattgctttttttctccaagttgaataaaaaagtgttcccttgcttctttttaagaaacattccataatagcactgggaatttgcccagagctctcctacaaaattagctaagactgcttgttaacttttaattttttctccctaaaggaacagttgccagatcatgagccgcctttgaaattaccaatgaatcaatttctatttgacttaaatttccaagtttctctgaacacactgcacatcaggctattttgatagtcaggctgacactgaggatctctgttcacctagtacaattgatcagaaacgttaggattaaatagggaatactcataaacgcccccatccagaactgttccatagcagctctactgactggccgaggtcctcgcctatgtttttctttagcaatgaaagggatggtgtccgttccagtggaatttaaatgcaaccatgtgtctgtggggagtttgagcaaattctgggccatcatgaaggacagggaggtctgccgtgctgcagtccatgcggttgcagagtcagctatgactgagtgactgcacaacagcaacagtgggtgtgtgtgtgtgtaaaatcattttccctaaaatattttttgtttcttaggtcagattagaaactagatttctactgttttgtcagacactcctacaagatgcatacag

SEQ ID NO: 32257 - DNA, 1749 bp, Bovine  19866880207413
tcttgcctggaaaatccatggatggaggagcctagtgggctgcagtccatggggtcgctaagagtcagacacgactgagcgacttcactttcacttttcacttgcatgcattggagaaggaaatggcaacccactccagtgttcttgcctggagaatcccagggacgggggagcctggtgggctgccgtctatggggtcgcacagagtcggacacgactgaagtgacttagcaagcagcagcagcaagccaggttcaagcttggggagggacccctgaggaagtagactccatttttctcactgtccctgggacatgggtgcccatgtcagccctgtagtcagggtcactgtagtcagtaccaaggcagaaagggtggagggcggataagagcattaacaagtgtctgaccttgaatcctgggggcccctgtgctccaggcaagccagccacacctggatctcctctcttcccagcagggcccatgggcccggggtccccgtcatctccttgctccccctgtgaagaaagagggcaaaggagaatttttcatgtttcaggaaataggcagccaaggaggcagggtgacttcaaaatccaccagcgtgggagaagcctggtgggggtggaggtcagactcagggatggaggccatgtgtgagaatggctggaccagtggggcaagaggacttgaagattcgtgggtagggagatgagggatcttaaaaaccagaagctctctgccctggacaggggttgtccctctgggtgctggcatggaggagagacagtgagacaggccattgtccaggtaccacagaatgaagccactgaccatgcaggaaacttctagatatgctgattctgcccatccaagttcccaaacctgctcctcctggcccatggcctatggcaccccacatcccaccacacgcgcacctcgtctcgaacagagacaccctctgttaacccccagtccggctcacctgctgtcctgcttgaccatcgcggccaggaagcccatctggtccagcaacaccctcggggccctgtctccccaccacgccccgaggccctgggagcccctgcaggccctgggagtaaacgagaagctggtgagggcttctggggagggcagggggtggggtgggtgaacgaaaagctgtaagccactcacctggatccccctccgtcctggcgccccagccttgccttgctttccctttggcccctgaaaaatcaaggggcacacgatggaggcttcctggaggaggcgcagaacccaaggggctccagaagggagatccctctgtggctcagccctgcccctctacctcggcatctgcatctgccaatgggcccaggcacccccacccagaagcccagggtcaaggccagccttgggacctgccaggtgcggcccctgaccctgctctgggccctgggccctcactgggaacccggtggcagagggtccaggcattggcaacttcctggtgggagctaagccccatggctggcaggtccgtgtgatcctcaggggtgtgggtatcccggaagggtgaggagtgtgtgtgcgagcagaaggaaggcgtgtgtgtgtgcacccctgggaggaagttgagggcagtgagacagccctggcccagcctcagtggagaccgatccaggaggcctgggtgaaggcaggaaattccctctccaccgcctccgaattcctccatgagtgtcacgctcccttcttcctcca

SEQ ID NO: 32258 - DNA, 1012 bp, Bovine  19866880207813
ctactggaaaaaccatagccttgactagatggacctttgttggcaaagtaatgtctctgctttttaatatgctgtctaggttggtcataactttccttccaaggagtaagcgtcttttcatttcatggctgcaatcaccatctgcagtgattttgaagcccagaaaaataaagtcagccactatttccactgtttccccatctatctgccatgaagtgatgggaccagatgccataatcttagttttctgaatgttgagctttaagccaacttttccactctcctctttcactttcatcaagaggctatttagttctccttcactttctgccatcagggttcctgctcctacaagcctccaaatccaccctccccttaaaccgctacactagattgtacttacctattttcctagcaagatgtgagctcagaaggggcaggatctatatgggattctctcgtcctggtgccctgcatggagactggcactgaatgggtgactgccccacctcagcacattcacagacatctctgctgctctcatcagccaggccaggagagggttaaacaactgccctggccttggagaggcaggtgacccaaagtttaaaccagatgcttcagagccttgtagaccgctaaactcaggaattcaatccagccacatcttcctggaactgggacctgggcccctcccatccttctagacccctctcccctccctgggctcagctggaagcagctggaactgctgcggaggggtgaggtgggaaggaagattacaaaagggaagaagtatgtggagagagtaggaagagcctggtcccatgctctgctcagactgtgtggcctgggctgagcctgtcccagtcccggcctcggtatccccatctgtgcacagaggagattggtctggtggtccctcctgatgggactggccaagggcaagagatcctcagactcccgaaccctctaactccagacttttccaccacacagggggaggttgggt

SEQ ID NO: 32259 - DNA, 1379 bp, Bovine  19866880374712
ttctacaatatggttataataaaaacggactctcagtccccttggagacagactgaataaatattattcctcatgattattaaaactcattaagtgtgtttgtaaggcctgggaattcccagtatctgccagtgtctccacgttgcggggagcctaaccccaagcccagggcctggcgggagactcgaccccgggaaggaggaacccacgaggtggtcatctccaaggcagaagagagcggaggcccgagctttctggaaactccatctcatcaattccccccacccggaggaattggcctccagctgcagaaaggtcgttgcccctggagacagtcccaggcacgctggaggcatcaagcccaagaccgtctcctgcacgtggaatgttctttctctctcccttgattgttcgcgctcaccctgacccttcttaccccaaactcctctaccagggcccacagatcaaatgtcttacaggagcgagcaggtaagagaaaccagatgaaagggctgggtcggaagaccaatcatgagatgtgtggacgagtacagacaagagcgggcctgtcctgtccaaggaagcagccgcaacccggccacagcccatgggccactgcctctctcccttcttccaagaaaagctggtcaccctgtcttttataagaaagctctcacattcaaaaaatattaatcacttattaaatatttttaaacaaatgttgcatgtgccaaataaaacatattcaggactacccatggacaacctttgcctgaaacttgcggacaagccagggggctggaggagctctggtccaggagtcagagagctggcctttggggactgtgggaccaggggccagtcagttcgtggttttccttcagccactcaacctttacagttatgttagcgagcagtcacctggggcttgggccaaccaaagcccagagatgctcttacctggagggggccaccagacccaagttcatcccaggggactacagatctgaggcaggatgtacaattcatgaatatgggagagatggaggcatggggggacccagggttcaagtcgaggctctgcctgtaaccagctcttcggtctagcttctcttcctctgccctgatcaagagcaaccgcccaaccacccctatcagccactcaaggtccaagcagaacgcacacccaccaactcttaccggcaaaccacagtctcccttgggtcctggaggtcccatcagcagcaggaaaggtgtgggtcccaccaggtggaagaacgaatagccagtactcatgggctgggggctggaggccaggaatcgcgccggggccagcaccggggccggggtggtctgctgcctggtccggggctgtctgg

SEQ ID NO: 32260 - DNA, 1022 bp, Bovine  19866880543332
caaacctcaaaaatgccaccaacccagggcttaattgtatgcagttcaggttttctgcaaaatgtatttcatgctaggctttcacttagtttgtgttctaattataattactgtgattggcttgataaatgcatcccaggagctaagatcccccattccccacattttatttctgtgcaaaggatatttgcaagaaggtactttgctttaggcagcagaaactactgttgcacacacgtttgagtaggaaaagcaacaccttcttctgcaaacatcagaaacccatctgggatgctgggctattgcttagtcatagaggctgattagggggggcagacaagttcaaggacatggaaaaagaactcactgggtcttcttccatccatcttgcaaaacctccttcgtatcagtttgccctgtgtactcttggatacaaggcagtgtgtaactgtgctcaaacctcaagaatcctatttcatgtctgaagatgtgtttgttgttcagaaataagctcttggaaacccaagatgcctgggctcctgagggctgcccagcctccggccttgaagacctggaaggaaatcctgagtacttgagcagacctggccttggttgcatactgccctcttcagaaggaaaataaaattttccggtatccgctgcaggcttcctttggctgtcttcaccaaagcgcctttttgtatagtccactgtcattccctaactctggcaaatcactgcccttctcctgtggatgttctgggaaactcggacacactggtgtggttgaaaaggcagagggaagaagactgacttgtcttcaactgacaagttgtttgtgtggaactgaatttttggttgtttatttctcatgcgtttgttttaaccaagagacaacatattaaattgcaccctaaatattgggcagaaaacgtggtttcaacttcataatgtccctttactagttgagtgacccatggcaaatggcttccctgctcaattgcaaaatgaagtttctaagc

SEQ ID NO: 32261 - DNA, 704 bp, Bovine  19866880582261
gggaagggcaatgggcccacatcagctccatcctgtctcacataaggggagagaaggaaaaggctcagaaactcttctagaggtcccagcccaagaactcacgcccactaaaaaaactagtgagagctttaatcctaaaatttaatcctctccttaacaacttaccaccacatcataaagacgagagcataacaacactggattgcaactgagagctgcaagacacagattctatctaaggaggtgttcctagggaaacccaaagacaacaggaagaggggaggggggataaacaaggagggagctgaaacctctggcatctacaggtacacgtgtgagtgccaagttgcttcagtcgtgtctgactcattgtgaccctgtggactgtagtctgccaggctcctctgtccacgggcttctccagtagagaatactagagtgggtcaccatgccctcctaccggggatcttcccaacccaaggatcaaacctgagtctcttatgtctcctgcattggcaggcaggttctttactaactagtgccacctgggaagcccatctacaggtatgctgctgctgttgctgctaagtcgcttcagtcgtgtctgactccgtgcgaccccacagatggcagcccaccaggctcccccgtccctgggattctccaggcaagaacactggagtgggttgccatttccttctcca

SEQ ID NO: 32262 - DNA, 2751 bp, Bovine  19866880658225
cagtctccccatctgtgttatggcctcaggaccttgagacccaataggcagcagagccagggaggaaaggtcagcaggaagaccagagggatctgcttagatgacaggtatcttcaaagggcaggaaagagaagaactcagtctccagactcagggccaggggtgggagacgaccgcttagccaggaccactgcatgtaaaggaagctgcctactagcttcatgctcacagagaatggaagagggaggagagaaggggagacaatggggagtcaggctccccccaggtgcaaacctggccccattgcataccagctatatgaccctggatgagtccctcagcctccctgagcctgtctccttctctgcaattcagctgacgttccctatcttgcaagccaggcgtgaggattaagtgagctcatgcatgtcaagggctcggactgctgccagccacagaagtgcttcttagaccaaccctgctgcccttgcaagctggatcccagaagggttaatgctctgctcaggggctcctgccaagatgggcagaggcagtgatccgatttcaccttcctgtgggagcagccactggtgacacccgaagccactggggcatctgatccccaggcaggcaaaggggagggcggcacgtggccagagtgggccagccaggaggcaggcagaaagaaccccgccaggcgggtggtgagggcaaaggctgggacacgctggcccaggatccatttccaagaggaaggctaggatggtgtgcttctggggaattgtgtaatccaggaaacccatctgccagagtggatgtcgggagccccaggttcttcctagctccctggaggccttggaaaacaagctcacactctgtgatttaatagcaaatcctccaatttaattgtaattagcatccatggtaatcctgacctagacaatgtggaaggcaccggtggttacctacccatagccttccccctcttcttgcttgttctgggagacatgaacttcaaaggaaattagatgactctggatagatctaagtccatcttgggaatttgccatgccagtgactggtttaggcctgcatatatgacgcaaatgtggccaatgagatgccaggaatgtctgtcaggacctcaaagaaagcatttcaaaggaacacaggaagggctttcttctagcctttcaatgttgttgaatgaaggcttgctgctgcagccgctttgtgtacatgaggtgacaagccacatgaacatgtgagaacgccagaatggaagaacggtgggtgtttgatgacacttgagacgctaaattggccaatcctattacggcttttcctttggacctctggatataggaggtaatgagtcccttactgcttaagccatgttcaactgggaattacatgcagcataaggcaagctaactgaaacagcattcagacgctgatggcagtcccttgaaagccttcagcttctgggccttagcacatgctaatctttagtgctctggactccactcttttgcctggtcagctcccactcacgtgttagagtgcagccaggatgtcatttcccacagtctgctgcacgtacctccccaggtatcccatgtgtgtctgtctatttttctgtctcattttctaactcaagtccctgaagggcagggcccacgtctgtcttggattcccagcacctggcaggcatgtagtaagtgttcagtgtatttttacagaagaaatgaatgtcgtctggaactacaggactctgaactttaaaaagtatcttcccaaagacttaatgccagtaggcccaccccacctctgactttttccaagggtgctcctggataacccttgctccctccttctcttctccaatctgctgccaccgctgagaatggttttcacgtgggacctgtcctccctgtctccagcttaccaccaggaataacaaaaggtcggtgcctagctgtcctgagttggggagagggctcgaggctgacccttctggcgtgacctgcctacttggagcaaatggtagccccatcagctacgacaaacgataagaggcagctctttttgatttgacaaaaactgagccttagggagggcaggtactttctcaaggtcaccgtgggcagcctctggggactaggtcctttttcccatacccaccaggtagctactccaggaaactgaccagatctactgaggaagagccgtctcctacatactagtcttggtagttccaaagcacaactgcatatcaaaggctctgagaagttctgcaataaagaaatcaactgccctttctgttggtcagcagtccctgaaactagaggaccagggtactcatttctcttgagaagacctcttcagaagacagtgctcctggctctgcagggttcctgcaacctcactaggttctctttcatttcctttcagtctcctcttttcccagccttttccaggcaccagccctcactccttgagtctctccctgtgtcgtcacatccacccttcttaggatgctccccaagctgataaagacaggccaggtggagaggagagggtacaagaaccacgcacatccttctcggtcaatttctcctgctggagttatgccaaggtgactaccctgtagagaataaaaggataaattcagaggcaatagttgtaatcccaggagaaagaagactcccaggggagatgggatcacactagccccttcaattaagcttc

SEQ ID NO: 32263 - DNA, 1895 bp, Bovine  19866880669803
actccatccaggctggggtagctttgtggagtggtgctatcaaccaaaacccggggctccccgatagacctccggagggtgagccctgaccttgggcccaggcccgagggccagtgacaggcccgagtctaggaaataagtctaggagcttccctcagggtctgatggccctctcttctgttctttggaatatatcttgtggggtttgagtctcatataaggagactgttgcggggtttgacaaatggactgccagctttggctactccagccactgtgcagagacattctatcgagagggaggctggtgaaggccctggagaattggggagccccattgttcagggaagatcagtcctgggaagaaggcccagaggctcccatgggcaatgtgctcctgctcaggtaggtgagagcagagccagggcagggtgaggagtggaggtccgatcaacctgtgtacagatcccggcctcacttcctctgggctctgtggtcttcagttacaggctcacttcccgagcctcagggatccactctgtcagatgggatctttacgatcactcttgttaggaccccatatatacccagaccagtctagagccgggttacttgggttcaagtcctagctcccatcactcttttaattgcaattctgagcacattttctaagcctcctgtgcctcagtttcttcatctttaaaatgggaataatatcagtccctaacttgggagagtactgtgaggattcagggaaactagtacatataaattgcctagtactgatgctgagaaagattgaaagcaggaggagaaggggacaacaaaggatgagatggttggatggcatcaccaactcagtggacttgagtttgaggaaagtcctggagatggtgatgatcagggaagcctggcgtgctgctgtccatgggctcacaaagagtcagacacaacttagcaactggacaacagcaagaagtacatagtaagcactcaagaagcactagtaataataataataaatttattaataatcataataatgattttattactactacttgttaattaatagtaaaataattactgttaataagtagtgattcactagtagtagtagtgttttatatactagggcttccctggtggctcagccagtaaagaatctgcctgcaatgcaggaaacccagattcaatccctgggttgggaagatcccttggagaagggaatggcaacccactccagtattcttgcctggagaattccatggacagagaagcctggtggactacagtccatagagtcacaaagagtcgaacacgactgagccactaagcacagcacagaacagcagccatttagaatgctgcattgagaaagatttcaaagtcacattagaaatcatcgggagacagtgctgcaattgattggtgatgtctgccttggcttgggattaggaagtgtcaacatgtgagtcatacatttgtcatccccgatgtcctttgtggagcaccttctttggcacaaggcactgacctgaatgctttggaaaaagaaatttctgcaatgagtattagggaacctgactttatgaggatcttcagaagtcttctggtccaaccctctcgaagctcagcaggactcccttctggaggattttggtcatatgaacgttacactccaacttgaacaccctggtgttggaagctccctcccttgaaagtccatccactttcacagagctctcattgtgcagggttttcctgtgttttgagtccaactcatctccctgtccctgggagaggctgttcaagatgtaaagatggttgcatctattattcctaaggctgcttcttcaggctatatgatccccgtccccaaagcttttctgcag

SEQ ID NO: 32264 - DNA, 1353 bp, Bovine  19866880674699
taagtatttcaacgtagaggtattcagtcatgtgaaagcctataaaagggagattttgacctaagttaggaaggttagagaagactgccttgacgaggtcaaggttgagctaatgtgtgaaggacaaataggagttaactaggcaaacagagggcaagaggaccctagcagagaggtcagcgtgtagagaggccctgtggcaggagagggtgtggcacggctaggccagggaaagactgagagggaccgtggaaagagctggaacagaagacctcacggggggtgcagacagggaccttcagcccatgttaaaggctcagctctgtcctgggaacatactggtgaattttgaggtggaggaaaatactggtgaaatttcaggtggaggatgcgatgattaagtggctgctacaggggtccaggcaagagactttagggcagtaggtgagtttgagagcaccctaggaggtaaccaggaccggagcaggtgacaggttggattgtggggtttaggggaagggaaatagcaaagacaccctgcaggtttctgccttgtgcagttggatggggtgatgtttccatttgctgagacaggaaacactagggggacaaccaggtttaaggattgaggctggaggacctttgagaccaccagaggaggtattaggtaagtatttggccctatgggggaatttactgggcttcttgccatcaccccatattaggaaaatgaaagcccaggggttgagatgacctaggtaatgggactcggtgagtccaggtctcgtgtatatgaagccatgacgtgtctttccagagtctgaagaagaggatgaggacagcccagaaagttccaacttgcctctcagctggctcccccagcaggatcctcaatcggacatgaccaaagaggatccaagtgaggctctgcaaggtcctgaggtccaggaagctggagagagctccccgaggttggggtatgagacctatctcagctcagggggccatgggagcaccagccccaccactctggactggggtcagcctgcaggctgggtagcttctagcaaacaagccagtggagacaaacttccagaacattctgaggtcaacccaactgctgacttcagttcacccaggtcctggagcagtgggactgtgagcctaaatcaccccagtgacaacctggattctacctgggaaggagagactgatgtcccccagcccactgccctggcagaaacttcaccccagagccccagccaccacctcctcaacccaaatgacagaactgaaggaagtgttgctctggcaacgcccacggaattccagggatcctcagcaccactcgcc

SEQ ID NO: 32265 - DNA, 1681 bp, Bovine  19866880748116
caatgggaagatctggccggacttaagcccccataagacgaaagcagaaccagaagctaaagaaaggttccttatgacactgaatcagatataactctgggctcttccgtagatgataataagtttccttttttcttaaaccacatagaatctgtcattgtaactaaacaattccagccactatcggttttttccctaggcagccaccacccggcacacgtctgaatgcttcccttccccaccccatctcagccaccagctatctacatccccatcttccatctaggaatgcaaatttcagaaatgaatggtgccaagggcacaagggagaggagcggggccaagtctgataatgaattcccatgcactctgtgagccatttggtggttattcaaaaacccattcaatgtttttctccagtgatgataagtacactgttcttggtattgtgtctgtcaccagctgaatgatagtgatatttccacttaggatcttagtagactcgtggctctgaaaataatgtttctcagagagagattggcagtgcaacagatgtgtgtgagcagaatgcccccagccccacccagccgagcagctggctgcccgagattcgctgccctcagattcgctgaggtctggaccctaatattttcagagattcctggcttcagaaggctttttctttccctttgaaatgggggctgcctcctgaaattggtgtctcccatgtgggcagtacgcagctgggaaggaagtggttagcagtgcaatgggggacttccctggtagcccagtggctaagactccaccatcccaatgcagagggcccaggttcaatccctgatcagggaactaaggtcccatgtgccacaactaagaatttacatgcctgaacaaagatgggagatcccacatgctgcaactaagacctggtgtagccaataaataaagaaatccagtattcttgcccgaaaaataccatggactgaagagcctgatgggctacagtccaaatggtcacaaagagtccaacacaactgagcgactaagcgcgcgcgtgcgcgcacacacacacacacacacacacacacacacacacacaaatatcaagcaagatgatgggttggctcagatcttggatctctacacctgctgcttcagaatttcctggggagctttctgaaagtgcctcttccagtccccattccctgcaagattcttaatcagtaggtctgggagctaacctgatatttatcaaggtgtctgattctaaagggcagccttgatgcagaatcataggtatgagatgtccagaggccagcgttcctctgtttcctctttgggggggccctcttcttccagcctttaaggtccctcgtgggaaccctcccagagtaacttttgtgagatcagatggtgtagggagcaatagtagagaccattgatgtagtgaaaccctgtaacttccaaataagaaccagaaaggccaaatgaatttccaaagatcacacagcaagtctacagattaaccagggtacaaaccagggaggctaaacatagaaagctctcctgggcctggtttcccacgctgaattatgggtgggggtgatatcccctgattgggcttcccaggtgtttcagaggttaaagaatccacctgccaatgcaggagatgcaggag

SEQ ID NO: 32266 - DNA, 797 bp, Bovine  19866880763666
tgcagggagccgcatccttcaggtctgcaaaggagagagggcagtgtgcagataaacccacacgctgtcggggccctgcagagtccagcatggctggtgtggtcagagctggatcttggggaaggcgggacacggtcacaggggccagtcacccagagccatggatggagttagttctttgtcccagaggcaacaggaagctgttgaggggatggaaacagaggggaccttttaggagatctccctggaagggtgggttttcacagagtcggacacaactgatgcgacttagcagcagcagcatacgctgtgttgaggagccccatgaagaggctgtggctgtactgatggtgatgaagacagcaccgtcttggggcttgggaggagcgatctgagggacagggggaggactggagatcaagcagcccacatctagaagctcgggcagatgtcctttggaacagtgggtgggcgaaactgcgttccaggccgagggcacagagtgagtgaggctcgggagccagccggaggcttctgagcaggggaggccgccctgagtcttcagagatgcctaggagagggtgctggtggacgggcggggggtgatgctggatgcaggtgaggagggagctcaggaccagggtcctcagtgaggcgggggtgggggtgagacctgcagagtcccaggctccagggtcctcgccctcacctgtccctccagactgcactaccaagcctcggaccccaaagagggcccaggctggcttctcccgactgtctgtgtgtctgtctatctt

SEQ ID NO: 32267 - DNA, 708 bp, Bovine  19866880765796
cccgtctgcgagacctgtgactctaacacctctcctggtctccaaacagcacagccaagttcacggtcttggctgtttcaaatacaggaaaactggactgtacagggaaggctgataaaaacctcaggatactgaatacaccactgagatgagctagtttacagtgtgactcgaggaacaaaaagggcaatcaaaaaaaaaaaaccctccaaaatataagttatagacattcagtgcctcctagcagagtttaaatcaaatttgaaaaaaaaaaaaaggcaaaaactgctaaaatgttaggaaaaaattattaaggagtggagacagttatcttatacttctttgaaaatgtctttttttccctctcttatattaaaaagcaaaaggtcagctttatattcttaaaagtctcctttcctgatttggggaaatagataggtgtgtttctaaggcggctgccccctgacacccaggggtatcgtaaaggcagcagctcaatgccctgaaggtgaacgagaacaaagtccagtgcagaagctgtccatctgatgcagtttggagaatccatggcagggcagctggggaggagtgggggtgtgatagggtcaaggaagactaggggcaggggtgacgggcagtagggggaccacagggtgaaggatagagagcgtcaagtcacttcagatctcagcgcctaacatttcacaa

SEQ ID NO: 32268 - DNA, 1580 bp, Bovine  19866880839906
ttggatgaagagatggtgggaatatgcaacaggaaaggtatacccaggtggcactagtggtaaagaatccacctgccaacgcaggaaacacaagagaggtgggttcaatccctgggttgggaggatcccctggaggaggaaatggcaacctactccagtattcttgcctgaagaatcccatggacagaggagcctggcgggcttacagtccacgggtcacaaagagtcggacatgaccaaagcaacctagcaaggacctgcaaggtatacccaggagtttctacaggattggaaatgtttgtttcttaggataggtagagtacacccatcttacaagattctttagggctttttgcttttaaaatacatttcctaataatttcttgtgactgtgtttatactcaaagctggtaacgcaaatcgtaacatttatatgtgttaatgaatctgtctcttctgctgagacatgaggtcacaccctcttgaagccagaatcacccagctaagctgcttccaaatttttgacccgctaggtttgggggtaattttgttacacacaagaaaactattatgaggaatcactgggtattcttgagcaaagcagtgacactatgaaagtggtatttaccaggctatcgtgtagcctccaaagaccaaatagctaaatttgctgttttgcaaagccccaggtggttagcacaaacccggaagagcctgcagcccagaactcgtgggcggggtaggcaacatgttggtactttcagtacggcctcagaccaatgttaatcaactctgaactttttccaaccaaatctacttgcctcaacagttcacccctgaggacaaaaagtagaccttcagacttctctgcaaacctccagaactcagctaaacatagagcaggggcagctgatttatgatgcttcacaggtgatgaggaaaaatatccccaacctggccgggagatgccgtgcagccctgagggacagagtgccgagagtggagccagagcctcctgcccttgcagctctccttgcagcctggtaagacactattccaggtttcatgtcctgttcgccatgctagacccatgcttccagtgagcacagaggtgagggtgggatagtgatgggtaaaagcagctcatgaaataaccataaagggaaaagcaaaaaaacatttagctaagcaaagggagcaatctttctctctaggctgcagttcccaaagcagattcaaaaagtaaactctgcagtcagggcatctccttaaaacaagctctagcaattgcctaagaattgagctctcagtgaaagggagagggatgaggttggtgacagaaatagatatggtccctggatggaaaatgtgtcatcatcctgatgtgctgttaggggctcagcttatgactttgattacaacaggaagacttagtgttgggttggaagtagtcatctcaaagctaaattccatttcttggaggtggagtagagaaaactcaactagatttgggcaaagttcacattacaagaagaaaaacatgacctccccacaaaaacagaaaatgtaaaaacaagttt

SEQ ID NO: 32269 - DNA, 1291 bp, Bovine  19866880852394
gagggaggcctggctggtggacctgggcagagggaagaagaacctgttggcacaagtccaggcatccattcatgacaactgggatggcacgcctgctcttggagcagagatcccttggttactccacatctgtggcaccacccataaggctatggtccttggcttgggctatggtggcgaagctgactgacctcagaggaggcaggaaaaccctgcagagtggacgtgtgttttctccgcctccttgctggggtccatgcatgtcagcagcaaggccccttatgtcctgggaatcacacacttctggcaaactgtgtccaagtcagcaggcaattgactgccttgagctgtagagtcccatagtggtcagtgccacagaacggggagccagaagacagaaactttctgaaggtccatgtcagggcaggcaccaggagatgagctggaagagccgacctcaatcctttggctgagctagaatttggatagggtggatattgctggagacaaggggccagtggctaggcctgtgagatctttgggttttattaagctgttcactgcaaggggatctgcagtaggcgagctgcctgcgtgagaaagcagacagaggaggggcaccttggtacagcccttcctactggcaacaagagtgtctgaaggacgaaagactggaagagagaaatgactacctgcgaccttatgcctgttatctggatgaggcagtcccaggagacagccttcagaaaccgagtggcactcacgtcatctctgcagagtaagccaagccctaaggatcgaactgaggtggaaaggagggacagaacaggaggtgacacgtttaactagatacctggaatttagtaagacttcctagaaatttcatgctggagggcagacatccccgagttccaaggagaaggacgctgatacttgggcttggtcctgatggctttgcaacacagtgaaatgccgacttgtggagtggcccctaaaatgaggcaagaccagcacagctccccgctcaaaagcagagagaggatgggctccgaggcttgactcctaccaactacacaacacaggcagcttccaccctcctgtgtggctcagagtgccaggtctccccggcagcaaggctggaggccttttggctgtaggcatctcacccaccagcaagcctgcagccaccttctggaaggtctcccaaagtctcatcaaatagcctgtcaatgctcccatatactatagaatgtgacaagcggtgactgtccagtgcaggtaagaggctctt

SEQ ID NO: 32270 - DNA, 758 bp, Bovine  19866880957738
cgtctgggccagcttcaggaactcctttccccgctcaccacgctcagagcacccaggtcggcgcacatgacccgcagcagccgctctgcgatgttctgccgctccttctcggggatcatgctgttgggtgtcaaaccactggtcgtggctggggggtggggggacacaaagagaggcgtgattaatcctggcattctaggcttcttggtctggcagcagcctaatactcaagcatctagtattaggaattacgaagtgatttcatcttgtgtgcaaaccgatggtggcggcaagtctttaacatgtgacagtctcccaggaatgaagttctgtgatagactagaaatgcctgccatgccatgaagttctgtgattgactagaaatgccggccatgggcatgggaacagagggtaagtggtatgtgtgcaaatatttgctgcatgtgccattcacctcgacctctgaagctaactagtctaaccagttcctcaaaacagaaacagcctctgatacagaaggcgttagtgaataagatacctgaggccacagtgtcaggaaaaagcagaccagagaaattgtgcagggtgaattctaattctgattctgtcatgaatttgtgttctctgatcacaaagagatcaggtctccccaggcctcctcttccatcctgtgaggtcggaattcccatcaactaggtctcaggtgtgaaagtgcttggtaaaccgttatgcgtggtcttgcatcaccatgggaggta

SEQ ID NO: 32271 - DNA, 1010 bp, Bovine  19866880979079
ctgagtgggacgggcttccggggtctggctttctttgtggcttctgatccagtgggtttcttgcttccagtggaggctgaaccaggagcgagagtgggaggcatcgctgtggccggtggccgagcggtcctgggagggctaggactggggacaggtgatgggggtgggactgtgggtggggggaggtctgtgtgtgctggtatgggcaggagccggctcactggcacgactactcatcttggcctcagcctggaccactgggggcaaaggctttttagaggaggcagcagctggaggtaggggccgggcactgggtggcgggagtctgggcatgccggggttcctctggatcggcttcactgtgggacgggagactttggcaggaatgggctgggaagtaggtagcaccggcttcttggtgggtggggctggctttgtgaaggcaggcagagctgtcttctgggtggggcgggggcttctgactggggcaattgaaggagaaagggctgaaggtgtggcggggtgacttttggaggtcttagtggctgtgttcttctgcaatggctggacaggtctgggggagctggcaggagagaccggggacacgggaggaggcccttcactgactgatagcttggcaggggacagaggggtccaggctggatgggatgtgatgggctggggcgggcgtgtggtgctagtcctcatgggcttgacgggcacagcaggcaccacagtcaccccaggccccctgcctgccggccgtgaccccagggctggcgtggcagtggtcagattctccaggcccaaccgggcgaggtcggtctggaaggtgaggagtgtgccagagtctcgggggaagaagggtcccagctggggccggtaggtgtcagcctgtccacactgctttctcaggtgggtacagtaattgtgagcgacctgcgccacggggtagatactaactgcacagggccccctcgaacggaccgcgtgcgggctcatcttcccaa

SEQ ID NO: 32272 - DNA, 3183 bp, Bovine  19866881087929
gtgaacacgtgtgaaacctaccccaccaagaacagtgaacatatcctccacctctggacgttccctcctgccctacccaccctcccagtcaccctcattcccagaaaaccactgacctgatttctgtcataaaagattgatttgcattttctctgtttacttttggatagtttctactgctaatctttaagttcactaattttgggtcaggtttaattgatttttctccctattttactgcttttgcgtgtgtgcgtgctaagtcacttcagtcatgtctgactctttgagaccctatcaagagacccgactcttgagattgtagcccaccaggctccactgtccatgggattctccaggcaagaatactggagtgggttgccatgccctcctccagggaatcttcccgacccagggatcaaactcccatttcttacgtctcctgcatttgcagataggttatttaccactacctccccctgagtagcccacctcgtcactttttattgaatgccagacattgtaaattttgccatgttgggtactggacattgttttattaaacaagcaaatttgaatcgtgaccattttaatttactacacttgaaatcagaaatgaaaaaatgtattacttttaaactttgtacacatttagcccatccacttagcattttatctggccaggtcacagtcacttatttctataaaatactttgagctgtttttctgagatgtgtttcagttacttggcagcagtttcatcctttcatggctttactctatattttattaaacgtgaacagagaaatatttagtctagtgttaattttctttactaatgaggcaatccccttttcagtcttcttgctgatgcttcatgtattatgagagttttccgctctggctgctcccaatgctgtgtgaacgctcagcgatataccctttagttctctcaggttttctttcctcagtcttggtgatttccacacacacaggcaggtgtcagtaaatgggatacttgtgagtgaccccctgctgacagccagagctctctctgttcagctttcttccctctggtactctgccctacaaatgcaagccaccttgactttctcaaactcccaggtctgtatcctcaactcaaggagcctacttggcttgacctgattctcccatcaacactatagactggaaactttctccaggtggaaagctggagcgtgggtgagacacttcattcatttcccatctctcagggattactgtcctttgttgaaagtgaaagtattagttgctctgctgctgctgctgctgagtcgcttcactcgtgtccgaccctgtgggaccccatagatggcagcccaccaggctcccctgtccctgggattctccaggcaagaacactggagcgggttgccatttccttctccaatacatgaaagtgaaaagtgaaagtgaagtctctcagtcgtgtccgactcctagcaaccccatggactgcagcccaccaggctcctccgtccatgggattttccaggcaagagtactggagtggggtgccattagttgctcagttgtgtctaactctgcgagcccatggactatagcctgccagactccctctgtgcatggaattctccaggcaagaacactggagtggaaagccattcccttctccaggggatcttcctgacccaggaatcaatccagagtctcctgcactgcaggtggattctttaccatctgagccaccagggaagcccctttactgagaatgttgtttggtttctcagttattcaaggaggaaagtacatctgatacctgtttctccagcttggccggaagcagaagccaggaaaaatttttaaactcgctaagactccatttccttacctataaaatgcaaataaaaatagtggcaatgtcacagagctttgcaacatttaattgttgcaacaattaaatgctttaatacttgaatctaacacctgttaattgctcaataagtggaagttatcatttttgttttaattgttattgctgttgtactgttattattatccatggatgggtttctaggatctgtaaacctcctgaattttcaattccaaacacagtccttgacacttccaaggtattaaatatttgtacctttactgctctatcccagacctctgcagtagatagctactgagcctcctactttggagcaggctaagaatgacctttgagatctttaacagccatcatttctatgcctcagagatctaattgatattctcatggagcaaattagcatttgcagcaaacatatttcactccagatttattatgccccctaagttaatgtaacaagggtattcagaagagcaaaccagagtttaattcatatgagtctggaggtcagtctctgagttagcaagaggaattcagggcaggaaagaaaaagcttattccaatccttcccaggctagtcgtatgggcaaataagatagagaactcggctctttaaaaaagagagaaggacttcccttggtggtccactggctgagcctctgtgctcctaatgcagggggcctgggttcaatccctgatcagggaattatatcccacattctgcaatgaagatggaagatcccacatgccacgactaagacccagcgcagctaaataaatatttaaaacaaaggaaaaaaagagaaacctatttgggatatgcagcggaaatgaaggaaatagtggctcagctcctcagtctccttatttccagcttctaaccttcagacatcttccatcagtgttgatgcgggtgctgtcaaatgcaatatttataactctttatggaccagacatctgcctgcatccttcaggaggcctgaggaaagccagttctgaggcaagacacaaatgtgtcacctgaacaagtaggatgtattctatgacagcctcagacagccctcatttcagtcttcctgtaagactcttcccacctggttcagtcatcagaaatagggtctgttccccatgtctcatcctgccctagtggtacagagacttatgcttcaggggcttataatgccccacacaatttcttaagaagcaggagcccttgtcctgctttatattgtttcagaaaagtcattttgtcattaagaactaaaattcttagctcaaatcagcag

SEQ ID NO: 32273 - DNA, 1265 bp, Bovine  19866881118387
agtgggagaagcaggttggaaaggtgggcccaggttaagtttagcttcactgcttcccacaaggtcagtcaccttcctccaggtccctaagtcaggggagctaggtgaccttctcaccctgccagctctgtccactaggcaatatgccctccaggttttctagaagccttgcttcccaaatcattacagggagcagatccgacttagtaagagaatggcttccagcccccggggaacccaaaacccacagacccgaatgggacctggatttctatgcccaaaccagtcctgaattgtgtactctgattcaaaaagaccctagaagactaaatagattgaaattcttttggcaatcagaaaaactgtcaggggtggtcttttagatttgttattgctcatcttgttaggtttactttcttccaaagtgtttaattaatgtttaggggaatggataaggaaagtggcaagcattttaattccctcccccaaattactagtatctcactctgtgcctctctcaagttcccatgacccctccattttaaccacccagttatgctgattcctataccactacatccagagaaggcagtggcaccccactccagtactcgtgcctggaaaatcccatgggcggaggagcctggtgggctgcagtccatggggtcactaagagtcggacaagactgagcaacttccctttcacttttcactttcacacactggagaaggaaatggcaacccactccagtgttcttgcctggagaatcccagggatgggggaacctggtgggctgctgtctatggggtcgcacagagtcagacacgaccaaagtgacttagcagcataccacgacatcatcttcccttctccatcccaaactcttcagtcttgtcgtccgtccaatgagccaatgaagctgccctgtgacctaaccctcgagaacaagttactcgttctgtctggggtgttcagtttgccttagattggtgtgatccaagagaaacggaatataagtcattaggtaatttcaaattttctagtggtcacatgtaaaaaactgaaaataaaagcaagtgaaatgtttaatatcttatttaacacaacatacaaaatactaccattttaatcttatttttaaaaatgatgactgagatcttctacagtcatttcttatttttcctactgattctttaagatctggatctagagaagagaaaaatgacaattcaaccaaaataaataaataaataaaacaaaccca

SEQ ID NO: 32274 - DNA, 1028 bp, Bovine  19866881123119
gcacccgggcactcccagagcccctgtggcctgacctggctgctgggcagggattgggcccctgggaggggagggctgtgcccggaagagacttctgccgcccagcaacattttgtgcaaatgtcatattttccgagcttgctgtttcccccacaaagtaggtgaacagctgtccagagtcctgagtcaggcactgggaaggggggcggggggcagagaggctggggcagcgtgaagccaggtttatgtaataaaagggatcttgctgtggccagctggccgggtccctccatctcggcgttgcgctgaattcattccccggtcccccagctcctctcctctgatgggatccttcctgcttgagtctctagcctgccttccaagcagttgaggggctccagtgcaggaaggtgcagtgatgaagcaaggacctggggccaagcagcctgggtttaaagcccagctgtgcctctgattataagctgtgtgaccctgggcaagttattgggttggccaaaaatttcatttgttatggggggggggtacccaaatgaacctttggccaacccaacactatatatggctcagctttctcaccctcttctgcgaaagagtggggatgacagacagtacctgcttcatagatgacggagagagtcaagagttaatgcctgtaaagcacttggtacgtagtaaatgctcaataagcattagttcttcttattgttgattatatatttacctgtgaagttggggcaagggtggcccttctgtgtctccatggagcccgcagtggtcagaggctcctggaggctagtggtgaccacctctgccagctccaggtagctgagttgggaggacttggcccctgaactgcagcgagtatgtgggggaggcctggagactgcctggtatcagctttagagcccacctggagagggtgataaggggaacctcctcagtgccccctggcctggccagttgtcatcttcccagggcgagtgcgaggggctgtaagtggtagggtg

SEQ ID NO: 32275 - DNA, 679 bp, Bovine  19866881211841
atagaaaatgttattcctgcctcagcccaggctcaggatttggggaagctgggtcattttcccctttaaggataccgtgtagacgctttctgtctgttgggctgtgtggtaggctctggggaatccagaggcatggcgtctgtcggggaagatgtatggtccagctggaaacacaggtcataaaaagatgactgagtgcaccagctggttgatcaatactatttgaatggctcaggcaataagagaacaggggagcgaggtcagcctaggaaatggagccttcggtgaaagggaagggtcctctcttcctttgcagaatgtagtgtgaagctacgccttcagcagtagctgggacaaagagggacacagagtcgagtctgtgcccccggggacaggaacacacccgtctcctatgatgcggtttggaaaccaccaccaggcccctgcagtgtggatctggagtcgcctttgaagatggacggttctggggtcttcgcagcccacccagctggcatcagacttgataccccagagcctccactcctgatccttagaacacagtgttctagatctggtcaggagatgcttctagtgtccactgggtgcttgggtcttccaagtaacgttaaggacagctggcttttcaggtgacactcgtggtacagaacctgcctgccaa

SEQ ID NO: 32276 - DNA, 926 bp, Bovine  19866881213377
aataatcccatggaagccatggtaaaataatgggtgccctaatgaattcaagataccagattttgttttcccctgcaaagaaaacagaattgtagaataatttcaaaatagtctggctgtcttgatttctcagcaggcgcccatggggatgtgtagaattacaatctttcttttcttcatgggcctctcattttgagggtaatgggcgactctttcctatccaactgtgagaaaaactattttgattttttaaaaaatttgtgcagtcattttccccctccccctatttgcctggactgttgatcttgtgatatatttatagagattgtggttggctgaccaggagttattttgcaataggaatttgtaagatttctactttgagcatgtgttccagacttttctttctttaaaaagaaataaaaaatctttcgtagagcttccactttgcccttgtgtaattatttctctttcacaaccaaagtaagccttctgttttgcatagttttttaatgtgtatttcgtttgtctctggtcttctctctcctttggtgtctctttttaactccagactttaaaaggccatggttccttcttcatgtaggaatgttttcgcagatgagaatgtgaagactggaaaaagggtgctttagggaccaggagacctctctttctctatctgtaaaaaaagagtatcgggctaaatttgtgggggcaagcatgcttctgtccccagctttacctcactcactacagacatcaataatcaatcacagcactcttcctagaggagcgctggtctggccccagaatccttctcagcacattgccccaggcagccacaactaatcgtgtagaattggtgctgaacaaaaatgcctgttggcctttcttggactagatgacccccttgaccccattcacca

SEQ ID NO: 32277 - DNA, 886 bp, Bovine  19866881247722
tgctttacatttaattaggtgtcctcataacaatggaattgcagaagtccttatatcactttgaattagtggtgcagctctttcaaacttctttaaaaattttttttcatatatcattttttaaaatagagctcattattttaattatatccatttaaatgtacagtggagcccttggatattctcagcacgaatcattaggtatattagtgaaaaagcacttggaatccatctacatgctgacactccataatctattctatttgtgtcgctgtaaaatagatttatatatagataactacaaaatagttgctcaagatatgctatgaattttatatttaacccgagtcacacttcaacataaaatctaaagtcaggcactaaaaggatatttctcagtaagtacatgctgtctgtggtcactagctcaggccagaatgccaggataggagccaaaccaagcaggtccctacccaaggaattccctaagggacctggcctttcactaaggtgaaggttctcaaagtgtgatccttgaaggcctaggggttccagagtgatggcccaaaagcaaccatggggcctgaattacaagggtggtggtgcgtaggcctccaggaacaccactttatctgtctctgatacctacaactttgcttttagtggtggtggtgggggggggtggtagtggggaatgggtaaatggtggcccctccaaaagatagaaagggttagttgttcagtggtgtcccattctttgtgaccccgtggactgtagcctgccaggctcctctgtgcatgggactctctaggcaagaatactggagtggatagcccaattcaaggatcaaacccaggtctcctgctgcaggcagattctttactg

SEQ ID NO: 32278 - DNA, 1954 bp, Bovine  19866881297413
ccaccagtaagcacactgctgactcattttctccaggagaccctgtgccagggcagatgccagcggttgggtagaaaagcggtgccaggagagcaccccacagtggggcccaagctttagacaagtgggcagtcacgcggctttgaggcccagcctctgcctcccttgctgctgcagtaccccagatgctatgccctctggcctcctagctttgctcttctgcacctcccagatcaggttccaggacactgttatggagcatccctggcttctctttgcttctccgtcctccctgtcctcagagcactcccccttccatatgcttccataagcctgctgtaccgccccccaccacccaccaggctcaatccagtagccatcagcaaccctggtgttgcattggcgggggccctgcccttcacatgtaaccccctgtctgtccctctctaagcacactctacctgttactttattggcatgttctcttcctccctctctgtgtttcagggaccctcttgataccccataacctgcccgacccacgaaatgccatgtcaattgatggtggaaacggaagcaaaacataaactcacacccatgagccaggagagcatggcaggccatgtgaatccctgcctctgttctgcaagctggggcgggcaccttgcctttctgcttctcctttttctcgtcctcaaataggcatcttcatttccagcaagcagggtttggtgaggattagtggggctgtgcttgtaaaaggcttttagaacagggcctggcatatagtaagtgctcaacaaacggcagctgctatttttatcattattcacttcatcttgaatggatgtgtgagtcagtgggaaaattctgggccgcatcctgtccagacagatgacctgtctgtgttcccatagaagaggtgtaaggtgtgaagaaggcccgggagtggctgtctgggcacatggggcctggccagtccatggaggcaggtgggacaggtccacccctcctctcttttctgtggtcctctggccagcatccttccccgctcgctccatgggagcacagccaagcccagagaccatgggtccacttggcctcgtgtttctatgccccaggtcttagctctgagtgcacagtggatgttcagactggtatcggtccctgaagctcccctgtgttctcaggtaacaaggatggaggaagaaaccatgcaagccagctgcaggttctggcagcctcatggtccagagaggaacacctgggttcccttcttggagggctcggtggccagtctgtgtctccaaggtcaggctcccgaactcatggcttccgttccggccgccttctgccgtctctggcccctgtgctctggtcttcccgacattctggagccctggcttcgctgagccaaggcccacgagtcagtggtgaaaacagaagtctggaagaacaaagctctgagccagctcaggcactaaacgttattagcagtagcctaaacaggattggaacgggagcaaaagaattggcagggcctccctctgggagccaactttccaggcctggagcttacttagatggctgttggctccctaggctgcatctctttcctgttggtgaaggctgggactctggtctctggcaagtaggaagtccctgtaagtctttgatttcttcttgggagatgagtcaagcgaaaatggtctgctaagtagtggagtcagatgatgtgggtcactggcatgctgtgtggctttgggcaagttgcttcccctctctgggccccagtggcccatttctacaaaggggatgagactagaatctggcctcgaaatcatctcagaggaccttctcccactctatgaagtgaagtgaaagtcacacggtcgtgtccgactcattgcaaccccatggactatatagtccgtggaactctccaggccagaat

SEQ ID NO: 32279 - DNA, 800 bp, Bovine  19866881334129
ctttgagctgatgtgttatacagtaatagatatctatctaatacagatggtgagataagcgtatatgggtaggaggaggcactgatgtggaataagtaacttctctatgtgccttgtcttgtacaccgctctgctccaccagcctcctgcttacctaccaattacaagcctttctcacctcgatggttaatactctcaaaagggagcatcccaagctctgactttctgattaattgcctgcttgcccctgaacaaactaacagcacatactttctgaaggcacccaatggaccacctagcctaagtctttatattgtatagtgggggaaactgaggcccaaagagggaaaagagatccccccaaccacggctgaattaggagcagggctcagactagagaccacaattcctgccttgaagctcagtgctatttctcctccaaaagcctgtgggctcctggtacccccgagtttgagtcctgcctctcccactcaccgcctgtgatgacattcccatcagggcagtgagcaacgctgtgggccctggcagggacgtgccagagctcttggctccaagcataccttacatctgtctgggcataaatttgcattctgaatccaggaggccccgattccaagtatgtcaaatgtaattaattacagcaaaccttctgcaactgttttcaaacgcggtattaaaggctctgtgcgcatgaaacacacagcccaggtccaccgaggcgagctgggagctgaggaataggagacggcaagtgccatacgaggtcctcggagtaggga

SEQ ID NO: 32280 - DNA, 986 bp, Bovine  19866881379242
tgaagaatacagttgccacgttcctggggcttcccagaatccctaatactactgtgattttatactagtagataaagtgaggctcagaaaggtaaagttacctgccccgaatcacacagctggtaaacaaatctgtacccaagcttgcctggccccaaagcccatatactcaactacagtgccgtaactaactcacccaccaaaacaaatgaaataagagcactataaataatcagactgcaacacaacacaaagaaacagtgggacttccctggtggtccaggggttaatactctgcactgacacgacagaggctgcatgttcaatccctggtccgggaagctcggcatgccacagggtgtggcccaaagcaagcaaacaaaataaaataaggaaataatgtttagagccgcacaatcttcccagaagtggtgggcttcctggggggaggaggtgcaccatcagagaaaagacagccatctggagaaaaaatagtcaatcttacaaacaaaaggatggatctgctctgggggggaggggataaaaaggagaagagagcgaaagggatggtgttccttgctccagttctgaattcttctggaagatctcaggccttcctaatactcccacagaccagctctaaacacccagcttttccatcctccatatttaaggactaccaaatatttcatttccttttttcccctcttcccgacttcacaagtgtagtaaaaagttaatgaatctataaattgctcactggctttaaaaaatgagaaaaaaagcagttaatggaaattttaatgaaaacaccctatccgcataactgatggcaaaccgagggctgaaatacctggggatttcacagcccaaactgggtgtcacgaaagcttgcacatatttatggaaagcggggttccaagctcattgatatctgaaagacgacaaagtctccactccaggcttcaaagcagcactgtgcgtga
